United States Patent 7,314,974 (EXPRESSION OF MICROBIAL PROTEINS IN PLANTS FOR PRODUCTION OF PLANTS WITH IMPROVED PROPERTIES) - sequence listing, part 8

SEQ ID NO: 26189 - DNA, 2004 bp, Schizosaccharomyces pombe
atgtttcaagcaccgagagaatccactctttgtaagcatccaatattgcgctggatggtaaattattaacatgttgtagttttgagtggtgaaaaaatcagtggagaggacgtacgaaaccaaaatggtatgttaattttcttttcataacttttaacattttagttttggcaacgaccgcaattgcgaatgtcgtcaaatcatccttgggtcctgtcgggttagacaaaatgctcgttgacgatattggtgtatgttaaagacctcgtgaagaaaagaaaattttagacaataatgggggatattggcctttaaccaatatttattgatttgatacgctagtgttgtaatcttctcgcatttaaggaaatcttaattggcagggaagagtcaaccttatattgtgaatcgaattaataagtattcctgccattatagttcatcttttattatattttttcttactttcttttatttctatctaacttgtattaggatgttactgttacaaacgatggtgctaccattttatcattattggatgttgaacatcctgctggtaaagtgctggttgaattagctcaacaacaagacaaagaagtaggtgatggaactactagtgttgtcattattgcggctgaattgttgagacgtgcgaatgagcttgtcaaaaacaaaattcaccccactactattataaccggttatcgacttgctatccgtgaagccgtaaaatttatgacagatgtcttgagctgcagcgtagatagtttgggaaaagagagtcttattaacgttgccaaaaccagtatgtcttcaaaaattattggtaatgattcagactttttttcaaccatggctgttgacgcaatgctttccgtcaaaacttctaattctaagggtgagacccgttaccctgttaaagctgtcaacattttgaaggcacatggcaaaagttctcgagagtccgtcctggttaaaggttatgctttaaattgtaccattgccagtcaagctatgaaaactcgtgttcagaatgctaaaattgctgttttggatatggatttgcaaaaaactaaaatggcgttaggtgtgcatgtgacgattgatgaccccgatcaacttgaaaagatccgtgaacgagaagttatgattacgctggaacgcgtcaaaaaaattctcaatgcgggtgccaatgttattcttaccacaaagggcattgatgatctctgtttgaaatccattattgaagctggcgcaatggctgttcgtagatgcaaaaaggaagatttgagacgtatcgccaaggcttccggtgctaccttactcagttcattgtcaaatttagagggtgaagaaacctttgaaagttcctacttgggctcggctgaagaggttgttcaagaaaaattttcggatgatgaatgtattcttgtcaaaggaaccaaagcttattcgtctgcatcaattgttctgcgaggccccaatgaatactctttagatgaaatggagcgttcaatgcatgattctttaagcgtcgtcaaacgcactcttgagagcggcaaagtcgttcctggtggcggcgctgtggaaacagctctgagcatttacttggaaaattttgctacctctttgggctctcgtgagcaacttgcaattgctgagtttgcacaagctttgttaattattcccagaactttggccgtcaatgccgccaaagactctactgaactgacagctaagttgcgtgcttatcacgcagccagtcaaaatgctgaggttacagatgttaagaaacggggatacaaaaattatggtcttgatttacttaatggcgtaattcgtgataatgttaaggctggtgttcttgagccatccatgtctaagttgaaaagtttgaagagcgccgttgaggcatgcattgctattttacgtatcgatactagtatcaaacttgatcccgaaagacaaccagaagacccacatgcagggttgcactaaagc

SEQ ID NO: 26190 - DNA, 3048 bp, Schizosaccharomyces pombe
atggatatgattgatgaggctataacagaagttgttaggaaaattgaaagagaaagatcagttattcatggcgccctttccatgaagcgcttgactcagaatcagacagttcaccaacaacttcatagcaatattgaagaatcaaaaaagagcattatttatttagaagaacgcttagaaaaactaaagcttcgcaaaaatggtgtccgaaagagtaattctgagaaaccgtccgttggcattgagaagaatccatcctttagcactacaaaatccgctaaaagcttttcctctacttcttctaatatcgattctaacttggatttgctaaattatgatacccctcttactatttcaaagatatcattcttattacaacaattggagttcaaattatctgttgaggaacaatatcgaaaaggtattgaaaagatggcaaagctctatgagcgtgaacatgaccgtcgtagtatagctgaagcagagaagaagtatgtagaaagtgctcaaaagattaccttactcaagcaagctttgaagcgataccatgacttgcatatcgaaatcgatgaggaagatgttcccagtacggaaagtagaggtaacttaaatgcccgtcgtccccagtctggtctccttaaaattaccgtaggatctctaaggaacgtcacgcattctgctggaatctccaagcaaacggaaatgatagttgcaattcgtgcagaggatcttgagcgtgcacgtactcgtccaagccgcaccgaccgttttaatgaaacttttgaaattgatctggagaagactaatgaggtcgaaatagttgtttacgaaaagaaaaatgaaaaattgctattacctgttggtttactttggatacggttatcggatttagtagaaaaacaaaggcgaaaaaaggttgaacaagaggtttcagataaaggttgggttagtgccgacaaaatgattaatcaaagactttcaatatttttaccttctgctcttaataatatttcaaagcctgaaagtactgaccgccccaacacagctagcggtaatcaaagtgtgagtgcttggttttctcttgaacccatgggacaaattaatttgaccatgaatttcacaaagcataatacaaggaagagacctatggatgctggcctcggtcgtcaaggtgctatccgtcaacgcaaggaaagcgtacacgaagtttatggtcacaaatttctacaacatcaattttatcaaattatgcgttgtgctttatgtggagagtttttgaagaatgctgctggtatgcagtgcattgattgtcattacacctgtcataaaaaatgctatccaaaggtagttactaaatgcatttcaaagtctagcgattctgcttctagcgaatacgagaaaatcaaccatagaattcctcatcattttgaatctcacacaaacataggtgctaattggtgctgtcactgtggctacatccttcctttaggaagaaaaactgccaggaaatgtacggagtgtggaataactgcgcacgctcagtgtgttcatcttgttccggatttctgtggtatgtctatggagatggctaaccgggttatttctgagattcgtacaactaaaatttataaagctcaacaacataaacagaaaagttcacatcacaagcatcatcatcataaaaagtctaagtcttcatcttcgaaacataaggaaaatgacaaagcatccgtttctattacaaccaccacaacaccatctatcactcctgcagaccctgttccaacttctccaaaaccactggcaattgaaccggttaaaagaaagcctgtacatgccggtaatttagaagtgacatcagtctctgataataaacttggcgctacagttcaggttgtcgagcagaaagtggatgacaaagctgatgcgttgacgaaacctccttccctagatgctgtgaaagagccaatcccagtaccatcagttgaaacctctgttgttgctcaagacctaacgcataaagctaagcgtatcggacttgaagactttactttcttatctgtgctaggcaaaggaaatttcggtaaagtaatgctggctgagcttaaaagtgaaaagcaattgtatgctattaaagttttgaaaaaggaattcatcttagaaaacgatgaagtcgaaagcactaaatccgaaaaacgcgtttttctcgttgccaaccgagagcgtcatccatttttggtaaacctgcattcttgctttcaaaccgaaacccgtatttactttgtcatggattttgtgagtggtggtgatttgatgcttcacattcaacaggaacaattttcacgtagaagggcacagttttatgctgctgaggtgtgtcttgctctaaaatactttcatgataacggtatcatataccgtgatcttaagcttgataatatccttttaagcccagatggtcatgttaaagtggccgattatggtttgtgtaaggaagacatgtggcatgataacactactgccacgttttgcggtactcctgaatttatggcaccggaaatcttattagaacagcaatatacgagaagcgttgactggtgggcttttggtgtactaatttaccaaatgctgcttggtcaatctccatttagaggagaagacgaagaagaaatttttgatgcaattttatctgatgaacctttgtatcctattcatatgccaagggattccgtttctatattacaacaacttttgactcgcgatcctaaaaaacgacttggatctggccctaacgatgcagaagatgtcatgactcatccattttttagtaacattaattgggatgacatctatcataagcgaactcaaccaccgtacattccaagtttgaattcacctacggacaccaagtatttcgatgaggaatttacccgagaactcccagttcttactcctgttaattctattctgacgaaagagatgcagcaacattttgaaggtttttcttattcatgcgaggatgataaaccctcgactaccgataatgct

SEQ ID NO: 26191 - DNA, 1318 bp, Schizosaccharomyces pombe
atgccaactgaattatctgatatcactatacaaagcgtacttccatgtgattatagtttgtttaaaaataatttacgggtttcaaggcttccagaatcgcgatttgttttttccccaaaagaagaaataaattgccaatctcttcttcaaggtccggaattggtatgtttaatgtaaaaggattttctttaaccattagaaaactgctttagataatttaaacttcattcataaacagaaatttgagcatcaatttcgacatggctattggaaattgcacccacatccgcatcatcaacatgattcaataattcctgcaagttggattcatgatactccgcatatgaaactcgtctttcatcgtttacagaatttacctgacggtgatctgttactagagaatgaccctaaaaataacgttggttatttcattagcggagggattgctggaatcgtctctcgtacctgtacagcgccattagatcggctaaaagtcatgttgatttcagacactggttctaaaccttccccgaagtatccttttgctactttgctacataccactaaagttttatggaaccgtaatgggatacgtagcttctttgtgggaaatggcattaatgttttaaaggtgatgcctgaatcctccataaaatttggtacatatgaagcgatgaaacgagtacttggaatatcttcaagctctgaaaatcatagtcctctttattcttacttagccggtggcatggctggttcagttgctcaaatgtttatatatccggtagatactctgaaatttcgcattcagtgcagcgatttatctcgtggtcagcatggaaaaagcattattttgtccaacgcaaaggaactttataaaagcgttgggatacggggttattacagaggcgtgctcgtgggcatactgggtatgtttccatacagtgcaacagatttgggaacatttgagggccttaagaggacatggataggtatcttagcaagtcgtgacaatgtcgatccacaagatgtgaaacttcctaatggtttagtgatggcatttggagcactttctggaagcactggcgctaccatagtgtttccacttaatgtcatacgtactcgtttacaaacgcaaggtacgtctgcacatcctgcaacatacgatggatttatagactgcttttacaaaactacaaaaaatgaaggtttccgtgggctttataaaggattgtctcctaatttgttgaaggtagcacctagtgtcgctatttcatatctggtatatgagaattgcaaaaaatggttgggcctagagtaa

SEQ ID NO: 26192 - DNA, 796 bp, Schizosaccharomyces pombe
acacaattattcttatccacagatttggaatctttggaaccaacttgcttatctaaagatacaatatatcaatggaaaggtatattttcattaatttttttcggcttattctagcttgtgatttcatttacacttcgttttgctgatacaattctagttgtacaaacgtttggagacaggctcaggcttcggcagcgtgtcttagctacagccatcgttttattaaggcgttacatgctaaaaaaaaatgaggaaaagggtttttctttggaggcgctagtggctacatgcatttatttatcatgcaaagtggaagaatgccctgttcacattcgcacaatttgcaatgaggctaatgatctctggagcctaaaagttaaacttagtcgttctaatatttccgaaatagaatttgaaatcatttcagtccttgatgcatttctcattgttcaccatccctacacttctcttgagcaagcatttcatgatggcattatcaatcaaaagcagcttgagtttgcttggtatgtatacttcttatattgaaaatcacagtcgattagatttttctaacgatcgaggaaataggagcattgttaacgattcatatgccagcagtttatgtttaatggcacatcctcatcaacttgcgtatgccgctttattaataagttgttgcaatgatgaaaatacaattcctaagcttttggatttaataaagagtactgatgccttcaaagttatattatgtgttcaacgcataatttctatttattattttgaggatattgaataa

SEQ ID NO: 26193 - DNA, 1782 bp, Schizosaccharomyces pombe
aagaacgccgtagctgctcaaggatttaaaaaaatgacacccgttcaggctaatgccataccattatttttgaaaaataaagatctggtagttgaagcagtaacgggttcaggcaagactttggcctatttacttccttgcttcgataaagtcactcgtagagatacggacgaaacaggtttgggtgcattaattgttgcacctactcgtgaattagctacacagatattcaatgttaccaaagagcttttggcgtaccaaccagactctttggatggagggaaaaaactcgttgcagatatgtatattgggggaaagggaacgctcacgaatgatttagcttcatttcgggaaaaaaacccctcagtggtgattggtacacccggtcgattgaatgaaatgctttctcatatatccagtaagcatttggaaatactaatattagacgaagctgatacccttattgacatgggatttcagcgtacattacaatccattatatctcaacttccgaaacaacgtcgaactgggttgtttagcgcaacaatgaatgacactgtgtcatcatttttaaaaattgctggccttcgaaatagcgtacgtgtttctgtgacagttacatcaaaaaaaattgatacaagaacaccgtcaagtctagctatacaatctttagtgattcctcccatatacaaagtacaatgtatgatacatttgctttgtacgatcgaatacgaaaaagcaattgtttttttttcttcttgtgcttctgttgaatattttaactccctttttctcacttataaattaccgtttgaaatagtagctttgcatggacagcaagttcagtcgaatcgatcacgtaattttgaaaaatttaagaaatcaaataaaaaaacagttctttttacaactgacattgcttcccggggtcttgatattccaaatgttgactttgttcttcagctcgacccgcctttggatccgaaatctttttctcatagatgcggcagagctggtcgcgctggtcgagcgggtgttgcaatagttttgttaaatgatggaagagaagaagaatatgaggaattgttaagggttaggaaggtacctattactcgtatagacactccaattgaagctttagatctttcacgacttaaagtattaacccacgaattgagaaaaatcgtatccaaagacagagatctatatgataagggattaagagcgtttgtttcacatgttcgtgcgtacacaaaacatcatgcgtcgtttatttttcgtatcaaagatttggatttgggacagttggccacggcatacgctttattacatcttccaaaaatgccagagttaaaagacaccgaaatatccgaaaatatttttaaaaaatttgacattgattatgcaaccataccataccgtgatcaagtacgcgagcaggccagacgacgccgattggaagtcgaaaaaactgaacccaaaaaattagctcggccagcaaaaattaagaacgaagcttggtccaaacaaaaggaagtaaaggagaagcgtaacacccgacgtgaaaaaaggaaatccaagaaagaatttttgaaggcacagaaaaacgaagcttctaataacctgaaacaagaaatagtatcaaaagctggagcacaagaaacggaaaacgatgacttaatagatgaggaatcggatgctttatctgaattagaagaggattaccgacagttgaaaaaaagcaaaaaaagaaaaaatcaagcatcctttggatttagtatg

SEQ ID NO: 26194 - DNA, 1644 bp, Schizosaccharomyces pombe
atgtcacaatttgctgagttcaaattacctgccattaagaacgagcctcctaaacactatggtcccaatagtgctgacagagagggaatcgtcaaggcctacaaggagttagaggctgaattacctgtcactatccctgtcatcattgatggtaaggaagttgaaacgaataccattggtgagcagcgttgtccttttgagcacaaaaaggtcgttgctcgctatcaccgtgctggtgccaagcacgttgaagatgccattgaggcagcacttcgtggaaagaaggtctgggaatccttaccttttgctgaccgttctgccattttcttgaaggctgctcatttgataagcaccaagtaccgttacaagctcatggctgctacaatgattggccagggtaagaacatctggcaagctgaaattgacgctggaatggagatcattgacttccttcgcttcaataccaagtatgctagtgaattatatgccagccaacctcccgaaaacactcctggtgtctggaaccgtatggaatatcgtcctttggaaggtttcgtttatgccattactcctttcaactttacagctattgctggtaacttggctgctgccccccttctcatgggcaacgtcgttttaatgaagccttctgaccatgcagtcctttctagctacattgtttaccaaatcttccgtgaagctggtcttcccgctggagcacttcaatttatccctggtgacgctgttgaagtctccaaggtttgtttcaaccaccctgagtttgctggtcttcattttactggtagcacagccgtctttcgtagcctttggggaacaattggcgagaatgttgccaacggaaaataccgcacttaccccaaaatcgtcggtgagactggtggtaagaactttcatcttgtacattcttccgctgaaattaagagtgccgttgttaatgctgttcgtgctgctttcgaatatcaaggccaaaagtgctctgccctttctcgtctttacgtttctaagtatgcttgggaaaatggtttccgtgatgagcttaccaaacaggtcaagtctcttaaggtcggtgctcctttaactgattttgctaattttgtgggccctgttatccatcaagcaagctttaacaaactgaagaaggttcttgagagtgctgcttccgattctgaaattgaagttttggctggcggtaaagctgatgattccgaaggtttctttgttgaacctaccgttttactttctaaaaaccctaaacatgatatattcgttaacgaattgttcggccccgtactgtctgtttatgtatatgaggatgacaacttagacgctgtttgcgatctcatcgatactaccactccttatggtttaaccggatccatcttcgctcaggaccgtgttgttgtcagaaagttgactgaccgtctccgtaatgccgctggtaacttctatatcaatgataagtgtactggtgctgttgttggtgaacaaccttttggtggtgctcgtgccagtggtactaacgataaagctggtagcggaatgattctgtctcgattcgtttctcctcgctccatcaaagatacgtttgcttatgcagactctgttttatacccttccaacttt

SEQ ID NO: 26195 - DNA, 1221 bp, Schizosaccharomyces pombe
atgggatgcatgtcgagtaaatacgctgatacatcaggaggagaagtcattcaaaagaagctttcagatacgcaaacctcaaacagctctacaactggaagtcaaaacgctcgagttccagtccttgaaaactggcttaatatcgtcctgcgtggaaaaccacaaaatgtggaaagttctggagtacgcgtaaaaggaaattctacttcaggtggaaatgacattaaagttttgctcttaggcgccggtgatagtgggaaaacgaccattatgaagcagatgagattattgtatagccccggttttagtcaagtagttagaaagcagtatcgagtgatgatttttgaaaatatcatctcctctctatgtcttcttcttgaagctatggataatagtaatgtctctttacttccggaaaatgagaagtatcgggcagttatcctaagaaaacacacttctcaacccaatgagccattttctccagaaatatatgaagctgttcatgccttgacattggataccaaacttcgtacggtgcaaagttgtggtaccaacctctctttgttagacaatttttattactatcaagatcacattgatcgaatttttgacccacaatatataccttctgatcaagatatccttcactgtcgtatcaagacgaccggtatatcagaagaaacatttctgttaaatcgtcatcattaccgattttttgatgtaggaggacagagatcagagcgcagaaaatggattcattgctttgaaaatgtcactgcattgttgtttctcgtttctttggcaggttacgatcaatgccttgtagaggacaattcaggaaatcagatgcaggaggcgttattattatgggattccatatgtaactctagctggttttcagaatcagcaatgatactttttctaaataaacttgatttatttaaaagaaaggttcacatttcccccatccagaagcattttcctgattaccaagaagttggttcaacaccaacattcgtacaaactcaatgccctcttgccgacaacgcagttcgaagcggtatgtattacttttacttaaagtttgaaagtcttaatcgcatcgcttctcgtagttgctattgccattttaccacagctacagacactagtttgctccaaagggtaatggtatccgttcaagatacgattatgtccaacaatctacagtcacttatgttt

SEQ ID NO: 26196 - DNA, 1841 bp, Schizosaccharomyces pombe
gttacttctttgaactaatattttaaaacagaaagaactgatgaggcaaggatgtttaatttttatgaaaaaatgcctaaagatacaaacacagtgcgtgtatttgatcgaggggtaagtattgatgaatagaaaaatttacttaaacttcgtaaaaaataacttgaaatattattattttttaatccaatctaacactgttttctaggaattttacgttgcaataggagaagacgcttcgtttgttgctcaaaacgcgtatcacactacttcggtgctaaaacaccacaatgtgtctaatacatcttattgtaacttatctccttcactatttattaagtttgcggaagatgttttaagcaaccttgcaaagagagttgaaatttggggagccaattccgcaaagacaggatttgaattgttgaagcaagctagtcctggaaatatgcaaatgctggaagatttgcttgttagtgagaattatcaagaatccacagccattagtgatagctcagttagttcggttttgttggctgttactactagggttaaacaagatcagcgaataattggcgttgcttttatagatccaattttaaaaaaattaggtgtttcagaatttgttgactcagatgcttatacgaactttgaagctctcatagtgcaagttggagcgaaagagtgcataatatcgcaatctgggcatgaatcgacgaatggcaattcagccgtttctattaacacggcagaaatcaatcgtcttcgaaatattattgaaggttgtggcgcattagttacaactataagaagctctgaattttcggctcgagatgttgaacttgagctctcaaaagtgctcgacagtccagttacacatgctcttgttccagaactaggtctacaattagcaatggcatcctgcaatgcattgcttcgctatttaggacctgcgttactaaaccctgacatggaagacgaccgtgaaaacacatctcgaaagctccatctgtatcatcacaacttggaacaatacatgcgattagatattgcagcagttcgttctcttaacctacttcctcctcccaatggtaatgctcataaaacaatgagtctttatggtttacttaatcattgtagaactgcgatgggagcaaggaatttaagaagatggattgttcagccacttttggatgcaaaatcaattgaacgaagacatgacttggtctccgcacttgtggaagatgctgaggcacgccagttattgcttgatgatgatcatcttcttcgttcaattccagatattcctaaactatgcaggcgtttaactcgtggatcagctagtctagaagatgttgtacgtatttatcaaatggcaaaggcacttccgaagatcgttacggtacttgactctttgactagtgaacataaagatttggtggataaagtatacacgaacgtccttaacaatcattgcaaaaacttggaaaaattaatagagcttgttgaaaccaccatcgacttggaagcattggattcacatcagtatattatccgtgcagagtttgatgaggagctattagatttgcgtcaacgattagacgaattacagcattctatctttgaagaacataaaagggtcggttcagatctccaccaagataccgagaaaaaattacatcttgagcaacatcacctctatggatggtgtctacgccttactagaacagaagctggctgtttaagaggccgtagttctcattatacagaattatcaactcaaaaaaatggagtctactttaccactaaacgtcttcattcactaaacaattcttatatggatc

SEQ ID NO: 26197 - DNA, 5187 bp, Schizosaccharomyces pombe
atggatcagtattggcgtgaacaagagggtcgtggactctttgaagatgatgccaatagttatgtctctgacgatgatactatgagctctctgacccgtatgatttacgataaaaactcttctcgtgatgcattacattctgattatgatagctcttcatttaatgtcgattccagttcagttgcttatccggcttggaatcaagctggtgaagaggctcctgttactatggaaggtgttcaagagatcttgttggaccttacaaataaacttggttttcaaaaagataacatgcgtaacatttttgattatgttatggttcttttagattctcgggcatctcgtatgtctccttcctcggcactgcttactatccatgccgatgtcattggtggtgaacatgcaaatttttcaaagtggtactttgcttctcattttaatgacggtcatgccattggatttcacgatatgtcttccccaattgtcgaaacaatgactttgaaagaagctgaacaggcatggagagatcaaatggcagcattttcaccccatcgcatgatggtgcaggtgtgcctttattttctttgctggggtgaagctaacaatgttcgttttgttcccgagtgtctttgttttatatttgaatgtgcttatgattattatatctcttcggaagctaaagatgtcgatgctgctttgcccaaggaattttatttagactcggttatcacccctatttatcgatttattcatgcacagctgtttgaaattttggacggcaaatacgtcagacgagaaagagatcattctcaaatcattggctatgatgatattaatcaattgttttggtcctacaagggccttcaggaaatcatgtgtgctgataaaactccgttgttagatttaccaccgtttatgcgatatcgacatctttccgatgttgaatggaaatcatgtttttataagtcctattacgagtatcgttcttggttccataacgttaccaatttctcacgtatttgggtaatgcatatatctgcttactggtattattcggcttataattccccaaatttgtacaccaaaaattatcacatccgcttgaataataaacctcctgcttcttgtcgttggacagcttgtggtttagctggtgctatagcttcttttatcaccttggcagctgtggttttcgaatatatacatgttcctcgtcgttatcattctgccagaaggttgtggccgagtatgctgttattgataagtacgctacttctaaacatcgcacctgttgttttcatatttgcttcgtctacgaaagagcagcattatgcttctcgattggttgtaggaattgtgcatttctttttctcgttggtctgtgtagtttactattcgattacgccgttacgaaatttggttggtttcaccacaaaaaggtctggaaaaaaccttgctaacagatttttcaccgccaatttcactccgacctcaaaaacaggtgctttcgtttcttggtgtctttggattacagttttggtggccaaattcttggaatcttatttctttttaactttgaatttggcagattctatcagatttttgggtgctatgcgaccttatgactgccgtgattacattttaggagctggactatgcaaggctcagcctaaaattctcttgagtttactgtatttaactgatctttctctgtttttccttgatacttatctatggtacattcttatcagcactatctattctttggcttatgctttttgcctgggtatcagtgtgtggactccttggagagaattgttttaccgcgttcccagaagaatatatacaaaactgttgtataccgatgacatggagattgtcttcaagccaaaagtacttatttctcaagtttggaatgccattattatctcgatgtacagggagcatttgatttcccgtacccaaattcaggagttgttgtaccatcaagtaccttctgaaaaggcaggctatcatactcttagagctcccaactttttctactcccaacaggttaagcattataagcaagatttgtttccggctaattcagaagctgctcgaagaatctcctttttcgcacaatccttggctgaatcaatacccaagactagttccattgatgccatgcctaccttcactgttttggttcctcactattctgagaaaattttgttatctttaagagagattattcgcgaggaagatcaactttctcgcgtaactctattagagtacttgaagcagctatatcctgtggagtggagaaattttgttgatgatacaaaattacttgctgatgaaaatgattctgttattggcagtatcgacaatgaaaaaaatggagtaaataaagcatatgaccttcctttctattgtgttggatttaaatctgcgactccggagtatactttgagaacaagaatttgggcctctctgagaactcaaactttgtatcgcactatcaacggtttcagtaactatagtcgtgccatcaaactgttatacagaacggaaacaccagaattggtcgaatggacaaatggtgaccctgtgcgattagatgaagaattggatttaatggcaaacaggaagttccgattctgtgtctccatgcagcggtatgctaagtttaccaaagaagaagccgaaaatgcagaatttttattaagagcgtatccagacttgcaaattgcatatatggatgaagatcctcaatctcgacataatgacgagcgccatctttattctgtactgattgacggtcattgccccattatggaaaatggaaagcgtcgacccaaatatcgtattcgtctatctggtaacccaattttgggtgacggtaaatctgataatcaaaatatgtctattccttacattagaggtgaatatgtacaaatgatcgatgccaaccaggataattatttggaagaatgtctaaagattcgtagcattcttgctgaatttgagcaacttactcctcccttacatagcccttactcggtaaatgccaaagctgctgacaatcatcccgtagctattctcggtgctagagaatacattttttcagaaaatacaggtatgcttggagatgtagctgctggaaaggaacaaacatttggtactcttttcgctcgtattttatcgttgattggtggaaaattgcattacggacatcctgattttattaatgttttgtttatgattactcgtggcggcgtttcaaaagcacaaaaaggtctgcatgttaatgaagatatttatgcaggtatgattgctcttcaacgtggaggacgtattaagcattgtgattactatcaatgtggtaagggtcgtgacttgggttttggctcaattcttaactttactacgaaaattggaacgggtatggcggaacaaatgctttcaagagaatatttcaaccttggcacacaattaccgtttgataggtttttgtcatttttctatgcccacgctggatttcacgtcaataacatggtcatcatgttttctttacagttattgatgcttgttattattaatttgggagcaatgtacactgttgttccggtttgtagataccgccaatttgactccttgacagcttctttgtaccctgaaggttgttatcaattaaaaccagttctcgagtggttgaagcgttgtattttgtctattttcattgtctttggtattgcttttgttccacttgctgtttgtgaattaggggaacgcggtgccatccgaatggttattcgtttagcgaaacaaatattctctctatctcctatttttgaaattttcacatgccaaatatatgcgcagagtttaattgcaaatcttacgtttggtggtgcacgctatattggtactagcagaggttttgctactgttcgtgtgccgttctcactattgtattctcgattctctggaccatcactttattttgggtcacgacttatgtacatgttattgtttggttcaattactgcttggttgccgcattatatttacttttggattacgctgactgctctttgcattagtccattcctttacaatccccatcaattcgcctggaccgatttctttgttgattatcgtgagtttatgcgctggctattccgcgaaaattcacgcaatcaagcaaattcatggattggcaactgtcaactttgccgtaccagagtaactgggtataaacgtaaaatatatggtaagaaggcagataaaattgctatggattccccgcgtgcgagaattactacaatgttttatggtgaaatattagggcctctaggaacactatttttcacgtgtattccatttctctttatcaattcccaacctggtaacgatgatgagacccaatctactaatgcttttattcgcttgattattatgtcagttgctcctttggttttaagtgcaattattgcttttttctttttctgtttaggaatcatgttacgtcctattctcggcgatagatctaaaacgtatggtgtatatttggctggagtggcccatttcctttttgtgtgtgttgatgttgttgtctttgaagtattgggctatttggaaggttggtcattttcaaaaactttacttggatttgtagcaatcatttcaattcacaggtttgctcataaattttttatcatatgtttcctgtctcgagaatttcgtcatgatggtgccaatttagcttggtggtctggacgttggaatggccaaggttttggatatatggttttaacgcaaccatggagagaatttgtgtgtaaaactacagagttgaatatgtttgctggtgatttccttttaagtcatcttttgttgtttttgcaagcgcctgttattttgattccttatatcgacaaacttcactcgatcatattattctggcttgtgcccagcagacaaattcgacccccaatttataccataagacaaaacaaacttcgtcgtcaaatagttcttcgctatgccactttgtacttttcattgtttattgccttttttgttcttttaattttgccttttgtgtttggtaaatcagctgctggaacttcaatggataaatttaatctgattcagccagcgacaaagattgtttattcttcaacaaagaattcttctgtc

SEQ ID NO: 26198 - DNA, 2013 bp, Schizosaccharomyces pombe
ggtctcaaacgtctggaatatcggggttatgattcttcaggatgtgctgtcgatggagatgaaggtgaagacttcatcatgttcaaagaagttggcaatgttagtaaattagaggcatctataaaaggatcgaacgtgaataaatccactaaatttatcaaccattgcgccattagtcacacccgttgggcaactcatggcatcccttctcccattaattgtcatccccagcggtctgaccctcatagtgaattcatagtcgttcataacggtattttaaccaactatcgtgagctacgcaccgttcttgaatcgagaggcatggtttttgaaagcgaaaccgatactgaatgtgtggctaagctcgctaaatttatttacgacactactccaggagttgacttcacatcactcgctaaactcgtctttcgtgaacttgaaggtgcctacgctttactcattaaaagcagtcactaccctggtgaagtggtcgcaactcgtcgtggttctccattaatagttggtgtcaaaagtgagcaaaagctcaaagttgactttgtcgatgtagaatttcccgagcctgcagaaggtctacctggaactcctaaacccaccagcttgcatccagttttttccaacccagctaccaatggtatgcttcgtggtgacaaacccgacttgttacatcgcgctcaaagtcgtgcttttgtatcgggtgaaggagttccgggtcccatagagtattttttcgcatctgatgctactcccatcattgagtacactaagcgtgtgatgtttctagaagatgatgatatagcacacgttcgcgatggtgaattacatgttcataggttgcgtcgtgaaggcggtggtagtacgactcgtaccattgaaactttggagatggagattgccagtgttatgaaaggaaactatgaccattacatgattaaagaaatttgtgaacagccagatagcctgttaaataccatgcggggacgtgttaattttgtaaacaggcttgttacattgggtggtttggaaagttattatgacattattcgcaaaagtcgtcgcctaattttcgtggcttgtggaacctcctaccattcatgtgtagccgttcgtcctttgttcgaagaactcactaatatccctgtagtggtggagttagcgtctgattttgtggaccgttgtccatcagttttccgtgatgacactttcatttttgtctcccagtctggtgagactgctgattctttgctggctctgcagtataccttagaaaacggtgctttggctattggcgtagtcaattgtgttggttcaagtatttctcgtaagacgcactgtggtgtccatattaatgctggccctgagatatgtgtcgcatccactaaagcctatacatcgcagtatgttgcattagtgctcatggcattatatctatccagagattccgtttcacggttggaacgccgtaatgaaattatcgacggacttgccgaaatcggagaaaaagtgcaagaaactttacatcttaacgccgccataaaacaaactgccattgagcagttaattaacaaggacaaaatgttaattattggacgaggttatcattatgccactgccttggaaggtgcattaaaggttaaagaaatttcttatacacatgctgaaggtgtcttagccggcgaactaaagcatggtgtgttagcacttgtcgataatgatatgccaatagttatgcttttaccagacgactacaactttccgaaggcttggaacgcatttgaacaagttagagcacgtggtggtaaacccataattattacagataaaaaactagacaatttagaaggctttaccataattaaagttcctaaaactgtggattgtttgcaaggaattttgaatgtcattccttttcaacttctaagctattggttagctgttaaacgtggccacaatgttgatcagccacgcaatttggctaaatcagttacggtggaa

SEQ ID NO: 26199 - DNA, 1469 bp, Schizosaccharomyces pombe
atgagctggaaagggtttacaaaggcacttgcgcgtacgccgcagactctacgcagcaagtttaatgttggagagattaccaaagatcctatttatgaggatgctggaagacggtttaagtctttagaaacggaagcgaaaaagctggctgaagacgccaaaaagtatactgatgctattaatgggttattgaatcatcaaattggatttgccgatgcttgtattgaaatttacaagcctattagtgggcgtgcttcggatcctgaatcgtatgagcaagaaggcaatgcggaaggtattgaggctgccgaggcttacaaggaaattgtatacgatctccaaaagaatttggcttctgaaatggatgttatcaacactcgcattgtcaatccaactggtgaactgctcaagattgttaaggatgtagataagcttttgttgaaacgcgatcataagcagctggattatgatcgtcatcgttcatctttcaagaaacttcaggaaaagaaggataaaagccttaaagatgagaagaagctttatgaagctgaaaccgcctttgaacaatcttcccaagaatatgaatattataatgaaatgctgaaggaggagttacctaaactatttgcattggctcagagcttcattgctcccttattccaaggattttactatatgcaattaaatgtctattacgttctttatgaaaagatgagtcactgcgaaattcagtactttgatttcaataccgatattttggaatcgtacgaaagaagacgcggcgatgttaaagatcgcgcagaggctttgacgattactaaatttaagaccgctaaaccgacgtataaacgaccgggtatgggaccgggtggtaaagatgcaactgcttcttcttcttcttccttttcgtcaaagcgtgaagaagcagcagccgaaccctcctcttcgacagctacggatattccacccccatactcaacgccatcggttgccggagcttccgattattctaccccaagtgcaggttatcaaactgttcagacgaccactactacaactgaagcagcagctgctcaataccctcaagcggcctttcctccccctccagttatgcctcaacctgctgctgcggcagtgaccacacctgttgctgcaccggtagcagcagctgcagccgcagttcccgtacctccaccagcgcctgcacctgctgcggctcccgccgcagagcatgttgttgctttatatgattatgctgcccaagcagccggagatttatcttttcatgctggcgatcgtatcgaagttgtttcacgtactgataatcaaaatgtaagtacttaaacttaaattttcatttttttcttattaaacaaggactttactaatatatattttaggaatggtggattggccgacttaacggtgcacaaggtcaatttcctggtaattatgttcagcttgaataa

SEQ ID NO: 26200 - DNA, 1509 bp, Schizosaccharomyces pombe
atgtcaactacactgggacaggaaagcaaaactgactgggctagtttggactctgatgaagaggttcaaagaattagtgataaagtcaatcagttaaatacttcagaaaataaaaatgaagatcaaaaagcaacaaatttaagtgacagattaggtccaaaaatcactgagaatgttgatgcaaaatctgagcaagacaaagcgaccaacacgattgcagaggacgccaatacgaagcaatctgaaaatgatgaatctaatttaataccaaataaaaacgaggttcgtgtaaaattagcagatctacaggctgatccaaactcacctcttttttctgttaaaagttttgaagagttggagctcaagcccgaattattaaagggaatttattcaatgaaattccaaaaaccctcaaaaattcaagagaaggcgcttccacttttactctcaaatcctcctcgcaatatgatcggacaatcacaatccggaactggtaaaaccgctgcatttgcattaacgatgctttctcgtgttgatgcttctgttcccaaacctcaagctatctgcctcgctccttctcgtgaattggcccgtcagattatggatgtcgtgacggagatgggcaaatatactgaagtaaaaacagcttttggtattaaagactccgtccctaaaggtgcaaaaatcgatgctcaaattgtaatcggaacgcctggcactgtgatggatttgatgaagagaagacagcttgacgctcgcgatattaaagtattcgtgttagatgaggcagacaacatgttagatcagcaaggattaggagatcaatctatgcgtatcaagcaccttcttcctagaaacactcagattgttcttttcagtgctaccttttcggaacgcgttgaaaagtacgctgaacgttttgctcccaatgctaatgaaattcgtctgaagactgaggagctttctgttgagggaatcaagcagttgtatatggattgccaaagtgaagaacataaatataatgttttagtggaattatatgggttattgactattggtcaatcaattatattttgtaagaaaaaggataccgctgaagaaattgctaggcgtatgactgcagatggacacactgttgcttgtcttaccggtaatctggaaggtgcacaacgtgacgctattatggattcattccgagtaggtacttcaaaggttttggttactacgaatgtaattgctcggggtatcgacgtatcgcaagtcaacttggttgtaaactatgatatgcctttagatcaagcaggaagacccgatccacaaacatatcttcaccgtataggtcgtaccggtaggttcggccgtgttggagtaagtatcaattttgttcacgataaaaagagttgggaagaaatgaacgccattcaagaatacttccaacgtcccatcacgcgagtgcctacagatgactacgaagagcttgaaaaagttgtcaagaatgcacttaaaatg

SEQ ID NO: 26201 - DNA, 2477 bp, Schizosaccharomyces pombe
atggaacaacttattccattggtgaatcaacttcaagaccttgtctacaacacaattgggtcagattttttggatttaccatccatagtggtcgttgggtcccaatcttgtggaaaatcttctgtattggaaaatattggtaagtactgtttattaaaattaatttagataaagaatcaacagctaaaaaattatcagaggtgttttttcctctggataaatttttcgtaattttgacagtacattgttattaactcattcgtattttagttggtaaagattttttacctcgtggtaccggaattgtcactagaagacccttgatactacaactcatcaacttgaagcgcaagaccaaaaataaccatgatgaggaaagtacttctgacaacaattcagaagaaacaagtgctgctggggaaacaggcagtcttgaaggaattgaagaagattctgatgaaattgaagattatgctgaatttttgcatatccccgataccaaatttaccgacatgaacaaagttcgcgcagagattgagaatgagactctacgggttgctggtgcaaacaaaggaattaacaaattgccaatcaatctaaaaatttattctactcgcgttttgaacttaactttaattgatttgcctgggcttacaaaaattcccgttggagatcagcctactgatattgaggctcaaacacgctctcttattatggaatacatcagccgtcccaattccattatacttgctgtatctcctgccaactttgacattgtcaacagtgagggcctaaaactagcgaggtctgttgatcccaagggtaagcgcactattggtgttcttaccaagcttgaccttatggatcaaggtaccaatgcaatggacatattaagcggtcgcgtttatccccttaagctgggtttcgtagcaactgttaaccgttcccagtctgatattgtatctcacaaatccatgagagatgctttgcaatctgagcgctctttttttgaacatcatccggcatatcgtaccattaaagatcgttgtggaacaccctatcttgccaagacattgagtaatctattggtatcacatatccgtgagcgccttcccgatatcaaagcccgccttagcactctaatatctcaaactcaacaacaactaaacaattacggtgactttaaactttctgatcagagtcaacgtggaattattttattgcaggcgatgaatcgctttgccaacacgttcattgctagtatagatggaaattcttcaaatattcccacaaaagaactttcaggtggtgctcgtctttactccattttcaataatgtatttactactgcattgaattcaatcgatcctttacaaaacttatcgacagtcgacatacgtacagctatattgaatagcacaggctctagggctaccttgttcctttcggaaatggctttcgatatattggtgaagccgcaattaaaccttttagcggcaccctgtcatcaatgtgtcgagcttgtttacgaagaattaatgaaaatatgtcattattctggtgactcagacatatcgcattttcccaagttgcaaactgctctcgtagaaaccgttagcgatttactacgagaaaatttaactcctacttattcttttgtagaaagcttgattgctattcaaagtgcatatattaatacgaatcatccggatttcttaggggtgcagggtgcaatggctgtagtattgtcaagaaaagaacagaatcgcttaatgctttcccaagaaaatgatgaacccatttcttctgctttggacactgtgaagcctgacggaattgagttgtattcttcggatcccgacacttctgttaagagtattaccaataaagcgacgaacgagattacaactttgaagagcgatgattcagcaaaaatgcagcctttggatgttttggcttctaaacggtataataatgcctttagcactgaaactgcggaaagaaaaacatttcttagctatgtctttggtgccaataatgcgactaggaaagcaatgagcattgataagtcttctagctatcctttaaatgattctctttctggaggagatacaaatcacaaaaacaaccatcctttaaagatgacagatttatcaaatgaagttgaaacaatggcgttggaggacatgagtgaaagggaagaagttgaagttgatcttattaaagagctaattacttcttatttcaacttaactaggaagattataattgatcaggtaccaaaggtaattatgcatttgctcgtgaacgcctctaaagatgccattcaaaatcgtttggttagtaaattataccgagaggatttctttgacaccctccttattgaagatgagaacgtcaaaagtgaaagagaaaaatgtgagcgtcttttatctgtttacaaccaagcaaacaaaattatttcaacggttttttaa

SEQ ID NO: 26202 - DNA, 2013 bp, Schizosaccharomyces pombe; identical to SEQ ID NO: 26198

SEQ ID NO: 26203 - DNA, 2221 bp, Schizosaccharomyces pombe
atgaaaatatatgctgttagagaacctgtgttttcaggacctacaccttcattccaaaatgtctcaaatgatattcctttagtaattgataatggtattataatacgaacaatttttttaaaatggttactaatgaatatactgtataggatcttggcagttaagagctggatggggtggtgaaaaagatccaaaattagtttttgacaatttagtttctcgataccgtgatcgtaagctttcacgtacctctacacttgtgggaaacgatactctaattgaggtgggctcaaggtcaattgctcgctcaccgtttgaacgaaatgtcatcagtaattgggatttaatggagcaagttcttgattacacatttctaaaacttgggattgatagaatggaacatcccatctgtatgaccgagccattagcaaatccaacgtatgttcgttccacgatgaccgaacttttgtttgaattgtacaatgcaccatcggttgcttatggcattgacggtcttttttcattctaccataatacaaagccatcttctagtggaatcgttttgaacttgggaaatgctgcttctcatgtaatacccgtattaaacggtgaaagaattttgtcagaggctaagcgtatttcttggggtggatcgcaatcctcttcgtatctactgaaattattccaaattaaatacccttcttttcctataaaaatgcttccttctcaagctgaattgcttatgcacgatcattgccatgtttcttctgattatacacatgatatagcgcacgcccttgatcgtgatattttagaacgcgatgaaatcgtattacaatttccatatacggaggcagctgctcaggagaaaagtcaggaagagttggaattaatagctgagcgcaagcgtgaaagtggtagacgccttcaggctcaagctgctataaagcgaaaagaaaaagcagctgagcgtgatcgtgagcttgctactttaacggaacttcaacagcagagtttagttttatctcgtcgtgcttttcaaagagcattggaagaagctggctttgaggatgaatctcaactcaatgctcaagttaaaaatgttcaggctaaaattcgaagagcccaaagagatcaacaacgtcaagaggagtcggagggatctttagatgttacagaaattgatgtcgaacaagcttttcctctattgaacgtccccgatgcagaacttgacgaagctgggctacgtcaaaaacggcaccagcggttaatgaaagcaaattacgatgcccgagttcgtgcgaaggctgaaaaggctatagaagaagcagctgaagctgaacgagctgaagctgatgaacgcttgcgacttgaaaatttctcaacttgggtcaacgaaaagagagaaactcataaaattttgctggaaaaaatatcaaaaaataaaaggctcaaatttgaattgaatgacagaaaatcacatgcctcacaaatgagaatgaaaagtcttgctactcttgctagcgaacagcccattcaaaaacgaaaacgcaaagatcaatctgaagataatttcggcgctcgagatgaagattggaaagtgtatcacgacgttttaactgctgaacaacttgaagaggaacgtaagaaacttctcgaccaaatatattctctcgaaaaacaacttttggaatatgattcacaatttacgcaggcaaatacttatgacacattaaatgatccgcgagctacgctcttgtacgcatttactcgtggcgtgagtgactttgacgttaacgatgttgcgcaagcttttcaactacatcttaatgttgaacaaatacgtgttccggaagttatattctctccaagcatagtaggtattgatcaagcaggaatactagagattatgcgttcaattttgcaaagacatagtttagaagaacagcaaaagctcgttagtaacgtactaattactggtggacttggttcccttcctggaatggagactcgcataaagcgagagctaaccagtattatgcctgtgggttcctcaattaatgtatttcgagcttctaatcctcttcttgatgcatggaagggtgcatcagagtggagtgttactgaaaagtttaaagctgctaaagttactcgtgaagaatatctggaaaaagggcccgagtatattaaagagcattctttaggaaacataaattcttaa

SEQ ID NO: 26204 - DNA, 2034 bp, Schizosaccharomyces pombe
atgaagacttatgaatatgtattgctggtcattattttgatccttagcttgtgttactttatttataacaattttctcaacaagccaaaggctcctgagaggcgagtcgtggctaccgacagtattgtcgagttgatggaggccgaaaagctcactgccgcggttttctttggatctcaaactggtaccgctgaggactttgcctaccgtttttcaacggaagcaaaggcaaacttcaatcttaccaatatggttttcgatcttgagaactatgatttaaccgacttggacaactttgatagatcaaaactattggtattctttctcgcaacttacggtgaaggtgaacctacggacaatgcggaggcctttttgcaacttcttgagggcgatgataccgttttttcaagtggaaaaggcattgaagatactcccttcgaaggaattcgttatgcaatttttggccttggaaatcatacctatgagtattataacgcaatggctaaaaaggtagatgctgcaatgactcgtttaggcgctactcgtgtgggcaatctaggtttgggcgacgatgccgctggtatgcttgaagaggactatttacaatggaaggatgatactttacctgagataggtaagctgttccatttgcaagaagtccacaaggaatacaatcctatgtttgaagttattgagaagcctgaaatttccaacactagttctactgtctttttgggagaaccaagtcgtcagcaattgaaaggaaatgttgcatcgaaagctccacgttctcaagctaatccatttttctcttctcctgtcagatctcttgagctattcaaatctggaagtcgtaattgcttacatttagagttggatatcgcagactctggtatgcgatatcaaacaggtgattacgcttctatttgtcctatgaatcctagtcaagctgttgatgatcttctcgaagttctcggtctcaaagagaagagggatactgtaataattgttaaacctatcgatactctcgataaggctcctgttttaagtcctactacctatgacactgtttttcgctactactatgaaatatgtggtatcgtctccaggcaactgctttcttttattgctcctttcgctcctacaccagaatctaagcaagaactcgagaaattaggcaacgattatgactactttaagaagaacgttgtagacttgcacctaaaccttgctcaagtccttcgtcgtgtttctcctgacgctccatttacaaaacttccattctcaatgctattggaaaatatggcacacatgaaaccgcgttactattcgatttcctcgagcagtgtagtgcatcctgacaaagttcacgttacagcggtagttgacaagaaagaatggactgataagaatcatatcttttatggactaactactaattatttgttggcacattgtcgtcatatgcacggtgaaaaaattccacatccaaatggtttggaatatacccttgagggtcctcgtaaaaactggaccggaaaaattccgatgtttgtaaagaaatctacttttcgattggctcctcccgatgtccccataataatggtaggcccgggtactggtgtagccccattccgcggttttgtgatggaacgggctaatttagcttctaaaggagttaaagtagcaaaaacacttttattttatggttgccaatattctgacaaggattttttatataaggaagaatggcaacaatacaaagatgtcttgaaagactcttttgaactgattaccgcattttcccgtgagcaagatcataaaatctatgttcagcaccgtcttttagagcacagtgataccattgctaaacttgtagaagaaggggctgctttttatatctgcggtgatgctgatcatatggctaaagatgttgtgaatgcattggcttctattctgaccactgttgatgttgacggtatgaaagccgttaaagctcttcgagatgacaatagattttttgaagatacctgg

SEQ ID NO: 26205 - DNA, 1977 bp, Schizosaccharomyces pombe
tttatttataacaattttctcaacaagccaaaggttcctgagaggcgagtcgtggctaccgacagtattgtcgagttgatggaggccgaaaagctcactgccgcggttttctttggatctcaaactggtaccgctgaggactttgcctaccgtttttcaacggaagcaaaggcaaacttcaatcttaccaatatggttttcgatcttgagaactatgatttaaccgacttggacaactttgatagatcaaaactattggtattctttctcgcaacttacggtgaaggtgaacctacggacaatgcggaggcctttttgcaacttcttgagggcgatgataccgttttttcaagtggaaaaggcattgaagatactcccttcgaaggaattcgttatgcaatttttggccttggaaatcatacctatgagtattataacgcaatggctaaaaaggtagatgctgcaatgactcgtttaggcgctactcgtgtgggcaatctaggtttgggcgacgatgccgctggtatgcttgaagaggactatttacaatggaaggatgatactttacctgagataggtaagctgttccatttgcaagaagtccacaaggaatacaatcctatgtttgaagttattgagaagcctgaaatttccaacactagttctactgtctttttgggagaaccaagtcgtcagcaattgaaaggaaatgttgcatcgaaagctccacgttctcaagctaatccatttttctcttctcctgtcagatctcttgagctattcaaatctggaagtcgtaattgcttacatttagagttggatatcgcagactctggtatgcgatatcaaacaggtgattacgcttctatttgtcctatgaatcctagtcaagctgttgatgatcttctcgaagttctcggtctcaaagagaagagggatactgtaataattgttaaacctatcgatactctcgataaggctcctgttttaagtcctactacctatgacactgtttttcgctactactatgaaatatgtggtatcgtctccaggcaactgctttcttttattgctcctttcgctcctacaccagaatctaagcaagaactcgagaaattaggcaacgattatgactactttaagaagaacgttgtagacttgcacctaaaccttgctcaagtccttcgtcgtgtttctcctgacgctccatttacaaaacttccattctcaatgctattggaaaatatggcacacatgaaaccgcgttactattcgatttcctcgagcagtgtagtgcatcctgacaaagttcacgttacagcggtagttgacaagaaagaatggactgataagaatcatatcttttatggactaactactaattatttgttggcacattgtcgtcatatgcacggtgaaaaaattccacatccaaatggtttggaatatacccttgagggtcctcgtaaaaactggaccggaaaaattccgatgtttgtaaagaaatctacttttcgattggctcctcccgatgtccccataataatggtaggcccgggtactggtgtagccccattccgcggttttgtgatggaacgggctaatttagcttctaaaggagttaaagtagcaaaaacacttttattttatggttgccaatattctgacaaggattttttatataaggaagaatggcaacaatacaaagatgtcttgaaagactcttttgaactgattaccgcattttcccgtgagcaagatcataaaatctatgttcagcaccgtcttttagagcacagtgataccattgctaaacttgtagaagaaggggctgctttttatatctgcggtgatgctgatcatatggctaaagatgttgtgaatgcattggcttctattctgaccactgttgatgttgacggtatgaaagccgttaaagctcttcgagatgacaatagattttttgaagatacctgg

SEQ ID NO: 26206 - DNA, 3699 bp, Schizosaccharomyces pombe
atgggacgtttactaagactggaagttgaaaactttaagtcttatcgaggacatcaaattataggtccttttgaggactttacctcgattatcggtcctaatggagccggaaaatcgaatttaatggatgccatttcttttgttttaggggtcaagtcttctcatttacgatcaactaatgttaaagaactgatctatcgggggaaaatactgcaaagagataatacagatttcactgattctagtaatcctactacagcatatgtgaaacttatgtatgagttggataatggggagcaaagagagtataaacgcgcaatcactccttctggtgctactgaatacaaaattgatgaagaaatagttacgttttctgaatactgcggatctctccaaaaggagaatattcttgttcgagctcgaaatttcttagtttttcaaggtgatgttgaaaccattgcttcgcaatctcctttagaactttcaaagcttgttgaacaaataagtggctctctggaatataaatctgagtacgataaatctaaagacgagcaggacaaggctgtaaatttatctgctcattcgtttaacaagaaacgtggtatcaacgctgagttacgccaatatcaagaacagaaaactgaagccgagcgttatcaaagtcaaaaagaaaaacgagactctgcgcagttagtttaccttttatggaaactctttcatctagagaaaagtattagttctaatatggcagaggttactcgattaaaggcagattccattcaacttatcgaaaggcgagatgagaacactaaagagatagaaaagttgaaagaaaaagagggcagtatacgaagaaaccttcttgcattcgatagaaaagttcgaaaacaagaaaagttgattgcttcgaaacgtccagagctcatttcaattgccgagaaagccctagagtctaagtcaaatctccgaaaaattcaaagaaaagctgcggaaatagaaaaagattattctgaccaagctagtacgttacaagtattagaaaatcaattgacttcactctcagctgctgaaaaagagtttttaaaagacatgcaggaaaaagagcaactcaaagggttgcgattgttaccagaggataaagaggagtatgaaggacttcgaagtgaggcggacaaattaaactcaaatctattgttcaaattgcagacgttaaataggaatattaaagttacttctcaatcaaaggattcattaacgagcatcgttggagacttagagtcgaagattaaaagccttcatgaaagtgtttcttctcttgataccgagcgagcggatttgcttgctaaaataaatgaaaagattgaaagtttggaacttgaaaagcatgatcagcagaagaagaggttgacttattctgagctttttcataaaacacaagaattaaatgaagagcttcaatcttgtttacagaaaattttagaggcaagtgccgaccgcaatgaatccaaacaggatgctaaaaaaagagaagcattgtatgctttgaaaaggatatatcctgaagtcaaaggaagaatcattgacttatgtactcctactcaaaagaaatatgaaagcgcaatcgctgctgctttaggcaaaaattttgacgcaattgtcgtcgaaacgcaggcagttgctaaagagtgtattgactatataaaagagcaacgcataggtattatgaccttttttccaatggacaccatagcagccagtcccgttaatcaaaaatttcgtggaacacacaaaggcgcccgacttgcaattgacgttttgaattttgagtctgaatatgaacgtgtaatgattagtgcagttggaaatacactcatttgtgattcaatgactgttgctcgagacctttcctataacaaacgtctcaatgccaagacagttactttagagggaacggttatacataaaacagggttgattactggtggatcttcaaacaaccggtcggcgaaacactgggatgaccatgattttgatctgcttactcaaacaaaagatagacttatgcatcaaattggtgaaatagaatatcaaaagtcatcttgtgtgattacagaaagtgatactgtcaagttgcatagtcttgaatctgagatatctctactcaaagacaaatatacagtagtttctagatccgtggaagacaaaaaaaaggaaattggacattacgaatctttaatcaaagaaaaacagcctcacttgtcagaattggaaatggaacttcgcaactttgttaaaagtagagatgagcttcaaattcaagtagaaaaggttgaggaaaagatattctccgggttttgcaaacgaattgggataagtgatatacatacttacgatgagatacatcgcacttttactcaaagttttacacaaaaacaactcgaattcaccaagcaaaaatcattacttgaaaatcgtattagttttgaaaaacaacgtgtttcagataccaggttacgattagagcgtatgcataaattcattgaaaaagatcaggaatctattgataattacgagcaaaatcgggaagcacttgaatcagaagttgcaactgccgaggctgagcttgaattattaaaggaggattttgcaagtgagaactctaaaactgaaaaaattttattagctgcatccgagaaaaagctagtgggcaaacgattagtgtctgagttaacaaagttatcaggaaacattactcttttagaatcggagattgaccgctatgtatctgaatggcacgcaattttacgaaaatgcaaactagaagatatagatgttccgttacgcgaaggatctttgacgagcatacctatagatgatgtctcaaacagcggtgatatcaccatgggcgaagagccgtctgaaccagtaataaattttgagaaatttggagtagaagtggattacgatgaactggatgaagagttacgcaatgacggttctgagagtatggcttctgttcttcaagaaaaattgagagagtattcggaagagctggatcagatgtctcctaatttaagggctattgagagacttgaaacagtagaaactcgcttggcgaagttagatgaagaatttgctgctgctcgtaaagcagccaaaaacgcaaaagaacgcttcaatgccgttaagcaaaagagattgcaaaaatttcaagctgccttttcgcatatctcggaacaaatcgatccaatatataaggaacttaccaaaagtcctgcttttcctcttggtggaacagcgtatttgactttggatgacctcgatgagccatatcttggaggaatcaagttccatgcaatgccacctatgaagagatttagagatatggatcaactttctggaggagaaaagaccatggctgctttggctctgctatttgctatccactcttatcagccatccccattttttgtattggatgaaattgatgcagctttggatcaaaccaacgttaccaagattgccaactatattagacagcatgcatccagcggttttcaatttgttgtcatttccttgaaaaatcagttgttcagtaaatcagaagctttagtgggtatttatagagatcaacaggagaattcttcacgaacattatcaatcaacgtaagggattactttttcttaattttaaaatac

SEQ ID NO: 26207 - DNA, 1713 bp, Schizosaccharomyces pombe
atgggaattaaaggtcttttgggacttttgaagcctatgcagaaaagctctcatgtcgaggagttttctggcaagactttgggagttgatggatatgtttggttgcacaaggcagtgtttacatgtgctcatgaattagcatttaacaaggaaaccgataaatacctaaagtatgctattcatcaggcgttaatgctacaatattatggtgtaaaacctttaatagtattcgatggaggacctcttccctgtaaagcatcaactgagcaaaaaagaaaagaacgtcgccaagaggcatttgaacttggtaagaaattgtgggatgaaggtaagaaaagtcaagcaataatgcaattctcacgctgtgttgatgtgaccccagaaatggcttggaagttaataatcgctttgagagaacatgggattgaatcaatcgttgctccgtatgaagcagatgctcaactcgtatatttggagaaggaaaatatcattgatggcattattacggaagactctgatatgctagtttttggcgctcaaacggtactatttaagatggatggatttgggaattgcataactattagacgtaatgacatagcaaacgcacaagacttgaatctccgtcttccgattgaaaaacttcgacatatggcaatattttccggatgtgattacacagatggtgtagctggaatgggattaaaaactgctttacgttatttgcagaaatatcctgaacctcgggcagctattcgtgcaatgagacttgataaaagccttaaagttccagtatcttttgaaaaggagtttgcacttgctgacctagcctttcgacatcaacgtgtatattgtccgaaagacaaaactctagttcatctgagtcctcctgaaagggaactttctgtacatgaggatgcatttataggctcattttttgataatcagttggctattgatatagcagagggaagatctaatccaattacgaaatgtgcttttgatatcaaggattcgtctatgcaatcatttaccaaaactacaattactattagtaaacgaaagggtatatcaaagacggatatttccaacttttttatgaaatctattcctccttctaaacgtcctaccaaaagcacgagccttattgatgttaccaacgtcaaagtgcaacgaactcatttagcaaatgatatttcatccgaaaaacaatcaatcaaatctgcgaatgaaaaagcatatgttactccaaaatcaaattctttaaaaccaggttttggaaaatcactttccgatatctctaattcagcgacaaagaatgaaaatgtccctttccttcctccgagaacaggtgttagtaaatattttaaacttcaaaaaaatactgaaaaagaaattgatgagcaagtacctagtcaatccaacaatacaactccaacatctgctaaatcagattctgcttcaccccaaaattggttttcttcattctcttaccaaacaccgaattctgcttcacccccgttttcttcactatctcatacactcccaatttcagcacttgctaaaattggtcatgatgcgttaaaccgcaaaaatcatgcctctcttccgtctcgtcggattgtgtataagccaccgtctagtccctcaaccccaatatctatgaatcctagacctaaaggaatcctatcacttcagcaatataaatttcgt

SEQ ID NO: 26208 - DNA, 5832 bp, Schizosaccharomyces pombe
atggaaaatgacgaggcttttgatagattaataagaaaaattcaggaaaatcaaaaacacccatctttcgaagggtccaataaagttttgcatttggcgctttcatacctaaatactaacagacaaaaccctcattgggtttgtgatcctaaattacaagtagcagttcgtgaatgtctttttctattttcttttcaaaatgataacgagtatctggtatggttcaaaaaacatttgaacgaacgccttcagttatgccccaaatgtatagttaaatatcaccaatctttagatgatttcaaaagtctatgtttaaacatttttcactttgacccaaatactcttgagattgtaatggagaaaatttatagttgggacatttttcggttacaggaagttctcaaaacagtgcctaaaatcgacacgtcctcggcctctaaacctatactatgcgccttctacgaaatcttatactctcctcgtattttacataataaagaaatctttcccttgttccgaaacagatttcttgagtccggttttcttcggctctcgaaaaacctagtgccaggtgtcataagtcttctcttctcgagagatgatgagctccgaagatgggcttgcagtattttaagtgatgtaaaaacaatctccgataatgaatttaaaatccttgagggtccccttcttcaggaaattcgttctttagaccagaagaaagaaaatgagaacgagatgcaaatttttctgaaaggtttatcgttgctgttaaagcatgttgatcatctttattttaggggacttacaggaaaaaatttcaatgtcgccgattttattctttcgggattgcaaagcgaccatactaatttatgtccgtctttccttgtatgtttacattctttgttatactgctatggacgtaatttttggacgccagaaatttctcccagtgaagtaatagataaaatttttaatggtaatgcttataagaggtggacagaagaaaatacatccaatttttcaaacgaccaaaaggcagagaatccgtttgaatgggctacctctcttttgaagacaatttcaatcattgatgaagttgaattaattaacaaaattttgattaattacaccatgcaatataaaaaggaactggaagtcggtttcaaaaatgttcagttacttcaatcacttgctgacatattttcagttttgttttccgaatattttatgattttcccccatagtgatcaaagtttacaaaacaaagtatttgaattacattccactttagcgattaagtttgacgagctgtttcgtttgctaaacttggaaaatgaagagtctgttgaatggaggcttattaagaaagtttttgaataccgattgaatttagatctttatattttgaagcaattctattgccattatttggacagaaatagaaagccacccttgaatatcaaatcggtaagtgagtcttttaaaaatttttgggtatatttgcaaaacgtatttcgagaggagaagttctttatggttcgtattgtttttcgtgcttgctctacagtttgcttgattgataagttgccgcctaagaaagttgacattccgttcaaaagtgatttcgaaaatgcactaaacggatttgttgcaacattttctgaaatgcttattcagactcaatgttggcatttgtcggcacaaacccaattggtttcaaatcctttaacttttcgtggaatcttttcactcgttttttctccaattcttgagatctcaacaggaagtatctcaattattaaatctatttcgctttctgacagcgttgttgatactataggagagctattgagaagccagttttcaaatacactaaattcttcatgttatgttcttctgcagtggcttaaagtcagaaactttggaggagccaagcacattgtttattttaataaattaattataaacactatttttgactctgttgatggcttaacttctaaggatgcgacttttgcaaaacaagtggaaaagaaagaatcccttaagaatttctgggaatcgttatggaaattctttactcattttttcattgttcttcctacttggccagttcatgataaggacaatttagttgatttaatgcgggatacccttgatttttgcgatatgctcattaatatttttgaggaagttaacggattcatttttggattatcggataacgatattaaaattgtttcggctaatgataagggcagtgctttagctatgtgtatagctgattctttggttactgtatcttattggcttaagttaactgattcttcacttctaacatccgttgtgaaagtgatttgtaaaatgcttaaaatttgtaaaaagttggagtgtccaattagtcaaaatgtgattgatattatccatagggcatcaattaccagtgatgaacaaacaattcttacattcactgagagagaggatctttttatatcgctcacaccatacctttcagaagacgttcttaatcactctcctttcaatgataccaatacgcttgaaactaagttacagagtgatgatcggggtttgctttctaaagaccagactattgggattgcgaaaaaattacctgagtcaaacattagtacttcaaatcattttttgcttcctccgaaggctatttctgcttctaaagccatcaatagaaatgctcaaaaatctcaaaatttaaattttttgaaatctaaacaagagacaacacagcgaattcgcgaatccgcgaaagttccaagaaccagtgcggggaaccatctttctgagaaacttaattcggataatcatataccaaaagctttgcaaaagctcgattctgctgacccaattcgcaagccttcacttttgcacacttctaaaagttattctaatccagatgacaaaaatacttcaacttccgatgaagatacctcggagtccgaagaagagtctagtaacggtctattctcgcttgcacgtgaagctaattctcatgcctctaaatctcttccacaaagaaggcagattcagttcttggactttgattcccttaaaacaaaaaatgtagttcatcctactcaattgcgccgtaatactcaacaaagtgcacaacttgctcgactccggctaaaccctgatgttcaagagttttacaaagtaattttgggttggaacccattagctgattctttttcggcgtctaatgttgagatgcagtgcgtccaagctaaattcacgtataatgattcaaacgcttatgagaaagttttcaaaccaatgttgtttcatgaatgttgggctcaagtgaaaagtgccgttgaagaaaagcaataccctcccatagatttaatcctcaacacccgcagtacagttgataactttgtcgatatttactttacgtcctgttcacctaccgaagtctcttttttaagtgatacagatatttgcttactgtcaaaatcacaaagttcgggcgatactaataacccaaaatcttttcagttgtgcaaaattcaatccatttctcgtaaaaaagaatcacttgaactctgtctgcggatgaatattgaatcaattgatctacaggagtatgcaccgaacattaggttcacagcacaaaaattatttaatgctactactagcttacgtgaatttgctgctttaaaatctcttcgccatttaccattgtctcagagaattctggatgccaatgtaacgcgtctaccttcaaattttacagatgacaaaaagcaaaaaataatgaagtcttatggtgtaaatgaaccccaggcatatgcgatttatgcatcttctgtaaatgatggttttacgctcattcaagggcctcctggaactggaaaaactaaaaccattctaggcatgattggagctgtacttacttcttctagtcaagggttgcaatttaatgtcccaggacagacgcgaaaaacctcaaagaataagattttaatatgcgctcctagtaatgcagccatagatgaaattctccttcgtatcaaagccggtgtttacgatcatgagggtatcaaattttttccaaaagttattcgtgttggatttggtgactccataagcgttcacgctaaagaatttactttggaagagcaaatgataaagcaaatggaacttacgaacctaaagaaagatcaagaagcaaacaattccagtgatactcggaaaaaatatgactcaattattaaaaaaagggactctttacgcgaagatctagaaaagtttcgtagtactggaaaaaatagttcaatattggaagcacagcttcgtgagattaccaaacagaaaaacatgcttgaacagagccttgatgatatgagagaacgtcaacgctcaactaatcgtaatctggatgttttgaaaaaacaaatacaaaatcaactacttcaggaagctgatattgtatgtgctaccttatctgcgagtggtcatgaactacttttaaatgcgggtttgacttttcgaactgtcataattgatgaagctgcacaagccgttgaattaagttcaatcatacctcttaagtatggctgtgagagctgtgtaatggttggtgatccgaatcagcttcctcctactgtgctatcaaaaacctctgcaaagtttggatattcacaatctctatatgtcagaatgttcaaacagcataatgagagcgcttgtcttcttagcatacagtatagaatgaatcctgaaattagccgatttcccagcaagtttttctataattcaaaactacttgacggtcccaatatgtcagcagtgacatctcgaccttggcacgaggatccgcagctaggtatttatcgattttttaatgttcacgggacggaagctttttccaactcaaagtctctgtacaatgtggaagaggcttcgtttattttattattatatgagaggctaattcaatgttatctaaacattgattttgaggggaaaattggagttgttaccccttatagaagtcaagtacaacagcttcgatcacaatttcaaagaaagtatggttccattatattcaagcatcttgatattcataccgtcgatgggtttcagggacaggaaaaggacattataattttttcttgcgttaggagttcgatgagcggtggaatcggtttccttcaagatcttcgtcggcttaatgtagctttaacaagagctaaatcatctttgtatatcgtaggcaattctaaaccgctaatgcaagaggatattttttatagcttgattgaagacgcaaaaactcgtggtgtttggagagacttgagtgctaatcaatttaagaactcaaaaagtatatcaaacgtttcgacacacctcgcatctaacaatttaaatttagcctcacgggataccccaattaagtcgccgtcggttggtatctgtgaggaaaaacaagaagcacataaagtcaaaaaacggcacaatatagatagtgctaatttgtcaagaggaactgagagagatgaagatataccgaataagcgcgctaagaacaaagtttccactgatcagactgctgctgataataaggtcacgaaaccacgccttgatgaatcatccagttccaagcaagatgtgttaaacaaaatagacgaatctgaaattgaacaagcgtcttccaaaaagccgggttatgtggaaaaaaataaagataaaggccatatgaaaaaatcaaaaaagcccaaatcgaaacttgctctggcggcgatggcccacggttttgcacctccaaaagttgagcatttcaaaaggaag

SEQ ID NO: 26209 - DNA, 525 bp, Schizosaccharomyces pombe
atgtcgaaagttgctagcgctgctggaaaggcgattgattgggctagtgtagctagcaagctgaagcttgatgccgcaactgcttctgctattgctaattttcgctctcgtcatgctcaggcagttgccaaattgggtacattgcgagagcaggctaccacagtcgactttgctacctatcgtagtgttttagccaacaaggagattgtaaatcgtattgagtcttctatgaaatcttttaaacctgtgaagattgatttaaattcgcaactcaaagcgatcaatgcatttgaagcaaaagctagcgagggtgctaagaagaatgtcgaacttgtcaaagctgaattacagaatttgagtgctacattgaagaacattgaacaagctaggcctactgaagaaattaccattgaggatatgaaacaagcagttcccgaaattgagaagattgttgaaacaatggttaccaagggcaaatgggtcatcccaggctaccgtgaaaagtttggtgatttgagtattatg

SEQ ID NO: 26210 - DNA, 2176 bp, Schizosaccharomyces pombe
atgcctagaagaaagtcattgaggagtcaactattaattaacggcattgataaaagtctgctatctgatgacagcgctgacagttctgatattgacgaagaggaagtttacggtgtttggactgaagagccctttcaaaaagaggctggacgttcttattacagatctttaaagaaaaacgatgtaatatatcgcgttggagatgatattactgtacatgatggagactcaagcttttatctgggggtaatttgtaaattgtacgaaaaagcaattgataagcattctggaaagaaatatgttgaagcaatttggtatagtcgagcttatgctaagagaatggaaattaaacctgaatatttgttgccagaccggcatataaatgaggtgtacgtttcttgtggccgggatgaaaacctgacttcatgtataatagagcattgtaatgtctactctgaagcagagtttttttcaaaatttcccgctggaattcctacaaaacgaaaagatttgtttccttgtaacttctttatccgacgcggtgtacacttgaaagtgaacaaatacacagaacctctcgattggtcttattatgctcataatcttgaaaggatagaagatcttttggttgagatggaagaaaatttgcgaccaactaaaaagaaatctggttctagaggtcgtggtcgccctcgtaaatatcctttaccaaatgtcgaaagcaaagaaagcagttccaaagttaactctaaggatgaaaattttgatttacaagatgatagtgaatcttcagaagataatttgactatacaacctcagacaccaaggcgccgtcataaaagatcaagacacaattcatcaaatttggcttctactccaaaaagaaagtaagttattttatattctaagtttttttttcgtatactaacgttgatttagtggctacaaacaaccattacaaattactccgctacctattcgtatgctgtcccttgaggagtttcagggttctcctcatagaaaagctagggctatgcttcatgttgcttcagttccaagcacattacaatgtcgcgataacgaattttctaccatattttcgaacttagaaagtgccattgaagaagagacaggggcttgtctctatatatctggtacgccgggaacaggaaaaactgctactgttcacgaagtaatttggaatcttcaggaattatctcgagaaggacaacttcctgaattttcattctgcgaaattaatggaatgcgtgtaaccagtgcaaaccaggcatattctattctctgggaatctttgacgggtgaaagagttactccaatccatgcaatggaccttcttgataaccgatttactcatgcttctccaaaccgcagtagttgtgttgttcttatggatgagctcgatcaactagtcacccataatcaaaaagttttatacaattttttcaattggccgtctctaccacattcacggttaatcgttgttgcagttgctaatacgatggacttacctgaacgtattttatcaaatcgcatttcatcacgtttaggtttgtccagagttccgtttgagccttatacgcatactcagctagaaataataatcgctgcccgtttggaggctgttcgggatgacgatgttttttcttcagatgcaattcggtttgcagctcgaaaagtagctgcggttagcggtgatgctagaagagcccttgatatatgtcgtcgtgcgtcagagcttgctgaaaacaaaaacggcaaagttacacctggattaattcatcaagcaatttccgaaatgacagcttcaccgcttcaaaaagtattacgaaatctctcattcatgcagaaagtatttttatgtgctatagtcaatcgtatgcgccggtctggatttgcagagtcgtatgtttatgaagtacttgaagaagctgaacggttgttgcgagtcatgactactcctgatgctgaagcaaaatttggcgagttaatattgagaagaccagagtttggatatgttttatcaagtctaagcgagaatggtgttctctaccttgaaaataaaagtagtaggaatgcaagagtacggctagcaattgcagatgatgagattaaattggcatttcgtggagattcggaacttgctgggatagcataa

SEQ ID NO: 26211 - DNA, 607 bp, Schizosaccharomyces pombe
atgtcggtgaaatactttgaacctgaggagattgtggagcacaataattccaaagacatgtacatggtcattaatggaaaagtttacgacgttagtaactttgctgatgatcatcctggaggcttagatataatgttggactatgcaggtaaataattcgacaaaacttttgtagaagtaaacaccatattatgttggagactgctatgctcaaaagcgatagtatacttttaatcgctatcgtttcattcatcagttcttcacttgtgtgccttcttgattaaaacattgtatacggctttttaaacatgtccactaactatttgttttaggccaggacgccactaaggcctatcaggacattggacactctattgctgcagatgagttactagaagagatgtatattggtgatttaaaacccggaactgaggagagactcaaagaattaaagaaacctcgttcatttgataatgatacgcctccgtaagaaaatgatttgtgtacgatggttgtttcatgctaacagaacagattgcctctattaatcgcattaattgtcctgccagccatagcagtaattgtgtttgttaagcttaacaaataa

SEQ ID NO: 26212 - DNA, 762 bp, Schizosaccharomyces pombe
atgtcgcgaaaaaacctcataaaacttaatcatgatcctactgtcacttacagtaccaaagatgatgctgatgaattatttgatgatctctcttcttctcctcttcatgaaaatgttagttggatatcttggttctgctcaagaccaggtcgtgaatactttgtcgaggtgaaggaagattttatcgaagatcttttcaatttaaccggtcttaatttggctgtccctttctataatgaggctttggacctaattctcgatcggacagctcctgacacattggagaattttgatatggacgtaattgaaacgagtgctcaaatattgtatggtttgatccatcaacgttatattattacccggacaggattacatcaaatggcggaaaaatacagcatgggtatttttggttgctgtcctcgtgtaaattgctgctatactcatgttttgcctgcaggactttctgatatagttggaaaaatgcctgtaatgttattttgccctaattgtcttgatttgtacgctccttctagttctcgatacaaaaacatagatggctctttttttggtgctacttttcctcatctgttttttgaaagctatcctgaactgaatcctaagcgctcaatcccttgtggtaaaatttatcagcctagaatttatggctttaaagtcagcgaattaagtaaaacaggacctcgaatgcaatggcttcgtatgtacttggaagatagtggtagcgattcggagtctgaaagtgat

SEQ ID NO: 26213 - DNA, 2055 bp, Schizosaccharomyces pombe
atgacttcttcctcatatactgatatcgatacccttgctatcaacaccatccgtacgttggctgttgataccaccgcacatgccaagtctggtcatcccggtgcccccatgggtttggctcctgccgctcacgttcttttcagtcgtatcatgaagttcaaccctgctcaccccaagtggttgaaccgtgatcgcttcattctctctaatggtcacgcttgtgtcttacagtacatcatgtgccacttgcttggttacaaattgaccattgaagacttgaagcaattccgtcaagtcggcagtaagactcctggtcatcccgaaactcataaccctgacctcaacattgagactggtgctggtcctttgggtcaaggtattgctagtgctgttggtcttgccattggcaaagctcattctgctgctgtttacaacaagcctggttttgaccttttctccaactacaccttttgcttcttgggtgatggttgtcttcaagagggtgtctcttccgaggcctgttccttggctggtcacttgaagcttagcaacttgattgctgtttgggataacaacaagattaccattgacggtgctacctctatgtcctttgatgaagacgttgaaaagcgtttcgaggcctatggctggaacatcgttcgtgttgccaacggtgatactgatcttgatggtattgaaaagggtttccgtgaagccatgtcttgcactgacaagcctactttgattaacctcaagaccaccattggttacggttctgaacttcaaggtactcacagtgttcacggcagtcctcttaagcctgaagactgtgttcatgtcaagaaactctttggtttcgaccccaccaagactttccaagttcctcccgaggtttatgcctactacaaggagcgtgtcgccatcgcttcctctgctgaagaagagtacaaaaaaatgtatgcttcttacaagcaatcttaccctgatctttccaatcagcttgagcgtatcttgagccgtaaattccccgagggttgggagaagcatcttcctgtttacaagcccggtgacaaagctgtcgctactcgtaagctttcagaaattgttctcgatgctctttgccctgtcttgcctgaacttgttggtggttccgctgatttaactccttctaacttgactcgttgggaaggcgctgctgatttccaacctccttctagcaagctcggtacctatgccggtcgttacattcgttacggtattcgtgagcatggtatggctggtatcatgaacggtttggccgtctatggtcctatcatcccttacggtggtactttcttgaactttgtttcttatgctgccggtgccgttcgtatggctgccttgaacaacagccgtgtcatttatgttgctacccatgattctattggtttgggtgaggacggtcctacccatcaacctattgagacttttgctcatttccgtgctatgcccaacattaactgctggcgtcccgctgacggtaatgaaacttccgctgcttactacagtgctttgactagtgatagcactccttctattttggctttgactcgtcaaaaccttcctcaacttgagaactctactattgaaaatgctcttaagggtggttatgtcatgttggagaacaaggaggccgatattactcttgtcggtactggttctgaagtctctctttgcattgacactgtcaagacccttgagaccgagtacaacttgaaggctcgtgtcgtttcattgccttgctgggaagttttcgaacaacaaccagaaagctaccgtctttctgtcattcctgacggtattcctgctatgtccgtcgaggtttgggctaccaatggttggagacgttacgttcacgaggcctttggtatgcacacttttggtgactctggccctgctcccaaattatacgagaaattccatttcaccacctctggtgttgctcaacgtgccaaaaagactgttgatgcttacaaggatatcccttatattcgttcccctgtccgccgtgctttc

SEQ ID NO: 26214 - DNA, 1876 bp, Schizosaccharomyces pombe
atgtcgaggcatcgtgatgtaaaaaatcttgatcttgatggttcgtaccatttgatattgtaatagtttgtatttttttttaacgtctttctagattatgaactcgacgaggagccaggagaggaagaattgactgaagagcaggaaggttagtaaatgatttcttaaaaatattaacgaacaatatctagaggaattcaggtctgctgtagccacagtaagggagacattattaggtgttcctatttcagaaaaagaaattgccgatacagtttggtactattactttgacgtagagaaatcagtcaactatcttttgcaaaaggctagttccaaagctggagctaaagaaaaacagaatactgattcccaaaaagaaaaaaaacagaacaaatcgaaagaagctttagcggatgccaaagatccattggatgaatcttctaatggtattaaaaatttaagcctaaacaaaaatgatgaaccagcatttcagacgaacggtgaagtaaagatgaaaaattcctccgaaagcgataaccaaccggagaaaaagaaaattaaaaagcaaaacccgacggatctagtatctgttcccgaaatatttgaacaatccaatcctaaacccgtggttcacttagttgttacaggacatgttgattcgggaaagagtactatgcttgggagaataatgtttgagttaggagaaatcaatagtcggtcaatgcaaaagttgcacaacgaggctgccaattcaggaaaaggtagcttttcgtatgcttggttgttggatacaaccgaggaagaacgagcacgaggtgttacaatggatgttgcttccaccactttcgagagtgataaaaaaatttatgaaattggtgatgcgccaggtcaccgggatttcatttcagggatgatagccggcgcatcttcagctgattttgctgtgttagttgtcgactcctctcaaaacaattttgagcgtggttttttggaaaatggacaaacaagggagcacgcctatctgttgcgagcccttggaatctcggaaatagttgttagtgtcaacaaattggaccttatgtcttggtcggaggaccgtttccaagaaataaaaaacatagtttctgattttttgatcaaaatggttggatttaaaaccagtaatgtacattttgtacctatatctgcgatttcgggaactaaccttatccaaaaagactcatctgatctttacaaatggtataagggtcccactcttttgagcgccttagatcagctggttccccctgaaaagccatatcggaaaccgttgagactaagtatcgatgatgtttatcgttctccacgtagtgttacagttaccgggagggtcgaagcaggtaatgttcaggtcaatcaagttttgtatgatgtttcttctcaggaagacgcatatgtaaaaaatgtgattcgtaatagtgatccttcttcgacttgggctgttgctggtgatacagttacattacagttggctgacattgaagttaatcaacttcgtcctggggatatactatcaaactatgaaaatcctgttcgtagggtaagatcatttgttgctgaaatccagacatttgatattcacggtccaattttatcaggttctacccttgtccttcatttaggtaggactgtgacttcggtatctttaaaaattgttacagttaacaataaacgttcgaggcatatagcaagcaggaagcgcgcattagttcgtataagttttttggatggattatttcctttatgtctagcagaagaatgccctgctttgggaagatttattctaagaagaagtggtgatacggtagctgctggcattgttaaagaattatgttaa

SEQ ID NO: 26215 - DNA, 3105 bp, Schizosaccharomyces pombe
acagttatctttcactctatgcaggacactgagtatagatactttgcagatgcctgcagtactagtagtaaatcttttttgagattctctttcttagatgcatttcaaggaggagtttcacaattttttctttactctgtcttttttcaaggtctttggtttggcaatcatttggccacaacgaaaagggtaaatgtggggcaagtcgttactgtttttggctcttgtttatcagtggcttcctcattacagcaaattttaccagctataccagatttgattaaaggaaaatttagctctcattttattaaaacattatgtgaaagccatgatcctatagaggctgcgaagcgttcagcggctaaaataaaaagcatatcgtttgaacgaggttttcgctttgataatgtctcctttgcatatccttctcgagatgagaacttgtttagtttaattaacgtgtctgtgttcataccttttggagagttggtacatattattggtccaagtggctctggtaagagtacctttatcagtcttttgttgcgttacttttctccaacttacggaaatatatatttggatgactttcctttggaagaaatagatgaacatgtccttggctctactattacactggtgtgtcagcaacctgtcatttttgacatgactatacgtgagaacattattatgaggaatgaaaatgctagcgagtcagattttgaagaagtttgcagattggcacttgttgacgaatttgctcttacatttgatcaaagctatgatacaccttgtaaggaagcttcgcttagtggaggtcaacagcaaagaatcgcattagctagagctttgcttcgtgacacggagattttaatacttgatgagccaactagcgctcttgatccaatcactaaaaatctcgtcatggatgctattcgagctcatcgcaagggaaaaactacattagtaattactcacgatatgtctcaaattaacaacgatgaattggttttggtgatagataagggtcatttaatacagagatgcgctaggaaggaattggtgttgtttgaggattttgaaaacaatgtatcaatcgatgaaaaggttttgaaggaagaagctgataatccgtttattttaccaaatgaggaatcactgcttgaaaagtattggattaattacaatgaaagtttttcgcagttatccagagagtcattattcaccagtttagaatctccattcaccgatatagaatctcctacaattgtgtcgcgaagaaaaattgttgagcaaaggaagttgcgtatggaaaaagaatcctttcaagaaacgaatgtagaccaaactttccatttatttgatgacaaagagcatgcatgttcgttaacattaatctttaagagtatttggaaagtcaaaaagctaaggtggttttttcttcttggtttgctcacgtctttgatacaaggtgctagtgttcctatatttgcttacgttatttcaaagtgcttaaatttgtttatgcaaattgatccatcgattggagtagcattttggtcttcaatggttttggtcgttgctgctggatcgggggcttcctatttttttagtcattatattttttcaatatctgctaaaatttggtgtgatcactaccggttattagctgttaaagtacttttcactcaggatcaagcttggttcgatcaaatcgaaaattatccactcgtgttatctaaaatacttgttaacaatatcagtgatatgcgaaacatgattagttctctcattgaggaggtttttattgcatttactatggcgattattggaatagcatggtctttcgcaactggctggagattggctgctgtactggttgcagtaagcccaattttatgtctgacttccagaatgttttcatatatatatgtcagcactgagcggatgtgtcaagatgttgtaatatcgactacctctatccttcataaaacgatcgtcaatttggatacaattaaaggatattcggtgctatctttttttcgagaaaatcataaaaattctttgcgcaaaagctgggaagctttcaaaaggcgagccttttggactagtcttgggtttgctattaacaactctcttttgtattttgtcagagctcttctcttttattgttcttccatatttatatccaaagaattttatactgttgaacaaatggtccaggtgctgtctttggctacttttacattgttgatggcttctacttgcatcatgtctttgcccaatgtatcagctagccgaatcgcgactagtagagttctgaaactcagttcattgaagccaggaaatcttcataaaagtggatatctaaaatttcctcttgtaggaaaaatagaattcgatggagtatcgtttgcatacccagactccgagcgtaaccacttagcgctgaataatgtatcattgtctattgaagctagagaaaaggttgcaattgttggaatttctggatctggaaaatctactttggtagaactattgagaaagacttacccttcagaggatatttacattgatgggtatccgctaactaacatcgatactaattggttgcttaaaaaggttgccattgtagatcaaaaacctcatcttctaggttctacaattttggagagtttgctatatggtgttgacagagatattaattctgttatggatgcacttgacaaaacttacatgactgaggtaatacaaaaccttcctaacggcttagatactcctttgcttgaatttagcaaaaatttttccggtggtcagatccaacgccttgcgtttgcaagagctcttctacggaaccccagacttttaatattggatgaatgtacgtctgctttagatagcaagtcaagccttcttctagaaaaaacaattcaaaacttgagttgtacagttttgataattacacaccaaccctcattaatgaaattggcagacaggatcattgtaatggattctggaattgtcaaggaatctggcagtttcgatgaactaatgaatcgacatacacatttttggaaattaatacaccgcggtgaatggattgag

SEQ ID NO: 26216 - DNA, 3105 bp, Schizosaccharomyces pombe; identical to SEQ ID NO: 26215

SEQ ID NO: 26217 - DNA, 1503 bp, Schizosaccharomyces pombe
atgcttcaaagactggagcaactacaaatgcaaacatcgaatattctcaaggaactgcattctacgtcgattttcacggattctaccacctcacaacttcataatggaggtgagaactctgtaatggatactgaggaatcctcggctattgataaattaagtgcctctttacagcaagtaaacatttcttcaccatcagttcctacctctcaatctcgggttacccaaggccagtcattaggaaatacccaaatatctaatcctacttcaaagactaataatgtacgagccaaagctcggaatattcgtaatccctctcaacgtcttcgaccctcgactagtttggccaggttatcaaataacgcacctcgcattcccaaagaggcatcactacatgagaattcaatttcttccaaggaatctccttctgtaacgacctctaaacatgtcgctactattacaaaaccttcaacgtcgtctatcgcccgaatgtcctcaaatgctagaattgctgctattccgagagcgaaatcttcaatggcagttcgttcaccatcacgccttggtaatggcccgaatgtgcgctcaccaaaggtcggcttcaatgcaaagtcggatgatagccccgtcgtcaaatctcctggctctaacgacaagccttcagcttctcctcgaatttctgttcgttctctcggaaattcttctgtcgttcgtccacccacaaggacttccaccacccgtccattatctagagttaacgtaacaaatgcttccggaagtatctcaaagaattctactagtccttccaaagtaaaagtcaacgcatcgaccaagatcgtgcgtcctgtaagtgcagctcagactgtccgaccgggatccagaatcttcagagaaaactctgcgtccaatactcaaagacccaacgtctctgccacttctaactcaactgttcgggtagcttcttcattagctgtacgacctgtttcacgtaacgcgcaggcgcgtactccctcaagattagaacagagagaagttaatgtgaaaaattcatcagctaaaatcgttcgtccaggtacttctttaggtgttcgttcaccttctcgcattcaatccactctctcttcgaggacaactacaggcaatgttcgtactaaagcggctaatatcgttcgtccttcttcatcaatcaaccgtcgccctccttcgtcaataaatcaacgccctccttcaaacttgcgcattttggctccatctcgctcgcgtgcaacaattcatgagagaccaagcagttcaattttacacaggcatgcccattcactaacttcttcatccttttccactaaaacattggctacaaccaaagaaattcagaattcgcctactttggtagagtcttcgacagtcgttcatcatgatccttcttatcttcaaaaccaaacttccgaaattaacgatactaatcactcttctcattcgtcacctttggaccttaacagaatgata

SEQ ID NO: 26218 - DNA, 2394 bp, Schizosaccharomyces pombe
atgtcgtgtccgcacctcacagagacaaacgttgtaatcccagataattctcaggtaatatatcgtgaagaatgcgtccgttgctttaattcgcaggtatgttttttaaatagcttgttttaaaacatgtactcagaggagttcaaattcgttaacaaacgttaggatgaagaaggtggaattgatttatgcttaacctgttttcaatctggatgtggggaaactgggttaaaacactcacttgtccattttgaacaaactttgcacccaattgtggtcaccattgccaggcaacctaagcaaaaaattaatgatgagcctccccaaaaaattacgaaacttgagatcagagaagatagtgatgaagatttatatgattatttttatgtccctaagtgtttggtctgtaatataatattagatatacaggatcccttactttcgttatcattagaggcaatgaaaaatgctaccaaggcatcaaacaaaagtcaattaactgcatgggaaaatgaattaactacttgtgatcatataataaatttaccagaaaatgaaacttacgtcacaaatttggacaatgctacatgttcaaaatgtgatcttgcagaaaatctatggatgtgtttaacatgtggcgcattaagctgtggaagaaaacagtacggaggaggtggtgggaatgggcacgccctttctcattatgatgatacaggacatccgcttgcagttaaactcaaaagcatttcacctgatggtcaggctgatatatattgttatagttgcgatgaggaaagaattgacccaaatataaagacacatatgctaaatttcggcatcgatatcgccaagttgaacaaaactgaaaaatctttggctgaactacaattagagcaaaatttaaattgggattttggtgcctccgaagaggatgacgcttcaaaaagattgtttggaccaggattaactggtcttaaaaatcttggtaatagctgttatctggcctcaactatgcagtcgttgttttctattaaggaatttgctattcacgaattaaaccttttcaacacttataattctgtttgtcaaacccccactacagatttgcaatgtcaacttggtaaactagctgatggtttagtaagtgggaaattttctaaacctagcaaaattggtttactcaataatccttcttcatcgattcttccttaccaagatggtttgaggccttttatgttcaaagatgttgtgggacaagggcattctgaatttggaacttctcaacagcaagatgcttatgagtttttattgtatttgctggggaaaatacggaaatctagtattgcgaaaactgacattactaagatttttgactttgaaacggagcaaaaattatcttgtctttcctgtaaacgcgttcgctattcttctttctcttctcagggattgactttgacagttccgcgtgttaaaattggtgaaattgagggtgagcaaatttatgaagaagtctcaatagaccaatgtttagatgcaactatacaaccagaccaaatggagtatacttgtgaagcttgtaaaagtaaactaggagctacaactactactgccatgaagtcgttcccgaaagtcttgatcctacaagccaaccggtttgatttacagggatatcaagttaagaaattaagcatccctataatagttaatgaagacggaatttataatttcgatcgcttaatggctaaggaccacccaaatgacgaagattatcttcctgaaaagacagagaccattgaatggaaccaaagtgctattgaacagcttcaagctatgggatttcctttagtcagatgccaacgagcattactcgctactggaaattctgatactgaaactgccatgaactggctatttgaacatatggaggaccctgaaattgacaaacctattgaagtttctgaattactgcccaaagcagactcaagtgtttcagaagaaaatgttcaatcattatgtgaattcggctttactgttgcacaagcacgaaaaggattgcttgaatctaacaataatattgagcgcgcagttgattggattttaaatcatccggatgaaagttttgaagaaccaccacttgaaggatcagattcttcaataaaaaatgaaaatatgggtagttgggaatcgacaaacgttccagtcaactacaatttaaaggccataataagccataagggctcaagtgcgcatgccggtcattatgtagcatttatacgcaaagagatagatggaaagcagcaatgggttttgtttaatgatgaaaaggtgcttcaagttgcctccttggaagaagcaaaaactaccggatatgtctatctttttgaaaggctagat

SEQ ID NO: 26219 - DNA, 3336 bp, Schizosaccharomyces pombe
atgggggtttcaggtctttgggatattttagaaccggtaaaaaggcctgtcaagctagaaacacttgttaacaaacggttggcaattgacgcttcaatttggatttatcaattcttaaaggccgtacgtgacaaagaaggaaaccagctgaaaagcagtcatgttgtaggattttttagaaggatatgcaaactattattttttgggattaaacctgtatttgtttttgatggaggagcgccgtcattgaaacgccaaactatccaaaaaagacaagccagaagactcgacagggaggaaaatgccacggtcacggccaataaacttctggctttgcaaatgaggcatcaggcaatgcttttagaggaaaataataaaaaagctactgcattggcaaatgcctcggttcaaaatgagagacaaatgccttcatctatgacattggataattcagaaattaagccagtacttaatcaaagaaaaaattatttgaagcctgatccataccaactacctgaaatggacgtttcgtttgataagttagggtcgagttacgaccctcgaattatgtcccaggatgagcttacacaatatgtctctagttttactaaaattgaagatataaatttatttgatttttcaaatattgattttgactctgaattatttcaatcattacccgatacggataaatatagtattttaagtgcagcaagattacgctctcgtttacgaatgggtttaagctctgaacaactttccgagatgtttcctaatagaatggatttctctcgttttcaaattgagagactgaaggaacgtaacgatttaactcagagattaatggactttactggaatgaatgagtttggaccctctagagtagtaagtgaaaaaaaccgagaatatattttagtaaaaaacgaaggtgctgaaggtggatgggctctcggtgttatctcaggatctacaaacaatgaacctattattattgatgatgaggctacaaaacttagcagcaatcttatagacgaagacgaggatgaggcattctacgatgtgcctttacctagccgatctcatagcatgaaccctagagaattggtagccgctaaattaaaggaaataaaagaaaattcattttcggaaaatcagcaatcagatgaagcagattataatgttactgatgatttaatacttcaattagcaacccagcaatctctagaggaaaacaaaaaatcaaaagagctgtttagtctttcggcttctgagtttgataagttgaatagcgagaaaaagacgtttgaaattttgtcgaccgatattcctgcagaggattcaatgaattcacttcttaacgacgaggaaaatttgaaacttgaacatgttggagatgtttccaatgattcattagcattcgcggaaaaaaagcatcctgaaaatgggacttcaatttttatggatgcccttccatctgcgagtagagagaaaaaaaccaatgatttaattgatcctttaccttttcagcctatggattggggaaagtctatttttttcgagaaattaaagaaaccaactgaaacatttatggattctaaaactgatataccaagtgaggcaccggataattctaaacttgtggaagatacaaatttacatactattaatgcaacagttaatattgaatccgatttagacgctgctaaacctggaattgaaaatccaattatttcacctcttcttccggtaaaagatgatgaaaaagatttagacttacgtgaactcaatcctttggaaccctttgagaatatgaaagaacaagctgatgatggcacagttaccaacccattaaatgtttctagtgataaggccatgtcagtgtatttattgagctccgaaaatgctaaggatactggggatatcaaatccgaatcaattgacgctgttcttcctactttagagaccagcagcccttcacttagcattccaactgactttcaaaaagaagcctctccaaataaaggagctgctgccttgagttcgaaagtagagcctgaagtggttgaaaaacttttagatgaggaagaagaggaaatgattatcaggatggcagaagaagaaaaggaatatgatcggtttgtttcagaactcaatcaacgacatgaaactgaagagtggaatcaagaggcctttgaaaaaaggttgaaagagctcaaaaatcaaaaaaggtctgaaaaacgtgatgcggatgaggtcactcaagtaatgattaaagaatgtcaagaacttctgcgtttatttggcttaccatatatcgttgctcctcaagaagcagaagcccagtgttctaaacttttggagctaaagctggttgatgggattgttactgatgactcagacgtgtttctttttggtggaactcgggtatatcgaaatatgtttaatcagaacaaatttgtcgaactctatttaatggatgatatgaaaagagaatttaatgtgaatcaaatggatttaattaagttggcacatcttttgggaagtgattatactatgggactttctagggtaggtccagttcttgcactggagattttacatgaatttcctggtgacactggactttttgaatttaaaaaatggtttcaacgtttatcaactggacacgcatcaaaaaatgatgttaatacgccagtaaaaaagagaattaacaagttggttggaaaaattattttaccatcagaatttcctaatccgttagttgatgaagcttatcttcatccggccgtggatgatagcaagcaatcgtttcaatggggcatacccgaccttgacgagttacgccagtttttgatggctactgtgggttggtcaaaacaacgaactaatgaagttttacttccggttatacaagacatgcataaaaagcaattcgtgggtacacagtccaatttgactcagttttttgaaggtggtaatactaatgtatatgcgccgagagttgcataccattttaagagtaaacggcttgaaaatgctctttcatcttttaaaaatcagattagcaatcaaagcccaatgagtgaagaaattcaggcagacgcagatgcatttggtgaatctaaaggatcagatgaactacaaagccgtattcttagaaggaagaaaatgatggcaagcaaaaattcctctgattcagattcagactctgaagataactttttagcaagtttaactccgaagacgaattcttcttcaatttctattgagaatctacctagaaaaaccaagcttagtactagcttactaaaaaaacccagcaaaagaagaagaaaa

SEQ ID NO: 26220 - DNA, 2673 bp, Schizosaccharomyces pombe
atggagtaccgtaccaataacgtacccgtcggtaatgagacaaagtctgccgctttaaatgcgttgccgaaaattaaaatatctgactcgcccaaccgtcatcacaacctggtggatgcttttatgcaatctccttcttattctacacaaccaaaatccgctgtagagcctctgggtttatctttttctcctgggtatatttctccttcttctcagtctccacatcatggccccgtaaggtctccatcaagtcgaaaaccgctaccagcatctccttctcgtacgcgggatcatagcctgcgagtacctgtatctgggcattcttatagcgctgacgagaagcctcgtgaaagaagaaaagtcataggcaattatgtactaggtaaaaccattggggctggtagcatggggaaagttaaagttgcgcatcatttaaaaacaggtgaacagtttgccattaaaatagttacccgtcttcatccagacataacgaaggcaaaagctgctgcttctgctgaggctactaaggcagcacaatcagaaaaaaacaaggaaattcgtactgttcgcgaagctgccttatctactttgctccgtcatccgtatatttgcgaggcaagagatgtttatattactaatagtcattattatatggtctttgaatttgtcgacggtggtcaaatgctggattatattatttcacatggaaaattaaaagaaaagcaagctcgaaaatttgtgcgtcaaattggaagtgcgctgagttatttgcatcaaaactctgtggtgcacagagatctaaaaattgaaaatattttaatttcgaagaccggtgacatcaaaattatcgattttggtctttcaaatttgtatcgacgtcagtctcgcttgcgcacgttttgtggttcattatattttgctgctccagaacttttgaatgctcaaccgtacattggtccagaggtagacgtttggagttttggaatagtactttacgttcttgtttgcggaaaagtgccatttgatgatcaaaatatgtctgccttgcatgcgaaaataaaaaaaggtaccgtcgagtatccaagttatttaagtagtgattgtaaaggtttactatcaagaatgttggttactgatcctctcaagcgagccacgcttgaagaagttttgaaccatccttggatgattcgcaattatgaaggacctccagcttcgtttgctccggaaagatctccgatcactcttccattagatcctgaaattattagggaaatgaacggttttgattttggaccaccagaaaaaattgttcgtgaattaactaaggtaattagcagtgaagcttatcaatctttagctaaaactggattttattccgggcctaattcagctgacaagaaaaagtctttctttgaattccggattaggcatgctgcgcatgatatcgagaatccaatattaccatctctttcaatgaacactgatatttatgatgcgtttcatcctctcatttcaatttattatttagtttctgaacgtcgtgtatatgaaaaaggtggaaattggaataggatagcaaaaacaccagtttctagcgttccttcttcgccagttcagccaactagttataatcgtactttaccgccaatgccggaagttgttgcctacaaaggcgacgaagaatcacctcgtgtttctcgaaacacatcacttgcacgcagaaagcctttgcctgatacggaatctcactccccttctccttcagcaacctcctccatcaaaaagaatccatccagcatttttagaaggttttcatcacgccgaaaacaaaataagtcttctacatctactcttcaaattagtgctccccttgagacctcacaatctccaccaacacctcgaaccaagccgtctcacaagcccccagtatcttacaagaataaacttgttacccaatctgctattggaagatcaacctctgttcgtgagggccgctatgctggtatctccagtcagatggattcactaaacatggattcaacagggccctctgcatccaatatggcaaatgcacctccgtcggttcgtaataatcgtgtacttaatcctcgtggtgcttccttggggcatgggcggatgtcaacttctacgaccaaccgccaaaagcaaatccttaatgaaacgatgggcaatccggtggacaagaactctacttccccatccaaatctacggataaattggatcctataaagcctgttttccttaaaggcttgttcagtgtttccactacatcgactaaaagtactgagtcaattcaacgagatcttattcgggtaatgggcatgcttgatattgagtataaagagatcaagggtggttatgcatgtctatataaacctcagggtatccgaacccctacaaaatcgacttctgttcatacacgacgtaagccttcttatggctctaattctaccactgattcttatggatcggtgccggacacagtcccattagatgacaatggtgagtcgcctgcctctaaccttgcctttgaaatatatattgtgaaagtccctatactctctcttcgtggcgtttcttttcatcgaattagtggaaactcatggcaatataagacattggctagtcgtattcttaacgaattaaaattg

SEQ ID NO: 26221 - DNA, 2071 bp, Schizosaccharomyces pombe
atgccaaagaaagctgcattggacgagcttaaatggaaggaagtcaagcttcctgaccacctagacgacttcgatgggtttatgggcttggaagagattgaaggtgtggatatcaaatatcagccaaaaggtgctatgaaagaagtaatttatgaggtataattgtttattatctaatttattaacaaacagttaccagaagttcatgaaaaaaaagataaaaagccggaaaagcgaaaaaaagatcaaaaagaagctagtgaaaaaaagaaaaagggaaaacgtacttcccctactattgaaatgacttcactaggatcaaaggtgacttctaaaaactataatgaattctctacattagaagaagaggatgaacacaattctcatggtgtggacgtctctgcttgggcacacttttcactttcaccggaaatgcttggctcgttatctaaagctggcttttcaaaaccgatgccaattcaatcattggtaattcctgaagcttctattggatttgatatcattggaaaggcagataccggttcaggaaaaactttagcttttggcattcccattttagagcattgtcttcgcaatgtagatgcaaaatacgtacaggctctagttgttgctcctaccagagaacttgctcatcaaatttgccaacactttgaacttatcaagccaagtcctaacattcgtgttatgtctataaccggtggattagcagtacagaagcagcagaggcttcttaacaagcaccctcacgttgtggttgcaactccgggtcgcttgtggtctgtcatcaacgagaacaaccttacaggaaactttaagaaaatcaagtgtttggtattagatgaagcagatcgtttactgcaaaaaagtcattttgaagaattgagcaaactacttgaaattttaggaaatcccatgcatactcagcgtcagacttttatcttttctgcaactttcgatgagggtttacagcaacgccttaaaaagaatatgaaaggcaatataactgagaaatacaacagcccgatgggtatgttcaattagaaatattttactttctcacttactaacgactgcatagaaaatatgttgaaggaggttcgtttctttggcaaacccaaatttttggatgccaatcctcaaagtgcagtggcaagccgcgtattagaagggctcatagagtgtgctccagctgaaaaagacttgtatctttattatttgatcatgcgttatcctggaaaaaccatggtttttgccaatggtattgaggatattaagagaatcactccttttctaaatgagttaaaagttccatcctatcctctacatgctcaattagatcagaaaaaaagacttcaatctcttgaaaagtaagttatttttatttatatgttactaactaacaaggttcaaaaataatcctaaaggagtccttgtttgcactgatgtggccgcccgtggtattgatattcctagtgttacgcacgtaattcattatcatgttcctcatacagctgatatgtatgttcatagaagcggtcgtaccgctcgcgctaacgaagatggcgtttcaattttaatgtgtggtcctaaagaactgtcacagctgaaacgactatgttatcggttgaaaaagaaaatcgagacctttattaattttcctgtggatatgtcaatattggacattttaaaaacgagggtcgtcttagcacataaaattgtaaatctcactagaaaagacggaagagtgggacgtgaggaagcttggttaaaatcgatggctcaggaattgggagttgaaagttctgatgatgaggatccggatttgccaaaaaaatctgaatctagtaagaataagaaacagatagcgcatcttcgctcagagcttgctcccttattacacgaaaaaataagaacaggattttctggtagatacttgacgagcggtcttgtaaatatggctgaaaaattagccaacgaagaagttcatgataatattatcggaatggactcaattagtgctttggaagttctgcaaaaaaggaagaagtaa

SEQ ID NO: 26222 - DNA, 992 bp, Schizosaccharomyces pombe
atgtctgatatcgatgatgaggaatttgagcagcttgcagttagcgccttagaagaagtagagaaaaaagctggttttgctcaacagccaactcctcaaaaagtgtctagggttacagctcactctattttggtaaaccctcgacaggtaagaagctgaagacagatcgcatggtttgttatagcaggttgaaaatgcatttttaatcttgcttttttcttttctgtagtgggattatcaccattctgataaggactatattaacttcttatagaaaggaaatcctttattggtaagtttcttactcgtggataaagcttgctcataaacaatagcctcacgttcgaaatgtaccatgggaatacaccgacatagttcccgattttgttatgggaacaggtatttgctctttgttcttaaggtatgttaaattccccaaagcataattcgtttattgaaggactgacttacatcatgctagcttgaaataccatcacttgcatcctgaatacatttattcacggatatctaaactcgggaaatcatacaatttaagaatcttactgattttagttgatgttgagaatcaccaggcttcaattcaagaattagtcaaaactagtatcgtgaatcagtatacacttattttggcctggtcttctgaagaggctgctcgatatctagaaacgtataaggcttatgaaaacatgtcacctgcacttataatggagaagccatcaactgattatctttctcaggtgcaatcttttttgactagtattcgcggtatcaacaagagcgatagcctgtcccttttatcaaagtttggttctttagagagagctttagtggcttccagagatgaactagaacagttagaaggatggggtcctaccaaggtcaatcgttttctagaagcagtgcagcagccttttatgtcccattctaccattaaaagacctgaagcaataaatttaaaacaaacttgattt

SEQ ID NO: 26223 - DNA, 2409 bp, Schizosaccharomyces pombe
atgaatattttacctaagagtattccgatacgaatacaatcgctccgtaggtaccaaggaagtttaaaaacttctcttcgggcattgagtactcgacccatttttgaaaaacggctgttagctgaaacaccattttctataagaccaagtaatgcttctgtactcatagctaagagatctccaaagtttggatggaagcaagtacgcttttatgcagcaaatccaaatggaggaaattttcgaatggatttaggcggcggacgcaaacaaggagccgctttggaagaatatggcacagacttaacagccttggctaaacaaggaaaattggatcctgtaattgggcgtgaagaagagattcaaagaaccatccaaattctctctcgacgcacaaagaataatcctgcgttagttggtccggctggtgtaggtaaaacagcaattatggagggattagcctcgcgaatcattcgtggagaggtccctgagtccatgaaggataaacgtgttattgtcctagatttaggcgctctcatttcaggagccaaatttcggggagattttgaggaacgtttaaaatctgtactgagtgacctggaaggagctgaaggaaaggtcattttgtttgttgatgaaatgcaccttttacttggctttggtaaagctgaaggctcaattgatgccagcaatctattaaaacctgctttagcccgtggtaaattgcactgttgtggtgcgacaaccttggaggaatacagaaaatacatcgagaaagacgctgctttggcaagaagatttcaagcagttatggtaaatgaaccttctgtagctgacaccatctcaattcttcgtggtctgaaagaacgatacgaagttcatcatggtgtacgtatcactgacgatgctttggtaacagcagctacgtacagcgctagatacatcaccgatcgatttcttcccgataaagccattgatttagtcgatgaagcctgctcctctcttcgcttacaacaagagtctaaacctgatgaattgcggcgtttagaccgtcaaatcatgactatacaaattgaattggaatcccttaggaaggaaactgacacgacatcggttgagcgacgtgagaaattggagtccaagctcactgatttgaaggaggaacaagataaactatctgcggcatgggaagaagagagaaagcttttggactccatcaagaaggctaaaactgaacttgaacaggctcgaatagagcttgagagaacacaacgtgaaggtaattatgcccgtgcttctgagctccaatatgcgattattcctgaattggagcgtagtgttccaaaggaagagaaaacgcttgaagaaaagaagccatccatggtacatgattcggttactagcgatgatattgcggttgttgtatcaagggcgacaggaattcctaccactaatttaatgcgtggtgaaagagacaagctccttaatatggaacaaactattggcaagaagattattggtcaggacgaagctttgaaagcgatagccgatgcagttcgtttatcacgcgcaggtctccaaaacaccaacagacctttggcatcattccttttccttggacctaccggtgtaggtaagactgcacttaccaaagctttagcagagtttctatttgacactgacaaggctatgattcgttttgatatgtccgagtttcaggagaaacatacaattgcgcgtctgattggtagtcctcctggatatattggttatgaagaatctggagagttgactgaagctgtgcgtcgcaaaccatacgccgtacttttgtttgacgaattagaaaaagcgcatcatgatattaccaaccttcttctacaagtactagacgaaggatttttgaccgattcacaaggacgtaaagtggatttccgatctaccttgattgttatgacctcgaatttgggaagcgatatcttggttgctgatcctagtactactgtcacccccaaatccagggatgccgttatggatgttgtacagaaatattatcctcctgaatttttgaacagaattgacgaccaaattgttttcaacaaattatcggaaaagaaccttgaagacatagtaaacgttcgtttggacgaagttcaacaacgtcttaatgaccgtcgtataatccttacagttacagaagcagctcgcaaatggcttgctgaaaaaggttattctccagcgtatggcgctagacctttgaatcgcttaatacagaagcgtattttgaacacaatggcgatgaaaattattcagggagaaattaagtcggacgaaaatgttgtgatcgacgttttggatggtgaacttgagtttaaagcaaataagcttgagccacaatctacaagtcatgaggat

SEQ ID NO: 26224 - DNA, 611 bp, Schizosaccharomyces pombe
atgggtttgagtattagcaaattgttccaaagcctctttggcaagagggaggtaagtgaaaacctttgaaaagtttgaaaaagaaggacttttattaatagtatcgtttgtttatgtagatgcgtattctcatggttggtcttgatgctgctggtaaaactacgattttatataagctcaagcttggcgaaattgtcaccacaattcctaccattggtttcaacgttgaaactgttgagtatcgcaatatctctttcactgtatgggatgttggtggacaagacaagattcgtcccttgtggagacactatttccaaaacacgcaaggtattatcttcgttgttgattctaatgatcgtgaacgtatttccgaagcccatgaggagttacaacgtatgctcaatgaagatgagcttcgtgacgcgcttttgttggtctttgccaacaaacaagatttgcctaatgctatgaatgccgctgagatcactgataagctaggacttcattctcttcgtcatcgtcaatggtacattcaagccacttgtgccactagcggcgacggtctttatgaaggtcttgaatggctttctaccaatcttaagaatcagtaa

SEQ ID NO: 26225 - DNA, 682 bp, Schizosaccharomyces pombe
atggcaaaccctttcgttcgaaatcaatcttttaaatcagtattttttaaaaatttagtcggaattaccctatgggtacccgtattaatgttcgttgaacaacatgtagtcagcgtcggtacaattgaaggtagatctatgaaaccagcctttaaccctgagacaaacatgctgcagagagatagggtactactttggaaatggaataaggattacaaaagaggagatgtagttatactacggtaagttcttggatcgttgcagggtctttcggtactgagtttccctttttatcgttactaataagcaacaagctctccagaaaacccagaggaactattggtaaaaagagttctaggagtagaatacgatatcatgaaaacgagacctcctaaaaagttgtcattagtacccgttcccgagggacatgtgtgggtcgaaggcgatgaacaatttcattctatgtaggtttccaacaattgtttttttactttttcgttttcttctatagagatattaactagtttacagtgatagtaacaaatttggcccagtatcgacaggactcatcactgccaaagtgattgcaattttgtttcccttctctcgtgcagggcgtattgatcatgaaggtttccgaaagaatgcagtgtttttaagtggaaaacgttctgttaagtaa

SEQ ID NO: 26226 - DNA, 2301 bp, Schizosaccharomyces pombe
atggcttcagccaattttattcgccagtttgagctggggaacgattctttttcataccaaaaacgcccagaggatgagccatcacaacccctttcaaacagaaatataaacaaactaaacgattcatctactttaaaagactctagttcaaggatttttattaactcccaagttttacgtgatggccgacccgtagaattgtatgctgtcgaatgttcaggcatgaaatatatggagcttagctgtggggataatgttgctcttcgaagatgtccagattcttactttaatatctctcaaatacttcgacttgctggtacttcgtcatctgaaaacgccaaagaattggatgatattatcgagagtggggactatgagaatgttgactccaaacaccctcaaatagatggagtatgggttccatatgatcgagcaatttctatagcaaagcgatatggggtttatgaaattttacaaccattaatttcttttaatcttgatttattccccaaattttcaaagcagcaacaaatcgaaagttcttcaatctccaaaaatttaaatacttcttcttttaatacgcgatcccctttgaggaatcataatttttcaaaccctagcaagtcttcaaagaatggggtgcacactataaacaatatgcagagttcaccttcaccttcttcctctttcttactacctttaactcaaattgatagccaaaatgttaaacgctctaacaattacctctccacctctccacctatccttgaacagcgtttaaaacggcatagaattgatgtcagtgatgaagacttacatccctcctcacagttaaatgataatgaggcctcttcattgtttccagatacgccaaggttgaaccattcactttcttttgtatccttggtttctagtcttcctccacttgatcagaatattatgcaggattatcatacatcaaaagacattttgacctctatctttttagatgtaaactttgctgattccagcgccttagaagcaaagctgtcggactcattagatttggatgtccccattgacgaacttggacacgccgctctgcactgggcagcagccgttgccaaaatgcctttgttacaagccttaatacataaaggagctaatcctttacgtggcaacctcacaggagaaacggcattaatgagatcggttttggtaaccaatcatctcaatcagaactcttttggtgatttactagacttgctttacgcatctcttccctgtacagatcgagctggacggaccgtcgttcatcacatttgtcttactgcaggtataaaaggccgaggttcagcatcgagatattacttagaaaccttattaaattgggcaaagaaacatgcaagtggtaacaacggatatatgctgaaagacttcataaactatttaaatcatcaagataaaaatggggatacagctttaaatatcgcagcaagaattggaaataagaacattgttgaagttttaatgcaagccggagcttccgcttatattcctaatcgtgcagggttaagcgtagcaaattttggaatttttgttgaaaacgcattaaaacaacccgaagactcaaaacaaacaaaagtttcccttatgagtgaaaatctgtccagcaaagaaaagactgctgtccctcctcgtcaaaagagtagagacattatcgcctctgtgaccgatgtaatatcttctctggataaagattttcaggatgaaatggctgcaaaacagtctatgattgactcagcctacacccaattgcgtgaatctacaaaaaagctgtccgatcttcgtgaacaactacacgtgtccgagacgcaaagaactttgtttcttgaattaaggcaacgttgtaaaaatcttatgacttcgatcgaagaacagaaaagtgaattaagtaatctttatgaatcttttgatcccaatgggatacacgattcaatatcattggatgctgacgctcctttaactgtcaatgaaaacaacaacaaaaatttatctattgctgaattgaagtttcaagttgctgcttatgaaagaaatgaagccagattaaacgaattagcgaacaaactttggcaacgaaattccaacataaaatcaaagtgccgtcgggttgtttccctatgcaccggtgtcgatgaatctcgagtggattcattattggaaagtttgttacaagccgtggaaagtgacggtcaacagggagaagtagatatgggtcgagttgctggattcttacgtgttgttaaagaacatcaagca

SEQ ID NO: 26227 - DNA, 979 bp, Schizosaccharomyces pombe
atgggtggaaataagcgtgcatactatgcagtagcgcgtggtcgaaatactggtatatatagtacatggtaagactgcgtatctcaagaaaatggtttcgttgttaaatataagtttcacgttaagcaagtttcgatacggtcgtatgctttgcttcaattcaatctgaatcggttttttcaagatgatctcttattaacatttccttgatggatacaccttgttgtttaacaaactcttactaatttttagggatgaggcgtcggatcaggtgaaaggttatggaggtaatcgctacaagaaatttgacagctatgaggctgctcaggaattttgcaggaccgaaggaagtcgctactcctcgtcttctggcccatatcgccgcagtacaacaagttatgggtactctccatattcttctagttcctcaaattactctgctagacactccgataaatatagaaagaaaatttctagaagttatagtaccgaaaaagatattgaaatattttcgaatgacactcatgaaaaatcaattgcgtgctcggatcgacaggtcgtctatgctgacggttctagtttgcgaaatgggaaaaaaggagctgttgctggctgtggagtttttttcggaaatgatgacccaagaaatatttcagtaccgttggctggggaagagcaaaccaacaatcgtgcggaattgcaagccataatcctagcccttgaaaatacatctggcgatttgaccatccgctctgacagcaattattccattaagtcactaaccacatggctgcctaaatggaagaaaaatgactttaagactagcaattcacaacctgtaaaaaatttggatttgatcaaccgcgcttcagatttgatgagtgacagaaatgtttcgctagagtacgtgaaaggacacagtaccgattacggtaatcaacaagccgatatgcttgctcggcgaggagcttctgagtaa

SEQ ID NO: 26228 - DNA, 3313 bp, Schizosaccharomyces pombe
atgacagataggtcttcaaatgagggcgtcgtgttaaataaagaaaactatccatttccccgaagaaatggttcaattcatggcgaaattacagatgtcaaacggcgacgtttaagcgaaagaaatggatatggtgataaaaagggctcatcctcaaaagaaaaaacttcatcttttgaggatgagctggctgaatacgcttcacaattggaccaagatgaaataaaatgtaaggttttttggatagctaaccatttattagtatactgactccttgatagcttcaaaagatcagcagtggcaacgaccagctttacctgcaataaatcctgagaaggatgatatttattttcagcaaatcgatagtgaggagttcacagaaggatctgtaccttcaattcgtttgtttggtgttactgacaatggaaacagcatccttgttcatgttgtgggattccttccgtacttttatgttaaagccccggttggatttcgacctgagatgctagaacgtttcacacaagatttagatgctacttgtaatgggggtgtgatcgatcattgcattatagagatgaaggaaaatttatatggatttcagggaaatgaaaaatctccattcattaaaatctttactactaaccctcgtatattatctcgagcacgaaatgtatttgaaagaggagaattcaacttcgaagagcttttccctgttggtgtcggtgtcactacttttgagagcaatacgcaatatcttcttagattcatgattgactgtgatgttgttggtatgaattggattcatcttcctgcttcaaaatatcaatttcgttaccagaatcgagtttctaattgtcaaattgaagcttggattaattacaaagacttgatcagtcttccagctgaaggccagtggtctaaaatggccccactgaggatcatgagctttgatattgaatgcgcaggtcgcaaaggcgtttttcctgatccctctattgaccctgtaattcaaattgcaagtatagtaacgcagtatggagactccactccttttgttcgtaatgtcttttgtgttgatacatgctcacaaatcgttggaacacaagtatatgaatttcaaaatcaggctgaaatgctttcaagttggtcaaaatttgttcgtgatgttgacccagatgttttaattgggtacaacatctgcaactttgatatcccttacctcttggatcgagcaaaaagcttacgcattcacaatttcccattacttggccgtattcataattttttttctgtcgcaaaggaaaccacgttttcaagtaaagcatatggtactcgtgaaagcaaaaccactagtattcctgggcgtttgcagcttgatatgttacaagtaatgcagcgtgattttaagcttcgatcttactctttaaatgcagtctgctctcagtttctaggcgagcaaaaagaagatgtacactattctatcatcactgacttgcaaaatggcactgccgattctagaagacgtttagctatttattgtctgaaagatgcatatttaccccaacgcttaatggacaaattaatgtgttttgttaactatactgaaatggcaagagtaacaggtgtaccgtttaattttcttcttgctagaggccaacagattaaagttatttctcaattgtttcgcaaagctcttcaacatgacctagttgttccaaatatacgtgtaaatggaacagatgagcaatatgaaggtgctacagtcattgaaccgattaaaggatactatgatacccctattgcaacactggattttagttcactttatccttcgattatgcaagcccataatttatgctatacgacattacttgactcaaatactgcagaattattaaaacttaagcaagatgttgactactcagtgactccgaacggagattatttcgttaaaccacatgttcgtaaaggactactccctattatcttagctgatttacttaatgcacgtaagaaagcaaaagcagatctaaaaaaggaaacggacccattcaaaaaggctgttttggatggtagacagctagctttaaaagtaagtgctaattcagtatatggatttactggtgctaccaacggacgtttgccgtgtttagcaatttcttcttctgttacctcttatggtcgacaaatgattgaaaaaaccaaggatgttgtagaaaagagatacagaattgagaatggatactctcacgatgcagttgtaatctatggtgacactgattctgttatggttaagtttggcgttaaaacgttacctgaagccatgaaattaggagaggaagcagctaattatgtttcagaccagtttccgaatcctattaaactggagtttgagaaagtgtactttccatatcttttaatttccaaaaaacgttatgcaggattattttggactcgtacagatacttatgataaaatggactctaaaggaatagaaactgtcagaagagataactgtcctctagtatcttatgtgattgacacagctttgagaaaaatgttaattgatcaggatgtagagggtgcacagttgtttacaaaaaaagttatttccgatttgttacaaaacaaaattgatatgtcacaacttgtaatcacaaaggcattatcaaaaactgattatgctgccaaaatggcacacgttgaattggctgagcgaatgcgtaaacgagatgctggctccgccccagccataggagatcgcgttgcatacgttattattaaaggtgcacaaggtgatcaattttatatgaggtcggaggaccctatatatgtattggaaaataacattcctattgatgcaaaatattatttggaaaatcaactctccaaacctttgcttagaatttttgagcctattcttggtgaaaaagctagctctttacttcatggtgaccatactcggacgatttccatggcagcccccagtgttggaggaataatgaaattcgcagtaaaggttgagacctgtcttggatgcaaagctcccataaaaaaaggtaaaactgctttatgtgagaattgtctaaatagatcggcggaactgtatcaacgtcaggttgctcaagtgaatgatttagaagttcgttttgctcgcttatggactcaatgtcagcgatgccaagtaagtatgcatcaagacgtcatttgtaccagtagagactgccccatattttatatgcgaattgcagaacacaagaaacttcagcaatctgttgacttactgaaaagatttgatgaaatgtcctggtga

SEQ ID NO: 26229 - DNA, 1605 bp, Schizosaccharomyces pombe
atgctaataaacgagcacgtacgagaacgctatcattttcttcgtgtctctcttacaagagtcgcacatcttgtctttgctaacagtcatgaaagcaatgacttaaaaatggttgaaaacgtatcttcaacgcctaaaaaaggagttcttgaagatccttctacattaacaccagaagttgttactcctcgaacaccaggacatcgaattataaaagctaagggtgcatataccaaagaccgttcagctaaaaggcggcgaggtagaattgagattgaaaggcatttattgggagaatttgatgataatgttggttcgaattcactacttgatgttccgctctattctttagaggccgaacctctttcaccatctgtgatgcttgaggatgaaagcatggaaggaattaatcaatctccccaaggtatttccgtggagaagctaggaaaagaagataacagaagtcgttcttccacacctgcctcgccatctcttgaaagccatgagttttctgaaagtagagaagccggcttatctcaatcaaacggctttgaagcgaggagtcatggcacggggtttgatgaatactttgataaattttctcagcgaaaaacttcgagcaacactttatctcagttgcctgttttggataatcaagtatacctagatactgtaaaggaaatctgtactgaaaccgagcagcacactcaaactctagttcattttcagtctcgtaattttcatcaatggtattttgaacttgtgaataattttaatttactgttttacgggtttggttctaaagagcattttctatcttcttttgttgaaaaaaaacttccttgtttccccatttttgtcgtaaaaggctacttccctcagttacagttaaaaaatgttctttcatcctttcttgaatttttagaggtcacacctgctgcgtctgtatctgatatgttaattcaatctttgagtattatcaattctccctctttttcgttaggaaaaatcgtgtttctggttcataatatcgatggtgaaagtctaattgacgaacgatttcaatctgctttggcggccatagcttcttcaaaaaatgtgtatttcattgcttctgtggatcatgtaaattttgcacttttatgggatacatctctagagtcttcgtttaattttgtcatgcacgatgcgactacctttgcacggtattataatgagactacatatgaaaattctttaggtatcggaagagcgaatgtgtctaataaagagaaagctataaagcacgttctctattctttgcccgccaattctcgcggtatatttaagttccttctaattcaccaactcgaacgcatgatggatactcaagattttgatgcccgccaaggtgaaaaagtcggtattgaatatcgttctttctttcaaaaatgtagcgctgaattcctttgcagtaatgaacccaattttcgaagtcaactcacagaattttttgaccataacattatcgaatcaaaaagagatgtatcaaattctgagattttatgggtaccatatcccaaaaatctccttgaaattttgttggaggatatgatggaagacgta

SEQ ID NO: 26230 - DNA, 1685 bp, Schizosaccharomyces pombe
atgggcagagaaatcattacgttacaagctggtcaatgtggtaatcaaagtatgttcacctatactactattaatcaaatcgaaattctaattactcacaaacttgtctagttggttcacaattctggcaacagttgtgtttggaacatggcattgggcctgatggcacgctagaaagtttcgcaactgagggtgttgatcgaaaagacgtttttttctaccaggttggtttattgatacactttaaagtttcaacatgttaactcattttagtctgatgatactagatacattcctagagccattttgattgatctggaaccaagagtatgttatcgcatccttttattagtatttgctgaaatattcaagtgactaatgtcctctttaccttaggtggtcaacaatattctaagcgacacctacggcagcctttataatcccgaaaatatacttattaccaaaaatggaggaggtgctggcaataattgggctaatggttattcgcatgctgagaggatttttgaagatataatggacatgatagatcgtgaagctgatggaagtgattctctagagggtttctcgcttttacattctatcgctggtggaacgggttctgggctgggctctttcttgcttgagagattaaacgatcgttatcccaagaagattatccaaacttattcagtattccctaatagtcaatccgtatcagatgttgtggttcagccttacaacagtcttcttgcattgaagcgactgacattgaatgctgattctgttgttgtgttggacaatgcagcacttgctcatattgctgctgatcggttacatactcagaaccctacgtttcatcaacaaaaccaattggtaattgatttatattaggtcttttcatcaactaactattctaggtttcaactgttatgtctgccagtacaacaactttaagatatcctggctacatgaacaacgatcttgtcagtataatagcttcattaattccaagtcctcgctgtcactttttactaacctcatacactccttttaccaatcagcaagtggaagaagcaaaggccattcggaaaactaccgtgcttgatgtgatgagaaggttgttgttgcctaaaaaccagatggtttccgtcaatcctagcaaaaagagttgctttattagtattttggatatcattcaaggagaagcagatccggcggacgttcacaaatccttgcttcgcataagagaacgacgatacgcttcattcattccttggggaccagcaagtatacaagttgcactttctaaaaagtcgccctatataaaaacgaaccaccgtgttagtggacttatgcttgcaaatcacactagtattgcctctgtatgtttctgcaaatttttttttgagacatttaatactaatctttgtagttattcaagagaacactagatcaatatgatcgtttgcggaaacgaaatgcctttttagagcaatataaaaaggaggctattttcgaagatgatcttaacgaattcgattcttctcggtaagtatcttgtcttataatttcatattttgagttaatttactaatgtatttgacagcgacgtcgttgccgacttgatcaatgaatacgaagcttgtgaagatcccaattatttatctctttaaaaaatccttcat

SEQ ID NO: 26231 - DNA, 1129 bp, Schizosaccharomyces pombe
atgagtgaagtaataaaatctgtacccccgggctctcaaaacacttctcagtggataataagtaaagatcagttggtatttactccatctgcattagatgggatacctttagatcaagaagaaattcaaagatctaaaggatgcaatttcattataaatgtcgggctgagattaaaactgtacgttaattacgatgtatcagttcagtaaattaatgaaactaacaataataacagacctcaaactgcgcttgctactgctaacatctatttccatcgattttatcttcgattctcactcaaaaattatcattattatgaagttgctgctacttgcattttcttggcaaccaaggttgaggattccgttcgtaaacttcgcgatattgtaattaactgtgcaaaggttgctcaaaaaaacagcaatgttttggttgacgagcaaaccaaagaatactggcggtggagagatgttatcttgtacacagaggaagtactgttagaagctttatgctttgactttacggttgaacatccatatccttacgtcctaagttttatcaaaaaattcgtggctgatgataaaaatgtcactaaggttgcttggacatacattaacgatagcactagaagtatcgcatgtctactttactctccgaaaactatagctgctgcagcattccaatttgcattagaaaagaacgaaataaatctctctactacgactgatgggcttccggtatggatggaagagtctcaagtttcttatgaagacgttaaaggtatattatatatttttttatagccttagcactaacaatgcaggagtgttgacactaatcgactcgttatacaaaaagataaacccttccaaacaagcccttccaatcgaccaaaaaaacggatctcatgcttccagcgtagctcctgggacaccgtcgtcattggcttccgtctcgacacaagctacccctcaacatcaaaattcatcaggaagaactgactcatttcattccctaaacacagaaaccccatcaaaaagtacggtggacgaccaaatactgtcgacagccgcccagccaaaaaaatcatctgatacagataaagagatggagacggaagcttcataa

SEQ ID NO: 26232 - DNA, 690 bp, Schizosaccharomyces pombe
atggaaccttcaacaccacctatgcgagggttgtgtactccatctaccccagagtctcctgggagttttaaaggagtcatcgatgcttcgttagaaggtaattcttctattatgatagatgaaatccctgaaagcgatttaccagcacctcaagttagcacatttccacctacacctgctaaaactcccaaaaagcaattactaccaaatttaatgctacaagatcggagtaattctttagaaagatgtatggaagaagacagagaacacaatccttttctcagttcatctgataaccagcttttgtcaagaaagaagagaaagcctactcctcctccttctgatggtttgtactatgtttttcgggggaaaagaatcaagaaatccttcaggcctggaactgatttatctacttttaagcccaaactcttgtttgctgactcggcgccttcttctagttcagataacccaacatcctctgtagaccttaatgactattctcaaattggcattctccctccaaacctgaattctattgggaataaaatgttctcgttaaaatcaagggttccatcttcctcgtcaggttcctttgttgctcccccaccgcaaatgcgtttacctgcgtattcatcaccacaaaaatcacgatctaatacaaaagatgaaaacaggcacaatttattacga

SEQ ID NO: 26233 - DNA, 1662 bp, Schizosaccharomyces pombe
atgatcgaaacaatcccaacgaaaccatatgagggccaacgccctggtacatcaggtcttcgcaagaaggttactgtctttgagcaaccaaattacgttgagaactttgttcaagctacgatggatgtagttgaaccatctgccaaaggagcccatctagttgtcggtggtgatggacgttatttcaactttcatgccatccaagtcattgctgctatagctgctggcaatggtgttgagaagatcattgttggtacaaatggatatctgtctactcccgccgctagtcacattattaggaagtacaagctaaccggcggtatcattttgaccgcttctcataatgccggtggtcccaagaacgatttcggtattaaatataaccttggcaatggtggaccagcacctgaatctgttactgagaaaatttattccattactaaaaccatatccgaatacaaaatggtaaagattcctcccttggatttaacgacgaccggtgtccgtagatatggcccattgacggttgaagtcatcgacccggtcaaggattatgttcagttgatgaaagaaatctttgactttgatttgattcgcagcttcctatccaaaaaccccgattttacatttgtctttgatgctttacatggtatcactggtccctacggtgaggctcttttctgtaaggaactcggtatgccttcatcagtttgtcagaattgcaaacctcttcccgactttggtggtggtcatcctgaccctaacctcacttacgccaagagtttggtggctcgtgttgatcgggataacattgtaatgggagcagcatctgatggtgatggtgatcgtaacatgatttatggtgccaatgcattcgtcacacctagtgacagtgtagccatcattgcccatcatgccgaattaattccatacttccgtgatggaggtgttcatgggtttgctcgttcaatgcccacatctggcgccattgacagagttggcaagtataagggaaagaatgtgtatgaggttcctactggttggaagttcttctgcaacttgtttgatgctaagcgtttatccatctgcggtgaagagtcttttggaaccggtagtgatcacattcgagagaaggatggcgtttggggaatcttgtgttggttgaacattcttgctggattgaacgcgcaaaaccccaagatcaagacgttgatcgatgttaagaaagatttttacaatatttatggccgtacattctacagtcgttatgattatgaagagttggaaaatgaagctgccggtaaggtgatggatagaatgcgtgccattgccgatgataagagcaaggttggagaggcagttttgcctggttttgtcgtttctgaagccggtgattttgagtatcatgatcccattgatggtagcgaaagcaagcatcaaggattatacatcaaatttgagaatggtagtagaattgtgacacgtttgtccggtactggatccagcggagccacgttacgactctacatggagaagcacgaatcagattcgagcaagtttgatcttgatgctcaagttgcattgaagccagtggttcatgcagctcttgaaatcttggctctggaggaattgactggtcgtaaggagccaactgtcattact

SEQ ID NO: 26234 - DNA, 1008 bp, Schizosaccharomyces pombe
atggcaattcctaaggttggtattaacggtttcggtcgtattggacgtattgtcctccgtaacgctttggtcgctaagaccatccaagtcgttgctatcaacgatccttttatcgatcttgaatacatggcctacatgttcaagtacgactctacccacggtcgcttcgatggctccgtcgagatcaaggatggtaagctcgtcattgatggcaatgccatcgatgtccacaacgagcgtgaccccgccgacatcaagtggtctacctctggtgctgactacgttatcgagtccaccggtgtcttcaccactcaagagactgcctctgctcacttgaagggtggtgccaagcgtgtcatcatctctgctccttccaaggacgcccccatgtacgttgtcggtgtcaacgaggagaagttcaacccctctgagaaggttatctccaacgcttcttgcaccaccaactgtttggctccccttgccaaggtcatcaacgacaccttcggtatcgaggagggtctcatgaccactgtccacgctaccactgccacccaaaagaccgttgacggtccctccaagaaggactggcgtggtggtcgtggcgccagcgccaacatcatcccctcctccactggtgccgccaaggccgtcggtaaggttattcccgctcttaacggtaagcttaccggtatggctttccgtgtccctacccccgatgtttccgttgttgacttgaccgtcaagttggccaagcctaccaactacgaggacatcaaggccgccatcaaggctgcctctgagggccccatgaagggtgtgttgggttacaccgaggacgctgttgtctccactgacttctgcggtgacaaccactcctccatcttcgatgcctctgccggtatccaactttctcctcaattcgtcaagctcgtctcttggtacgataacgaatggggttactcccgccgtgtcgttgacttggttgcctacactgccgccaaggacaac

SEQ ID NO: 26235 - DNA, 5076 bp, Schizosaccharomyces pombe
atggatcaaagcaagcgattgttaaagtcagctgttccaaacccgcctgaacattttaaaacaggtatatcctggcttgatgaccttgacgagaaggacgatgactcagcgacgtctgtgaactatgatataccagaaataaccgaagcaaatctctgtaatgactcccatgaagctctttcaccttgcactcaacctgtcggtaattctggacgacctgtcgaagcttttaagacctatcctagcactcctgcagtacctagcaaaagcgtgcttttccatttttatgaaccggatgagaactttagcttatctgacacgggacgtactaaatcggataccgccttagctgcaagagaaagctctgaaaagtctgaagtgccacgtgatacccgtagtgctgggataaagccatacaaagaaaataactcgtctaattgtgcaatttctaaagaagcaggccttcgaagacttattgataaggacagagaatctttcgacaaaaacctgaatcagtcatttaccaatctaacttttccagaaccgatttctgatgacagtgacagtgtggagtttcaacgtgattctcttaataacaattggccagctagtttggaaggtagcatacacgaattacccaggaatagtgatgatgatggaatccctgcttctgcggctcatatcctggacctcgattatcatagagatagttatgatagcccttggaagaagtttttaccgtacccttccattttatccgatgattcttggaaagctccggagagttggggaactagtttgcccactgaggctattccaaagcaggtttttactactagattttttgctcgtccttccctgggcaatagaaagaaagagttctttcttcgagtataccgtgatgatcgaacttccgtatcattcatttgccctattggcatacaaactcatgaagtgattaagctgttagcaaggttattttttcttccctcgtctgctaatttttacctcttattaatccaattcaatacagaacgtattttgttgcctcatgaacagccatgcattatatttgaacgattattgagtttgtttgggtgtaaggtaacttccgatgaagaaataaatgaagaagataattatagtgttgctagattggtgtttactacgatggatattggagcggatgtattgcgtaaattctctgaaaaaaaaattactgcgaaccttgacattagtaggtcaaacctggaggttattccggtaaagatctatccctatgcccatgaacttatctcgttgaatgtttcgcacaatttatcgctggacctgcctttagatttcatggagcgctgtgtcaagcttaagcggttagacatttccaataatttaaggtctccaagaggaaaaccgattactgctcttcgccaattggaagttttgaacatgtctcgtaacgatatatatgaattggatcctcttatattctctgggcttagtcgaaattctctgaaagaattgaatatagctaataataagctgttcttccttccccattctactagatatttggtgaatctaacctatcttgatttatcctacaataattttgtgactttccctttaataattactgagttgtcccaattggagactcttaacttttcgcataatttattgtcacagatatctagcaaaattggctctcttgttaaattgaagcatctatatctacaatttaatgatttatctaatcggcttccacaggaaataggcttgctaaaaaatctggaaacaattgaccttagttataatgcgattactaacatcgccagtttatctgaatgtccgaaactaaatagcatcaatgtagcttgcaatttactttctttttacgaatattccaatccgtcagctacattcatcgacttctcgttttgtccactgactacaattgatccggcatttagctatagcaatctcgtctactttgatatctcacatgcgaagcttattgggctcaaggattctgtcattgaaactttagtaaatgtagaaacagtgaaagtgaattacaaccactttactagcatttccgatgcaatttctgctatgcaaaatttgaaatatttgtcttgcacgaactgtgaaatgtcttatgtttcaccaaaccttggcaaattaaagcatttagttcacctggatttacatgcaaataatatcaaaatattccctgaggaagtatggcaagtctcttcactaaaagttgttaacctgtcttccaatatcctggagaaaatcaagttaccagttgcaacgtcaaaaaaattaactaggacaattagccaattaaaaatcatgcgtactttatcaggaaatccggtatcgagcctctcctcccaagaatttgttatgcctaccgttgaagaattatacttggtggacaacagattgggcaatgactgttttacggctttagaatactttaagtgtttaaaagtcttaaatttatcttacaattatttaacggaaattccaagcaagtttttccaaaatttttctgatcttaaacacctttttgtgtcaggaaatgagcttgcaaatctttccatttccagtacagcgcaggtcctacttgaaactttgtacgcgaatggaaatcgtctttcctcttttcctaaaaatgaagctttgtctaaaagtttaagatttttggacataagtaccaataatctgcagaatttagcagtagaaaaagctgaaaagaagagtttaactaaacttcctcaattggaataccttaatctatctggtaacacatggtttcgattctctgagcatgaagatacaaactttacaaaatcatatttgaagaatttaaagtttttgagcatcatggatttgaatacaaaattttctaatgcgccttctgatgttctaaaccattttattcaacgcaactctcctcaacctaacattttgaggtatggagtatgtggatacctttctcgttctattcccgtcatctctgcatgtgaattagttgttaacaactttttgcatcctcaatcatctttatactgtgtgcttgacagtgacatcagcgctggaaaaaacaaccgggttttaaaatttgtgtacgacaatttggcttcatgcctagcgcatgagattaatgcagcagattcctcttctgaacaaatttgtaacgctttgagaagaggatttcttcgtttaaacaaaaaattaggaaatgtcattcattatgaccttaggaagtcttcagaaggagacgtggatagtaattacgttaccactatgaatatttcagaaaagggttattctatggacagttcttgcttggatataggagttagcattatcttagtgtacgtcagggatacaagagctttcgttgccaatgtgggcacatcaatggctataatgtctacgagaaatgattcggaacctacaactttaagtgtcatgcatgatgtgtacaatagggatgaaattcgtcgcatagttgattcatgtggtttcatatctggtgaaataaaatcgaccactacacgtgctattggtcgtttgtctcaatttcctggcgtccaagcagttccctatgttaatgtgcagtacttatctgaactaaacgaatttatcattctagcaaatcaggaattttggagcgtattatcaaaacgcacagtaattgacgttgttcgtgccaacagacattctcctctattagcctctacgaagctacgtgactatgctattgcatatggtgcagaaaaaaatgttcttgtagttatcgtcgaattgaacggattgtttgaagagaattcccttaatttcaaccaactacggggggatgaaaaaactttagcaatttctgaaaagaacgataatatgtcatttgtccaagatttacccgatgattcttctttagcacgaatgaatagagaagtctctcccccgaaaggttgtattgccatggtttttactgatattaagaattccacattattgtgggaaagacatcctattgcaatgagatctgcgatcaaaactcataatactattatgcgtcggcaactccgtgcaactggaggctatgaagtaaaaaccgaaggagatgcgtttatggtttgttttcaaacagttcctgctgcattactttggtgtttttcagtacaattacagttactttcggcagattggcccaacgaaatagttgagtcagtgcaaggacggttggtactcggctcaaaaaatgaggtgttatatcgagggcttagtgttcgaattggtgtcaattatggtgtaaccgtgagtgaactagatcccatcactagacgtatggactattacgggcctgtagtaaacagaacatctagggttgtatcagtcgctgatggtggtcaaattgctgtttctgctgaggtggtatctgtattgaatcagcttgattcagaaacaatgtcatcagagaagacgaatgtcaacgaaatggaagttcgtgctcttaaacaaatcggttatattatccataaccttggagaatttaagttaaaaggtttggatactactgaaatgatttcattggtttatcctgtgcaattgcaaggaagactggagagattgataaagagccgaagtttgggaacacccacagccctcccggaaactcagacttatactcccgttcgtagtagaagcaacagcttgcgacccatgttagcaagattgagtgattcaaaatctgtccatggagaggagggtggttctgggaagagatcggtttcatccttgcgcaacgtatcaccatcagagagtactggtggatatgaaggttgtatttttgatgaccaacagtatcaattactttatgaactttgtgagcgtcttgaagaccatgccgctatactgcatgggtttcctgaaccaccgccttgcgataccggtctggcagctcccgtaaaccaggccgaggagtattcattgttctaccgtctgactttgcgtatcgagaatactatttattgtgtcagtcaaatgcttggacacactggc

SEQ ID NO: 26236 - DNA, 1170 bp, Schizosaccharomyces pombe
atggttcgcttgccaagaaagttcaaacgtgttttacttttagtggtattacttacattggttgtatttgtacgtttcaaaaagcaatacatcccaactatcagtgtatttgagggcagtctgattgacaatcgagatactctttcgtatttcaatatttctaatctagagccctcagaacgctccgaatggcttccaaataaacgggttaatgctgcctttgttacgttggcaagaaatgaagatttgaatgatttacttaaatcaatccgaaaacttgagaagactttcaatcataaatatcattatggatgggttttccttaacaatgaggagttctctgacgaatttaaggagcatgttattgaagcggtctctggcaaatgtgaatttggtttggtacctcaggaacaatggagcattccggaatatattgaccaagacaaaatgcatgaaaattggaaaaaacttcaagaattaggaattctttatgctgacaaagaatcttatcgtcacatgtgtcgctttgagtctggtttcttttatcgtcatcctcttgttcagaagtacgaatattattggagagttgaacctagtgtggatttcttttgcgacctcgatttcgatccatttgcttatatgaaggaaaataacaaggcgtatgcattcactatcactgtaactgaatattcagaaacaattccttctctttggccctctaccaaagaattcatcaaaatgcaccctaatgctcttcatcctaataatgctctaaacttcatatctaatgatgatggggaaacttataacggatgtcatttttggactaattttgaaattgcgaaagttgatttttgggaaagtgaagtttatagtaaatattttgactaccttgataaaagtggtaatttcttctatgagcgttggggtgatgctccagttcatagcattgctgtttcgttgttcgctgatcgtgacaatatccattttttcaatgagattggctattggcatcctggtagcggtcattgtcctttggatgatgctacacgcgctaaatgcgactgtgatccttatgaatccattgattataatggatggagctgtctagataaattctataccgcatttgaaatgcctttccccgaaaactggtctttttatagccat

SEQ ID NO: 26237 - DNA, 2717 bp, Schizosaccharomyces pombe
atgaagctttgcctttcgggctcttcgcaggcaattccatccaaaggaattagtttggttgcagctcgattccaaagcactgcttcgagggcttcctatgtgacaccgccatatgagaagttgatggggaaactccaacaagttcgcaagtttcttcctggtcaaaagctcactttggcggaaaaggtcctttattctcatttggttaaccctgaagagagcttcagtggtgtctctccttcagacattcgtggctccttgtacctcaaactgaatcccgatcgtgtagccatgcaggatgcctctgctcaaatggccttgcttcagtttatgacgtgtggtcttgaaaaaactatgattcccgctagcattcattgtgaccacttgattgttggtcatcgtggtgccaacagtgatatccccgatagcatcgccaataacaaggagatttttgattttttgcaaagtgccgctaaaaagtacggcatacagttttggggcccaggaagtggcattattcaccaaatcgtgctagaaaactatgccgctcctggtggaatgatgcttggaacagattctcatactcccaacgctggtggtttgggtatgattgccattggcgttggtggtgccgatgccgtcgatgctatgaccaatacaccatgggagttaaaagctcccaaaatcatcggtgtcaaccttacgggcgctatgtctggctggactactccaaaagaccttatacttcatttggctggtaagcttaccgttcgtggtggtaccggtcatattattgaatactttggccctggtgttgcgtccctctcttgcactggtatggctactgtttgtaatatgggcgctgaagtcggtgcaaccacctcaatctttccttataccgattctatgcgtcgctatctaattgccacacaccgtgcagaggtcgccgatgctgcgtcggaggttcatagtgaatacaactaccttgctgctgatactggggctaaatatgatcaaataattgacatcaacctttcggaacttaccccttccctcaatggtcccttcactcctgatttgagcactcctgtttcaaaatttggtgaagccattgagaaaaacaaatggcctaaaaagttgtcggctggccttatcggttcatgtaccaattcttcttaccaagatatgacttgtgttgtcgatgttgttgaacaagctatatctgctggacttaaaccaaaggttccatttttggttacaccgggtagtgagcaaattcgcgcaaccattgaacgtgatggcattactgaacgcttggaagaagctggcgctactgtgctggcaaacgcatgtggtccatgcattggtatgtggaagcgtaccgatgacattgcttcaggcgagccaaatgctattcttacaagtttcaatcgtaatttccgctctcgtaatgacggaaatccatcgactatgaacttcttgaccagtcccgtaattgtggctgccaagattttttcctctgatcttgcatttgatcccacgcatgatacattgcaaacacccgatggtaaagccttcaagtttagaccccctcagggcgtcgagcttccttcggctggattcatcgctggtgactcttcctacattcctgagcctaatcctcagcctgttccggaaaccgaagttacaatcgatcccaaatctgatcgtttggaggcccttgaaccctttgagccttaccaaggaggagaaatggaaaaccttaaggttgcagtgaaggtcaaggggaagtgtactaccgatcatatttctgccgctggtaaatggttaaaatacaaaggccatcttagcaacatttgtaacaacacacttattggtgcaatgaatgctgctactggagaagtcaatcgtgcctatgacaatggcaaaggcatgacaattcctgagctgatgtggaagtggaagaaggatggacaaccttggttggtagtagctgaacataactatggtgagggttctgctcgtgagcatgcagctttgcaaccccgtgccatgaatggtcgtattattttgaccaaatcatttgcccgtattcatgagactaatttgaagaagcaaggcgttttgcctttaaccttcgtcaatgaagccgactatgaaaagatagatgcagaggataaggtttccactcgtggtattgaacaacttttagaaggtgttttggaccagcctattacccttgtcgtcactaagaaagacggttcagttgtagagattccttgcaaacacacaatgagtaaagaccagatagaatttttcaaggccggttcagctcttaatttgattcgcgaaaaggcccattctggcgtggtaaatcaaaaggttatagattcaataaaacaacaactgaccactatgctgatgcgtatatatttaatcgtcattttgttatagccaaaggagatcaactaggattgccttttcacttgaaaggtgtccaggttggtgatacgatacgacttgataaaatcgcttccttcggctcaagagattttactctctttggtaacccgtatgtagacccttcattgtttacgattgaagcggttgtattatcattccctaaaagcgcattaagtgttcgagtaaaacacaagcgtcgtcatcgtcatgatcgtgtaatgaaacataaacaaacgtatactattttaaggtaa

SEQ ID NO: 26238 - DNA, 2067 bp, Schizosaccharomyces pombe
atggatattaaggactattactgcgtcgaaacaaaggattctaagcaacccggcgaatcctacatatatcgctctatccactcggcgggaaagcttttagatactccagaagacggtgtcagcaccgtttatgacttactgtgtactgcggctaaaaaccatggcgagaaacaagctatgggcagtcgtaaactcatcaaagagaacagagaggagcgagaaattattaggaaagttgacaacgaagaggttgttgagaaaaagttgtggactacctacgagctgggtccttacgaatatatttcttttaataaggtctatgagattgctcttgcacttggttctggtcttgtagcctcgggaataacttcagagactacaatgctattttttgctgccaccagtgccaaatggttcacgactgctcaaggttgcagttcacaagccattcctattgtaactgcttatgaaacccttggtgaagatggtatatacacgtccctcgacgagtgtaagtctagggctattttcaccgatcccaacttaattcccaaattacttggtcccttgaaacaatcaacttgggtaaagcttattgtttgcagctctactcctagtgaagatttagttgaattggttaagtctaccgctcctgatgttgaaatcatcacttatgataatttactttctttaggtaaagaaaaaccccaacctcctcatcctcctaaagccgatgacatttgctgttatatgtatacatctggctcaaccggtaaacccaaaggtgttgttttgttacatcgcaacatcattgccgcattgggcggtatcaatcgcattttgagccaacatattaatgtcaaagattatgtccttgcttatcttcctttagcccatatttttgagtttatttttgagatgtgctgcctttactggggcggagttttgggttatgcgtctcctcgcaccttgacggatgctagtgttgttaattgcaaaggtgaccttactgaatttaggcctactgttttaattggcgttcccgccgtgtatgaacttatcaagaagggaattttagctaaagtctcttccatgcctgcacatagacaaaaggtattttctggttcccttagcttgaagcaatatttaatcgaaagaaatcttcctggttcagccgctcttgatgccattgtcttcaacaaggtcaaggcagctactggaggtagacttcgatactgcatttctggtggtgctgcattagcagctagtacacaagcttttttaagttcctgcatttgccctgtgcttcctggttacggacttactgaaacttgtgctggaagttttgtactttctccagaacagtggcatttatatgctaatacagttggtttccctattccttctatcgaatttaaactagtagacattccagatttaggatactataccgattcctccccacctcgtggtgaagtttggattcgtggacctgctgtttgcaatggatatctcaatcgtcctgaagataacaaggccgcatttactgaagatggatggttcaagactggtgacgttggtgaaattgcaaaaggcaatactctgcgtttgatcgatcggaaaaagaatattgtgaaatctctcaatggtgaatatattgcacttgagaaaatcgaagcacaattttttacaagtcctttagtttcaaatgtttgtgcttatgcagatgtcaatcatgctaagccagtcgttattgtcaaccccgatgaaaatggtttacgcacctacctgactaaaaacagtggttcttcatttaacggcaatcctaatgatacactgactaatctctgtaaggacagtggtgttcaacatcttatccttaaggaattgattaacattggaaagcaacaacgtcttgcttcaattgaaattcctgaaggcgttgttctcagtgactttgaatggactgcggaaaataatttcttgactgcatctcgtaaagtgaaacgtcaagttattgtagcacactactcagacgaaattcagaaggcttatagtaaaaaacat

SEQ ID NO: 26239 - DNA, 3518 bp, Schizosaccharomyces pombe
atgaaaatagaggaactcatcattgatggtttcaaatcatatgctgtgcgaactgtcattagcaattgggatgaccaatttaatgctataacgggcctcaatgggtctggaaaaagtaatatattagatgcaatatgctttgtcttgggaattacgaatatgtcgactgtccgtgcccagaatttacaggacttaatttacaaacgcggacaggcaggaataaccagagctagcgttaccattgtgtttaataatcgggatcctgcgtcttcaccaattggtttcgagaatcacccgcaagtaagcgttacaagacaaattatcatgggcggtacaagcaaatatttgattaatggacatagagctctgcaacagaatgttcaaaatttgttccagtctgttcagttaaatattaataatcctaattttttaattatgcaaggtcgaatcaccaaggttcttaatatgaaggctactgaaattttatcaatgattgaagaagcctctggtactcgaatgtttgaagaaaggaaagaaaaggcttttcgaacaatgcaacgaaaagaagcaaaggttgaggagattaatacactgttaagagaggaaatcgaaccccgacttaccaaacttcgtacagaaaaaaaaacttttctagaatatcaacatatttataatgacttggaacgattaagccatctttgtactgcttacgactattataagttgtcacttaaagtggaggaattaacggttcaagcatcccagaagcacagccatatcgccgagatggaatcttcattacaaacatcgaaacaggaggttttaatactaaaggaaaagattaaaaaaattgaagatgagcgaatgagacaaatgagtgtttcttcggatcgtaccttggactctcagttacaaactgttaatgaaaacatcaccagaataagcacgtcgatagaattaaagaatacagctttagaggaagagcatggggaccttcaacaaattcgtggaaaagctaaggaattagaaactttgttgcgcggaaaaaggaaacgactagatgaagtgcttagtgtatacgaaaaaaggaaagatgaacatcaaagtatttcaaaggatttcaagtctcaagaagagctaatttcatcacttacaactggtctttccactacagaaggtcatgaaactggctattctagaaaactacacgaagctcgagatacgttgaatgactttaaagctgaaaaagaaaccaatcgattaaagcttgaaggactcaataaacaaatatctttaactaaacctaagaaggctgaggctacaaaacgatgtgatcaactcaatcgcgaaatcgatatattacaaaaccatgttgagaagcttaaaatgtctttaaaaaatacaaattccgacattacaggtgaagatgtactccagcaaaagttgaagcaacttgctaaagatcgcggcaatttgttaaatgaacttgatgctttaaaaagcaaacttgcttatatggaatttacttataccgaccctactcctaattttgatcgctcaaaggtgaaaggattggtggctcaattgctaaccttgaatgaagagaattatgacaagcaaactgcattagaaattacagctggtggccgcctttataatctcattgttgaaaccgagaaaattggtgcacaattgcttcaaaaaggaaacctgaagaggagagttactattattcccctcaacaaaattaccagcttcgtagcttcagcagagagagtaggcgcagccaaaaaaatttctaataataaagcccaacttgctttggaattaatcggttatgacgatgagcttttgcctgcaatgcagtatgtttttggctccacattagtctgtgatacccctgaatcggcaaagaaagttacctttcatccttcagttaaattaaaaagtgtcacgcttgatggtgatgtttatgacccatctggtacccttactggtgggtctgtgaataaatctgccggtcctttactacagatacaaaagctgaacagtctgcagctaaaattgcaagtagttacttcagaatatgaaaagttggagactcaacttaaagacttaaagactcaaaatgccaattttcatcgacttgagcaagaaattcaactaaagcaacatgaattaacacttttgatagagcaaagagagaccgactcatcttttcgtcttttatctgattatcagcagtacaaagacgacgttaaagatctcaagcaaaggcttcctgaattagacagacttatattgcaaagtgaccaagctataaaaaaaattgaacgagacatgcaagaatggaaacataacaagggatcaaaaatggctgaattggaaaaggagtttaatcaatacaagcacaagttagacgagtttactcctatattggaaaagtccgagaatgactataatggcgttaaactcgaatgtgaacaattagaaggcgaattgcaaaaccatcagcaatctctcgtacaaggtgaatcgaccacgagtttaataaagacggaaattgcagaacttgagctgtcacttgttaatgaggagcataatcgaaagaaactcaccgaactaatagaaattgaaagcgccaagttttctggacttaacaaagagatagattcactcagtacctcaatgaaaacattcgaatctgaaataaacaatggggagctaacaattcaaaagctgaaccacgagtttgaccgattagagcgagaaaaatcagttgctataactgctattaatcatttggaaaaggaaaatgattggatagatggacagaaacagcactttggtaagcaaggaaccattttcgattttcactctcaaaacatgcgtcagtgtagagagcagttacataatttgaaaccgcgatttgctagtatgcgtaaagctattaatcccaaggttatggacatgattgacggtgtagaaaagaaagaagccaaattgcgctctatgataaagaccattcatcgcgataagaaaaagatccaagatactgtcaaaagtattgatcggtttaaaaggagtgccttagaaaaaactggagagaagtcaattcttctttcggtgaaatttttgacgaactacttcctggtaatagtgcagaactacagccaccagagaataaagaattcactgatggattggaaattcatgtaaaaattgggtcaatttggaaagatagtctggcagaacttagtggtggacaaaggtctctagttgcattggctcttattatgtctctacttaaatataagcctgctccaatgtacattttagatgaaattgacgcggcgctcgatttaagtcatacccaaaacattggaagacttattaaaacaaagtttaaaggttctcagtttattattgttagccttaaagaaggaatgtttaccaatgctaatcgactatttcatgtacgatttatggacggatcatctgtggtacaagctcgctaa

SEQ ID NO: 26240 - DNA, 1107 bp, Schizosaccharomyces pombe
atgtctcctacccttgttgttgatcaagagaattcggaagaatttaacacctcctcatttgaaggtcctgaaaaattgctggaactatggttttcggctcctataaaaaccaatttaagtgcgggtgaaaaggctaacttgggactaaaagctgtttctcgcaatgattgggatgatatgctagcccaagcccaatgtaaagtcctcagcgttgttaatagtgaagaaatagatgcatatttactttctgaatcctctatgtttgtgtttgcccataaaattatccttaaaacatgcggaaccactacactactggctagtttgcctcgcctattagaaattgcttctagtgttggctttgatcgtcctcttcgtattttttactcaagaaaaaactttttatatcccgaacgccagcttgcaccacatacgagttgggaggaagaagttcgttacttacaactgttttttccaagtggatgctcttatgtagtgggtccgacaaacaagaatcactggcatctgttttctgatctggctgatgattattctttactggaagattcccttgatcctgaagatgagaccctagaggtactcatgactgatatgtctcccgaacgctcgcttcagttttacgctccatccttggatgttgttcggagcgctagaggtgatgactatgttcgagaaaaaaacaatctctcggggggtcacatccttggcagttatgtagctgatgaatcgggtgttagagacttatgtagtacctctgataaaaaagcagtgcttgatgcttttcaatttgagccaattgggttctcgtcgaatatgatttacaaggaccgctatgccacaatccatgttacgcctcaagaacattgttcttatgcttcatttgaaacaaatgtttcgcaattccaattcggaagatccatatctgaaacaatcgaaaaaactgttaaaacttttggtgcaaacaaattttgtcttacccttttccaggctaaaggtgcgtctcaagagaagcatttctcggccaaacttaaatcttttagctcttataagcgtgaagaatttatagtgtatgactttcctggatatgat

SEQ ID NO: 26241 - DNA, 567 bp, Schizosaccharomyces pombe
atggctggcatgttccgtattcctattgccgtcgttcagattgctgcatttgtgcatcaaattcatgagtatctttttcaagtgcaaatgacatcgggtccaagtatgatgccaacattaaattctgggtattgaaataacgctttgtatttatggttctaacttaaaaagtggtgaattcgttttgttagataaattgcatggtaggtttgctcgttcatgttctgtaggagatgttgttgtttcggcaaaaccttccgattcaaagcaacacgtgtgcaaacgaatcattggaatggtgagtatttcacatggaacgttatcctttttgtactaattttatagccaggagatacaatttatgtcgatcccacctcttcaaataaaaaaataactatacctttaggtcatgtttggcttgcaggagataacattgctcactcacttgatagtcgaaattacggacctgttccaatgggccttattaaggctaaagttatagctcgtgtatggccacatccccactggatgtctaacattttgaatgacatagatgtggaataggta

SEQ ID NO: 26242 - DNA, 1296 bp, Schizosaccharomyces pombe
atgaatttgacattcaaaaatctacagcagcagaaatttgttatttctgatgtttctgcagataccaaagtatgataattgtggcatattatttttctaacgtaaacagatttcagaattaaaagaaaaaattcaaacgcaacagaattatgaagtcgaacgtcaaaagttaatttactcaggtatataacataattttaatatgtaaaatactaatttataggtcgaatccttgctgatgacaaaactgttggcgaatacaatataaaagaacaggatttcattgtatgcatggtttcacgacccaaaacttccacctctactccgaaatcagctgccagtcctgcccccaatcctccggcttccgtacctgaaaagaaagttgaagctccttcttctaccgtggcggaatctacctctactacacaaactgttgctgctgctgccccttcaaacccagatactactgccactagtgaagcaccaatagacgccaacacattggcagttggtgctcaacgaaatgttgctgtcgaaaatatggtagaaatgggatacgaacgcagcgaagttgaaagagccatgcgtgccgcttttaacaaccctgatcgggcagtggaatacttattaactggtattcccgaagacattctcaatcgacagagagaagagagtgctgcagcccttgctgctcagcaacagcaaagcgaagcccttgctcctacttccactggccagccagcgaatctttttgaacaagctgctttatcagaaaatgaaaatcaagaacaaccttctaataccgttggtgatgaccctctaggcttccttcgtagcattcctcaatttcaacagctaagacaaattgttcaacaaaatccacagatgttggaaactatattgcaacaaattgggcagggagatcctgcattggctcaagctattacgcaaaatcctgaagcatttttgcaattattggcggagggtgccgaaggcgagtctgccttaccttctggtggaattcagattcaaattactcaagaagaatctgagagtattgatagagtatgttatttctatttttttgttttaactatctaacaagcttttagttatgtcaacttggcttcgacagaaacattgtaattcaggcttatttagcttgtgataaaaatgaagaggtgtgttttttttttttttttgatttattgaattatcaactaacaattgtagcttgctgctaattaccttttcgagcatggacatgaatctgaggatgaaccttaaagcgcgcac

SEQ ID NO: 26243 - DNA, 4422 bp, Schizosaccharomyces pombe
gaatgttgggtttccaataataacggtcattgggatgctgctcgattaatcgaaataaaagataatggaggaggtaaagtcgtagcaactgttgcaaagagcagcggtgttttagaaacagtgaattaccaacagttacaaaatcgaaacatcggtcaatcagagtcgccttctgatttaacgaatcttccttatttaaatgagccatctgtccttcatgccttacataatcgttacaataacaagcaaatttacacatattcgggaatcgtgcttgtctcaataaacccttaccaaaatcttcccgagttttacaacgacaatctgataaaacatttccataaagatcccgaagcagccaaagttcctcacctatactctatagcaagttcttgttaccatgctttaactacagattccaagaatcagactattattgtgtctggagaatcaggtgcaggcaaaacagttgctgctaagtatattatgcgttacttgacctcggtacagggagtagatcataatggtgttgttaaacgctctgttgagaatcaagttctcgctactaatcctattatggaagcatttggtaacgcaaaaactatcagaaatgataactcttcacgttttggtaaatatgttaccataagctttgatgaaaacttgttgattaccggagcaaatgtaaacacatatttacttgaaagatcccgagtagtctctttacttaaaggggaaagaaattatcacattttttatcagctaattactggatgtacagaggaacaaagggataaatggtttcttgagtctgcgtcttcttttaattatttatcacaaggaaattgtgatgaaatatctggcgttgacgacagtaatgactttactataacttgcagagctctttcaactattggtatttcagagtcaaggcaggaggatgtattttgtctacttgctgccttactccaccttggtaacattgaagtctgtgcaacaagaaatgaagcacaaatacagcccggtgatgggtatcttcagaaagctgctttattacttggtgtcgattcatctacgcttgctaaatggattgttaaaagacaactgaaaactagatccgaaaccattattacctcatcaactttggaacatgctattagcataagagactctgtcgctaaatatttatattccgcactgtttttgtggattgttcacatgattaatgcatcacttgaccataacaaagttaaaagagctgcctacaaatatattggtgttgttgatatttatggcttcgaacatttcgaaaaaaattcgatggagcaattctgtattaattatgctaatgaaaaacttcaacaagaatttaataagcacgtttttaaactagaacaggaagaatatgttaaagaaggattagactggcgacttatagaatattctgacaatcaaggttgcatatccttaatcgaagacaaattagggatactctcgttgttggatgaggaatgtcgcttaccttcagggaaccaccaatcgtttttacaaaaattaaataatcaacttcctacaaaacactctcagttctataaaaaatctagatttaatgatggttcatttatggttaaacattatgctttggacgttagttatcaagtacacgattttttagcaaaaaattcggatgccatacctgatgagtttataagtttactacaaaactcaaaaaatgagtttataacttatctgctagacttttatatgcagttggtttcttctcaaaataaaaatcctagaaagactgctataagcaggaaacctacactttcatcaatgtttaaatcttctttgtctcaattaatgacaactgtttcctctactaatgttcattacattcgatgcattaagcctaatgaagaaaagcttccttggacgttctccccgccgatggtgctctcacaactcagggcctgcggtgtttttgaaacaattaggatatcctcgttagggtttcctgctcgattttcgtatgaggaatttgctcatcgattccgcattttgttgtcttctaaagaatgggaggaagataataaaaagttgactcttaatattgttaactctgtaattcctcatgataacctaaactttcaagttggtcgctccaaaatatttttcagatcaaacgttattggaaattttgaagaagcccatcgagctacatgtagcaaatcgacagttttattacagtctgctataagaggcttctttactcggaaggagtatcaaagaactgtaaaatttatcattaaactacaatcggttattatgggctggttaactcgtcaacgttttgagcgagaaaaaattgaacgagcagccattcttattcaagctcattggcgatcttatatccaacgcaaaagatatttgtcccttatcaaatgtgctattgttattcaatcaatagttcggaagaatatcgcatattctcgttatataaatgagttaagggaaagttctgctacacttcttgcaaaattttggcgagcgtacaacgcaagaaaaacttttagaggtttgaagaagtcagttattgctctgcaatgtgtgtcgcgctctgtattaaccagaagatatcttcgcagattacaagattcggcgggcaggactagcattctttatgagaagcaaaagaacctgcaggcttctataaccgaagtatccaaacagttgaaatcaaatagcaaaaaagtaacagttttaaggaataagcttaatattttaaataactcactatcgaaatggaagtgtttaattaagaagcccagtgacttttctgaacccgttagtatggattttactagcaacgatgaacagcttgtgcaacttttgcaagccgaatcaaagcttcggcaagcatctcagcaactttatatggcagccaaaaaatcggagttgggatttgttcaatctcaaactgcccgagagaacttgtcgaattattaccaagctttacagatgacagtttctgaaaaatttgaatatgatactgaacaactaccttcccgtgttcttttttacgcaatggatagatacttctccatccacaaaaaactcaaacagcttcttgaattagttggtgttgaaaatgcatctctcttacctaatgaagttgttaataaacaaactaaagatttattgtatgagaaaagggttgtttttttaaagcaaattaagcaagctctcacggtttcttctttgtttaatgcagttggttacaaagatggtgttatgaggttgttagaaacggatcagaactcactactttttgctggggtagtaaactttctaatttttgcaggtattagccttgatttgaagacacaaatcagtgagtttttgagccaattgtgttcctatttcactaaaatcgttgacggtacagttattgaaaatgataaaactctagatttctatgaaaaacctctacaagcggttttgtattggttcgcaacgttacacaaaattcgttcatttttagtgcatcttttatctattaattcacatggaaagcaaagtgtggtagaggatttatggaatccgttgattttgaaattctcaaaacatttttctaatctggaaaattcatttcattccttggtccagaaactattaagttgttgtaccgagggatcgattaatgctcttttaaattcaaaatgtttaccagagtttatcgatgcggctgatgagaacacaacacctactggaatgaatatttatgagttgatagacagaatgaatttaatacacaaattattaatatcttctgccttgcaaccaaatttattggaattgactatatctcacatgcttcaacatataggacaacgtgcctttcaaacattaattcatgggtaaggcagctatcaaaaaaactatcactaacattctagccggtcaccgtacacttggaaatctgcttctcaggtttcctataatgcctcgctgttgattaactggtgtcatcaaaagggtattagttatgttaactcgtcactattgcctttaatgcagtctcctttggtattttgccttcgtaaaaacgatgcaaacgatttggatgttattctctctgtttgtaatttactttcgccatttgaagttgtatgcctcctaaataggtatcagccatgcgctggtgaaaatcctctaccaaaatccttttcaaaagccgtagaggcattatcttgtaagtataagcaatctggttttacaaatggtaaaatcacaaacactaatgggcacgctattcctatagctgcttctaaaaaccctttattatcacttgaaaataatcatatatacgaagagcttcgactttcagagttgataaacttattggctaaagctacatta

SEQ ID NO: 26244 - DNA, 1338 bp, Schizosaccharomyces pombe
atgatagagtcctgttttaatgtgggaatatgggctacaggtttggctttgttgatgaaccaaggtcaatctccgctactttctaatgttggtctctctgtcttagcatacaaagctacagcaatgttcattcctagagtaggaccctcctttattaaacgaggcttttcggggaaggacatgaataaagtagagaaatatgtaatacctgaaacaatgggagcagtttctgcattggtatattttatgtgtatgattatatttataccggtactattttataagtacttggtacctaatcataacccgaatcttccatccgatggatctgtcgccgaggttgccaaatcccagtttccacatgatcttttgggcgcttatttgtctgccctcctttcaattctgtcggtttctttacttggaattcttgatgatttattcgatattcgatggaggcataaattctttttaccagcaattgccgctatcccattgttggttgtttactacgttgactatggagttacttatgtgtccgttcctagcattgtaagaccatttttaaagagatctcttatcaacttgggttttctttattacttttatatggctgcggttgcgattttttgtccaaacagtattaacattattgctggagtaaatggtgttgaggcaggccaatcgcttgttcttgctcttgttattgcttgcaatgatttgttttatgtactctctcccaaaaataaggatgcattaagagctcatctcctttccctttatctagtcttgcctcttataggtgtcactgctgggcttctaaaatacaattggtggccttcgcgagtgtttgtaggtgatacgttttgctattttgcaggaatggtaatggcagttgttggaattttaggtcatttctctaagacacttatgctcttttttatccctcaaattttcaattttgcgctttccgttccacagctttttggattggttgaatgtccccgtcatcgacttcctaaactaaatgtgaaaactggattgttggaaaactcctacacagaattctctctaaacgagcatcctttacctaaaaagactttgctgactatttctatttttgaaaaattacgattgattcgggttgagtacgatcctagcaccgggcgcccgctcaggtgtacgaactttacaattattaattttgttttgtatcatctgggcccaatgagggaagaccatttaacaatatgtataatgggattgcaattacttaccggaatattcggtttaattatcaggcattttgtcgctcctttagtgtatcctgaagataacata

SEQ ID NO: 26245 - DNA, 1985 bp, Schizosaccharomyces pombe
atggctcaatcttcctactcttctggtaattcaacttcagatttaaacaagattgttttggactatctgtttaaaaagggttattccaggactgaagctatgcttcggttggaaatatccagtgttggcgcaattcctgaagaacagcaagactggcacatcggtgcttctgaaacttatgtacaagtttatattttattaagagattggattgatggtacattagatttgtataagccaaaactacaaaaagtcctttatccaatttttgtacactcttacttagacttactgcaaaaaaatgatcccgaaatggcaatatacttctttgaatcatttcgtatagagcatgaagtgttgcatggctatgacattcgagcattagctcagttgaagattgcatcagacgttgaggagatagaaatagctcagctttatcgcaaaaataaataccggattaatttcacgaggtctacatttgatttactagtacagtttttgttcgaaaacgaagtcaatggaagtggaataataattcgcttattgaatcagtacattgatataaaaattactatgcctcaagtcgagggcaaggaggaccctaatgtgcaagcggtctatgaaatggacgaagctaaaaatgaacagacaataattagtgagcaagaaggaattcctggccattccgaacagcttcttgattacaacaagcaaagcatacaacttggattacgtcccttgtcagaagaagttgtcacaactttaaaaaacttgttagaagtaaaagataaagacgtggagggaagaaatgaagctctgaataaaatattgcatcctgcaaagaaccttgtcgaattgctgactgaaaaagaaaatctaatcaacgaatcaactctagaatcaccatctgatcccccattacctccaaccaaaatgaaggacatagactattttgtttctttactggaaagcgaacagaattctttaatactcggaaaaaatgctacggatcctagtgttttcatgtataccatgcacaatacactttccgctgtaaattgtgctgcattctctgatgacgcctctatgttcgctctgggttgcgcagactcttcaattcatttgtacagttctactaacaatggtccgcaaccattagtgggaagtcaaaatgagcctttacaaaagtcctctttaattggacatacgagaccagtttttggagtgagcatctctcctcaaaaagagtttatactgtcatgctctgaggatggctttactcgtttgtggtccaaggatactaagtccactattgtcaaatatgctggtcataatgcgccgatttgggacgttcagttttcccctttcggctattattttgcaacagcctcgcacgaccaaacagcacgtctatgggatgttgagcatgcagcacctttgagagtatttgttggacatcaaaatgatgtggatgtaaggaactttatttaactaacaattcttatgagcagtaactaaccttgatttagtgtgtttcatttcatccgaatgcagcttatcttgctacaggatctagtgatcatacaactagaatgtgggacgttcgcactggtggaacagttcgcgtgtttaatgcccatcattctcctgtttctgcattgtgtatgtctgctgatggcttatcgttggcatctgctgatgaatcgggcataataaaagtgtgggatctcagaagtagtaatcagcacgtttcattcgttaaacactctagtatcgtttattctctttctttttcatatgataacaaaattctggtttccggaggtgcagatactgatgttaacttttgggatttgacataccggaataacttatcggacggcgaacagtccccgcttttattcaattttaaaaccaaaaatactattatacaaaacttaagttttactcgaagaaactattgtctagcattaagctcttcctaa

SEQ ID NO: 26246 - DNA, 982 bp, Schizosaccharomyces pombe
atggcacctgcaccaccgcctcctcctccagcaccagcgcctgctgctgctgctccggccccccctctaatgaccggagatcgatcagctctgctcaattctatccagaaaggaaagaaactaaaaaaagctacaacgaacgaccgatcggctcccgttgtcggaggaggtgtcgtaggcgaacgtaaatctaacactccaaaaagctttgctgctcctcctgtacccacaggcgcaccctctttaccgacttcttcaaataatactcagcaagcagaagagagaccttccatgcctgcattaggaggtttatttgctggcggcatgcctaagcttcgtcatattggaaagtcaagtgcttcagccgcaccaccttccgctcctgctcctcctactccacaatctgagttgcgtccgccaacaagtgcgccccctcgaccttcaattcctccaccatctcctgcatctgctccacctattccttcaaaggcacctcctattccatcgtctctacctccacctgcacaacctgctgcaccggtgaaatctcctccttcagctccttcattgccctcagcggtacctccgatgccacctaaagttcctccacctcctctatctcaagctcctgttgctaatacatcatcacgcccttcttcttttgctccaccagcaggacatgcacctaacgttacatcagaatctcctaaatttcctaatagaggtccatccattccttcagcttctgttcctccagttcctccatcttcttacgtcttgcagcagcgacctaatcgtggtaagtttgcgatcattaaaagcattatttttttattaacacaaaactctagttgatgatcatggaagattccactttaaggatgatagttacttaccaattcctcatccctttcttggagtccctaaagtttatcggggtggtagtggcactacggtccctttgaatctctcttcattttaa

SEQ ID NO: 26247 - DNA, 741 bp, Schizosaccharomyces pombe
atggccgaaaccgctgaaaaagttattttgttgactggatcctctaagggtattggattggctactgcagaagctctacagaagaaggccaaggttattgctgttagtaggtccttgaccccagaactagaaactttgcttattcaaaatcctgactcatttgttcacgtgaagggtgacgttacggaggttggaaaagctagtatcgaaactgctattaaaaagtttggaaaattggactcggttattctaaatgcaggtgtccttgaacctatagccaaaatcgctgatgcagatatcaatgaatggcgtaagttgtttgatatcaactttttcagtgtggttgaaacagtgaagtatgcaatcccgcatttgcgtaaaaccaagggtactattgtgattgtatcctctggcgctgctgttcgtgtttttcccgcgtgggctgcatattgttgctcaaaggccgccatcaacatgctagtcatgaaccttggcagcgaggagcctgatataatgagtgtggcagtacgtccgggagttgttgatacccctatgcaagttagtatccgtaatgattccaataaagaagccatgggtggagatactcataattttttcaaagaacttaaaacatccggtcaacttgtggctcctcaggacatcgccaaagctctttcttttctagccttgaataacaatccaaagcttactggtcaattcgtagaatggaaatcatttgtc

SEQ ID NO: 26248 - DNA, 7005 bp, Schizosaccharomyces pombe
atggagtattttagtgatctaaaaaacaaaaatgaaagcattcaactagcagccgctgatcaattaaaagaatttgtacatagttctactaaggaattatcaggtgaatcccttgcgcgtttcaataacgatatcaatcgtcgaatttttgagcttattcatagccatgattcccacgaaagatttggaggaatccttgcgataggcaagctaattgaattcgaaagtgagggagatgttactaatctttcgcggtatgcaaattacttacgaatgacccttcctagtacggattggcattcgatggaactatctgcgaaggttcttggtcatttggctgcgtctggtggtacccttgcagccgaattcgttgaatttgaagttcagcgtgctttcgagtggcttcaaggagaccgtcaagagcaaaaacggatggcggctattttaattattaaggctttagcacaaaattctcctaccttagtttacttgtatattagtgaaattttccaaaatttgtggactggattgcgtgatccaaagcctcttattcgggaaactgctgctgatgctttgggtgcttctttagacgtggtttgtcaaagagaagctaaagttcaattgcagtgttttaatgaagttctgcttcaagctgaacatggtttacgacagtcgagtgtggaatatctgcatggaagtcttctcgcatacaaagagcttttcgaaaaatctggctcttttattcgtgaacattacacagaattttgtgatttggcgcttcgtttacgagagcatagagataactctatcagacgctgcatagtatttttactgcctacattgtctgaatataaccccaaaaaatttcaacagcgttatttagattcttttatggtttacttactttcccatatcaggaaagacaaggaaaagtctttagcttttgaagctattggaagaatagccatggcagtcaatgaagcaatgattccttatttacagaatattttaaaagtaataagggatacattgacagcaaaagtacgtgaaaaaacgcaatatgaaaagcctgtttttgaatgcattggcatgttggctgctgctgtaaagcttgaactccttgaagattctcgaagtctacttggtctgattttttcttgcgaactgagcgttcacttgcgtcaagctcttgtgaaaatggcagaaaacatccctcctcttttggctcctattcaagaacgattattgaatatggttagtcaaattttgactggaaaaaactttgaaattcgtactaatgacacatatactcccagtttcactaatatatactctgctagggaacctgaccaaagaagtaaaagcacggaatcaattattttggctttagaaactttgggtacttttaattttactggttattcattaattagtttcatccaagaatctgtcttatcttacttggaaaatgataattcagagatccgtattgctgctgcacgaacttgctgtcaggtttttgccagagatccgatatgtagaaaaacaaatcctttggctgttgaatcagtcgctgaggtgcttgaaaagctattaacccttggaattgcagatagtgatccaaaaattagggaaaccgtactctcattactagatgaaagatttgatcggcatttggcacatcctgataatattcgttgcttatttatcgctctgaatgatgaagttttttcaatcagagaaattgctatcattattataggaaggcttgcattgtataatccggcccatgtgatgccatcgctacgaaaaactattattcagttattatctgacatggaatattcgggtaatagtcgtcaaaaagaagaaagcgcacagcttctcaaattactggtatccaaagctagaacactcattaagccatatatccaatcgatcattcatgtaatattaccgaaagcagcagatacgagtcctggagtttcatctgccattatatcagctttaggtgaactcgcaagtgttgaaggagaagatatgcctgtggatgttcgtggttccttcatgaagttaatacttgtgaatttacaggatcaaagctctacattgaagcgacttgcttctcttaaatgtttacgaaaactttgtggtcgttcaggttatgtaattcagccatatttagattaccctcctttgttgggcgcgctaattggtattttgcaatcagaacaaccaacaccgataagaagagaagtactgagaacattaggtgtgttaggtgctttagatccatatacgtatttaactactgaggaagtttcagatgatttacaaagtagtcataataatgcccatggtgtacctcaaattagtgccgcgcagtacccgtcattggaaaactacgctatggttgctgttgtcactttgataggtattttaaaagacagttcgctctctatgcatcactcttctgttgttcaagcagtgatgcatatttgctctcaaatgggatctaaatctactgtatttttacctcaagtggtaccaacgtttctacaagtaatgcaatccttatcggcttcctcggctgagttttattttcagcagttaacgactttaacttctattattggaccaaacattagggattatgtatctgatatttttaatctttcaaaagtcttttgggaatctaccacatctctattgctagttattcttgaactcatcgatgccatagcaattgcactgcaggatgaatttaaattttacttgcctcaaatattatcttgtatgttgaaagcattttcccttgataatacgtcttcccgttccgtttcatacaaagttttacaatcatttgttatatttggttctaatattgaagaatacatgcatcttgttctaccagttataattagaagttttgagcgtgatactataccccttggattcaggaagagtgccctcaaatgcattgcccaattatttcaatctgttaatttctcggatcatgcctctcgaatcattcatccattggttcgcatgctagggaaatctaatggcgatttgagagcagttattatggatactctttgtgctatagtatcgcaacttgggtatgattattcgatttttataccgatggtgaataaagttttggttagtcacaagataagtcatccggcttacgaacttttggtttcacgacttttgaaaggtgagcctctacccaaagatgtcgtagtaaaggagtttaagccgaggccctcaacaaagcctttttctacacaagatgaagtcttgacaaagcttcctgttgatcaagcatccttgaaagcagcatgggaatcatcacaaaaattgacaagggatgattggcaggactggataagaagaataagtattgaacttctgaaggaatccccttcttcggcacttaggtcttgttcgaccttagctggtatataccatccattggctcgcgatttatttaatgtcagttttttgtcttgttgggatgagttaactgaaagcaataagaaaaatctcgttaaatcaatagagctcgctatgaatgcccctaacatttcagtagaaatattacagactctgttaaatcttgctgagtatatggagcgtgaagatcatacattaccaattcctatcaaagtaattagtgctcatgcatctaagtgtaatgtttatgccaaggctctgcattatacagaattacaattcgttcaagagacgaaagaggaagttagcattagcactatcgagtctctcattaccataaacaatcatctgcaacaatccgatgccgctgtaggtatgcttcaatataccaaagaacacaagcagtttagtttgaaagaaacttggtatgaaaaattacatagatgggatgatgcattagctgcatatgagcatcgagaacgtgaaggtgactcgtctttcgagataaatatcggaaaattacgctgttattatgctttgggtgactgggatcacctttccgaattggcacaaaaagcttgggtaacgtctgaacaagaacatcgtgaagctattgctccacttgcagctgccgctgcttggggtttgggtcaatggaatttaattagtgaatatgttagtgccatggaccgtgacccacaagataaagagtttttttccgctattagtgctgtacatcttggtcaatacaataaggcgtatggccatatcgagagacatcgtgatatattagtaaacgacctttcttccataatcggtgaaagctataatcgtgcatatggtattatggtcaaatcccaaatgctttcggaacttgaagaaattattgactataaaaagaatatgcaatatgaaaacaatttggactctcttaaaaaaacgtggcggaaaaggcttgaaggatgtcagaaaaatgtggatgtttggcataatacgcttcggtttagggctctggtattgtctccacaagattctcctgaaatgtggataaaattagctgatctttgccgtcgttctgaccggttgaagctttcaaatcagtgtctcacatatttgatgggtcgcgatccttcaaatgcttacccgcttgactcacttaagcttctcaatcctcatgttgtatatacgtatttaaaatatttgtgggctacagatcaaaaaaatattgcggtatcggagctcgaagagttcacctcatatctatcgtcaaaacatgggtataaaatgggtgattcttcaaagttggttgatattttagcctcatcatctgtaagttcggaagagcgttcgtttttagcaaggtgttttcataaacttggcaaatggaaaaagtctcttcaagatagtgttaatcaagaaagcgtaagggatattttgaattgttatttttatgctactttgttcgataaatcgtggtataaagcttggcactcttgggctctcgcaaatttcgaagtcgttggttattatgaacagactgaacatggggttacccaagatatgtatgaacaatatattgtacctgctattaaaggattttttcactcttctgttttaaatcaaaaaaactcacttcaggatatattgcggttacttaatttatggtttaaattcggtgagcacagcgacgtagcagccgcaattgttgaaggattttccaatgttccaatggatacatggttagaagttataccacaactaattgcacgaatacacacttcaagttcttcagttagagcatctgttcatcagttactttccgatattggtagggtgcatcctcaggcattggtgtattcacttactgtgtcctccaaatctacaaatccgcagcagaagcattcagcaaaatcaattatggatagcatgctttcgcatagtgatacgttggttcgtcaagctctacttgttagtcaagagctaattagagttgctatactttggcatgaattatggtatgaaggattagaggaagcttctcaagcttatttttcagatcacgatatatctttaatgattgatattgtgaaacccctgcatgaaacattggagaagggtccttccaccttgtctgagatatcatttgctcagacatttgggtatgatttacgtaaagctagaagttactggcagaaatttttgcaagatggtgaccctacggaattaaatcagtcttgggatttgtattatcaagtctttagacgtattcaaaagcaattaccacggattaagcatttggagctacaatatgtttcccctaagttattggatgcttgtgatttggaactagctgtgcctggaacctatggtcataacaaaccggtcattcggatctcgcatttccatcacactttcgaagttatttcttctaagcaaaggccaagaagattgacaattcatggtagtgatggcaaagattatcagtatgtccttaagggtcatgaagatttgaggcaagatgaacgagttatgcagctttttggtttatgtaatacgttactgactacggattctgagacattcaaacgacgtctgaatatagagcgttatacagttattccgctatctcccaattctggtttgctggggtgggttccgcatagtgatacattacatttcctgatcaaagagtttcgctcaaagcgtaacatattgttaaatttagagcatcgcatgatgcttcaaatggcacccgactgcgacagtttaacattattgcaaaaactagaagtattcgaatatgttatggctaatactgatggttatgatttgtatcatgtgttgtggcttaaaagtcgaagttcagaagcatggcttgataggagaaccagctatactcaaagcttggcagtcatgtcaatggttggatatatacttggacttggtgaccgacatccttccaatctaatgatggatcggtattctggtaagatcattcatattgactttggtgattgttttgaggttgccatgcatagagaaaaatttcctgagaaaataccgtttcgacttactcgaatgcttattaatgctatggaggttagcggtatccaaggtacttacaaaattacttgcgagcttgttatgcgtgttttaagatcaaatacggagtctttaatggcagttcttgaagcatttgtctatgaccctttgattaattggagacttatgactaaaagctctttcggggcttctacgacactccggcctacctcaagtagtgtagaagagaaaggaaggtcctacactcatcgtgcgcgtcacgctgattatgcagctcttagtgaaacaaatggtgtaaacgccgaaggactcaacgagagatctattcaagtcttgaagcgtgtctcaaataagctaactggtaaagatttcgatttgaaagagcaattgccagtcaaagcgcaagttgaaaagcttatccaacaagctacagctcccgaaaatctttgccgttgttatgtaggatggtgtagtttttgg

SEQ ID NO: 26249 - DNA, 1098 bp, Schizosaccharomyces pombe
atgattcgtcttcaaaagtttggtgaaattgttgggaccagtcgttcttggaaacttcttagttcaaccatcgcaaagcgctattcttcttcttccaatggagtgaaggaaatgaccgttcgtgatgctttgaacagtgcaatggaagaagaaatgaaacgtgacgatcgtgtcttcttgattggcgaagaggttgcgcaatacaatggtgcttataagatatctagaggtttattagacaagtttggtcctaaacgtgttatcgacactcccattactgaaatgggttttactggtttggcaacaggtgctgcttttgctggtttacgtcctatttgtgagtttatgactttcaatttttccatgcaggctatcgatcatatcgttaactcggccgccagaaccctgtacatgtctggtggtattcaggcttgtcctattgtcttccgtggacctaatgggcctgccgctgcagttgctgctcagcattctcaacactttgctccatggtatggtagtatccctggtcttaaagtagtttctccttactcagcagaagatgctcgtggtttgttgaaggctgctattcgtgatcctaatcccgttgttgtacttgaaaacgaaattctttatggtaaaacctttccaatttcgaaagaagcgttgagcgaggactttgtgcttccctttggccttgctaaggtggagcgccccggtaaagatatcaccatcgttggtgagtctatttctgttgttactgctttagaagcagctgacaagctcaaggctgactatggtgttgaagctgaagttataaacttgcgtagtattcgtcctttagacatcaatactatcgcggccagtgttaagaagacaaatcgtattgtgactgttgaccaggcatatagtcaacatggtattggtagtgaaattgctgctcaaattatggagtctgacgcatttgattatcttgatgctcctgttgaacgtgtaagtatggcagatgttcccatgccttatagtcatcctgttgaggctgcttctgtcccaaatgccgatgttgttgttgctgctgctaaaaaatgcttgtatattaaa

SEQ ID NO: 26250 - DNA, 747 bp, Schizosaccharomyces pombe
atggcctcttgctgtccaacaagtcgtggtgccgcagcttctaacaagtcctatacctttaagggtaaagaaattgaaaactttggaggattgaccacctatgttgttggatctacttccaatacccgtgttttgattggtttcatggatatatttggtctctctgatcaaattaaagagggtgctgataaattggcagatgatggctttaccgtctacttacccgatttcttagagggaaagccgttgccagttactgctttaccccctaagacgccagaggaccaaaagttatgcaatgattttttttctactagaatttctcctaatttgcactggccgaaacttgctaaagttgtagaagctgtgcgcgctaaccatggaccaaatgttactattggcacttatggattttgttggggtgctaaagttttggtcacttatcccgctacaattgatttcgttggaattgctagctgtcacccttccttccctgatagcgctgatgcagccaatgttcattgtcctgtattgtttctttgctctaaagacgaagatgctaaaatcatcaaagaatgggaagaagcgttcaagacaaaccccgcttatgccaagtcttccttcgaaacattcagcgacatgttccatggttggatggctgctcgcgcagacctttccaaccccgaacaaaggaagcgctttgatgaaggctaccaaaaggtttcttcatttttccaatctttaatg

SEQ ID NO: 26251 - DNA, 1512 bp, Schizosaccharomyces pombe
atgtcgaaaaattcgttttcttcaatggcgaactctgtcacgtcgttttttcaatcgttaacaactcctaatcgtcatgctgatccctcttttcgtccttctcgtcgtgaaaaacaatcccgccttcctacacctcttcaatctgttgctgcttctgcttattcaggtgtcaatgcaagccaaaccggattgttgaacgatagcagggctaattctgttaccaatttacctaactcctctaacacctctcaggttggtttgaataatattagtccagctccggttggttatgttcctggaagtaagaccaatgaacttgctaataattctatggaaatgcaagagattagccccaacggttcagcctccttgccgcctccagtctctgagtcctggagacgtattgatcgttgggctgaagaaaattattatgagctttattgccagctatgttatggagctaccgttgctgatgtcgacagtcttgagtatgaactcgagtgcacgcttcctcgagatgtacgcgaaagtttatacatccatgatggtcaagatagaggtggacaacctaccggtatattatttggcgttactttgctcgatattgaagaaatcgaagaggaatctgaactatggcgtcgtgttgctcaatcctatgcagaagctacacttgctggcaaaattgatcaagcggttgcctctcgtcaagcttctttccctcctggtgcggttcaatgcgtgtatgctcatcccggctggattcctcttgcgaaggatttcgtgggtaataatattgcgatcgacctagctccgggccctgctggtcaatggggacaagtcattttgttcggcagagatcaggacactaaatatgttgttgctcgctcttgggcagactttttagcaattgtagcatacgatatggagaatggcaagtggttagttgatgaagatgacaactctttacgcttgatttatggtcctcctcgtgaacaatggtcatatctcgatatccttaagtatagagctcgcaaggcagagcgtaggaaattcaagaagcgtgatggtaagcgaactactcgtcccattccgaaatccattgccaaggaagacgttacgaacagtgcgaatagtactgcaccatctacgggtaccactgttcttgatgacggtttagataataattacgaagatattcctttatatggtccttctaaggatgaagaactaattaagaaggaagaattagaagcagacacagatcttggtttaattaatacatctgagattaatcagcctgcgaatctccccgatgaaccaaccgctgagacttctaatcctgtttcagctaccactgttgaagcagtaactacaactgctgataacaaggatgaagagaaaaatgatcatgtaacagaagacgtgtcccaaaacagcactattgccgaagctagttctcttcaagctcaagaagaggaaaaagaaatagagactacaagtgtgaagcaagag

SEQ ID NO: 26252 - DNA, 1571 bp, Schizosaccharomyces pombe
atggacttctattcagtgaagtctcagccgtttgttcgatctcctctagtcgaccaaaatcccagtatacaaaatataaacgaagaagtaaagagagatattcaaaatcctcttagctataaaacagaaacttcggacaaagaactgtgtcaaactgcagcttgcgcaacttcatgctccgactggtaccctcaacaacaaacgcacatgcctcatcaaaatgcctttgactctgctaaagccacagcaaagatggctctcccacccactgctttttcaaactactgtgtaaaaccttccctaacgcgaaacaaggatataccaagaaccagcattcgagtttccaaacttcgttactggcaaagagattatcgattggcgtttcccaactttatattttactttgacaacgttgatgaggaaatcaagcgtcgtgttacgcaaaagattaataatcttggagccgtaagtagttcatgcaagaacttgcgcagatcaaaactaacacatatatagaaagtagcaacattatttacttttgaagttacacatttcattaccaccaggactaccgacccagaaatgtgccagccgaatgatgtactttacctttcgaaaactgccaatatgaaaatttggctcctggacagtaagtcttcttaatatatcagtgtaaccttcgctaactttcttagaactattgaacagaatcctctttacattactcaactctgatagcctggttaatacctcagcttcgtgcttgcaatctctcctagacggtgaaaaagtgtatggtacatcagacaaagacttttacgtgccaagcaaaaacgtcgagtactttcgtgaatacttcctctgcattagagatttatcacaatactataagccaattgcagtacgagaatgggagaaaacattggattctggagagatcttatggccaagtcttgctataaccgcacaaggaagatgtccatttaatactggtagaagaagggagttaaaaatcacaaaacataaccatccagctcacgaaatcagaaaacagctcttaagttgcactaatcaaactaaccaaaataacgttgttaaaaattcagcgagtgtgttggtgcgtcaaatcatgggggactataatatcacagaatcagcagttgatggtgcaaaacaaatgccgacagagtttccaaagccagaaaacctcttaccggtagagaaacgcgccgcaatgtctccacttaaccttcttgaacctcgtttaataaacaaacaaaacaccttggctaaccaaagtcctcgacaaccacctaatgccttcgatgcagatcctctagctcacaagaaggtgaaaatcgaaacaaaatcaggatattgtgaaaactgctgtgagagatacaaggacttggaaagggtaagttaaaccaatcatagcaaaaacagcactaacacatcgatagcatttgggcggaaaacatcatagaagatttgcagagaaagatgaaaatttccagggtttagatgatttgtttttgctaatccgacgcccaattcggacaaattaacgt

SEQ ID NO: 26253 - DNA, 1975 bp, Schizosaccharomyces pombe
atgttagctcttaaacttcaaaagaagtatccggagctcactaatgaggaaattctaaccttaaccgaccaatttaacaaacttgatgtggatggaaagggatatttagatcaacctaccactattaaagcctttgaagattcaaagaagggttcttacgatgaggtccgtgaagcaattcgtgaagttaacgttgattcgtctggacgtgttgaacccgaagactttgtaggagtaagtaatgttttccgtaattttcacgatatgtgtctctatatcgcttcatcaattggattactaatgcatatagattttcaatgttttaaaaaaaggtgtagaaggtactgaagtaaaaaagggtcggattactatcaaaggatcttcctcaagtgtttctcataccattaatgaggaagagcgaagagaatttatcaagcatattaattccgtcttagctggagaccctgatgttggttcccgagtccccatcaacactgaaacctttgagtttttcgatcaatgcaaagatggtttaatcctctcaaagttaattaatgacagcgttcccgacaccattgatgagcgtgtactcaataaacagagaaataacaagcctcttgataatttcaaatgtattgaaaataacaatgttgttattaactccgcaaaagctatgggtggtatctccattaccaacattggtgccggcgatattttagaaggtcgtgaacatttgattcttggtcttgtttggcaaatcattcgccgcggtctccttggaaagattgatattactttacatcccgagctttaccgccttctcgaagaggatgaaacccttgaccaatttctccgtctccctcctgagaaaattcttctccgctggttcaattatcacttaaaggctgccaattggccgcgtactgtctctaacttctcaaaagatgtttcagatggcgagaattatactgtgctgctcaaccaattagctcccgaactctgttcacgtgctcctcttcaaactacagatgttttgcagcgtgctgaacaggttttacagaatgctgaaaaattggattgccgcaaatatcttacacctaccgctatggttgcagggaaccctaagcttaaccttgcctttgttgctcatctctttaatactcatccaggtttggagcctttaaatgaagaggaaaagccggagattgaaccatttgatgcagaaggtgagcgtgaggcacgtgtttttaccttgtggttgaactctcttgatgttactccatccattcatgacttcttcaataatttacgagatggcttgattttgttgcaagcttacgataaaatcacacctaataccgttaactggaaaaaggtgaacaaggcacctgcatctggagatgaaatgatgcgtttcaaagctgttgaaaactgtaattatgcagtggaccttggaaaaaatcaaggtttttctttggtaggaatacaaggtgctgatattactgacggttctcgtacactcaccttagcattggtttggcaaatgatgcgtatgaacattaccaaaactctacatagtcttagccgtggaggtaaaactctttcagatagtgacatggttgcgtgggccaattctatggctgctaaaggtggtaaaggttctcaaattcgttcattccgtgatccttctatttccactggtgtgttcgtcttagacgtacttcatggaattaagagcgaatatgttgattacaatcttgttaccgatggttctactgaagaacttgctattcaaaatggtatgtatatatatttgatatatttttaattttcattactaacacatcgtttagctcgtcttgctatttctatcgccagaaagttgggtgccgtaatctttattttgccagaagatattgtggccgttcgtcctcggttggtccttcattttattggcagtttaatggccgtataa

SEQ ID NO: 26254 - DNA, 2364 bp, Schizosaccharomyces pombe
atggaacccattattgcgttgctgattggcaatggcggtcgtgaacataccatcgcatggaaactttgtgagtctcctttaatttccaaagtttacgtggcgcctggaaatggtggtactgcaagcaatggagcggaatctaagatggaaaatgtaaacattggagtttgcgattttgagcaacttgtcaaatttgcgcttgataaagatgtaaatcttgtcattcctgggcctgaactccctttggtagaaggtattgaaggtcattttcgtcgtgtgggtatcccatgctttggtccatctgcattagctgctcgtatggaaggtagcaaggttttttctaaagattttatgcatcgaaacaatattcctacagctgtatataagtccttttccaattatgatcatgcaaaaagctttttggatacatgcacctttgatgtagtcatcaaagctgatggacttgctgctggaaaaggtgtaatcattccgaaaactaaaaaagaagcctttgaagctttagaaagcatcatgttaaatgaagagtttggatctgctggtaaaaatgtggttatcgaggagctgttggagggtgaagaattatctatcttgacattttctgatggttatacttgtcgttcgcttcctcctgctcaagatcataaacgtgctttcgatggtgataagggtcccaacactggaggtatgggttgctatgctcctactcctgtagctagccccaaactacttgaaacggtccaatccaccattatacagcctaccatcgatggaatgcgtcatgaaggttatccattagtaggtattttatttactggattaatgcttactccctctggcccccgtgtcttggagtataatgttcgttttggtgaccccgagactcaagcagtattaccccttttggaatccgatttggctgagattatccttgcctgtgtgaaccatcgcttggatgctatagatattgtcatttcgcgtaaatttagttgcgctgttgtttgcgttgccggtggatatcctggaccatataataaaggtgatatcattacttttgatgccctaaaagacaaaaatactcgtatttttcatgctggtacctcaatccgtgatggcaatgttgttaccaatggaggacgtgtacttgctgtggaggctacgggagattcagttgaggctgctgttagattagcttacgaaggtgtgaaaactgttcattttgataagatgttctaccgtaaagatattgcccaccatgctcttaatcctaagagaaagacacgcgaaatccttacttatgagaattcaggcgtctcagttgataatggcaatgaatttgttcaacgtatcaaggatttggtcaaatctacacgtcgtcctggtgcagatgctgacatcggtggttttggcggtatttttgacctcaaacaagctggctggaatgatccattgttggttagtgctactgacggtgtcggttcaaagttgttaattgctcttagccttaataagcatgatactgttggaattgatttagtagcaatgaacgtcaatgacttggttgttcagggtgctgagcctttgatatttttggattattttgctaccggttcattagatttgaaggtttctactagtttcgttgaaggtgtcgtcaagggctgtaagcaagcaggttgtgctttagtaggtggtgagacatctgaaatgcctggtttgtatcatgacggacattacgatgctaatggaacctcagttggagctgtctccagagatgatattcttcctaaacccgaaagtttctctaaaggtgacattttgttaggtcttgcttctgacggcgttcattcaaatggctattctcttgttcgcaagattgttgaatatagcgatcttgaatatacttctgtctgcccttgggataagaacgttcgcttgggagattctttgttaatacccactcgtatctatgttaagccacttttacatgtcatcagaaaaaatattgtaaagggtatggcacacattactggtggtggtcttgttgagaacgttccccgtatgcttcctagtcatctcaatgccattatagacgttgatacttgggaagttccagaggtattcaaatggctgaaagatgctggaaacgtacctatttcggatatggctcgtactttcaatatgggtatcggtatggtggttgctgtcgcttctgaagatgctgaagaaaccatgaaggaattaacgtccgtcggtgaaaccgtttaccgcattggtcagcttgtggataaagaaagcagcagtgagcgttgtcatttggtgaacctgaacaaatgggaaacattt

SEQ ID NO: 26255 - DNA, 5067 bp, Schizosaccharomyces pombe
atgaatattgcacagccagtctcttcggagattaaaagtgtgaagtttgggatttacgatgttgacgatgtcgaaaaaatatccgtcaaacaaatcgtaaatcccgttttgcttgacaatttaaatcaccctactaacggcggattatatgaccttgctttgggtccatatctaaaaaattctgtttgcgctacatgtcatttggatgaaagatactgccctggtcattttggtcatatagtacttcctattcctgcatatcaccctctatttttttctcaaatgtacaatttattacgttcaacttgcttgtactgccatcatttcaagctttcaaaagtcaaggttcatcttttcttttgtagactcaagttgcttgattatggtcttttaaatgagtcagagatggtggagaatgtcagtcttactgaggcaatcataaagaattctaacggcactccacttgaagatggaagtgacagcgaggacagtggtcttggacacgatgatattgctaaagatgctgcaacacttatgcgcattcgcgatgaattcgttgctaagtctattgctgactcacgccagaacgctcatatcgatgctcagttgactacacttcttttacacgagaggaaaaaagttgtgcgtgccttctaccatgccatttcatctcgcaaacaatgtgataattgccagtctttttcccctaactttaggaaagaaggctttgctaaaatattcgagattccattgagtggaaaaaatctccaatttatggagcaaaccggaaaaattcgttctgacgttcttcgtgatactagtaaaaagcatcatgaagatgagggatatgatggagattctgattcgagtaatgaaagtgaagtagaaggaatagatctctttgaagaagatcctaatcctttgaaaaataaatcaaaatctccaattgctcatggagccaaatatatgacttctactgaagtccgtaaccatcttcgccgtctttttgtaaaagaaaatgttgtcctttctcgtctttatgctcataaacgcggaaaacctgcctctgctgatatgtttttcctccaaaatattgctgttcctcctactcgcttccgtccagcttccaaaatgggcgatgaagtacatgaaaatatccaaaatgaacttctgaccagaattttacaatcctcaatacaaattgcttctctctctaaagactctacagttgaagtaaatcctgatgagaaagaaggcttggagcgtcgttctcgtgcttttgaactgttgattaacgcttttgttcaactacaacacgatgtaaacagcctgattgatagtaataggaatcctagttctggaggacagagtagaacagtacccccgggtattaagcaaattttggaaaagaaggagggtcttttccgtaagcatatgatgggtaaacgtgtgaattatgcagctagatctgtcatttcacctgacccgaacattgaaactaatgaaatcggtgttccgccagtctttgctactaaactcacatacccagaaccagtaactctttacaactttaacgagatgagaaatgcggttattaatggtccccataaatggcctggtgctagtcatattcaaaacgaagacggcactttaatttctttaatgcctttaacaattgaacaacgcactgctttagccaaccagcttcttacacctcaaagcaatttaatatcttccccatattcttattctcgcttaataaatactaacaaaaaggtttatcgtcatgtcagaaatggagacatgttgatattgaaccgtcaacccacccttcataagccttcgatgatggctcataaagctcgtattcttccaggtgagaagacgattagaatgcattacgcaaattgcaactcttacaatgctgatttcgatggcgacgaaatgaacatgcattttccacaaagtaccaatgcgcgttctgaggctcaatttattgcaaacacagactctcaatatttggtgcctacctctggtgatcctttgcgcggtcttattcaagaccatgtcgtaatgggtgtttggcttacctgtaaagatacattttatactcgagatgaatatcagcaacttctatttcaggctttaaagcctgatgaaaccggtatgtatgggcgtatcaaaactcttcctcctgccatacaacgtccgggtatatactggacaggtaaacaaataatatcttctgttttgctcaacctaaaacccagtgatcgtcctggtcttaatcttaaaagcaaagcaaaggttccaggaaaatactggtcacctgactcagaggagggatcagtattatttgatgatggtgaacttttatgcggtattcttgataagtcctcttttggtgcctcggcttttggcttagttcactcagttcatgaattgtacggtcctgacatcgctggtcgcttgctttctgttttaagtcgtctattcactgcgtatgctcaaatgcggggctttacttgccgtatggatgatttgagacttgatgagcaaggtgataattggagaagacaactattggaaaacggaaaatcctttggacttgaagctgccagtgaatatgttggcctttcaacagattcgccaattgcgcttttgaacgctaaccttgaggaagtttacagagatgatgagaagttacaaggtttagatgctgctatgaaaggtaaaatgaacgggcttacttcctcaattatcaacaaatgtatccctgatggtttacttacaaaattcccctataatcatatgcaaactatgaccgtttctggtgccaagggtagcaacgtaaacgtctcacagatttcttgtcttttgggtcaacaggaattagaaggacgtcgtgttcctcttatggtgagcggaaagtcacttccttcctttgttccatatgaaacttctgctaagtctggtggttttattgccagcagatttttaactggtatcgcccctcaggagtattattttcactgtatggctggccgtgaaggcttgattgataccgctgttaaaaccagtcggtctggttatcttcagcgttgtctgatgaagcatctggaaggtttatgtgtacaatatgatcatactgttcgcgattccgatggatctatcgtccaattccattacggagaagattctttagatgtcacaaaacagaagcacttgacacaatttgagttttcagccaaaaattataaatccttaattcagaaatacaaggtcaaatctgtcttatcggcggttgattccgaaactgcatcctcttacgcgaagaaagcgttgaaaaagccgtacaaatatgatccagtattggacaagtatccccctagtcgatatttgggaagcgtaagcgagaagtttcaacgtgctgttgatgaatatacccagaaaaatccggacaagttgattgcttcgaagaaagagagcaagcttgatgattctcttcttaatgaatcaaagttcaaggcattgatgcagttacgttaccaacagtctctggttgatcctggtgaaagtgttggtgtattagctagtcaatcaatcggtgagccatctactcaaatgactttgaacacattccattttgctggattcggtgctaagaatgtcacattaggtattcctcgtttacgtgagattatcatgaccgctagtgcaaatattcaaactcctacgatgactcttcgtttgaatgacggcgtttccgataaaagagcttcagctttttgtaaagaagtaaataaattggttttatctgaagttgttcgacaagtccgagtaactgaaaaaatttctggtcaaggctctgacgaacaatctaaaacttatgctattcgacttgatttatattctcgtgatgaatatcaggatgaatatggtgttcttcaggaagagattgagtcgacctttagtaatagattcttaaaaattcttaaccgaattattaaaagctatttggctaaatctaagcagcggaagtcaggaggtaaagatgatacagtacctgaggttggtcaggcattaaagccacttgaagatatcgatgaagcacccattgaaggtcgtgctcaagaagctctcgaagatgaagacaatgatgctaccaatgagaaaatggtctctaggtcgaaacagcatgcttcttatgaggggcctgatgaggcagacaaagtcgcccttcgtcagctaaaaggatcaaataaagttgaagacgtaaacatggatgaagaggaagatgagggtttcaagtccgatgaaagtgtctctgattttaaagaaaggaaattgttggaaaagcagaacacagtttccatttcggaaaggcgggaacttcagttaaagacagcaaaagaaatactcagcaattgcaaacacctcgactttgattacgttaacggtgagtgggcaactgttgaattggtgttcccaatcaatactgaaaagctattaatggtgtcacttgtggaaaaggcatgttccgaaactgtcatacacgaaattccgggcattacacgctgtttttccaaacctccagactctgccttagacactgttccgaaggttatcactgaaggtgtcaatctgaaagcaatttgggaattttacaatgaaatctccatgaatgatatttacacaaatgatattgcagcgatccttaggatatacggtgttgaagcagctcgtaatgcgattgttcatgaggtttcctccgtttttggagtgtatggtattgctgttgatcctcgtcatctttccttaattgcagattatatgactttcgagggaggatacaaagccttcaatagaatgggaatagaatataacacttctccatttgcgaaaatgtcttttgagaccacttgtcactttttgactgaggccgccctccgtggtgatgttgatgacttatccaatccttcatctcggttagtcgttggtcgagtcggtaactttggcaccggttcttttgacatattcacccctgtagtcgattctcctgcaaac

SEQ ID NO: 26256 - DNA, 906 bp, Schizosaccharomyces pombe
atggctttggggactaagcacgtactccatctcacaaaaccgtcttccaggtcaagtcctttgaacattgtcattgaaccagcagtgcttttttctatccttgaccattcaacccggaaaagtgaaaataatcaacgtgttatcggtacacttttgggaacacgttctgaagatggccgagaaattgagattaaaagttgttttgcagttcctcataatgagagcagtgagcaggtagaagttgaaatggaatatcatcgtgcgatgtaccatttacacctcaaggctaaccctcgtgaagttgtcgttggttggtatgctacttctcctgatttagatgctttcagtgcactgattcaaaatttatatgcttctcctgctgaacccggaactgctccactaggaacgtatcctcatccctgtgttcaccttactgtcaacacagatgttagcagtccccttgccatcaagacttacgtttcttcaccagtaggtattacagagcgccttgctgacagctgtgcattcgtccctaccccttttaccattcgtgatgacgaggcagtccgttctggtttgaaagctgtagctgctcctaagaatgacccatctagacttgctagcctattcacagatctccagcaacttcgaagatcaaccttggagcttttatctatgattgaaagagtttccgattatgtgcaaaacgtaattgatggttcttcgcctgctaatgttgctgtcggtagatatttgatgaagtgctttagtttaattccttgcgtagaaggccaagattttgaaaaaattttttcatcacatcttcaagatgttttggttgtagtttatctcgcaaataccttacgtactcaagtggatattgcttcccgtcttaatttgcttccc

SEQ ID NO: 26257 - DNA, 962 bp, Schizosaccharomyces pombe
atggccactactgtgaaagatactatgaatgttgacattaatgctattaaaaaggggtatgattgcgggaaattgattttgaaagttctgactttgtagagaaattcgtatgggtaccaccatcacggcgctccgttataaagatggcgttatacttgctgcagattctcgaacaactatgggtgtgtattggaatatcagaacttttcgttctttgatttctaacgttgctaggtgcatatattgcaaatcgtgtcactgataagctgactcagctgacagacaatatttggtgctgtcgcagtggttctgctgctgatacgcaaactgtggctgatcttctaaaatactatctttccatgtatcggtaagttacccttgaatgaaccgaatgactgtaaattaaggctgctttagctggtttatcctttagaataaactatcgacttactctcaagtccttatgtttactagatgattactaaagcctttttgcatgttttatttttcattttattgttgttaaaaaaattatctaacgattatgaagtattcaatttggccatgaccctagtgttcatacagctgctactttagcttctgaaatgtgttatcaaaacaaaaatatgcttagtgcaggtttaattgttgctggatatgatgaaaaaactgggggagatgtttacagtattccgttaggtggtagtttgcataagcaacctttagctattggaggaagtggttctgcttttatttatggattttgcgatgctaactttcgcgaaaatatgacccaagaggaggctgttgaatttttaaagaacgctgttgctttagccatggaacgcgatggcagcagtggtggtaccattcgaatggtcattttaaataaagatggaatggagcgtaaattttttgccattgatactgctaaccctattcccgtatttactcactaagta

SEQ ID NO: 26258 - DNA, 1530 bp, Schizosaccharomyces pombe
atggatctggagcataaacgcattagccgaagtacattgccggattatgcggatcccgattacttcgaggctagaggtgaaagaaatccggtaaaacctcagtcttccaacgtagtaccaggaacaagtcatataggatcgatcaaatctccggcggattacgtttttggtgacattataggagatggatcattctcaaaggtaagttgatacattgcttctcagttcagaagtttttcaaccgcaggtcgattaacctatggaccttcgattactgacgaataagttgtctaatattcgttaggtgagaagagcaactgataaaaagagttggaaggagtacgctatcaaagtccttgataaaaaatatattgtcaaggaaaataaggttaagtatgtgaatatagagagagattctatgatgagacttaatgggtttcctggtatctctcgtcttttccatacatttcaggatgatttaaaactttattatgtgcttgaacttgcacccaatggtgaacttttgcaatacatcaaaaaggtatattttttcattagtctattcatttttcctttattaactaagctttggtagtatcgttttcttgatgagaattgtgtgcgcttttatgctgctgagattttatcaagtatcgagtatatgcactcctgcggtataattcacagagatctcaagccagaaaagtatgtttgagtagtggtcattaaatgttcgtttccttttcctaattctaacctattttttagcattttatttgatggaaatatgcatgtaaaaattaccgatttcggcacagccaaaatcctaccccctaaatatgtaaatagccctgattacactacctttccaagctcctttgttggcactgcggaatatgttgctcctgaactattgtctagacaagttgtttcaaaatcgtaagaaaacctattatcccagtctattttttttctgacaaatatttaagttccgatttatgggcttttgcgtgtgttgtttatcaaatgattgttggttcccctccttttcatggcagcaatcctaataatattttcaaaaagataatgagcctggaatatgagcttccaaagctcttaccacctgatatcgttcctttgtttagccatcttttccgtattcagccatctgatcgatctacaacccaacaaataaaacaatttcctttttttgctactattacttgggacaatttatggactcaagatcctcctcctatgcagtcattccggcctaattataacatagccattcctaatgctcctgcttattatcgctcaaatgtgacagccgcagctgctgctaatgctgccgcggcatttgcttctgcatccattgtaaagcatcaggaaactgctcgacgtcaggagcttcctacggtaaatcgtttcactgctccaactgctcattatggctatgcttcacttcgaagccatcagatgcctgttgacagactttattacaagttggttccatcgtctgagtcgatc

SEQ ID NO: 26259 - DNA, 756 bp, Schizosaccharomyces pombe
atggccggcaaaaagaagcatttgctgaaagttattattttaggagaaagcggtgttggaaagacttctatcatgaatcaggtatgttttttgaaatatgttaatgttatgactgtcatgtttgaaatgaaagttattgaccaaatctgtttagtatgtgaatcgaaagtttagcaaagattataaagcaaccataggagcggattttcttaccaaagaagttctggtcgatgacaaagtcgttacattacagctctgggataccgctggtcaagagcggttccagagtttgggggttgcgttttatcgaggcgcagattgctgtgtcctcgtttatgatgttaataacagcaagtcctttgaaactttagatagctggcgcgacgaatttttgattcaagcatcaccgagcaatccagagacatttccctttatcttgcttggaaacaaggtcgacgtggaagaacaaaagaggatggtatgtgtctaaagtattgaatttttaatacaaagctgagaatttcttgctaataatttcaggtttcaaaatcaaaagcattggccttttgccaagctagaggagaaattccctatttcgagacaagtgctaaagaagctatcaatgttcaagaagcattcgaaacagtggctaagttagctctggagaacatggattctgacgatattgcggcagactttacagatcctattcatttagatatggagagtcaaaaaacttcatgttactgttaaacc

SEQ ID NO: 26260 - DNA, 3616 bp, Schizosaccharomyces pombe
atggatcctcattggaaaagacacgattcttcaaacattcctacacagccttcaccttccgcctctcccaaatcaaataaaccttcctctgctcagaggtttggtaatcttccttgggttggtaagttttgtcaagttcgatgaagtatcctgcaactatgaaataagtttttctttgaattttgaatttttttttttcatcttgctagattcttcagcttttttcttctaccagagtatttatcactaactcagttatttagctccagacgtaatccaatctcaaatcgagtatttacaggcactgcaaatgcagcaatctctctctgaatctgagaattacttacagccaaactttttccctttccaatccggtccgttctcaaaatctcgaagggagaacacattgttgcccagattaaacccgcttgcacctattggagcaagacagcctaatccttcaattccacagcaattttccaagcctatcaatgaatctggtactggtacaatgggtcctgcagtaggagagctcaccagccctgtgatgaagaatcgagcggaatcgatattcagtccggtaactgagtcttttgaagcatttactcaagggatgcagacaactccacaacgagctggagcaggtgtttcgactgctacatcgcatacaagacgtcgttcttctgctggtacagatcctttttctccggtttcgccttcaaatccaaatttcctgacgcctttgaaacctatagatggaaatcaggaatggcagcaatcacctttagagtctcccttgtctatgcattctttgcaggaaagcttacacagcgttgaacctgaatctccgatttttcaacaggctccgcaaatccctttgtcaaatgcttctcaacaatcctacatcaatcattcatctgatggagcttctcttcctcaaagctcctttttaaattttaacagtagcggaaaacgggtctccgtttctgctgctgcccaacagcacaaaaatctttttcttccttatcttccccaagcgtcccttccgaagttcattggtactggtaagttgcttgttgggacccttcacataaatcgtaaaaatcgttctgatgcatacgttattacggacgtgcttgacgagcctatttttatttgcggatccaaggacagaaataggactttggaaggggatttggtagccgtcgaacttttggatgttaatgaaattatgcaaacgaagagagagaaagaggagaagaagattcgccgtaacctatccctctctggttcttctaagtattcagtcaacagtaaagcaaaaatgatgtctatcagtacacccatggctttaggaatgaataggggtgttctttcgtttgaaaggtctattgagaaacggaagaacgattacgaggtaaccggccagagtctttcgtttgtcgacgatgtttcacttactcccgattctgctccaaaatacgcaggtcatgtcgttgctgtactcaacagacctagcggtgaaacttgctcaggcactttagcgttgtatagacccaatagccttgctttgaagaatcagtcctctcatcgaagaaattcatccacatccagtggtgaaacgggaaaaggccctaaaattgtttggttcaaaccaagtgacaagcgtattcctcttattgctatatctagtgaccaagtaccccctaccttttttacaaataacgacgattttaaggataaggtatttttggctggcatcaagagatggcctactacgtccttgcatccttttggaacgctatatgaaagtattggaacaattggggaccccaaggtggagtacaaagcaattcttcacgatttcagttgccacacatatgacttccctgaatccctttctcattgtgttaaaagattacctacgcctatccctgcagaagagctacaaaagcgatacaatttacgagataagttaaccttcatgattggaacgcgtgattatgctctccatattgatacaggctccatcgacggagtcatcacacttggaatacacgttgcagacgtcgcgtattacgttaagcaagatatgcctcttgatgatgaagctgccaatagagtatcagaagtacaattgttgcaaggttccgtaccctttttaccgaaaaaggtctcagaagagatttcccttatagagggacatgattgtttaacaattagtatagttgtacagcttgatttgaaaagcggcgctgttttacagtgttcccttgggccctctgtaatccacccgtcaagttttattagtttagaaagtgcacaagcaaacttgcaaaccaacgaagcgcttcagctagttgatgcatcggcccatgtccttaccaaactaagattgaaaacagataagaaacttgacttacaatccttatactgctttgaattttgcgatgggcagattcctaatatacagaatattaacatgagtatttttgaggcattccctattgcatgttctttacaacaaattgaacattgggtaaacgagaaagttgcatctcatttaatgtctgtttttcccagtaaagtgattttgcgaaaaaatcaaagaccttctgactttgcatctcttgttgcagtttctgagttaaccggagtgaatttatctgcttcatctactccttcggaaatcatgaccgaaattgcaactaccaaggataagagaaccaaaatgttactacaattgactctaagaagaatgtgtaatgaatctgaatacactatcggtacttcaaatgctaaggatgtttcgcattttgtgttctcttgtccttactacacccatttttgtcaccctactcgtagatatatcgatatatgtgtacagagacaattacgcgaagcctttgatggcagaccagacttttccaaagactacagaagtttactttctataactcagtcttgtaacacactgagcaacttctaccgtaatgcccaggaaaaaagtctacatgcatatttatgtcaacttctccattctattaatttacgatctgggctcgttaagcataaggcttttgttttggctgttgaccaggagtatattgacatagtcatatacgaatttggcttggaaagaaggatctccttggatctgctaccgcttagtaactgcgactttaatgagcaaaaacacgaactctatttatcatggaggacaaatgcttctttcttttatgcttcatcttctttggaaattgatacaccttgtttcaatgactttaagaaaaaatttttggattccaacgggatgtgcaaacaaatatgcgatatgatggatgcacaggttcgggatttagctaacgctgctgagtcccaggagtctttctattcaaaggctcgaggcaatgacagtactagtaaaacagctaaaagttcctctggcaatcaggatatttccggagatggaaaacttcatagtttacgtatgaaagagcctgaggttgttcaaaccatccgtccaggccaagaggttagtgtacttatatttgctgatacttccgctacttactcactctcgttaattactttacaaagtcctctatccagttaa

SEQ ID NO: 26261 - DNA, 948 bp, Schizosaccharomyces pombe
atttactaacttcttttagtccgtggtagtcgtccaggtagacaggttcaattatctgaagatgaaatacgatttttatgtaacaaagcacgtgaaatatttattagtcaacctatccttctagagcttgaagctcctttgaaaatttgtggagatattcatggccaatattacgatcttcttcgactttttgagtacggaggattccctccagaagccaactatctgtttctaggtgattatgttgacagaggaaaacaaagcttggaagtaatttgtcttttgctcgcttataaaatcaagtaccccgaaaatttttttattttacgtggaaatcatgaatgcgccagtattaatcgtatctatggattttacgatgaatgtaagcgccgttataacattaagttatggaaaacatttacagattgcttcaactgccttcctatagcagctatcattgatgaaaaaatttttactatgcatggaggtctttcgccagatttgaactctatggaccagatccaaagaatcatgcgaccgaccgatgtccctgatactgggttactctgtgatttactttggtctgatcctgacaaggatcttacaggctggggtgataatgatagaggtgtttctttcacgtttggacctgatgttgtctctcggtttttgcacaaacacgatatggatcttgtttgccgagcccatcaggttgtggaagacggttatgagttcttctctaaacgtcagctagtcacattgttcagtgcacctaattactgtggcgagtttgataatgcaggtgcgatgatgagtgttgacgagagcttgttgtgcagtttccagattttgaaaccggctgaaaaaaaacaacgctacggataccaaggttcaagtcaaaattggcacatgactccacctcggaagaataagacaggaaattcaaag

SEQ ID NO: 26262 - DNA, 1197 bp, Schizosaccharomyces pombe
atgtcagctagcagaactaacgttaacgttgctattgttggtaagcacacaataaattgaatgcttgaatgttttgtaaagcgaaagctaatcacttaaaaataaataggtacaggaaacatcggcggtgaactcttaaaccaaattaagggttttaatgaaaacgcttctaccaatggcactacctcttttaacgttgttgccatttctagtatggaaggtcactacgtctccaaggattatcagcccattaatttgtctgaatggaagaaccttacttctcagaaccaaggtgcttattcattagatgctttggtagatttccttgccaagtccccccttcccgccattttggtcgataacactgcctctgaagcaatcgctcaatcttatcctaaatttttgagcaagaaaatcaacattgctactcccaacaagaaagcattctctgctagtaatgatgtctatcaaaacattatcaaggctagcaaggagagcggtgctttattgatgcacgaggcttctgttggtgctggtttgccaattatctccacattaaaagaacttatcgctactggtgatgaaatcataaagattgaaggtatcttttctggcactctgtcttacatcttcaacgtttggtctcctaacggcaagaaaggaactgcctcattctctgatatcgtcaaaattgccaaacaaaatggctataccgagcctgaccctcgtgatgacttgaatggcatggatgtcgctcgtaaagtcaccatcttgtctcgtattgctggtgttcatgtcgagtcagctagctcattccctgttaaatcgctcattcctgaacctttgaagagtgctgtaaatgctgaagagtttttagctggattacctaactttgattcagaatttgctagcatgcgcgaagaagctgagaaggaaggcaaggttgtccgttttgttggtgaggctgacgttgctaacaagaccactcttgtcaaacttgaaaagtacgacgcttctcatccgttcgctaaccttcaatcgtctgacaacattatatcctttaccactaaacgctaccatactcgtcctttggtagttattggtgccggtgctggagctgctgtgaccgctgccggtgttcttggagatatgatcaaaattatgtctcaggttcgcgcgtcagatgctccttccgct

SEQ ID NO: 26263 - DNA, 1555 bp, Schizosaccharomyces pombe
atggctgaaagcttgattcaaaagttagaaaacgctaatttgaatgaccgagaatcctttaaaggacaaatgaaggctcagcctgtagacatgcggccgaaaacagaggtgagtgactaagtaattagaattggcgttgattaacaattaccaggatgttacgaaaaccagaggaacagagttcgaagattattatttgaaacggtatgatggtttctttcttatgaaatttgtatattgacacatggtttacagcgaacttttgatgggcatctttgaggcgggcttcgagcgtccatctccaattcaagaagaatctatccctattgctcttagcggccgtgatattttagctagagctaaaaacggtactggtaaaacagccgcctttgtaattccctcccttgaaaaagttgatactaagaagagtaaaattcaaacattaattctcgtccccactcgtgaacttgctcttcagacatctcaagtctgtaagactttaggaaaacatatgaatgtcaaagttatggtcacaactggtggtacaactttaagagatgatattatccgtttaaacgatactgtccatattgtggttggtactcctggtcgtgtccttgaccttgctggtaaaggcgttgctgatttcagtgaatgtactacttttgttatggatgaagccgataaattattaagtccggaatttactcccatcattgaacaacttctttcctattttcctaaaaatcgacaaatctctttgtatagtgctacctttccgttaattgttaaaaactttatggataaacatcttaataaaccttatgaaattaacttgatggacgagcttacccttcgtggtgttactcaatattatgctttcgttgacgagagccagaaggtgcattgtcttaacaccttgttttcaaaacttcagatcaaccagtcgatcatattctgtaactccactaaccgtgtcgagttacttgccaaaaaaattactgaacttggatattcatgcttttattctcatgctaaaatgttacagtctcatagaaaccgtgtttttcataattttagaaatggcgtttgccgcaatttggtttgttctgatctgttgactcgtggtattgatatccaagctgtaaatgttgtcatcaattttgattttccgaagaacgccgaaacttatttgcaccgcatcggtcgttctggtcgatttggtcatcgtggtttggctattagtttcatctcttgggctgacagatttaacctttatcgaattgaaaatgaacttggcactgaaattcaaccaattccccctagtattgatccctccctgtatgtttttcctaatggtgattatcaaatccctcgacccttgactgcatctgccgatcaagtattggctgctcaacaagccaaaggacaggagggatatcataatcgtccgaacaataatcgtggtggtcatcctcgtggaggtggaaatcgtggtggttatcgtcagtccaatcgacaacccagataccgtggtcaacaaaaagcagactaa

SEQ ID NO: 26264 - DNA, 1645 bp, Schizosaccharomyces pombe
atggcagaggcccatatcacactatcacctaaagtaactcatgaacaacaaacagatattgattctgaatgtgaaatcactgaggtggacgatgaaaatgtaaacgaaaacaaatctcaagaaatgattcaagatatccctgcacgagaccgcgaagaaattgaaaatatcacaaggacgttcgtagagctacaagagaactatcggctaattgaaaaaattggagaaggtaaacttcaattaccgtttttagtactgttttgaaactatcttgctaattcgtttaggtacgttctccagtgtatataaagcggaagacctacattatgggaggtatattaatgattgggacattcaaagtgaagtgttaaaggaatcttcttttggaaaagaaaaaattcctgttaatgaagacagccggaaaccgaagtacgttgctataaaaaaaatttacgcgacaagtagtcctgctagaatatacaatgaattagaaatcctatatttattaaggggatcgtcggtaatagccccgctaataactgctttaagaaatgaagatcaggtactcgtagttttaccctactacgagcatactgactttcgtcaatattatagcactttttcctatcgcgatatgagcatttattttcgatgcctttttcaagctatgcagcaaactcagactttgggaatcattcatagagacattaagcctagtaactttctcttcgatgttcgtaccaagcatggtgtcttagttgactttggattagcagagcgttatgatggaagacaacaatcacattcttgccggtgcactaattcaaatgcggccgaattagcacatgatttttcgattgcgcaggaaacatctcttggatacataaaaaacgatactcgaccaagcaaacgggccaatagagccggaactcgaggatttcgagcacctgaagtattgtttaaatgctcatctcaatcacccaaagttgatatttggtctgctggggttattttgttatctttccttactaaacgtttccccatgtttaattcaaaggacgacgtggatgcactcatggagatagcatgtatatttggaaaaagcgaaatgcgccaatgtgctgctttacacggtaagaacgatctaatgtcccttacggaagtgtttgtgttgatttttttcgctaacctgccaggttgtacgtttgagacaaatgtaagcacgcttacagaaaaaagagtaaactttaggaaacttattttgtgggccagttgtggttcagccagtatatacaaagaaaagcttcgtcataaaccaagccaagaagagcgattgtgcctggattttttagagaaatgtcttgaacttgactgtaacaaaaggatttcagctgaggaagcattggatcacgatttcttgtatctcgataatttagcttacgaaaagaaagatgacgatacagcttttgataatagctttggagaaacctctttcgagaaagacgaagacttaactgctaagcacttatcccatatccttgattttaaagagcaggaagaaacagatgaacctacttctttatcaaagcggaagcgaagtattgatgaaattttaccaaatgatgctttgcaggatggagcttga

SEQ ID NO: 26265 - DNA, 1711 bp, Schizosaccharomyces pombe
atgacttcttacggcaatggctttcgcatgatggcgaaatgtcttttatctctacgttcaggatattcagtcactgctccagtgtctaaatccatggccaacgtcctttgggcccgttatggtatgtgttgttgatcatgatgtagatattgtttgttaaaggagacgggatatatatgttagtactcaacttgctcataagaatcaacttttgctaagtgcatctgtcttaaactttattttgaatcaagtggacgctgttgatttcaaaataattaaataattcttcacaaggtcatattcacacatgaataggaattctcaactatgttttcttcctttcactcagtatcttcgggatttactttttcttatgttgtttcaatttcaaaaatcattaactatatttttagccagtacacgcattaaaacgcctccgtttcctgaatctattacggaaggtaccctcgcacaatggttaaaacgtaagttgattcataaaaaaaagattttttgctattataaatactgacttttgttgatagaacctggagaatatgtcaacaaggatgaggaaatcgcgagtgtggaaactgataaaattgatgcccccgttacagctcctgatgccggtgttttaaaggaacaactcgttaaagaaggtgacactattaccattgatcaggatattgcggtcattgatacgagtgccgctcctcctgaaggcggtagtgccggtccaaagaaagatgaagtcaaaactgcagatgccgatgcagctaaggacctttcaactcctcaagattcttctaaacccattgaagagaaacccatgcctgacctcggtgctgaacaaaaggaatctgcaccttcctctactaagcctgctcctgatgccaaagaacctgaattttcttctcctaagcctaaacctgccaaatccgaaccagttaaacaaagtaagcctaaagctacagagaccgctcgtccttcctcattttcccgtaatgaggatcgtgttaaaatgaatcgcatgcgtcttcgtatagctgagcgccttaaggagtcccaaaatcgtgcggcttctctcactactttcaacgaatgtgacatgtctgctgtggtcgccctccgtaagaaatacaaggatgaaattttgaaggaaaccggtgttaaaattggattcatgagttttttctctaaggcttgcacccaagctatgaagcaaattcctgcaatcaatggctccatagaaggtgaaggaaagggtgatactcttgtttatcgcgacttttgtgatctcagcattgctgttgctacccctaaaggtttagttacaccggtcattcgtaatgctgaaagcatgtcccttttggaaattgaaagtgctattgcaactttgggttcaaaagcgcgtgctggcaaattagctattgaggacatggctagtggaactttcaccatctctaatggtggtatttttggctccctctatggtacccctattatcaatcttcctcaaacagctgtattgggtttgcatgccattaaggaacgacctgttgttatcaacggccaagttgttccaaggccgatgatgtatttggctcttacttatgaccatagaatggttgatggtcgtgaagcagttactttcttgcgtttagtaaaggaatatattgaagatcctgcaaaaatgctattagtataa

SEQ ID NO: 26266 - DNA, 1269 bp, Schizosaccharomyces pombe
atgaataaaggcccaagacatcgtccaaaattcttatcaaaaaagggaaaaaagcttcgcataatggtagcaggatctagctacaccagttaccaagcttgtatcaatagcttgtgcagtaaacaaatactggaagctgaaacagagatagatccgctaaaagctcatattgatagaatactggaaataagggaatttaatgctggtgagttattacggttttaattttcgtgtgctaactgtaattagatattttagaagatgagttccatgttgaccttacggtcattgaagtaaatggtttcggagataaaattgataattcagctaggtaataccaaaaggtatttttctaaattaaagctaatttcaatgcattagtttcgaggtagttactcattatttggaaagccaattcgatcaagccttgatagaagaatctaaaatcaaaagaaattctaaatttactgatacggtacgaaatctgcaaacaaagtttttccgtccttaactatttcaatcaagttacttccattacttgatttaatgttgttaagtagaaaaccaagagaacacattggtttaagaatgaggaatgaaaaaaaagttttctaacgatattttagcgcgttgatgccctactttattttattgcaccccgtggacattgcctgtctgagtttgatttggaagccatgaaacggttttcaaagcgcgtaaacgtaattcctgtcattggaaactccaacgcttttactgaagaagaattaaagaacttcaaagatgtgataatgaaggatttgaaacaatgtaacataaaggtatttgactttccttgggatcctgaggaggatgaagacgaagtcattgaggataacaaacgactttgggaaagtgttccattcgctgtatctggaggggtatcagaggaagatgaagaaggatatcaaagaatcgtcaagaaattccaatggggaacattcgtaattgatgatcctgcacattctgattttcttaacttgaagaccgtattgtttatttctcatttggatatactcaaaagtataactaaacaaacctattatgagaattatcgtacagaaaaactgtccaacgactcaccttcgaacacatcattgtaagaaattaactatgcataagcgagctaataagttaggtcattgcaaaagcaaaattccatagttgcaaatgaagataaaagaagtgtaaatggttctgagagaacggagactcgatcttcgattgatc

SEQ ID NO: 26267 - DNA, 1722 bp, Schizosaccharomyces pombe
atgctctccaaattttacgaagacatagattccaaattggaaaatgcaatgttatctcaaatagaaagcagtacaataacttgtgatggtaaatccctaaacacattgcctacccctaaacaagaggatgtcgagtttggcgttcctctgcagccagaagacactcaagatctccaaagaaagctgaagccccggcatatgcaaatgattgccataggaggatgcgttggcactggtctgtttgttggttcgggtaatgcactggccgatggtggtcctgctagtattcttatagccttcgcagtgataggaacttatgttttatttacaaccagcgcgttggcagaactctccgcaatttatcccgtttccggttcattttatacatacttttcgaaattcatcgacccggcatgggggtttgctgttggtatacagtattggttatcttttgccgtgaccgttccattagaacttacagttgccccgttgattattaatttttggaatgcatctggtccggtttcgatttggatttcagttttttacgtaattattatcgcgattaacatttggggaaccgaggggtatggtgaggtggaattttttttgagtatcatgaaagtcatttcagtcatcggttttgtaattctaagcataataattgcagcaggtggagtaccaactgatgatcgaggagtaatcggagtgtcatattggaaacaaccgttggtttttaacaatggattcaaagggttatgcgctgtttctgttatagctattttctccctgtcaggaaccgaactagttggtcttgccgcatcagaagcaaagaatcctcaaaaaacagttcccgcagcagtcaaacaaatattttggcgtattttcttgttctatattgttgctcttttcatgcttactttggtggttccgtctgacctacctgggctacgcacgagcgataactcaaatgtgctaatttcaccattcgttattgccattcaactggcaaatataagggcacttccgagcatcatgaacgtagtaattctgctttccacattatccgtaggaaattcagcttcctatgcggcgtcacgtgccttgtttgctttagcaaagaacggctatgcacctaagatttttaataaaactaacaaacgaggtcatccaatttatgcaattgccgtaacgcttttatttggttctatagcatacttcactgaagctggagttggcggcgcactctttggttggttgttatcaatatgtggtttgtcaacaacatttatatggggaagtatttgcctcgcccatattcaatttagaagagcgtggaaaatacaaaataggaaactagaagatcttccttaccgtagcatttttggagtatatggatctatttatggtgtggccatgacaatattggctttaattgcccaattttatgtcgcggtattcccaattggaaaaaaaccaaatccagtggatttttttcaggcatatatggctgcacccatattaattatcagctttgtggcatggaagttttttagacgtacatcatttgttcgtatcgaaaaaattgatctttcagagggtgcgcatggcgaacagaaacaaaatctcgaacccgtcatcaatatacccgttgaagagatagacttcccaatgaaagtagccaccaaggagagcatgaaaaatgtagagaaaaatgcgtta

SEQ ID NO: 26268 - DNA, 1005 bp, Schizosaccharomyces pombe
atggatatcgaaaagtctgacaagtggacgtatgtgaaggagcgcaaagttggtgaaggaacgtatgccgtcgtgttcctgggtcgccaaaaagaaactaatcggcgtgtggctattaaaaagattaaagtgggccagttcaaagatggtatcgatataagtgctttacgagagatcaaatttcttcgggagtcaaggcacgacaatgtcatcgagttagttgatgtattctccacaaagtccaacctcaacatcatcttggaattcctggacagtgatttggaaatgctgatcaaagacaaattcatcgtttttcaacctgcccacatcaaatcgtggatggtcatgttgttacgcggtttgcatcacattcattctcgcttcatccttcatcgagatttgaagcctaataaccttttaatttcgagtgacggtgtcctaaaattggctgattttggcctttctcgtgattttggcaccccaagccacatgagtcatcaggtcattacacgatggtacaggcctccagagctatttatgggttgtcgaagctatggcaccggtgttgatatgtggagtgtaggctgcatttttgcagagttgatgcttaggaccccgtatttgccaggcgaatctgatctggatcagcttaacgtaattttccgcgctcttggaactcctgaaccagaggtcattaaaagcatgcaacagcttcccaactacgttgagatgaaacacattcctcctcctaacggtggtatggaggctcttttttcggcagctggccatgaagaaattgatttactcaagatgatgttggattacaatccatatcgtcgtcccactgctcaacaagcccttgagcatcattatttttctgcccttcctaaacccacacatccttctcttctcccacgcaaagggggtgaggaaggaatcaagcacgtctctagtgacctgcagcgacaaaacaactttccaatgcgtgcaaatattaaatttgtt

SEQ ID NO: 26269 - DNA, 1886 bp, Schizosaccharomyces pombe
atgtcgcttggaggtcctcaaattcctgtcattggtaagtttgtatgcagatgaaagtatctctaatcgtttgcagtactgaaggaaggtacggatgattcccaaggacggggtcaactgctttcgaacatcaatgcttgtgtcgctgtacaagacacgatccgaaccactctcggtccattgggcgctgataagttaatggttgacgatagaggagaagttgtaatttcaaatgatggcgcaactattatgaaactcttggacattgtccatcctgctgcaaaaacgctagttgatattgccagagcccaagatgcggaagtcggtgatggtactacttcggtcgttgtattcgctggcgaattattgagagaagcgagaacatttgttgaagatggagttagttcacatcttattataagaggttatcgtaaagctgcccagttggctgtgaataagattaaagagattgctattcacttggatttatcggacgaagggtaagacttttaatttatagaatttttatctgggcattgcttaactagcttgcttagaataagttttgtaaagtttattattggtgcttttcgctatactttttttattacttattagaaggatttttagttattttatatttgttcagtttactaatactttacagaaaattacgagatctgttaacaaaatgcgcatctactgcaatgaactcaaagcttattcgttcgaattctactttttttacaaagatggtagttgatgctgttttgacattagatcaagaagacttgaatgaaaacatgattggtattaaaaaagtccctggaggagcaatggaggattcacttcttgttaagggcgttgcatttaaaaagacattttcgtatgctggttttgaacaacagccaaaattcttcaagaatcccaaaattctttgtttggacgttgagttggaattaaaggccgagaaagacaatgctgaagttcgcgttgataaagttcaagaataccagaatatcgtcgatgctgaatggcgtatcattttttccaaacttgaagcgattgtcgctactggtgcgaaagttgttttgtcaaaattgcccatcggtgatttggccacccaatatttcgcggatcgtgacattttttgtgctggaagggttgctgcagatgatttaaatcgtgtggtacaagcagttggcggctccatccagtctacctgctcaaatattgaggagaagcacctaggtacttgtgatacttttgaggagcgtcaaatcggtggtgatcgtttcaatctatttgaaggttgtcccaaggccaagacttgcactcttattcttcgtggcggtgctgatcagtttattgcagaggtggaacgctcgttacatgatgctattatgattgttaaacatgcgttaaaaaataacttagtagtcgctggcggtggtgcttgtgagatggagttatctaaatatctccgtgattattctcttactatatctggtaaacaacagaattttatagctgcctttgctcgctcgttggaagtaatccctcgtcagctgtgtgataatgcaggattcgattcaacaaatattttgaataaactccgtatgcaacatgccaagggtgaaatgtgggctggtgtagatatggatagcgaaggggtcgcaaacaattttgagaagtttgtttgggagcctagcaccgtcaaatcaaatgccatattatcagcaactgaggcagctactctaattctgtccgttgacgagactattaaaaatgaaccttcacagcaacctcaagctccacagggtgcgttacctcctggcgctgctaataggattatgcgtggtagaggtcgaggaatgccccgctaa

SEQ ID NO: 26270 - DNA, 702 bp, Schizosaccharomyces pombe
atgtctagcgttcccataagaacgaatttttcactgaaaggttcttccaaacttgttagcgaattttttggtttgtaaatgtttcaaatatgccatgctaacttaatgaagaatatgcggtgaactcaatcctttttcaacgaggaatttacccagcagaagacttcaaagttgttcggaaatatggattaaatatgcttgtcagtgtagatgaagaggtcaagacttacattcgaaaaattgtatctcagttacacagtgagttgttgttctattatcacttttggaattaacaaatttttagaatggatgtttgcaaaaaaaattcaaaaactgattttggtaattactagtaaatgttcaggtgaagatttagagcggtggcagtttaatgtggagatggttgacacagctgatcaatttcagaacattggcaacaaagaagatgaactgcgagtacaaaaagaaattcaagctctaattcgtcaaatcactgctacagtgacctttttgcctcaactagaagaacagtgtacgtttaacgttttggtatacgctgataaagacagcgaagttccaacagattgggtagacagtgaccctaggattttaagagatgctgaacaagttcaattacgaagttttagtacgagtatgcacaaaattgattgtcaagttgcatatcgagtgaatccttagttg

SEQ ID NO: 26271 - DNA, 729 bp, Schizosaccharomyces pombe
atgtccttggcgtttacgcttttaacctcaaaagataacacagatgaagatgaagaacacttggagctttcttcttttaatcaagaaaagctcttggaaatgatatctgtgtttctctcgcgtctaacgcgtttgaacgatagcaagcaggaagctactgaatcagatcaaataccattatctccaacaagtttaaagaacccttgtttgatattttctgcaaaaaatgtgccttccatatctattcaggcttatctaacacgaatcttaaagtactgtcctgcaactaacgatgtatttttaagtgttttgatttaccttgacagaattgttcatcattttcatttcactgtctttatcaacagctttaatattcatcgtttcttaatcgctgggtttacggccgcaagcaaatttttcagcgatgtcttctatactaacagtcgctatgcaaaagttggtggtattcccttgcacgaattaaatcatctggagttatctttttttgtgtttaatgatttcaatctttttatatctttggaggaccttcaagcatacggtgatcttctactttcatggtatcggcaaaatgggcagaattacaaccctaccgatgtttcatgctctattgaatctcccatttcccatactccgcaacaaaatcaacaagatgaacagccacgtcggcccataatggatcgaaggttactctcttctcactcaattggt

SEQ ID NO: 26272 - DNA, 1686 bp, Schizosaccharomyces pombe
atgttcagaacgaccaaaagtcgagtagttgaaaagaatcaaaatttttctagtgctagttttgagagtttaagttatcctacgcgacttaatttttataagaaacctcctgtctctgaaataagcattgaagagtttgaaacatgggcaatagaccgattagttggtatgctttccattttctttattattttctattcttttggagtaagctaactatttagttttgggtgaaattgagtcagcaatgctccgcaataagacgaaaaatgaattgaacgggattataaaaaagatactggataaacgtctgccgatgagtagcaacatggctaggactgtaaaaggaaactccttagatgaagaaagaaggaaagatcattattctcatttcattctgcgcctggctttcagcagatcgtaagtaaaaatgtgctatatttgagtgctgtctgtcgaaaaatatctcatttagacttataaatgcgttcgcgttatggcataagtagtaaattgaacataaagtgggtatcaatttgctgcttcagttaaacagaaagcattatatatatgaatacatttaaacttgcttttattcttttcctaacgcattcattagtgatgaattacgaatcaggtttttaagagctgaatccacgttatttcggtttcgatttgtgaatgaggaaacccgagaacgtcaagcgtttatagatagtcttgattttcaatgggaatctgtttcacaagaagaaaaagacgttttttatgaaaagctacaggcttcttctcaaagaaatatagaaaacgaatctttcttcaaagtacctttttttaaagttccggatttagtagaacgaagggctgttttcgttcacaagggatacgcttacgtaccattttcggaacaagtaagtctagttgttgaagagtttgaagaaaacttaaaaaaagcgcttgagtctaccgcaaaatctcttcctaggcttgatgaagacgatcgtcttttgccaattctcaaccatttgagtaaaggattcgttgctcccgagagttcaatagttgctcctaaatctggtgctattactgctggacaagtagacagttttgtttcacattttccattatgcgccaaacatttacatgaagtacttaagcgtgataagcatctacggcattttggccgtcttcaatatgggctatttttaaaagtatgaaacttattttttatgtagtaatttactaatttttcaggatattggcctttctgtcgacgaagctttggtcttttggaggaaaagttttacaaatgtaacagaagacaaatttaacaaagaatatcgctacaatattagacatacttatggacttgaaggaaataggaaaaattacaagggttataattgccagcagatccttacagggcctcaacttggtcctggagatgcccacggttgtccttatcgtacatattcagtaaataatctagtgtcagcattggcttccatgggaatagcaccggattctgccggatgccgtgaagttgttgaggcagttaaagcgaggcattatcatattgcgtgtacgcgtgtttttgagcttactcatccaaatgtcggttcgctggaggagagcattcaccatcccttacaatattttcaacttagtttagaatcataagctaag

SEQ ID NO: 26273 - DNA, 1734 bp, Schizosaccharomyces pombe
atgcaattttgttttaggattttaatattgtatatatcgttaagcatagataacaattacttggttactacgttaatatctctgaaggaaaatgtttttttgcatatttttactctaacctttctcttcaaagctttccttttaaaaatggcgaaacgatcagtggaagagttaaaaagatcggcggatgaagaagcttctgttaagcgaaaggagaagaaatcaaagcatgagcataagaagcataaaaaagataagccctctgccgacaaggatagaatttcaaaaaaggataaaaagaaatcaaagaaaggaaaatcaaaaactaaagaagaatcgatagaaatcaatgcggaagagggagcaaaaatcgcacaacccgcgatcggctcagctaacgcttctaatcataatgatgaagaagcgtatgaccgttacattaagaagcataatatttcttttgcggatcctaaatcctctgaaaatttacttccaattcttcagttcgatgaactagacgtttcagctaagttacgcgagggtttaaagaattataaggaacctacgcctattcaagctgctacttggccttatttactagctgggagagacgtggtaggaattgctgaaaccggttctggtaagactgttgcattcggaattcctgctttgcaatacctcaatggtttgtcagataacaagtctgtccctcgtgttttggtagttagtcctactcgagaattagccattcaaacgtatgaaaacctcaatagtcttattcaaggtaccaacttaaaagctgtggttgtttatggcggcgcccctaaatcggagcaagcgagggctgccaagaacgccagtgtcattattggtacccctggtcgtttgttggatctgattaacgatggctcgattgattgttctcaagttggttaccttgttttagatgaggcagatcgtatgcttgacactggattcgaacaagatatccgtaacatcatcagccataccccagatcccactcgtaatggatccagacaaactgtctttttcagtgctacttggcctgaatccgttcgcgctcttgctgctacctttttaaaggatcccgttaaaatcactattggaagtgatgaactagctgcttcccaaaatatcacacagattgttgaaattctggatgacccaagaagcaaggagagaatgcttgataatcttctcagaaagcatctttcttctggagggaaagacgataaaatcctcatatttgttttgtacaaaaaagaagcagctagagttgaaggtaccttggctaggaaatataacgtggtgggcattcatggtgatatgtcccagggagcccgattacaagcattaaatgactttaagtctggaaaatgtcccgtactagtagcaactgacgttgccgcccgaggtttggacattcctaaagtgcaacttgtgattaatgttactttccccttgactatagaagattatgttcatagaatcggacgtactggccgtgccaacacaaaaggtactgctattacatttttcactccacaagacaagtcacatgctggtgagcttgttaatgttcttcgtcaagccaaacaagatattcctgaaggactattcaagtttggaacagctgtcaagcccaaacttaatgcttacggaagtcgtgtagtcgacgttcctgtaaaggctgctactaagattgtttttgac

SEQ ID NO: 26274 - DNA, 2223 bp, Schizosaccharomyces pombe
atgtctcaacaattaagctttaatgcatcttcagcaaagcctgataaaagtttttcaaattacttttgggtatggtgtctaagccaacgtggatagctcattatctgccaaaactttcgatttttgtgttaaacacaacaccttaactaacattctttattagggtgcaaatgatgagggttatcatgctttactttcgcgttttagcgatgtgaaacacattaatgaagagcttcggtcgttttatcatgaaaggtgagaaatttgaggtgaagcagggtttaacatgctatgatcgtttattctaacttcaaccttagagcgaacattgaagaagattatgccaagcgaatggcaaagttgtctcgaacaaccttcagttctttggaaactggttgcctcaaagaatcagtccaagttatgaaagctgaagttgacaatatggcaaagtctcatttgcagatttctcagttgcttcaggatgatgtcgaaaatgcgtttacgcggtacgctgcctctttaaaggacaagaaaaagatgatcgtttcggggatagaaaaagttcataaggataaactctccaagcatcaagctcttgttaaagctcaagacaaataccattacttgtgcaagaaagtaaattactatgtttctcagcaaaacatgcttttcggaaaggagctagagaagaacaatgcgaaattaaacaagactcagaatgctatcactgctagttcttctgactatcaatcagctgtagcagctgtcagagattcatacgctcgttggaccaacgaatggcggtcaacctgtgacaaacttcaggacattgaagaagaaagaagacatttcctgaaaagcgtcatgtggacatttacactacttatctctcgtagttgctttaatgatgatcaagcatgtgaacgaattcgcaaaaatcttgaacagtgcagtgtctctcaggatgttttggaatttattgacgcaaaatctacaggaacgggaattcctcaacctccaaaattttatgactattataagggcgaggttcccgatgattctgtagagttggttcaggctaattttcagcgggcccaaaccaaaatagaaaatgacaacatgccattgaatcgtccatacgtcctttctgccaccgctcgtaatgagtcgtccttcgaaaatacccttcctaatactcctagtgcaattcaatcgcttaccactgtttcttctaactcttcccaaaatggtagaagctctccaaagaaaagctttttgagtaagtttaaattaacgagtcgtccttcgactccaaacgttggtaatacggctccggatgcattatcaagtccgagaaatgactctcctttaacttcagcggctgatgaacagatgaagcatctttctttacaagaagagccaaaacagaatcctacgcctgctgctcctggtgccttccctaactctaatacactaccaccaaggtataacgaacttggttctctaccaagtcctaattctgtttctttcaccgaggactcccgcccaaatgttaacactccatcacggcgtcaacaaattcaggaagaatttggtagtgtactacaaatggagaatcgtgcggtttcacccgtttatgattcaagaaagaatggatctcgaagttcattcacattgaggaaaagtaggtcaccaaaacgtccttcctcttccctttctcagaatgccagccgacttcctcgttccttaacaccaggaaatttagagccaaattatgatttcggtgttcgagttgatccagcaagtggtactgcacctaccgatgacgagccttatactgatcgggactcttcctttgttgatgatacaataaatacaaaagctactggaaacacgtctaaccgactttctttacctgcatatcctacagacggcggtgacaccagtattgataatccaacaagtacagatggtcaacgtattcttggttatggtatgtctaatctgtccatcgctattacaattactaacttgaatttagtatctgctttatatgattatgatgctgcaatacccgaagagataagcttcaggaagggagataccattgcagttcttaagctttatgaagacggctggtgggagggatttgtcgttggagaggatgaccataaccgtgggcaatttccgtcaaattttgttcgtgaaatcgaggtttagctt

SEQ ID NO: 26275 - DNA, 852 bp, Schizosaccharomyces pombe
atgaaaaccaccatgttgatgctagtattgctagtctgctcatacatacattatgtatgtgcgcaaattcgattcgtcactccggcgacaacagatagtatggattttaccgctatttcgttttcatgggaagaatctaatacgggaatacctcttgaggacataaccaacacagttttttatatatgtagtggtagcatggatgctcctcaaccttgtgcagtcttgtatacgtcccctagtccttcttctatatcccaagctggacccttcgctatttctcaggtttttggaccagctggacgtctttactttctttgggcacaatctacatatgctggtggtatagttaatgactatactgactttttcactgttaatggtctaacaggaacttttgataattacgaaatttatgcgtctttgatggctcttggtgtgtatccttatgttcctacccttactggttttagcacttttcttggtgtatggcctacaggtacaatgcgagattggtatctatctcaaactaccggtgttctccgtacaggacctattcaaaatcgaccagattctacttttactgctgctacgaccgacatacaaccgctatgggaaacttcctcttattccgtatttaccacgtttgcaggtcctcccattgccacctcgactgtctttgcatctccaacgtacatgtatacgttgtatgctaattatgctagtacggcctctaagcctactataatcgcaactccaactgctggtttaaggagacgagacagctgggctcaagctgctccgaaacgtgggatgcgtttaggtgaacacaaacgtgggttgttatattcc

SEQ ID NO: 26276 - DNA, 1593 bp, Schizosaccharomyces pombe
atggggttcaagcgtggaaagaattttacccttgttatgttaattttcgtctccatggccggttggatgtttggtgctgataccggttccattggtggtgttactagtatgcgcgattttcgtgagcgttatgctgatagatatgacccgatcaccgaccagtattctttgtcttcggctcgtcaaggtcttttaactggtatggttaacgttggttccttgtttggatgtatcatttcttctcccattgccgatcgttttggtaagagactttctatcattggtttttgtgctgtttatatcattggtatcatcgttcaagttaccgctgttccctcttgggtacaaatcatggttgccaagatttggactggtattggtattggcgctctttctgtcttggctcctggatatcaatcagagactgctcctcccagtattcgtggtaccgtcgtcgtcacttatcagttgtttgtcactggtggaattttcattgccgcttgtatcaatatgggtactcacaaacttcataaaactgcccagtggcgtgtttcaattggtattaatctcctttggggtatcattaccatgattggaattctcttccttcccgaatcccctcgttatcttattcaagttggcaaggatgaagaggctgttagagttctttctgaaagtgctgagctttttcctgatagtgaggaagttcaaaatgaatatcaccgtctcaaatcatctattgacgaagaatttgctggtggcccttgcagctgggcaagcattttcggtaaagacattcgttatcgtactttccttggtatgtttgttatgtcgcttcaacaattgaccggtaacaactatttcttctactatggtttctcagttatgcaaggagctggtattaattctccttacctatctgctatgattcttgatgcagttaattttggctgcacttttggtggtatgtatgtattggaaaggtttggtcgtcgtaaccctcttatcattggtggtatttggcagtcaatttgctttttcatttattcagctgtcggttctcgtgctttatatcataagaacggtacttcaaatacccgtgctggtgccgttatgattgtcatggcatgtcttttcatttttggatttgctcaaacttgggctcctgccgcatacgttattgttggtgagtcataccctgttcgttaccgctctaagtgtgctgccgtcgctactgctagcaactggctctggaatttcctaatttcattctttactccattcattcaagcttctattggattcaagtacggttacgtttttgcttcttgtaatttgaccggtgcaattgttattttcttgtttgctaaagagactaaaggtcttactttggaagaaattaatgagttgtatatgtctgtcatcaagccctgggaatctggtaactttaagcttaactattctgagcaaaagaaagttgagaaagagaaatccagaaagggcggtgcccgtggtgagtctgttgagtatgttgagcgtgcttcaaacactgactcatctccacaatactcttcccatgaggaagattacgca

SEQ ID NO: 26277 - DNA, 1542 bp, Schizosaccharomyces pombe
atggcgttactaaataggttggcaaaaaccttttccccttattatggattaaacaaagttgaacaaaagcttttaataaaaatagattggttcatactttcttactgttgcgtttcatattttattaattacttggatagatcatcaataaacaatgcataccttagtggtatgcaagaggatttgaaaatgcatggtaatgaattgcaagatataaacgttgtttttacatgtggatacattataggacaattgccaggttcttatgcattacagagagtaccagcaagactttggttttcggttatgaatattttatggggacttatgacgattttttcatttgcggtacattccgttcgagcattgatgattttacgctttttcatggcggttgcggaggcatctacatttgctggtacgcattatatattgggcgcatggtacaaagaaagtgaactatgcaaacgtgccggaattttttcagcctctggtttagtcggcacaatgtttgctgggtatttgcaaacagcagttcattcatcattaaatggtaaaggtggtttatctggttggcgttggctttttataattgatggcattttgacgattcctctttcattatatgggctctttctgtttcctgacgttccagaaacaaccaaggctccttattttacagaacaagaaaaagaattaagtttcaaaaggctacccgctcgccccaagaagaagccattaacgctaaaagcgataaaggatattgtacgttcatggcgaatttacggtttgtgcatcctttggatttttagcggagaaacacaagctatagctgtcaatgtattgatgggtcagtggatgaaatggagcaacaaattttctgttgcccaaataaataattacccaactgtgattacagctgttggcgtagtatcaacgttaggtgctagtgttatttctgataaattagctggaaacccaagatggccttttggactttttctgtgcgtaattactactgtttctgctacaatacttctagcatggaacgtgccagatggcgcaaaattctttgcttatttcgcttctggttgtacatatgctggacaagcagtttggttttcttgggcaaatgacatttgccgggataatgatcaggaaagaggagttgttgtgtttttgatgaatatgtgtcagaatatctggcatatttggtgggcacctataatgtatcccaatactgatacgcctcgatttataaaaggattaattggtttgctggtggtaggaggaatagtctttgttagctcttgtattgttagttacatgcaaatccgcgataaaagaattaaacgatccatccaggatgcaaaagatttcgatgatgtattcactgagcatgaaagtttagagttaaaaaaaataggcaaaaatgatgaggaatcactcaacacaactaatgcggtcaaagaaattagttctccagggcttgtgataacgcgacagcgaatttccatgccaaaagaaacgaatgcccaagat

SEQ ID NO: 26278 - DNA, 1155 bp, Schizosaccharomyces pombe
atggcgttactaaataggttggcaaaaaccttttccccttattatggattaaacaaagttgaacaaaagcttttaataaaaatagattggttcatactttcttactgttgcgtttcatattttattaattacttggatagatcatcaataaacaatgcataccttagtggtatgcaagaggatttgaaaatgcatggtaatgaattgcaagatataaacgttgtttttacatgtggatacattataggacaattgccaggttcttatgcattacagagagtaccagcaagactttggttttcggttatgaatattttatggggacttatgacgattttttcatttgcggtacattccgttcgagcattgatgattttacgctttttcatggcggttgcggaggcatctacatttgctggtacgcattatatattgggcgcatggtacaaagaaagtgaactatgcaaacgtgccggaattttttcagcctctggtttagtcggcacaatgtttgctgggtatttgcaaacagcagttcattcatcattaaatggtaaaggtggtttatctggttggcgttggctttttataattgatggcattttgacgattcctctttcattatatgggctctttctgtttcctgacgttccagaaacaaccaaggctccttattttacagaacaagaaaaagaattaagtttcaaaaggctacccgctcgccccaagaagaagccattaacgctaaaagcgataaaggatattgtacgttcatggcgaatttacggtttgtgcatcctttggatttttagcggagaaacacaagctatagctgtcaatgtattgatgggtcagtggatgaaatggagcaacaaattttctgttgcccaaataaataattacccaactgtgattacagctgttggcgtagtatcaacgttaggtgctagtgttatttctgataaattagctggaaacccaagatggccttttggactttttctgtgcgtaattactactgtttctgctacaatacttctagcatggaacgtgccagatggcgcaaaattctttgcttatttcgcttctggttgtacatatgctggacaagcagtttggttttcttgggcaaatgacatttgccgggataatgat

SEQ ID NO: 26279 - DNA, 1580 bp, Schizosaccharomyces pombe
atggacaacgaaaataataaaaatacaaaaaattcacagcaagacagctcattttctgaaggaggaattcgtgaactgctagaccgattggcgttgagatctttgatagaaaaagaagaagctgcagctcccccaaagacttacgaagatttcaaattttggaaaacccagccagttcctaagtttggtatgcctatcctggtttgttgaaatatactctgagattcttttatacatattaatgcttaccataatagatgatgaatgtactcaagaaggcccaatagatcccaataccgatataaaccaggttcctagagaaccttatcgtttgctaaaagagtttgagtgggcaactattgatgtaacaaacgacaatgaggttagtgtagtttgatgttttctgctacgtattaagaagcaaaacttgctgacatttctatagttatctgaggttcatgaactcttaactgagaattatgtcgaggatgctacggcgatgcttcggtttgcatacatctcagagtttctcaggtgggcccttatgccccctggatatgtaaaagaatggcacgtcggagtacgagtaaagtcctctcgtaagttggtagctttcatttctgctgttcctttaagtattagggttcgtgacaaaattattaagaaatgtgctgaagtgaacttcttgtgcatacataaaaaacttagaagcaagcgccttactcctttattaattaaagaagtcacacgtagatgtcatcttgagaatgtttggcaagctgtttatacagccggtgtattattacccagtcccgtgagtttgtctcgttatatgcatcgtagtttaaactggaagaaactgtacgatataggattcgcaccttttcccttggggtcaacggagaaaaaggagactgcaaaatatcatttacctccaaatactcagaccccgggtttacgtccgatggagttgaaagatgtacctgccgttcagtcgctgttatctcaatacatggaacgtttcgaacttgcccacttattttcggaagaggaagtgcgacattggtttttgtacactgacaaggtttcaagtggccctgttgtttggagttacgttgtggagaatccagagtccaagaaaattaccgattttttttcgttttactctttaccctcaactgtaataggaaacccaaaatacaaagatattcaagctgcatacttgtactactatgcctctgattcttgtccaaaagacttatcttctgaatcacagttggcattcgttgaacgttgtaaattgatagttaatgatgctcttatattggctaaaaaggtaagtttatatggttttattacttgctaataattcaaaacagttccactttgatgtattcaatgctgttacggttttggataacaatctattcttgaaggacctaaaatttggagaaggagacggttttttgaactattacatctataattataactgtccaaaaattcctggaggaatcgatgcttctaaaagtgttgattattcgaggcctagtggaatgggttttgtaatgatttaaatc

SEQ ID NO: 26280 - DNA, 957 bp, Schizosaccharomyces pombe
atgctctttaacaactttctttgttttgcggtttccgccattcctttggtttcagctatgcctcttggtaatgctccctatcaccatcaccatcatgccggtttgaatgctagcaatataactgttggtgtcaatgtcacaaacactaccgctttttcaaaaagagacggtggttttcctgacggcgtatacgactgctcctcttttcctgatgatcaaaatggcgttgtccgccttgattacttaggttttggaggatggtctggtgttcagaagaatgatggtaaatacggaacagcttctacatgccaagataacacatactgttcctatgcatgcaagcccggaatgtctaagacccaatggccgtctgagcagcctgacaatggcgtttccgttggtggtttgtattgcaagaacggtaaattatatctcacccagaaggataattctaatctttgtgaagatggaaagggtactgcctatgttaaaaatacattgagttccaatgtcgcaatttgccgtaccgattaccccggaactgagaacatgaatatccctaccaatattgatggtggttcaaaacaacctctttctgatgttgatgaagattcatactataattggggaggaaagaagacatccgctcaatactatgttaataaatctggcagaagtgcagaagatgtctgtgtttggggtaatgagggcgatgattatggcaattgggctcctatgaacttcgggtctggttacactgacggcaagacttggctttctatgtctttcaatcctttatcatctgctaaacttgattacaatatccgtattaaatctgatggtgggtcccttagtggtgattgctactatgaagacggatcattccatggttccaccgctgacagcagtggttgtacagtctctgtcaccggaggcaatgcctactttgagttgtac

SEQ ID NO: 26281 - DNA, 2325 bp, Schizosaccharomyces pombe
atgaatgagaagaaaaaagatagcctatctgttttagattccaatgaatttttcggtgagacaactatggtatcaccgagtattgatgtttcctcttctccccggccaaatgtcgagagattttctccatgttccactaaaaaagatctcctggaaggaaataatataatgaccagaattcccgaggagcttagtcgtgttagtctacaatttgatagcaagggaagtcagcaatcgatgatatttactaacaatcgatgtttatctgataaagaaaatttggaaaacttgcaaaatcttttatatctacattgtgatcttaaccggccccatttgagttgtgagctgccgtcagagcatcgcgaaaagtgccttaaacgccgtaactctagtctcagctctaatttgcatgctaataagcggtttctcttcaattctcaaagtgatgggaataaaaagaatgaaacttttccttctactaactactcgaacgttttctacccaaacaactgtgacagtaaggaagtcgctagtgaaacaacattctcacttgatgcaccaaataattctgttaattactcttatttttctcctaatttactcggcaacgattccaaaacccgtcaatcttttccccctcattcatcttcatcttcacataattctttgcatgaacctgtcatatatgatttttcttcagaaaatcctagcattcatccttctaatcatttgagctctcaaaaaaatgctgttttgaaattagcacaattaatttcttccttcgaaaaattacccgaaagtgttcgtcaatacttactttttcatcttctttctcgatgtggaaaacatgctgttcaaaatattcacaaaattctgcttcctatctttcaaaagaactttttaactggatttccggctgagattacaaatttagtgcttacgcatttagatgcaccttcattgtgtgcagtttcgcaagtttcgcatcactggtataagttggtatcgtccaacgaagaactttggaaaagtctctttttaaaagatggtttcttttgggattcaattgatagtaaaatccgtacgatgtgtttagaacaatctttgtcagcctgtgcgataatgaagcgggtctattttagacattttaatcttcgtgaaagatggctccatgccccggagaaaattaagcgatgttcattcccaattcatggagttcgtcttattaccaaacttcagtttgatgatgacaaaataattgttagcacctgcagtcctagaattaatatatatgacacgaaaacaggtgtcctgatacgcagtttagaagagcatgaaggtgatgtttggacttttgaatacgttggggatactttggttactggctccacagacaggacagtaagagtctgggaccttagaaccggtgaatgtaaacaggtgttttatggacacacgtcaacaatccgttgtatcaaaatagttcaaggcaatcaaagtactactgatactgatgatgtggaaaaagaaaacagaccagcttcaaatgatgctaattcaatgcctccgtatataatttcaagttcaagggattgtacgatccgtttatggagtcttccatgccttgacgatccaccatttgttaatgtaaatgaaaatcctgatcagaataatgactttacttcagctacgaccaatccgttttacatccgaacattacgtggtcatacggactcggtacgtgaagttgcttgtcttggagatttgattgtcagtgccagttatgatggtactcttagagtatggaaggcatctactggcgtttgtttacatgttcttcggggacacgtcgggagagtatacagtgtcacaattaatccttctcgtcaacaatgtatcagcgctggtacggatgctaaaattcgtatttggaaccttgagtctggagaacttctacagacccttcatggtcattcgaatttggtaagtcaagttacatttaaccaaaatatcttggtatccgcttctgctcctcctgatacatcgttgagagtttgggatctaaacaccggaagttgtcgagatattttaaaatgtcctttgggacacatattttttcaacacgacgagagcaaagttgtcagtggaagccatagtacgctacagttatgggacattcgttccggaaagttagtaagagacctattgactgatttggatataatctggcaagttgcttataatgaaaatgtatgtgtggctgctgttttaagaaataaccgtttttggatcgaggtcctagagtttggatctactaaatcttct

SEQ ID NO: 26282 - DNA, 816 bp, Schizosaccharomyces pombe
atgccttcttctgctagtgaacaacttcttcgaaaacaactaaaggtaagcgcacgaaatcttcatatccaaatattcatgattgtacatagtatcttaattcttgaacacatactgatagatataggaaattcaaaaaaatcctccacagggttttagcgttggtttagtcgatgataaatccatttttgaatgggaagttatgatcattggaccagaagatacattatatgaaggtggttttttccatgcaacattatcgtttcctcaagtatgtatttatgtttcacagaaaaataatatttgttgtataaggtaaacaagctggtcactaacctcgaaaaattaggattatcctctgatgcctccaaagatgaaggtatagtaaatacattgattttttaattgatagaaactacatagtctatgcctaaaaacgattctaacggtaacagttcacaacggaaatttggcaccctaatgttcatccgaatggcgaagtttgcatatcgattcttcacccaccaggagatgacaagtatggatacgaggatgctggagaacgttggcttccggtacactctccggaaaccatattgattagtgtaatttccatgctttcttcccctaatgatgagtcccctgccaatatagatgctgccaaggaatttcgagaaaatcgtgagtatatactaacctacaaacaaaaaaatttactctttaataatcaaatcgtactaactttttccagcacaagaatttaagaaaagagttcgtcgacttgttcgcaggtcaattgaaatgatttgaagataa

SEQ ID NO: 26283 - DNA, 2265 bp, Schizosaccharomyces pombe
atgacctcttatgaactttcacgagagctaggtggccataaacaagatgtatgaagaaagggttatttgttaataccataatcatgaacatgttcaataacaaatatatattaggttcgcggtgtttgcagtatttccaatgaattgataggatctgcctctcgagatggaacttatagtgtctgggagcaaatcaatggagaatggacgccccatttttacgaaaatcatgaagggtttgtcaattgtgtttgttatgtgccggcgatcgataaaaactctaggggtaattactgatattgattttatttatttattaactttgacaaaggttacatattttcaggcggacaagacaaatgtggtattcttcaagaagtaggcactaattcaccctcttattatttgtttggacatgagtccaacatctgttctgcatctgcattaaatagcgaaacaattattactggaagctgggatagtacggctagagtatgggctttaggccaatgtaaatatgtacttaaagggcaccaatcctcagtttgggctgttcttgcccttggtgaggatatctttataacaggttcagccgataaattgatcaagatttggaacggagaaaagcttgtcaaatctatcttagcacataacgattgtgttcgctcgctttgtcaaattcctggaggttttgcttcctgctctaatgatggtgttattaaactatggacttcagatggtgaattcttatatgaattgcatggccatacctcgtttgtatattctttaacttatatccacaaccagcagctgatcgcatcttgtggtgaggatcgtacaatcaggatttggaaaggtaaagagtgcttacaatgtattactttaccgacaactagtgtttggagtgtttcctcccttccaaacggtgatttagtttgcggttccagtgatggttttgttcgcattttcacagtggataaggttcgagttgcacctactgaagtactgaaaaattttgaagaaagagtttctcagtttgccatttcgagccaggaagttggtgatattaaaaaagggtcactgcctggtttagaaattctttcaaaacccggtaaagctgacggggacgttgtaatggttcgtgtaaataatgatgttgaggcttaccaatggtctcaaaaagagaatgaatggaaaaaaataggccaagtggtcgatgctgttggtaacaacaggaagcaattatttgaaggaaaagaatatgattatgtctttgatgttgacgttgcagatggtcaagctcctttaaagcttccttataatgctaccgaaaatccatatcaagctgctaacagatttttggagctgaatcaacttcccttgtcttacaccgacgaagtagttaaatttattgaaaaaaatactcaaggtcacagtttggaatcgaaaaaggagccgaacctagagagccaatcttcaaacaagattaagacgaccatatttccagtttctcaattgcttttctctaatgctaatgttccggcaatgtgtcaaagattacgttccttaaacaatacaaagtcaaaccctttacctgctaaatctatcgacagtttagaacgtgctttgtcttcaaaaaaaattacagatacagaaaaaaatgagcttttggaaacttgcttatctatcctcgattcatggtctttggcagaaaggtttcctgcgttagatgctttaaggttactagcaatcaattcttcttctgatttagctccaatatttttagaagtatttagccgagttgtgaaatctgtgccttctagtgggaattttgaatcgatcaatgtgatgctagcgttacgtggtttgtctaatgttgtcccaaatatcactgatgctgaaggggtatcgaaactgatggattgtttgacatctactgttccgcaagctagtagcgccaaggactttaaaattgcgtttgcaacattagcaatgaatttatcaatattgttgatacaactaaacctcgagaacactggaattgaacttttatcaatactattttcatttttggatgatccatctcctgacaacgaagctttttatagagcattaatggctcttggtacactttgcactgtacccgatatcgctttagcagcttctcaaatatatcatgcccagtcaatcgtccatgggatagcggaaaggttttcacaggagatgcgctttgtagacgctgaaaagcaaatcctttcactcttt

SEQ ID NO: 26284 - DNA, 772 bp, Synechocystis sp.
ggcgcgccatcgccggctggcggaaattaccgaaatgatccacaccgctagtttggtccacgatgacgtggtggatgaggcggatctgcggcggaatgtgcccacggtgaatagtttatttgacaatcgggtggcagtgttagcgggggatttcctctttgcccaatcttcttggtatttggctaacttagataatttggaggtggtgaaattattatcggaggtaattcgggactttgcggagggggaaattttacagagcatcaatcgttttgacaccgacacagatttagaaacctatttggaaaaaagctattttaaaaccgcctctctcattgccaacagtgccaaggcagcgggggttttgagcgatgcgccccgggatgtgtgtgatcatctttacgaatatggtaaacatttggggttagcgttccagattgtggacgatattttagatttcacttcccccacggaggttttggggaaaccggccgggtcagatttaatcagcggcaacatcaccgccccagccctatttgccatggaaaaatatcccctacttggtaaattaattgaacgggaatttgcccaggcgggggatttggaacaggccctggaattggtagaacagggggatggtatccggcgatcaagggaattggccgcgaaccaagcgcaactggcccggcaacatctgagtgtgctggaaatgtccgctccgagagaatctctgttggaattagttgattatgtgcttggtcgtctccattag

SEQ ID NO: 26285 - DNA, 939 bp, Synechocystis sp.
atgctttccctagaaaatcaacgtattttggtcactggcggggccggtttcctcggtaaacaagttgttgcccaattaattgcagccggtggcgatcgcccaaaaattaccattccccgctccaaagactgtgatttacggcaagcgtcagcctgcgaacgggcagtggaaaatcaagacattgtcattcacctagcggcccatgtggggggtattggtctgaaccgggaaaagcccgctgaattgttctacgacaacttaatgatgggggtgcagttaatccatgcggcccaccaagcgggggtgaaaaaatttgtttgtgtgggcaccatctgcgcctatcccaaatttacccctgtaccctttaaggaagaagacttatggaacggttatcctgaagaaaccaacgctccctacggcgtggccaagaaagcattgttggtgcaactggaatcctaccgcttgcagtatggctttaatggcatttacctcttgccagtaaatctttacggcccagaagataacttcgatccccgcagttcccacgtgattcctgccttgatccataaggtttacgaagcgcaaaaagctggacaaaaacaattacccgtttggggcgacggcagtcccaccagggaatttctttactccactgatgcggcccggggcattgtgatgggaacccaagcctacgacaaagccgatccggttaacctaggcaccaattttgaaatttccatcaaagacttaacggaattaatctgtgaactgatggagtttgagggggacattatttgggaaaccgatcaacccaacggccagccccgtcgctgtttagacaccaccaaagctaaagcagaatttgggtttgaagcccaggtgagcttgcgggaaggattgaaaaataccattgactggtatcggcaacaacggagctaa

SEQ ID NO: 26286 - DNA, 1089 bp, Synechocystis sp.
atgtcaaagtctaaagttgttttgctgacaggcatcacggggcaagatggctcctatctgagtgaattgttgttggaaaagggctaccaagtccatggcatcattcgccgaacttctacctttaacactgaccgcattgatcatctttatgttgatccccatgatcttgaggcgaaactccgacttcattatggtgatctgaccgacggcaccaccctgcgccgcattttagaagatgtcaaaccgacggagatttacaatctgggggcccaatcccacgtgcgggtgagctttgattctccggaatacactgtagattcagtggccatggggacgctacgactattggaagcgattcgggattatcaacatcgcaccggcatccaagtaaggttctatcaagccggttcttcggaaatgttcggcaaagtgcaggagattccccaaaaggaaaccacccccttttatccccgcagtccctacgcctgtgccaaggtttatggccattggcaaacggtgaactatcgggaatcctatgacttattcgcctgtaacggcattttgttcaaccacgaatccccccgccggggagaaacctttgtaaccaggaaaattactagggcgatcgccagaattgtggccggcacccaaaagaaattgtatttaggcaatatcgattccaagcgggattggggctatgccaaggactatgtacgggccatgtgggccatgttgcaacaggaacagcccgatgactatgtggtggccacgggggaaacccacgaagtgaaggaatttttagaaattgcctttggttacgtcaacctcaactggcagaactatgtggcctttgatgagcgctatttacgccccgctgaagtagatttattaatcggcgatccggcgaaaaccaaagcccaattgggctgggaaccctcggttacctttacggaattagttcatttaatggtggaggcagacttagcagtccttggtttaacttctcccaaccagagtggacgaatcaaggagctcatggcccaggatatggccttcattcggagccaaaatggccatgccgtcgattaa

SEQ ID NO: 26287 - DNA, 1980 bp, Synechocystis sp.
atgggggaagaacctgtgccggcggataaagcattaggcaagaaattcaagaaaaaaaatgcctcctggagcattgaagaaagcgaagctctgtaccgggttgaggcctggggggcaccttattttgccattaatgccgctggtaacataaccgtctctcccaacggcgatcggggcggttcgttagatttgttggaactggtggaagccctgcggcaaagaaagctcggcttacccctattaattcgtttttccgatattttggccgatcgcctagagcgattgaatagttgttttgccaaggcgatcgcccgttacaattaccccaacacctatcaggcggtttatccggtcaaatgtaaccagcaacgacatctggtggaagccctggttcgctttgggcaaacttcccagtgtggattggaggcaggttccaaaccggaattgatgattgccctcgcaactctaccacctcccttagaccgtcaggacaagcataccaagcccctaatcatttgtaatggctacaaagaccaggattatctagaaacagctctgttagccaaacgcttaggccatcgtcccatcatcatcattgaacaactacgggaactggaatgggtactacacatctctcagcagttaaacattaaacccatgttgggggtacgggcccggttaagttgtcagtcgctcaaatcctcggaaatttcctctggcaacggcgatcgggctaagcttggtctgaccatgccggacattgtgaccgtaattcatcgtctagaggaaaataattgtctcgattgcctgaaaatgcttcattttcatctgggaacgcaagtttcggacattgctctgattaaagaagctatgcgggaagccagccaactctatgtggaattggtcaagctgggggcaaaaatgcgctacctcaatgtggggggcggtttggcggtggattatgacggttccaagaccaactatcccgcctcgaaaaattacaacatgcaaaactacgccaacgacattgtggcggccattcaagatgcctgtgagcttgggcaggtttcccctcccattcttgtgagcgaaagtgggcgggcaattatggcccatcagtcggtgctagtttttgatgtgctaggcagcaaccaaacaggcttcagtgaaccccatccccccgatgaaaatgcccatcccctgctaaaaaatctctgggaatgttacgaaacaattacagcggaacaataccaggagcaataccatgatgctctgcaattaaagacggaggctagtagtctttttaacttcggctatttaagtctgacggaacggggacaagcagagcaaattcactgggcttgttgtcgtaaaatttttgaaatcaccagacaactagagtatattcccgaagattttcaagcgctggataaaataatgaccgatatttattacgttaacttatcggttttccagtcagcaccggaatcctggtctttagatcaactttttcccattttgcccattcaccatctcaatgagaaacctagtcaaagggtgattttagccgatttaacctgtgacagtgatggtaaaattgaccgttttattgacctgtgggatgtcaagtcatacctagaagttcaccccctagaaaatgacggcaatccttactatttaggtatgtttttagtcggtgcttaccaagaaattatgggcaatttacataatttatttggtgacattaatgtagttcacattgccactactccccaaggttatcagattgaatcggtggtgcggggagataccatgacggaggttttgggttatgttcagtacgattctgatgatttactcgaaggcctgcggcgtcatacggagttagccttgagcaatggacaaattaccctggaggaatctcggcgcttattggaagattatgagcaaagtttacggcgctacacctatctaagttga

SEQ ID NO: 26288 - DNA, 1818 bp, Synechocystis sp.
atgctcctttcgccccagtctaatcgacaagttttaatggcttatctaagtccccagtgggggcaagtgctggctttggcgatcgccttggggggaagcattatcctacaagtgcttaatccccagattttgcgctatttcatcgacacagccatggccggagggccccaaaccatactggtgtggctagcattgggctttatggcgatcgccgttgtacgtcaaggattggaaatcgttgccacctattgcagtgaaaccgttgcctggactgcgaccaataatctccgcttgaacctagctcgtcacaccctcaatctcgatctaacttttcacaaaaatcattgccccggggaactagtggaacgcattgatggagacgtggacgccctggcccgctttttctcccaatttgtgctccaagtactgggcaatggcttgctagtggtgggtgttctagtcgtgttgtggttcgagcagtggcaggcgggattgggtttgactctttttgccctagtagccctgggtattctcagccggttgcaatccttggcggtggggccatggcaagtttaccgtggcatcagtgctgatttttacggttttatcactgaatatttagccggattggaagacattcggggcaatggagcggtggactatgtcatgaaccgcttttatacattgataagaaactggctaagggcgtttcatcaagcacggttgcagagcaccctactatggggcagcaccgttggtctattcacggtgggcaatgctatcgccctggccttgggcgcttacctgtggcgtgtacagggtatcaccattggtacagtctatcttttgttttactatgccagtcttctccaagatcccattgaacggatacgggaagaactagaacagtttcaacaggccgttgccagtctttatcgcattcaagacctcattcgtcagtctccgtcaccccgattgggcagatcccaagctttgccatcggggtcactttccgtcgaaggaaaaaatgtgtggtttagttatccaaccacagcgagtttaaaacctggggacggcaaccacgaattacctgagcaccgccaaggtcaccaccacgaagatgctgattacgctctgcagaatttaacctggcatctacccgctggaaaagtgcttgggttgctggggcacaccggcagtggcaaaagtacattcgctcgactcttgttgaatttttatgccattcagcagggccaaattcagcttggcggcatcaaccttggggagatatctcagcgggagttacatcagcgggtcggttttgtcacccaagacgtgcaactgttccaaacttccatacgcaataatctgacattttttaatccccacatcccagaccgattgattttacaagccctgaacgaccttgggctggagccttggttggcaacattaccccagggtttagatacggaactaggcacggatgggggaggattatcggcggggcaagcccaattgctagcttttgccagggtatttctcaaagatcctgggctagttatcctcgatgaagcttcgtcacggcttgatcctttgacagaacagttaattgagcgggctatcaatcgattactagagcatcggacgggaattatcattgcccatcgcctcaagacggtggaacgggccgatcaaattctgattctagaccggggcaaagtgctggaatacggcgatcgcccagccctggcccacaatcctgcatctcgtttttctcagttactgaggactagctctgcgatcaagttaacctag

SEQ ID NO: 26289 - DNA, 669 bp, Synechocystis sp.
atgggattcttcgatttattcggtaaaaaaactgccatggttgcccccaatgaagcattacccgggcgatcggccactatgcccgtgccagataagcattttgtcaacggcaatcctctcaaagctccctttccccagggaatggaaacggctctgtttggtttaggctgtttttggggagcagaacgcaaattttggcaaatacctggagtttacagcaccgctgttggttatgcggctggttatacccccaatcccacttaccaagaagtttgtacgggtatgactggccataacgaagtggttttagtagcctttgatccccagcaagtgagttacgaccaattgctcaaagtcttttgggaaagccataaccctacccagggcatgcgccagggcaatgatgtgggtacccaataccgctctggcatttacacctattccgaagcccaacaacaggccgctttggcatcgaagcaagcctatcagcaagctctgcaacaggcaggctacggggaaattaccacggaaattttaccagccccggatttttattacgctgaagactatcaccaacaatatttggcgaaaaaccccaatggttactgcggtttggggggcactaatgtggcctgccccattggcacagaagtttccctgggagcttag

SEQ ID NO: 26290 - DNA, 1476 bp, Synechocystis sp.
atgtacatcgttcaaattgcctcagaatgcgcccccgtcattaaggctgggggattgggggatgttatttacggcctaagccgtgaattggaactgcggggccattgcgtcgagctaatcctacccatgtacgattgcatgcgctatgaccacatctggggtttacacgatgcttaccgcaacctagaggtgccctggtatggaagctcaatcttctgtgatgttttttgtggctgggttcacggtaggctctgcttcttcattcagcccaaatcttctgataactttttcaatcggggtcattattatggcgctctagacgaccatatgcgctttgcctttttctccaaggcggccatggagtttttgctacgcagtaacaaacgcccagacattatccactgccacgattggcaaacgggactggtgccggtgttgttgtatgaaatttaccgtttccatggcatggaccatcaacgggtttgttacaccatccacaatttcaaacaccagggtattgctggagccaatattctccacgccactgggctcaataatgacagttattatttcagctacgatcgcctgcaggataatttcaatcccaatgcgattaacttcatgaaggggggcattgtctactccaactatgtcaacaccgtttccccccaccatgcttgggaagcccgtttttccgatatttcctgtggcttgggccataccctggaaatccatcagcaaaaattcggcggtattttgaacggtttggattacgaagtgtggaacccagaaattgatcctttactggcgagtaacttcagtgtcaaaacctttggcgataaggcaaaaaataagcaagcgttacgggaaagattactgttagaaacggatgataaaaaacccatgctctgctttattggccgcttggatggacaaaaaggtgtgcacttggtgcatcactccatctactacgccctcagccagggagcgcaatttgtcctgctcggctccgccaccgaacccaatctgagcaaatggttctggcatgaaaaacaacatctcaacgataaccccaatgtccatctagagttgggctttgacgaggagctggcccacttaatttacggagcggcggacattattgtggtgcccagtaactacgaaccctgtggtttgacccaaatgattggtctgcgttatggggccgttccggtggtgcggggagtaggcggtttggtaaatactgttttcgaccgggattatgaccagaaccatcccccggagaaacgtaatggttttgttttctatcaaccggatgagtatgccctggaaacggccctcagtcgggcgatcgccttgtataaggatgatcccgtggcttttaaaaccttggccttgcagggcatggcctacgactactcttggaataaaccagggctccaatatgtggaagcctacgaatacatccgggcttaa

SEQ ID NO: 26291 - DNA, 999 bp, Synechocystis sp.
gtgtcccccatggaattaacccctgaaaccaaggccgctgtggttacccaaggtttgaccaaacgtttcgatcgccagggggcggtgaccaatgtggatttaagcattgcggagggtgccgtgtacggtctgatgggtcccaatggggcggggaagactaccctaatccgtatgttggccactgcggaagaacccaccaagggggaaatttatttatttggcgatcgcctggtagcgggggcagacaatttacgcatcaaacaatatttgggctatttgccggacgattatcccctctatgaagacttgaacgtttgggattatctcgattactttgcccggttatatcatttgaaaaatcctggccgtcgccaccgcatccaggaagtgttggagctagtgcaactaaccagtaagcgccacagccgcattaacagtctttcccgggggatgaaacaacggttaagtttggcccgcaccattatccatgagcccattttactcctgctggatgagccggtttccgggctggatcccctcgctcggcaacaatttcgtgacattattcgggtgttgcaggccgctggcatgaccattctgatttcctcccatgtgctcagtgacctggctgaactctgcacggcgatcggggtgatggaactaggttgtttggtggaaagtaccactttggcagatttatataaccggctggggcagcgcactatctccatcttcctattggagggagtagagcaattgcaggattgcctgaagaatcaacccggtgtggaggattggcagataaactatgaccagggagatcagccaaattccgccccaggtacccactgctctgtgattttttctggttccccggaagacagcgccaacctgctcagaaatttgatctatgctggttgtcgagtcagtcaattccattgtcaacaggaggatttagaaagtattttcctcaaactaggacatcaacaggtttcttga

SEQ ID NO: 26292 - DNA, 828 bp, Synechocystis sp.
atggctaatcaagatttaattcctgtggtagtgaacggtgcggctggaaaaatgggccgggaagtaattaaagccgtagcccaagcccccgatctccaattggtgggggcagtggatcataatcccagtctccaaggtcaagacattggcgaagtggtgggcattgcccccctggaagttcctgtcttagctgatctccagagtgtgttggtgttggccacccaggaaaaaattcaaggggtaatggtggacttcacccatcccagcggcgtttatgacaatgttcgttcggcgatcgcctatggggtgcggccagtggtgggtaccaccggattgagtgagcaacaaatccaagacctaggggattttgctgaaaaagctagtacaggttgtctgattgcccctaactttgccattggagttctgttgatgcaacaagctgctgtgcaagcctgccaatactttgaccacgtggaaattatcgaattacaccataaccagaaagccgacgcccctagcggcactgccattaaaaccgcccaaatgttagcggaaatgggcaaaacatttaacccaccggccgtagaagaaaaggaaaccattgcgggagctaagggaggactagggccagggcaaattcccatccacagcattcgtttaccggggctaatcgcccatcaagaagtcctatttggttccccagggcaactttataccatccgtcacgacaccaccgaccgggcttgctatatgccgggggtacttttaggcattcgtaaagtggtagaactgaagggcttagtttacggtctggaaaaactactctag

SEQ ID NO: 26293 - DNA, 1392 bp, Synechocystis sp.
atggttagcctcacccccaatccgagttatagcgtcagcctactgttggaactccccaaccacgccggaactttggccagcgttacccaggcgatcgccgatgcggggggcagttttgggcaaatttccctgattgagagtaacttaaaactcacccggcgggaaattgcggtggatgcttccagcagtgagcacgccgaaaaaattattggggcagtgaaagctctggataatgtcaaattgctgaaggtgtccgatcgcacctttgatttacaccgtcagggcaaaattagcgtggttagtcgcattcccctcacctcccaatcggatttggccatggcctataccccaggggtggggcgcatctgtcgggcgatcgccgaagatccggaaaaggtttattccctgaccattaaaagcaatacggtggcggtggtgaccgatggcagtgcggtgttggggttgggtaacctggggccggaagcggctttaccagtgatggaaggcaaggccatgttattcaaggaatttgcccaactggacgcttttcccatctgtttggatacccaggatacggaggaaattattcgcaccgtcaaggcgatcgccccggtgtttggcggcgtaaatttggaagacattgccgctccccggtgttttgaaattgaagcccggctgaaaaaagaattaaatattcctgtatttcacgatgatcagcacggcaccgccattgttaccctggccgctttgttaaatgccctcaaatttgttggtaaagccatggccgctgtccgcattgtcatcaacggcgctggggctgctgggttggcgatcgccgaattgctcaaggaatccggagccaccgatatttggatttgcgactccaagggcattgtgggcaaacatcgcaccgatttaaacagcaaaaaacagagctttgcggtggatgcggaagggactttagccgatgctatggctggagctgatgtgtttttaggggtgagtgcgccgggggtagtgaccaaggaaatggtgcaatccatggccaaggacccgattgtgtttgccatggccaaccctatccccgaaattcagccggaattaatccaagaggatgcggcggttattgccacggggcgcagtgattaccccaaccaaattaacaatgtgcttgcctttccgggggttttccggggagccattgactgtagagctagcattattaccaccaccatgtgcatcgaagcggccaaggcgatcgcctctttggtgcacagcaacaccctagatagtgagcatattattccttcggtttttgacaatcgggtcgccactaccgtagccagtgcagtgcagttggccgcccgcaatgaaggggtggccggtcaatag

SEQ ID NO: 26294 - DNA, 948 bp, Synechocystis sp.
atgcattcctacaccctccatgccccggccaaaattaatcttttcctcgaaattcttggcgatcgccccgacggtttccacgaattggtaatggtgttgcagagcattgccctgggggataaaattaccgtgcgggccaacggcaccgatgacatccggctcagttgtggggatagtcccttggccaacgatgccaccaatttggcctaccgagcggcccagttgatgattaacaattttccccaagcccatgataattacggcggcgtagatatcaccttgaccaagcatattcccatggcggcgggcttagcggggggctcggccgatgcagcggcggtgttagtcggtttagacctgctctggaatttaggcttaaccaggccggaattagaacagttagcggcccaactgggttccgacattcccttttgcattggcggtggcacggcgatcgccacgggacggggggaaatcctcgaccccttaccggacggcaattgcttctgggtggtattggccaaacatcgttccatagaagtttctaccccctgggcttaccaaacctatcgtcaaaagtttggcaagaattacctaaacgatgaccagtcccagcgagcccggcggaaaaccatccatgcagggcccctactccagggcattcagcaccgcaacccagggcaaatcgccagccatatccacaacgatttagaaaaagttgtgctcccggctcatcagcctgtagcccagttacgtcaggtcctacagtcagcggggggattgggcaccatgatgtccggctccggccccagcgtgtttaccctttgccgggagcaagcagaagcggaacaggtcctggcgatcgccaaagaaaaattaaacgaccccgacgtggatttttggctaacccacaccatcggccacggcatccaaattatgaataattga

SEQ ID NO: 26295 - DNA, 909 bp, Synechocystis sp.
atggttgcccaacaaacacgaaccgactttgatttagcccaatacttacaagttaaaaaaggtgtggtcgaggcagccctggatagttccctggcgatcgcccggccggaaaagatttacgaagccatgcgttattctctgttggcggggggcaaacgattgcgaccgattttatgcattacggcctgcgaactgtgtggcggtgatgaagccctggccttgcccacggcctgtgccctggaaatgatccacaccatgtccctcatccatgatgatttgccctccatggataatgacgatttccgccggggtaaacccactaaccacaaagtgtacggggaagacattgccattttggccggggatggactgctagcctatgcgtttgagtatgtagttacccacaccccccaggctgatccccaagctttactccaagttattgcccgtttgggtcgcacggtgggggccgccggtttagtggggggacaagttctagacctggaatcggaggggcgcactgacatcaccccggaaaccctaacttttatccatacccataaaaccggggcattgctggaagcttccgtgctcacaggcgcaattttggccggggccactggggaacaacaacagagactggcccgctatgcccagaatattggcttagcttttcaagtggtggatgacatcctcgacatcaccgccacccaggaagagttgggtaaaaccgctggtaaagatgtcaaagcccaaaaagccacctatcccagtctcctcggtttggaagcttcccgggcccaggcccaaagtttgattgaccaggccattgtcgccctggaaccctttggcccctccgccgagcccctccaggcgatcgccgaatatattgttgccagaaaatattga

SEQ ID NO: 26296 - DNA, 2241 bp, Synechocystis sp.
gtgccacagttgatatctgttcccaacctgtccaccgatgtccaccttggccaaacgtttcccttaggggcaacggtctacgccgatggggttaatttctgcttgttttccaaacatgcggaaagggtcacgctattgttgtttgatcgccctaatgatccggccccggcccgcaccattgagcttcatcgaggacggaaccgcaccttctactactggcatgtttttgtgaagggtttaaaggcggggcaggtttatgcttaccgtgttgatgggccccacgaaccggaaaagggccatcggtttgacccggacaaagttttgctcgacccctacgccaaggcgatcgtcgggaaggatatttacgaccgcaaagcagccatggccctcggagataactgcgcccaggccctacgcagcgtggtggtggacaccagtgtgtacgactgggaggatgaccatgccccccgcacgccctacgccgccagcattatctacgaactccacgtcgggggctttacccgcaaccccaattcgggcttaagcgaaaacaaacggggcacctatgcaggattaattgaaaaaattccctacctcaaggaattgggcattacagcggtggaattattaccggtgcattattttgaccctgaagatgcccaaccaggactgaccaactattggggttatagtaccatcggcttttttgcgccccaccaaggctacagtgctgccgatgatcccctggaagtggtagacgaatttcgggacatggtcaaagccctgcacaaagcgggcatagaagtgattttagatgtggtctttaaccacactgcggagggcaacgaaaaaggccccaccctttccttccggggcattgataacagaacctattacatcctcgatgaagataaaagttcctacagcaactacagcggttgcggtaatagcgttaaggctaatcaccccgtggtggggggtctaatccttgattccctgcgctactgggtatcggaaatgcatgtggatggctttcgctttgatttggcttccgtactggtgcgagataccaaaggagtgcccctccatggtagtgaaattgccaccgccaacatcatctgggcgatcgaatccgacccgattttagccggtactaaattgatcgccgaagcttgggatgcggcgggactgtacagcgtcggtaaatttgtggagttggcagactggtttgcggaatggaacggtccttttcgggacgatgtgcgtcgctttgtcaaaggggataatggcgcagtgccagcattggctagccgcctactaggtagccccgacatttactatcgccaagatacggatattaaccgcagtatcaactttgtcacctgccatgatggttttaccctggtagacctggtttcctacaacgaaaaacacaacgaagccaacggagaaaagaaccgagacgggaccaatgataatttcagttggaactgtggcgtggaaggggaaaccgatgaccccaaaattaatcaactgcgactgcggcaaattaaaaactttctaactattttattcttttcccagggtacgccgatgttgctgatgggagatccggtgggcagaacccagcagggcaataataacggctattgccaagataacgaactaagttggttcgactggagtggggaagaaacccacagcgatgaaactcactttttgcggggcattattgctttgacccaaagcctatccctatttcttgaggaaagtttattgccggtgctaaattttgctctaccccgctttcccgatgaaaatgacggctctgagggggatggccaggacggggaagaacccgtttataaacccctccctccagtggacgaagcagctctgcgggaaatgtatcttaaagcaactaaggatttaccgggctcctgcgtggtttggcatggagtgaaactagcccagcccgattggtcttacacttcccatactttagcggtcaccctattccatccaggagcggaggaaattctccatctgatctttaatgcctattgggaaccgctgaattttgaattgccccctctaaacgatggtttgatttggcatcgactggtggatacctatttaccaactccgttggacttccaggagccggcgatcgcctctccggttgagggagaaacatattgggttcagccccgttcttctgtggtgttaatggcaaaatag

SEQ ID NO: 26297 - DNA, 921 bp, Synechocystis sp.
atgcatagtcctaataaatttacctctgggcccaaacagtttctggagtcggaagccattacctcctatgctgatgccgctgtggtggtggtgcccattccctatgaggcaactacttcctaccgtaagggttgtgagcatggccctgaggcggtgctagaagcttcggaccagttggaagcctatgacgaagagttgggcacttccccctgccatgatttgggtatttacacctgcgctcccctggcggacagcaataagcatcccgctttggctggagacgccatggtaacggaggtttgtgacggcattgccccttttgtggaagacggtaaatttgtagtggcgatcggtggggaacatgccattaccactggggtagtgcgggctatgcaaagggggacatcggagccttttacggtggtgcaaattgatgcccatggggatatgcgggacaaatttgaaggttcctgccataaccatgcctgtgtaatgcgccgggtgttggaattgggcttacccactctgccgatcgccattcgggccatttgtcaggaagaggcagatttgattcgggaaaaaaatattcctgtgttttgggccagggaaatggccgataatcccaattggattaacgaggcgatcgccagcatcaccacacaaaaagtctttctcaccattgatatggacggttttgatccggggtttatgccgggagtcggcacccctgaaccgggggggctaggttggtatgaagggttaaattttttccgccgtctttttcaaaccaagcaagtaattggttgcgacttgatggaactggccccagtgcgaggctcggtggtgtcggaattttctaccgctaaactagcctataagttgatgggttactggggagagtcccaacggaaaaaactctag

SEQ ID NO: 26298 - DNA, 1896 bp, Synechocystis sp.
atgtgtggcatcgttggttacatcggcacccaaacggcagtaaatatcctcattgaagggctagaacgcttagaatacagaggttatgactccgccggcattgctacggtcaccgaaggaaaaattgagtcggtgcgggctaagggcaaactatttaacctcaaggaaaagctagaaaaccacagcaacttttcccgcctgggcattggacatacccgttgggccacccacggtaaaccggaggagcataacgcccacccccacttggataaccagcaacgcatcgccgttgtgcagaatggcatcatcgaaaattatcaaaccctgagggatcagttaaaggaaaagggttaccagttttattcggagacggataccgaggtcattccgattttgattgccgacatccttaaggatttgcccagtgatgatccagacgaagctctactggaagccattggcaaggccgtacatcagctagagggagcctttgcgatcgccgttttagatgcccattgtccagagcaactaattgtggcccgacagcaagcacccttaattctgggctttggccagggggaattcttttgtgcgtccgatgtgacagccttagtgcaccacaccaccacagtactttctttggagaatggagaaattgccaggttaacgcccctgggggtagaagtttacgactttaacctgaaaagggtgagaaaattaccccgcaccctcgattggagcgccaccaccgttgaaaaacagggctttcggcactttatgctcaaggaaatctacgagcaaccagccgttgtccgcacttgtttagcaacttatctcaatgaacaatggcgggccgccgaccatcctagccatagtcccgtattcctgggtttagacccccagttgaccaaaaatctccaacatattcaagttctggcctgtggtactagttggcatgcgggtctggtggggaaatatttactagagcaattggccggcattcccaccacagtgcattacgcttcggaatttcgctatgcggcccctcccctgacgccccacaccctcaccattggcgtgactcagtcgggggaaacggcggatactttggccgccctggaaatggaaaaacaacggcgcttaactttggaagacgactataaacccctgattttgggcattaccaaccgtccggaaagtaccttggctaccatggttaatgagattattaatacccacgctggcattgaaattggggtggccgccaccaaaacctttgtggcccaagtgttggccttttattttctcgccctggacattgcctttcagcgacacagcctgagcttggaagccatagaacacatcatggttggtctgcgacaattacccgcccaaattgaaaccattttggaacaacagggtagtgctattgaagccctagcccatgaatttgccgaaacccaagactttattttccttggtcggggcatcaattttcccattgcgctggagggagctttaaaactcaaggaaattagttatatccatgcagaaggttaccccgccggggaaatgaaacacggccccattgccctcctggatgccaaagtcccagtggtggcgatcgccatgccgggttcagtgcatgacaaggtaatttctaatgcccaggaagccaaagccagggatgccaggctcatcggggttactcccatggacgacagccaggcccgttctgtgttcgatgatttattgttagtgccccacgtggaggaaatgctttcccctattgtggcagtgattcccctgcaacttttgtcctaccatattgccgcccgccgggggttagacgtggatcaaccccgtaatttggctaagtccgtcaccgtggagtag

SEQ ID NO: 26299 - DNA, 945 bp, Synechocystis sp.
atgcctaaccttaaagcgattcgtgaccggattcagtcggtcaaaaatacaaaaaaaattactgaagcgatgcgtctggtggcggccgctaaggtgcgccgtgcccaggaacaggtgctttctacccgtccgtttgccgatgctttagcccaggtcctttataacctacaaaatcgtctttcctttgcggaaaccgaattacctttgtttgaacagcgggaacctaaagcggtagcccttctggtggtcaccggcgatcggggtttgtgcggtggttataacgtcaacgcaattaagcgggctgagcaacgggccaaggaattaaaaaaccaaggcattgccgtcaagctggtactggtgggcagtaaagccaagcaatattttggccggcgggactatgatgtagccgccagctatgccaatttggagcaaattcccaatgcatccgaagcggctcagattgccgattccctagtggctctattcgtatctgaaacggtggatcgggtggaattaatttacactcggtttgtctccctaattagctcccaacctgttgtacaaaccctgttccccctctctccccaaggattggaagcccctgatgacgagatttttcgcctgattaccaggggtggcaaattccaagtggaacgggaaaaagtggaagctccggtggaaagttttcctcaagatatgatttttgaacaggatccagtgcaaattctggaagcgctgttgcccctgtacaacaccaaccagttattgcgggctttgcaggaatccgccgccagtgagttggcggctcgaatgacagccatgagtaatgccagtgacaacgctggacagttgatcgggactttgaccctgtcctataacaaagcccggcaggcggccattacccaagaattgttggaagtggtagcaggggctaattccctctaa

SEQ ID NO: 26300 - DNA, 1512 bp, Synechocystis sp.
atggtaagcattagacccgacgaaattagcagtattatccgccaacagattgagtcctacgaccaaagcgtccaggtttccaatgtgggaacggtgctccaggtgggggacggtacggctcggatctatgggctggaacaggtaatgtcccaggagttactggaatttgaagatggcaccatcggcattgccctaaacctagaggaggacaatgttggggcggtattgatgggggatggttttggtatccaagagggcagtaccgttaaaaccactggtcagattgcccaaattcccattggggatgccatggtgggccgggtggtggattccctcggtcgtcccatcgacggtaaaggccccatcagttccaccgctacccgtttgttggaatccccggcccctggaattattgaacggaagtccgtttgtgaacctatgcaaaccggcatcaccgccattgatgccatgattcccattggtcggggtcagcgggagttgatcattggggaccgtaagaccggtaaaacggcaatcgccattgacaccatcattaaccagaagtccgaagacgtaatttgtgtttacgtggcgatcggtcaaaaagcttccaccgtcgctcaaatcattgacaccctgacggaaaaaggtgccatggcctataccattgtggtggccgccaacgccaacgaccccgccactctgcaatatttggccccctacaccggtgccaccttggcggaacactttatgtatcaaggcaagagcaccttggtaatctatgacgatttgtccaagcaagcccaggcttaccgtcagatgtccctgttgatgcgtcgtccccccggtcgggaagcttaccccggtgatgtgttctacatccactcccgtttgttggagcgggccgccaaattgagtgatgccctcggcggtggtagcatgaccgccctaccggtgattgaaacccaggctggagacgtatctgcctacattcccaccaacgtaatttccattaccgatggtcaaattttcctttccactgaccttttcaacgctggcttccgtcctgctattaacgctggtatttcagtgagccgggttggttccgccgcccaaaccaaagccatgaaaaaagtggctggtaaattgaaactggaactagctcagtttgctgagttggaagccttctcccagtttgcctctgatttggatgccgccacccaagcccaattggcccggggtcaacggttgcgtcaattgttgaagcaaccagaaaattcccccttgtccgtgtgggaacaggtggccattagctatgccggtttaaatggttacatcgacaccattcctgtggacaaagtgactgaatttgcccagggtctgcgggattacctcaaggccaacaaagccaagtacgtagaaattatcaatagctccaaagctttgaccgacgaagcagaaactttgttgaaagaagggatcaaagaattcacccaaggttttgccgcctaa

SEQ ID NO: 26301 - DNA, 558 bp, Synechocystis sp.
atgaaaggttccttatacagtagtaagattgctgaaccctacgcccaggcgttgataggattggcccaacagcagaatttaactgaagttttcggggacaacttgcgctctctgttgaccctgctccaagattctcccgatctgtcggcggtgctttctagccccgtagtcaaggacgaagataaaaaatccgtgctccgctccgtgctgggggacgggggcaatggctatcttctcaacttcttaatgttgttggtggataaacgccggattgttttcctcgaagccatttgtgagcagtacctcgccctgttgcggcagttcaccaatacggtcttggcagaggtcacctccgccctcaaactcaccgatgcccaaaaggatcaggtgaaggaaagagttaagcaactcaccggggcccaggcggtggaactagaaaccaaagtagacggcgacatcctcggtggcattgtcatcaaagtgggttcccaggtgtttgattccagtttacggggtcaactccgccgggtgggtttaagtcttgggaccgccctctag

SEQ ID NO: 26302 - DNA, 1437 bp, Synechocystis sp.
gtgcaagcaacgatgagtcaggattttgattacgatttggtgattattggcgctggcgttggcggccatggggctgctctccacgccgttaaatgtggtctgaaaaccgccatcatcgaagctaaagatatgggcggcacctgtgtgaatcggggttgtatcccttccaaagctctcctcgccgcctccggtcgggtgcgggaaatgtccgaccaagatcatttgcaacaactaggtatccagatcaatggcgttaccttcaccagggaggcgatcgctgcccatgccaacgaccttgtgagtaaaatccaatctgacctgaccaatagcctcacccgtctcaaagtcgataccatccggggttggggtaaagtatccggcccccaggaagtgacggtgatcggggacaacgaaacccgcattctcaaagcaaaagagatcatgttatgcccaggctcggtgccctttgtgccccccggcattgaaattgaccataaaactgtctttaccagtgatgaagcagtgaagttggaaacgttgccccagtggattgccatcattggtagtggttacattggcttggaattttccgacgtttacaccgccctcggttgtgaagtgaccatgattgaagccctgccggatctgatgccagggtttgatccggaaattgccaaaattgccgaacgggtgctgattaaatcccgggacattgaaacctataccggcgtatttgccaccaaaatcaaagcaggttcccctgtggaaattgaactcaccgacgccaaaacaaaagaagtgattgacaccctggaagtggatgcttgtttagtcgccactggccgcattcctgccaccaaaaatttagggctggaaacggtgggagtggaaaccgatcgccggggtttcattgaagttaacgaccaaatgcaagtgattaaggatggcaaaccggtgccccatctctgggcggtgggagatgccacgggcaaaatgatgctggcccatgccgcttctggccaaggagtggtggcagtggaaaatatctgcggccgcaaaactgaggtggactaccgagccattccggcggcggccttcacccatcctgaaattagctacgtgggtttaacggaagctcaagccaaagagctaggggaaaaggaaggatttgtggttagtacggccaaaacttactttaaggggaactccaaagctctagcagaaaaggaaaccgacggcattgccaaagtggtttaccgccaggataccggggaattattgggtgcccacattatcggtattcatgcatcggacctaatccaagaggcggcccaggcgatcgccgaccgcaaatcagtgcgggaattggccttccatgtccatgcccaccccaccctgtcggaagtgttggacgaagcgtataaacgggcggtttaa

SEQ ID NO: 26303 - DNA, 2031 bp, Synechocystis sp.
atgaccaccctgaccccctttattcccctcaatttccccatcacggcgatcgtcggccaagaggcaatcaagctggctttactcctaggggcgatcgatcctggcttggggggcattgttattgccggacggcggggcacagccaaatcggtcatggctagggcaattcacactttgctccctcccattgaaatcattaagggcaaccgttaccaatgcgatccaaaaaatcccggcagttgggatgatgacaccctagaaaaatttgccgatgttcccctggatcaattggaaacccaggtaattcccgctccctttattcaaattcccctgggggtcacggaggatcgcctgttgggatcggtggatgtggaaaaatccgttaagcaaggggaagcggtgtttcagccgggattactggcccaggcccatcggggggtgctgtacattgacgagttgaatttactggatgaccagattgccaatcagttgctaacggtgttaacggaaggcaaaaaccagattgagcgggaaggcatgagttttcagcatccctgccagcctttattaattgccacctataaccccgaagaagggccgttgcgtcgccatttattggaccgcattgcgatcgccttgagtgcggacggtattttggggctggatcaacgggtagcggcggtggatcaggtgctagcctatgccgattctcccattagttttattgaccagtacgacgccgaattggacgacctaaaaaccaccatcattctggctcgggaatggctcaaggaagtgagtttaaccccggaacaggtgagttatctggtggaagaagcaatccggggcggcctccagggccatcggggagaattgtttgccatgcgggtagcgaaggcgatcgccgctttggatggccgtagtgatgtgcaggctgatgatctgcggcaagcagtggaattggtgattgtgccccgtagcgtgttgatggacaatcccccgcctccggaacaggctccccccccgccgccccctccccaaaatcaggatgaagggaaagacgagcaagaggatcaacaggatgacaaggaagacgacaaagataatgaaccggaagcggaacaggatccccccagcattccggaagaattcatttttgatcctgaaggagtaagccttgatccctcggtgctgtattttgcccagatggcccagaaacaaggtaaatccggcagtcgttccgtaattttttccgatgaccggggccgttacctcaaaccgattttgcccaaaggaaaagtccgccgcattgctgtggatgccacgttgcgggccgcttccccctaccaaaaatcccgtcgtttacgccatcccgatcgccaggtaattgtggagcagggagatattcggggtaaaaagttagtgcggaaagccggggcattaattgtgtttttggtggatgcgtcgggttccatggcgttgaatcgtatgcaggccgccaaaggggcggtgatgcaattgctcacagaagcctacgaaaatcgagatcaggtttcccttattcccttccagggagaaaatgccgaggtactattgccccccacccgttccattgccatggccaaaaaacggctggaaactttgccctgtggcggtggttctcccctttcccacggcttgatgcaagcggtcaatgtgggtatgaatgctaaacgatccggggatattgggcaggtagtaattgtggccattaccgatggtcggggtaatattcccttggcccgttccctgggcgatgaaattcccgaaggagaaaagcctgatatcaaagcggaattgttagaaattgccgccaagattcgcggtttagggatgcaattgttggtgatcaacaccgagaaaaaatttgtttccactggcttcggtaaagaattggcccaaaaagccgggggcaaatattatcaactccccaaagccactgaccaaggtattgcctccatggcccgccaggcgatcgccgacatgcaatag

SEQ ID NO: 26304 - DNA, 1452 bp, Synechocystis sp.
atggtcaacctcaatcaacaagatttgcccctggtcaatgcgttaaaagccctagctcaacaaccggatacgcctttttatgcgccgggccataaaaggggtcagggtatttcccctagttttaaacaatggttggggccaaacctcttccaagctgatctgccggaattgccggaattagataatctctttgctcccaccggggcgatcgccaaagctcaggagttagccgcggatttatggggggcagaacacacttggttttctgttaacggttccaccgccggtattgtggccgcaattttggccacctgtggggatggggataaaattctcttgcctcggaatgttcaccaagcggcgatcgccggcattatccatgctggggcagtgccaatatttttggaaccggaggttaaccccgattgggatttggctttgggggtgacggaggaaactttaagtaaagcattgcaagaacatgacgatgcaaaagcagtatttttgctcaatcctacctaccacggtgttgtgggggacttacaaaaattaattaaattaagtcatagagttaacctacctgtcattgttgatgaagcccacggtgcccattttgctttccatccatccttacccagaccggctttagaattaggggcggatattgtcatccaatccacccataaaatgctgggagctttgagtcaatgtgccatgatccatggccaaggaaacttaattaatcccccaagaattagtcaatgtttgcaattaattcaatccactagtcccaattatgttttattggcttccctcgatgatgcgcggcaccaaatggccaatggcggcagagaaaagatggcggaattattgaattttaccctccattatcgacaacaattaagtcaaattcctgggttaactttattagaaattaccaaacctttgcccggagctttaatcctcgatcccacccgcattaccgtcgatgtcactgcctggggaatgtcaggatttgaggtagatgatttgttacgggaaaagtttcaaattacagcggaattgcccaccctaaggcagttaagttttatcgttagtattggcaatcaagcccaggatttaggacatttattggaagctttaacccagttagcacctacgaatcctcaacaaccttttcacctaactttacccgtcttacccggtactattctggctatgactccccgccgagcggcccatgctgcccaaaaatcggtaaccgttaatgaagcgattgggaaaattagtgctggtctgctttgcccctatccccccggtattcccgtccttgttcccggagaaattatcaccccggaggcgatcgcctttttgacagaagttttaaatttagggggtaccatcagcggtttagctagtgaggaattaacccatttggctgtggtgaattaa

SEQ ID NO: 26305 - DNA, 2505 bp, Synechocystis sp.
atgcaaatcaataaccatgttttcaaaggtttggctgattttcgatcagtgtcttggcaaaggcaaattatagtggcgatcgccatctatggaactatctatatttcccaattatttattacctatgcgggcaccgcttcatcgcccatttggattcctacgggtatggctgtaggctttttatctatttggggttaccaagtctggccgggtatggttgggggattattactgggagaaattatggctctccacggtttggaaagtgctgctaatttcatactaacggtggcgatcactggggtagtcagtttagtcaatcttttttcagtctatcttagtgacattcttacagccaataattatctattttctaaaattaagaatattattagatttattgtttttgtttgctttggtagtcgtcttcccgctgcaatcatttgtccatttttattatatttatttgagaaaatttctttcggcttatattctgaaattgcctatacttggttgttgagtgatgcttttgccctcttgattgttactccctttatcattgcttgtaatcataattttaaagtatttattaaactactacaagaacaatggctcgaagcggctagcattattttttttattttattaattgttaaaattattgccaacggttatcccattgagtatctactgattccttttttactttggtcagcctttcgcttcactgaagttggatcttctctgttgacaattgtagtttctgccctgttggtgttaattcttgccctagaccaagaaaaagcagctatcaaagatcaacttttattattgcaatcaattttagcttgcatcagtatgacaaccctagttttaaatgccgtcctcagtgaaaatgaaagatcgaaaaatcaattgtttacgaccaatcagatattaatagaacaaaatcaaaagctccaggaactctatcaacaaagggaattagaaagagctcaaagggaaaaaattctcatagaatacaatgaatccttacaaaaacaggttgacctagtgagggcaaaagaaatagctgaaagtgaggctaaggctaaaagcacatttgtggctaatatgagccatgaactgcgctctcctctcaatgctattattggtttttcccagctgatgctgcgtaccaaaaatctaccaatggagcagtatgaaaatgctggcattattcaacgtagcggggaatatttattaaatttaatcaataatattcttgatttttctaagattgaagctggtaaaacccatttaaatcgccataattttgatctttatcttcttctggatgatttagaagatatgttgcatctcaaggcggccaatgaaggtatcgagctgatttttattcgagatcatgatttaccgagatacgtttacggcgatgaaattaagctcagacaaattttgctaaatcttctcagtaacgcgattaaatttacaacggagggagaagtagtcctaactagcaactttagaaatgcagaacaacaggaagtgattaacccagaaacatcaacggagcctaaaaataaatattggttagacttcacaattaaagatacgggtaaaggaattagtgaagtggagttgagtcacttatttgaagctttttcccaaacagaatctggtcgtaatgcccaggaaggcaccggattaggcctcgcaattacccgtcagtttattaagttaatggggggagatattaacgttagtagtgtggttgaccaggggaccacctttagcttttcgattttagttgatttgggggaaataactttgagtcgggaacccaactctgcgaaaaaagttcttgccctcaccccaggacaacctgtctataaaattctggtggtggatgataaaagtgtgaatcgtcaattactaattaaactcctcgctccctttggttttgagatcgaagaagctagtaacggccaggaggcgatcgccctgtgggaaagctgggagccccatttaatctttatggacatgagaatgcccgtgatggacggctatgaagcaactaaatacattaagggtcaggtcaaaggcaatgcaacggcggtggtggccctaacggccagtgtgctagaggaagaaaaggcgatcgtactgtcggcgggatgcgatgattttctccgtaagccattccgggagaacaccatttttgactccttgaccaaacatttaggagtaacatatgtttatgagtcagccccaaacaagaacgataatcatgaagacaccgcactgaagccagaaagttttctaattatgtcccaggattggttgactcagttatcccattatcttttagaagctgacactgagcaggtaatgaaattgatagcagaaattccagcttcagagtcagaattggagcaaaatctaactaaattagtacgtagatttgaatttgaaaaaattcttgatttaattgagccgctatcatag

SEQ ID NO: 26306 - DNA, 750 bp, Synechocystis sp.
atgtcccatactctgactaagctcgatctacccaccttacaaacggagctggaaaatgccaccgcccaacagatcattacctgggcggcccaaacctttggccctggcttggtgatgagtactagttttggcattcaggcggcggtgatgctccatttagtgactagcattgtgcccaatattcctgttatctggattgacacgggctatttaccgctggaaacctatcaatttgcggatcagttgaccggacggctacagctaaatttaaaggtttaccaatctcccctcagcccagctcgcatggaagctctgtacggcaagctctggcaacaaaaagacgtggaatccctcaaccgttatgatcaaatccgcaaagttgaaccgatgcagagggcattaaaagaactagaggcgatcgcctggttgacggggttaaggagggatcaaactcggcaccgccagaatttgaaaccagtggatctccagggtaatcagtataaagttctccccattttggactggaattctaagatggtttacgaatatctcaccgcccacgatttaccctaccatccgttttttgaccagggttacgtctctgtgggggattggcattctagccggcccctgatggcccacgatgaagatgaaagggatacccgtttccacggcctcaaacaggaatgtggtttacatttacccctgtccccggaagctggccagagtttggattccagtgctttgtag

SEQ ID NO: 26307 - DNA, 570 bp, Synechocystis sp.
atggcccaggatctaatcaaagaacaattacaaggcgttaacctgtttctgatcggcatgatgggcagtggtaaatccaccgtcgggccgttgttggcagaacagttggggtaccgttttttcgatgcggatgtgttgattgagcgggtggctggcaaggcgatcgccgacatttttgcggaggatggggaagatacttttcgggatttggagacggaagtgttgggacatctggcggcccaaaccagaagcgtcattgccaccgggggcggagtggtgctccgacgacaaaattggagttatctacaccatggcctggtcatttggcttgatggttccctggaattacttttggccaggctccagggagatgaagcaagacccctgctccaggtggaaaatctggaagaacggttaggaaatttattggcccaacggcaacccctctacgcccaggcggatctccggtttcccctgcaggcagaccaagatcctctggcgatcgccggagaattactggccactattccaggactgcttaaaccccaatgcagtgccgaacaaaattga

SEQ ID NO: 26308 - DNA, 1176 bp, Synechocystis sp.
atgggtaagaatctcctcgaacaactgcgccaatttacagtggtggtggccgacaccggcgacatccaagccattgaaacctttacccccagggattccaccactaatccttctttgattacggcggcggcccagatgccccagtaccaggaaattgtggacagcaccctgctcaaagctaaggacgaagctggggaaaatgcatctattaaagacattgtccgattggcctttgaccgtttggcggtggcttttggcctcaaaattctgcaaattatccccggccgggtttctacggaagttgatgcccgcctttcctacgacacggaagccaccattgccaaagctcgctacctaattggggaatatgccaaagctggcattgataaaaaacgcattctgatcaaaattgcttccacttgggagggtattaaggctgcagaagtattggaacaagaaggtattcactgtaaccttactctactattcggtctccaccaggcgatcgcctgtgccgaagccaaagtcaccctaatttccccctttgtgggacgcattttggattggtacaaaaaaagtactggcaaggaatatgacagccacgaagacccaggggtacagtctgttacaaccatttacaactactacaaacgctttggttacaaaactgaagtgatgggagccagcttccgtaacattggcgaaatcatcgaactggccggctgtgacctgttgaccatttccccccaactgttggatcaactgcggaacaccgaaggggatttacctcgcaaactcgaccccgccacggtgccccaggacattgaaaaaattgttatggacaaggccaccttcgacaaaatgcatgccgaagatccgatggcctcggaaaaactggccgaaggcattgccggtttcaccaaggctctggaggtgttggaacatttattggaagaaaggttaaaagttctcgatggccaagagcacatcaaacatggggcagaggaaattttccatgcctatgatctagatggggacggttttattaccagggaggaatgggccggcaccgatgtggtttttgatgccctagaccgggaccatgatggcaaaatcaccgccgctgaaatgtccgctgggttgggagccgctttccgtttagcctctgttggttag

SEQ ID NO: 26309 - DNA, 645 bp, Synechocystis sp.
gtggggttggcgatcgccgtgggtagctttctcatcagtcctttttccaaggttattcccgacccagtggtggacattaacccggtctctacaacggcaaggggcaccgaaaaagccgtttttgccgggggctgtttttggggactggaggccatgtttgaggaagtgcggggtgttaaggatgtgcaaaccggctacagcggcggcactgaagccacggccaactatgccagggtgagtggtggcggcacggaccatgcggaatccattgaaattgtttatgaccccgcccaggtaagttacggcgaactgctgaaaattttcttttccgtcggccatgaccccacccaagttaaccgccagggcgtagaccagggtcgtcaatatcgttcggccatttttgccaccactcctgagcaaaagcaggtggcccaagcttacattgaccaactagaggaaagtcaggcctttgaccaggcgatcgccacggaggtgaatgactttgatgccttttatccagcggaggattatcaccaggattttgtccaacggaatccggcccatccctatgtgttggtccatgatttgcccaaactccgaaaatttcgtcagcagtatagcgataaattaaaagcccaaagttag

SEQ ID NO: 26310 - DNA, 801 bp, Synechocystis sp.
atgttaattttgaaaaattctatggcatccccccatccttttccctggccccaacgcttcaccgtcatggctttaacctttgcctggggcttgagcttgcccgtgttggcccaaactaagtcagcggtgcaatggtacaacgatggggtggacaaactagcggcgcaaaatttctccggggcgatcgccgattttaccgaatccatcaaactcaatgaccaggacgccgatgcctattacaaccggggctatgccaagcacgttttggggcaataccaggcggccattacggactacaaccaggccattagtttaaatcctgaatttgcctatgccctgggtaaccgttgttatgcttattttttactgagtcagtacgacaaagccattcaagattgcagcaatgccatcgaaattaatcccaactatgcggacttttatgtttatcggggtaactcccagtcccaattaggcaatgaaactacggcgatcgccgactataacgatgccattcgcattaatgcccaacatgccaatgcctattacaaccgggcgttgacccataatcgtctcaagcaagaccaacaagccttagcggattataaccaaagcattcagttggatcccgactccgctgaagcctatttcaatcgagggttaacccaatatcgtctgggagatgaacccaaggcgatcgccgatttaaccaaggccgccgaattattcaacgcccaagagaaaaaggacatggcccaaaaagcggaagctatcctgacccaaatccgggccattgatgcttag

SEQ ID NO: 26311 - DNA, 1428 bp, Synechocystis sp.
atgtacgaaaaacttcagccccccagcgttgggtcaaaaatcacctttgttgcaggtaagcccgtagtacccaacgatccgattattccctacatccggggggacggcaccggggttgatatttggcccgctacggaattagtcatcaatgcagcgatcgccaaggcctatggcggcgagaggaaaatcaactggttcaaagtctatgccggggacgaagcctgtgaattgtacggcacttatcagtatttaccggaagacactttaacagcgattaaggagtatggggtagccatcaaagggcctctcacaaccccggtgggcggtggtatccgttccctaaacgtggccctgagacaaatttttgacctctacacctgtgtgcggccctgtcgttactatcccggtactccgtctccccacaaaaccccggaaaaattagacattatcgtttatcgggaaaatacggaagatatttacctaggcattgaatgggcggaaggtacggaaggggcgaaaaagttaatcgcttaccttaacgatgaactgattcccacaactccagctttgggcaaaaaacaaattcgcctcgactctggcattggtattaaaccgattagtaagactggttcccaacggttggtgcggcgggctattctccatgcattgcgcttgccgaaagcaaaacagatggtgacgttggtccataagggcaacattatgaagttcaccgaaggggcgtttcgggattggggttacgagttggctacgacggaatttcgggcggaatgcgttacggaacgggaatcttggattttgggcaataaggaaagtaatccggacttaaccattgaggccaacgcccacatgattgaccccggttatgacactttgaccgaagaaaaacaagcggtcattaaacaagaagtggagcaggttttaaattccatttgggaatcccatggtaatggccagtggaaagaaaaagtcatggtcaatgaccgcattgccgatagtattttccaacagatccaaacccgccccgatgagtattccattctggcgaccatgaatttgaacggggattacctttccgatgccgccgccgctgtggtgggaggtttgggcatgggccccggagctaacattggggatagtgcagccatttttgaagccacccacggcactgcccccaaacatgctggtttagaccggatcaaccccggctctgtgatcctttccggcgtaatgatgctggaatttatgggctggcaggaggccgctgatctgattaaaaaaggtatcggagcggcgatcgccaatcgggaagttacctacgatttagcccggttaatggaaccgaaggtggataaacccctaaaatgctccgagtttgcccaggcgatcgtcagtcatttcgatgattaa

SEQ ID NO: 26312 - DNA, 1086 bp, Synechocystis sp.
atgggggaaattaaacgcattggtattttaaccagtggaggagactgtgccggactaaacgccgtaattcgctccgtggtacaccatgccattggcacctacggttgggaagtaattggcattcaagaagccacccagggactaatggaaaatccctccaaggcgatcgccctgcaccgggataacattgaccatttgttaatgatgggaggtacctttttaggcaccaccaataagggtaatccgttcgcttttcccatggccgacggcactgtgcgggaccgcaccgaagatattattgccggttatcgtcagttggggcttgacgctctcattggcattggcggagacggtagtttagccattttgcgccgcatagcccaacaggggggcatcaacttagtgggcattcccaaaaccattgacaatgatgtgggggcaacggaaatttccattggtttcgacaccgccaccaacattgccaccgaagccttggatcgtttgcatttcaccgccgctagccataaccgggtcatggtgctagaagtgatgggtagggatgcgggccacattgccctggccgccggcattgggggaggggcggacattattctcattcctgaaattccctaccgcatccaaagtgtgtgcaataaaattcgtcaacggcaggccgaggggaaaaacttttgcctggttatggtgtcggaagcggtgcggacagaattgggcgatcaggtcaagcaaatccaacagtttggcgaagaccgctacggcggcattggtaaatacattgcggaacaaattgcccaacgcactggagcagaaaccagagtcactgtgctgggccacatccaacgggggggcattccttcacctttcgatcgcctgttggggagtgtgtttggggtcgcggcggtggacttgattgcggaaggcaaattcgaccacatggtggcctggcgcaatcgtcaaaccattagtgtgcccattgaggaagccatccaaacctatcaaacggtgcagttggacggcaccttggtgaaaactgcgcggggattgggcatttgccttggtaacgattaa

SEQ ID NO: 26313 - DNA, 1362 bp, Synechocystis sp.
atgcgtgtttgtgttatcggaacgggatatgtgggtttagtcactggcgtttgcctggcccatattggccatcaagtaatttgtgttgataacaacgaggaaaaagtcaagctcatgcgggcagggcaatcccccatctatgaacccgggctgtcggagttgatggtggccaatatggaaagcggtcgtctagtattcactacggatttgggcaagggagtccaggagagtgcaattcttttcattgcagtgggtactcccgccttggaggatggttccagtgatacccgttatgtggaggcggtggcccgcagtattggtgagcatctcgatgaacagtatcgggtgattgtcaataaatcaactgtgcccattggttccggggattgggtgcggatgattgtcaccgaaggcaatgaagcccatcaacaacaaacgggtcaggcgatcgccgttaactttgacgtggttagtaacccagaatttttgcgagaagggtcggcggtttacgatacgtttaacccggacagaattgtgttggggggcaataatccccaggccttggctttaatgcgggaactttacacgcccttaattgaaaggcgggtgggggaaaatcctgagctgccgccggtgccggtggtgatgacggaccttagttcggcggaaatgattaagtatgcggccaatgcttttttggctaccaaaattagttttattaacgaggtggccaatatctgtgaccgggtaggggcggatgtgacccaggtggcccagggcattggcttggattcccgtatcggtagtaaatttcttaatgcgggcattggttggggaggttcctgttttccgaaggatgtgtctgcgttgatccacactgcgaaggactatggttacaccacttcaattttgaatgccgtagtggaggtaaaccaggtacaacggctgattgtggtggaaaaactacagcaggagttaaaaatccttaaaggtaaggtgattggcctgttgggattgacttttaagccggatacggatgatatgcgggatgctccagccctgaacataattcaacaactaaatcgtttgggagccaaggtgaaagcctatgatccgattgtttcccagtctggggtaagccatggtttatcgggggtaaaaattgagtcgaccccggctatgttggcggaccagtgtgatgcgttaattttggtgacggaatggcaggaatttttaaagctagattttcctgtcctggccagccgtatgcatcaggctgtgatcattgatggtcgtaatttcctcgacaaggaaaaattgcaaggggcaggattccgttacctaggggttggtcgtagttag

SEQ ID NO: 26314 - DNA, 1305 bp, Synechocystis sp.
atgcccatggctgttgtttccctacctttttcaccccaaaactttccccacagctctagctgttccgtccaagatttgcctccccaccaacaaatggcgatcgcccaggctttagctgagccggaacatgcccccagtcattgggtggccccagaaagtcagcaagagttgcaatgtttgctaagtgagtgcgatcgaaataattggccagtcatcccctgtggcaaccaaagtaaattggcttggggtggattagctaagccggtgcagttactggttagcagtgctggcctgaataggattgttgaccatgcggtggcagatttgaccgtgacggtggaagcgggggtcaaactcaaggatttacaggctattttgcaaccccatcagcaatttctgccccttaatcccctctaccatgaccaggcaacggtgggaggcattatggccacaggttgtgcggggccgtggcaacagcgttacggtggggtgcgagacctagttttggggttctcctttgtccgctgggatgggcaactggccaaagccggcggtagggtggtcaaaaatgtggcaggttatgacctgatgaaacttttcgttggttcctacggcacgttaggttttatttcccaaattaccttccgtctttaccctctaccttcccattcccaaacagtttttttaactggtgataccaaccaactagccaaactcagccaagccctgcggcgatcgggactggcacccaccgcggccctaatctgttccccggctctagttcaagcattaaaccttggggaagaattgggcttactcgtccgtttccaaaacctagagccggtggtgcaggcccagattgatgaggtaaaaaaactcgcccaaactttgaccttggccagccagtcctttgacaatcaagcagagagcgaactttggcaacggtgggaaaatgccatggccgggcagggtactacggaaaccatactctgtaagtttggtcttttacccgctaaggcagcggattttctgcaacagttaccagggttgggacatgtacaattgggcaatggcattggttgggtacgttttggccaactggaccgggaaaagttgaaccagcaaaggcaaatttgtcagaattatggtggttatgtaacggtgttagaagcgtctccggaatgtaaaaaacactgggacgtttggggccagagtggccatggtttggctatgatgggccgtctaaaaaatcagttcgacccccacaatacttttagtcctgggcgctttgtaggtggtttttag

SEQ ID NO: 26315 - DNA, 1023 bp, Synechocystis sp.
atgaccgtctctcccacaacccagccccaaactaatcattccttgcccccggcggacgctaaacagcgggtcagccaatttatgcaaactcttcaagacgaaatttgtcagggtctagaggccttggatggcaagggcaaattccaggaagatagttggcaacgggaagaagggggcggtggccgttcccgggtgttggcggacggagattttttggaacagggcggagtcaatttttccgaagtctggggcaaatccctacctccttcaattttgaagcaacgccccgaagcggaaggccacgaattttatgccacgggcacttccatggtgttgcacccaaaaaatccctacattcccacggtgcatcttaattaccgctactttgaagcaggcccggtgtggtggttcggaggtggagccgatttaactccctactatccctttgctgaagatgcggcccatttccatcacacgttaaaaaatgcctgtgaccaaacccatggggaattttatccggtatttaaacgctggtgcgacgagtatttttacctcaaacatcgccaggaaatgcggggtattggcggcatcttttttgattaccaagatggcaatgctcccctgtaccgtggccctgaccccaatggcccggcggcccagtacagcaaccaattagcccccattgaacccctgggttgggaggatttatttagttttgcccaacgctgtggtcgggcctttttacctgcttacagtcccattgtggaaaaacgtcgcaatactgaatatggcgatcgccaacggcagttccagttatatcgccggggtcggtatgtggaatttaacttggtctatgaccggggcaccattttcggtttgcaaaccaatggccgcactgagtccattttgatgtctttacctcccttagtacgttggcaatattgctacagtcccgaagccggtagtcccgaggcggaattaacggaaaaattcttagttccccaggactgggttaatagttag

SEQ ID NO: 26316 - DNA, 1908 bp, Synechocystis sp.
atggtaaccacccccaccgctgccccccgtaaaccgtccaaggtagaaggcatcaaggaaagaagcaattatttacgggaacccctggccaccgaactgttgaatgatgctaactattttacggacgatgccgtccaaattctgaaattccacggttcctaccaacaggacaatcgggacaatcgggttaaggggcaagaaaaggattatcagtttatgctccgcacccgcaatccggggggattgattccggcccaactctacaccgccctagatgatctgtccaaaacccacggtaaccaaactctccgggtgaccaccagacaaggtttgcaaatccacggcattgtcaaaaaagacctgaaaatggcgatcgccacggtggtgaataatttggggtccacgttgggagcctgtggcgacattaaccgtaacgtgatggctccggcggcacccttccgagataaaccggaatatggttatgcctgggactatgccaataaggtggcggatctactcagcccccagagcggtgcctattacgaaatttggctcgatggggaaaaggtcattagtggggaggaagccccggaagttaaagcggcccggcaaaaggatctcaatggcactaacctgaatgaccccaaggaaccgatttacggccaacagttcatgccccggaaattcaaaattagcgtcaccgtgccgggggacaattccattgacgtttacacccacgatattagtttggtggtaatcaccgatcgccatggggagctacggggttttaatgtattggctggcggtggtttgggacgtacccacaataaagaggaaacctttgcccgggccgctgaccccattggttatgtgagcaaagacgatgtctatgatctagtcaaagccattgtggccacccaacgggattacggcgatcgccataaccgtcgccatgcccggatgaaatatttgttggcggactggggggtggaaaaattccgcaaacaagtggaaacctacatgggtaaaccgttccaatctttcaaacctctgccagcctggcgttaccaagattacctcggttggcacgaacagggggatggcaagctctttttcggtttgtcggtggaaaatggccgcatcaaagacgagggggattttcagcttaaaaccgccctgcgcaaggtagtggaccaattccaattgcccctgcgcctcaccgccaaccacaatatcctgctctacgacatcaatgcccaggataaagcggcgatcgagcaaattttccaacagcacggcgtagtcaccgacccagaggcgatcgacaccctagtccgttactccatggcttgccccgccctgcccacctgtggcctagcagtcaccgagtcggaaagaattatgcccagtgttaacgcccgtctgcgggatttgttgaacagtctggatttacccaatgaaagtatcgtcacccgcatgaccggttgccccaacggttgtgcccggccctacatggcggaaattggttttgttggtagtgcccccaacagttaccaagtgtggctggggggaagtccgaaccaggaacgtttagcggcagcctatacggaaaaaatgcccctggaacagctagaaagcctttttgaacctttatttgtgtacttcaagcagagccgtaaaggtaaggaaagttttggagacttttgccatcgagtgggcttcactgccctacgggaatttagccatggttacacagcaccggccaagggcggtaaaaaccgcaaaaaccaacggcgggtcagcctgtccgatgaaatgtatgcccagcttaaggcccggtctgagcgggataattgccccatgaatcagattgtgcagcaagccctcaccgcttacctgggcaaataa

SEQ ID NO: 26317 - DNA, 1176 bp, Synechocystis sp.
atgcaatttgctgatcgtctcaacgcctttggtggtaatgtttttgctgatatggacttggctaaggcccaagcccgggcccagggtcaaaccattattgatctttcccttggctcctctgatttacctactcctgcccccattctggccacgatcgccaaagctttagaagatcccagcacccatggttatttattgcaccagggaaccctaccattgcggcaggcgatcgccgtttggtacgaaaagcgttttggcctagcggtggatgcggaaacggaagtgctgcccctgattggttcccaggaaggcacagcccatttaccgttggcggtgttgaatcccggcgatgtggctctgttgatggaccctggttatccctcccacatggggggcgtgtacctggcggggggagaaatttatcccatggcgttgcgctcggaaaaccaatttttgccagtgtttacggccattcccaactcagttttagccaaggccaaaatgacggtgctcagctatccccacaatcccaccacggcgatcgccagcttagaattttttcaaacggcggtgcagttttgtcgtgaccatgatttagtattagtacatgattttccctacatggatttggtttttgatggtatagcaatgccaccgtcagttttgcaagcagaccgacaaaaatcctgtgccattgaattttttaccttttccaaatcctataatatggggggcttccgtattggttttgccattggtaatatccagttaatttctgccctgaaaaaaatcaaagcggtggtggattttaatcaatacgcaggcattctccaaggggcaatcgccgccctggaaagtccaccggaaactgtgcaacaaaccgtgcaaatttttgcccaacgccgggcaacattgattgatgctttagcgaagattggctgggctgtgcctctgcccactgccaccatgtatgtttgggcaccattacctgaaagttggcttggcaattccttggaattttgtcaaaaactggtggctaaaaccggtgttgccctttctccagggtctggctttggtgcagggggggaaggttatgtacgttttgccttagtacaggagccggatattttggctacggcggccaaaaaaatcggtcaatttcttgaccaaaactag

SEQ ID NO: 26318 - DNA, 1056 bp, Synechocystis sp.
atgatcgtcgtcatgaaagtcggcaccccagaaatagaaattgagcgcattggtaaggagtttgccgaacggggcctcacccccgaaaagattgttggtaagcacaaagttgtgatggggttggtgggggaaacagccggacttgatcctttgcaaatccaagaggttagcccctggattgaagatgtattacgggtggaacaaccttttaaacgggctagtttgactttccgccatggggaatacagtgaagtaatcgtttctacccccgctggccccgtggcgatcggcaaaaaccatccggtggctgtggtagcaggcccctgttcggtggaaaatgaaaccatgattgtggaaacggcccgtcgagttaaggcggccggggcccagtttttacggggcggcgccttcaaaccccgtacctctccctacgctttccaaggtcatggggaaagtgctctaggtctgttggcagcagctaaggaagccactggtttgggcattatcaccgaagtgatggatgcggcggatttagaaatcattgcggaagtggcggatgtaatccaagtgggtgcccgcaatatgcagaatttctccatgctgaaaaaggtaggggcccaggataagccagtgctgttaaagcggggcatggcggccaccattgatgaatggttaatggcggcagaatacattctcgcggcgggtaatcccaacgtgattctttgtgagcggggcattcgcacctttgacggccattacacccgcaattgccttgatttgtcggtgttgcctgtcctgcgctcccttacgcacctgcccattatgatcgaccccagccacggcaccggtaaatccgagtatgtgccctccatggccatggcggcgatcgccgcggggacagactccttgatgattgaagtgcatcccaacccggctaaagctatgtccgatgggccccaatctttgacccccgaccgcttcgacgaaaccatgaagcaattggcggttattgggcaaactgtaggacgttggcctaaagtagcggccctggcctag

SEQ ID NO: 26319 - DNA, 1230 bp, Synechocystis sp.
gtgacagaaggccatcctgataaggtgtgtgaccagatttccgataccatccttgatgccctcctaaccctggaccccaacagtcgagtagcggcggaaaccgtagtcaacacaggcttgaccctagtgacgggggaaattacttcccaagcccacattaattttgtcgaattgatccgccagaaaattgctgaaattggctacaccaacgccgataatggctactccgctaacagttgtgccgtcatgctggcgatcgacgaacagtcccccgacatttcccaaggtgtaaccgccgcccaagaacagcgccatgccctcagcgacgacgagttagacaaaatcggtgcgggcgatcagggcctaatgtttggctatgcttgcaacgaaaccccagaattgatgcccctacccattagtttggcccaccgcattgccctgcgcctatcggaagtacgtaaatctggccaattggcttatcttcgccccgacggtaaaacccaagtttccatcctgtacgaagatggctcacccgtagccattgataccatcctcatttccactcagcacgacgagcacattggcgatatcaccgacaacgatgcagtccaagccaaaattaaagccgatctttgggacgtagtggtgggtcattgcttcagcgacattgccctcaagcccactgataaaacccgctttattgttaatcccactggcaaatttgttgtggggggtccccaaggggatgctggtttaacgggacggaaaattattgtggacacctacggtggttattcccgccatggcggtggtgccttttccggtaaggatcccaccaaggtagaccggtctgcggcctatgccgcccgctatgtggccaaaaacattgttgctgccggtttagcagataaatgcgaagtacaggtcagctacgccattggggttgctcgcccagtcagcgttttaatcgatacctttggcaccggtaaggtagatgaagaaaaactgctggaagtcgtattggcaaactttgaactgcgcccagccggtatcatccaatccctcaatttgcggaatttgcccgccgaacggggggggagattttatcaagatgtggccgcctatggccattttggtcgcaatgacctggatttgccctgggaatacaccgacaaagtggatgtgttgaaagcagcttttgcttctagcccccaggccgtggccgtctag

SEQ ID NO: 26320 - DNA, 1083 bp, Synechocystis sp.
atgctagataagtcgttttggcaaggtaaatccgtttttttaacgggccatacgggttttaaaggcagttggttaactctctggctcagtcagttgggagcaaaggtgtcgggctattcattagatcctctgacaaaccctaacttatgtgaactggctgaaattgctaaatgtttgcgctctgatactcgggctgatgtcaatgatttagcgaatcttcaaaaggcgatcgccgaagccaggccggagattgtctttcaccttgcagcccagcctctagtgcgccgtagctatcgtgatccagtcggcacttttgccactaacgtgatgggaactgcccaccttcttgaggcgttgcgggcctctgactcagtgcgagtggtggtgattgtgactaccgataaggtttatcgcaatgttgaatggtgttggccataccgagaagatgatcaactgggaggtcatgatccctatagtgcgagcaaggccgcctgcgaaatcgtagtagccagttatcgtgatgcctttcttcgagaacaaggagtggccgtggccagcgcccgggccggcaatgtcatcggagggggagattggtcagaggatcgtctcattcctgatgttgtccgcgccctagatgcaaaaacgatggtcataatccgtcgtccccaagctattcgtccctggcaacatgtgttagagcctctagctggctatttattgttagctcaaaaactttggcattcaccagaattggcaggggcctataacctaggcccggaaacaaaagacgcagccactgtgcgtcaaatattagaatttgcttcgcgaatagaacccggcttgcaagtggaatatggcgatggcaatgaagggccccatgaggcgggttggttatccctcgagattgcaaaagcgcgaactttactgggatatcgtcctagttggggggtcgaggaggcagtacgacgcacaatgatctggtatcgttctcaacgacagggagaaagcccattaactctttgtcagacagaaattgaagaatatgaaaaggagctaatggctctgtcagaccttgctatctga

SEQ ID NO: 26321 - DNA, 963 bp, Synechocystis sp.
atgaaaatagcattaatttctggcatatcaggacaagatggggcatatttagctcaactactaattgaaaaaagttatgccgtttggggtacgtcaagggacgctcaaatatccaatttccgtaatctcaaaattttgggtatccgggagtctataaaagtcgtctccatggccttaacagacttccgcagtgtcttgcaggtggtttcacaggtcaaccccgatgaaatttataaccttgccggacaatcttccgttggtttatcctttgaacagcccgttgaaactctagaaagtatcactatcggcaccttaaacctattagaagttgttcgctttttggacaaaccaatcaaactctacagcgctagttctagtgaatgctttggagatacaggcaattccgccgctgatgaaaataccgcctttcgtcctaggagtccctatgccgtggccaagtccgccgccttttggcaagtggcaaactatcgagaagcgtataatctatatgcgtgctccggcattctttttaaccatgaatctcccttgcggccagaaagatttgtgactcaaaaaattatcgctactgcgtgtcgtattgcccagggcagtcaggaaaagctctatttgggcaacaccagcatcagtcgggattggggatgggctccagagtatgtcgaggctatgtacctaatgctccaacaggcaaaaccagatgattatgtcattgccacaggggcgagttatcttttacaggattttgtggaaattactttctcttcattgggattaaactggcgggagcatgtcatcatcgatcaaagtttatttcgtcctacggatttggcaatgggtaaagcaaatccccgcaaagctcaggagcaattggggtggaaagcagagtataaaaccccagacgtggtaaaaatgatgattaatgcgaggtcaaatgggaaatattga

SEQ ID NO: 26322 - DNA, 774 bp, Synechocystis sp.
atggatattcaccgcttaccagccctggccgataactatattttcctcctccatgatcgccagaggaatcaggccgcagtggtggatccggcggaagctaaacctgtattggattgtctagaaaccttaggagccgatttagttaccatttataacacccatcaccatggggaccatgtgggagcgaatcgagagctgttagcaaaatatcccaatctggaagtttacgggggagtcgaagatcagggacgtattcccggccaaacggtgtttctgcgagacggcgatcgcctcagttttgctgatagggaagccacagtttattttgtaccaggccacactaggggccacattgcctactattttgctccagggtcaggagaaaccatcggggatttattttgcggtgacaccatttttgctgggggctgtggccgattgtttgaaggcactcccgcccagatggtgcaatccatcggcaaattacgccaactaccagatcaaacccgtctgtggtgcgcccacgaatacaccctaggtaacctcaaatttgccctcaccgttgaccccagcaacaaggatcttcaggaacggttccagacagtgcaaggcgatcgccaacggggccaggccaccattccatcttggttgggcacagaaaaacgcaccaatccctttctgcggtgggacaatccagctattcaagctagggtaggaatgacggagccagctcgggtatttggcaagctccggggcatgaaggacaacttctag

SEQ ID NO: 26323 - DNA, 534 bp, Synechocystis sp.
atgcaacaacgtggcgtaacaatttggttaacgggactgagtggagcggggaaaaccactattacccacgcattggaaaagaaattacgggacagcggttaccgtctggaagtgctagacggtgatgtagtgcgtaccaacttgaccaaaggactcggttttagcaaggaagaccgggacaccaatattcgccgtattggttttgtgtcccatttgctcacccgcaacggtgtgatcgtcttggtttccgccatttctccctacgcagccatccgtcaggaagtgaaacacaccattggggattttctcgaagtgtttgtcaatgcgcccttggctgtttgcgaggagcgggatgtgaagggtttatatgccaaagcccgcagtggagaaattaaaggtttcactggcattgatgacccctatgagccccccaccaatcccgatgtggaatgccgcaccgacctagaggaactggatgaaagcgtgggcaaaatctggcagaagctagtagatctaaaatatatcgagggctaa

SEQ ID NO: 26324 - DNA, 1230 bp, Synechocystis sp.
atgttacgtctcatcacccagtccggtgacattgttcaggagttgcgacgtttacatcatcgtcccgttccttccccctggccggtcatggcccaggtggtggcggcgatggagcattgggctgccatggaccaggatgctccccccagagttagtggagcggagttggatgcggcttatcaacgcattagccaggaaaaattgtcggtgattcgccaggcttgcgctgccctggagcaggtttaccgcccgcaactgcccaagacccaagtaagctttccggaagatggcacagtgcggggacaaaggttttatccggtcagaagagctggtttttatctagaagcaaaaaggggcgatgccctgggcaatttactccgccaggggatgttggccaagactgtgggggtggcggaacgggttttggtgacggaaaccattagttcgactattttggtggcggcccaggaaatgggcattgaagaaatttatctggccgctggggtgccggcgatcgccatgctgacctggggagcaaaaaatattgccccggtggagtccattacaggggcaggctgcccaagggtgatggcggctaaacaattggtgagtggtgtggtaaccattgaccaaaccctggctaggacaaatttaatggtgctagcggacggtgaagctaacggacaatggctagccctggatttgttagcccatgccgaacaatatcccaatgccagcgcagtgctactgaccgatcgcctggagttgggggaagaggtgattcaatcagtcaatcgctattgtcgggagcaggaacattctgtacatacggaaaaggctttggcccattacggcctagtggcgatcgtcgaagacctagaggcctgtggaagttggatcaatgagttttgcccccatattttactgttagccatggaagacccctggaccatggtggagaaagttcagcgagccagggaaatttacatcggccaccgcagtccgagcattttgggtcattacctcagtggggccaaccgtctgcaaacccaggatggggccatggccaccgctagtgaattggcattccattgttttctgcgctccagtcaattactcgactacggcaataatccaccgcccccttggttaaaggatttggtcaattggcaaggcctgacggcgatcgaggaacgcttggggcaattgggtcgactcaaggaaagttag

SEQ ID NO: 26325 - DNA, 1851 bp, Synechocystis sp.
gtgagcaaaaataataaaaaatggcgtaacgcgggcctatatgccttgttgttaattgtcgttttagcgttggcatcggcctttttcgaccgaccgacccaaactagggaaaccctcagctacagcgattttgtcaatcgggtagaagccaatcagatcgaacgggtcaacctcagtgccgaccgcacccaagcccaagtacccaatcccagcggtggtcctccctacttagtcaatctgcccaacgaccccgacttgatcaatattctcacccaacacaacgtggatattgctgtccaaccccagagcgacgaaggtttctggttccgcatcgccagcaccctatttttgcccatcttgctcttggtgggaatttttttcctcttccgtcgggcccagagtggccctggttcccaagccatgaactttggtaaatccaaagcacgggtgcaaatggaaccccaaacccaagttaccttcggggacgtggccggtattgagcaagccaaactagaactcaccgaagtggtggacttcctgaaaaatgcagaccgcttcaccgaattgggagccaaaattcccaagggtgttttgttggtaggcccccccggaaccggtaaaaccctgttggccaaagccgtggctggggaagcgggtgtaccgttcttttccatctccggttcggaatttgtggaaatgtttgtcggtgttggtgcttctcgggtacgggatttgtttgagcaggctaaagccaatgctccctgtatcgtcttcatcgatgaaattgatgccgttggtcgtcaacggggcgctggccttggtggtggtaatgatgagcgggaacagaccctcaaccagttgctaacggaaatggacggttttgaaggcaacaccggcattattatcgtcgccgccactaaccgtcccgatgtattggattctgccttgatgcgtcccggtcgtttcgatcgccaagtggtagtagaccgtcctgattatgctggccgtcgagaaatcctcaatgtccatgcccggggtaaaaccctttcccaggatgtggatttggataaaattgcccgtcgtacccctggatttaccggtgctgacctgtccaacctgttgaacgaagccgctattttggctgcccgtcgcaacttgaccgaaatttccatggacgaagtcaacgacgccattgaccgggtgttggctggtcctgagaagaaaaatcgggtgatgagcgaaaaacgcaaaaccctagtggcttaccatgaagctggccacgccttggtgggtgctttgatgcctgattatgatccagtacaaaaaattagcattattccccgcggccgggccggtggtttaacctggttcacccccagtgaagaccgtatggaatccggtttatactcccgttcctatctgcaaaatcagatggccgttgccctgggaggccgtattgctgaggaaattattttcggcgaagaggaagtcaccaccggtgcttccaacgacctccaacaggtagcccgggtcgcccgccaaatggtaacccgtttcggcatgagcgatcgcctgggcccggtagctttgggtcgtcagggtggtggggtattccttggtcgggacattgcctctgaccgggacttttccgatgaaaccgctgcggcgatcgatgaggaagtaagtcaattggtagaccaagcctatcaacgggccaaacaggtcttggtggaaaaccgtggcattttagatcaactggcagaaatcttggtagaaaaggaaactgttgattctgaagagctgcaaactctcctggctaacaacaatgccaaattggcacttctagtttaa

SEQ ID NO: 26326 - DNA, 2091 bp, Synechocystis sp.
gtggacagtggccatggcgctcaatccaggataaagcttggtcagactgggtataaactgtcaacatatttctgcaagagtgggcccaattgggaaaatcaacctcaaatccattggaatagccttttttcaaccgtaaaaatccaactttctctcttcccttcttccttccatctgattatggttacgccaattaactaccattccatccattgcctggcggatatctgggctatcaccggagaaaattttgccgatattgtggccctcaacgatcgccatagtcatccccccgtaactttaacctatgcccaattgcgggaagaaattacagcttttgccgctggcctacagagtttaggagttaccccccatcaacacctggccattttcgccgacaacagcccccggtggtttatcgccgatcaaggcagtatgttggctggagccgtcaacgccgtccgttctgcccaagcagagcgccaggaattactctacatcctagaagacagcaacagccgtactttaatcgcagaaaatcggcaaaccctaagcaaattggccctagatggcgaaaccattgacctgaaactaatcatcctcctcaccgatgaagaagtggcagaggacagcgccattccccaatataactttgcccaggtcatggccctaggggccggcaaaatccccactcccgttccccgccaggaagaagatttagccaccctgatctacacctccggcaccacaggacaacccaaaggggtgatgctcagccacggtaatttattgcaccaagtacgggaattggattcggtgattattccccgccccggcgatcaggtgttgagcattttgccctgttggcactccctagaaagaagcgccgaatattttcttctttcccggggctgcacgatgaactacaccagcattcgccatttcaagggggatgtgaaggacattaaaccccatcacattgtcggtgtgccccggctgtgggaatccctctacgaaggggtacaaaaaacgttccgggaaaagtcccctgggcaacaaaagctaattaatttctttttcggcatttcccaaaaatatattttggccaaacgcattgccaataacctgagcttgaaccatctccacgcttcggcgatcgccaggttggtggcccggtgccaagccttggtgcttagtcctctccattacctcggggacaaaattgtctaccataaggtacgccaggccgctgggggcagactggaaactctcatttccggaggaggggcgttagctagacatttagatgatttttacgaaatcaccagcattcccgtcctggtgggctatggcttaacggaaacggccccagtaactaatgccagggtgcataaacataatttgcgctattcctctggccgccccattcctttcacagaaattcgtattgttgacatggaaaccaaggaggatttgccccccgaaacccaaggtcttgtgctaatccgtggtccccaggtgatgcagggctattacaacaagccggaagccaccgccaaagttttagaccaggaaggctggttcgacagcggtgacttaggctgggtaacgccccaaaatgatttgattctcaccggtcgggccaaggacaccattgtgctcagtaacggggaaaatgtggaaccccaacccattgaagatgcctgtttacgcagtgcctacattgaccagattatgctggtgggccaggatcaaaaatccttgggggctttgattgtgcccaacttcgatgcattgcaaaaatgggcagagacgaaaaatttacaaatcaccgtgccggaaccgtcggctagcagtgaagggatgcaggctagtggtttgtatgacccccaagtggtggggttaatgcggtcggagttgcatcgggaagtgcgcgatcgccctggctaccgagccgatgaccagattaaggatttccgttttatcccagcaccattttccctggaaaacggcatgatgacccaaaccttgaagctcaaacgaccagtggtaacccaaacttatcaacatttaattgacgaaatgttttaa

SEQ ID NO: 26327 - DNA, 837 bp, Synechocystis sp.
atggctccccagactaatttttcagcaactaccattttgagcactcccagggaaaattctatgttagatctcagcggcaagcacgcctttgttaccggcatcgccaataatcgctccattgcctggggcattgcccaacaactacaccaggccggggctgaaattggcgttagttatcttccagatgagaaaggcagatttgaaaagaaagtgcgggagttgaccgagcctttgcatcctaccctcgtcttgccgggggacgtacaggacgatgcccaggtggatgccctgttccatagcgttaaggaaaaatggggcaaactcgatattttgatccattgcttagcctttgccgacaagtccggtttgacggggaattataccgatattcccaaggaagcctttagtcaagcaatggaaattagcacctattccctggggcgtttggctcggggggcaaaacccttgatgaccaatggcggtagcatcattaccctgacttactttggcggcgtgaaggttattcccaactacaacctgatgggggtggcgaaggccggtctggaaatgactgtgcgttatctggccgcagaattggggccccaaaatattcgtgttaatggtatttccgctggccccatccggaccctggcttcttcggcggtggggggcattttggatatgattcaccatgtggaagaggtggcaccactaaagcgtaccgtcacccaaacggaagtggggaatacagcggctttcctggccagtgacctttccagtggcattaccggacaaattatctacgtcgattctggctatgaaattatgggtatgtaa

SEQ ID NO: 26328 - DNA, 3996 bp, Synechocystis sp.
atgtttactaacgtcaagtccaccatccgccgtgttgatcccgaagcgttgaatggacgccagctactcaaggtggtttatgtggtcttggaatcccagtatcagagcgctttgtcggcggccgttagaaacattaaccgtaccaactccagcctggccattcagttaacgggctatttgatcgaggagttgcgggacccggaaaattacgccaactttaaacatgacgtcagcgaagctaatctcttcattgcttccctgatttttattgaagatctggccgataaggtggtggaagcggtaactccctatcgggacaatttggatgcggcgatcgtgttcccctccatgccccaggtgatgcgcctgaacaaaatgggttccttttccatggcgcaattgggccagtccaaaagtgcgatcgcccagttcatgaaaaagcgcaaggaaaacagcagtggtgctggcttccaggatgcgatgttgaaactgttgcggaccctgcccacggtgttgaaatatttgccggtggaaaaggcccaggatgcccgtaattttatgctcagcttccagtattggttgggaggctcccaggagaacttggaaaacttcctgctgatgctgaccgacaagtatgtttatcctgatttgggcttggataaactggtcaactaccaggagccagtggtctatcccgatatgggcatttggcatcccctgtccatgcagatgtttgaaaacgtgaaggattacctggagtggtataaccaacgtcccgacatcagcgaagatctcaaagatcctttagccccctgcattggtctgattatgcaacgcacccacctcgtcaccggggatgatgcccattacgttggcatggtgcaggaattggaagccatgggggcccgagtgatctgcgtgttctccggcggtttagatttctccaagcctgtcaacgaatatttctgggataaatccgttaacggtgtggaacccctgcccattgtggatgcggtggtttcgttaactggttttgctctggtgggtggccccgctcgtcaagatcatccccgtgccattgaatccctgaaaaagctcaaccgtccctatatgtgcgccctgcccctggtgttccaaaccacagaggagtgggaagccagcgatttaggtttacaccccatccaagtggcgttacaaattgccattcctgaactggacggggcgatcgaaccgattattctttccggtcgggatggttccaccggtcgggccattgctctccaagaccgcctagaggcgatcgcccagcgggccatgaagtgggctaatttacgcaaaaaacctaagctggataaaaaagttgccattaccgtattcagtttcccccccgataaaggcaatgtgggcacagcggcctatctggacgtgtttggctccatctatgaagtgatgaaaggcctccagggcaacggctacgatgtgcaagatttacccggttccgccaaggaattaatggaagcggtcatccacgatgcccaagcccaatacaacagcccagaattaaacatcgcccatcgcatgtcggtggagcagtatgaacgcctgaccccctactcggtgcggttggaggaaaattggggcaaaccccccggacatctgaacagcgacgggcaaaatttactgatctacggtaaggaattcggtaacgtcttcatcggtgtacaacccacctttggttacgaaggggaccccatgcgcttgctattctcccgttccgccagtccccatcacggttttgccgcttactacacctatttgaaccacatttggaaagccgatgcggtattacatttcggcacccacggttctttggaatttatgcccggtaaacagatgggcatgtccggggaatgctatcccgataatttgattggcaccattcccaacttgtactactacgccgccaacaatccttctgaagctaccatcgccaaacggcggggttatgcgtccaccatttcctacttgacccctcccgcagaaaatgccggtttatacaaaggtttgcaggagttaaacgagctaattggctcctaccaaaccctgaaggattccggccggggcatccagattgttaataccatcatggaccaggcccgcatctgtaaccttgaccaagatgtcaatttgcccgacatcaacgccgaggaaatggatcaaggtcagcgggataccattgtcggttccgtttaccgcaagctgatggaaattgagtctaggctcctgccctgtggtctccatgtcattggccagcccccaagcgccgaagaggcgatcgccaccctggtaaacattgccagtttggaccgggaagatgaaggcatttgggctttgcctaccctgattgcggaaagcatcgggcgcaatatggaggaaatttaccgcaacagtgacaaggggattttggccgacgtggaattgttgcaagacattaccctagctaccagggctgctgtggccgctctggtacaggaacaaattaatgccgacggtcgagtttcctttgtttccaagctgaacttcttcaaaattggcaaaaaagctccctgggtcaaatccctctgcgattccggctaccccaacgtcaatgaagaaaaactcaaacccctgtttgaatacctggaattctgtttggaacaggtttgtgccgacaacgaatttggtggcctactccaagccctggaaggggaatacgtcctgcccggccctggtggcgaccccatccgtaaccccaatgtgttgcccacaggaaaaaatatccacgccctcgatccccaatccatccccaccctggccgctgtccaatccgccaaagtagtggtcgatcgcctgttggaacggcaacgcgccgaaaatggtggtaattatcccgaaaccattgcttctgtgctctggggtacggataacatcaaaacctacggcgaatccctggcccaaattatgtggatggtgggagccaaacccgtccccgatgccctcggtcgggtaaataaaatcgaactggtgcccctggaagaactgggtcgcccccgcattgacgtggtggtgaattgttccggggtattccgggatctgtttattaaccaaatgaacctgttggatcaagcggtgaaactagccgccgaagccgatgaacccctggaaatgaacttcgttcgtaagcacgccctggaacaggcagaagagatgggcattggcgtaagggaagcggccacccggattttctccaacgcctccggttcctattcttccaacgtcaacttagcggtagaaaacagcagttgggaagatgagtcggaattgcaggaaatgtacctcaaacgcaagtccttcgctttcaactccgataaccccggcatgatggaccaaaatcgggatatgttcgagcgggctttgaaaaccgccgatgccacattccagaacttggattcctcggaaattagcctcaccgacgtatcccactacttcgactccgaccccaccaagttaatttccaccctgcgggatgacggcaaagcccccgccgcttacattgccgacaccaccaccgccaacgctcaggtacgtaccctatcggaaacggtgcgccttgatgcccgcacgaaattgctcaatcccaaatggtacgaagggatgctttcccatggctacgaaggggtgcgggaactatccaaacggttagtcaataccatgggctggagtgccactgccggcgcagtggataactgggtttatgaggatgccaacagcaccttcatcaaagatgaggaaatgtgcaaacggttaatggacttaaaccccaactctttccgccgcatggtcagcactttgttggaagtcaatggccgcggctattgggagacttctgatgaaaacttggaacggctacaggaactttatcaagaagtggaagaccgcattgaaggggttgaataa

SEQ ID NO: 26329 - DNA, 993 bp, Synechocystis sp.
gtggtcataatggaggcgaagtcaaattacccaaaaaccatgtcctttgctaatgccgatactcccccccaagtcgttgtgttgggggccggagcctggggctctagtcttgcctacgtgctgaataacaatgacattcctacccaagtttggtctcgccgatcgccgcagagcctagaatccatggtggctggagcggatgtaattgtctcggcggtttccattaagggggtaccatcggtggcggcccggttggaggccatggacctccagcggcggactattttggtgacggccactaagggtttagatccagaaaccatgactaccccttcccaaatttggcaagctgcccttccttcccagccgatcgccgttttgtcggggccgaatttatcgaaggaaattgaccagggtttaccggcggccacggtggtggccagtagcgaccaagccgcagcggaggaaattcaaaccatttttgccgcggataacttccgggtttacaccaacaatgatcccttgggtacggaattgggtggcaccctgaaaaacgtcatggcgatcgccgtgggagtatgcgaagggttggggctaggcaccaatgctaaatcagcgttaattaccagagctttaccagaaattaccagggtggggttacattttggggcccaaccggataccttttggggtttagccggactaggagatttattggccacctgctctagcatgctcagccgcaattatcgagtgggttatggtttatccaaaggtcagtccttagaagaaattttggccaacctggggggcaccgccgaaggggtcaacaccaccgacgtactaatcaaaattgccaatcgagaaaaaattgctgtgcccatcacccggcaggtttaccgtttgctccatggaaaaattacccctccccaggcagtggaagcattaatggaaagggaattgaaagcggaatttgaagattttgatctttaa

SEQ ID NO: 26330 - DNA, 1305 bp, Synechocystis sp.
gtgactcgtattcttaagctctcgcaccttaccccccaacaattaaaccaactcaaacgtcgctcggaacaaaacattgaccaagccctggcgatcgccaaggaagttattgagcaggtaaaaatggagggagatgcgggggttttgcattacagccgtcagtttgacttcgctggggccacggcggaaaatttgcgggtgagtgaagcggaatttgccgaagcggaaaagttggtggatcctgaactacggcgggcggtggaacacgcttttcgcaatattgaaaaggttcatgctgggcaaatgcctccccccatgcacctagcggaaattgagccgggggtatttgcgggggaaaaaattacgcctctgcccacggtgggtttgtacgtgcccaggggtaagggggctttcccttccatgatgttgatgttggcggtgccggcccgggtggcaggggtaaagaaaattgtggtttgtactccccctgacaaagagggaaaagtggagccggtttccttggtcactgcccgcatggccggagtggatgaggtctataaattgggtggtgtccaggcccttgcggcaatcgcctacggcaccaaaacggttagcaaagtggataagctaattggcccctgcagcatttacggtgcggcggcgaaaagattactgtccggcattgttgatgtgggtttaccggcaggacccagtgagtccattgttttagctgatgaaaccactgaccccaagctggcggcgttggatttgttgatcgaagcggaacacggctccgactcagcggcgctgttggtgacccactctgcaagtttggcggaaaaggcattgggttatttaggggaatacctggaaaaactccccccctggcgcaaaaagttttgtgaagatggtctgggttcctatggcggcattttgctcactgatagtttgcaagcttccctagatttcattaacgattacgctccggaacatttgcaggtgttgacggcggaccccctcaaattggtgggcaaaatcgacaatgcgggggaaattttgctgggcaattacactccgtcttcagccgctacctatgccattggggtaaatgcggtgcttcccacgggaggctttgcccgttcctactcggcggtgtcggtgtttgatttcctcaagcgttctaccctagcttatttaacggaggaaggttttgctggggtgaaggaaacggtcactaccctagcggactatgaggattttccagcccatgccctggccatacgggaacgggaaaatttgctttaa

SEQ ID NO: 26331 - DNA, 1557 bp, Synechocystis sp.
atgaataattctactgtctctagtattgacattactccccaagatagatacaaccaacaattactagcccatgttcatcctccggactggattaatccttctcctaaagatcaatatgacctggtagttattggagctggcaccgctggtttagtcgtagctgctggggcagcgggtttaggtattggtcttaaagttgctttaattgaaaagcatttgatggggggcgattgtctcaactttggttgcattccttctaaggccctaattagctccgcaagggtggtaggagtaatgaataatgctaatagtttaggcatcaaaaaaccagacagcattgaaattgattttcccgctgtgatggcgagaatgcgtcaaattaggaccggcattagccaccatgactctgctcaaagatttcgggatttgggcattgatgtttttcttggagaaggacattttgttcgtaataatcaaattgaggtgggaggggctattcttaactacaaaaaagccataattgccactggagcgaaagcggttaaacctaacattcctggcatagaagaagtcggatttttaactaatgaaacagtgttttccttaacggcatgccccgatcgcctaggggtcattggaggtggcccgattgggtgtgagttagcccaagcttttcaacgattgggggcgcaagttacgctctttcatcggggtagtcatttgttgaacaaagaagatccggaagcggcggcgattgtacaggaatccttaatcaaagatggcattgaactaattttaaacgccaaattggaacgggcagaattaactgatcggggtaaagttttgcattacagggctaatggcgattctggcaccattgtagtggatgaaattctggttggtgcagggcgagcccctaatgtggaggaattaaacttagaggctgtgggggtaaaatttgatcgccgaggagtgaaagtcaacgattatttgcaaactaccagcccgcaaatttatgccgccggggatatttgtatggactggaaattcacccatgccgccgatgccgccgcccgcattgtgattaaaaatactctcttttctcccttcggtttaggacgcagtaaactaagcagtttaaccatgccttgggtaacctacaccgacccagaaattgcccatgtaggattaaatgaaactatggctgaggccttagacataggctataaaattattaaaattcccttttcccaggttgaccgggcgatcgccgctgacgagacagagggatttttgaaaattatccacgtagccaacagtgatgaaattttaggtgctaccattgttgcctcccatgccggggaaatgatttctgaaattaccacggctattgttaataaaattggcttaagcaaattagccggggtgatccatccctatcccacccaggccgaagcgattaaaaaagccgccgatacttaccgccgtactttgctcactaataatacgaaaaatttactaaaacttctaactaaatttcccagtaaattattctag

SEQ ID NO: 26332 - DNA, 1923 bp, Synechocystis sp.
atgcacatcagcgaactgacccaccccaatgagttaaagggtttatctatccgtgagctggaggaagtttcccggcaaatccgagaaaaacatctccaaactgtggccaccagcggcggtcatctggggcctgggttgggagtggtggaactgacggtggccctatattccactcttgatttagacaaagaccgggtgatttgggatgtgggacaccaagcctatccccacaaaatgttgacgggacgttaccatgatttccataccctgcggcaaaaagatggggtggctggttacctcaaacgctctgaaagtcgttttgaccattttggtgctgggcacgcttccacaagtatttccgctggtttgggcatggctttagctcgagatgccaagggggaagattttaaagtagtttccatcattggcgatggtgctttaaccgggggcatggccttggaggcaatcaaccatgccgggcatttgccccataccagactaatggtgattctcaatgacaatgagatgtccatttcccccaacgtgggagccatttcccgttatttaaataaagtccgcctcagcagtccgatgcagtttttgacggacaatctggaggaacagatcaaacacttgccctttgtgggggattccctcaccccggagatggaaagggtcaaggagggaatgaaacgtcttgttgtccccaaagtgggagcggtgattgaagaactaggatttaaatattttggtcccattgacggtcatagtttacaggaattaatcgatacctttaaacaagcggaaaaagtgcctggtccggtgtttgtccatgtttccaccaccaagggcaagggttatgacttagccgaaaaggatcaagtaggctaccacgcccaaagtcctttcaacctttccaccggtaaggcctatccttctagtaagccgaaaccccccagctattccaaggtttttgcccatacgttgactaccctggccaaggaaaatcccaacattgtcggtatcacggctgctatggcgacggggacagggctagataaactccaggccaagctacccaagcagtatgtggacgtgggcattgcggaacaacacgcagttactttggcggcgggcatggcctgcgagggcattcgtccagtggtggccatctattccacctttttgcaacggggttacgaccagattatccatgacgtttgtattcaaaaattacccgtatttttctgcctagaccgggcgggcattgtgggggcggatgggcccacccaccaagggatgtatgacattgcctatctccgttgcattcccaatctggtgctgatggctcccaaggatgaagcagagttacaacaaatgctggttactggggttaactacaccggtggggcgatcgccatgcgttatccccggggtaatggcatcggggtgcccctgatggaggaaggttgggaaccgctggaaattggtaaagctgaaattctccggtcgggggatgatgtgcttctgttgggctacggctccatggtctatcccgctctgcaaacagcggaattactccacgaacacggcatcgaagcaacggtggttaatgcccgctttgttaaaccactagatacggaattaattttgcccttggccgagcgcatcggcaaagtggtgaccatggaagaaggttgcctcatggggggctttggctcagcagtggcggaggccctgatggataacaacgtgttggtgcccttgaaacgtttaggggtgcccgacatacttgtggaccatgccactccggaacaatccaccgttgaccttggtttaaccccagcccagatggcgcagaatattatggcttcactgttcaaaactgaaactgaatcagttgtcgctcctggagttagttag

SEQ ID NO: 26333 - DNA, 5898 bp, Synechocystis sp.
atgagcgtctacaatcttgatttgtccttagtctatgggaaactgtccgcttttgcaggcttggagagtttttggcagaatttcgagattatttatggaaataattatgatgttgtcgccgtagaagctttgcgaagtcgttgggctattggagattttagcgatcttcctgtcattgaagtactcagtgccgaaaccttgggctctgctgtgggagcctatgcccaaagtatcaataaaatttatctgtctgaccaatttgttgccactgcccccccagacgctctgattgaagtcatcctcgaagagattggacattttgtggatgctcaagttaacgcagtcgataccataggagatgaaggacaattatttgcagatctagtgttgggagatgttgtctctgcgtcggaattggcaaggataaaagccgaagatgatacacacaccatcattatcaatggtcaatcattacaggttgaacagtcagtacagtctttaataggcgagtcggttactgtcaatgtgcgtttcaccggtagtggttctgatggcagcttcaattttgacctgtttacccaaacatttaccgtaacgtcaggacaggaaatcacagatcaagctatcactgctacttttaattcatcaggatccccccaaacgctgaccggcaacgtagacatagatgtatcggaaaataccatctatgtgaatttttcgggtactcagcaaggaggagctttaactttcatttttacatctctagcagatgaatcaataggttctgttgaatctgtgattcagacaaatgtatctggtttcactactggcgttaaccaacctctcaccccttctgtatcaaacaataatgttactgttggttttttcccctttggttctcagcctggcgttaatctctctcagacctctacacttacctatggaactccccccacggataacactccgcccaatgccccgtctacgccagatttgagtgcaagcagtgatagtgggctttctagtacagacaacatcaccaatgacaccacaccaacgtttaacggtacggctgaagccaacagcacggtaaccctatttagtggaggtagtacccagataggaagcaccactgccaatggctcaggaaattggacaattacggcttcgactccagctgatggcaactacagtattactgccaaagctaccgatgctgcgggcaatgttagtacggcttcttcagccttaggcattactattgataacactactccaaacctcgctagtgctattgagattagtgacaccgctctaaaaatcggtgatacagcgaccgttacctttactttttccgaagcagtaattgggtttacaaatgcagatattattgtcgtcgacggttctttgtcatctccaacgtcatccgacggaggaataacctggacagccactcttaccccaaatgctaatgctgaatctaattccaatgttattaccctagacaatacagggattagtgacctagctgggaataacggaaccggcacaacaacatcagttagctatgctgtagatactattccccctacactcacctctattgatgatggggatgatgataacattgttcctatcgacactccgctgacctataccctgaccttcagtgaagatatagactccacaactgtcactgctgatgattttgacaatgcgggaacagcgacaatttctattggaaccattacagaaaccagctcgggggtattttctgtagttgtcactcctaacacttcaggcactatcattctgcagattcctaatggggcagtgcttagcgatatggcaggcaataatctagcagtccctgtgcaagatgatgatgaacttcaagtcaaccaaggacccagcgctgttatagttcctaatgccagtctggcagaaaataccgatactacgaacccactcaaagtagcggatattgctattaccgatgatggtttagggagtaatgatatcagcctgtcaggtattgatgcagccttttttgaagtcattgggcagagtctctttctcaaggctggtacagtattgaactttgagagtaaagccagctataccgtcacagtgaatgtggatgatgacacggtaggtagtacccctgacttgactgcggatttcaagttaactatcaataacctagatgaagtagcgccaaccatcacatcgggagatacagcaaaggcgatcgccgaaaatagtggtgcgaatcaaataatttaccaagtaaaagcaacggatgatggtgacataagtgcaggaataacctttggcttgaaaccgggggatgatgctgactcgtttatcatcaatgccaccactggagaagttaagttaattggcaatcctgactttgaaacccaatccagttataaattcaccgttactgctgacgatggagttaacccggccaccgaacaattggttaatttagccatcattgacctagacgaaatagctcctactatcacatcgggagatacggcgaaggcgatcgccgaaaatagtggtgcgaatcaagtaatttatcaagtcactgccacagatgatgctgacgtaagtgcaggaataacatttggtttaaagccagggaatgatgctgacctgtttatcatcaactccaccaccggacaagtaatcctaactgaaaacccagattttgaaacacaatccagttataaattcacggttactgctagcgatggggttaatcctgccaccgaaaaaatagttaccctagccatcattgacttagacgaaatagctcctactatcacatcgggagatacggcaaaggcgatcaccgaaaatagtggtgccaatcaagtaatttacgaagttattgccacagatgatgctgacgtaagtgccggaataacatttggtttaaagccagggaatgatgctggttcatttaccatcaatcccatcaccgggaaagtaaccctcattgatgacccggactttgaaacacaatcaagttataaattcaccgttactgccagcgatggtgttaacctggccacggagcaattagtcaacttaaccatcattgacttagatgaaatagctccaaccatcacatcgggggatacagcaaaggcgatcgccgaaaatagtggtgccaatcaagtaatttacgaagttattgccacagatgatgctgacgtaagtgccggaataacatttggtttaaagccagggaatgatgctggttcatttaccatcaatcccatcaccgggaaagtaaccctcattgatgacccggactttgaaacacaatcaagttataaattcaccgttactgccagcgatggtgttaacctggccacggagcaattagtcaacttaaccatcattgacttagatgaaatagctccaaccatcacatcgggggatacagcaaaggcgatcaccgaaaatagtggtgcgaatcagataatttaccaggcaacagcggatgataatgcggatataagtgccggggtaacctttggcttgaaaccaggggatgatgctgactcgtttatcatcaatgccatcactggacaagttaccttacttgataacccagactttgaaacccaatcaagttataaattcactgtcactgccagcgatggtgtgaatcctgtcactgagcaagttgtcaatttaaccatcattgacttagatgaaatagccccaactattacatcgggaaatacagcaaaggcgatcgccgaaaacagtggtgcgaatcaagtaatttaccaagtcactgccacagatgatgctgacataagtgccgaagtaacctttgggttgaaattgggtgatgatgccacatctttcagcattgactccacaacaggcaaagtaactttaatcaacaatcctgactttgaaagccaatccagttataaattcaccgttactgctagcgatggtgtgaatcccgccaccgaaaaaatagttaccctagccatcaataatctagacgaaataggcccgaccattacatcaggcgatacagcaacgcctattgatgaaaacagtggtgccaatcaactaatttaccaagttattgccacagatgatgctgacgtaagtgccggaataacatttggtttaaagccagggaatgatgctggctcatttactatcaatcccatcaccggggaagtaaccctcattgatgacccggactttgaaacccaatcaagttataaattcaccgttactgccagcgatggtgttaaccctgctacggaaaaaatagttaccctgactattaatgatctggacgaactcggtcccaatattacatctgataatatcgcaacagcaattaatgaaaacagtggtgcgaatcagataatttaccaagtaacagcagacgatggtgatgatatcagtgccggagtgacctttggcttaaagccgggagacaatgccaaccagttcagtattgatccaacaactggacaagttaccttacttgataacccagactttgaaacccaatcaagttataaattcacggtcactgccagcgatggcgttaaccctgccacggagcaattagtcaacttaaccatcattgatcttgatgaaatagctccaaccattactagtggagatacggcaaaagcgattgccgaaaatagtggtgcgaatcaagtaatttaccaagtaacagcaacggatgatgctgacacaagtgcaggagtaaccttcggcttaaaaccaggagaagatgctaactcatttaccatcaatgccgccactggagaagttgagttaattggcaatccagactttgaaacccaatcaagttataaattcactgtcactgccagcgatggtgtgaatcctgtcacggagcaagttgttaatttaaccatcatcgacctagacgaaatagccccaactattacatcgggaaatacagcaaaggcgatcgccgaaaatagtggtgccaatcaagtaatttatcaagtcactgccacagatgatgctgacataagtgcgggagtaacctttggcttgaaaccaggggatgatgccacatctttcagcattgactccacaacaggcaaagtaactttaatcaacaatcctgactttgaaagccaatccagttatagattcaccgttactgctgacgatggcgttaatccagttactgaacaacaaatcgcattagaaatcttagatgacaatgttgctgttattgaaaatggctttttcttcgctcaatttttagataatactcgccaagctcttttgtttcagaatcaaccattctctactgatcaatctgtaaactggaaaatcttagacacagaaactgttgatggctccaatcaagtgctttggtacaatcaagttactgaagaagttggtgtatggctgactgataataattggaactggatttcttctgacacatggcaagtgaaatcatcaagaacttttaataccgaattattatttgggacggacattaacggagattctctcattggcgatcaatacactgttttagaaaatcaaggtgcggttggtctcctggaaggaatttttggcgcttactatgttcagcccggggatgacccagttactcctcttaaatttttagggcaaccattcgagaatcagtttggtagttggcaagccctagccgcagaaagggttgaaaacatcaaccgagttttatggcaaaattttgacaccggagaaattggaatttggcgaacagacaataattggaattggctttcttccaatgtttttacccccaattccactgaaatagccaccgttgaaagcctttttggcattagcctttag

SEQ ID NO: 26334 - DNA, 924 bp, Synechocystis sp.
atggaacaagtgcggaattattatcaaattttgggagttccccgcaatgccactgctgaagagattaaaaagtcttttcggaagctagctcgtcagtatcatcctgatgttaaccccaacgataaaacagcggaagagaaatttaaagatattaacgaagcctacgatgtcctttccgatgaaaccaagcgccgggaattagatagtcgtttatttggccgattccgccgtccccccaccagtcgttttagccccaatagtaacggtgggcgatcgcctaacggaacaagtgtcaatggccaagttcgtacccccactgggcgcactggaacccgtcagccggcgcagtcatggcaagattttagtgaaactagacgcacgaaagtggtgtcccccgcccgccctgtgcccagggatgtggaagccaatttgaccctgccgttggaaaaagcctaccggggaggcaaggaaagaattcgtttggaagatggccgttctttggaggtggaaatgcctgggggcatgggggatgggcaacggattcgcctcaagcaacagggcattaatgggggcgatctatatctaaaaatcaacctttctccccacccgttatttactctccaggggacggacattgcttgccaggtgcccgtaactcccagtgaagccattttggggggcgctattgaggtgatgaccattgacggcctggtgaaaatgactgtgccagcgggtttaaaaaatggtcaaaaactacgtttggccaaaaagggctttcccaacaaccaaggcgatcggggagaccagttagtggaaattcgggtggaaattcccccggaacccagcccagaggaattggagctttaccgtagaattcgggaaaaggaaacctttaacccccggcaaaagttctttgatttttaa

SEQ ID NO: 26335 - DNA, 2367 bp, Synechocystis sp.
gtgttaacgagtattaaccgctctgcaaattttgggagcaaagaaaacaacatgggaaaagtcgtcggaattgaccttggaactaccaattcagttgtggccgtcatggaaggcggcaaacccattgtcatcgccaatgcggaaggcatgcgtactaccccctccgtggtggggttcaacaaagaaggggaattggtggtgggtcagatgggccggcggcaagcggtgctcaatccccaaaatactttctatggcgtcaaacgttttatggggaggcgttacactgatttaactccagaatctaaacgagtagcctacaccatccggcgggatgaccgggataacattaaagtgcgttgtccccggctgaaaaaagactttgccccggaagaaatttccgccatgattttgcggaagttggccgaagaagccagccgctacctgggggaaaaggtcaccggagctgtgattactgtgcctgcctactttaacgattcccaacggcaagccactagagatgcggggaaaattgccgggctggaagtgctacggattatcaacgaacccacagcggcatctttagcttacggcttagaccaggggcggatacaaaaaatcctggtgtttgacctagggggcggcacctttgatgtttctgtgttggaagtgggggacggcatttttgaagttaaggccaccagcggtgatacccagttggggggtaacgattttgatcgccgcattgtggattggctagcggaaaagtttttagaagcggagaaagtggatttacggcaggatcgccaggccctacaaaggttaaccgaagcggcggaaaaggccaaaattgaactttctggggtcggtactacggaaattaatttacccttcatcaccgctacggaagacggtcccaaacatttggaaacccagttgagccgttcggaatttgaagatttatgtggagatttagttactcgtctgcaaagacccgttaaacgggtgctgaaagatgcgggcttgagtccggtacaaatcgatgaagtggtgctagtgggaggtggcacccgtatgcccatggtcaaaggccttgtccgtagtttcattgaccgggaacccaacgaaaacgtcaaccccgatgaagtagtggcgatcggagcggcaatccaggcgggcattttggacggggaagtgaaagatatcttgctgctggatgtaacccccctttcctttgggttggaaaccattggcggcgtgatgaaaaaattactgccccgcaacaccaccattccagtgcgtaaatcggacattttttccaccggggaaaataatcaaaccgtagtggaagtccacgtgctccaaggggaacgggaaatggccagcgataatatttccctcggtcgttttaaactgagcggtattccgccggctcccaggggagtgccccaggtgcaggtttccttcgacattgacgctaacggtattttgcaggtgacagcgagggacaaaaccaccggccgggagcaaagcattacagtccaaggggcttccatcctcagtgaaggggaagtcaatcgcatgatccaagaagcagaaacctttgccgcccaggaccgggaacggcgggaacgcattgaaaaacgcaacagtgctaaggcattaacggatcaggctcagcggcggctcaaggaagttaccctggatttcggcagtgcgttcaccgtgtcctaccgtcgtcaagtggatgcgttgtgcagtgaaattttagacagtctggaaaaagatgatgagcgtcggttagaccgggcccaggcagatttgcaggatgtgttgtacgagttaaatcgggaagtgcgtctgcagtatgacgacaaggaagaaggctttttcgaagcgattaagaaaaccttcactggcgatttcgatgacgatgatgattactacaaccgtcgccctgctcccagggatgattatcggggaggtaatgactacggtcgctatgacgattacaactacaacgccccttcccgtcgagaggcacccatgcccagggctggcgctggccggggcccttccttgagcaaagattaccgttccaccgcctatgctgattgggaccagtccagggtcaccagacaacgaccttaccaaggagagagtttagggggtacctacgacgatcgccgttctagcccccaggatgattactctagaggcgatcgccagaaggattacgattatcgggaaaatgcccccagtcgttctggtcggggaggcaatggccgctatggggaacggcctgcccagcccggtcgcaatgccccattacaaaacggttgggatgatgacgatgatgattggttctaa

SEQ ID NO: 26336 - DNA, 1152 bp, Synechocystis sp.
atgagagctctggttattggcggtgatggttactgtggttgggccacggcactgtatctctctaacaaaggctatgaagtcggtattttagacagtttggtgcggcgctattgggacgcccagttgggggctgaaaccttgactcccatcgcccccatccggcaacgccttgatcgttggtatgagttgaccggcaaaaagatcgacctgttcattggcgatattaacgactatccctttttgaccaacgccctccgtcagttccagcccgatgcggtggtgcattttggggagcaacggtcagcgcctttttccatgattgaccgggaacatgcggtgctgacccaggccaataacgtattgggcaacttgaatctgctctatgcactgaaggaagatttccccgattgtcatttggtgaaactaggcaccatgggggaatacggtacgcccaacattgacatcgaagaagggtacatcaccattgagcataaaggtcgtaaagacaccctaccctaccccaaacaacccggtagtttctatcacctcagtaaggttcacgatagccataacatccacttcgcttgcaaaatctggggtctgcgggccacggatttaaaccagggcattgtttacggggtactcaccgaagaaaccggcatggatgaaatgctgatcaaccgtcttgattatgacggtgtatttggtacggctctgaatcgtttttgtattcaggcggccattggccatcccctgacagtgtacggtaaaggtggacaaacccgtggtttgctggatattcgggatacggtgcgctgtattgaactggcgatcgccaacccggccgataaaggtcaattccgggtgtttaaccaatatacggaactgttcagcgttggtgacttggcccaaatggtgcaaaaagcgggcgcggatctcggtctaaaagtggaaattgaccacttggaaaatccccgggttgagttggaagaacactatttcaacgccgtcaataccaatctgctggatttgggactccaaccccacttcttgtctgattctttgctcgattccctgttgaactttgccaccaagtacaaagaccgggtggatcaaaaacacattctgccgaaagttacctggcgcggctag

SEQ ID NO: 26337 - DNA, 1290 bp, Synechocystis sp.
gtgacctattcccctgttgttgaatccgtcgaagcccaagcttttgccgtaaccgacctatcccctgccgccgagtttaaaaccgcagattttgatacctatgtgatgaacacctatgggcgatttcccattgcgatcgccaggggtcagggcagtactttatgggataccgagggcaagagttatcttgattttgtcgctggcattgccacctgtacccttggccacgcccatccggccttggttagggcggtttctgaccaaattcaaaagctccaccacgtctcaaacttgtactatattcccgaacaaggggagttggctaaatggattgtggagcattcctgtgcggaccgggttttcttttgcaactctggggcagaggccaatgaagcggcgattaaattagtgcgaaaatatgcccacactgtcctggatttcctcgaacagcccgttattctcaccgccaaagctagtttccacggccgtaccctagccaccatcaccgccacgggccagcctaaatatcagcaatattttgaccctctggtgcccggctttgactacgtaccctataacgatattcgctctttggaaaataaagtggctgatttagatgaaggtaatagtcgagtggcagccattttcctcgaacctctccaaggggaggggggagtccgccctggggatttggcctatttcaaacgggtgcgggagatctgtgaccaaaacgatattttgttggtctttgacgaagtgcaagtgggggtaggacgcactggcaagttgtggggctacgaacatctaggggtggagccagacattttcaccagtgccaagggtctggccgggggcgttcccattggggcgatgatgtgcaaaaaattctgtgacgtatttgagccgggcaaccatgccagtacctttggtggtaatcccctggcctgtgccgctgggctagcggtcttaaaaaccattgaaggcgatcgcctgttggacaatgtccaggcccggggggaacagctacggagtggtttggcggaaattaaaaatcaatatcccacactctttaccgaagtccggggttggggcttaatcaacggtctggaaattagcgccgaaagttccctcacctccgttgaaattgtcaaagccgccatggaacagggtttactcctggcccccgctggtcccaaagtgttacggtttgtgccccccctagtggtgacggaagcagaaattgcccaggcagtggaaattctccgtcaggcgatcgccactttggtttga

SEQ ID NO: 26338 - DNA, 1110 bp, Synechocystis sp.
atgaaatcccgtgccgccgttgcctttgaagtgggcaaacctttgcaaattgtggaaatagatgtggctccaccccagcaaggcgaagttttggtcaagatcacccataccggagtctgccacacggacgcatttaccctcagcggcgatgacccggaaggactttttcccgttgtgctgggccatgagggagcaggcattgtggttgaagtgggggaaggggtaaccagtgttcaactgggagaccacgttatccccctttacactgctgaatgtgggaaatgtttgttttgtcgctccggtaaaaccaatctctgcgttgcagtgcgggccacccaaggcaaaggggttatgcccgatggcaccagtcgtttttcctacaatggccagtccctctatcactacatgggttgtagcacctttagcgaatataccgttgttgccgaagtttccctcgccaaaattaaccccgaagcaaaccacgaacacgtttgtttactgggttgcggcgtcaccacaggcatcggcgctgtgcacaataccgccaaagtacaaccaggagactcagtggcggtgtttggcctggggggcatcggcctcgctgttgtacagggagctcgtcaggccaaagctggtcgcatcattgccatcgacaccaaccccgccaaatttgagctagcgaagcagatgggcgccactgactgcattaatcccaaagaccatgaccaacccattcagcaagtcatagtggaaatgaccggctggggagtggaccactcctttgaatgcatcggcaatgtggaagtaatgcgctccgctctggaatgtgcccaccggggttgggggcaatcggtaatcattggcgtagcaggggctggccaagaaatttccaccagaccattccagcttgttaccggccgcaaatggatgggcaccgcttttggcggtgtgaaaggtcgttcccaattaccaggtatggtggaacaatccatgcggggggagatccaactagccccctttgttacccacaccatggaactaaaggatatcaaccaagcctttgacctcatgcatgacggcaaatcgattcgcagtgtgatccactactaa

SEQ ID NO: 26339 - DNA, 1074 bp, Synechocystis sp.
atgactgccacccttgccgcccccagcaaaacccgccgtgttgtttttccttttacggcgatcgtcggtcaagatgaaatgaagttggccctgttgctcaatgtcattgatcccaagattggcggcgtcatgatcatgggcgatcggggaaccgggaaatccactaccattagagctttggcggatttgttgccggaaattgaggtggtggccaatgatccttttaactcttcccccagcgatcccgagatgatgagtgaggaagtacggatccgggtagatagccaagaacctttatctattgtcaaaaagaaagtcaccatggtggatttgcccctgggggcaacggaagaccgggtgtgcggcaccatcgacatcgaaaaggcattatcagaaggagttaaagcctttgaaccgggtttattggccaaagccaaccggggcattctctatgtggacgaagttaacctgttggacgatcacttagtggacgtgttgttggactccgctgctgggggttggaacacggtggagcgggaaggtatttccattcgccatccggcccggtttgttttagtgggttccggtaacccagaagaaggggaattgcggcctcaattgttggatcgattcggcatgcatgctgaaattcgcactgtgcgggaaccggaattgcgggtaaaaattgtcgaacaacggacggagtttgaccaaaatccccatcctttctgtgaccaatatcaaacggaacaggaagcgttacaagcaaaaattgttaatgcccagaatttactgccccaagtgaccattgactacgactatcgggtgaaagtatcggaagtctgtgcagaacttgatgtggacgggttacggggagatattgttaccaatcgggccgccaaagccctggccgcttttgaaggtcgcactgaggtaacagtggatgatattagccgagtaattgtgctttgtttacgccatcgtttacggaaagatcctctagagtccattgattccggcagtaaggtggaaaaggtatttaaacgggtttttggcgttgtcgatgaagcttaa

SEQ ID NO: 26340 - DNA, 1998 bp, Synechocystis sp.
atgagtcatcgtccccgttccgatcgccatagtttctccagccctagccgcttttggcaccgtttggggatgggtttactggtagctggcaccctagccctaccggtatctaccctggcccaggaagggggagaaggggcccaacccaaggccagtcccagtcccatccaatcccctaactccagcaatggagaagccacaccccgctccttttttaactctggctccccccggtctgctgaaccgaaaatgaactatgggcagttgatcgatgccattaaagctaatcaagtggccaaagtggaagtggacactaaccgccgccaggcgatcgttaccctcaaggatgctcccccagggtccaagccccaaaccgtgcagttactagacaataatccagagttgctcaacctcctgcggagccgttccgaaaccatcgatttagacatcaaccgcaccccggataattcggccctgtatggtctactaaccaatttgctggtggtggctattctgatcggtttggtggtgatggtggtgcgacgttctgccaatgcgtcgggtcaggccatgagttttggcaaatccaaggcccggttccaaatggaagcaaaaaccggtgtcggctttgacgatgtggccggcattgacgaagcgaaggaagaattgcaggaagtggtaactttcctcaagcaaccggaaaaatttaccgccatcggcgcaaaaattccccggggtgttctactcatcggccctcccggtacgggcaaaaccttattagctaaggcgatcgccggggaggcgggggtgccatttttcagcatttccggttcagaatttgtggaaatgtttgtcggggtgggggcttcccgggtcagggatttattcaaaaaagctaaggaaaatgccccctgcctagtatttatcgatgaaattgatgcggtgggtcgacaacggggtgtgggctatggcggcggcaacgatgaacgggaacaaaccctcaaccaattgttgacggaaatggatggctttgagggcaacagcggcatcattgtcattgcggccaccaaccgccccgatgtgctggatttggcccttttgcggccaggacggttcgatcgccaggtgacggtggattaccccgatgtccagggccgggaattaattttggcaatccacgcccaaaacaaaaaattgcacgaagaggtgcagttagcggcgatcgccaggagaactcccggatttacgggggcagatttggccaacgtgttaaatgaagcggccattttcaccgctcggcggcgcaaggaggccatcaccatggcggaagtgaatgatgccattgaccgggtggtggcggggatggaaggtacacccctagtggatagtaaaagtaaacgcttaattgcttaccatgaagtgggccacgccttgattggcaccctctgtcctggccacgatccggtggaaaaagttaccctcattccccggggccaagcccaaggtttgacctggttcacccctgatgaagaccaaagcctcatgacccgcaaccaaatgattgcccgcattgcaggattgttgggggggagggtggccgaagaagttatttttggcgacgacgaggtgaccaccggagccggtaacgacattgaaaaaatcacctacctagcccgacaaatggtgacgaaactgggcatgtcttccctgggtctagtggccttggaagaggaaggcgatcgtaactttagcggcggagattggggcaagcgttccgaatattccgaagacattgccgcccgcattgaccgggaaatccaagccattgtcaccgctgcccaccaacgggccacccgcattattgaagaaaatcgtaatttaatggatttactagtcgatgcgctcatcgatcaagaaaccattgaaggggagcattttcggcaactggtggaaagttatcaacaatctcaaaaacagcctgctctagccggtaagtag

SEQ ID NO: 26341 - DNA, 615 bp, Synechocystis sp.
atggctctacatttttcggcgatcgcctacccagacccagcagttacaccaacggattctagttatttactcgtgatgctccatggttggggggctgatgctcgggatttgtcagacctggctcccatgttggacttacctaattatcagtggcgctttgttaatgccccctttacccatccccaaattccccagggccgggcttggtatgacctcgaaagtcaaaattttgaaggtttggcccaagcaagacagggtttacgagcctatttattgggtttagcagaggaaacgggcattcccctggccagaactatactgggaggcttttcccaggggggagccatggctctggatgtgggcttaacattgcccctggctaaaattttttccctgagcggctatctccatttccagccggaatcccaaccccaggcgatcgcccctatcttgttaatccatggcaccgaagatccggtagtaccactgcggatggctcaacaggccaaggctgaactggaaagcattggggcctcagtggaatatcaagaatttcccatgggtcatgccattcctcccatggcgttggctcggttaaagtcttttttgagttga

SEQ ID NO: 26342 - DNA, 1953 bp, Synechocystis sp.
gtggcgaatcttaggacacattttgtctgttttgatgatgtccctgcaaaagaactgtcaccacctgccgttagcgactttccccgtctccaaacatctatgaatgacctgattttggctgtgcgtcaactggaaattgctttccccgatgctgataccagggaaaaattgttggccgtcaaaggggttgattttgagttagagcggggggaaatcctcggcattgtgggggaatctggttccggtaaatccgtcacttccctgggcattatggggttggtgcccaagccaggctgggtggaacctagcagtgaaattgatttttttgcccaggcccagagttcccctgtcaacctagttgctctgccagagggggacaagcgtcagtaccggggcggcaaaattgccatgattttccaggagccaatgagttcccttaatccggtttataccattggctttcaaattattgaagcaattcgcctccaccaaaacgttacccaggaagaagctcaaaaccaggcgatcgcccttttgcaggaagtgagggtattgcccaaagatgaagtgctggaagaagaatttttagcccaagaacaggcccagcctaggggcaaagtaacccaaaatttagctagttatatccaacagcggaaacaaagttttctcaaacgttatccccatgaactatccggcggccaactgcaacgggtgatgattgccatggccatttccgccaatccccgactactcattgccgatgaaccaaccactgctttggatgtgacagtgcaggcggaaattttgcggctcctgcgggatttgtgcaaacaacatcaggaaatgtccctaatttttatttcccatgatttgggggtgattaacgaaattgcggaccgggtggcggtgatgtaccggggggaaattgttgagcaggggctaaaggaacagattttgcatagtcctcaacatccctacaccaaaggtttattggcctgtcgtcctcgcttggaaatacagttagaccatttgcccacggtgggggattttctcaatgctgatggtccgcctcccagttatcaagttattactccggcccaggaaagcgatcgcctggctcaattgcaagccaaaccccctctgctggaagtgcaaaacctaaccgttagttacgggcaggggggactatttgggaaaaaatccgttttcaaagcagttaatgatgtttccttccaggtttatccgggggaaaccctggggttagtgggggaatccggttgcggtaaatccaccttagctcgggctttattgcgcttaactcccattcaaacgggtcgaattatctttgatggacaaaatgtggctgctttaccggaaaaatcccaacaatggcgacgtttacggcgggaaatgcaaattattttccaaaatccctacaattcccttaatccccgcatgaccattggtcgggccatccaagagccactgattattcacgagcctaaacaatccactaagcagcaacggcaacgggtggcggaactgttggaacgggtgggtattagtccccaatggtttaaccgctatccccacgaattgtctgggggccaacggcaacggatttgcattgctcgggccttggcgctcaatccccgttttatcatttgtgacgagtccgtttctgccctggatgtgtcggtgcaagcccaggtattaaatctgctgaaggaattacaacgggatttacaactgacctatatttttatttcccatgatttgagcgttgttcgtttcatgggcgatcgcattatggtgatgaaccgggggcaactggcggaacccatcaatacggcccaggaaattatcgaaaatccccagagcgcttacaccaaaaaattaattcagtccattccccgttttcctgaaaccctcaattggttgcaatcagcctag

SEQ ID NO: 26343 - DNA, 1782 bp, Synechocystis sp.
gtgactaaacccattgcccccctcctcagccttttaaattacagccgggtccaccgtgccaaaatttactgggcggtaacctgctcattgctgaacaaaatttttgatctggctcccccggccctaattggtttagccgtggatgtggtgatcaaacagcaggattctttcctgtcccgttggggcattgtttccgtacaaagccaactgttggtgctgacggtggcttcggcggttatttgggccctggaatcaatttttgagtatgcctacgagcggctttggcgtaacctcgcccaggatatccaacacgatctgcgcctggatgcctatgcccatttgcaacagctagacctggcctatttcgaggaaaggagtacggggcggctgatggccattctcaacgatgacatcaaccagttggagcggtttttggatgtgggggccaacgaaattttgcaggtgctgaccacagtggtggtgattggtggagcattttttgtcattaccccggacattgcttggatggcggtggtgcccatgccctttgtgctgttggggtcgatctattttcagtctttgctcacttcccgttatgccctagtgcgggaaaaggtcagtaatttgaacagccgtttgtccaataacctcagcggcattatgaccatcaaaagttttgccaccgaagcggaagaggtggaacggctccggcaagacagtgatgcctatcgggacagtaatcaacgggcgatcgccttgagtgcggcctttgtgcctttaattcgggtgattatttttgccggtttttccaccattctctacttcggtggtttggatgcggtgcggggtaatttggcggtgggcagttacagtatgttggtctttttaacccaacgactactctggccgctgacgggtttgggcaaaactctggatttatatcaacgggccatggcttccacccagcgggtgatgcaacttttagcaactcctattcaagctcatccgggggaattaagcctccatcctagccaggtgcaaggggaattagttttccaaaatattagctttgcctatccccatcgttcagcggtgttgaaaaatgtttccctaagggtaccggcggggcaaaccatcggcattgtgggggcaacggggtcgggaaaaagcactctggtcaaactattactgcgactgtacgaatgggatagcggtgacattctcctagacggggtggatctgaagaaatatttcctgggggatttacggcgcagtgtcggtttagtaagccaggacgtgtttttattccacggtacggtgcgggagaatattgcctacggcagtgctgacgccactttggcccaaattgaacgggcggccaacctagcggaggcagaggaattcatcaaccagttaccccagggctacgacaccattattggcgaacggggacaaaaactttccggtggtcaacggcaacggttggcgatcgccagggctattttaaaaaatcctcccattctgattttggatgaagccacgtcagcggtggacaacgaaacagaggcggccattgtccgttccctggaaaaaatcaccaaaaatcgcaccaccattaccattgcccatcgcctttccactgtgcgctatgccgatcaaatttacgtgctggaaaacggcatggtacaagaaatgggcagccacgaaagcctactggctcaccaaggactatatgccaaactgtggcgggtgcaaacggggctaaggagtggggttagttag

SEQ ID NO: 26344 - DNA, 2238 bp, Synechocystis sp.
atggcccaaaccatcaatctgcaactagagggaatgcgctgtgcggcctgtgcttccagcattgaacgggcgatcgccaaagtgccgggggtgcagtcttgccaggtgaattttgccctggagcaggcggtggtcagttatcacggggaaacgaccccccaaatcctcacagatgcggtggagcgagcgggttaccacgctagggtgcttaaacaacaggttttatcttcccagcaaaccgaggataggaaacccgtgttttcggccaaattggtaacggggttagtaatcagcgctgtgctcttttttggctccttgcccatgatgctgggggtaaatattccccattttccccatattttccatgatccctggttgcaatggttattggctacgccggtgcagttttggtctggagcggagttttatcggggagcttggaaatccgttagaacccgcagtgccaccatggatacccttgtagccttgggcaccagtgcggcgtatttttactccgtagccattaccctctttccccaatggttaactagccaagggttagcagcccacgtttattttgaagcggcggcggtggtgatcaccctgattctgttggggcggtcgttggaacagcgggcccggcgggaaacttcagcagcgatccgtaaattaatggggctacaaccccaaacagcactcgttaaacggggggaacactgggaaacagtggcgatcgccgagttggcaattaacgatgtggtgcgggtgcggccgggggaaaaaattccggtggatggcgtggtggtggcgggaaattccactgtggatgaatcgttggtgacgggggaaagttttccggtagataaaaccgttgggacggaagtgattggggccacgttgaataaaagcggcagtttagacattcaagtcagcaagttgggccaggattccgtgctcgcccaaattatccaactggtacagcaagcccaagcttctaaagctcccatccagcactttgttgaccgcatcacccactggtttgtccccacagtaattgtggtggcgatcgccgctttttgtatttggtggctgaccacgggcaatattaccctggcggtgttgaccttggtggaagtgctgatcatcgcctgtccctgtgcgttgggcttggccacgcctacgtctgtgatggtgggcacgggtaaaggggcggagtatggcgtgctaatcaaagaagctagcagcctggaaatggcggaaaaattaactgctattgtgctggataaaactggcacgttaacccagggcaaacccagtgtgaccaacttttttactctgtcccccacttccacggaggaaagtttacagttaatccaatgggcggccagtgtggagcaatattccgaacatcccctagcggaagcggtggttaattatggtcaatcccaacaggttagtttgctagagatagacaatttccaggcgatcgccggttgtggggtggcaggacaatggcaggggcaatggatacgattaggaacgtccaattggttaaccgatttgggggtaactggtacggagcatcaaccatggcaaagtcaggcccagcaatgggaaaaggaacaaaaaaccgttatttggctggcagtggacacggaagttaaagctctattggcgatcgccgatgccatcaaaccatcctctccccaggtagtacaggctctgaaaaaactgggtttatccgtttatatgctcactggagacaaccaagccaccgcccaagccattgccgacacagtgggtattcgccatgtgttagcccaagtgcgccccggcgataaagcccaacaggtggaacagttgcaacagaagggaaatatcgtcgccatggtgggggatggcattaacgatgctcccgccctggcccaggccgatgtgggcatagccattggtactggcaccgatgtggcgatcgccgccagtgatattactctgattgctggagatttacagggaattttgaccgctatcaagctgagccgggccaccatgggtaatattagacaaaatctcttctttgcgtttatttacaacgtgatcggcattcccgtagctgctgggctgttctatcccctcttcggtttactgctcaatcccatcctggctggggccgccatggcctttagttccgtttccgtggtgaccaacgctctgcgtctgaaaaaattctgtccttag

SEQ ID NO: 26345 - DNA, 882 bp, Synechocystis sp.
atgaaaactgcatgggtattccccggccaaggttcccaagctgtgggcatgggggtagatctgctctcaacggcgatcgccaaggaaaaatatcagcaagccgaagaaattcttggctggtcagtggtggaaaaatgccaaggggatgaagctagcctggccctgacccaaaatacccaaccctgtttgtacgttattgaagcaattttggctgatttgctcagggataaaggttttcagcccgattacgtagccggtcatagtctgggggaatattccgccctctacgccgctggggtatttgattttgccacgggtttgcaactggttaaacaacggtcagaggtgatggccagcgcttccgggggcatgatggccgccctgatgaagttcgatcaaacccagttacagcaagccctgacggataatacagaggttgtattagctaacgataacagccccgaacaggtagtaatttccggtactgtggccggtgtagaagcaattttagccaacgtcaaggcacgccgagccgtgcctctgaaggtttccggtgctttccactccagctttatggcccaaccttcccaatccttcgcccaaaccctgacagcttgccatttcaacgacgccactgtgcccgtactctccaacgttgatcctagccctacccaaaacggcgatcgcctgaaagaaaaactaattcaacaaatgaccggttccgtgcgctggcgggaaaccatggttaacctaggagaaattggggcaacggattattgggaagtgggcccaggcaaagtactgactggtctatgtaaacgaacttgccctgatctgaacctgaaaaatattggccaattagacgacttgaattccctgtag

SEQ ID NO: 26346 - DNA, 1386 bp, Synechocystis sp.
atgacaaaaaaaacctggagcgatcgttttgaaggcacattgcaccccgccattgccctgtttaatgccagcattggttttgacattgaactaatcgaatatgacctggatggctcgatcgcccatggcaaaatgttggccaagacgggcattatcagcccaggggaagcagaacagctagtgcagggcttggagcaaattcgccaggaataccgagccggtaatttcaatccaggggtagaccaggaagacgttcactttgctgtggaacgccgattaacagaattggtgggggatgtgggcaaaaaactccacactgcccgttcccgcaatgaccaagtaggaaccgatgttcgtctttacctgcgtgcccaaattgatgacatccgccaacggttaagggattttcaagcagtgttgctccaactggcggaaaccaatgtggaaaccttaattcccggctacacccacctacaacgggcccaaccggtcagtttggctcaccatctactggcctatttccagatggcccaacgggattggcaacggttaggggaaattcgagctagaactaacgtttctcccctcggttctggggctttagcaggaacaacttttcccatcgatcgccattacagtgccgaattgttggggtttgcaggggtttacgccaacagcttagatggggtgagcgatcgggattttgccattgaatttctcaacgccgccagtttgatcatggtgcacctcagtcggctgagcgaagaaatgatcctctgggcttcccaggaatttagctttatcagtttgaccgatagctgtgccacaggatcaagcattatgccccaaaagaaaaatccagacgtaccagagttaattcggggtaaagccgggcgggtgatgggtcatctgcaaggaatgctagtactgatgaaaggtttgcccctggcctataacaaggatttgcaggaagacaaggaagccctgtttgatgcagtaaaaacggtgcaagtgagcctggaagccatgaccattttgcttgatgaaggtattgtttttcgtcaagaacggttagcggaggcggtggcggaagatttttccaatgcgacggatgtggcggattacttggcggctaagggagtccccttccgggaagcttataatctggtgggcaaggtggttaaaaccagtttggcggcagggaaattgctcaaggatttaaccctggcggaatggcaagcgctccatcccgcttttgaagaggatatttaccaagctattaccccccagcaagtggtggcggcacgcaatagttacgggggcacgggctttgaacaggtgaaaatggcgatcgccaatgccaaagctgaattaagccagacttaa

SEQ ID NO: 26347 - DNA, 447 bp, Synechocystis sp.
gtgtggagatatgcccaggttttcattaagttactgctccgtcgtcccctatcagcagtgacggtaattccggttctatcagatagttccatagtcctagtcaaacgacgggatacagggcaatggagtttaccaggggggctgatcgactggggggaaacagtggcaataacggccgcccgagagttacaggaagaaactggtttacggttgataaaaatagatcgcctgcttggggtctattccagtcccgacagagatccccgcatgcactccgtcaccatttccctggtggttaaagcgcaaggtgatttgctcattggcgatcgccaggaaatatccgaagtaaaagcttttgcggtggaagatttaccgttaggagcattaagccatgaccacgatcaacaactacaggattttttacggggggaaacaatcattgcttga

SEQ ID NO: 26348 - DNA, 1173 bp, Synechocystis sp.
atgagcgatgccaccccgtttcgtcccccttctgaagctgaagaagccttaatcaaagaaactcggctacccctgaccggttggcagcaggaggttgaccaagggctaacctatggtttagaagccgccgccagcattaaagaccgctccatccccaccttttcccggggagaattgccccactatgcgggcattaacaccttcatgaaggctccatatctggaagatgtgcgggaagtcgggaaatatgatgtggcgatcgtcggagtgccccatgattctggcaccacctatcgaccaggtacccgttttggcccccaggggattcgtcgtatttctgctttgtacactccctacaactttgaaatgggggtggatttacgggagcaaattagtctctgtgacgtgggggatattttcaccattcccgccaacaatgagaaatcctttgaccaaatttccaaaggtattgcccacattttcagttccggagcgtttccgataattctggggggtgatcattccattggttttcctacggtgcggggcatctgtcgtcatttgggggataaaaaagtcggcattatccatttcgatcgccatgtggacacccaggaaacggacttagacgaacggatgcacacttgtccctggttccacgccaccaacatggccaacgctccagctaaaaacctagtgcaattaggcattggtggttggcaagtaccccgccagggggtcaaagtttgtcgggaacgggccaccaacattttgaccgtcactgatattaccgaaatgagtttggatgcggcggcggactttgccattgcccgggccaccgatggcaccgattgcgtttggattagttttgacattgactgcattgatgcaggttttgtccccggcaccggttggccagaacccggtggtttactaccccgagaagctctgtatttacttaaacgcattattcgggaaactaacgtttgcggcatggaagtggtggaagtttcccctccctacgacatcagcgacatgacttcgttgatggccaccagggtaatttgcgacaccatggcccatttagtggtttctggccaattaccccgcacggaaaaaccggcctatatccatgctgaagcgaacatggcagtggatgagccctggcaatag

SEQ ID NO: 26349 - DNA, 2919 bp, Synechocystis sp.
atgggatggaaaaccatctttgttgcaccgatgaattcctccaccacggtttggtctattgccccagaagcggtttacgaaaggttggagacgagtccccaaggtttatccggcgaggaagcggcccgaagattgcaacgctatggactgaacgagctggcggaaccggtacaacgacctttatggttgcgttttgttgatcagatgacccatttcatggcgttattgctctgggtggcgggcattctggcttttgtttccggtacgccgcagttgggctgggccatttgggcggtgatttggattaatggtttatttagttttagtcaggaatttcgggccgaaaaagccctggcgaccctcaagaaagttctcccagcccaggtaaaagtttatcgggacggcactttacagtctgttctggctagggaattagtgcggggggatgtggtgcaattggaagaaggcgatcgggtatcggcggatttgcgcttagtttcagcggatagtttatacgttgatgtgtcggtgatgacgggggaatccttacccgtagctcgttttgccgaatcggcccaaattcgagaagttgtgcctaaacggggcggtcaagttttagtccatgggggggaaagggcactgcaagacccggttaaagcccaggaaattcgcaatttagtcctagccggttccaccattgccacggggcggggagtaggggttgtctatgccaccggagcggaaacggaatttggccatatggcccatctcaccaccaatgttaagcgggaacccagcaccctggaagtccaaattagccagattgtgcgggtaattaccctgattgccgttggcatgggagttttggtgtttgtgttggcgtccctggtgacccatctggaattaaaggaaagtttcatttttgccattggcattattgttgccctagtgccagaaggtttgttgcccacggtgactttatccctggccatgggggtacaacggatggccaaacgtaatgctttggtgcggcgattatcggcggtggaaaccctcagtgccactacagttatttgtacagataaaacgggaactttaactaaaaatgaaatgaccgttcgttctctttggattccggcaacgaaccatggccaaaccttaacggtgccaggggaaggctatgatcccagcacgggcaaaattacctttcccccaggtaaagatgaaaagcaacaggttaaattactgctcattggttccgctctttgttccaatgcccatttgattcatccttccggttccagccgttggcaagaaatgggagaccccacggaagcggcattattggtggccgctctgaaggcagattttgatttagaacaactccagcaagattatccccggcgcagggaagtgccctttgattcccgacgacggatgatgacggtggttttggattggcaaaaggctggggaaaatttgcctttccttacttccggcagaaatgatttgccatgggaaaatttggcttttaccaaaggtgctcccctggaggtgttgcgctgttgtcaatccattttaaaagccggacaggtgaccgaactaacctccggcgatcgccaaataattacggaggccaatgatcactacgccaaggaaggttttcgagtattgggcttggcggttcgggccgaccatgaaaatttactagaagcatcaccccaaaccctagagcaacaattaattttcgtgggtttagtggccatgtttgatcctcctcggccagaagtgcctgaggcgatcgcccgttgtcatggggccggtattgctatcaccatggtcactggggactatggcctcaccgcagaggcgatcgccagaagtattggtctagtcaaggaaaaagtacgggtagtgactggggatgggctaacccatttgtccgatgcccaactgcgacagattttaaaatatcgttctggtcttatctttgcccgcatggccccggaacaaaaactacgcttagtgcaagcttatcagggcttggggcagattgtggcggtaacgggggatggggtcaatgatgctccggcattgcgggcggccaacattggcattgccatgggcttaaacgggaccgatgtggccagggaagcggcggatattgtgcttaccgacgataattttgccaccattgtcagcgcagtggaagaaggccgcacagtttatcaaaacatccgcaagtttataacttacattttggcttccaatgtagcggagttagtaccatttttagcaatgattttcctcaacattccccccgcattactaattatgcaaattctagccattgacttaggaacggacatggttccggccttagccttgggtatagaaaaagctgaagtcggaacgatgaaattgcctccccgccaaaaaaatcaagccctattagatcgtgctttattgttaagagcttactgctttctaggcataattgaagcgggtttgggcatggccggatttttcttagtttggggaagttacggttacggattagctgagttacaagccgttacgacaagtattctccatcacacagcagatccaattttaatggctatctatgcccaggccaccaccatgaccctagcagtgattgtggcctgtcaagatggaaatgtttttgcttgccgctcagaacgcacttctgccttcaagttaggctggtttagtaatcccttaatttggattggcattgccacggaatggatgttaattttgtctttaatgtattttccttctctccaagctattttcactaccactccactgacaaattggcagtttgctctgcttctttcctgtcctcctttattgttaggagcggaggagttacggaaatttaaattcctatga

SEQ ID NO: 26350 - DNA, 1806 bp, Synechocystis sp.
atgaccccgtcccctgctgctcccccgtctgataatgattggcgcttgttattgcgtctgcttccttacgtcaagcgctatcccaaggaactggcggcggcgttagttttactgattcctgtggctttttctggagcagtgcaacccctaatcattgggcaagcagtttccctgttgcgggaggaaccagcctggggctttttggatgccatgccattggatagggccttacataccctagtgattatcttggcagtcaccattgtcattcggttgctatttttggggttacagggctttattgtgcaaaaaatggggcaggaaattaccgccgatgtgcgtcaggatttatttgaacatgtcacttctttgtcggtaaacttctttcaccgtacccctgtgggccgtttggtaacccgtatcaccagtgacgtggaggcattaggggaagtatttgccagtggggcgatcggtgtggtcagtgacattgtctccattctggctatcatcgtgactattttttgggtgcaatggcagttggccctgctactggtggggatgttggtgccggtgactgtgttgattatttatttccagcaacaatatcgcaaagctaactaccaagctcgggaagagttatcccgccttaattcccagcttcaggaaaatgtggccggtatcaatgtggtgcaattattccgtcgggaagagttaaacagtcgttcctttcgtcgcgtgaatgaaaaatatcgtcgggcagtggataaaactattttccatgactctgctgtgtcggccaccttggaatggatcagtttagtggcgatcgccggggtgctgggtttggggggctggctaattttgcgggataatctggaatttggggtgttggcggcgtttattctgtacggacaacggctatttaatcccctgcgacagtttgcggataaattcaccatgtttcaatcgggctttacggcgatcgagcgcattggggaattaatggaagaaccggtagaaatcaaagatcaagcggtgattacccccattgaaatcaatggtgctttgcggggtagccatggggaaatttgctttgaaaatgtttggtttggctataaaccagacgagtacgtgctgaaaaatttaaacttcaccatcaaacccggggaaaaagtcgccctagtggggccaacgggggcaggaaaaagttcgattattcgtctactgtgtcgcctgcacgatccctcccggggtcgcattttagtcgatggcattgatattcgagaactgtcccaacagcaactgcgccgttttattggcgtcattctccaagatagtttcctctttgccggggacgtgaaacggaacattaccctaggggaagaatacagcctggaagaagtgcaacgggcagcccaattaaccagcgtcgatcgcctgattgaagaattaccccagggttaccacacccaattacgggaacggggtagtaatttgtcagggggacaaaaacagttactagcctttgctcgggtggccattcgggaaccctatgtattggtgatggatgaagccactgctagcctagatgtccgcactgaagcggatattcaagcggctttgttacatttgctccaggatcgtacttccatcatcattgcccatcgcttatcgaccattcgcaatgtagaccgcattttcgtgctcaaacacggggaaattgtggaaactggcaaccatgaccaactattagacctcaaggggctttacgctagtttgtaccagttacaaatgctggggggctaa

SEQ ID NO: 26351 - DNA, 2013 bp, Synechocystis sp.
atggtcgttgctacccagtccttagacgaactttctattaatgccattcgctttttagccgttgacgccattgaaaaggccaaatctggccaccctggtttgcccatgggagccgctcctatggcctttaccctgtggaacaagttcatgaagttcaatcccaagaaccccaagtggttcaatcgggaccgctttgtgttgtccgccggccatggctccatgttgcagtatgccctgctctatctgctgggttatgacagtgtgaccatcgaagacattaaacagttccgtcaatgggaatcttctacccccggtcacccggagaattttctcactgctggagtagaagtcaccaccggccccttgggtcaaggcattgccaatggtgtgggtttagccctggcggaagcccatttggctgccacctacaacaagcctgatgccaccattgtggaccattacacctatgtgattctgggggatggttgcaatatggaaggtatttccggggaagccgcttccattgcagggcattggggtttgggtaaattaatcgccctctatgatgacaatcatatttccattgatggttccaccgatgtggccttcaccgaagatgtgagcaagcgttttgaagcctacggttggcacgtgctccatgtcgaagatggcaataccgatttggcggcgatcgccaaggctattgaggaagccaaggccgtaaccgataaaccttctatgatcaaagtcaccaccatcattggttacggtgcgcccaataaatccgataccgcgggcatccatggggctgctttgggcactgatgaagtggccgccacccgcaaaaacttgggttgggattatgctccctttgaagtgccccaggaggtgttggactacactcgcaaagccattgaacggggagccagctacgaagcggaatggaaccaagcctttgcccaatacaaaaccaaatatcccactgaagcggccgcctttgaacggcaactgagcggtgctttaccggaaggttgggacaaaaccctagctagctttacccccgatcaaaagggtttggccacccggaaatattccgaggaatgtctcaatgcgttggcccccgtattaccagagttaattggtggttcggcggatttaacccactccaacctaacggaacttcactgctctggggatttccaaaaaggagcttatcaaaaccgtaacgtccactttggggtacgggaacatgccatgggggctatctgtaacggtattgctctccacggttctgggttactacccttcggtgctaccttcctaattttcaccgattacatgcgggccgccattcgcctttcggccctttccgaggcaggggtaatttgggtcatgacccacgactccattggtcaaggggaagatggtcccacccaccaacccattgaagtgctggcttccctccgggctattcccaacttgactgtgattcgtcccgccgatggcaatgaaacctccggtgcctacaaagtggcgatcgccaaagcgaaggaaaatgcccccaccctgttatccttgacccggcaggcggtacccaatttgcctggaacttccattgatgccgtggccaaaggtgcctataccattgttgattctgaaggtgttcctgagttaatcttgataggtacgggttccgaagtacaactttgtgtggctgctgctgaaaagttagccgctcaaggcaagaaagtccgggtagtttccatgccttcctgggaactgtttgaaacccaggatgccgcctacaaagagtcagtgttgccaaaggctgtcaccaaacgcctttccgtagaagccgccaccaactttggttggcacaaatatgtgggcacggaaggagatacagttagtattgaaacatttggtgcctcggcgcccggcggggtttgcctcgagaaatttggtttcagcgttgataatgtgctggccaaagctaaaactctcctgagctag

SEQ ID NO: 26352 - DNA, 1251 bp, Synechocystis sp.
atggcaaatttggaaaagaaacgtgttgttgtaacgggattgggagccatcacccccatcggtaatactctccaagactattggcaaggcttaatggagggtcgtaacggcattggccccattacccgtttcgatgctagtgaccaagcctgccgttttggaggggaagtaaaggattttgatgctacccagtttcttgaccgcaaagaagctaaacggatggaccggttttgccattttgctgtttgtgccagtcaacaggcaattaacgatgctaagttggtgattaacgaactcaatgccgatgaaatcggggtattgattggcacgggcattggtggtttgaaagtactggaagatcaacaaaccattctgttggataagggtcctagccgttgcagtccttttatgatcccgatgatgatcgccaacatggcctctgggttaaccgccatcaacttaggggccaagggtcccaataactgtacggtgacggcctgtgcggcgggttccaatgccattggagatgcgtttcgtttggtgcaaaatggctatgctaaggcaatgatttgcggtggcacggaagcggccattaccccgctgagctatgcaggttttgcttcggcccgggctttatctttccgcaatgatgatcccctccatgccagtcgtcccttcgataaggaccgggatggttttgtgatgggggaaggatcgggcattttgatcctagaagaattggaatccgccttggcccggggagcaaaaatttatggggaaatggtgggctatgccatgacctgtgatgcctatcacattaccgccccagtgccggatggtcggggagccaccagggcgatcgcctgggccttaaaagacagcggattgaaaccggaaatggtcagttacatcaatgcccatggtaccagcacccctgctaacgatgtgacggaaacccgtgccattaaacaggcgttgggaaatcatgcctacaatattgcggttagttctactaagtctatgaccggtcacttgttgggcggctccggaggtatcgaagcggtggccaccgtaatggcgatcgccgaagataaggtaccccccaccattaatttggagaaccccgaccctgagtgtgatttggattatgtgccggggcagagtcgggctttaatagtggatgtagccctatccaactcctttggttttggtggccataacgtcaccttagctttcaaaaaatatcaatag

SEQ ID NO: 26353 - DNA, 234 bp, Synechocystis sp.
atgaatcaggaaatttttgaaaaagtaaaaaaaatcgtcgtggaacagttggaagtggatcctgacaaagtgacccccgatgccacctttgccgaagatttaggggctgattccctcgatacagtggaattggtcatggccctggaagaagagtttgatattgaaattcccgatgaagtggcggaaaccattgataccgtgggcaaagccgttgagcatatcgaaagtaaataa

SEQ ID NO: 26354 - DNA, 1248 bp, Synechocystis sp.
gtggtggtgcggccccaggggggagtaaacgcaggccacacaattgtggttaacgatcagacttttaagctccacctaattccttcgggtattctctatccagatacagaatgtatcatcggctcggggacagtcattgaccccaaagtcctattgcaggaatttgaccaattggaagcattagatgtttccctcgatcgcctgtatatttcccaaactgcccatgtgaccatgcccttccaccgtctcctagaccaggcgtcggaggagaaaaggggagagcataaaattggcaccactgggcgaggcattggtcccacctacgccgataaatcagagcgcatgggaattcgggtggtggatttaatgaaccccgaaattctccggaaaaaattgctttggaccgtcgaatataaaaatgtcgttttagataaactctacgacctgcctcccctagacccagaaacggtgatcgccgaatataccacctatgccgatcgcctgcggcctcatgtagtggatagttccctaaaaatttacgacgccatacatcaacgaaaaaatatcctctttgaaggggcccagggcactctactagatttagaccatggcacctacccctacgtcacctcctccaaccctattgcggggggagcttgtgtgggtgctggcattggccccaccatgattgaccgagttatcggcgtggctaaggcctataccacccgagtgggagaaggaccctttcccacagagctagatggagaattaaatcaacatctctgtgaccgtggagcagagtttggcaccacgaccggtcggcgtcggcgctgtggctggtttgatggggtcattggccgctacgctgtgcgtattaatgggctggactgtttggccatcaccaaattagacgtgctggaccaactagcggaaatcaaagtttgcgtcgcctatgaactagacggcaaaacctgtgaccatttccccggtaatgcggcggaatttgctcggtgtcagcccatctataaaacccttcccggttggcaatgttccacggaagaatgccgcaccctggaggatttacctccccaggccctggactacttgaagttcctggcagaattaatggaggtgccgatcgcgattgtttccctaggggccagtcgggatcagacaattattgtcgaagaccccatccatgggccaaagcgagctttactttatgccaacggcgatccgctagcttga

SEQ ID NO: 26355 - DNA, 831 bp, Synechocystis sp.
atgggtattcgtaattatcggccaatgaccccaggaactcggcaggcaagtgtctccgatttcactgaaattaccaagagtaagccggagaagtcattaaccactaaccgccatgaccaaaaaggtcgcaacaaccgtggggtgatcaccagtcgtcaccgggggggcggccataaaaagctctaccggattatcgacttcaaacgtaacaagcaaaatattccggcccgggtagcggcgatcgaatacgatcccaaccgcaatgcccgcattgccctgctgttctacaccgacggggaaaagcgttatattcttgctcccgctggattacaggtaggcatgaccgttattgctggggaagaagccccctttgaaattggcaacaccttacccctgagccgcattccccttggtagtgaaatacacaacgtggaattggtagcagggcggggcggccaaatggtgcgttctgctggagcttttgcccaggtggtggctaaggaaggagattacgtgaccatcaaactgccgtccaaggaagtgcgtatggttcgtaaagagtgtgtggctaccctgggtcgagttagtaatgccgaattccgtaaccttaagctaggaaaagccggtcgtaagcgtcacttaggtcgtcgtccccatgtccggggtagtgtgatgaacccctgtgatcacccccatggtggtggtgaaggccgggcccccatcggtcgttccgggcctgtgtctccctggggtaaaccagctttgggtgccaagacccgcaacaagaagaaacgcagtagcgctctgattgtccgccgtcgcaccaaataa

SEQ ID NO: 26356 - DNA, 894 bp, Synechocystis sp.
atgagcagtacccaagattatatcggcgaggaagccgccaccagagtcaaaatcctcagtgaagctttgccctacatccaacactttgctggccgcaccgtggtggtcaaatatggaggggctgccatgaaagacagcaacctcaaagacaaggtaatccgggacattgtctttatggcctccgttggcattcgcccggtggtagtccatggcggagggccagaaattaacacctggctagataaggtgggcatcgaaccccaatttaaagatgggttacgggtcaccgatgcggccaccatggatattgtggaaatggtactggtgggtagagtcaacaaagaattggtcaatttaattaaccaagccggaggaaaagccgtgggactttgtggcaaagacggccaactgatgaccgcccgcaccatgactaataaagatgttggttttgtgggggaggtgagctccgttgatgcccgggtggtggaaaccttggtgaaaagcggttatattcccgtcatttccagtgtggcggcggatgaatttggccaagctcacaatatcaatgccgacacctgtgctggggagttggccgcagccctaggggcagaaaaactaattctcctcactgacaccaggggcattttgcgggattataaagacccctccaccctaattcacaagttagatattcaacaggcgcgggaattgattggctccggcatagtggcggggggcatgattcccaaggttacctgttgtgtgcgttccctagcccagggagtaagggcggcccatattctggatggccgtttgccccatgctctgttgttggaggtattcaccgatctgggcattggttcgatgattgtggcttcgggctatgatctctga

SEQ ID NO: 26357 - DNA, 981 bp, Synechocystis sp.
gtggtggaaaatttgagcaaggtttatcccattgccctcaaatcccctggtctgaagggaacattgcaacatttttggcagagacgttaccgccaaattttggcagtgcaagatatctcctttaccattccccctggggcgatggtgggcttcctcggtgccaatggagccggcaaaaccaccacattgaagatgctcacggggctaattaaaccctcggggggaaaagtgcgggtggcgggctttgatcccttccgtcggcagacagcttttttaaggcgcactagtttagtaatggggcaaaaacaacagttaatctgggatttgcccaccctggattccctgcgcatcaatggggcgatttacgaaattcccgaccaagtctttgaacaacggctgggagaattgagcgaaatgctcgatttaaccacagaattaaaacaaccggtgcgtaaactttccctggggcaaaggatgaaggcggaattgttagccgctctgctccaccaccccaccgttttatttttggatgaacccaccttgggactggatgttaatgcccaagtggcggtgcggcggtttttgcaggagtacaatcggcgttaccaagccacagtgttattgactagtcattacatggcagatatcaccaccctttgtgagcgagtgctattgattcaccaaggacagttgatgtatgacggtgatctggaagctctggtggaacgattttccccttaccgacaagtggcggtggaattatctgcccccatacctttggaaaaattacagctctatggcgaagtggagagtgtggagggtctactggtgcgctttttgctaaaacgggaaagcctcaccacggcgatcgccaaactgttagcggagttgccagtatcggatttaagcgtatctgacccccccattgaagaaatcattggccgtctattttcccagggcaatttggataataaactttga

SEQ ID NO: 26358 - DNA, 3603 bp, Synechocystis sp.
atggtttatgtcaagcgcatcgaactatcccatttcaaatcctttgggggaaccaccgccattccttttttgccggggtttacggtggtgtctgggcccaatggttcgggcaagtcaaatatcctcgatgcattgctattttgtttggggttagccacttccaagggcatgcgggctgaacgactaccggatttggtcaataacactttcaaggggaaccggggcagttccgaagctagtgtgtcagtcacctttgaattgcatgatggggaaaacctatccgagccaggggctaaccataatggcaacggcaacggagcaaaaatttctaaggaatggactgttacccgtcgcctgaaggtgaccaaagggggcaattattcctccaactattacatcaatggggagacagccaccgtcacggaactccatgaacaattaaatgaactgcgcatttacccagagggctacaacattgtgctccagggggatgtgacccgcattatcaccatgaactccaaggagcgccgggaaatcatcgatgagttggcgggggtagcggaatttgaccgcaaaattgttaaaaccaaggagactttgacggaggtgcaagaccgggaagaacgctgtcaaattattgcgacggagttggagcgcactttggaacggttggcggccgatcgccagaaggcagaaaaataccaggccctgcggcaacaggtacaggaaaagcaagggtgggccaaggttattcagtacaaagcagtggagcaacaacggcaaaagctatggggacaattggagcgggatcgagaacaatcccagcaaattcagcaagccctagaccaacgcagtcaagccattcaaactcagcaaacagagttggaaaagctcaatgcccaggtcaaggccctgggggaagaggaacaattggccgtggcggcccagttggccacccaaaaagcccaacgggaccaactccagcaacgttataacgacggcgatcgccaaattaccaatcaccaacaacaggtggggcaaatccaggcggaaattagccagagtcaacagcagtttttgcacattcaacaggaaaaatccttccataacacccaaaccctgccccagctagaagccgcagtgcagaccagtcagcaacagttggagcaactccggcaccaggcccaggcgatcgcctccgcttccgaagcatgggtacaggaacaaacccaactcagccgcactgtcaaccaattacaagacgagttaatcccccaacgcagtcagttggcccagctagaggaacgccaacaacaattgctaaccaatttggctgaattaacccctctgctcacaaaggtttctgttgagttggaagaaaaacagtttgcccaagggcagttcaacttccagggagaagcactaaccagtcagattcaaactctggccagcgatttggcccaactggaacaggaacggagtttgctacaggaaacccaaacccgcctgctcaaagaacaacaggaaaaacaacggcaattggacaaattagaagcggctagtcaagctcagcaggaagtgcagggcacctacgccaccaaagtgattttgcagtcggatttacccggggtctgcggtttagtggcccaattgggtcaggtggagccccaatatcaactggctctggaaattgcggccgggggccgtttgggttttcttgttgtggaagatgatggtgtggcggcggcgggcattgaaatcctcaaacaggccaaagcaggacgggccacttttttacccctgaataaaattcgtcctcccaagggtcaaaatcccaaccttagttatgcccatggttacattgacctggcagtgaatttaatcgacggcgatcgccgttacgccgacatttttgcttttatctttggcaataccatcgtttttgacaccttagttaacgcccgcaaccacctgggcaagcatcgcattgtcaccctagagggagatttactagaagccagtggagccatgagtggcggcagtcgcaaccaacgctcaggactacggttcggcaccatggtcagtgaagatacggcagaagtgaaacagttgcgtcaacggttacaggacattcagcaagtccaaggccgtaacgaagagttattgctagaaagaacagttcgtagtaggcagttaactcaacagttgatggaaatgcggcaacaacaacgggaagcacaacttcacggagaacaaacggaacgagacatagcacgcctcagtcaacagcaaacacaaattaatcaacaacaaattaatcaacagcaaaaactagcagagttacaacaaaatttagctttgttgcagcaatctttgccgcccttggaacaacagttagcctccgctcagcaacaattaactgccttggaaacttcccaaacccatcaacaatggcaaactatccagatccaaattcgtaccgtggaagcggagtaccaacgccaattgcaagccctacgccagggggaggatcacctcaaggatttgcagaatagtagccaacgcctagaggaaaaaattgcccaagcccaggaaaaaattgcccaacatcaagctcaggatctcaccctagcccaggaacaggagcagttaaaaatagctttggcggaaatgaatggggctatccaaaccacggaagctcagttggcgaaactgtcggaaaaattgggtagtactaagcaagaaagggatcgtctagaaactcagcttaaccagctccgtagtcaacaacaggaacagcaatggcaatgggaaaagttacaaactaatcaacaggaataccaggaaaatttaactcaactgcaaactcaattggaagcattagaacaggatttgcccgatccctggccggaaattcccctgctccaagaccgggacgaagcaaacttggattttgccaatattttggaggaattagagcgatccattcgcaatggtcaaaaacgtttggaagccatggaaccggtgaatatgctggcgttacaagaatatgaaaaaactgaagctcgcctaggggaattgtcagaaaagttgcaaaccattgccggggaacggaccgagttactcctcaggattgaaaattttactaccctgcgtcgtcgttctttccaagatgcttttgatgcagtcaataaaaactttcagattatttttgcagaactttctgatggggacggctacttacaattagacgatgcggaagatccttttaatgggggtttaaacctagtggcccaccccaaaggtaaaccggtgcgtcgcctcagttccatgtccggtggagagaaatccttaactgcgctaagcttcatttttgccctccaacgctaccgcccctcccctttttatggctttgatgaagtggatatgtttttggacggtgccaatgtggaaaaactgtccaaaatggtccgcaaacaggcccaacaagcccaatttattgtggtgagcctccgtcgtcccatgattgaagcggcggaacgcaccattggagtaacccaagcccggggagcccatacccaggttttgggcattaagttgtag

SEQ ID NO: 26359 - DNA, 636 bp, Synechocystis sp.
atggccttacaactcggtgatgttgtccccgactttacccaagaatccagccaaggccccatttctttccatgagtgggccggcgatagctgggttgttttattctctcaccctgcggattacactccggtttgtaccaccgaattgggcactgtagccaaacttaagccggaatttgataagcgcaacgttaaggtgattgccctcagtgtggatgatgtggaatcccacaaaggctggatttgtgatattgacgaaacccaaaacactaccgttaactacccaatcttggccgacggcgacaaaaaggtgtccgatctgtacggcatgatccaccccaatgccctcaataatttgacggtgcgttctgtcttcatcatcgatcctgccaaaaaattacgcttaactttcacctatcccgccagcactggccggaactttgacgaaattttgcgggtaattgactccctccagttgaccgattatcaccaagtagctacccccgctaactggcaagatggggacaagtgtgtggtggtgccctccatttccaccgaggatgctaaggtcaaattccccaaaggggtggaagaaatcaagccttatttgcgtttgaccccccaacccaataagtaa

SEQ ID NO: 26360 - DNA, 1692 bp, Synechocystis sp.
atgggcatagcagaaaagtcgatgatccaagttctcgatcgccagttggtggatttaattgcggcgggggaagtgattgattctcctttggcagtggtgcgggaattggtggaaaatgccttggatgccggtgctgatcggattttggttcgtgtttggtgggatcagtggcgtttggaagtgttggacaacggccaggggatggatgtaacagagttaaaaaccagcgtattgccccatgccaccagcaaaattagtacccaagcagatttacaacggattaaaactttaggttttcggggggaagccctccatagtttggcccaggtggcccggttgaccattagcagtcgcagtgtggccagtccgggttgtggttggcgcattacctacagcccccagggttcaccagaacagattgagccagtggcgatcgccatgggaacgagggtggaagtgcggcaactgtttgctaattttccccaacgtcggcaggcctttgctaaaagtcagcagttttggcggcccatggtcacctatctgcaacaattagccctctgccatccccaagtaacgtggcaactgtggcaggacgaacggttacggttgagccttagccccggtcctaacccagaagctatcttgttgcaatgccttaaatccctccaggcgggccagcttggttacactcaacaatccctgtccctccccgttgatctagaaaatcaggcaacatcggcccagctaagcttgacctttggttaccctgaccgctgccatcgtccccgtcccgattggttaatcattgccattaatggtcgtcctgtgaatgtgccggaattaacccagacaattttggcggtttttcaccgtaccctgccccggcaacggtatcccctgtgttttgcccattggcaattgccgccccagtgcatcgattggcatcgtcaccccgcaaaaacagaaatttatttgcaagatttaccccattggcaagggcaactaaaaaccttattgcaccagagcctagcaattttgggcaatgacgctccccctcgcctgaatcaattgctcaaggccgctgaacccaagggagtgtatcaactacaaggtgccagttctctcacggaaacggtgctgggctatcccaaggcttttaaggccatcgcccaggtttgccagacctatgtggtggtggaacatgaccagggcatttggttagtggagcaacacgtggcccatgaacgggttttgtttgagcagttacaacggcattggcaatgtttacccctggagcaacctctggtcttgcaaggatttaacccagaacaggtggaacgtctgcaaaatttaggcttggaaatagacccctttggggaagatatttgggctgtgcggagtttaccggcccttcttcaaggacaggaggaaatcattgctattttgcgggaattgagtcaggtattttccctctccaccgcccaagcggcgatcgcctgtcggagtgccattaaaaacggtatggaattggatcgcattgccattaataaactcattgagcaatggcaacaatgtgataatccccacacctgcccccacggtcggcccatctacttagctttagatgaatcttccttggctcgttttttccgtagaaattggctggttaaccccaaaacttctggttcttga

SEQ ID NO: 26361 - DNA, 3279 bp, Synechocystis sp.
atgcctcaatttaaagctattacgactattgcaattattttttatcgttcccattatttgtctggcaatacaactcccattgatgctctttgtcaagctttagaaaaacataatttaaatccccttgctatctatgtgtcttccctgcgggagcctgacgtacaagcagaaattttagctattctagaaaatttggaccagcccttgggagctattttaaacaccactagtttttccctcgccaagttacaaagacagatcggcaatctggaaatgattcccctctggcaaaaactaaatgtcccggtgctccaggtaattcttagtggtggcgatcgccaacaatggcaggaagggttgcggggactgaacccacgggacttagccatgaatgtggctttgccggaagtggacggcagaattatcaccagggcaatttctttcaaagcgatggcagcccgtcatccccaactggaaacggaggtggcaatttatgagcctgtgctggatcgagttgagtggatagcagaactaactaaaaatatcattaattgcgctcaaactgaaattttccaacggaaaattgctctaattttagccaattaccctaacaaagatggtcgtttggctaatggggtggggttggataccccagctagttgtctacaaattttagaagctttaaaaattgctggttatcatctttccgccattcctaaagacactgaaactttaattaaacaattaacccaaggggtaaccaatgaccaggaattagcccaatatcgaaccgttaatcaaaccattgtcacagagaaagtatggcaatttttttacagtttgccccagtctgtacaacaggcaatgacagagcggtggcaagttagggagaattgggataatttaccggatcaatttgccattagcggcatccaatttggcaatattttcgttggtattcaaccggctaggggctatgattttgatcctagtttgaattaccatgcgccggatttagaacccacccttcattaccttgctttttatctttggttacgccaggaattttctgcccaggcaataattcatctaggtaaacatggcaatttggaatggttaccgggcaaaagtgttgttttatctgaccattgccatccagagattgccctaggcccattacctaatttttatccctttattgtcaatgatccaggggaaggaacccaagctaaacgccgtagtcaggcttgtattattgatcatttaacccctcctttaaccagggcagaattgtatggcgacttggaaaaattagaggctttaattgatgaatattatgaagcccaagccttggatccaactcgtgttaaaaccattggcgatcgcctccgtaaattattggcaaccagcaatttacaaactgatttaggtttaacccctccggccctgaaggatttacaacccttgttaacttcggcggatagttatctgtgtgaactaaaggaggcccaaattcgggacggcctacatattttaggtcaaactcccacaggagagcagttgcgggatttggcgattagtattgcccgatcgccatcctatcaaagacttggtttaacccaggcgatcgcctttgatttagaactagaatttgatccggttttggacgatcctaatgaaccatggcaattgtcgtcaaccatgcagatgaagttgcaacaatgggaattaacccaatttattgaattatttaattcctgtcggatagggggacaggttattgaaattttagaagaaattgccaagcagttagtgggaagtctacttgaaatagtaattgtcgatcaaaaagtcaatttattctttcaaaagcccgacagtaaaactaaatctaatcttgattatatcgagcaaactcttttaccaatgctacaacaaactccccaggaaatcactaatttactccggggtttaaatggggaatatattgccagtgggccggcgggggcacctagtcgtggtcgccctgatgtactgccaacgggacggaatttctatgcggtggatatccgggccattcccacagaaacggcttgggacattggccgtcgagccgctgaaaccctgattgaaaggtacacccaagaccacggagaatatccccaaactttagctatttctatttggggcacttccaccatgcgtactggcggggatgacattgcccaggttctggccctattgggagtacaaccagtgtgggatagcccttcccgtcgcattgttgattttgaaattttgcccaccactgtactaaaacgtccccgggtggatgtgaccatcagaatttctggattttttcgggatagtttccccaacttggtggaatttctccaccaggcgatcgccgctgttagtcaattggatgaaccggcaaatttgaatcctttagcagaaaaagttaagcaagaaaccgagcaatggcaacaattaggtttagcaacggaagaagctgtaactaaagcaacctatcgtatttttggctctaaaccaggggcctatggtgctggcttacaaggattaattgaagcgcaaaattggcaagatgatagtgacttagcccgagcctatcttaattggagttgctatgcctacgatcgccagggcgttggccacaatcaaccggaagtatttgcccagcgcctgcaaaatttacaaattgttttacataaccaagacaatcgagaacatgacttgctcgactccgatgattattatcagtttcaggggggattaacagcggcggtgcggtcattaactgggaaaaatcccaccgtttattttggtgataattctaatcctgcccaaccaaaagtgaagttattgacccaagaaattgccaaggtttatcgttctcgggtggtaaatcctaaatggatcgctggggtaatgcgccatggctataagggggcgtttgaaatggccgccacgttagattatctctttgcctacgatgccactgcccattgtgtggaggattttatgtatacgggaatagctcaggcatacctactggatgaagaagtgcagaaatttgtgcaacagcacaatccttgggcgttaagggacatggcggaaagattattggaagcagagcaaagacaactctggagcaatgttgacccccaactactagatcaactgcgggcgatcgcccatggtgcggaagaaattttggaaaatagtcaaatttaccctagacaagaaaagctgaaataa

SEQ ID NO: 26362 - DNA, 459 bp, Synechocystis sp.
atgacaacggtgtggaaagtattggtgctccacggtcccaatttgaatttgctgggccagcgggaaccgggtatttatggatccctaaccctaggggaaattgacgcctgcctgcgggaagatggcgtcgatttagaggcagaggtgagtactttccaatccaatagtgaagggcaattggtcaccgccatccatggagccctaggaaattaccacggcattgtttttaatgcggcggcctatactcacactagtattgccctgcgagatgctttagcagctgtgcaactaccctgtgtggaagtgcatttaagtaatatccataagcgggaatcatttcggcatatttcccacattgccccagtggcgatcggacaaatttgtggctttgggttgaatagttatcgtttgggattgagggctttggtggattatctcaacggtcaggctgatagttaa

SEQ ID NO: 26363 - DNA, 1215 bp, Synechocystis sp.
atgcactcacaaaaattggtcacagccatgaaaatcttggtgctagcttgggaatttcccccccgcattgtcggcggcattgctcgccatgtggcagaactctacccagaattagttcaacagggctatgagatccatttaattaccgtggccacagaggaaagtccgtcccaggaaatggtcgatggcatccacatttaccgagtgccagtgccccccagcaatgactttttccaatgggtagataacatgaaccgtgccatggaacagagagggcaagccctattccaggaacagaaaaaatttgatgttatccacgcccacgattggctggtgggagatgtggccattaaccttaagcaccacggtaaaattcccctggtggtgactatccacgccacggaatacggccgctataacggtctttacaacgatactcaacgctacattgccggcaaagaaggaattttaatctacaacggttggcgggtaattgtttgcagcaactacatgcgccatgaactggaaagagcctttggcaccccctgggacaaaattgacgttatctataacggcattcgtccggaaaaaaagcaccgtcgtccagactttgattaccgtaattttcgccgcaaatttgccgaagatggagaaaaaatcgtttactacgttggtcgcatgacctatgaaaaaggaatttccgttctgttaaccgctgccccccaggtactggaagccctcaatgatcaagtgaaatttgtcattattggcggaggcaacactgatcgcctgaagcaattagcatggaacctgggaatttgggaacactgttttttcaccggcttcatgtccgacgaagatttagacaaattccaaaccattgccgactgtgccgtttttcccagtttgtacgaaccctttggcattgtcgccctggaaagttttgctgcccgggtacccgtagtagtatctaatactggtggactagcggaggtggtacgtcaccatagcacaggcattgtcacccaaaccaataatcccgattccctagcccacggcattttggaaattctttctaatccatccctggccaaacagctggtggaagcagcctacaaagatttgggcatccgctttaattggtctaagttggcaaaagaaaccgccgctatttacgaaagggtggtggaggaaagacaaacggtggagtggtag

SEQ ID NO: 26364 - DNA, 1089 bp, Synechocystis sp.
atgggaaacacgtttggcagtttatttcgcattaccaccttcggtgagtcccatgggggcggcgtgggggtaattattgatggttgccctccccgattggaaatttccccagaggaaatccaagtagacctagaccggcggcggccaggacagagcaaaattaccacccctcgtaaggaagcagatcaatgcgaaattctctctggcgtgttcgagggtaaaactctgggtacaccgatcgccattttggtgcgaaataaggatgcccgttcccaggattacaatgagatggcggtgaaatatcgtccttcccacgccgatgccacctatgaagcgaaatatggcattcgcaattggcaaggaggaggtcgctcttctgctagggaaaccattggccgggtggccgcaggggcgatcgccaaaaagattctggcccagtttaacggggtggaaattgtggcctatgtgaaaagtatccaagacattgaggcgacggtggacagcaatacggtgaccttggagcaagtggaaagcaatattgttcgttgtcccgatgaagaatgtgccgaaaaaatgattgaacgcattgaccaggtgctacgacaaaaagactccattggcggggtggtggaatgtgcgatccgtaacgctcccaaggggttgggggaaccagtgtttgataagttggaagcggatttggccaaggcaatgatgtccctccccgctaccaaggggtttgagtttggctctggttttgccggtactttactgactggtagtcaacataatgatgagtactacctggatgaagcgggggaatggcgtactcgcaccaaccgttctgggggggttcagggaggcatcagcaacggcgaacccattattatgcgcatagcatttaaacctactgccaccattggtcaagagcaaaaaaccgttagtaacattggggaggaaaccaccttagccgctaaaggtcgccatgatccctgcgttttgccccgggctgtgcccatggtggaagcgatggctgcattagtactttgtgaccatttgttgcgattccaagcccagtgtaaaactttataa

SEQ ID NO: 26365 - DNA, 1833 bp, Synechocystis sp.
atgaaccgtgcctcccccatgacccaagctgtgccaggcctctgggcagtgatcaccaccttttggccccaaattcgtgcccagtggcgactcttgctggtagcgatggtgactttgctggcggatgtggggttgcgactgttggaaccctggcccctcaagctgctcattgacggggtactgattcccactcaaacccagccgagtctttctctctggggctttactaacctcaatgccgcttggctgttgatgttaatcgccgttggggtgattatcattgccgtcagtcgggcgatcgctacctattggaataccgtcagtttggcgatcgttggtagtcgcgtcatggcccaggtgcgggatcaactctatgggcatttgcaaaggctttccctgcgttaccattaccaagcccgcagtggcgatctgattatccgagtcagtagcgatgccaaccgtctccaggaaattttgctcacagcagctttgcccctggtggtcagccttttaactttgggcggcatggtgggggtgatggcctggctagacctaaaattaacccttttgtccttggcaacttttcccctgttttggttggccgccaatcgtttaagtgccaaaattcgccatgcttccctcacccaacgtcaccaggaaggggccgttgcctccaccgccgctgaatccctctccgccattaaacttgtccaagctctctccctggaacaagcctttgccgatttgtttagccgccaaaatcaacggagcctccaagaaaacattgaaactaagcgtttagccgccaacctggagcgattggtggacgtgttgattgccttcggtacagctttggtgatgggttacggaggccatctggtcattgaagatgctctgacagcgggaacggttttggtgtttttaacctatctacgcaatgcctacaaaccggtgcagaattttgctaaatacacaggtcgtctggctaaagcggcggcatcgggggagcgaattttgaatattttggcggaaacccccgatattcaggacaaaccaggggctattcctgccccatttttccaggggcgcattgaatttaaatatgtttcctttggctatcatccagatcaagccattcttgacgggttgaatttaacagtgcgaccaggggagaaaattgcccttgttggtgcttctggcagtggtaaatctactcttttaagtcttttactgcgcctgtatgacccaacagcagggaaaattttcattgatggccatgatctgcgggattatcaactgacgagcctacggaaccaaatggcagtggtattacaggagagtttattatttgcggccacgatccgggaaaatatcgcctacggcatcgagggggcgacaatggcagagattgaagcggcggcccgtttagccaatgcccataaatttattctggaactgccccagggttacgacacagtagtgggagaaaggggcactactctctctggtggccagcgacaacggttggcgatcgccagggccgccatgcgacaaacccccattctgatcctggatgaacccaccagcggcttggataaagttaatgaacagttggtttttgaagccctagaacggttagcggaaaatcgcaccacttttttggtaacccataatctgcagttggcgatcgccgctgaccaaattctttacctctaccaggggcaaatcagggaacagggtacccacgccgaattactggctcgtcagggggtctatgctgatctctttcaacggcaaaccctcgcaaccgtcaccaaatccctggggcgttaa

SEQ ID NO: 26366 - DNA, 975 bp, Synechocystis sp.
atggctgagaccctactgtttgccgccctacgccaagcccttgacgaagaaatgggacgggatgtcaacgtccttgtgctgggagaagatgtgggactctatggcggttcctataaggtaaccaaggatttgtacgagaagtatggcgaaatgcgggtgctggatacgcccatcgccgaaaacagttttaccggcatggcggtgggggcggccatgacaggattgcgcccagtcattgaaggcatgaatatgggttttcttctgctggcgtttaaccaaattgccaataatgcggggatgttgcgctatacctccggcggcaattaccaaattcccatggttatccgtggtcctgggggcgtaggtcggcaattaggggcagaacattcccaacggttggaggcctatttccatgcggtgccggggttaaaaattgtggcttgctccaccccctataacgccaagggattgctcaaagcagccattcgggataataacccagtgttattttttgagcacgtacttttgtacaacttgaaagaaaacttacccgactacgaatatattgtgcctctggataaagccgaagtggtgcgccccggtaaggatgtcactattttgacctattcccgcatgcgtcaccattgtttacaggcactaaaaactttggaaaaagaaggctacgacccggaaattattgatttgatttccctcaagccttttgacatggaaaccatcagcgcttcggtgaagaaaacccatcgggtcattattgtcgaagaatgtatgaaaaccggaggcatcggcgctgagctcattgccctaatcaatgatcatctctttgatgagttagatgggccggtggtgcgcctttcttcccaagatattcccactccctacaacggtatgttggaacgactgaccattgtgcaaccgccccaaattgtggacgcagttaaggcgatcatcggctaa

SEQ ID NO: 26367 - DNA, 1530 bp, Synechocystis sp.
atggtaacgctactcgaaaatcccttccgcactggactccgtcaagaacgcactccagaacccctcattttgaccatttttggtgcatccggggaccttacccaacggaaattggtgccagccatctaccaaatgaaacgagagcgccgcttgcctccagagttaacggtggtcggttttgcgagaagggactggagccacgaccattttcgtgagcagatgcgtaagggcatcgaagaattttccaccggcattggcagtgaagacctgtggaatgagtttgcccagggtttattctactgctctggcaatatggatgacccagaaagctatctcaaattgaaaaacttcctgggggaattggatgaaaaacgtaacaccagaggcaatcgagtcttttatttagctgtttcccccaacttctttcccccgggtattaaacaattgggggcagcgggtatgctgagtgacccggttaaaagtcgcattgtgatcgaaaagccctttggtcgggatttgagttcagcccaaagcttgaaccgggtagtgcagagtgtctgcaaagaaaatcaggtgtatcgcatcgatcattacctgggcaaagaaacggtgcaaaatctgatggtgttccgctttgccaacgctatttttgagccactgtggaaccgtcagtttgttgatcatgtgcaaattaccgtagcagaaacggtaggggtagaagaacgagccggttattacgaatccgccggggctttacgagatatggtgcagaatcacctcatgcaactgttttgtctcaccgccatggacccccccaatgccattgacgcggacagcattcgcaacgaaaaggttaaagtgttgcaggctacccgtttagcggatattaataatttggaaaatgccggtatccggggccaatataaagctggttggatgggaggcaaaccagtgccgggttatcgagaagaaccgggggtagatccaagttccaccactcctacctttgcggccctcaaactgatggtggataactggcgttggcagggggtgcccttctatctacgcacgggtaagcgcatgcctaaaaaagtgagtgaaatcgcaattcaattccggcaagtacctctgttaatttttcaatcggtggcccaccaagctaatcccaatgtgttgagtctaagaattcagcccaacgaaggcatttccctgcgttttgaggcaaaaatgcccggttcagaactgcgtacccgcactgtagatatggattttagttatggttcatcctttggagtggccgcagcggatgcctatcaccgccttttattagattgtatgttgggagaccaaaccctgttcacaagagccgacgaggtagaagaagcttggcgagtagtaactccggtgttgtcggcttgggatgcccccagtgatcctctttccatgcccttgtacgaagctggaacctgggaaccagcggaggcagaatggttaattaataaagatggccgtcgctggcgccgactttag

SEQ ID NO: 26368 - DNA, 1059 bp, Synechocystis sp.
atggcaggctgtccagctttttctttactagatttttccgccagtattaatcctttgggcccccccgcctctgtcctggccgccattgagtcagctttgccggccctgcgccactatcccgacccccaatatattcatcttcgtcaggcgatcgccgatcatcatcagttgtcgatggattgggtgttgccgggcaacggttccgcggaattgttaaccctagcggggcgcacttttgctagtttggattgtacctatgtggtgggcccggcctttggggactatggccgcagttggcggggagccggagccgagcttaaaactattccctggcaggttgatcaaccatggccttggcgaaaattgcgatcgccatcggaaattgccaatacttcagccgtccagtcctcacaccacggtttaattctcaataatccccataatccctccggcactctactagctcgggaggaaattcttgccctcctgccccactatcaatgggtgttgttggacgaagcttttatggattttctgcccccgggagaagagcaaagtctggtgggggatttggagaaacatcccaatttaattattctccgctctctgaccaagttttatcgtttgcccggattacgcttaggttatgccctagcccacccagatcttttagctcaatggcaagcttggcgggacccctggcctgtgaatgtgttggccgaagcggcggcgatcgccagtttggaagccgaggaatttcgtcaactggtttggcaatggttaccccctgcccgtagcgcattgcagcaagatttagcgagtttaccagggctatttcccttgccgagtcagaccaattttttgctcgtaaaaacgaccatacctgctccagaacttcaagaagaactattaactaaatgccaaattttgatccgagattgtcttagttttcccgaattaggtgaggattttttccgagtggcagtgcggacaatggcagataaccaaaaattaacccaggccctagctactattatggccacggccgcccctagctag

SEQ ID NO: 26369 - DNA, 1437 bp, Synechocystis sp.
atggctgatcgccaatcgttggaagaagctctccgccgaatttggggctatgaccactttcgctatccccagggagaagtaattgattgcctattggccaggcgggattgtctggtggtactacccactggaggagggaaatctatttgctttcaattgccggcattattgggggagggattaaccctggtggtttcaccgttggtggccctcatggaagaccaggtacaaagtttacgtaggcaaaatctgcccgccgcctgtctccatagccaattgagtcgccccgaaagaaaacaggtgttgtaccaattggggcaacagcaactaaagctcctttacctttcgccggaaaccctgctgagtgagccagtctggaatttgctccggcaaccccaggtcaaattgcaaggaatcatgctcgatgaagcccattgtttggtgcagtggggagatagttttcgtcctgcctaccgccgtttgggagccctgcgtcggggattaggcagagacaagggccagattcccctggccgccttcaccgccacagccgatcgccagcaacagaatttgatcgtagaaggattgaatttgcgatcgccggagtgttttcaggtcagcccccatcgcccccaactacatctgaaagtcaaaatggtgctgagtgaatattgccgccggcaacaattacggcgttttttgctcaagcatctccaggaaagcggtttgatttacgtccgtacccgcaccatggccatcaacttagcccaatggttgcaggaacggggctttgacagcgaagcttaccatggcggtttgggcccccaccaacgacgacagttggaacaaaaatggttaacggggcaaatttcttcggtggtttgcaccaatgcctttggcctgggcatagacaagcccgatacccgttgggtgttacattaccaagcccccctgatgttgatggattatctccaggaagtgggacgggccggacgagatttgcaaccggcagaatgtctcaccttagttagtgaacccaccggttggttggactctggcgatcgccaattgcgtcagtattttttgagtcaagccagcaaatatctacaacgagccgaggtcttgagtcaacaaattccatcccagggcaacctagggcaactaaaagcccattttcccgatttggaaatggctctggcgtggctccaccgtcggggtaatttagagtggttagatccatttaactaccgcattaaccccggccattaccaggccaatcccctggaggaattgaaaagccagtatcgcctgatgacccaatacctgaccacttcccgttgtcgttggcaaacgattttggttgcctttggtgacaattctccggcggcgaggcgaccctgtggcacctgtgataattgtttagttggacgctgctaa

SEQ ID NO: 26370 - DNA, 1887 bp, Synechocystis sp.
atggccatcaaaccccaaccccaatggcaacgtcgccttgctagcgtcctgctgtggggctccaccatttatctgttagtgaacttgcttgccccggcattatttcgctcccaaccgccccaggtgccctacagtcttttcattgaccaggtggaaggggacaaggtagccagcgtttacgtaggacaaaacgagattcgctatcaactcaaaccggaagcagaggatgaggggaaagaaaaagccgccgaggggcaaattttaagaactactcccatttttgatctggagttacccaagcgcttggaggccaagggcattgagtttgcggccgctcccccagcgaaaaattcttggtttggcacccttttgagttgggttatccctccgctgatttttgttggtatttggtcatttttcttgaaccgcaataataacggtgctcccggtggggctttggccttcactaaaagtaaagcgaaagtttatgtggaaggggactccactaaagtcacctttgacgacgtggccggggtggaagaagccaaaacggaattgagcgaagtggtggattttctcaaatttccccaacgttacaccgccctgggagcaaaaattcctaaaggcgtattgctagtcgggcctcccggcacaggcaaaaccctactggctaaagcggcggcgggggaagcaggggtgccatttttcatcatttctggttctgaatttgtggagttatttgtgggcgcaggggccgccagggtgcgggatttatttgagcaagccaaaaaacaagccccttgcattgtcttcattgacgaattggatgccattggtaaatcccgggccagcggcgcttttatgggtggtaacgatgagcgagaacaaaccctcaaccaactgctgacggaaatggatgggttcagtgcggcgggggcaacggtgattgtattggcggccactaaccgcccggaaaccttggatccagctttactgcgtcctggccgtttcgatcgccaggtattggtggaccggccagatttggcgggcaggctgaaaattttagaaatttatgccaagaaaattaaattggacaaagaggtggaattaaaaaatattgccacccgtacccctggttttgccggggctgacttggctaacttagtcaacgaagcggcactgctagccgctaggaataagcaagatagcgttaccgaagccgatttccgcgaggcgatcgaacgggtggtggctggcttggagaagaaaagtcgggtgctgtcggataaggagaaaaaaattgttgcctaccatgaagtgggccacgcactagtgggagcagtgatgcccggcggtggtcaggtggcgaaaatttccattgtgccccgggggatggccgccctgggttataccctacagatgcccacagaagaccgctttttgttaaacgagtctgagctacgggaccaaattgccactctgctggggggaagggccgccgaagaaattgtttttgacagcatcaccactggcgcggccaatgatttacaacgggccacggacttagcagaacagatggtcaccacctatggcatgagtaaggttttgggccccctcgcctacgataaaggtcagcaaaataactttctggggcagggcatgggtaatccccggcgcatggtcagtgacgacactgccaaagaaattgacctagaggtcaaagaaatcgttgagcagggccataaccaagctttggcaattctggagcacaatcgagatttactagaggcgatcgccgaaaaaattcttgaaaaagaggtcattgaaggggaagaactacatcacctattgggccaggttcaagctcctggcaccctagtggtataa

SEQ ID NO: 26371 - DNA, 2145 bp, Synechocystis sp.
atggattcaccagctattcttcccaccaccagaaccctttgtccttactgtggagttggttgtggtttggaggctgttgctagtccccaaaagtcggtagttgatgccggtcatgcccataaaattagaggcgatcgccagcatccttccagccaaggcatggtctgcgtcaaaggagctaccgtaatggaatccatggataaacagcgattactttaccccatgtttcggtcaagtttagatcagccgtggcaacaaattagttgggaagcagccctagaaattgttgttgataaaattcagcaagttaaacaaactttgggggtaagtggtttatgtatgtacgcctctgggcaaatgcagacagaggattactacgtggcccaaaaattatttaaaggttgtttgggtaccaataattttgataccaattctcgtctttgcatgtcttcggctgtgtctgcctatagcctaagctttggttccgatggtccgccttgctgttatgaagacttagaaataaccgattgcgcttttttaattggtactaatacagcggactgccatcccattatttttaatcgtttacgcaaacaccacaaacaaaatccccacgttaaattaattgtggtggacccccgttgtactgccaccgcagaagttgcggacttacatttagcgatcaatcctggcagtgacattactttactccatggcattgcctatttgctaaaaaagtggaatttaattgatcaaaaatttattgataatcacacccaagattttgagcagtattgtcaagttattgatcattatcccccggaaaaagttacccaaatttgtggcattagtttagaacaattagaaaccgccgctcactattggggcaatgccaaaacagtgctttccctttggtccatgggaatgaatcaatcttttcaaggcacagctaaaggtcgttgtttaattaatctccatttactcactggtcagattgggaaaccaggcagtggacctttttccctcactggtcagcccaacgccatggggggtcgggaagcagggggattgtcccatctgttgcctggctatcgttcaattaaaaatcctcaacaccgccaagaggtagaacaactttggcagatttcccctggccgtattaatccagaaccaggtttatcagcctgggaaatgttcatgggattggaaaatcaacaggttggtttcctatggattgtggcgactaaccctgttgttagtatgcctgatttagaaagggttaaaaaggctctgcaacaatcaacttttacgattcatcaggatgcctattcccccactgaaacggcagaatacgcccatttgttattgccagcagctcaatggagcgaaaaaactggcacaatgaccaattcagaacggagagttaccctttctcctgcgtttcgctctcctcctggggaagcaagacccgactgggaaatttttgctgaggtaggacgtagattaggttttgaaaatcaatttaattttgttgattcagccgcagtacatcgggaatatgtgcaactaactgctgaaagattatgtgaccaatctggtgtcagttatgaaaagttgcaaaagctggggccgctgcaatggccctgtcgtcaatcagatcaagaaagtcaacttttatcaactaaaagactttacaccgactataaattttgcacagaaaatggtcgggcaaacttttgcttagaccacagtcggggattagctgagccggtcgatccaaactatccttttgtcctcaccaatggtcgtctttatggtcattggcatacccaaacccgcactggccacattgagaaaatcaaaaaaatgcatcccaaacctatattggaaatgcatcccaaggacgcagaaaaattgggtattaaaagtcaggatttagttgcgattaaatctcgacggggttctgctcagctagaagttctagttactagagccattgcccccggtacggtttttatgcccatgcactggggttttttgtgggacgataatgctgaagttaatagtttgacccatgccactgcttgccctatttctaaacaaccggaattaaaagcctgcgccgttaatattacaccagtttaa

SEQ ID NO: 26372 - DNA, 645 bp, Synechocystis sp.
atggccctcaaactttatttcctgcgccacgcacaaaccgcctacagtgccaccggaggctattgtggtaccccggaaaatgaccctggcttgaccccagaaggaattttaatggccaaggaatttgctgaagcctacgcccaacacccctggcaagcagtttatgttagccctttgcaacgggcccgccaaacagtccaacccctatgcgatcgcctaggtattgaaatgcagatccgccctggcctaagggaagtggcctatggagaatgggaaggactccatcccgacgaagtttaccaaagggaccacgacctttatatgcaatggctcaccgatccagcttggaactctccccccggtggagaaaggggcattgacatcgcccgccggggcactagggtgctagaggaaattgaagaccgcttcgatgatggcaatgtgttgttggtttctcacaaagccaccatccgcatcctactctgctgcctcctgggcatcgacgtaggtcgttaccgagaccgttttgccatgcccgtcaccggactgagcgtggtggaattatcttcccggggaccgctctttcactgtattgcggaacggtctcacctcagcccctatttacgtagtttgcccagcacctag

SEQ ID NO: 26373 - DNA, 2382 bp, Synechocystis sp.
gtgcccatgactgttgtccccgactaccttgcccacctcaatccttcccaacggcgggcggtggagcatttttgtggccctcttttggtggtggccggggccggctcagggaaaactagggcactaacctaccgcattgcccatctaattcgtcagcatcgcatcaatccggaaaatatcctggcggtaacctttaccaataaagccgccaaggaaatgaaggaacgtttggaaaagatttttgcccaagcctgggcccaacaggaatttagccaacggtgggaattgttggggaaatatgaacaaaaacagttgctttccagggtgtacaaaacagttacgaaacccctctggattggcactttccacagtctatgttctcgtattctccgctacgacattgataaatatcaggacagcagtggccgccgttggacaaaacagttttccatttttgatgaaagtgacgtgcaaagtttgtttaagaccattgtcactaaggatatggatttggacgaaaaacagttcaatcctaagagtattcgctaccaggtcagtaatgccaaaaacctcgggcaatcaccggagacctatctaagggaaaatcccagttataaaggtagggtcattgcggaagtttaccaagcttaccaaaatcaattggccgctaataacgctctagattttgatgatttaattctcatccctacccgtttatttcaacaaaatgaatcagttttaggctactggcaccgaaaatttaaccatattttggtggatgaataccaagacactaatcgcatccaatatgatttaattcgtctgctgagcaccaatggggaagaacggcagtcggagtgggattggcgggggcgttccacttttgtggtgggggatgcagaccaatctatttacagtttccgcatggcagactttaccatcctgctcaatttccaagaggattttggcgatcgcctgttggatggggaaacgaccaccatggtcaaactagaggaaaattaccgttctcgggaaaatatcctccaagcggctaaccatttaattgaacataatagccaacggattgacaagatcctcaaggctacccggagtggcggagatgatattatcctttaccaggcggatgatgaaagggatgagtcccgttttgtgattaataaaattctgagcttaaggaaaaataacccagaattaaattttggtgattttgctattttatatcgcaccaatgcccaatcccgggcctttgaagaacagctattaaataataatattcgctacaatattgtcggtggttttcgcttctacgatcgccaggaaattaaagatgccattgcctatctccgggtgttagttaatccggcggatacggtcagcttgttgcgtatcatcaatactccccggcggggcatcggtaaatccaccattgaaggttttgttaatgcctctaaggaattggacattcccctgtgggaaattattaccgacgaaacttcggtgaatactctggccgggcgatcaggtaaaaaaaccctgcaatttgcccgcatgctccaggaaatccaaagccaaattggtgagctttctgcgtcggaagccctcagcttagtgttggaaaaatccaattatgtggacgacttaaagcaaaaaggcaccgaagaagcggataatcgcctggccaacctgggggaattggacaatgcagtgcgacagtttgaagcagaaagtgaagaccctagcctagtggattttttggcttcagcatccctcacttccgaccttgatgacctggaggaatccggagacgaagtgtccctcatgactctccactctgctaagggcctggaatttccagtggtcttcttagtggggttggagcagggcacttgcccccacgcccgcagtttaaatgatcctttggatctagaagaggaacgccgtttatgttacgtgggcattaccagagcccaggaaaatctctttttgacccatgctcgcatgcgttacatctggggttctttagaaaccaaaataccgtcccaatttctccaggaattaccaccggatttattggccgatggctcaactggtcgtagaactggtcgcaatgctcctgccgccgatcccaagggaccttccattgcccaaaaacaagcccgaaaaaaaactggttcccagtccactcaaccggctaaagacctaatctggaatgttggcgatcgggtaatgcacaacaattttggagaaggcactgtgacccacattttaggcaaaggccataaagctaatttggccatcaaatttcccggcattggtgtgaaaattattgaccccagtttcgcccctctacgccgcctttga

SEQ ID NO: 26374 - DNA, 1728 bp, Synechocystis sp.
atgctcgaacaggacgttgtcattgtcggtgggggtttagccggttgtcgggccgccctagaaattaagcgtctggcccctgataccaaagtggcgatcgtggccaaaacccatcccatccgttcccattctgtggccgcccaggggggcattgcagccagtctgaaaaacgttgacgctgaagattcctgggaagcccatgcctttgatacggtgaagggatcggattatctagcggatcaggatgcggtggaaattctcaccaaagaagccccggaagtaattattgagctagaacatttgggagtacttttttcccgtttaccagacggtaaaattgcccagcgggcctttggcggccactcccacaatcgcacttgctacgccgccgataaaacaggccatgccattttgcacgaactcgtgaataacctgcgccgcaataaggtggaaatttacgatgagtggtatgtgatgaaactcatctacgaagaaggtgaggcaaagggcttggtgatgtatgaaattgccaccggtcgcattgaaattgtccgagctaaggcggtgatggtcgccacggggggctacggccgggtttataacactacttccaatgactacgcttccactggggacggtttggccatggcggcgatcgccggaattcccttggaagatatggagtttgtccagtttcatcccacggggctatatccggtgggggtgctaatttccgaagcagtgcggggggaaggagcttacttaattaatagtgaagggcgcaggtttatggaagactatgcccccagtcgtatggagttggcccccagggacatcacctcccgggccattaccctggaaatccgggcggggcggggggttaacgccgatggcagtgctggcggcccctatgtttacctagatttgcgccatatgggtcgggaaaaaattatgagtcgtattcccttctgttgggaagaagctcaccgtttagtgggcattgatgcagtggaacaaccgatgccagtgcggcccacagtgcattactgcatggggggcattccggtaaataccgatggtcgggtacgaaaaaatgccaacgagttaacagaaggattttttgctgcgggggaatgtgcctgtgtttccgtccatgggggcaatcgtttaggcagtaactccctgttggaatgtgtggtttatggtcgtcgcacgggccggagcattgccgaatatgtccaagggcgatcgctcccggaaattgacgaagcagtttataaaactgaggcccaaacccgcattgatcagcttcttaaccaacagggtacagtgcgtattaacaccctgcgccaagcttttcaggattgcatgaccagccattgtggggtgttccgctccgaatcctttatggcagaaggtttggaacaggtacaaaatcttaaagcccagtacgggcaaatctttttggacgataaacaaccgcaatggaatacggaagttattgaagccctagaactgcaaagcattatggcagtgggggaattgattttaacttctgcgatccaacgccaggaaagtcggggttcccatgctcgggaagattttcccagtcgggatgatgaacaattcttgcgccacaccttagccagttttgacggcgaacaaataaaagtggaatatatgccggtggtcattaatcgctttgaaccgaaggagcgtaaatattaa

SEQ ID NO: 26375 - DNA, 2550 bp, Synechocystis sp.
atggagcaccttcccatggcttttaacaccaccaatcccctcattcaggtggaggatgaccgcactggtctgagcgtggaaaccctcaagcgggctttggcagacaatttgttttatctccagggtaaatttcccgccattgccactaaaaacgattgttatatggccctggcctacactatccgcgatcgcctcctgcaacggtggttaaatacattccaaacctatctcaactgtgacaatcgggtggtgtgctatctgtcggcggaatatttgctggggccccatttgggtaataacctaattaatttagggctatgggagccggtgcaacaggcggtggaagaatcggggttgagcttggatgagttaattgatattgaagaagaaccggggttgggcaacggtggtttaggtcgtttggccgcctgctttatggattccctggctacgttggaaattccggcgatcggctacggcatccgctacgaattcggtatctttgaccaggaaattaaagacggttggcaggtggaaatcactgataaatggctccaactgggtaatccttgggaaattgcccgtcctgaatccgctgtgttagtcaaactggggggccatacggaaccctacaccgatgaccaaggtaattatcgggtgcgttggattgccggcagtttggtcaaaggcattccctatgacactcccattttgggctacaaagtcagcaccgccaataatttgcgcctgtggaaatcggaagcggcggaatcctttgattttcaacggtttaatgtgggggattattacggggcagtgcaggacaaaatgtcctcggaaaatctcactaaagtgctctatcccaacgatgaacagattcaggggaaagagttacggctggcgcaacaatacttttttgtttcctgttctttgcaggacatgattcgcattcacctgtcggacaatcccaccctggagaatttccacgaacattttgcggtgcagatgaatgacacccatccttccattgcggtggctgaactgatgcgtctgttggtggatgagcatcactatgaatggcaacgggcttgggccattaccgaagccacctttggttttactaatcacactttgctaccggaggcattggaaaaatggtctttgcccctgtttggcgaaatgttaccccgccatttggaaattatttacgaaatcaaccaacgtttcctagatcaagtacggatgaaatatcccaacgatggcgatcgcctggcccggttatccatcattgacgaagcaggagaaaagtcggtgcggatggcctatctggccacggtgggttcccatgccattaatggggtggcggcgttgcatagtcaactggtgaaggagactattcttaaagacttttacgaactttggccagaaaaatttagcaataaaaccaacggcgttaccccccggcgctggatggtgctcagtaatccccgcctgagtaacttaatttcttcccgcattggtgatggctggattaaaaatttagacgagctaaaacaactggaaccctttgctgatttggctggattccgacaggattggtgcaaagttaagcgggaagttaagcaggatttagctcgctatatccacaccagaactgacttagtggttaatcccgattccctgtttgatgtgcaggtaaaacgaatccatgaatataaacggcaacatttgaatattctccacgttatccatctttatttgcagattaaaaataatcctaatctggatgttacaccccgtacttttatctatggtggtaaagcagcccccggttattttaccgctaaattaatcatcaagctgatcaactccgtggcagatgtagttaataatgaccccaccattggcgatcgcctgaaagttatctttttgccggactataacgttaaatttggccaaagggtctatcccgccgctgatctttccgagcaaatttccaccgctggcaaagaagcttccggcaccggcaatatgaaattttccatgaatggagctttaaccattggcacattggacggggcaaatattgaaattcgagaagaggtgggggcagaaaactttttcctctttggcctcaccactccagaagtggaaaaaaccttggcggaaggctatcaaccttgggaatattacaacaataatgccaacttaaaagctgtggtagatctgattaattctggctttttctcccatggtgacacagcattatttcgccccttaatggattccttgttgggtcaagacccataccttgtatttgccgatttccaagcctatgtggattgtcaaaaccaagtgggagaagcctataaagatcaggaaaactgggctcgcatggccatcttaaatgtggctcgcatgggtaagttttcctcggatcgcactattcgggaatacgccgaagacatctgggctatcaaacccgtggtaattgaattagaagacctctgtcccgatggtcaatgtttgttaatttctcctaataaatag

SEQ ID NO: 26376 - DNA, 924 bp, Synechocystis sp.
atggctgaggttgtctgttttggagaaatgctcttcgactgtttggcagaccagttgggagtccccttggaacaagttaaatcctggactaactacgccggtggtgcccctgccaatgtggcctgtgccctagtcaaacaaggtgttagcgccgcttttgttggtcgtttgggggcagaccaggccggacaagaacttaaaaatgttctacagcaatgtcaagttaataccgatgggctccaaatcgatccccaccggcccacccgtttggtttatgtgacccggacaggggacggcgatcgccattttgctgggtttggggaatatcacaccggggattttgccgacacagcgatgcagggagaaaccattcccgaatccctattcacctcagctcaatatttggtgatgggcaccattgccctggcctatgcccccagtcgcactgccacggagcggttagtggcattggcgaaaaagcaccaggtaaaaatatttttagatgtcaactggcgatcggttttttgggacgatgaagcacaggcaaaggaaagaattcccgccctgattacccatgcccaaattttaaaatgtaccgacgaggaagcagtgtggctgtttggtcaccaagatccggtcaccatccaccagaaactaccccacctccagggagtattggtcaccgccggggacaagggttgttcctactccttaggcaaaaaccatggggaagtccctgcttttaaagttaatgtgcgggatactaccggggctggggacagttttgtggccggatttttggcccaggccctgacccacggagagaatttattcatagaccctcatctcagttgccaggcagtgacctatgccagtgccataggagccttgaccactctccacccaggggcgatcgccagatag

SEQ ID NO: 26377 - DNA, 1605 bp, Synechocystis sp.
gtggggcgcatggccaaatatatcggtgcaggggatgtgcgctccattttaatcatggcgggggtcgcagcggggatttttctggtgcggggcatggcccagtatgggcaggataccctcatggccaaggctgccctcaatatggcattaactctgcgggaacagacctatgcccatctgcaacgactaagcctgagctattttgaagaagcaaaaacgggggatttgtcctaccggctgacggaggatattgaccgcattggggaagtggtgaataagttattccacgattttgtcccttcggcgttgcaactggtggtggtgtttggttacatgttctatctcaactgggccctgacctgtgcggtattggtaattgctcccttaatggcggtgctaattggcttttttggagaacagttattaaagtttagtcgccgtagccagactcggatttctaatctgtcttctttgttgacggaaacgttgggagccatccgtttagttaaagcctttgccgcagaagattatcagttagatttattccgggaagaggcccaacaacatcggcgatcgcagtttttggccgaacggatgaaggcgttacagtttgtcgtagtgggttttttagaagctatgggagtggtggttttattttgcctggcggcttggcaaatttccctcggtaatttaactggcattgaatttattagctacgtcaccggggtagcaatgttgattgaccccattagtcacatcaccagcaattacaatttgttcaaacagggagaagcctccgttgaccgcatttttgaaattttcgacctgcaaccttcggtggaagatagccccacggcgatcgccattgaccatctccaaggagcggtggattatgaccatgtggactttgcctatctagaagataaactggtcttaaaagggattaatttacaagcccagccgggggaaatgatcgctttggtgggggcttcgggggcgggcaaaagtaccctggtaaacttgttaatgcgactccataacgtgactggcggctgtttacgtattgacggccatgccattgatagcattacgttgaaaagtttgcgagaacaaattgccattgtgccccaagaaaatatccttttttccggcacgatcgcccaaaatattgcgttcggcaaaactgatttagatttggcagcgattgaggaggcggcccgcattgccaatgcccaccaatttatcactgaattaagtcaagggtattatacctatgtgggggaacggggggttaccctttcgggcggccaacgtcagcgcattgccattgctagggcggttttaagaaatcccagcattttaatcttggacgaagcgacttctgcccttgattcggagtcggaagctttggtgcaggaagccttggagcgcattgtccaagaaagaactgtgtttgtcattgcccaccgtttagccaccgtgcgtaaagccacccgcattgtggtgttggaaaggggagaaattgtcgaaatgggtagccatcaggagttaatggcccaccaaggtcgttatgctcgtttccacgcccaacagtttgcttcctaa

SEQ ID NO: 26378 - DNA, 1776 bp, Synechocystis sp.
atgcaaacgtctccccttccccgtcgtaccaaaatcgtcgctaccattggccccgcgacccaaagcaaggaagtgctgagacaactgatccaagccggtgctaccactttccgcctcaatttttcccacggagaccacgcttaccaccaacaaagtatccgtttgattcgccagattgcctttgaactgaaccaaccagtgggcattctccaggatttacaggggccaaagattcgggtgggcaaatttctcaatgatgccggctctgtgcaactcaaaaacggtgatccctataccctcaccagtcgcccggtggaatgtacggaaaccattagttccattagctacgaatatttagccgacgaagtaccttctggggcaagaattttgctcgacgacggcaaactggaaatgttggtggaggaagtggacactgttgcccgggatctccactgtcgggtgattgtggggggaaccctttccagcaataaaggggttaattttcccggggtctgcctttccgttaaggccatgaccgataaagataaggaagatttgatgttcgggctggaccaaggggtggactgggtggccctgagttttgttcgtaatccccaggatattgatgagattaaggggttaattgcggcggcagggaaatccgtgccggtaatcgccaaaattgagaagcacgaagcgattaaggatatgcaggcggtgctggaaaaatgtgacggtgtcatggtggcccggggggacttgggggtagaactacccgcagaagatgtacctattttgcaaaagaaactcattgccactgctaaccggttgggcattcctgtcattactgctacccaaatgttggacagtatggtcaacagcccccgacctactagggctgaagtgtccgacgtggccaatgccatcctcgatggtaccgatgcggtgatgctctccaacgaaacggcgatcggtaaatttcccgtggaagcagtggctattatggccaaaattgcggagcgcattgaacaggaagatatcaatccttcccaagcggaagccagtcgcacttctattcccaatgctatttccagcgccgttagccagattgcggaaaccctcaacgcggcggctattatgtctttgactaagaccggatccaccgcccgccatgtgtcaaagttccgccccaaaacccccattctggccgttacgccccatgtggatgtgtcccgtcagttgcagttggtgtggggagttaagcccctgttggtattggatttaccttccaccagccaaacgttccaagccgccattaacgtggcccaggaaaaccattttctccgggatggagatttggtggtgatgaccgccgggacattgcagggagttgccggttcgacggatttaatcaaagtggaagtggtcaaggccattcttggtcggggtgtaggtattggccaaggagctgtaagtggccgggccagggttgccagtcgtccccaggcgatcgcccaatttacccagggagaaattttagtagttccctctaccaacgctgattgtgtggacatgatgcgacgggcggcgggcattatcaccgaagaagaaagcctgactagccatgcggccattattggtttgcggctgggggtgccggtcattgtgggttttaaaggcgctacccaaaagattcgagatggagccattgtcaccatcgatgcccaaaaaggactgatttattccggtgcattacccccggtgtccaaaggatag

SEQ ID NO: 26379 - DNA, 2568 bp, Synechocystis sp.
gtgatgtcaccccgactttttcatcaggaacaatcaatgattgatcaatctaccctaaacacttcccctcaacccactatcacaattgaagatgaccgcaccggcatgagtgtggccactttgaagcgggcctttttggataaccttttttatctacaggggattgatcgttcccaggcaaccctctacgactactacgttgccctggcctataccatccgcgatcgcctgttgcatcgtttcatcaagaccgtcgccacctataagcaggaaaaagtgaaggtggtttgttacctgtcggcggaattcctgatgggacggcatttaggcaataacctcattaacctggggttgtacgacaaaatcgaccaggtaatgaaagaatttgacctggacttaaacgaaattattgagcaggaaccagaccccggcttgggcaatggtggcttaggccgtctagcggcctgtttcctcgattcccttgcttccctagaagtgccggcgatcggctacggcatccgctatgagtttggaatttttcaccagcgtattcaggacggttggcaggtggaagtgcccgacaactggttacggtttggtaatccctgggaaatcccccgggctgatgagtcggtggaagtaaagctagggggccacacggagatcatccataacgaaaaaaatcaacccaaggtggtctggattcccgaaaggactattctggccattccctacgacactccggtacctggttatcaaaccaatacggtcaatcccctccgactctggaaggcagaagctagtgaagaatttaactttgaagctttcaattctggtctgtacgaccgggcagtagcggaaaagatggatgcggaaaccatttccaaggttctttatcccaacgacaatacccccgctggccgagaattgcgcctagcccaacaatatttctttgtttctgcttccctgcaggatctaattcggattcatctccgcacccaccctaatctcgatactttctacgaactcaccgccattcagttgaacgatacccaccccgccgtggcgatcgccgaattgatgcgcctgtttgtggaccgttatgactacgactgggataaggcctgggacatcacccaaaaaacctttgcctacaccaatcacaccctcatgccggaagccctagagcgctggtcagtggatttgtttgccaaactattgccccgtcatttggaaattatttacgagattaaccaccgcttcctaacggggttgcaaacctggttccccaacgacgaagctctggtggaaagcctttctttgattgaagaaaaccatggcaaaaaaattcgcatggccaacctggcctgtgtgggtagccatgccatcaatggagtagccgccctccacaccgaactgctgaaaaaagataccctgcgggactttgccaagctctggccccagaagttctttaacaaaaccaatggcgttaccccccgccgctggattttgctcagcaaccctgaactatctgcgttggtaacggaaaaaattggcgatggttggctgaagaacctggatgaaatgcgacaaattgaaaagtttgttgatgatccggaattttgtcgtcgctggcgagaaattaagcaaaataacaagcgtaacttagcggcctatttgctcaagtatcgcaatgttcagattgacgttaactccctgtttgatgtgcaggtcaaacggattcatgaatataagcgccaacacctagcggccctagaaattattcacctctataaccgcatcaaacaaaatccccatgcggaaattgtgccccgtaccttcatttttgggggtaaggccgctccaggttatttcatggccaaattgattattaagttgatcaatgctgtgggggaggtggtcaacaacgatcccgatgtgcggggaaggctcaaagttgtctttgtctctaacttcaacgtttccctggggcaaagaatttatcccgccgccgacttgtcggagcaaatttccaccgcaggcaaggaagcctccggtacaggaaacatgaaattcgccatgaacggcgccctcaccattggaaccctagatggggctaatatcgaaattcgggaagaggcagggccagaaaactttttcctctttggccttaccgctgaacaggtatatgccatgaaagaaaacggttaccatccccacacctactatgacaataactttgatctaaaagctgtgattgaccgcattgcccacggctacttctcccccggtaaccccaatttgttccatcccattgtggagtcccttctgcaccacgatccctatatgctactggcggactaccaagcctatgtgggctgtcaggatgaagtcagcaaagcctacgccgaccaagaccggtggacaaaaatgtccattctcaactcggcccgcatgggtaaattctcctccgatcgcaccattcgggaatactgcaaggaaatttgggatgtgcccccggtgaaaatttccctggatgaataccatcccgaatacgccgatttatag

SEQ ID NO: 26380 - DNA, 399 bp, Synechocystis sp.
atggaactggaacatcctgacgatctctattatttggattcccacgagtacgtccgctttgatggggaaacggccaccattggcctgagtgcctttgccgtggatgagctgggggatattgtctttgtggagttacccgaagaaggggacaaagtggaatttgagcagtccatgggggcagtggaatcggtcaaggccgcctcggatttatattcccctgtgacgggcactgtgatcgaaaaaaactcagctttggaagatcagccggagttgctcaatcaagacccctacggggaagaaggttggttgatcaaggtgcgcctagatgatgtggaagatgccaaagaaggattgatggccgccggagactaccgcgccaccctagagacgggagattag

SEQ ID NO: 26381 - DNA, 1065 bp, Synechocystis sp.
gtgaccgggtcatttttttgctatttattccccaggagtttttcaatgttaaaaatcggcatcaacggctttggccgcattggtcgtcttgtggcccgcatcgccatggccaatccccaagtgaccctagtgggcatcaatgacctcgttccagcctctaacctggcctatttgtttaaatacgattccacccatggttcctacggtggcaccgtggtagccaaggaagagggcattgtcattgacgaccaatttatcccttgtttttcccaacgggacccggcccaattaccctggggagatctaggggcggattacgtcgtagaatccacgggtctatttaccacctacgccaccgctgaaaaccatctcaaagccggtgccaaacgggtaattatttccgctcccagtaaggatcccgaaaaaattcccacctttgtggtgggggtgaaccatctcaactacaacgccgacactgacaaaattgtttccaatgccagttgcaccaccaattgcctggctccgatcgccaaaatattagacgataatttcggcattgtggaaggattgatgaccacagtccacgccatgaccgccacccagcccaccgtcgatggcccgagcaaaaaagattttcggggaggtaggggggcagcccaaaacattattccctcatccaccggagcggctaaggcagcggctttagtgctaccgcagttaaaaggtaaattaaccggcatggccttccgggtccccacccccaacgtgtctgtggtggatctaacttttaaaacggaaaaagccacgagttacgaagaaatttgtgctgccatgaaaaccgccgccgagggggaacttaaaggaattttgggctacacagcagatgatgtggtgtccatggatttccgtaccgatcctcgctccagtattttcgacgccggggccggcattggtctgaacagcaacttttttaaagtagtttcttggtacgataacgaatggggctattcctgtagggtcattgacttaatgttgaccatggcgagcaaagacggtttggtctag

SEQ ID NO: 26382 - DNA, 744 bp, Synechocystis sp.
atgacggcattaacggcacaggtggcattggtaacgggggcatcccggggtattggtaaagcgacggctttggccctggccgccacgggcatgaaagtggtagtgaactatgctcaatccagtacggccgccgatgctgtggtagcggaaattattgccaacgggggagaggcgatcgccgtgcaggccaatgtggctaatgctgacgaagtggatcaactgattaaaaccacgctggataaatttagtcgcatcgatgtgttagtgaacaatgctggcattaccagggatacgctgttgttgagaatgaaactggaagattggcaagcggtcattgacttgaatttaaccggggtgtttctttgcaccaaagcggtgtctaagttaatgctcaagcaaaaaagtgggcgtatcattaacatcacttctgtagcgggcatgatggggaatccggggcaagctaactacagcgccgctaaggctggggtaattggttttactaaaaccgttgccaaagagttggccagtcggggggtaactgtcaatgccgtagctcctggtttcattgccacggatatgacggaaaatctcaatgcagagccaattttgcaatttattcccctggctcgctatggtcaaccggaggaagtggcgggcaccatccgttttttagccacagatccagcagcggcctatatcacgggacaaacatttaatgtggatggcggcatggtaatgttctaa

SEQ ID NO: 26383 - DNA, 747 bp, Synechocystis sp.
atgcccatggccatcgatattagcaacaaaacagttctggttactggtgccaatcgggggataggcaaagtactggtggagtcttttttggagcatggggccgcaaaagtgtacgccgccgtcagaaagttggaaagcgccgctttcttagtggacaaatatggcaataaaatagtccctattttgatcgatctagcagacccagaatccattgccgccgctgcccaaaccgccacagatgtggaaattgtggtcaataatgccggggtgcaaaaagttgcaaatcccctggccgaagaggcgatcgcctgcttgaaatttgaaatggagaccaatgtgtatgggttgatctccatggcccaagcctttgctccagtgctcaaagccaatggagggggagcttttgtgcaactcaactcagtagtttccctcaagtcattctgcaatgttgctacttattctgcttccaaagccgcagcctattccattacccaggcattgcgggaagttctggctggacaaggcactctggttcagagcgtccatcctggccccatcgccaccgaaatgacccatgcttctggccgggctgatattgccgaatcccccaccctagtggcggaagctattattgctgcactacaatctggcgagtttcacgtttttcccaacgacaccatggcgaaaggaatgggcgatgcctatcaaagctttggcaaaaatgtgattgaggtcagctttgattga

SEQ ID NO: 26384 - DNA, 981 bp, Synechocystis sp.
atgcgtatttttcctgtatttttactaactttcagcctttttttaatcaaggaagaaatagttacagcagaagttaaagtttctgcgccggtggttaatcaatctggcattaagctaaatcttgagcgacaatttacggggtctgatgtggctattaaccgtatccattttagtcccgacggacaatttttactaacggcggccgcagatggcgtgggcactttatggactaaagaaggggaaatgctggggcaactacagggtcaaaagccccccatgttcaatgctcgtctttcccccgatcgccaaattttaatcaccactggctatgacggtaccattcgcttgtggaatttgcagggggagctactggaggaacaacagccccatcgagcagcggtggccgatgccatatttagtcccgacagtcaaattattgtcacctgttctgatgatggccaaactaaaatttttacccgccaaggtcaagaaatagctagtgttttaaaatcaggtacagctcgaaatttggcgtaccatccccagggacttttaattgctagtgtttccgatagcggttccctccatttaattaatcccaacggcaaaattgaacgggaaatttccacaggccaagggcgaattaataatgttaactttagtccgaatggtgaacaattattaacttcaggcattaatggttctgccaagttatggaatttagcaggggaattaatccatgaatataaagttgtgcccaccggttgggttaacagtgcccagttctatcctaaaggtgaatggctagccaccgccagtgacgacggtacgattagattttggcaaaaagatggtcaattaatttatgaattaccgttggttaatgcccgcttaactagcttgagtttttctcccgatggcaagcagttagcggccaccagcagtcagggacaggtttgggtttttaatttatcttattaa

SEQ ID NO: 26385 - DNA, 2124 bp, Synechocystis sp.
atggaacgcatagatattcatcccacccacaccgctaacggttacaaactccgctgtggccagccctttccctttggggccaccattgtgccggggggagttaatttttccatttactctagccatagcaccgcttgcaccctagtactgttcgagaagcgggctccccagccctttgtggagattccctttccagaatcttttcgcattggtaatgtctattgcatggtggtgtttgacctggattttgagaatctggaatacggctatcgcatggaaggccccaataacttccagcagggccattggtttgaccccagtaaagtccttcttgatccctacgccaaagtggtcagtggccgggatgtttggggcacccaacccaattgggacgatatttatcaacaccggggccgcctcagctttgacgattttgattgggaaaacgattcccccctggatgttcccctcgaagacatggtcatttatgaaatgcatgtgcggggtttcaccaaagatccttcctccggagtaaaggaaaatcaccggggcaccttcgccggcattctcagcaaaattccctatctacaggaattgggtgttaataccatcgaattaatgccgatattcgagtttgatgagtttgaacatagtcgttaccacccagaaacgggggaatttttagttaactactggggttatagcaccgttaacttttttgcacctaaagcgggttacgctgccaccggtaaattcggcatgcagattgacgagttgaaaaacttagtcaaggaactgcataaagtaggtatttccgtcattttggatgtggtttttaaccatacggcggagggcaatgaacggggccccaccatttcctttcgaggattggataacaaaacctattacatgctcaccccggagggttactatttcaactttagtggcactggcaataccttaaactgcaataatcccattgtgcggggcatggtgctggactgtctgcgatactggacagcggaatttcatattgatggttttcgctttgatttagcctctattttgggaagggatccctggggctaccccttggccaatccccctcttttggaaaccctggcctttgatcccattttggcccgttccaaacttattgctgaagcctgggatgccggtgggctataccaagtaggatcttttcccagttatggccgctgggccgaatggaatgggaaataccgagatacggtgcgaaaatttattaaaggagatgcgggggtaattggggaaatggcccaaaggctacagggttcccccgacctttatcaaggagccggacgacctccctccacttcgatcaattttgtgacggcccacgacggctttaccctggcggatttggtggcctataacggcaaacataattacgctaacggggaaaatggcaatgatggagccaacgacaattacagttggaactgcggggtagaaggtcccaccgataaccctgatatcctcagactccgggcccggcaaatgcggaatgcgatcgccattttgttggtgagtcagggggtgcccatgctgttgatgggagacgaaatgggcaaaacccaagacggcaacaataatacctattgccacgattcccctttcaattggctcaattggcatttacttgaacaaaaccaggcttggtttcggtttgtcaaacactgcattgctttccgtctagcccaccctgtattacgcaacagtgaacatttccaaaactgcgattaccttggtgtgggatttcccgatattagttggcacggagtcaagccctggcacgctgactggtccgccgatagccgagttttagcttttatgctttgtggtcgccatgccaaaggtggccgagttaaggataatcaaatttatgtggccatgaatatgcattacgaaagtctttggtttgaactgccagctcccccggtgggcaccacttggcacgttttcgccaacacaggggcccagcctccagaagatatccatccccctgggcaggagccccccctctcttcccaatcatccctactcattggcgatcggagtgttgttattttactggctaaataa

SEQ ID NO: 26386 - DNA, 765 bp, Synechocystis sp.
gtgacagaagtgaatttatcagttgttagttgtagttccacgggaaagacggatcccggtctagttcgtcagtacaatcaggatagtttttaccttgatccagagggacgattttacattgtcgccgatggtatgggggggcacgccggaggagaagaggccagtcggattgcagtggaaagggtacgggattacctggacacctactggcaatcggagattacctcggaacaattgctgagggatgcactaatggatgccaatgaaggtattcttgaggatcaaaaaattaacctggaacggcgggatatgggtaccaccgcagtgttaatcgcctttcgggaagatggtgcttggcgggcccatgtgggggattctcgcctatatcgtttacgaaatcagcaattggagcgggtgacggaggaccatacctgggtggccagggccttgaaaatgggggacattgacccggcccaggctaaggtccacccctggcgccatgtgctgtttcaatgtttggggcggcaggatttgaattttatcgaggtggaagctctagatgcccaaccgggagacacctttatgatgtgtagcgatggcttaacggaggaagtgcccgataatttaattgaaaaaatcctcactggtcaggggaattgtgatgatcaggctgtccaattaattgaagaagccaaaaatgccggcggctcggacaacatcaccatagtgcttgtggatttttctgaggataaccaggacagttaa

SEQ ID NO: 26387 - DNA, 1446 bp, Synechocystis sp.
atggttgcttcccccatccacagtcgtggtttagatctgcctttgccgtcaacgatgggagaattcggcttgagcttgccccgatcgccattgtttggcacggacggtatccggggtaaggctggggaattgttgacggctcctttggctttatccttgggcttttgggcggggcaggtattacgggaacaaactgatactgctggaccagtgattatcggccaggattcccgactttccagtgacatgctagccaacgccatggccgccggtttgaacagtgccggggtagaggtgtggcaactcggactttgtccgactccctgtgtggcctatctcaccagaaaaacagcggcaatcgggggcattatgatttccgctagccataatccgccggaagacaatggcatcaagttttttgatcaccaagggctaaaattacccaaatccctagccacggcgatcgaagcaggactgcggggacaaaatcaaacctccgggctgaatgccagtcaatggggaaggagttatggccagccccatcgtgtccaatattaccaagattttttgctaggtagtttgccccaacccttgaattttcaagggctaaaagtggtgttggatctagcctggggagcttcggtcaatttggcaccccatatttttcgcagtttgggagcggaggtcatagctctgcacgatttggccgatggcagtcaaattaacgttgattgcggctccacccatttacatcgtttgcaaagggctgtgcgggaaaccggggcggatttaggttttgcctttgacggcgatgcagaccgggtgatggcggtggatgcccagggccgcccggtggacggagattacattctctttttatggggcaaaactctccaggagagcaaccatctgcccgataacctaattgtcggcactgtcatggccaacttagcctttgagcgagcttgggaaaaactggggggtaaattaattcgcactgcggtgggggaccaaaacgtccaagcccaaatgtgggaaaccggagccatgctagggggagaacagtcaggacacattatttgccaccaccacagttattccggggatggcctgcaggcggccttgcatttagccaccctagtgcaaaagtccggtttatctttgagcgaactgctgtcggaaagtttccaaccctatccccaaattctccgcaacgtcagggtactagaccgggagcgccgcttacattggcaagaatgcgcccctttgcaacaggcgatcgccacggcggaaaagtccatgggcaccaccggaagaattttagtgcgggcttcgggcacagaaccattaattcgggtcatggtggaggcggcctgtgcggagacggcggcccattggtcggaccaactcaccagcactgtgcaatgccatttgggggatagttaa

SEQ ID NO: 26388 - DNA, 963 bp, Synechocystis sp.
atgactgtttcgacctctgctcccacagttcggataggctcacggaaaagccaactagccctcgtgcaaacctattgggtgcaggaagaattgcaaaaacacttccccgatcgccaattcgatgtcgaaaccatggaaacccagggggataaaatcctcgatgtggccctagcaaaaattggggataagggactattcacccaagaacttgaagacggcatgttgggaaaaagaaccgacttagctgttcactccctcaaagatttgcccactaatttgccagcgggcttgatgctgggctgcgtgaccaaacgggttaatcccgccgacgctttggttttaaatgctaaacaccaaggcaaagatttggcttccttgccggaaggggcggtgattggcacctcttccctccgtcgtttggcccaactgcgctaccactttccccatttaacctttaaggatgtgcggggcaacgttaatacccgtttggccaaattggatagtaatgagtacgatgccatcattctggccgccgctggtttggaacggttagacatggccaatcgcattgaccaactaattcccccggaaatttctctccatgctgtgggtcaaggggctttgggcatcgagtgtcgtgaaggcgatcaagaaattctcagcctgttgaaagtgttggaagacgaaaatagccgggatcgttgcttagcggaacgggcctttttgcgccaactagaaggggggtgccaagtgcctatcggtgttaatacccatttagatggcgacaatttaacccttaccggcatggtggccagtttggatggccaaaggttaattaaagataccctcagcgctccccggaaagaagcggaaaaattgggtcaggatcttgccctcaaactccgggaacagggagcaggggaaatcctagcggaaatcttagcggaagctggccggggataa

SEQ ID NO: 26389 - DNA, 1308 bp, Synechocystis sp.
atgcgtaatcatcagtccatccatcgtcttgttctcgataacggcattaccctcatctgtgcagaaaatccagcggcggatctggtggcggggcggatttttttaaagcaagcaggggcttgttgggactctccccaaaaagtggggctttccaatctcatggccacagtgatcaccaagggcactaaacggcgatcggccttggacattgccgaatttgtcgaatccttaggggctaatttaggggcagatgcggccagtgattactgggctttgagtttaaagaccgtcaccgccgattttcctgtcatcctcgatttagcggcagaaattctgcgttaccccaggtttgacgtgggggaaattgaactggaaaaacgcttaattgtccaggcaattcagtcccagcgggaacagccctttaacgtggccttccaccaactgcgccaatccatgtatcccaaccatccctacggttactccattttgggtagcgaagaggtggtgccccactttactgcccaggatctgtgggaatatcaccaggcctattttcgccccgataatttggtaatcagcttggcgggacggttgaccctagcccaggcccaggattgggtcgaaactagttttggggattgggttattccggaacaatcgattgtttgtccgatcctaacgccgttaaatgcctgcccccaagaacagctcactccccaggcgacccagcagtcggtggtgcttttgggttatttaggagtcggagttaaacacgaagattatgcgcctttgaaattgctcagtacctaccttggtaacggcctctctagtcgtttatttgtggaattaagggaaaaacggggtttagcctacgacgtgtcggctttttatcccacccgcttaggttcttcccaatttgtcacctacatgggcactgctccagaaaatacggcgatcgccattgcgggattaagggcagaaacggaccgattatgtgaagaaagattggaggaaggggaaattaaagcggcgcagaacaaactattggggcaatatgctttgggcaaacaaaccaatggggaaatcgcccatttatttggctggtacgaaaccttgggtttgggtatagcctttgacagcgaattccaggaacaggtgcagaaggtaacggaggtcgatgcccaacgggtggcccaaacctatttagccgaaccctatctctccgtggtggggccagaggaaggtttggcgaaatattttgacctagtggcggaaggacaaagccaagtgtcttctgctttggtgtaa

SEQ ID NO: 26390 - DNA, 747 bp, Synechocystis sp.
atggaattaactggaaaaacagccctggtcaccgggggaggcataagggttggtcgggccctagttatggccctggcggaagccggttgtaacgtctttattcactacggtaattcccagaccggagccctagaggttcagcaagaagtggaagcattgggtaggaaagcttttacctactccgccgatttgagcgatgcccaggccacccaaggaattattcccaaagcccaggaagtctttggccaggtggatattctgatcaacagtgcctcggtttttcccctagaagataaattctttcaagtggatctcgacctgtgggaatggatttttgccgttaatctccgggccccctttcagttgtcccaggcctttgctcaacaagtagccggcgatcgccaaggaaaaattattaacattaacgatgcccgcattccccgaccaaggccagaccattttgtttaccgtcttaccaaacggggtttgtgggatatgacggaaattttagccctggaattggcccccaatatcaccgttaatggcctcgccctaggacagattttagaagctccggaagcgccggacccggaagagtttatgcgggattatgcagagcgacgtattcctttaaaaatgaccggcaatcccaaagtagtcactgatgcggccctatatttgctacaacaggattttctgagtggcaccaccattcgtttagatggagcagaatatttgaagttttag

SEQ ID NO: 26391 - DNA, 1392 bp, Synechocystis sp.
gtggtctgccattcggactacattgcaaagattagagaaacttgtttaacaaaaaacgtcgtaatttctgcgaccaccaccttattagagaatcctttaggagaacccatgaatattgccgttgtgggactgagccataagacagccccggtggaaattcgcgaaaaactcagcatccaagaagctaagttggaagaagcgctaacccatctgcggagttatccccacatcgaagaagtcactgtcattagtacttgtaaccgcctggaaatttacgcggtggtgacggacacagaaaagggagtggtggaaattacccaattcctttctgaaactggcaatattcccctggcaaccctacggcgttatttgtttaccctcctccacgaagatgcggtgcgccatttgatgcgggtggccgctgggctggaaagtttggtgctcggagaaggacaaatcctggctcaggtgcgtactacccataagttggggcaaaaatataaaggggtgggtcgtctgctcgatcgcctatttaaacaggccattaccgccggtcgtcgggtcagaaccgaaacggatattggtacaggagccgtgtccatcagttccgccgctgtggagttagtccatcgtcaagtggatttatcgagccaaaaaactgtcatcatcggggctggtaaaatggcctgtctgttggtgaaacatctattagctaaaggagccacggacatcaccattgttaaccgctcccaacgtcgttcccaggatttagccaaccaattcccccaagcccagttaaccctttgtcccctgacggatatgtttacggcgatcgccgctggggatattgtctttaccagcactggggccacggaaccaattttaaactgcgagaatttgactggctgtgtgatcaaccgcaaaagcttgatgttagtggatatttccgtcccccggaacgtggccgctgatgtccacgctatggaacaggtgcgggcttttaatgtggatgacctgaaagaagtagtcgcccaaaaccaagccagccgccgacaaatggcacgccaagctgaagcattactcgaagaagaaattgccgcctttgacctctggtggcgatcgctagaaacggtacccaccatcagttccctccgcagtaaggtggaagatatccgggaacaggaattggaaaaagccctttcccgcctgggcagcgagtttgccgaaaaacatcaagaagtaatcgaagccctcaccaggggcattgtcaacaaaattctccacgaacccatggtgcaactgcgggcccagcaggatatcgaagcccgtaagcaatgcctacgctccctgaagatgctgtttgacttggaagtggaagaacaattcggttag

SEQ ID NO: 26392 - DNA, 759 bp, Synechocystis sp.
atgacttcccccactgctccgttaatttcctttgaccagttgcaaaaaaactttggcgccctccaggttttgcggggagtaacgggggaaatttaccccaaagatgtgatttctatcattggcccttccggttgcggcaagagcacttttttgcgttgcctgaatcgccttgaacccatcagcggtggccgtctcgaagtggcgggggtggacttatccggggctaaaattgaccagaaacatctgcggcagttgcgggtgcgggtgggcatggttttccagcatttcaatctgtttccccatctgacggttttgcaaaatctcttgctggccccccgtaaggtgttacgcattcccatggcggaagctaaggaccgggctttaacctacctggataaagtgggtttgggcactaaagctgataactacccagaccaactctccggcggccaaaagcaacgggtggcgatcgccagggggctgtgcatgaagccggaaattcttttattcgatgaacccaccagcgccctagacccggaattagtgggggaagtgctgaatgtgatgaaacagttggccgaagaaggcatgaccatggcggtggtgacccatgagatgcagtttgcccgggaagtatccaatcgggtctttttctttaaccaaggaatcattgaagaagagggcgaccccaacgaagtttttcgcaatcccaagagcgatcgcctacgggcatttctcagtcgcattcagtccagttaa

SEQ ID NO: 26393 - DNA, 996 bp, Synechocystis sp.
atgcaagtccaatttcaaattttgcgccaaaaaccgcaacagtctccctacctagaaaaatttgatctagaagtggagcccggtgccaccattttggagtgtttaaatcagattaaatgggaacaggacggcagtttaaacttccgcaaaaattgtcgcaataccatctgtggcagttgcagtatgcgggttaatgggcgatcggccttggcttgtaaggaaaatgtgggcagtgaaaccagattatttacccaggttaacgaagcaggcattcctgtggtgacggtggctcccctcggtaatttgcccgtcatcaaagatctaattgtggatatgcaacccttctgggacgacttggaacgggtggagccctacgttagtacccaggggcgcaaggtgccggaacgggaatttctccaaaccccagcggaaagggaaaaactcaaccaaatgggcaattgcattctctgtggagcttgctattccgagtgcaacgctaaatctgttaatcccgattttgtcggcccccatgccctggccaaagcccaaagattattaaccgactcccgggatggagccacagccgatcgcctcgaaagctacaacaatgctacagccggggcctggggctgtacccgttgttacctctgtaacgaagtctgccccatggaagtggcccccatggaccagattgggaaaattaagtctgcccttctggcccagaaaacagcccaggacagtcgcccggtgcgccaccgcaaagttatggtggatttggttaaagccggtggttgggtggatgagcgtaagttcggtatttacgtagtgggtaatttcttccgggatctcaaaggtattgctagtattttgcccctgggcctgcggatgattagcagtggcaaatttcccctgggctttgaaccttccgccggtactgaggaagtgcggagcttaatcgaacaggtgcaagaagcggaaaaacttgccaatttctga

SEQ ID NO: 26394 - DNA, 1176 bp, Synechocystis sp.
atggccaatcctgtcactttgccccaaacttttctgttactcggctctggggaattgggcaaggaatttaccattgccgcccagagattgggcaatcgggtcattgcggtggaccgttatccggatgcgccagccatgcaggtggcccaggttgccgaagtcatttctatgttggatgggaatgccctggaagcagtggtaaaaaaatatcagccggattggattgtgccagaagtggaggccatccgcacggaaaaattgttggagctggaagccgggggctatcgggtcattcccaccgcccaagccaccaatctgaccatgaaccgggaccggattcgggagttggccgcccaacagttgggggtacgtactgcccgttacaattacgccaccagtttggccgagttagaggaggtaagccaggccattggttttcccaatgtggtcaagccggtcatgtcttcttcgggtaaggggcaatctgtagttaacaatgcaggagaggtgcaacaggcctggtcagcggcgatcgccggagcgaggggggatcagaccaaggtgattgtggaggaatttattcccttcgagttggaaattacgctcttaactatccgccaatggcagggagaaactctgttttgtgatcccattggccaccgccaagaacggggagactatcaagaatcatggcaaccagcccccttaacccaaaggcaactagcccaggcccaggcgatcgccaaaaccgttaccgatgctctggggggggcgggtatttttggagtggaatttttcattaccccggaggaagtgattttttccgaattgtccccccggccccatgacactggcatggttaccctcatttcccaaaacttgaacgaatttgagctacatttgcgggccattttaggtttacccattcctcaaattaaacaaacggggcccgccgccagcgcagttatcctcgctctagaagctggggaaaagcttagttacgccggattagcagaagctttaacagaatccggcaccgatgtgcgtttatttggtaagcccaatgccagaccccataggcgtttaggagttgccctagcccaggcagaatcggtcgatgcagcccgacgtttagcccaaactgtggcggaaaaggtaatagtgcaaacagaataa

SEQ ID NO: 26395 - DNA, 1527 bp, Synechocystis sp.
gtgccccaccattacgacagggtaaatattaacaaattattaacaaggactagaatcaccatggttacaaccccagattgggtgaaaaaagccgttttctatcaaatttttcctgaccgttttgccatcggccaacaacaggcgatcgccgtcgctcaacaaccaaagctagaaccatgggaggccccgccaacggtgcagggttataaggggggcaacctgtggggagtgatcgaacatttggattatctccaggattcgggcattaccgctttatacttgacccccattttccagtccgcctgtaatcaccgttatcacacccatgactattaccaagtggatcctctactggggggcaacgaggcgttgcaggctttactaacccaggcccaccgccgggagatgaaagtagtcttggatggagtgtttaaccatgccagcaggggtttctactttttcaacgacattttggaaaatggcccccattctccttggttagattggtttcacattgaagattggcccctatcagcctatgacggttctctgccagctaactatcggggctgggtagatttgcgggccctgccccagtttaaccatgaccatcccgacgtacgggaatatttgatgcgggtgggggagtattggattgcccagggcattgatggttggcgtttggatgtgcccgattgtgtcaaagcggaaggtttttggcaagaattccgctgcagggtcaaggccattaatccagaagcctacattgtgggggaaatttggtgtgatgctagcccctggttagccggagatcaattcgatggggtgatgaactatcgctttaccgaacctaccgtagcttttgccattggcgatcgcctgcaaaaagaacatctacggggggaagaatatcgtccttacccagccctaactgcagaagcctatggggaaagaattagccaactgctgcaacaacatccctgggaaattcagttaacccaattaaatttactcaacagccacgacaccgcccgcttattaaccctagccaatggcgatcggcccagcgttaacctcgctcttttactgatgtttactttccccggtgctccctgtgtttactacggagacgaagtgggtttgcctggggaggccgaccccgattgtcgccgagtttttcctgctaaaactgactgggacttggattgttgggaattctaccgccaattgattgccctgcgccatcgctatcaatgtttgcaattgggggattacaaaattatcgccacggcaggtatgggctatgtttttcaacggcaatacggcgatgaaaccctaatggttgccgttaatagtggtgacaacataatagaaattatattatctccagacataataaatttggataaaatagacatagctgaacctgtatttagcgctaatggtgagaccgtaattgaccggaacaccgcagggttacttttgaccatggcccctcaatcaggagcagctttcgccatcatttga

SEQ ID NO: 26396 - DNA, 2739 bp, Synechocystis sp.
atggattgccgacttaagtgcactaatcaatgcactagtttgatgatggctttcgataaatctcatacaattaaaggctgctccacagaattttccctttccatgactgatactccgatcctcggcactgttaaagaaccccaacgggactatcgcaccctcgatcgccagaagttgacgccgatgttccagcactacacggaggttaaggaacagtatcaaggggctttgttgctttaccgggtgggggacttttttgagtgttttttccaggatgcggtgatcattgctagggaattggaactgattttaactagcaaagaggggggcaaggaaatcggccgggtggccatgactggggtaccccaccacgccttggatcgctatgcgcggcagttggtggaaaagggttatgcggtggccatctgtgaccaggtggaggatgcagcggaagcccaggcagaaaaacgcatggtggaacggcaggtgaccaagttactcacccccggcactttgaccgatgacagtatgcttccggccaagcggaataatttcctggcggcgatcgccatggtggaggataaatggggcctggcccatgcggatatctccactggggaattttttacgtgccaatccagtaatttggatgacctagcagtggaattacttcgactccaaccgtcggaagtattgatacccacctctgcccccgatattcgcaatattttgcgccctggggaaccttcagagcatattcctaaacagttacccaccagtttttgttattctctccgttcccaagcgcccttttccttggtggaagcaaaacagagattactaaccacttttcgagttaaatctttggagggcatgggctgtgaaggtttacccctagcaatccgggcggcggggggattattggaatatatcgaagatacccaaaaagcccatgtggtgcccattcaaccattaaaaacctatggcttaaccgattttctggttttggatcaccaaacccgacgcaacttggaaattaaccaaaccgtgcgggatggtagtttccatggttccctactgtgggctttagatcgcaccagcaccaccatgggtagtcgggctttgcggcgttggttattgcagcctttattggatctcaaaggtatccaagctcgccaggacaccatccaagagttgtaccatcatcccgctttgcgtcaggatttgcggcaattgctccggcaaatttacgatttggaacggttaacggggcgaattggggccaacaccgccagtgctagggatgtgtatggcttagcatcttctttggtgcggttgacggatttagctgagttagctcaggaaggccatagcccctatttaaaagccttacagacagtgccgccggagttggaagaattgggcaaatatgtgttagcccacattgtggaaaatccccccttacatattcgggaaggcaatttaattcgtagtggtgttaacccgacgttggatgaaatgcgtcaaagtttggaagatgataatcaatggttagctaatttggaagtaacggagcgggaaaaaactggtattgctaatttaaaagttggttataacaaagcctttggttattatttaagtctaccccgcagtaaatcggaacaggccccagacaattacattcgcaaacaaactttagtcaatgaagaaagatacattacaccggaattaaaagagcgggaaacccgtattctcaccgcccaagctgacttgaatcaattggagtatgaaatttttaccgaagtgcgggccacagtagcagaaaaagcccaaccaattcgggacgtggccaaggccgtagcggcgatcgatgtgttggcaggtctagcggaagtggcagtttatcagggttattgccgtcccattatgcaaatggaaccaggcttaattgacattgaagcaggtcgccatccagtggtggaacaatcccttggggcaggtttttttgttgctaacgacacccaattgggccacgaccattggcatcctgatttagtaattttgacggggcccaacgccagtggcaaaagttgttatttgcgtcaagttggcttaatacagttaatggcccaaaccggcagctttattcctgctaaaaccgcgaccctgagcatttgtgaccgtatttttaccagagtaggggccgtggatgatctagctacggggcagtctacttttatggtggaaatgaatgaaactgccaatattcttaaccatgccacggctaaatccctggtattactggatgaaattggccggggcacggccacctttgacggtttggcgatcgcctggtcggtggcggagtatctagcgggggaaatccaagcccggacaatttttgctacccattaccatgagttaaacgagttggcttctttactggaaaatgtggctaactttcaagttacggtgaaagaattgccagaggaaattatctttttacaccaagtaacaccggggggagccgataaatcctatggcattgaagcgggacgtttagcgggattgcctagttcagtgattaccagggcccgccaggtaatggcccagattgaaaagcatagtaaaattgctgtcggtttacgtaagggtaatcggggtaaagttatggctagtcaagcggctgctgaagcagcggaagatcaagctaaacagttagatatttttggcttttag

SEQ ID NO: 26397 - DNA, 816 bp, Synechocystis sp.
atgactaatttgtccggttcaatgcccagctccacagcagcggatttacagcctgccctcagggttgaaggtttgggattttattacggcaccaaaaaagtgttagagggggtaaccatggcaatccccgttggtaaggtcactgccatgattggcccttctggttgtggtaaatcaactttgctcaaagcttttaaccgcattgccgaactggagggacgggtgaaagtaaccgggaaaatcgaatttttcggacaaaatatttacgatcaaaaggtcaatattaatagcctgcgtcgggaaattggcatggtctttcagcgccccaatcctttccccaccagcatttacgacaacattgtctatggggttaaactttgttgcaatgtgagccgggccgaattggatgaaattgtcgaacgttccctcactagggcagtgttgtgggatgaagtcaaggatagtttgaaaaaatctgctttgggtttatcggggggacaacagcaacgcctatgtattgccagggcgttagcggtcaatcccaaggtgttgttaatggatgaaccctgttctgctctcgatcctatttctactctgaaaattgaggaattaatcaatagtctgcgggaaaatgtgaccatcaccattgtgacccacaatatgcaacaggccctgagggtgtctgactacacagcgtttttcaataccgatgaaagccgtatcggtcagttagtagaattcgacaccacccagaatattttctctagtccccaggaaacccaaaccagggattatgtggctggtcgctttggctag

SEQ ID NO: 26398 - DNA, 699 bp, Synechocystis sp.
atgctgtttcgtcaattgtttgatccggaaacctccacttacacctacgtaattgctgaccccaagggtcggtctgcggccttggtagattctgttttagaacaagtggatagggatctaaacttgctcaaagaattggatctcaagttaactttttgtctggaaacccacgtccatgccgaccatatcaccggagcgggaaaactacggcaattaacaggttgtcaaaacctcgtaccccagtatgctgaggtggactgtgctgaccgccatttgcaggacggggaaattgttcatgttggctccatacccatccaggcgatcgccactccggggcacaccgatagccatttagcttttttggtcaatcaaacccatgtgttgacgggggatgctctgctcatccggggctgtggccggacggatttccaaagtggagatgccggtacgttgtatgacgctatccacggtaaattattcaccctgccggaggatgtttttgtctatccgggccatgactaccggggccacaccgtttccactattggggaagaaaaacgttttaacccccgcttattagggcgcgatcgccagaactttatcgaatttatggatagtttaaatctgcctgatccaaagaaaattatggaagcggtgcccgccaatcaactctgtggtcaaaggactgttgcggtttaa

SEQ ID NO: 26399 - DNA, 1104 bp, Synechocystis sp.
atgggagaagctttaaacaaagggatttattgcccctttgatcgtaattgcgcaatggtgtctatccgtccgtccgtccgtcatacccccgcctatgtgcctggggaacagccccaaaccaacgattttatcaagctcaacaccaacgaaaatccctacgatcctcccgcccaggtgttggcagcggtggcagcggagttaccaaaagtaaggctttaccctgatcccgtttcgacccagttacgtcaagcagcggcggatttgtatggagtggatttaaatcaggttttagcaggcaatggctccgacgatattctcaatattgtggtgcgtacctttgtcgatccaggggaaactgttgcctttttagatcttacttactccctatatgaaacgatcgcctcagtccatggggctaaggtacaaaaaattgccaccgatgccaattttgatttaaccgggccggtgatttgtccagaggcaaaactgattttcctcgcttcccccaatccccccaaaggcaagcatttaaatcgagaattcctttggcagacctgcgcccaggcggagggagtagtggtcattgacgaagcctacggggatttttccgacgaggaccattgggactttctgcaagagtttgacaatgtgattatttcccgtaccctttccaagagttatagcctggcggggatgcgggtgggtttggcgatcgccgctccggccttgattgaagaaatggataaggtgcgggattcctacaacttggatcgtttggcccaggtattgggcaccgccgctttacggaaccaggctgaatttgtgcccctctgggaaaaggtacgccacactcgcacccgtttaatggagcaattggcggagttagatttccaggtatgtccctcggatgccaattttgtgtttgccgctccccgttggatggccgccgctgacctgtaccaagccttaaaggaaaagaaaattctggtgcgttactttaaccatccccgcattaccgattatctccgcattaccgtgggtactgacggggaaattgatcaactactgttggcgatcgccagtttgaaagggtctttgggatag

SEQ ID NO: 26400 - DNA, 2697 bp, Synechocystis sp.
atgtccaaactcgttatcgttgaatcccccactaaagcccgcactatccgcaactatctgccccaggattatcgggtggaagcttccatgggccatgtccgggatttaccggcttcggcggaggaagtacccgcggcttacaaagataaaagttgggctaatttgggagtcaatgtggaagaccatttcagtcccctttatgtgattcccaaaagcaaaaagaaagtagttaaggaattgcaaactgccctgaaaaatgccgacgaagtaattctggccacggacgaagaccgggaaggagaaagtattagctggcatttgttgcaactgctccagcccaaagtgcccattaaacggatggtgttccacgaaattacccaggaagccattcgcagtgcgctggagaattgccgcgatattgacgagaatttagtccatgcccaggaaacccgccgcattttagaccgtttggtgggctataccctttcccctttgctctggaaaaaaattgcttggggactatccgctggccgggtgcagtcggtggcggtgcggttgattgtgcagcgggaacgggcccgccgggcctttaagaccgctggttactgggacttaaaagcagaactggaacagaataaaaatccttttcaggccaagttgatgaccttggggggcactaaattagccaatggtagcgattttgatcccaatactggtgcgttgttgcccgataaacaggtggtggtgctggatgaagcccaggcgatcgccctgaaggagcgtttaaccggcaagccctgggcagtggtcaataccgaagaaaagcccggtgtccgtaaaccgtctcccccctttaccacttccaccctgcaacaggaagccaaccgcaagttaggcatttccgcccgggatacgatgcgagtggcccaaaaactctacgaagagggttacatcacctatatgcggacggattcggtgcatctttctgaccaagcggtgacggcggcccgcaattgcgtgcaacaaatgtacggcaaagaatacctgagtccccagcccaagcagtacaccaccaaaagtaaaggggcccaggaagcccacgaagccattcgccccgctgggacagagtttcgcattcccaatcaaacagggttaaaagaccgggaattggccttatatgagttgatctggaaacggacggtggcctgccagatggccgatgcccgcattacccaactgagtgtgctgttaaaagtggaagatgcggaatttcgcgcggcgggtaaacgcattgatttccccggttatttccgggcctacgtggaagggtctgatgatcccgatgccgctctggaaaaccaagaagtgattctgccccccctcaaagttggcgatcgcccgaattgccgagaaattgataccgtgggccacgaaacccaaccccccgcccgctatacggaagcttcgttggtgaaaacgctggaaagtgaaggggtaggccgccctagtacctatgccagcattattggcaccattatcgaccggggttatgtgcaaatgcggagcaaagctttgacccccaccttcactgcctttgcggtggtgagtttactggaatcccatttccccgacttagtggatacgggtttcacttcccgcatggagcagaagttagacgaaattgccatcggtaaaacccagtggctcccctatttacagggctttttcctgggggaatcggggctagaaaaccaagtcaaagtgcgccaagaccagatcgacccggcgatcgccaaggccattgagctggaaaacctggccgctaaggtgaaaattggcaagtttggcccctatatcgaaattccccagggggaagaaattattaccgcttccattcctcaggatctaactccggcagacctcaaccccgaacaggtggccgtgttgctcaagcaaaaaacggagggccccgataaagtcggtatccatcctgaaaccggggaaccaattttcatcctcattggagcctatggcccctacgtccagctaggggaagcaacggaggaaaataagaaaccgaaacgcacttccctgcccaagggggttaaaccggaggatgtcaccctggaaatggcagtgggattgttggccctgccccgtaatttgggagaacatccggaatcgggcaaaaatattaaagccagtctgggtcggtttggcccctacgtagtccatgaccaaggtaaggatggcaaggattatcgttccctcaaaggggatgatgatgtgttgaccatcaccctggaacgggctttggagttgttggcggaaccaaaacggggccggggcagccgcactcccctcaaacaattgggcttacatcccgaagaccaggagccggttaatttgttcaaaggcccctatggggtttacatcaaacatggcaaagttaatgccagcttgccggagggggaaacggaagaaaccattaccctagaaaaagctttacccctgttggcggaaaaggccggcagcggtaaaaaaactagccgtaaaaaagccaccaccacagcgaagggcactaagaaaaccacttctaaaaaagctagtgccactggtacggccaagaagaccaccactaaacgcaccacccggaaaaaagctgccagtccagaccagtccagcgaggctggttaa

SEQ ID NO: 26401 - DNA, 1230 bp, Synechocystis sp.
atggccgcccatcccaacccatggcattggaaaacaattatgcgtgatgtttttattgttgccgctaaacgaactcccctgggacgttttggtggctccctgaccaatttttcggcggcggatttgggagcccatgtgatgaaaagcgtcctagcccaggccggggtggggggagaccagcttgacctgtacattatgggcaacgtgttaagggctggccatgggcaattgattccccggcaagcggccttgaaggcggagattcccgatacggtggacggttatgcagtggatatggtctgctcttccgccatgatgagtgtgattaatgcagctttaaccatccgggctggggagggggatttaattttagctggagggacggaatccatgtcccaaactggtttttacctttcccaccgggcccgctggggctacaagttcctcatgggagcaccggaaaatttaaccgatctcctgctccatgatggtttgacggacagcaccaatggggagggcatgggggaacagacggaaaaattggccgcagagcatggtttcagccggatagaattggacgaagtggcctgcttatcgcaacaaagggcggcccacgccacggaatctggttattttgactcagaaattgccccgattgaaatcaccagtcggaaaggaacccaggtgttagccagtgatgaaggtattcgcagtgacaccaccgtggaaagtctaggcaaattgcgctcggcctttgccaaggacggagtgttaacagcgggcaactgtagtcagattaccgatggggcggcagctttgctcctggccagtggggaagcggtggaaaaatatcaactcaaacccttggcaaaaattttgggaggcagttgggcggcgggtactcccagtcgttttcctgagttgcctattaccgctagccagaaactgttagcaaagctagataaaaccctggcagattttgacttgtttgaaaataatgaagccttctccgtcagcaatcttttatttgagcggcggttgggggtggatcgggacaagttgaatgtgaacggtggggcgatcgccctggggcatcccattggagcgtcgggggccaggatcatggttaccctactctatgccttgcaacaacgggataaaactctggggttagcagccctttgccatggcacggggggcggtacggcgatcgccttagagcgggtgtga

SEQ ID NO: 26402 - DNA, 723 bp, Synechocystis sp.
atgttaagtcttggtttggaagataaagtaatcgtggtcaccggcggcaatcggggcatcggcgcggcgatcgtgaaattactccaggaaatgggggccaaagtagcttttaccgatttagctacggacgggggtaatactgaagccctgggggtggtggccaacgtcaccgatttggaatccatgacggcggcggcagcggaaatcaccgataagctgggccccgtttacggtgtggtggccaatgccggtatcaccaaagacaactttttcccaaaattaacccccgccgattgggatgcagtgttgaacgttaacttgaaaggggtagcctacagcattaagcctttcatcgaaggcatgtatgaacggaaagccggctccattgtggccattagttccatctccggggagcggggtaacgtcggtcaaactaactattccgccactaaagctggggtaattggcatgatgaaatccctggctcgggaaggggcccggtatggagtgcgggccaatgcagtagcccctggtttcattgacaccgaaatgactttggcgatccgggaagatattcgggaaaaaattaccaaggaaatccccttccgccgttttggtaaaccggaggaaattgcctgggcggtggcctttttactttcccccgtagccagtagctatgtcaccggcgaagtattacgggtaaatggggcccaccacacctaa

SEQ ID NO: 26403 - DNA, 3045 bp, Synechocystis sp.
atgtccccatcccagccccacccacccattgctacttttgagccggagagttttctcattctggtggtggatgacgtaaaagagaatatttatgtgatttcggaactgttggaaggggaaggttacagcactacttttgtgacctccgggccggaagctttgcaacgggtgacccaggcccaaccggatctcattctgctggatttgatgatgcccggcatggatgggctggaggtgtgcgatcgccttaaacaagatccccaaaccagggatattccggtaatttttctcactgctagcaacgaaaaacaagatttgctgcaagcctttgccaagggggcagtggactatgtcaccaaaccctttagcccgccggaactgttggctagggtaaaaacccacctggaactgaaacaaaccagggataatctacaccacactctcctggaacaggccaggaccgccgaagccctggcctgtacttccacccgcctgggtatcctggtgcaaaatatgcaagcaggggtgttgatgaccgacgcccagggcaccattgtggtggtcaatcccgaatttgcccggctgtttaatctgggttttcccgccgaccttctgctgggcaaaaatttaacggcgatcgccccccgcattaatggcttgatatcccatggccagggggtaacccacaactttttggcgatcgagtccccggaacccctgctaaaagtggaacttgccctagaggatgggcgcttttttgagcgagattatgtgccgatcatgttgggggatagctcccagggtcatttttggctttaccgggacatcagccaacgtaaacaggtggaaatgattcagggacagtccctggaaatggaacggcgcatgcggcaacaattggccgaacaaaatcaggaattggtggcggccaccacggcggcggaggcagctaatcggtctaaaagtgaatttttggccaccatgagccacgaaattcgcacccccatgaatgccatcatcggcatgaccggattattactagacacggacctaaccactcaacaaaaatatttcgcccaaaccatccgcaacagcggggaaaccctgctcaccttaattaacgatattttagatttttccaagattgaggccggcaaattagacctggaagtgtatccctttgatttggggcaatgcctggaggaagccttggacgtggtggtgccgagcgcccggcaaaaatccctcactctgatccgacgttttctcacccccattccccccaacctccagggggatgtgactcgcctcaggcaaattttggttaatctcctcagcaatgcggtcaaattcaccgaggcaggacaggtcaaggtgacggtggaagtggtggaccacgacgcagctaagggggaatatcaaatctgttttgcggtgcaggatacgggcattggcattgctcctaaccaacaacaggctttgttccaggcctttagccagggcaattcttccattacccgtcgctttggcggcactgggttaggcttggccatttgtgtgcggttgactgctttgatggggggcaccatctgggctgaaagtaatggctgtgtggtgggaaatccccctgaactttggcagatagggcaaccgacgatcgagggttcgactttctatttcacagtcaatttaacggtgctgcccagttgtgcctattctgtccataatttgcgccactccctcttcattgggcgatcagtgttagtggcagattacgatgagggccggggcaccagaatgcgaaatcttttggccagttggcgtctccaagcggagcaaattaccttttcctcccccgctaaactaggggaagatctcaaaagcagattaactcaaaaaaactatggtgccctcatcctccattgcccctatccagagggccggggaaagcagttcaccgattttgacttagggaaaattacaacctgggcccctacggaacaggacattccagtgttagtagccacggatatttatctatccccaggggagcgctacagcggcgacaaaccaccggtgcaagcctggatcaagagtcccattaaccccgatgagcttgaaaataccttggtggacgtgttggggcaaactgagcccccgaccctggtgtctacggaggcaattagcgggcctttgtttccctattcctcctctaatttaactattttgttggcggaggataacctaatcaatcagcaggtagctaagcttttactgaaaaagttggggtacccagtggatgtggtcaataacggtcaagaagctttatcggctttggcaaaaggtgattatgacgtggtgttgatggatgtggaaatgccagaaatggacggtttaaccgccacggagcatattcgacggtcccagggccggagtgaaaggccttggatcattgcggtgacagcctattccatggaaggcgatcgggaaaggtgtttggccagcggcatgaatgattatgtcagtaagcccattcgcctagaagccttacaacaggccctacaagtggccgccactgcgctccagtccaccagccaagatcggatggctactgtttcctgtgttagtgcttttgaggctaaaccatccccttctagtccctgcccagaagatccggctggcacaactttaccccccattgaccaagacataatctgttctctacgggacttggatcgagagaatggtcagttaattcttcgggagattatcgatatctattgccaaacggcgccggaactattgcaacggatcaaactggcgatcgccaatcaagattggggaaatttgagttcggccgcccatacattgggttctagcagtgctaatttaggggcggtactcctggcacaacaggctaaaactttggaaaatctgacccgccaacgggactcccgggccatggacccagggcatttcccgaccttagcggccagctacgaaagggtgcagggagaactgaaaactatgcttgatcgcctctag

SEQ ID NO: 26404 - DNA, 1278 bp, Synechocystis sp.
atggaagagtttgcagtggtgataattggggcggggccggccgggggccaatgtgcccgacagttggcccaacaaggtgtccgagtcctgctagtggagcaacattcaaattttagccaaaataattactccagcgcggctagtcctttggaaaccatggcattgttcgatctgcccccgggggtggtggcccgttattggcgcaatttggcgatcgccgccacggaaaaggaacaaatatggtacagcgatcaaccccggggtgtggtgttcgattttgctaaattgcgacaatttttagcggatacggtcacgaaagcaggggggcaagtgtggttggggcaccgcttttggggttaccagcaagttggtgatggtttggaggttaccctgcggcgatctagtaaaaattccctaagtagtgactcagtggagaaagtcgaaaaagttacagtaaaaactcaggtactcattgatgcaacggggtcaaaacgggcagtgattaattgtgggcaacccaaagcgacggataacaaccaatattatcggggcattggtacggaatatttgattacagtagatgaaaccacccaccaacgttttgcggataccctagtttttttcctcggttaccgttggagtccccagggttattcctggatttttcccatggataatcaccagttaaaggtagggacagcaatttttgccgggcaacaccgttatttgggcgaattgaagccgctccgttcctacactgaagctattatccgggattatttaaaactggaaaaatcccaataccatctggaggaaattcacggctctgtgctggactatgccgttaaccagggggatacataccatcggggctccgtgctggcgatcggtgatgcggtatcaacggtgaactttttagggggggaaggcatccgccatggtatgcagggagccaatattgccgttccttttgtggcggattatctccggggtcatgtacaagcttttgaaaaatatgaacaggccatgaaagcccattttgctgaaccctggcaacggacagaaaaattaagccaacgggtttacctcgaattcggcgatcgccagattgatttgggggtgacctacttgagttacctccgctatgatgacgtgctggatctccttttccattaccgatttgataggatctatgggggcattactcccctgttgctcaaaaaagttgcccaatttagccagcagtgccgccaatggctcagaaaactctcaccatga

SEQ ID NO: 26405 - DNA, 2718 bp, Synechocystis sp.
atggatttccccaccttaagttcttacctccatcaccatcgaccaggggaagacattcttgcagatttgcacaccgatccaggtttaggtctgacagcggaggcggtggcccagcgttacgaacaatatggccgcaacgaattgaaatttaaaccgggcaaaccagcttggttgcgttttctgctgcaatttcaccaacctctgctctacattctgctcattgctggtacggttaaggcttttctcggctcctggaccaacgcctgggttatttggggagttaccctagtcaacgccatcattggttacatccaagaagcgaaagcagaaggggcgatcgcctccttggccaaggcagtaacaacagaagccacagtgttgagagatgggcaaaatctacggattccttcccaggatttagtcatcggtgacattgtttccctcgcttcgggggataaggtgccagcggatctaaggctgttaaaagtgcgtaatctccaggtggatgagtcggctttgacgggggaagcagtgccggtggaaaaggcggtggaacttttaccggaggaaacgcccctggccgaaaggttaaacatggcctatgcggggagctttgtcacctttggtcagggaaccggggtggtagtagctactgccaatgccacggaaatggggcaaatttcccaatccatggaaaagcaggtcagcctcatgacccctttgacccgtaagtttgccaaatttagccacacactgctctacgtaattgttaccctggcggccttcacctttgcggtgggttggggacggggtggttcccctttggaaatgtttgaagcggcggtggccttggccgttagtgccattcccgaaggtttgcctgctgtggtgaccgtcaccttggcgatcggggtgaatcgcatggctaaacgtaacgccattatccgtaaactgcccgctgtggaggcgttgggtagtgccacggtggtttgctccgataaaactgggaccctaacggagaatcagatgacagtgcaagcggtgtatgcggggggcaaacattacgaagttagcggcggtggttacagtcccaaaggagaattttggcaagtgatgggagaagaagtggataacgttttgttggatggtttacccccagtgttggaagaatgtttgctgacgggcatgctctgtaacgattcccaactggaacatcggggggatgattgggcggtggtgggggatcccacggagggagcactgctagcttcggcggccaaggctggtttcagtcaagccggtttggcaagtcaaaaaccccgtttagattccattccctttgaatcggattatcaatacatggcaactctccacgatggggacggcagaacaatttacgtcaaaggttcagtggagtccttactacaacggtgtgaatccatgctcctcgatgatggtcaaatggttagcatcgaccgaggggaaattgaggaaaatgttgaggatatggcccaacagggtctaagagtgttggcctttgctaaaaaaaccgtggagccccatcaccatgcgattgaccacggggatattgaaacagggctaatatttttaggtttacagggcatgatcgacccgccacgaccggaggccattgccgcagtccacgcctgccatgacgctggcattgaagtgaaaatgatcaccggcgaccacatcagcaccgctcaggcgatcgccaaacggatgggtattgccgctgaaggggatggcattgcttttgaaggacgacagttggcaaccatgggtccggcagaattggcccaagccgctgaagatagttgcgtgtttgccagggtagctccagcacaaaaattacaactggtggaagctctacaggagaagggtcacattgtcgccatgacgggggatggggtgaacgatgccccagctttaaaacgggctgacattggcattgccatgggtaaagggggcacagaggtggctagggaatcctccgatatgttgctcacggacgataattttgcctccattgaagcggcggtggaagaaggacgcaccgtttaccaaaatctccgtaaggcgatcgcctttttgctgccggttaatggcggggagtccatgaccattttgatcagcgttttactggcgttgaatttgcccattctttccctgcaggtgttgtggttaaacatgatcaactccatcaccatgactgtgcccctagcctttgaagccaaatcaccgggcattatgcaacaggctccccgcaatcccaacgaacccctaattaccaaaaagttactgcaccgcattttactggtatccctgttcaattggattctaatttttggcatgttcgagtgggttaatcgcacctatgacgacttagccctagctcgtactatggccatccaagccctggtggccgctagggtgatttatctactcagcattagccagttagggcgtagttttctgggctatgtgacgggtaaacgtcaaaccattaccaaagcctccatactgttactgggcattgcggtggcgatcgccttacaaattggtttcagtcaactgccatttatgaatgtattgttcaaaactgctcccatggactggcaacagtgggcaatctgtttactacctatgattcccatggtgcccgtggccattctggctaaccgccttgatccttaa

SEQ ID NO: 26406 - DNA, 501 bp, Synechocystis sp.
atggcaatgtcaactccggaggtgactcccactttaagcgatagtaatggcaatgaagccggtgtccaaacccaatttactatccaggaaattagtgatttactgccccaccgttaccccttcgccttggtggaccgcatcattgattttcaaccgggtaaatgcgccgttggcctaaagaatgtcaccatcaacgaaccgttttttcccggccatattcccgatcgcccgattatgccgggggtgttaattgtggaatccatggcccaggtggggggagtgattttgacccaactgccggggatgcggggtaaattcttcgcctttgctggcattgatggggtgcggttccggcggccagtggtgcctggggatcagctaattatgacagtggaattacaatcctttaaactgcaacgcattgccaaaatgcaaggggaagctagggtcgatggacaactggtttgtgggggggaaatgctcttttccctaattgattag

SEQ ID NO: 26407 - DNA, 783 bp, Synechocystis sp.
atggcagccaccctatctcgtcttgatatatccgtcgatggtgtcagcgttacctataacaacgcccgtttggccctttataacgctacctgcaccgttgaacccggcaccattaccgccctggtggggcccaatggcagtggtaaatcgactctgttcaaatccatcatggggtttttgcaaccgagtcagggacgggtacgcattggtggcttttccgtacaaaaggcccaaaagcaacagttgatggcctacgttccccaagctgatgaggtggactggaactttccggtcagtgtgtttgatgtggtgatgatggggcgctatggctatatgaatgtgttgcgtattcctagcgccaaagaccgtcgtttggtgatggaaagtctagagcgggtgggcatggtgaaataccgcgatcgccaaattggggaactttccggcggtcaaaagaagcgggcatttttggcccgggccttggcccaggaaggcaaggtaattctgttagatgagccttttaccggggttgatgtgaaaacagaaaaaggcatgattgatttactcatggaactgcgggatgaggggcacaccattctgatttctacccatgatttggcctccatttccaccttttgtgaccacaccattctgctcaaccgcactattttggcccagggtaaaactgaagaaaccttcaccaaagaaaatttggaactgacttttggtgggctaccaatgctgagtctgaatcagatgtttgaatcgacagaggtagatgcgtga

SEQ ID NO: 26408 - DNA, 2265 bp, Synechocystis sp.
atgggcacccaacccgccaggaaattaagaaacagagttttcccccacccacacaaccatcgtaaggaaaaacccatggctaatgatcaggtaccggccagtaaatgtcctgtaatgcacggagcaaatacaaccgggcagaacggcaatctcaactggtggcccaatgcgctgaatctagacatattgcatcagcatgaccgtaaaacaaatcctatggacgatgggtttaactatgccgaagcgtttcaacaactggatttagctgctgttaaacaagacctacaccatttgatgaccgatagccaaagttggtggcccgccgactggggtcattatggtggattaatgattcgtatggcctggcacgctgctggcacttatcgcattgccgatggtcggggtggggccgccactggcaaccaacgcttcgcccccctgaatagctggccagataacgtcaatttagacaaagcccgccgcctactctggccgatcaaaaagaaatatggcaataaactttcctggggagatttgatcattttggctggcaccatggcctatgagtcgatggggctcaaggtttacggttttgccggtggtcgggaagacatttggcacccggaaaaggacatttactggggagcagaaaaggaatggcttgcttccagtgaccatcgctacggcagtgaagaccgggaaagcttagaaaatcccttggccgccgtacaaatgggattaatttacgttaaccctgagggggtggatgggcacccggatcctttatgcacagcccaggacgtccgcactacctttgcccgcatggccatgaatgacgaggaaaccgttgcccttaccgctggggggcacaccgtagggaaatgccatggcaacagtaaagctgagcttatagggccagaaccagagggagctgatgtggtggagcagggcttgggttggcacaaccaaaacggcaaaggtgtggggcgggaaactatgtccagtggcattgaaggggcttggaccacccaccctacccagtgggacaacggttatttttatatgttgttcaaccacgaatgggaactgaagaaaagtcctgccggggcttggcaatgggaaccggtcaatattaaagaggaagataaacccgtcgatgtggaggacccgaatattcgccacaatcccatcatgaccgatgccgatatggccatgattaaggaccccatctaccgacaaatttccgagcgtttctatcgggagccggattattttgcggaagtatttgccaaggcctggtttaaactaactcacagggatctaggaccaaagagccgttaccttggccccgatgtgccccaggaagatttaatttggcaagaccccattcccccagtggattacaccctttctgaaggggaaattaaggagcttgaacaacaaattttagcctccggcctcaccgtttccgaactagtctgcactgcctgggatagtgcccgcaccttccgtagctccgactatcgagggggagccaatggagcccggattcgtttagaaccccaaaagaattggcccggtaatgaaccaactcgattggcaaaagtcttggcggtgctggaaaatatccaagctaattttgctaagccggtcagtctagcggacttaattgtgctaggagggggagcggcgatcgccaaagcggcccttgatggggggatcgaggttaatgtaccttttctgcccggtcgaggggatgccacccaagccatgaccgatgcagaatcctttactccgttggaaccgatccacgatggttatcgtaactggctaaaacaggattacgctgtgtccccggaggaattgctgttggagcgaacccaattaatgggactaacggcaccggaaatgactgttttaatcggtggtatgcgggtgttgggtactaaccatggcgggactaagcatggagtctttaccgatcgggtgggagtactcagtaacgacttctttgttaatttgactgatatggcctaccaatggcggccagcgggcaacaatctctacgaaattggcgatcgccaaacaggggaagtgaaatggactgccaccaaagtagacctggtgtttggttccaactccatcctacgctcctacgcagaagtgtatgcccaggacgacaatcgggaaaaatttgtccgtgattttgtggccgcctggactaaagtgatgaatgccgaccggtttgatctccctaggggctag

SEQ ID NO: 26409 - DNA, 1866 bp, Synechocystis sp.
gtggttgcatcaattcctaatcccaaaacaaatttcctgaaaactgttcctagccaacggcaaaccggggcttatatcctgatggatagcctgaaacgccatggggtcaaacacatttttggctatcccggcggggcaattttgcccatctatgatgaactgtaccgctttgaagcggcgggggaaattgagcatattttggtgcgccatgaacaaggagcttcccatgcggcggatgggtatgccagagccacaggtaaagtgggagtttgtttcggtacatctggaccaggggcgactaacttggtgaccggcattgccaatgcccatttggactcggtgcccatggtggtgattactggacaggtgggccgtgccatgattggtagcgatgctttccaggaaattgacatttttggcatcaccttaccgatcgttaagcactcctatgtggtacgtagtgcggcggatatggctcgcattgttactgaggctttccatcttgctagcaccggtcgtcccgggccggttttgatcgatattcccaaggatgtgggcttagaagaatgtgagtacattcccctcgaccccggtgacgttaatctaccgggttatcgccccacggttaaaggtaatccccgacaaattaatgcggcattgcaattgttggagcaggccagaaatcccttgctctacgtagggggaggggcgatcgccgccaatgcccatgcccaggtgcaggaatttgcggaaaggttccagttgccggtaacaaccaccctgatgggaattggggcttttgacgaaaaccatcccctttcggtgggtatgttgggtatgcatggcaccgcctatgccaactttgccgtcagcgaatgtgatttgttgattgcggtgggggcccgtttcgacgaccgggtaactggcaaactagacgaatttgctagccgcgccaaagtaattcacattgacatcgacccggcggaggtgggaaaaaacagggctcccgatgtgcccattgtgggggatgtacgccatgttttagaacagcttttgcagcgggcccgggaattggattaccccacccatccccataccacccaggcatggttaaatcgcattgatcattggcggaccgattaccccctccaggtgccccactatgaggatactattgccccccaggaggtagtacacgaaattggtcgccaggcccccgatgcctactacaccaccgatgtgggacaacaccaaatgtgggcggcccagtttttgaacaatggcccccgccgatggatttccagtgctggcttgggtacgatgggctttggtttacctgccgccatgggagccaaagtgggagtgggggacgaagcggtcatttgcatcagtggagatgccagcttccaaatgaatcttcaggaactgggaaccctagcccagtacgacatccaggttaaaactattattctcaataacggttggcaggggatggtgcgtcagtggcaacaaactttctacgaagaacgttattctgcttctaacatgtcccagggcatgccagacattaatctcctctgtgaagcctatggcatcaagggtattactgtgcgcaagcgggaagatttggccccggcgatcgccgaaatgctagcccacaatggtcctgtggtgatggatgtggtggtcaaaaaagatgaaaactgttaccctatgattgcccccggcatgagtaatgcccaaatgctaggtttaccggaagtgccggtacgggacaatggtccccggatggtggagtgcaaccattgccaaacccaaaatttcatcacccatcgtttctgttctggttgtggagccaaactctaa

SEQ ID NO: 26410 - DNA, 1944 bp, Synechocystis sp.
atggttattgccgcctctccctccgttccttgtcctagcaccgagcaggtgcgccaggcgatcgccgctagtcgggacttcctgctatcggaacaatatgccgatggctactggtggtctgagttggaatccaatgtcaccatcactgccgaagtggtcatactgcacaaaatttggggcacagcggcccaaagacccctggagaaggcgaagaattacctgttgcaacaacaacgggaccatggcggttgggaactgtactatggtgatggcggtgaactaagtaccagtgtggaagcctacactgccctgcgaattttgggggttccagccaccgatcctgccttggtcaaagcgaaaaatttcattgtcggccgggggggcattagcaaatcccgcatttttaccaaaatgcatctggcgttaatcggttgctacgactggcggggtactccttccattcccccctgggtgatgcttttgcccaacaattttttctttaacatttacgaaatgtccagttgggcccgttctagtacggtccccctgatgattgtttgtgaccaaaagcccgtttacgacattgcccagggtctgcgggtggacgaactctatgcggaagggatggaaaatgtccagtataaattgccggagagtggcactatttgggatattttcatcggtttggatagcctatttaagctacaggaacaagccaaggtagtacctttccgagaacagggtttggccctggcggaaaagtggattttagaacgacaagaagtcagtggcgattggggcggcattattcccgctatgctgaattccctgctggcgttgaaagtgttgggctatgacgttaacgatctctatgtgcaaaggggcctagcggcgatcgataatttcgcggtggaaacggaagatagctatgccattcaagcctgtgtttcccctgtgtgggatacggcctgggttgtgcgggctttggcggaagcggatctaggtaaggatcatcccgccttggttaaagcggggcaatggttgttggataaacaaattctcacctacggcgattggcagatcaaaaatccccacggtgaaccgggagcttgggcgtttgaatttgataataatttctaccctgacattgacgacacctgcgtggtgatgatggcgttacagggcattaccctccccgatgaggaacgtaaacagggggccattaataaggccttgcagtggatagccaccatgcaatgtaaaaccggaggctgggccgcctttgacattgacaatgaccaagattggcttaaccagttaccctacggtgatttgaaagccatgattgaccccagcaccgccgatattaccgcccgggtggttgaaatgctgggagcctgtggtttgaccatggattccccacgagtggaacggggtttgacctatttactccaagaacaggaacaggatggtagttggttcggccgctggggcgtgaattatctctatggcaccagcggggccctttctgccctagccatttacgatgcccaacgttttgccccccaaatcaaaacggcgatcgcctggttgttgagctgtcaaaatgcggatgggggttggggagaaacctgtgaaagttataaaaacaagcagttaaagggtcaaggtaacagcactgcttcccaaacagcctgggccctaattggtttgttagatgccctcaaatatttacccagcctgggacaagatgccaaactaaccacggcgatcgaggggggcgtggcttttcttgtccagggacaaacccccaagggcacctgggaagaagcagaatataccggcaccggttttccctgtcacttttatatccgctatcactactaccgccaatattttcccctcattgccctagctcgttatagccatttacaagcatcttaa

SEQ ID NO: 26411 - DNA, 519 bp, Synechocystis sp.
atggatttaaaagctttaattcgggatataccggacttccccaagccaggcattatgtttagggatataaccaccctgctcaatagtccggagggactgcgctacaccatcgactccctggtggaacaatgtgaaagccaggaacttgtgccggaccatgtggtgggcatggaatcccgggggtttttatttggcatgccccttgcctatcaaatgaatgccggttttatccctgtacgaaaaccaggcaaattaccagccccagtccaccgagttgagtatgatttagagtacggtaaagactctttagaaatccatcaggatgcggtagctccccaccatcgggtgttaattgtggacgacttaatcgctacggggggaaccgccaaggccactgctgaattgttaactaagcttggctgtgaggtgttaggttttgcttttatcattgagcttgcggccctcaatggccgtcaatgtttaccggatttaccaattatttccctggtggaatattaa

SEQ ID NO: 26412 - DNA, 993 bp, Synechocystis sp.
atgacaattagcaccacagatacttccctaattatttggccggccatgggttgtggcacctgggcttggggtaacaaattgctctggggttaccagcctgctatgaatggagaactggaacgggtgtttagggaatgtgtggcggcgggaataactttttttgacactggagattcctatggcaccggccgactccaaggacaaagtgaaaaactgttggggcaattttcccaagcctatgaaggactaaatcaagacaaaatttgcctggccaccaaattagctccctacccgtggcgactcactccccaagctatggttggggccggcatggcttcccagcaacgactacagcgaccaattgatctcgtccaactccattggtccacggccaactatgctccctggcaagaacaacctttgctcaagggtttagtccaactttgccaacggggccacgctaaggctttaggtttatccaacttcggtcccaagcgtctgcaaaaggcctatgacttttgtcagaatgagggagttagcattgtcagtctgcaggtgcaatattccttgctttccaccgatcccgtcagcaaattaggcttgaaggaactctgtgagcaattgggcatcaaattaattgcctatagtcccctgaccctggggctgttgaccggtaaatatggtccccaaggaccttttcctccaggtatccgtggcctattgttccggcgactattacccaaaattcagcctcttttggatactctccaggcgatcgccagggagcgggaaaaaaccatggcccaggtagccttgaactggtgtatatgccaggggactatgcccattccaggggcaaaaaactgccaacaggtacaggacaatctgggagcgctgggttggcaactggatcggggggagatggacgagttgaacaatcaggcagcggccttaccccaaaccatggtgcaaaacattttccaaagtcgttag

SEQ ID NO: 26413 - DNA, 864 bp, Synechocystis sp.
atgcgccaacgctacatttgttcggcccaggaaaatttggccagtttgggggtaaaggccggccaaaaagccctggccatggcgggactacaaccggaagacctggatttaattattctggccacctccacccccgatgatttatttggcactgcagcccaaattcaagggggattgggggccaccagagcctttgcctttgacataacggcggcctgttctggttttgtggtggggttgaacgtagcagcccaatttttacgcaccggggtttaccaaagggttttaatagtgggaggggatgtactttcccgttgggtggactggtcggaccgcaccacctgtgtgttattcggtgatggagccggagccgtggtgctacaacgccaagcccaggacaatttgctcgcctttgaaatgtacaccgatggcactggcaatggctgtcttaatttgtcctatcaagcaaaccctcaacctttaacagcagaaaaaaccgttgcccagggcacctatcaagccatcaccatgaacggccgggaagtgtaccgttttgccgtggctaaggtgcccgaaatcatcgaaaaagtactgtttaaagcccagttgaccacctccgacttggactgggtaattcttcaccaagccaatcaacgcattatggatgcggtgggcgatcgcctgggtattccatccgagaaaatcatcagtaatgtaggggaatacggcaacacttcggcagcttccattcccctggctttggatcaagcggtgcgggaagggaaaattaaagagggagacctaatcgccctggccggctttggggccggcttaacctgggctgctagcatagtgcggtggtaa

SEQ ID NO: 26414 - DNA, 1089 bp, Synechocystis sp.
atgtcccagacctataacgtaaccctgctccccggtgatggcattggccccgaaattatggcggtggcggtggcggtgttaggcaaagtggccgaccagtttggctttgcgtttaattttcaagaggctttaattggcggagcggccattgatgccacagggcaacccctaccggaggcaaccctagcccaagcaaaggatagtgatgcggtactcttagcggcgatcgggggttatgcctgggacaatttaccccgttctcaaaggccggaaactggtttgcttgccattcgggaagggttggggctatttgccaatttacgtcctgcgacgatcttcccccaattgattgacgcttccagcctgaaacgggaagtggtggaaggggtggatattatggtggtgcgggaactaaccggcggcatttattttggtaaaccgaagggtattttcgagacggaaacgggggaaaaacggggggtcaataccatggcttacaccgtgggagaaattgaccgcattgctaaggttgcttttgaaacggctcgtaaacgacgcgggcaactctgttcagtggataaggctaacgtattagatgtgtcccaactgtggcgggatcgggtcatggcgatcgccgtagattatcccgatgtggaactgtcccatttatatgtggataatgcggccatgcaattggtgcggagtcccagacaatttgacaccattgtgacgggcaatttatttggtgatattctttccgacattgccgccatgttaaccggcagtattggcatgttaccctccgccagtttgggcagtgatggccctgggttatttgagcccgtccacggttccgccccggatattgccggccaggataaagctaaccccctagcccaggtgctcagtgccgccatgatgttgcgctacggtttggatcaaccccaggcggccgatcgccttgaggatgcagtgaaaaaagttttagaacagggttaccgcaccggtgatattctttctcctggcacacaattggtgggctgtcggcaaatgggagagcaattgttgagcatcctagatgaaatgtaa

SEQ ID NO: 26415 - DNA, 750 bp, Synechocystis sp.
atgaaaccagttgttcttatcaccggtattgctggggggatcggtcaggcgacagccgaactttttgcccaacaaggttggctcgtgacgggaattgatcgtcaagctgacccaaaatgcccttatattgaccactatcaacaagctgattgcggcgatcctaaagcccttgcggctgcctttgacaatttggtcggggaaacccaaaatctccatagtttgattaataatgtcgccctgcaaatttgtcagccaattctcgaaacctccctagacgattgggatcaagtaatggcggttaatctccgggccgcgtttcttttggcaaaaatgtctcacccatatctccaacaaacccacgggagtatcgttaacattagttcagttcatgcgctggcgacctccgccaatattgcttcctatgccgcctctaaaggtgggttaattgccttgacccgagccatggcgatcgaatgggccgctgatcagattcgagttaatgccctattaccgggggccgtaaatacccccatgctgagggagggtttgagtcgtggtcatttggtggaacaatccccccagcatcaactccaagaattagggtctaaaactgtgatgggtcgtgtcgggcaaccgtctgaaatcgctcaggcgatcgcctttttagcggacaatgagcaatctagcttcatgactgggcaaactataactattgacggcggggcgatcgcacgcctcagcaccgagtaa

SEQ ID NO: 26416 - DNA, 984 bp, Synechocystis sp.
atgtttcccaccatccgtccccgtcgcctgcgccaaactgatgttcttcgccgcatggtcagggaaaataccctcaccgtcaatgatttgatctatcccttgtttgccgttcctggtaatgccattgccaaggaagtagtttccatgcctggagtgtaccaactgtcggtggataaaattgttgacgaagctaaagaagtacgggatttaggcattccggccattattctgtttggtattcccgaagataaggataccgatgccacgggagcttggcatgattgcggcattgtccaaaaggcgacggaagcggtgaaaaaagcggtgccagatttggtggtaattgtcgatacctgtttgtgtgaatataccaaccatggccactgtggctatctggaaacgggggatttgaccggccgggtattgaacgaccccaccttggaattgttgaaaaaaaccgctgtttcccaagctaatgctggggcagatgtcattgctccctcggggatgatggatggttttgtccaggcgattcgggaagccttggatgaccatgatttccaaaatattcccattctgtcctacgcggctaagtatgcttcggcctattacggccccttccgggatgcggcggattcctctccccaattcggcgatcgccggacctaccaaatggatccaggcaatagtcgggaagcgttgaaagaagtggagttggatttgctagagggggcggatatggtgatggtcaaaccggctttgtcctatatggatattatttggcgcattaaggaaatgaccaatttaccagtggcggcctataacgtgtctggggagtattccatggtgaaggcggccgccctaaacggttggattgacgaacaaaaagttaccctggaaaccctcaccagctttaaacgggccggggcagatttgattttgacctaccatgctaaggatgcggcccgctggctacaggactag

SEQ ID NO: 26417 - DNA, 1086 bp, Synechocystis sp.
atggccaccactatccccgttcccctgccccagtccccctatcaagtacagattgtgccgggaggattagcggcaattgccgaccatttagctccccttggtttgggcaaaaaaattatggtggtgtccaatccggaaatttatgactactacggcgaagtagtgatccaagccttacaaagggctggctatgaagtttttcagcatttaattcccgctggggaaacccataaaaccctggcttccattaatgagctttacgatgtcgctttccaggccaatttggagcggaattccaccctgctgtccctggggggaggtgtcatcggtgatatgacggggtttggggcggccacttggctccggggcattaattttgttcaggtacccacttccttgctagccatggtggatgcttccattggcggcaaaacgggggtgaaccatccccagggcaaaaatttaattggtgctttttaccagccgcgcttggtgtatattgaccccgttgtgttaaaaaccctaccggaacgggaatttcgggcagggatggcggaggtaattaaatacggagtgatttgggattcagaattattcacagccctagaagaagcggaagatttgtctagcatcgatcgcctgccggacgaattattaaccaaaatcatccaacgttcctgccaagctaaagtggatgtggtcagccaagacgaaaaggaagcgggattacgggccatcctcaactacggtcatactgtcggccatggggtggaaagtctaacgggctatggagtgattaaccacggggaagcagtggccattggcatggaagcggcggccaaaattgcccattacctaggactttgtgaccaatccctcggcgatcgccaacggcaattattgcttaaaactaaattacccacggagatgcccccaaccctggcggtggagaacttgctagcgagtttactacacgacaaaaaagtcaaagcgggcaaggttcgtttcattctccccacggcgatcgggcaagtaactatcagtgatgctgtcaccgacgaagttattaaggcaaccctaggctaa

SEQ ID NO: 26418 - DNA, 1278 bp, Synechocystis sp.
atggtagcaacgcccgttaaacagaaatacgatattaaagatattagcctcgctccccaaggtcgtcagcgcatcgaatgggcggcccgggaaatgcccgtgttaaaacaaatccgggaacgctttgcccaggaaaaacccttcgccggtatccgcttggtggcctgctgtcacgttaccaccgaaaccgctaacttggcgatcgccttgcatgctggtggcgctgattctttgctcattgccagtaaccccctgtccacccaagacgacgtggccgcctgtttggtagccgactacggcattcccgtttacgccatcaaaggggaggataatgaaacctatcaccgccatgtgcagattgcgctggatcaccgccccaacatcatcattgacgacggtagcgacgtggtagccaccctggtacaggaacggcaacaccaactcagtgacatcattggcaccaccgaagaaaccaccactggtattgtgcgtctgcgggccatgttcaacgatggggtactcaccttccccgccatgaacgttaacgatgcggacaccaagcatttttatgacaaccgctatggcaccggccaatccaccctggacggtatcatccgggccaccaatattctcctggccggtaaaaccattgtggtggctggctatggctggtgtggtaaaggagtcgccatgcgggccaaaggcatgggggctgacgtaattgtcaccgaaattagtcccgtaccggcgattgaagccgccatggatggtttccgggtcatgcccatggccgaagctgcccaccagggagacatcttcatcaccgtcaccggcaacaaacacgttattcgtcctgagcattttgccgttatgaaagatggggcgattgtttgtaactccggtcacttcgacattgaaattgacctcaaatccctcaaggaacaagccaaggaagttaaggaagttcggaacttcaccgagcaatacattctccccaatggcaagtccattattgtgattggcgaaggtcgtttagttaacctggccgccgccgaaggtcatcccagtgcggtgatggatatgagctttgccaaccaggccctagcctgtgagcatttggtcaaaaataaaggtcaactagaacctggcatgcactccattccggtggaagtggaccaagaaattgcccgcttgaaactccaagccatgggcattgccattgacagcttgacccccgaacaggtggaatacatcaattcctgggcttccggtacctaa

SEQ ID NO: 26419 - DNA, 1902 bp, Synechocystis sp.
gtgcgttttgccatagagcaactggggctgttgtttggctgtcagcgggtccatgtgatttaccatgacccagccaaggactgtttacacatggcggaagaatggtgtgctgtgggtattgccccccggttatcaacttttcaaggagtaccggtggccacctatccttggctctgggccaatttgcaggatagtgaaggcgttttggtgagggatgtggagcaaatgccgccggaagctgagatggataaggtctccctgcaatttgacctggtgaaatccatcctagtggtgcccatggttaaggatgcccaggtgttgggctacatcagcatggttcatctccacgacaactatggttggaacccggaggagttgaacttggccaaactggtgggacaatttttggcgatcgcccaggcccggcaccaagcagagacaaccctgacccaagctaaggaagcggcggatgcggccaatcgggctaaaacggaatttttggccagtattagccatgaattacgcactcccctcaacgccattattggctttagtcaactgttgcatcgggatcccagtttggctccccaccgtcccaccttagatatcatcaaccggagcggtgagcacttattagagctaattaacgacattttggaaatgtccaaaattgaggcagggcgcaccaccctcaatgaaaaaatcattgattgccatcgtttgttggataatctccaggctcttttccaactaagggctcaggaaaaacaactcctccttaaagtggagcgatcgccggaggtgcccgaatggattaagactgacgggggcaaattgcggcaggtgttgattaatttgttggccaatgccattaagtttactgcccagggcggtgtcaccctcaaggttaaatgcctgaccgctccccagactgatgaaggtcaaggagcatccatctggcttcattttttagtgtcggatacggggccgggcattgctgcccatgaaatggatgaactgtttgtaccctttgcccagacagaaacggggcttaagtcttgtcaggggaatggtttagggctgcccattagccaaaaatttgttcagttgatggggggacaaattcaagtcaggagcaaggtcgatcaaggtagtgctttcttttttgccattccagtgcaggtgatggcggcccccaagccaaccccggaaacttcagcggttaccctgccgccgttagatcagtacaatcaaaaagttcttgtggtggacgatcgcccggaaagtcggttactactgcgccaattactcactagtctgggctttgttgtccaagaagcggaaaacggagaaatggcgatcgccctgtgggaaagttggcatccccaggtaattttgatggatatgcaaatgccagtgctggatggtcggagcactactcaaaaaattaaagccagcccccaaggtcaacatacgatcattattgccctcaccgccagtgcttttgaaggggaacgggccgaaattcttagcgccggctgtgacgactttttaagtaagcccttccgccccgaagaattgattgcccttctggctaaacacctggccgtggctttaccttcccaggggcaaccaccggcttcccctctccggccatttcctgtgataacggctccgtccctatcagaacaattggctaaaactccccagtcctggcgacaaaagatggcaaaaatggctttagaatgcaatgacgatgacctgattaccttggttgagtccctgccgaccttgtccccatccttagctcatctattggccacctgggccagggaatatcgttttgagcagattttcctagtggttgaatccagttttggggcggtgaccctagcggggtaa

SEQ ID NO: 26420 - DNA, 1452 bp, Synechocystis sp.
atggtagccgtaaaagaagcaactaacgttggcaaaattacccaggtcatcgggcctgtaattgacgcccagttccccagtggtaaattgccccgtatttataatgcccttaaagtccaaggcagaaactctgctggtaacgaagtagctgttacctgtgaagtgcagcagcttctcggcgataaccaagtccgagccgtagccatgagttccaccgacggtctcgtccggggcatggacgtggtagacaccggggcccccatcagcgttcccgtcggcaccggcaccctgggtcgtatttttaacgttcttggtgagcctgttgacaacaaaggccccgtgcccgctggtgaaactttccccattcaccgtcccgctcccaaattggtggatttggaaaccaagccccaagtatttgaaaccggcattaaggtaattgacctgcttactccctaccgtcagggtggcaaaatcggtctcttcggtggtgctggtgtgggcaaaaccgtaatcatgatggaattgattaacaacatcgccatccaacatggtggtgtatctgtatttggtggcgtaggggaacggacccgggaagggaatgacctctacaacgaaatgatcgaatccaacgtaatcaacgccgacaaaccggaagagtccaaaattgctctggtgtacggtcagatgaacgaaccccccggggctcggatgcgggtaggcttaaccgctttgaccatggcggaatatttccgggatgtgaacaaacaggacgtattgctcttcatcgacaacattttccgcttcgtccaagctggttcggaagtatcggctctgttgggccggatgccctctgcggtaggttaccagcccactttaggtacggacgttggtgatttgcaagagcgtatcacctccaccaaggaaggttccattacctccattcaggctgtgtatgtaccggcggacgacttgactgaccccgcccccgccaccacctttgcccacttggacggtaccaccgtgctttcccgtggtttggccgctaaaggtatttaccccgccgtggaccccttggattccaccagcaccatgcttcagccctccatcgttgggtcagagcattacgacaccgctcgggaagtgcaatccaccctgcaacgctacaaagaattgcaagatattattgccattcttggcttggatgaattgtctgaggaagaccgtttgaccgtagaccgggctcggaaaattgagcgtttcctttcccaacccttcttcgtcgccgaagtatttaccggtgcccccggcaagtacgtttccctggctgacaccatcaaaggtttcaaagcgattttggctggtgaattggatgatttaccggagcaagctttctacctggtgggagacattgaagaagctaaggccaaaggtgccaagctcaaagagggttaa

SEQ ID NO: 26421 - DNA, 1215 bp, Synechocystis sp.
atggaccgccaggggaaacaaaaaacggctccaatagaggctctggctatgggagtggtggtcactgggctagccctggacactgccttgggagatcaattacaaacttggacaaagttgttacagggaaaaacggccatcaagcccaagcaaccttttataaacttgccatcgttccccttggcattacagggaaattatcctcgttccctgggacaattggttccgcccttggtgcaggccgccattgatgatgcccaacttgatcccgctgaacaaccctggggagtggcgatcggttctagtcgggctaaccaatgccattgggaagattgggttgggcgcaacattaagcctccggtggcccccaactttaagcttgtggattggtggcagactttacctgatcaggccgcccgtttagctgcccaacttctaccggaagtaacggtgatgcaatgccccatggccgcctgtgccactgggttatgggcgatcgcccagggagtggagttaattagaacaggccattgccaacgggtgttggccggggcagtggaagcccccattacaccgctcacattggctggttttagcaaaatggccacgctagcaccggatggatgttatcccttcgatcgccagcgccagggtttagtgttgggggaagggggagctttgttagtattggaaacccgggaattagcccagaagagaaaagccagaatttacggtgaaattttgggttggggttttagttgtgatgcactccatcgtagtactcctgcctttgataaccacagtgcccagcaagccgtgaagcattgcctcacccgcagtggtttaaccccagagcaaattgacttgattcatccccacggcactggcactcttttcaacgatcaacgggaggccgctttaatccaaactctttttcctcaaaatcctctcattacttccagcaaaggggccactggccataccctgggcgcttccggggcgatcgccgtagctttgactttattaagccttcatcagcaaaaattgcccccctgtgttggtttgaaagaacctgaatttcccctcaactttgtccgcattgaatcagttcagccagcaactagccctttaaactatggtctctgcctcagttttggctttggcggccagaatggggcgatcgccgtgggacacgcaccactaccaacaaaatga

SEQ ID NO: 26422 - DNA, 1473 bp, Synechocystis sp.
atggtttacactcctgctccgattaaatttggtaccgatggttggcggggggtaattgcagcagaatttacctttgagcgggtggtgttggtggcggcggcggcggcccaggtgttggcggcagaatttggtagtagtggtcgggaacatcgcttaattgtgggatacgatcgccgttttatggcggaacaatttgccctgttggtggcccagacagtccaggaattgggttttgaagtctggttgagtgaaagttatgctcctaccccggcctttagttgggcggcccatcacgaaaatgccctgggcgcattggtgttaacagccagccataatcccgccaattatttgggtttaaaagttaaaggagcgttcggtggttccgtgggcagtgacgttacagaaaaaatagaagcccaattgcaaaattccttaccccagccccaagcgggaggtagtttgcaatattttgatccctggcctagttactgccaaggcttgcaggcaaaagtaaatgttcaacccattcgagaagcagttcaacagggaaaactccgggtatttgccgatgtgatgcatggcgcagccgccagtggcttggagcggttactaggttgtcccattgatgaaattaacggcgatcgagatcccttgtttggcggtgcttcccctgaacctttgcccaaatacgttcctaaattattagcagcgctgcaaacggcggccaaagctggtgggccagagttacgggtgggtttgatttttgatggcgatgccgatcggattgccgcagtagacggccagggtaattttctcagttcccagggtttaattcccattttgatttaccacttagctacccaaaaaggcctccagggagaaattgttaaaaccgttagtggctccgacctaattcccaagttggcagagctttacggcattcccctcacggaaacggcgatcggttataagtatattgctgatcgaatgttaaccagtccagtcttgattggtggggaagaatccggtggcattggctatgggggtcacattcctgaacgggatgcgttgttatccgccctatatgtgttggaaacagtggtacagtcccaacaggatattagtgaacagtatggtcgactccaggaaaaagtctgctttgtcagtgagtatgaccgcattgatttacccttggccagcatggatgtccgcactgcgttggtacaaaccctaaatgaaaatcccctaacggcgatcgccggagaacaagtgacagatttattgaccaccgacggctacaaattccgtatggccggtggcggttggttgctaattcgctttagtgggacggaacctttactgcggctttactgcgaggctcccaccagttcccgggtacagacggtgctccactgggcaaaggattgggcaaatggggtaacgcctgccaagcctgcacaatcatctcactga

SEQ ID NO: 26423 - DNA, 2862 bp, Synechocystis sp.
atgtctgaccctgatgtgtccgtctccccagttaaggccgaggcttggtatagctatggcatcgataaaaccctgcatcggttgaccactgctccccaccgggggttggcagaaaaaactgtgatggaacgaagacgcacctatggactaaatgaaattaccacgatcgccggtcgtaataattggcaaattttgctggatcagttcaccaatgtcatgctcttgatgttgatcggggtggcaattatttctggagcattagatctgatcagcttaaggttgggggaagaaaccatggagggttttcccttcaaggacacgatcgccatttttgccattgttatcctgaacggtttattaggctatttccaggaaagtcgggcggaaaaagctttagctgctttgaagaaaatggcgtcccccaaagtccaggtactgcgggatggcgatcgccaggaaattaaggcggccagcttggtgccgggggacattattttgctggaggcgggcagtcaactctgtgccgatggccaactgatcgaagcggctaaccttctcattcgagaatcggccctaaccggggaagcccagccagtggaaaaaaatgccagtaatactggtttacctttagatactccccttggcgatcgccaaaatatggtcttttctggcaccgaagtcgtccaaggccggggcaaagtggtgattaccaacactggcatggccaccgaattgggcaaaatcgccgagatgttacagagggtggccccggaacccacccctttgcaaaaaaggatggaaaacttagccggagtgctagtgtcaggctctctcctgctggtaaccctggttattattctgggggtgtggcagagtggctggggcgaactgcggcagttggtggaaacgtccctcagcatggcggtggcggtggtgccagaaggtttaccggcggtgattacggttaccctggccctgggcacccagaggatgattaaacgccatgccctaattcgcaaattaccagcggtggaaaccctcggttccgttaacgtcatttgttccgataaaaccggcaccctcacccaaaataaaatggtggtgcgggaagtgctgacccatggcgatcgcctcagcattggcggagaaggctaccaaccccagggcaacatcatccacctctcggatggagaacagagggcgacctccggaccatggcccccggccttgcaattactgtgtctcaacgccatcctctgtaacgattctgaactgaactacaatccaggggaaatggagtggcaagtgattggggaccccaccgaaggagcattgctagtgctggccaagaaatttggctttgaccaggcacagttaagacctagttttatgcggcggggggaatttcccttttcttcggagcgcaaacgcatgggggtgattgtggaagtgccagccgaaggagagtcccccttagcaaatttattgggcattttagaaaatttggccttaacgccagggccctacctaattttttccaaaggatcgccggagttactcctcccccactgcggacaaattcataccgctgaccattgtgtacccctcaatttccagcatcaagaacaaattttgagtgataacaatctcatggccagtcggggattacgggtgttgggttttgcctgtaaatccctggcccagattcccagcacccctgacctcatagctgccgaagataatctggtgtggttgggtatggttggcatgttggatgcgccccggccagaggtacggttagcagtggaaaaatccctcgccgctggcatccgcaccgttatgattaccggtgatcatcccctaacggccctggcgatcgccaaggatttgggcatcaatcaagctggcgatcgttttttgactgggcaaaccttagaacaactacaacaaagcgatctggaagcccaggtggaagaagtgagcgtttttgccagggtttccccggaacataaactacgcattgtcaaagccttccaagctcggaatcgttttgtggccatgaccggagatggggtcaatgatgccccagccctcaagcaagcagacattggcattgccatgggtatcactggcaccgatgtgagcaaagaagccagcgacatggttttgttggacgacaactttgccaccattgtggccgccgccgaggaagggcgggtggtgtataacaacattcgtaatttcatcaaatatattctgggtagtaacgtgggggaagtgatcaccattgcgtctgctccccttttagggctatctgccgtgccccttactcccctgcaaattctctggatgaatttggtcaccgatggcttgccagccttagctttggccatggagccgggggaaccaaatattatgaagcgtcgcccctttagtccccaggaaagtattttttctcggggattgggggcctacattatccgcatcggtctggtttttgcggtggttaccatcacccttatggtctgggcctatcacagtgctgacctagctggtgcgcccgacagttggaaaaccatggtttttaccaccctctgtattgcccagatgggccacgccattgccgtacgctccaaccatcgtttaaccatagaaatgaaccctttgaccaatccctacctgtggggggccgtaattgtcaccactatcctgcagttatgcttggtgtattttgaacccctgagaaatttctttggcaccgattggctcagtccccagcaactactggtttgttttggctttagcagtttaatgttcgtctgggtggagttggaaaagttattggcccggttcatcaaataa

SEQ ID NO: 26424 - DNA, 1596 bp, Synechocystis sp.
atgaataaccaacaactttggcaacgttatcaagattggctttattaccatggtggcctcgatttttacctggatgtgagccgcatgggatttagtgatgctttggtagaagatttgcaacccaagtttgccaaagcttttcaagatatggtggcgctggaaaaaggggcgatcgccaacccagacgaacaacgcatggtggggcattactggctacgcaatccggccctggcccccaatgatgggatccgggctgaaatcactgaaccattacggcaaatcaaagcctttgtcgctgacgtacaccaagggaacataaaaccccccacagcccctaaatttaccgacctgctggcgatcggcattggtggttcggctctaggcccccaatttgtggcccaggccttggcccccaatttccctcccttggcgattcacttcatcgataactctgaccccgacggcattgaccgggtgctgaactgcttaaaagcccaagacaaactaaaaagtacgctagtggtgaccactagtaaatccggcggcacccccgaaccccgcaatggtctggcggaaacgaaggcagtatttgaagcccagggccttcattttgccgattatgcggtggcggtgaccatgcccggcagtaaactttcccagcaggcccagacggaacaatggttacaagcttttcccatgcaggattgggtgggtgggagaacctctgagttatcggcggtgggactattaccggccgctctccagggcattgacattcaggccatgctcgacggggctaaaaccatggatgaagccactagggtgagggaattaagacaaaatccagcggctctattggcgttagcttggtattatgccggggatggccaagggaaaaaagacatggtgattctcccctataaagataggctgttgttatttagtcgctatttgcaacagttggttatggaatccctcggtaaagagcgggatttggatggcaatgtggtccaccagggcattgcagtctatggcaataagggttctacggatcaacatgcctacgtccagcagttgcgggatggggtgcccaacttttttgccactttcattgaggtattgcacgatcgccaagggccatccctagagttagagccgggggtcaccagtggggattatttatcgggatttttgcagggcaccaggcaagcgctatttgaaaatcaacgggactccatcactgtcaccattcccgaggtggacgctaccagcgttggggctttgattgccctatatgaaagagcagtgagtttttatggttccttggtgaacgtcaacgcctaccatcaaccgggggtagaagcggggaaaaaggccgccgcctcgattttggaactacagaaggcgattctctctaccctacaaaatgaatccgggcccattgccctagaagcgttggccaccaaagtgcaagcaccagaacaggtggaaacggtgtataaaatagtccgccatttagccgccaatgaccggggcgtgaccctccagggcgatcgccaatttccccaacggctgcaaatccagtggcggagttaa

SEQ ID NO: 26425 - DNA, 1056 bp, Synechocystis sp.
atgactgccacgattcccccgttgacaccaacggtaacgcccagcaatcccgatcgcccgattgcggatctcaaactacaagacatcattaaaaccctgcccaaggaatgcttcgagaaaaaagcgagcaaagcctgggcttctgttttgattaccctaggggcgatcgccgtgggctatttgggcattatttatctgccctggtactgcttgcccattacctggatctggacagggacagccttaacgggggccttcgttgtcggccatgactgtggccatcgctcctttgctaaaaaacgctgggtcaatgatttagtgggacatatcgcttttgctcccctcatctaccctttccatagctggcgcctactccacgaccaccatcacctccacaccaacaaaattgaggttgataacgcctgggatccctggagtgtggaagctttccaagccagcccggcgatcgtccggcttttttatcgggccatccggggtcccttctggtggactggttccattttccattggagcttaatgcacttcaaactttccaactttgcccaaagggaccgcaataaagtcaaattatccattgccgttgtcttcctgtttgcggcgatcgcctttcctgccctaattatcaccacaggggtgtggggtttcgtcaaattttggctaatgccctggttggtgtatcacttttggatgagcacttttaccattgtgcaccacaccattcccgaaattcgtttccgtcccgccgccgattggagtgccgccgaagcccagttaaatggtactgttcactgcgattatccccgttgggtggaagtgctctgccatgacatcaacgtccatattccccaccacctctccgttgccatcccttcctataacctacgactagcccacggaagtttaaaagaaaactggggaccttttctttacgagcgcacctttaactggcaattaatgcaacaaattagtgggcaatgtcatttatatgaccccgaacatggctaccgcaccttcggctccctgaaaaaagtttaa

SEQ ID NO: 26426 - DNA, 786 bp, Synechocystis sp.
atgaccttagcaaaacggattttgccttgtttagatgtcaatgcagggcgggtggtcaagggcataaactttgttgatctccaagatgccggggatccggtggagttggcccgggcctataacgaagcgggggcagacgagttggtgtttttagacatcactgctacccacgagcaacgggacaccattattgatgtggtttatcgcactgcggaagaggtgtttattcccctaacggtagggggcggcatttctacgttggaacatattaaaaatctgctccgggctggggcagataaggtgagtgttaattcctctgctgtgcgggacccggactttattagtcgagctagtgaccgttttgggcggcaatgcattgtggtggcgatcgatgcccgtcgtcggttagatgcggataatcccggctgggatgtgtatgtgcggggggggcgggaaaacaccggcctagatgcgatcgcctgggcggaggaagtggccaaacggggggcaggggaattgctggtcaccagtatggacggggatggcacccaagcgggttacgatctggccctcacagcggcgatcgccgaacgggtggaaattccggtgattgcttccgggggagcgggtaattgtcagcacgtgtacgaagcattcacggaaggcaaagctgaagcggcactgttagcttccctattgcactatggtcagttaaccattggggagttgaaaacctttttagaagcgagacaaattccagtcaggcacactgcggtttgtggctaa

SEQ ID NO: 26427 - DNA, 1299 bp, Synechocystis sp.
atgggacagccgagcgatttgacggaatccaccctcagattttcttctttggatcctctgcatcccccggttatttcccaattgacggcgatcgccaaaaggatccgacgcaatagcctccatctgcccaccatttggcaagaggcagtggatagtattggctctaccttgggggtaagccgttgcctactgttgacaaaggatttccaaagtcgccacctgcagattgaagcagaattctgtcagcccacagtgaccgccttcgctgctctaattgtgccggaggaaagtgaaatttggcggcagttattcgagcaacaccaacccatcactctctacaatgtccagtttcaaggggaggatttggggggactgtggattttccccaccctctaccaggaccaagccaacggctatctgtgtttgcaacaagttggtccggcccctggtccctggcatccagaaacagaagccctacttcaggaattggccgagcaaaccggcacggcgatcgcccatgccaccctctaccaagaactaacccaggccaccaaagcggcagaagaagcatcccggctcaaaagtgaatttctggccagcaccacccacgaactccgcaccccattaaatggcattattggttttctgcggctaattttagacgacatggcggattcagaggcggaaaaacacgaattcgtcgaagaagcctaccaatctgccctgttattgctcaatttaattaatgatattctcgacctggccaaaattgaagcgggtcgagtgggcattgaattggaagtggtggactttagtgaagtgctccaggcaacagaaaattttgccctgccccaggcccaaaataagggcctcagctttaatctcactgcccccaaccaaggccctctgctggtgtatggcaatcagcgttggttactgcaggtgatgctcaatattgtcggcaacgccatcaaatttacccacgaaggaggtattacagtggccgtggaagtaatgccccgcactgtgctctgggaaggtgtacagaaaccaggattattaaaagtgagcgtgggagatacgggcattggagtttccctcgagcaacagtccaaattatttaaaaaatttgtgcaaattgatggctcccattccaaagcctatggaggtacggggttagggctggtaatttctcaaaagttggtggaaaccatggggggcaaagtggccttttttagcatgggggaaggactggggtccaccgtcactttcactgttttactagaggaattaccctaa

SEQ ID NO: 26428 - DNA, 1260 bp, Synechocystis sp.
atgtggcaggcttttcctatggctgactggcaggtaattgagggcaacatcaccgcccccaaaggttttaaggcggcaggcatcacggcgggactaaaaccgtccggttcccccgatttaagcctgatttactccgaaactgaggcgatcgccgcgggagtttttaccaccagtcaggtgcgggcagcctgtgtggactattgtcgccaaaggttacaggctaaggccagcgctagggctattttggtgaactctggccaagccaatgccggcacgggcaaacagggctgggacgatgcggtggagtcggcccaactgctggcccaggggctaaacatttcccccgaaagtattctgctcgcttccactggtgtcattggccaacgcatcaaaatggagcagttacgccagggcattaccccattaattcaatcccttgcccccaatggcggcgataaggcggcgagggccattatgaccacggatttggtgcctaaaaccatcgccctggaaacagaaattgatggtcgcccggtgaggatggggggcattgccaagggctctggcatgattcaccccaacatggccaccatgctagcttttgtcacctgtgatgcggcggtttccaccgccctctggcagcagatgctcagtcgggccacccaaaaaacctttaaccaggtgactgtggacggggacaccagcaccaatgatagtctctttgccctagccaatggggaatcccgcaccgccgccattacggaaatgggccccaacgccgagaagctggaagccatgctcactgctgtgtgccaacatttggccaaggcgatcgccagggatggggaaggggctacctgtttgatggaaattcaagtcactggggccccggatgatcaatctgccagggccgtggccagaaccattgccggttcttccctagttaaatccgccgtatttggtcgggatcccaactggggacgcattgccggggcagcggggcgagctggagttaaatttgaccaaaataatctactgattaaattgggcaactacgtacttatggaccagggccaacccctagaatttgatcgccctggagcgagcaactacctcaagcaggccgcttctggcgcttatctagaacaggacacagtactaattcaggtggatctaggtactggttcggggcaaggaaccgcttggggctgtgatttgagctatgactatgtccggatcaatgcggattacacgacctga

SEQ ID NO: 26429 - DNA, 1107 bp, Synechocystis sp.
atgacagtcgcccaattttctcccgttgcccgcctttccatagaagactctgttttaacggtacaggacttaggcaaaagcttccgggggcaatccaccccagtactccagaaaatcaactttaatctagcgccaggggaaattctgggactattaggaccatcgggttgtggcaagacaactttgttgagaatcattgcaggctttgaaacccccaccagtggcaccgttcatttggagggggattgtgtttctggggaaaatggactcactcccccagaacagcgtcaaacaggcatggtctttcaggattacgccctgtttcctcacctcaccattaccgacaatatcgcctttggcctgcgccataaatcccaaaaattgaaccgtcaacaaatccaagggcgggtggcagaggtgctccatttggtgggattaacgggactggaaaaacgctatccccacgaactatccggtggtcaacaacaacgcattgccctggcccgggctttggcccctaaacctaacctaattttgttggatgaacccctcagtaatctggatgtgcaagtgcgccaaaggttacgccatgaaatccgccatatcctcaaagccaccggtacggccgctatttttgtcacccacgatcaggaagaagccatggccatttccgatcgcattggggtgatgtatcgggggaacttggagcaaatcggcaccccagaggaaatttatcgatcgcctgcttcccgttttgtggcggaatttgttacccaggccaattttgttccggcccagcgacagggaacactttgggccacggagtttggccaatggcctttaactttccaaggcattcagcctgaattgccctcagtgggggaactaatgttgagggaagaggaaattgaactgagccccgccagtgatggcccagtggtcatccgcgatcgccaatttttgggccgggaataccgctactgcttggaaaccccggccggtcgacagattcatgcccgtacttctttgcaaacggtaattccggtgggcagtcgggtcaacttaactcccaccaatccctgtcctcccctatttgcccagggctga

SEQ ID NO: 26430 - DNA, 996 bp, Synechocystis sp.
atgaccatggtggccagttggactcgaaaccacattttagacctaaccgattggcggggcgaagaattagacattgtgctacagaccgccaccacattccagcaagtactgagtggacaaacaaaaaaagtacctgccctccagggacaagtagtcaccaatcttttttttgagccatctacccgcacccgcagcagctttgagttagcggccaagcgcctttccgctgatgtgatgaatttttcccctggtacttcttcccttaccaagggagagactattttggacaccgccaaaacttaccttgccatggggtctgacatttttgttatccgccaccaacaggccggggtgccccatttcattgcttcccaaatggaccggctccaaaccggagtcaaggtactcaatgcgggggatgggcaacatgagcatccttcccaaggattactggatttatttactatctgctcccaatttgcgccggacaatcctgccattcaatgcctccagggaaagaagatcgcggtggtaggagacattttacattcccgggtggcgcgttctaatctgtggagtctaactaccgccggggctgacgtgcatttagcggggcctcccaccctgttaccaaaggaatttcaacaattaaccctagcgccgggatcgggtaaactccattgtcattggcagttgcagccagccttggaaggggcggatatagttatgactttgcggttgcaaaaagaacggatgacagcccatcttttacccagtttgcgggaataccaccattatttcggcattacccacgatcgcctaaaggtgtgtcaaccaggggtaaaagtgctgcatccggggccggtgaatcggggggtagaaattagctccgaactgatggatgacccggacattagcttgatccaagaccaagtaaccagtggagtagccatccgcatggctctactttatttgctaggcactgttcaggaatag

SEQ ID NO: 26431 - DNA, 3036 bp, Synechocystis sp.
atgagtctgaccattgccgattatcaatccttcttgcgggaaattgaaccctttgctcaacttcctgccccggcgatcgccgagatagcggcaaaactgaggccgctaaggtttcgcatgggacagataattcttgcccggggaaagttggccaataatgtttatttcttagtcagtgggcaagcaagactactcggttacgaccccggcactggttaccccgccaccatggctttgctccagaatggggcagtgattggggataacaacgccatcagaaatgtcccctgtgaaacggcgatcgcctctacggaaactatttgcgccagcctcactagggacgagtttttagctttggtagataagtatcctgaactagccagggtttatcgccaccaatgcggtcgggtggaactattcgatttattaggggaacagctacaacgcaccgcccaaggcaatgtggatttgcgccagctaaccctggaaatgttgccccagagtcaggtttacgagttgcaacccggtagccacagtttgcccagtgatttgcccgatcccgaaagactttggttggtgagtagtggtgaattggagcaatgtccccggggtagcgctttgcctgatccagactctgccttggtgctcaaggcccaaacccttgtccgtttgattgggctacctcctttaccccggtttttcccgggaagttctggatcgaaaaccaatggcaatggtaacggccatggagaagtgcccctggccacggtgacccgcctcgctccagaagattccccctgggatgatattccctatgctgaccccaaccaattgggagagccgctaccagagcccaccgtggtcaaatctgggcgcaaaagttatcccgttgtgcgggggcaaaatcccaccgatgccggggtagcctgcttccagatgattagtcaatatttcggtatgcctttccgtcgggacatcatccaaaggattgtcaccgaagaaattaagcgcagtgaagccctttctttgcccatttgcggtgccattgtggagttgatgggtttgaccagtcagttggtccgcatccccaagggagtttttgggcaaatgcaggtcccttttctcatccgctggcaagatagccttgccctggtctacgaagctggcgatcgggaagtaaaaattgccgtaccggaattgggtctagtcaaacgcgacaccagtgagtttcttgaaacctggggagaagaggggcaaggggaagtgctgatgatgtacccttccaaagatacgccccagcaacggttcggcttgagttggttttggccagcgttggtgaagtaccgctacattctcctgctggtctttgtggcatccttctttgtccaactatttggtctggccaatcccttgatgatccaaatcatcatcgacaaggtgattgtgcaaaacagcaaagataccctgcaggtgctgggtattgcgttggtgtcgatcgccatttttgaggccctcttaagcaccctacgaacctacttatttgtagataccaccaatcgcatcgacatgagtttggggtcggagatcatcgaccacctactgcggttacccctgcgctattttgagaaccgcccagtgggggaaatttccaccagggttaacgaactggaaaatattcggcaatttttaacaggtacggccctgacggtggtgttggactccgttttttctgtggtctacatcgtcgtgatgattatctacagccctctgctgacggcggtggccctgggaattgtgcccatttttgttattttgactctggtattttccccccttattcgtaggcagttacggctcaaagcggaaagaaacgcccaaacccagtcctatctagtggaggtaatgtcagggattcagaccgttaaagcccaaaacatcgagttgcgctcccgctggcaatggcaggacaaatattcccgttatgtgggggccggtttcaacactgtcattacctctaccctagctagctcctccagtcattttctcaaccagttatccggtttactcgtactttgggtgggggcatccctggtgttggatggggatttaaccctgggtcagttaatcgcttttcggatcattgccggctacgttacctcccctattctgcgtttgacccaactctggcagaacttccaggaaaccgccctgtccctggaacggttggcggacattgttgatacgccccaggaatcggagcgcgatcgccaaaacattcccatgcccgaaattgccggcgaagtgaagtttgaaaacgtcagtttccggtttaaaaaacaggggccattacagttgaacaacattaacctgtccttccccccgggcacctttgtggctttggttgggcagagtggtgctggtaaaagtaccctgaccaaactgctttcccgactgtatgaacccgaaggggggcggattttggtcgatggccttgatattggcaaagtggaactctattccctccgtcgtcaggtgggggtagtcccccaggaaaccctcctgtttgaaggcacagtgcaagaaaatattgccctgactaacccagacgcgaccacggaacaaattatctcggcggctaaagttgcctctgcccacgaattcattatgaccttgcccaacggttacaacaccagggtaggggaacggggagctactctctccgggggacaacggcaacgaattgcgattgccagatcggtgttacagcggccacgcattttggtgttggacgaggccaccagcgccctggattacataaccgaacaacaagtatgtatcaaccttggggatgccttcaaggatcacaccgtcttcttcatcacccaccgccttagctctgtccggagcgccgacgtaatcgttatgatggaccaaggttccgttgttgagcagggtagccatgacgaattaatggccctcaagggacgttactattacctttaccaacaacagggcgccggcggtgacgatgtttag

SEQ ID NO: 26432 - DNA, 1080 bp, Synechocystis sp.
gtgcgtctagaaatttcatcgcctcaaacaaagcttccttaccccaaaactgaagaattaccatttaccctccaagagctcagaaacgctattccagcggattgttttgagccatcggtagtccggtccttgggctacttttttttggatgttggtttaattgccgggttttatgctctagcggcctaccttgattcctggttcttctatccgattttttggttaattcagggaaccctattctggtccctgtttgtggtgggccatgattgtggccatggctccttttccaaatccaaaacccttaataattggattggtcatctcagccacacgccaattttggtgccttaccatggctggcgtattagtcatcgtactcaccatgccaacacgggcaatatcgacaccgacgaaagttggtatccagtgtcggagcaaaaatataaccaaatggcctggtatgaaaaacttctacgtttttacttgcctctgatcgcctaccccatttatctatttcggcgatcgccaaaccggcaaggctcccatttcatgcccggcagtcccctattccgtcccggagaaaaagcagctgttctcaccagcacctttgcccttgcagcctttgtcggcttccttggctttttaacttggcaatttggctggctatttttgctgaaattttatgttgccccctacctcgtgtttgtggtgtggttagatttggtcacatttttacatcacactgaagacaatatcccttggtatcgtggtgatgactggtattttctcaaaggtgccctctccaccattgatcgggattacggcttcattaaccccattcaccatgacattggcacccacgtcgcccaccatattttctcgaatatgccccactacaagttacgccgggcgactgaagccatcaagcccattttaggggaatattatcgatattctgacgagccaatttggcaagctttttttaagtcctactgggcttgccattttgttcctaatcaaggttcaggggtctattaccaatccccatccaatggtggatatcaaaagaaaccttaa

SEQ ID NO: 26433 - DNA, 2304 bp, Synechocystis sp.
atgcatcccaccctcatcagcgcccctatcagctcctccgccaatgatgcccatgccggcactagccagggttcccatcagggacatcgcatacaagtgatccgtagagatggctcctcaactcccctaaatattggcaaaattcgggcagtggtggactgggcttgccttgggttggaagtgaactccatcgccctagaagcagggctaacgactaggttgagagaggggattagcactagagagattcaagataatttaattagctgcgctctggaaatgtgcagtcccaacgaaccagactggcgctacgtggctggccgtttacatgtttggagtctgtggaaagataccctagtgcgtcggggatatcagtatgggcagtatctacgcacggtacaaaccaaggtcaccaatggggaatatgactcccgcatcttgacttacagcgaaggggaattgcaggaagcgggctgttggattaactcggactgggacacagactatgactatgccggggcagttttattaactagccgctatctattacccaacgaattaccccaggaagcgttattaacctgtgcgctgctattagcttcggtggaagcccccgatcgccgtttgcaatgggcccggagattttatgaatcaattgcagcccgtagaatttctttagccaccccaatcctggctaatttacgagtgcccggtggttctctgacttcctgcttcattgtggccatggaggataacctggaaagtatttttggggaaattaccaatgctgccagaatttccaaaaacggtggtggagtgggagttaacgtttcccgcatccgggccaccggcagttgggtaatgggtaagcccaacgcttccggaggggtgattccctggacaaaactgctcaacgatacggcgatcgccgttaatcagggggggcgcagagccggagccgtaaccgtagggctggatgtgtggcatttggacgtaccagaatttctggaaatgcaggcggaaaatggtgaccaacgacgtaaagcctatgatatttttccccagttaatcttgcccgatgaatttatgcggcgggtcattaacaaagaagattggacgttagtggacccctacgaagttagggaaaaaatgggcattgagttagccgaactctggggggaacaatttgaaggtgcctatcgagaaattgagtcaaacctcgataccaccattaccctctacaaacgtattaatgcccgggaattgtttaagcagataatgcgtacccaggtagaaaccgggatgccctatctttcctttaaagacactatcaataaagccaatcctaataaacatttaggttatattcctggcactaatctttgctgtgaatcattctccaacgttacccctggtcaggatgcccattgctgtaacctagttagcctcaaccttgccaatctagacttgcaagacattgctggggtcagtcagattgctgtgcggatgctggataacaccattgaattgactgcgcctccctttgccgatgctaaaagccataacaataaataccgcaccatcggggtgggagccatggggttagcagactggctggctaaacgtcgtctgaattatgacgagttagcggatattaatcgcttgttcgaggaaatcggctattggtgcacccaatcctccatggaattggccaaggaacggggagcttaccctgctttccccggtagtgactggcaaaaaggtttattaattggttccaaacccgtcagttggtttcaagctaatgcggctaaaccggaacgatgggaaaaactctccaacgacatccaaacccacggcattcgcaactcccacattacggcgatcgcccccaacacatcatcatccctagtccaaggttgcactgccagcattttgccggtctatagccgcttcttttacgataaatgggctaagggcactgtccccattgcaccgcccttcattggtaattgtttctggttctacccggagaataaaaccatggaccagcgcaaagtagtcaaagccgtggccgccatccaacaatggacagatacgggcatttccatggagttattatttaacctcaatgcgggcatttatttccctgaagaaccggaaagaagcctcaatgccaaggacatttttgacaccctggtcatggcctgggaggccggttgtaaggcgatctactatattcgcactgtacaaaaggatgactttaaggattcctccgatggctgcgttgcctgtgctaattag

SEQ ID NO: 26434 - DNA, 1173 bp, Synechocystis sp.
atgaccacttcccttgcagccattgccccccacggcggccaactgatcaatcgcctcgccccggaagcagaacgccaggaatttttggcgatcgccgataaattgcccagggtgcaactggatgaacgggccacatcggatttggtcatgattgccattggcggttttagtcccctcaagggctttatggagcaggacgactacgagctggtggtggaagaaatgaaactcagcaacggtttgccctggtcggtacccgtgactttatcagtgacagaggaagtggccgctcccttggaagtaggcagttgggtgcggttggacaacagcgctggtaaattcatcggtgtgttggagctgacccagaaatatcactacaacaaagcccacgaagctaaaaacgtttaccgcaccgacgaccaagcccaccctggagtcaaggtgatttatgaccaaggccctgttaacctggccggccccatctggttactggagcgggaaccccatcccctgtttcccaaataccaaattgaccccgccgcttcccgtcagttatttgccgagcggggctggaaaaccattgtcggctttcaaacccgtaaccccatccaccgggcccatgaatacattcaaaaatgcgcgctggaggtagttgatggcctctttctccatcctctggtgggggcaacaaagagtgatgacattcccgccgatgtgcggatgcgttgctacgaaattatggtggacaattacttccccaaagagcgggtcattctgggtattaatccttccgccatgcgctacgccgggccccgggaggctattttccatgccctgattcgcaaaaactatggctgtacccatttcattgtaggtcgggaccacgccggggtgggggactactacggcacctacgatgcccaggaaatttttgacgagtttgccccggaagcgctgggtattgtgccgatgaagttcgagcacgctttttactgcaaaaagaccctgcaaatggccaccactaaaaccagtcccagtggcccagaagaccgcattcacctctctggcactaaagtgcgggctttgcttcgggatggacaattgccgccaccggaattctcccgccctgaagtagcccaggaattaattcgggccatgcagggggaaagctaa

SEQ ID NO: 26435 - DNA, 1080 bp, Synechocystis sp.
atggtggatgagtttgatctgcccccggaaatcattgaccgccgggtacggaagatgaaaatgatctccccttccaacatcgaggtcaacatcggtcagaccctcaaggacgacgaatatatcggcatgtgccgccgggaagtgctggatggttttctccgggaacgggcggagaaactgggtacaaaagtcattaatggcaccgtttataaattagacattcctagcaaagatagtgatccctacaccctccactatgccgaccacagcgttggtggcaccactggggaaatgaaaatcctaaaagtagatgtggtgattggggctgatggcgctaactctcgcattgccaaagccattgacgctggggattacaactatgcgatcgccttccaagagcggattcgtctgccggaagacaaaatggcctactacgatgaactagcagaaatgtatgtgggcgatgacgtttctccggatttctacgcctgggtattcccaaaatatgaccacgtggcggtgggcaccggcaccatgaaggtgaacaaagcccgcatcaaagacttacaggctggcatccgcaccagggctgccaaaaaactagaaggcggagaaatcatcaaagtggaagcccatcccattcctgaacatccccggccccggcgggtggttggtcgagtagccctagtgggggatgccgctggtaccgtcaccaaatcctctggggaaggcatttactttgccgccaaatccgcccgtatgtgtgcggaaaccattgtggccaccagcaataatggccaacgggtgcccaccgaagccgatctgaaacaatacatcaaacaatgggataaacgctacggcgctacctatttggtgttggatattctgcaacgggtcttctatcgcaccgatgccaccagagaagcctttgtggaaatgtgttccgacatcgatgtgcaaaagctaacttttgacagttacctgtacaaaaccgtggtacccgccaatccattggtgcaaatgaaaattaccgccaaaaccattggtagcttgctccggggtaacgctttagccccttaa

SEQ ID NO: 26436 - DNA, 1158 bp, Synechocystis sp.
atggccccatcaatttcccctgtcacccaacctttggtttccatggcgatcgcccccacggtggtgattcgtagtgctttggctaaagcgggggaacatttgcaaaaattggggagtaagggcctagtggtaacgggtagccactctgctgagttgggggaaaagtctttacaaacattgcagaaaaattatggtctgaccctgcctctggccagctatttacctgactgcgccgagtcttccctcgaacagttgcggcgacgggttcaccaggaacagccagattttatcctaggtattgggggaggcaaagccctagatacggctaagttattggcccatcaaacccaattggcgatcgccacagtacctacctcggccgctacctgtgcgggttggactgccttggccaatgtttacagcgaaacgggggctttccgttatgacgtggccctagaccgatgcccggatttattgattgtggattatgaattgatccaacgggctgaaccaagattactagttgccggcattggagatgcgatcgccaaatggtatgaagcttccgttagtagtggtcaatccagcgatactttcaccgtggccgctgtacaacaagctcgaattttgcgggatattcttttccaaaaatccgctgaagccctggcccaaccgggtagcgaaacctggcgggaagtggtggatgccagtttgttgatggcgggggtaatcggtggtttgggtggtgctaactgccgcaccgtcgcagcccatgcagtccacaatggtttgacccaattgccccaggcccaccatgccctccacggggaaaaagtcgcctatggcattttggtgcagttacgcttagaagaattggtcagcggtaatcaactcgccgctactgcccgtcgccaattactgagcttttacgatgagataggtttacccaaaaccctgcaagatctgggtctgggacgaatttccctggaggaattacgacagacggcggaatttacctgtttacccaattcggacattcaccgcttaccctttactgtgaccccagaaacgttgatggcggccatggtttccaccctagtggaggaacaaggtactcgccaattatttgcccaaattcaagataattccggtctttaa

SEQ ID NO: 26437 - DNA, 1662 bp, Synechocystis sp.
atgcgtaatttcccagaaatccaaaatacggcctatgacctaattgtgattgggggaggcattaacggggttggcacggcccgggacggagccctacggggcctaaaaaccctcctgatcgaaaaggatgatttcgccagtggtacgagtagttggtccacccgcttaatccatggcggcctgcgctatctggaatattttgaatttaatctggtgcgggaatccctgcgggagcgggaagttctgctccacaccgccccccatttggtccagcccctccagttgaccattccggtgtacgactggtcgagccgggcctattgggaaattcaggcgggcatgattctttacgacatcctcagttttgataaaaccctcccttcccataggatgttaagcccccaacagttccagcaactgttccgagcggcggagaaaaaaggcttaaaaggaggagcccaatattttgacggccaggtggaatatgcggaacggttagatttagaagtgaccctatcggcccaaaaggccggggcggccatgctcaattatgtggctgtgaaggggttggagaaaggggaaaataacctgattaccgccatccattgccaggatcaactgagcggagaaaaatttactgttaatagcgcccaggcgatcgtcattaataccactggcccctgggtagatgaagtttgtggcttagcccatcgagggggagaacccgttgccattgtccaagaaagaaaaattggtggcaccaagggcagtcatattgtggtggatcccttccctggagcccccgcttcagccttatatgtggaagcgtttgtggataaacggccctatttcatcattccctggttgggtaaatatctgattggcaccacggaccaccgctatgatggttccctcgacagggttaaagccagtgatgacgagattgattacctgattgcggaaactaaccgggtgatgccagcagctcagttaaccaggcaggatgtgcgtttcacctattccggggtgcgccctctgccctacaccgatggcaaaaaggccggcagtattacccgcaaccatattctttatgaccatagtcaagacggagttaataatttgatttccctaattggcggtaagttgaccacctatcgccaggtgggagaagaaatggtggataaggtttatggcaagctgagacgctctgctcctccctgtccaaccctgacccaacctttaccgggggcagaagcctatcccctgtccttggaaactgccatggataaatatggcaatcatttggagcgtcattctattcaacatttattttgcctttacggagccagggctggagacattttagccttagtccacggagcgccggagttgggggaaaggattattccttccttgccggatatcaaagcccaagttgtttttgcagtacaagcagaaatggcccacaccttggtggatatttgtcgacgacgtacggcgatcgccatggtgactaacgattatggctttagcgccctggccggcatttgccaaacgttaacagaccattgtggctggacccaggagcaatgtgacaagcaaattcaaaagtaccatgaatatatggagcaaaactgcattcccgactattgtctccactga

SEQ ID NO: 26438 - DNA, 1500 bp, Synechocystis sp.
atgaattcatcccttgtgatcctttaccaccgtgagccctacgacgaagttagggaaaatggcaaaacggtgtatcgagagaaaaagagtcccaacgggattttgcccaccctcaaaagtttttttgccgatgcggaacagagcacctgggtcgcatggaaacaggtttcgccgaagcaaaaggatgattttcaggcggatatgtccattgaaggccttggcgatcgttgtacggtgcgccgggtgcccctgacggcggagcaggtaaaaaacttctatcacatcacttccaaggaagccttttggcccattctccactctttcccctggcagttcacctacgattcttctgattgggataattttcagcacattaaccgcttatttgccgaggcggcctgtgccgatgccgatgacaatgcattgttttgggtccacgactataacctctggttagcgcccctttacattcgtcagctcaagcccaacgccaagattgcctttttccaccacacccccttccccagcgttgatattttcaatattttgccctggcgggaggcgatcgtagaaagcttgctggcctgtgatctctgtggttttcatattccccgctacgtagaaaattttgtcgccgtggcccgtagtctcaagccggtggaaatcaccagacgggttgtggtagaccaagcctttaccccctacggtacggccctggcggaaccggaactcaccacccagttgcgttatggcgatcgcctcattaacctcgatgcgtttcccgtgggcaccaatccggcaaatatccgggcgatcgtggccaaagaaagtgtgcaacaaaaagttgctgaaattaaacaagatttaggcggtaagaggctaattgtttccgctgggcgggtggattacgtgaagggcaccaaggaaatgttgatgtgctatgaacgtctactggagcgtcgccccgaattgcagggggaaattagcctggtagtccccgtagccaaggccgctgagggaatgcgtatttatcgcaacgcccaaaacgaaattgaacgactggcagggaaaattaacggtcgctttgccaaactgtcctggacaccagtgatgctgttcacctctcctttagcctatgaggagctcattgccctgttctgtgccgccgacattgcctggatcactcccctgcgggatgggctaaacctggtggctaaggagtatgtggtggctaaaaatggcgaagaaggagttctgatcctctcggaatttgccggttgtgcggtggaactacccgatgcggtgttgactaacccctacgcttccagccgtatggacgaatccattgaccaggccctggccatggacaaagacgaacagaaaaaacgcatggggagaatgtacgccgccattaagcgttacgacgttcaacaatgggccaatcacctactgcgggaagcctacgccgatgtggtactgggagagcccccccaaatgtag

SEQ ID NO: 26439 - DNA, 1488 bp, Synechocystis sp.
atgacagcaaaacataatcagtatgtaatggccctggatttgggcaccaccggcaatcgagctattttgtttgattacgaaggcaatattgtcgggcaagcttacaaagagttaacccagttctatcccaaggctggctgggtggagcacgatgccctggaaatctggcgggatacgaaaacagtcatgcaggaagtggtgcaaaaaaccgctatccaaccccaacaaattgtggcgatcggtctaacggtgcaacgggaaacgtgtttgctctgggataagaccactggccaacccctccatccggcaattgtctggcaggatcgacgcactgctcacttttgtggagaattaaccgcggcgggctacgtggacgaaatttatgagcgcaccggcctcgtgttagatgcctatttttcgggcaccaaactccattggttattggattgggttaaacagagtaagagtgtcgatccagctaatctgttggcgggcaccattgatagctgggccctctggaacttaactgggggtaaagtacaccgcacggaccacagcaatgctagccgtactatggtgctcaatttagacagcctcatctgggatgaaaagctgttggatttattcaccattcccgcccagattatgccggaggtgcaacctagtttgagttacttcggcgttaccgacccggaaattctgggggtagaaattcccattaccgccatttttggtgaccaacaggcggccctctatgcccacggctgcgatcgcccaggattgctgaaatgtacctacggcacgggggcttttttggtggcgaatacggggcaaacggtaacccgttcccaacatcgcttactttccactgtggcttggacccaaaccaaccgagacaaaagcttgacaagggattacgccttggaaggaagtatgttcactgctggttcctgtgtgcaatggctacgggataagttgggtttaattgaatcagcggcggccagtgaaagcctagcccgcagtgtggatagcaatggcggcgtttactttgtgccggccctaagtggtttgggggctccccattgggacatgaatgcctgtggcgcttttcttggcttaacagcaggggtaactaaagcccatctagtcagatcggttctagaggcgatcgccttccaagcccgggaagtggtggaggccattaaccaggatagtcccgcccccattcaacaactgaaagtagatggaggagcctgtaacaatgactttttgatgcaatgccaagcggatgttttaggcattcccgtagaacggcctgcggtgttggatgccacggcccagggagccgcctttggagccgggctaaaaattgggtggaatcagcttcaaattaggtttttccgaaccttccaccacgggacgataagcttaatttgtcttcaatttctgcccatgcgtattcaggaaggtgtatccgttgaccagtga

SEQ ID NO: 26440 - DNA, 744 bp, Synechocystis sp.
atgtcctttgataccccgctcaaaccctatcttgctattcccatccaagattgtggtgaacccctcgcccccatcaatcttgaaggcgttaaatcgcttaaaccccatccctacgcacaagtaggagcggattaccaagggcgatcgccttacgtattgcgtactggagttttaaaaagattggatcaggctcggttgaccttggctgacattgagccgagctgggagattttagtatttgatgcttaccgcccgatcgccgttcaacagtttatggtggatcacacttttgccgaaattgtggcgagagatggcttacaaggccaagttttaacccccgaacaaaaggaaaatatttatcaccaggtttatcaaatttgggccgttcccaacaataatcccctcacccctccgccccacagcacgggagcagctctggacataacgttgctggatgacttagggcaacctgtggatatggggggagaaattgacgaattatcagcccgttccctgcccaattattatcaaacagtggaaccgaatagcgatcgccaaaggaaagaatttgagcaatatcaaagacgacgagaactcttaaataccatcatggaaagcgccgggtttctgcggcatccgggggaatggtggcatttttcccaaggggatcaactctgggcatggcaatataatcaacgacatccagaccaccaaaagatcgcctactacggccgggttgaatga

SEQ ID NO: 26441 - DNA, 2973 bp, Synechocystis sp.
atggttgcacaaatcgattcacaacaacagtatgaacaggccacccaggcgatcgccaaggaactattagcccagaccagggagaaaagatcgctgtgggacaaaattggcgataatctgcggctcgatgacaagttgctggattggaccatgggtcatcctggattgcgggtgcaattgttcaaatttatcgactgtctgccagcgttgcagagtaacagtgagattgccaaccatctccagcagtatatgagcgaagaggaggtggaattaccagaagcactgaaaaaattgttgaattttgccgatgcccactcgacgccggcccagattgcagcgggaacggtgagtaaagcgacggaacagttggcttttaaatacattgctggggaaacgatcgcccaggtgatcaaaacagtggaacggctccgcaaggaaaaaatgggctttaccattgatttactgggggaagcggtaattacggaatcggaggcggcggaatattggcaaaattatttggacctgatggcccagttatcccagcaagccaaatcctggtcgaaggtgccccaaattgatcaggcagacggggaaatattgccccaggtgcaggtatcggtaaagttaacggctttttattcccagtttgatcccctggaccccgcaggtagtaaagccaaggtttgtgagcggattcgggaattgttgcggcgagcccaagaattaggtgtcgctgttcactttgacatggagcagtaccactacaaagacctgattttaaatattctcaaggaattgttagtggaagaagagttccgctcccgcaccgatgtgggcattaccatgcaggcctatctgcgggattcgaccgaagatttggaagcattaattccctgggctaaacatcggggttatcccgtgactgtgcgcttggtgaaaggagcctattgggatcaagaaaccatcaaagcccaacagaatcattggcaaattccggtttatgtggaaaaagcccaaaccgatgccaactacgagcgcatgactcggctattactggaaaaccacgaatatttgtacgccgccattggtagtcataatgtccgttcccaagccctggcctgtgcgatcgccgaagagttgaatattcccaaacgtcgttatgaaatgcagattctttacggcatgggagaacccctggcccgggccattgttaaacggggtcatcgggtgcgggtctatgcaccctacggtcggctgttaccggggatggcttatttaatccgacgcttattggaaaatactgctaacagttcttttctacgccaaaacctagaagagcggcccattgaagaattaattgctccgccccaagttaaaggcattaatgacctacccaccaagggttatggcaacgctcccgacaccgattacgccgatgctgatttacgccagcaagcatttcaagccctaaccagggttaaacaacaattgggcaaaacctatctgccctacattaacggcgagtacgtggaaacggctaactacattgattccgttaatccctgtcgtccatcccaggcgatcgggaaagtggggttaatcagtgttgaacaggcagaccatgccctggaaatagccaaggctgcgtttcctgcttggaaaaaaactccagtacgggaacggtgtggcattctccgcaaagcggcagacattatggaagagcgtcgccatgagttaaacgcctggatttgtttggaagtgggcaaaattattccccaagctgatgcggaggtgtccgaggcgatcgatttttgtcgctactatgccgatgaaatggaacggctagaccaaggcgttaacctcgatattcccggtgaaaccaaccgttatttctatcaaccccggggcattgccctagtgatttccccctggaatttccccatggcgatcgccgttggtatgacggtggcggcgttggtgacgggcaattgtacgttactaaaaccagcggaaacttccacggtaattgcggctaaaattgcggaaattcttattgcagcgggggttccccctggggtcttccaatatgtacctggtaaggggtcggtggtgggttcccacatggtcaatcatcccgacgtacatttgattgctttcactggctccagggaagtgggctgtcgcatttacgccgatgccgctttggtacaaccaggacaaaaacacctcaaacgggtaattgcagaaatgggcggcaaaaacgccatcatcgttgatgaaagtgcggatctcgatcaagcggtggccggggcagtgtattccgcctttggttacacgggccaaaaatgttctgcctgttcccgggtggtggtgctttcccccgtacacgatgcctttgtggagcggtttgtagaggcaacccgttccctcaatgtgggccccaccgatgaccccagcacccaggttggtccggtaattgatgccaaggcccaagcccgcattcaggaatacatcgaacagggtaaggcggaatgtgaattggcgatcgcctgtgatgctcctagtgaaggctatttcgtcggtcccacggtgttcaaaaatgttgaccgccatgccaccattgcccaggaggaaatttttggtccagtggtaaccattattcgggcggccaattttgacgaagcgttggaaattgccaatggtaccgactacgctttaacggggggtctctattcccgtaccccagatcacattaatcgtgccgcggcggagtttgaagtaggcaatctttacatcaaccgcaccatcaccggggcgatcgtttcccgccaaccttttggggggttcaaaatgtctggggttggttccaaagcgggtggaccagattatttgttacagttcttagaaccacgccatgtaacggagaatattcaacggcaaggatttgcaccaattgagggggcagatcagtaa

SEQ ID NO: 26442 - DNA, 909 bp, Synechocystis sp.
atgaaatggcataaagagagcaaagtattactacaaggagtacatcatcccctcggtttaacctacctggaacagatgcggagctgtgggaccaagctggtggcgggggtaagtccaggccatgggggagaactaattggggatttgccggtatttgatttggtggatttagccgttaaaaccgtcggccccgtggacattagcttaattctcaatcccccctaccgagttttggatgcggccctagaggcgatcgccgcaggcattcgtcaactagtaattgtgtccgctggagtcccccccctggatatgattactctcctgcgggaagcccaagctacccacaccctgatccttggttccggtagtcaaggcattatgatcccccaacagttttccgtcggcaccctcgaccccaattgctatctacccgggcccatcggcattattagccactgcgatcgcctcaccgacgacatagcccaaaccttaagcgccgctggcttgggacaatccatggtgatcagtctaggcaccgacggcctcaatggttccaactttgagcaatggctccaggtgctagaagaagacgaacaaacggcaactattttattgctggggcaacccaacagtaacggggaaatgcgggcggcggattatgtggcctcggccattgaaaaaccagtggtggcctatttggcaggacggggcgcaaaaatcaaacgacactttggcgattccctcaccattgtggccaaccaactgtcccataaacgtccccttctaaccagcgttgagcaaacggtacaagcctttgagaacgctaacattccggtggcggaagccccctgggagctacccatttttttgcccctagccatggaaagtcgccatttgggcactgattag

SEQ ID NO: 26443 - DNA, 3105 bp, Synechocystis sp.
atgaacttggcagttcctgcattcggtctttccactaactggtctggtaatggcaatggttccaactctgaagaagagtcggtgctttaccagcggttaaagatggtggaggaattgtgggaaagggtgctccaaagcgaatgtggccaggaattggtggatttgctgacggaattaaggcttcagggtacccatgaggcgatcaccagcgaaatttccgaagaagtcatcatgggtattacccagcgcattgagcatttagaactcaatgatgccatccgggcggctcgggcctttgccctatatttccagttgatcaacatcgttgaacagcactacgaacaaaacgagcaacaacggaatcgttgggaagcttcccaggaaaccaacttctatgagcaggcgggcaatgaggaagaaatggtccccccatcccgattaggcgcgtcaacggaaccattgccagtgggcattgaccagaatgaattgcaagcttctgtaggtacgttccattggttaatgagggagctaaaacgcctcaatgtgcccccccaacatatccaaaatttattggatcatctggacattcgcctggtgatcaccgctcaccccacggaaattgtccgtcacaccatccggcgcaaacaaagaagggtggaccgcattcttcgtaaactagatcaactccagggttctgtgaccggtcgggactggctcaacacctgggatgcaaaaacggcgatcgcccaattaacggaggaaattcgcttttggtggcgtaccgacgaacttcatcagttcaaacccactgtgttggacgaagtggactattccctccattattttgatgaagtactgttcgacgctgtaccggaattgtccaaacggttaggacaagctattaaagaaacctttccccatctgcgggccccccgggctaatttttgttattttggctcctgggtcggtggcgatcgggacggcaacccttcggtaaccccagaagtgacctggcagacggcctgttaccagcggggtttagtgctggggaaatatttgtttagtttgggggaactggtggccattcttagcccttccctccattggtgcaaagtctcccaggaattgttggactctttggaacgggaccgcattcaattaccggaaatttacgaagaactttctctccgctatcgccaggaaccctatcggatgaagctggcctacgttaccaaacggctggaaaacaccctgcggcgtaataatcgtctagccaacccagaagaacggcaaacgatgatcaccatgccggccgaaaatcactatcgcactggggaagaattattagaggaattaagactcattcagcgtaatctgaccgaaactggtttaacctgcctggagttggaaaatttgattacccagttggaagtctatggctttaacctagcccagttggattttcgccaggaatcttcccgccacgccgaggcgatcgccgaaattgctgagtatatgggggtactcaccactccctacgaagaaatggccgaagaagataaattagcctggttaggggtagaactgcaaacccgccgtcctttaattccccaggaaatgcccttttcggagcggactagggaaaccattgaaaccctccgcaccctgcgccatctacaaatggaatttggggtggatatttgccaaacctacatcatcagcatgaccaacgatgccagtgatgtgttggaagtattgctgttagccaaggaagccggattgtatgacccggccaccgcctccaattccctccgcattgtgcccctgtttgaaacagtagaagatctcaaaaacgctccggggattatggattctcttttcagcttgcctttttaccgggctacattggcgggcagttaccattccttaaaagagttgcaaaatcagccaccggattattaccaaattcccaccaccacagccctactaaatcccggcaatctccaggaaattatggtgggctattccgacagcaataaagactccggctttttgagcagtaactgggaaattcataaggcccaaaaatcactgcaggcagtggcccaaagccatcgggtaattctccggctgttccacggtcgaggaggatctgttggccgggggggcggcccggcctataaagccattttggcccagcccgcaggcaccgtggacggtcggatcaaaattaccgaacaaggggaagtgttagcttctaaatattccctgccagagttggccctctacaacctggaaactttaaccacggcggtcatccaagctagtttacttaaaagtagttttgatttcattgagccctggaaccggattatggaggagttggcctgcactgcccgtcgagcctaccggagtttgatttacgaagaaccggactttttagatttcttcctgacggttacccccattcctgaaattagcgagttacagattagttcccgccctgcccgacgtaaggggggtaaagcggatctcagcagtttgcgggccattccctgggtgttcagttggacccaaacccgtttcctgctgccggcttggtatggggtgggcacggcgttgaaatcctttgtggaccaagacccggtcaaaaatatgaagttgttgcgttacttctatttcaaatggcctttcttcaacatggtgatctcgaaggtggaaatgaccctttccaaggtggacctcaccatcgcttcccactatgtgcaagagctatctaagccagaagaccgggaacgattcgatcgcctttttcagcagatcaagcaagagtatcaattaaccagggactttgccatggaaattacggcccatccccacctcctggacggcgatcgctctttgcaacggtcggtactcctacgaaatcgtactattgttcccctggggctactgcagatttccctgctgaaacgtttacgccaagtaacccaggaagcggagaccagcggcgtgcgttaccgtcgttattccaaagaagaactactgcggggagctctgttaaccattaacggtattgcggccggaatgcgtaatactggttga

SEQ ID NO: 26444 - DNA, 1575 bp, Synechocystis sp.
atgcctctgcttgtgttccgttctctatcccgttgtctattggtcactgccctaatattggttctccatggacccgggctttggtcccatccggcgatcgccgctgacttggccccgaccaataaccgcaatagccaaaccctgactccctacctcaaccgggcgatccagaggataacggaatttcaactggataatggcttgaaatttattgtgatggaaaataatgaggctccagtggtgtctttttacacctattttgacgtggggggcgtggacgaaccagtgggaaaaactggggtggcccactttttggaacacatggcgtttaagggaacggaacgcattggcactaaggattttacccaggaacaacagttgttggatcagttagaccaagtgtttgcccaaatcaccactgccagggctaaaggagataagacgggggaacaaaagttacaggagcaatttaagcaaatccaacagcaggcccaggatttaatcaagcagaacgaatttggtcagattatccagatggccgggggcgtgggtttaaatgcggccaccagtgccgatgctactttttacttttacagtttgccttctaacaagctggaactgtggatgtctctagagtcggagcgctttttggagccggtatttcgggaattttaccaagagcaggaggtgattctggaagagcggcgcatgcggaccgaaaataacccagtggggcaaatggtggaggaatttttagatacggcttttaccaaacatccctaccgccgcccggtgattggctatgacgaagatatccgcaatctttcccgccaggacgtgacggatttttacgagaaatattacatccccggtaacatgaccattgccgtggtgggagacgtgaaggttgaccaggtaaaaagtttggcgcagaaatattttggtcgtttcccccagcgtccccctacgccccaggtaacggtggtggagcctccccagacgcagcagaaggaaattaatctgaccttgccttcccaaccctggtacttcgagggttaccatagccccgcttttgatgatcccgacagtgcggtgtttgatgtgatgacgactattttgagcagtggccgcacttcccgcctttatcaatccctagtggaagaaaaacagttggcattgatggcccagggctttaacggttttccggcggataaatttcccaatttgttaatgttctatgcccagagtgcccccggtcgcagtttggacgaccttagcgaggcgttacacggggaaattgaacggctaaaaatggaacccgttaccccggaggaattggagcgggcccaaaatttactgcaaacttccgctttgcaatccctcaattccaatatgggcatggcccaactgttggtgaaatataacgtccgcaccggggattggcgtaatttgtttgcccgcttagaggcgatcgccgcagtgacaccggaggatattcaacgggtggcccaagaaacttttcgtccagaaaacagtaccattggtcggattttaccggaatctaatcgccaatga

SEQ ID NO: 26445 - DNA, 1470 bp, Synechocystis sp.
atgcgtgttgcaattgtgggagcaggattggcgggaatggccaccgcagtggaattggtagatgcggggcacgaagttgaactgtacgaagcccgtagtttcatcggcggtaaagtgggcagttgggtggacggcgacggtaatcacattgaaatgggtctgcacgttttctttggctgttactacaacctttttaacctgatggaaaaggtgggggccaagcaaaatctacggctcaaggaacatacccacacctttgttaaccaagggggccgcattggtgaactggactttcgtttcctcaccggtgctccctttaacggtctgaaagcatttttcaccacgtcccaactggataccaaagataaaattgccaactccatcgccctggccaccagtcccattgtgcggggtttagtggactttgacggagccatgaaaaccatccgggatttggacagaattagttttgcggaatggttcctcagcaaaggtggcaacgaaggtagtttgaaaaaaatgtgggacccgatcgcctacgcgttgggttttatcgatacggaaaatatttctgcccgctgtatgctgaccattttccaactgtttgccgcccgcacagaagcatcagtgttgcggatgttggaaggttccccccaggaatatttacacaaacccattcaggaatatttggaacaacggggcaccaagttttacaccaggcacaaagttaaggaaatcaagaccaaagttacggacggggaaaccagggtaacaggattaattatcaatgacggcgtggaaaccaaaaccgtaaccgccgatgcttatgtagccgcctgtgacgtgccgggtattaaaaatctgttgccggaaaattggcgcacccaatgggattttttcaacaaaatttactatttagacactgtccccgtggccacggtgcaactgcgctttgacggttgggttacggaaatgaacgatcccgctaaacgcaaacagttggaacaagcctttggcttagataatttgctctacaccagcgacgcagagttttcctgttttgccgacctcgccctcactagccccgccgactattaccgcccaggggaaggttccctattacaactggtattgacccccggtgacccttttatgaaagaatccaacgaggcgatcgcctatcgggtactcaaacaagtcaaagcccttttcccctcagcggcggatttgaatatgacttggtacagcgtaattaaactagcccaatctttgtaccgggaagcaccgggcatggacctgttccgccccagccaagcaacccccatagccaacttctttttagccggtagctacacccaacaggattacatcgatagtatggagggggccaccctgtccggtcgtcaagcggcccaggcgattttggccaaccaagcccgtttgcaaactgcagtcctggcatctcagtaa

SEQ ID NO: 26446 - DNA, 984 bp, Synechocystis sp.
gtgcagagtttcaataggataaattcaatgaaatatttccctttgagcaatggggagcagattcccgccctgggtctgggaacatggaaatcgtcccctcaggtagtgggtcaagccgttgagcaagctttggacttggggtatcgtcaccttgactgtgctgctatctatggcaatgaagcagaaattggagctactttagccaatgctttcaccaagggggtggtcaagcgagaggaactctggattacctccaagctgtggagtaatgcccatcatcccgacgcggttttacctgctctcgaaaaaactttgcaggatttgggtctagattatttggatctatatctaatccattggccggtggtcattcaacccgatgttggatttcctgaatccggtgatcagttactaccatttaccccggcttccctagaaggaacctggcaagcgttggagaaggccgttgatttgggactctgtcaccatattggggtgtctaatttcagcctgaagaagttggaaatggtgctgtccatggcccgtattccccccgctgtcaatcaggtggaattgcacccctacctccaacaatcagacttgctaacgtttgctaactcgcaaaacattttactaacagcctattctcccctgggctctggcgatcgcccggcggccttccaacaagcagcagaaccgaaattactaactgatccagtgattaatgggattgcagctgaacaagggtgcagtgcggcccaagtccttttggcctgggccattcaacggggaaccgtgaccattccgaagtcggttaatcctgaacgactagaacaaaatttgagggcggcagatatcaccctcacggatagcgagatggcgaaaattgccctattagaccgtcattaccgctacgtgtcgggagacttttggaccatgccgggcagtccctatacgttacaaaacctatgggatgaaatttaa

SEQ ID NO: 26447 - DNA, 903 bp, Synechocystis sp.
gtgatgactctcgaaccaaaccaggaacaactgaaaaaaatgaaatcccatcctggtttcattgccgccctagaccaaagcggtggtagtactccaggggcgttggccgattatggaatcgaacccaatacctattctggtgacgaccaaatgttcgcactggtgcatcaaatgcggaccaggatcatgaccagtcccggcttcactggcgatcggattttggccgcaatcctgttcgaggacaccatgaaccgggaggttgatggggagcccacggccaactacctttggcaaaacaaacaaatcgtaccgattttgaaggtagacaaaggactggcccaagagaaggatgggagccaattgatgaagcccattccccagcttgacagtctgctaatgaaggccaagaaaaaaggcatcttcggtaccaaaatgcggtcatttatcaaacatgccaatcccgccggtatcgaggcgatcgtggaccagcaattcgagctagcccagcaaattattgccgctggcctggtgccgattattgagcccgaagtagatattcactgctcggagaaagctcaggcggaagcgttactcaaacaagccatgctgaaacatctcaaccaattacccaaaggacagtgggtgatgctcaaactcactctgccggagcaagacaacctttatagcaattgcatcgaacatgccaatgtcttgagagtggttgctttgtcggggggctactcccaagcggaagctaatgagcgtctaagcaggaatcacggtgtcatagcaagcttttcacgagctttgactgagggactaacggcccaacaaactgatgctgagttcaacaccatgttggacgaatccattgaaaaaatctatcaggcatcgattacgtag

SEQ ID NO: 26448 - DNA, 1044 bp, Synechocystis sp.
atgaccgttagtgagattcatattcctaactctttactagaccgggattgcaccaccctttcacgccacgtactccaacaactgaatagctttggggccgatgcccaggatttgagtgccatcatgaaccgcattgccctagcgggaaaactgattgcccgtcgcctgagtcgagctgggttaatggccgatgtgttgggcttcactggggaaaccaacgtccagggggaatcggtgaaaaaaatggacgtatttgccaatgatgtttttatttctgtctttaagcaaagtggcttggtttgtcgtctggcttcggaggagatggaaaaaccctactatattcctgaaaattgccccattggtcgctatactttgctgtacgaccccattgatggttcctccaacgtggacattaacctcaacgtgggttccatttttgccattcggcaacaggaaggggacgatctagacggcagtgcgtcagatttattggctaacggagacaagcaaattgctgctggttatatcctctacggcccctccaccatcctggtttattccctcggctccggagtgcatagctttatcctcgatcccagtttgggggaatttattttagcccaggaaaatatccgcattcccaaccacggccccatttacagcaccaatgaaggtaacttttggcaatgggatgaagccctgagggattacacccgttacgtccatcgccacgaaggttacactgcccgttatagcggtgctctggtgggggatattcaccggattttgatgcaagggggagtgtttctttatcctggtacggaaaaaaatcccgacggcaaattgcgtttgctctatgaaactgcgccgctggcctttttggtggaacaggctgggggaagggctagtgacggccaaaaacgtttactggacttaattccttctaaattacatcagcgtacccccgccattattggcagcgcagaagatgtgaaattggtggaatctttcatcagcgaccacaaacaacggcagggtaattag

SEQ ID NO: 26449 - DNA, 2619 bp, Synechocystis sp.
atgcaacccacagatcctaataaatttacggagaaagcttgggaggcgatcgccaaaacaccggagattgctaaacagcatcgacaacagcaaattgagacggaacacctactcagtgccctactagaacaaaatggtctggccaccagcatctttaataaggctggggcgagcattccccgagttaacgatcaagttaatagctttattgcccaacagccaaaattaagtaatccgagtgaatcgatttatttaggccgcagtctcgataaattgttggacaatgcggaaatagccaagtctaaatatggagacgactatatttccatcgagcacttgatggcggcttacggccaagatgaccgcctgggcaaaaacttatatcgagaaattggcctaacagaaaataagttggcagaaattatcaagcaaattagaggaacccaaaaagtgaccgatcaaaatccagagggcaaatacgaatcccttgaaaaatatgggcgagatttaacggaattagcccgggaaggtaaactagatcctgtcattggccgggatgaagaagtgcggcgcaccattcagatcctttcccgccgcacaaaaaataaccctgtgttaattggggaaccgggggttggtaaaacggcgatcgccgaaggtttagcccaaagaattattaaccatgacgtaccggaatcattgcgggatcgcaaactaatttccctcgatatgggggcgttaattgccggggcaaaataccggggggaatttgaagaaagacttaaagcggtacttaaagaagttaccgacagccaggggcaaattattctctttattgacgaaattcataccgttgtcggcgctggggccacccaaggagccatggatgcgggcaacttattgaaacccatgttagcccggggtgctttgcgttgtatcggggccaccactttagatgaatatcgcaaatatatcgaaaaagatgcggctttggaacgacgtttccaggaagttttagtggatgaacccaatgtattagataccatttccattctccggggattaaaagaacgctatgaagtacaccacggcgtaaaaattgccgatagtgccctggtagcggcggccatgttgtccaatcgttacatcagtgatcgttttctgccggataaagctattgatttagtagacgaagcagcggccaaattaaaaatggaaatcacctccaaaccagaggaattagatgaagttgaccggaaaattctccaactagaaatggagcgtttatctttacaacgggaaaatgattctgcttccaaggagcggctagaaaaattggagaaagagttggctgattttaaagaagaacagtctaaacttaatggccaatggcagtcggaaaaaacggttattgatcaaattcgtactgttaaggaaaccatcgaccaggtgaacctagaaattcaacaggcccaacgggattacgactacaataaagcagcggagttacagtatggcaaattaactgatttacagcggcaagtggaagctttggaaacccaattggcggagcaacaaacctctggcaaatccctcttacgggaagaagttttagagtctgacattgctgaaattatctcgaaatggaccggcattcccatcagtaaattggtggaatcggaaaaagaaaaactgctccacttggaagatgaactacacagccgagtgattggtcaggatgaagcggtaaccgccgtagccgaagccattcaacgctcccgagctggtctttccgatcctaatcgtcccaccgctagctttatttttctgggccccacaggggtcgggaaaactgagttagcgaaggctttggcgaaaaatttattcgacacggaagaagccctggtgcggattgatatgtctgaatatatggaaaaacacgctgtttcccgtttaatgggggcccctccgggctatgtgggctatgaagaagggggacaattgacggaagcaattcgccgccggccctattcggtcattctttttgacgagattgaaaaagcccatggggatgtgtttaacgtcatgctccaaatcctggatgatggccgtttaaccgatgcccaaggccatgtggtggacttcaaaaatacgattatcattatgaccagtaacctgggctcccaatacattttggatgtggcgggggatgatagtcgttatgaagaaatgcggagccgagttatggatgtaatgcgggaaaacttccgcccagaatttctcaatcgggtggatgaaacgattattttccatggcttacaaaaatccgagttacgatccattgtccaaattcaaattcagtctttggctacccgtttggaggaacaaaaattaactttgaagttaacggataaagccctagattttctggctgccgtgggctatgaccccgtttatggggcccgacctttaaaacgagccgtccaaaaatacctagaaacggcgatcgccaagggaattttacggggggattacaaacctggtgagaccattgtggtggatgaaaccgacgaacgcctcagttttaccagtttaaggggggatttagtcatcgtttag

SEQ ID NO: 26450 - DNA, 1755 bp, Synechocystis sp.
atgctactatccctgcggatcaataactttgctttgattgattgcttagaaattaactttgggcaaggcttgaatgtattgacgggggaaaccggcgccgggaaatcaattttgcttgatgcgattgatttattactaggaggaaaggccggagcgagggttttgcgccaggggtgttccagcggtgtgattgaaggaattttttccaccagtaccgagcttaatgattggttagcaacccaagccattgaaccattggaagacaacaccattgcctgcacgagggaatttagcaaaaaaggaagctcattaaattcccgttcccgcctgaatggagtgttggtaaatcgccaaattttggcagaattgcggagccaattggtggaaattacagcccagggccaaactcaacaactattagatccggggcaacaacggcaactactggatttatttggcgggcaaaacttattagaaaaacgtcaagcggtggaaataacttataaagaatttacccaagccaaacaagctttaacagccaggcaacaatcggaacaaaatcgtttacaacggctggattttttaacctatcagttacaggaattgaccgaagcagaattaaccgatggcgatgaatgggaattgttaatccaagaacaggaaaaactttcccatgtggtggaactacaacagttaagctatcaagccacccagcttttgtaccaaagtgaacgggataccccggcgatcgccgatttgttgggggatgcggaaggacagttgcaaaccatggcggaatttgacagtagccttaatcccttattggaactggtacaaacagctttaacccaagtaattgaagcaggacggcaagtgcaacgctatggagataatttggaagctgatccagagcggttaggggaagtggaagcaagattgcaggtgctgaaaaggatttgtcgtaaatatggccctagcttaaccgaagcgattgcctaccaagaaaaaatccaagctgaatatgaccagttgacggatggagaacaatccctcgcccagttgcaggaatctttgaccaaggcagagcaagaattaattaaacattgtggtcagttaactttaattcgccaaaaaacggcgcaaaaactagaaaaaaggttggtacaagaactcaagcccctggccatggaaaaggtaatttttgtttgccaattggagtccagtgcccccagtagtttcggcgcagaacaggtggtgttttatttcagccccaacaccggggaaaaaattcaacccttggccgccactgcctccggtggggaaatgagccgattcctcctggccctcaaagcctgttttagtgaactggctccccccagccaaaccttaatttttgatgaaatcgacgtgggagtatccggcaaagtagcccaggcgatcgccgacaagctagcccaactcagtcagcgccaacaactgctctgtgtcacccatcaacctttggtggcggccctggccgatgcccatttccatgtggacaaagtggtcattaatgaaaatattgccgatcccaccaatccccagcttgacgaagatttacgcaccgttattcgcattactcccctccaatccgacggcgatcgccaacaggaattagcccaactcaccgggggccattccgccaaagaagcgttagcctttgcccaatctttattggaaaaatccgccgcccgtcgccaagcctcccaagtttaa

SEQ ID NO: 26451 - DNA, 1344 bp, Synechocystis sp.
atggccttgctttccctcaacaatcatcaatcccatcaacgcttaactgttaatccccctgcccaaggggtcgctttgactggccgcctaagggtgccgggggataaatccatttcccatcgggccttgatgttgggggcgatcgccaccggggaaaccattatcgaagggctactgttgggggaagatccccgtagtacggcccattgctttcgggccatgggagcagaaatcagcgaactaaattcagaaaaaatcatcgttcagggtcggggtctgggacagttgcaggaacccagtaccgttttggatgcggggaactctggcaccaccatgcgcttaatgttgggcttgctagccgggcaaaaagattgtttattcaccgtcaccggcgatgattccctccgtcaccgccccatgtcccgggtaattcaacccttgcaacaaatgggggcaaaaatttgggcccggagtaacggcaagtttgcgccgctggcagtccagggtagccaattaaaaccgatccattaccattcccccattgcttcagcccaggtaaagtcctgcctgttgctagcggggttaaccaccgagggggacaccacggttacagaaccagctctatcccgggatcatagcgaacgcatgttgcaggcctttggagccaaattaaccattgatccagtaacccatagcgtcactgtccatggcccggcccatttaacggggcaacgggtggtggtgccaggggacatcagctcggcggccttttggttagtggcggcatccattttgcctggatcagaattgttggtggaaaatgtaggcattaaccccaccaggacaggggtgttggaagtgttggcccagatgggggcggacattaccccggagaatgaacgattggtaacgggggaaccggtagcagatctgcgggttagggcaagccatctccagggttgcaccttcggcggcgaaattattccccgactgattgatgaaattcccattttggcagtggcggcggcctttgcagagggcactacccgcattgaagatgccgcagaactgagggttaaagaaagcgatcgcctggcggccattgcttcggagttgggcaaaatgggggccaaagtcaccgaatttgatgatggcctggaaattcaagggggaagcccgttacaaggggccgaggtggatagcttgacggatcatcgcattgccatggcgttggcgatcgccgctttaggtagtggggggcaaacaattattaaccgggcggaagcggccgccatttcctatccagaattttttggcacgctagggcaagttgcccaaggataa

SEQ ID NO: 26452 - DNA, 1296 bp, Synechocystis sp.
gtgatcgaacgttataccctgcctgaaatgggcaaaatttggacggatacctacaagctacaaacctggctagacgtggaaatcgccgtttgtgaagcccaggcggagttgggttatattccccaggcagcggtggacgaaatcaaggccaaagctaagttcgatccccaacgagtgctggaaattgaggcggaagtgcgtcacgatgtcatcgcctttttaaccaacgttaatgaatatgtgggggatgcggggcgttatattcacctgggactaacaagctccgacgtactggacaccgctctggcgttgcaattggtggcgagcctagacctgattttggagcagttggaaaaactaattcaggccatccgttaccaagctcagcagcatcgttacaccgtcatggtgggccgttcccatggtatccatgccgaacccatcacattcggatttaaactcgctggttggttagcggaagtattgagaaaccgcgatcgcctggtgcgggtagcccaatccattgccgtgggtaaaatttccggcgccgtgggcacctatgccaacattgaccccaaagtggaggcgatcgcctgtcagaaattaggcttagaaccagatacggcttccacccaggtcatttcccgagatcgccatgcggaatacgtgcaacagttggctttgctggccgcctctttggaacggtttgcagtggaaattcgcaacctgcaacgcaccgatgttttggaagtggaggaatatttttccaagggccaaaagggttcttccgctatgccccataaacgtaaccccatccgctcagaacgattaacgggaatggcccggctggttcggggtcatgcagtggcggcgttggaaaatgtagctctctggcatgaacgggatatttcccacagttctgtggagcgggttgcttttcccgactgctgtattctcacccattttatgttgaaggaaaccacggatttggtgaaaaatctgttggtctatcccgaaaatatgaaacgcaatatgaacgtttacggcggggtaattttcagccaaaaagttctgcttgccctagtggaaaaaggcatgaatcgagaagatgcctaccgagtggtgcagggttccgcccaccaagcctggaacacggaagggggcaattttgaagagctagtccgagctgatgcccaggtaacggccctactttctgccgaagaaattgaccagtgctttgacccccaacaacatttgactaacctggcggaaatttacagccgtttggatatttag

SEQ ID NO: 26453 - DNA, 1080 bp, Synechocystis sp.
atgctaacagcggaaagaattaaatttacccagaaacgggggtttcgtcgggtactaaaccaacgggtggatgcctactttgccgagcatggcctgacccaaagggataatccctccatgtatctgaaaaccctgattattgtgctctggttgttttccgcttgggcctttgtgctttttgctccagttatttttccggtgcgcctactgggttgtatggttttggcgatcgccttggcggccttttccttcaatgtcggccacgatgccaaccacaatgcctattcctccaatccccacatcaaccgggttctgggcatgacctacgattttgtcgggttatctagttttctttggcgctatcgccacaactatttgcaccacacctacaccaatattcttggccatgacgtggaaatccatggagatggcgcagtacgtatgagtcctgaacaagaacatgttggtatttatcgtttccagcaattttatatttggggtttatatcttttcattcccttttattggtttctctacgatgtctacctagtgcttaataaaggcaaatatcacgaccataaaattcctcctttccagcccctagaattagctagtttgctagggattaagctattatggctcggctacgttttcggcttacctctggctctgggcttttccattcctgaagtattaattggtgcttcggtaacctatatgacctatggcatcgtggtttgcaccatctttatgctggcccatgtgttggaatcaactgaatttctcacccccgatggtgaatccggtgccattgatgacgagtgggctatttgccaaattcgtaccacggccaattttgccaccaataatcccttttggaactggttttgtggcggtttaaatcaccaagttacccaccatcttttccccaatatttgtcatattcactatccccaattggaaaatattattaaggatgtttgccaagagtttggtgtggaatataaagtttatcccaccttcaaagcggcgatcgcctctaactatcgctggctagaggccatgggcaaagcatcgtga

SEQ ID NO: 26454 - DNA, 1125 bp, Synechocystis sp.
gtgcccctagataacggcagcatcaccgacgacaccaggattcgggcagccttacccaccatcaaagacctgttgagcaaaggcgccaaagttattttgggcagtcattttggccgtcccaagggcaaagtagtggacagcatgcgcctcacccccgttggcgatcgcctaggggaattattgggccagccggtggtcaaatgcgacgattgcattggtgctgaagttacagccaaaattgctagcctacccaatggtggtgtggccctgttggaaaatctccgcttccatgccggggaagaaggtaacgatgctgaatttgccaaagctttagcggccaacgccgacctctacgttaacgatgcctttggtactgcccaccgggcccacgcttccaccgaaggggtcacccatttcctcagccccaacgttgctggttacctaatcgaaaaggaattacagttcctccaaggagccatcgaagcccccaaacgtcccctagtggcgatcgtgggaggttccaaagtgtccagtaaaatcggtgtgatcgaaaccctattggacaagtgcgataagttgatcatcggcggcggcatgattttcaccttctacaaagcccaaggtttaaacaccggcaaatccctggtggaagaagacaaattggacttggccaaatccctcatggctaaagccaaagaaaaaggcgtggaatttctcctgcccacggacgtagtagtggccgacaactttgcccccgatgccaatgcccaaaccgttggtgtcgatgcaattcccgatggttggatgggtctagacattggtcccgactccgtcaaaaccttccaggatgccctcgctggttgtggcactgtcatctggaacggccccatgggggtatttgaatttgacaaatttgccgttggtaccgaggcgatcgcctgcagcttggctgaattgaccgccagtggcactgtcaccatcatcggtggtggagattctgtcgccgcagtggaaaaagtgggagtggccgaaaaaatgagccatatttccaccggtgggggcgctagcctggaattgctagaaggtaaagttctgcccggcattgccgctttagatgaccgataa

SEQ ID NO: 26455 - DNA, 657 bp, Synechocystis sp.
atggccatggaggtaaaaatttgcggtttacgccatcctgcccaagcccaggcgatcgccgctttgggattcaccaccctgggatttatttgtgtggaagcttcttcccgttacgtcagctccagggaaattgaactggttttgcaaagcttaactgcccataacaagcgatcggcgatcggagtatttgccaatgtttccctccctaaactgggggaatttttagcccaaactagtctgaacggtatccaactccacggcgatgaaagccccgacttttgccgccaggttaaacaagcatttccccaacaccgattgatcaaagctctccgactccggcgatcggcagatttagaacgggctgaagcctattacaatgccgtggatgtcctcctgctcgacgcttaccatccagaacaattgggaggtactgggcaaaccctaccctggcaaaagctacagcagtttcggccgcccctgccctggtggttggcggggggattaactcctagcaatgttcaagaagccttaaatttactccagcctgacggcattgacctttccagtggcgtggaacagggcccggcggataaggatgtggccaaagttgcccagttaagggctcagttggacgccctagcaattttgcagcactaa

SEQ ID NO: 26456 - DNA, 2697 bp, Synechocystis sp.
atgcaacctactgatccaaccaaatttactgaacaagcctgggacgccattgttaaatcccaagaagtagcccgtcgttataagaacacaaatttggaagtagagcatattctgctggcgttgttggagcaggatatgggtttggcggcaaggattttccagcgggcggcggtggatggcgagggactacggcaacagttggaaattttcaccaaccggcaacccaagcaggcttatgtagaacaactttacctggggcgtagtttggatgtgatgctagaccgggccgatgccgcccgtagtagctgggaagataaattcatttccgttgaacatttactggtggggtttgcagaggacgaccgggtggggcgcaaaaccctccgcgcgtttaaccttgacccccaggatttagagttggccatcaaagcgattcgaggttcccaaaaggtgacggagccaaatcaagaagaaaaatatgaagcgttggataaatacggacgagatctgacggagcaggcccgccagggtaagctagacccagtgatcggtcgagatgaggaaattcgtcgagttattcaagtactctctcggcgttccaaaaataaccctgtcctgatcggtgaaccgggggtgggcaaaacggcgatcgccgaaggtttggcccaacggattatcaatggcgacgtaccagaatcattaaaaaatcggcagttaatttccctggatatgggcagtttaattgccggggctaaatatcggggggaatttgaagaaagactgcggtcagtgatgaaggaagtgaccaattccgatgggcaaatcatcttattcattgatgaagtccataccgtagtgggagccggtggtcgcgaaggttctgggtccatggatgcagggaatttgctcaagcccatgttagcccggggggagctgcggtgcattggggccaccacattggatgaataccgcaaaaacatcgaaaaagatcctgctttagaaagaagatttcaacaggtttacgtcaagcaacctagcgtggatgatacgatttccatcctgcggggtttgaaggaaaaatatgaagtacaccatggggtcaaaatcaccgactccgccctagtagcagcagctaccctttcccatcgctatatccaagatcgatttttgcccgacaaggcgattgatttagtggacgaagcagccgcccgattaaaaatggaaattacttccaaaccggtggaattagaggatattgaccgacgcttaatgcaactacaaatggaaaaactttccctagaaggggaagaaaaacgtcctggtttaggagctgacaaatcttccaaagaaagactagaaaaaattcagcaggaaattactgaattagagggtcagcaacaggaattatccggtcaatggctgtcggaaaaacagatgctggaagaaattaacaccctcaaagaaaaggagcaagagctaagacttcaggtagaaaaagctgagcgggccactgattgggaaaaggccgccaaaattaagtacggagagttagaagtcctccaacatgacattgaagaaaaagaaagtaaattactagaaattcaaggctccggtaatactcttttgcgggaacaggtaacggaatcggacattgccgaaattgtcgccggttggacgggcatccccatgaaccgtctcatggaaacggaacggcaaaaattattgcaattggaaggtcacctccatcagcgagtgatcggtcagaaggaggcagtagcggcagtttctgcggccatacgtcgggctagggccggcatgaaggaccccagtcgccccattggctcttttctgtttatggggcccacgggggtaggtaaaacggaattggctcgggccttggccgggtttctgtttgacagcgaagaagccatggtgcggattgatatgtccgaatatatggaaaaacacgccgtttcccgtttaattggagctccccccggttacgtgggctacgaggaagggggacaattatcggaagcagtgcgccgtcgtccctattccgttgtgttgttggacgaagtggaaaaagcccatttagacgtgtttaatattttgctgcaggtcttggatgatggccgcattaccgattcccaggggcgggtggtggattttcgcaacaccattatcgtcatgaccagtaacattggcagtgaccatattctcagcctttccgccgatgatgccgactacgacaaaatgcagaaacaggtattacaatccctgcgcaaacatttccgtccggaatttctcaaccgtattgatgatctaattattttccatacgttgaaacgggatgagttgcgtcgcattgtcgtcctacaaattaaacgcatcgagaagttattagacgagcaaaaaatcacgctttctctttccgatgctgccctggatcacatcgtcagtgctggttacgatcccacctacggagcaagacctttaaaacgtgctattcaacgacagttggaaaatcctattgccactaaaatcttagaaaatactttcgttgcaggggacaaaattctcattgattgtgtggatggtcagttaatctttgataaagaaatagagcccacaacattaccagaagagccagaagaaaatatcacagcggtggaagtcgaggttctttcttcataa

SEQ ID NO: 26457 - DNA, 1326 bp, Synechocystis sp.
atgcatccggttgttagttccgctgaatatcgtcaacgtcgcgatcgcctaatggccaagctaggccaggggacggccatttttgccagtgcgccccaggcggtgatgcacaacgatgtggaatacgtatttcgtcaagatagtgatttttattacctgacgggcttcaatgaaccggaggcgatcgccgtttttgcgccccaccacgaagaacatcaatttattctatttgtgcaacccaaggatccagccaaggaaacctggacgggcattcgctacggtgtggagggggttcaatccagctttgggtcggacattgcctatcccattggggaattggatgagcatttaccgaaatatctggaaaaggcagataaaatccattaccacctcggtcgagatgaagcgttaaatcaaaccatcctcaagcactggcaaaaacaattggccgcctatccccgccaaggctatggtccccaagctttagtgaattcccatcccttggtgcatcccctccggcaagttaaaagtgaaactgaattagccttgttgcggcgggcctgtgacctgtcggcgatcgcccatcaacgggccatggaatttgctcgaccgggacattacgaatatcaagtgcaggcggaattggaaattatttttcggcgggaagggggcctggggccggcttatccttccattgtggcggcaggaaaaaatgcctgtattttgcactacatcaacaatgactgccctttgcaagatggggatttactactcatcgatgcaggttgtgcctacggttactataacggtgacatcacccgtacctttcccatcaacggtaaatttagtcccgaacaacgcaccctctacgaaattgttctaactgcccaggaagcggcgatcgccaaggtacaggcgggcaatccctaccacgaataccatgatgcggcagtgtccgtgattgtggatggtctgatggatttgggtctactggtgggaaataaggaggaaattatcaaagaagaaaaatataagcccttctatatgcatcgcaccggccattggctggggctagatgtccacgatgccggcaattacaaacaggataaggaaacctggacggtgttggagccagggcaagtgctcaccgtagaaccgggtatttacatcgcccccgatattaaacccgccgaaggacagccggaagtgccggaacaatggcgaggtattggcattcgcattgaggatgacgtattggtcactgcccaaggccccgatgtgttaaccagtgccgtgcccaaggcgatcgccgatttagaacattga

SEQ ID NO: 26458 - DNA, 1029 bp, Synechocystis sp.
atggtttcagaacgcattttgcctgaattgaacaccgcagaaatttccctggacagagaaaccgccttagtgctttacgaagacatggtcctgggtcgcttcttcgaggataaatgcgctgagatgtattaccggggcaaaatgtttggttttgtccacctctacaacggccaggaagcggtgtcctctgggataatcaaagccatgcgccaggatgaggattacgtttgcagtacctatcgagaccatgttcatgccctcagtgcgggagttccagctcgggaagtaatggcggaactgtttggtaaggaaaccggttgcagtcggggtcggggtggttctatgcacctattttcctcggcccataatctcctggggggctttgcgttcatcggggaagggattcccgtggccctgggagcggcgtttcaaactaagtaccgccgggaagtgttgaaagatgacggctacgaccaagttaccgcctgtttcttcggtgatggcaccagtaataacggccagttttttgaatgcctgaacatggccgccctgtggaaactgcccattctgtttgtggtggaaaataataaatgggcgatcggtatggcccacgagcgggcaacgtcccaaccagaaatctacaaaaaagccagtgtgttcaacatggtgggggtagaagtggatggtatggatgtggtggcaatgcataaagtagcaacggaagcagtggctagggccagggcaggcgaagggcctaccttgattgaagcgttgacctatcgtttccggggtcactccctagcggatcccgatgaactccgttctgccgaagaaaaacagttttgggctgcccgggacccaattaagaaatttgccgctttcatgacggaacacgaattagccagcaatgaagagctaaaggcgatcgataaacgcattcaagaagtaattgacgatgccctggcctttgccgagtctagccccgaacccaatcccgaagatctgaggaaatatattttcgccgattag

SEQ ID NO: 26459 - DNA, 828 bp, Synechocystis sp.
atggccaatctattttttctcggttttcccatggacatcgccagttggaacgttaattccgtccgcagtcgtcagcaacatatcctcgattggttgggcacaaaccctgttgatgtactttgtttgcaagaaactaaggtggtggatgaagattttccccggcaaccgtttgaagaggcgggctaccattgccatatttctgggcaaaagtcctataacggcgtggccattttcagtcgggaaccattgcaagacgtgaaaatcggttttgcggccctagtggagccagccttgacgggggatttggatgaacaaaaacgagtgatcagtggcgtttatgacggtgtgcggatcgttaatctctacgttcccaatggatctgccctcgacagtgaaaagtatttgtataaattgcggtggttaaacttactgcagacctatctggagcaactgcgccgtagtgacaccccagaatttttggtctgtggagatttcaacattgccccagaagaccgggatatccatgacccagtgggccgggagaatcatattatggccactgccatggaacgggaagctttaacggaagtgttggcgatcgccaatttgcaggatgctttccgtaaatttaccgaagaaacgggccattacagttggtgggattatcgcactaggggctttagtcgcaaccgggggtggcgcattgaccaccattatctaactccccaactctacgaccaggcccaaaaatgttggatagatagggaacccaggggttgggaaaaacccagtgaccatgctccggtggtggtaactatcaacaattaa

SEQ ID NO: 26460 - DNA, 450 bp, Synechocystis sp.
atggaacgcacatttatcatgatcaagcccgatggggtacaacggcaattaattggggaaattgttggccgtttcgagaaaaaaggcttcaaattagtcgccatgaaggtgatgactgtctcccaagaattagccgaaaaacattacgaagctctcaacgacaaaccgttcttttccggcttggtgaacttcatttgttcctctcccgtggtggccatggtctgggaaggtaattccatcgtttctacttcccgccaaatgattggtgcaactgatccccatgctgccgcccctggtactatccggggagattacggtgtgtccgttggtcgcaacattatccatggttccgatgccattgaaaccgctaaacgggaaatttccctctggtttaaggatgaggaagtgaatgaatgggatgccacccttaacccttggttgtacgagtag

SEQ ID NO: 26461 - DNA, 1599 bp, Synechocystis sp.
atggcagaggcaccgatcgccccggtggttctggtcatcctagatggctggggctatcgcccagatacccgcgcaaatgcaattgcccaggctaacacccccattatggatagtctgatcgccgcttatcccaataccctggtgaatacttcagggaaagatgtgggtttgcccaaaggtcaaatgggtaattccgaagttggtcacctcaatttgggtgctgggcgagtggtaccccaggagttggtgcgtattagtgatgccattgaggacggaactttttttgacaaccaagcgctgattgaagtctgccaacgggtgcgcgatcgccgaggaaaattgcatttaatcggtctttgttccgacggaggagttcattcccacattgaccatcttttgggactgattgacttggctaaactccagggcatcagtcaactttgcatccacgccattaccgatggccgggatactcccaccaatgaaggggcccattttgtccaacaaatccaagcccatctagagaaaattggcctgggccgcattgtcagtgtcagtggccgctactacgccttagaccgcgatcgccgttgggaccgggtggaaaaagcctatcgagtcatgaccgaagacggggtaggggatggccgcagtgccgcccaggtgatcaaggattattacgccagcgacatcaccgatgaatttattccccctactagaattggtgccggggcgatcgcctctggggatggggtaattttctacaacttccgtcccgaccgggccagacaactttgctacgccttggttaatcctagctttgatggttttcccagggaaaggattcagcctctggattttgtcacctttacccagtacgatcctgccctgccagtggttgtggccttcgagccgcaaaacttgaataacattttgggggaaattatctcccgccagggaatgaagcaattccgcaccgcagaaacggaaaaatatccccatgtcacctattttttcaatggtggtttggaacaaccctttgccggggaagaccgggagctaattcaaagccccatggtttccacctatgacaaagcgccccagatgtctgccaaagccgttaccgatgcggtttgtcgggccatggaaaaaggcatttattccctggtggtggtcaactatgccaaccccgatatggtgggacacaccggcaagctcaaagaagccattcaggcgatcgaaaccgtcgacctcaatttgggccgccttctggccagcgccgctaaagtggggggcaccgtgttgatcaccgcggaccatggcaatgcggaatatatgagcgatgaatccggcaatccctggaccgcccacaccactaatccggtgccgtttattttggtggaaggggaaggacgtaaaattcctggccacggcggtgaagtcaagctacgggaagggggaaaactggcggacatcgccccgactattttggatattttgcagttgcccgttccggcggaaatgactggtaaaaccttaatcgatcagccgttggtagaaatcaaggccaatcgcactccggtcaatctctcccgttag

SEQ ID NO: 26462 - DNA, 1302 bp, Synechocystis sp.
atgatttacgacattttcatgcccgccctgagttccaccatgaccgaggggaaaattgtttcttggactaagtcccccggcgacaaagtggaaaaaggtgaaactgtcttggtggtggaatcggacaaagcagatatggacgtggagtcctttaacgaaggttacctagccgccattctagttccagcaggggaagaagctcccgtgggggcaacccttggcctagtggtggaaacggaagcggaaattgccgaagcccaagctaaagctggctctggtggtggttctagtgcggctccgactgcaaccccagccccccaacaacctgaaccagtggcgatcgccagtgcaactgccatagagacaactccggcccctagcagtaacggcaatggcaaaggcagtgggcgaattattgcttccccccgggcgaaaaaactagccaaagagttaaaagttgatttagctaccattgctggcactggcccccacggcagaattgtggccgcagatattgaaagtgccgctggtaaacccgtcactgcttccatcgctgcccccagtgccccagctcctaaaacatcccctgcccctactccaagggtaacctctacccccagtgttcccgtcggccagacagtacccctgaccactttccaaaaagctttggtgcaaaatatggtggccgccatggccgctcctacattccgagtgggctacaccatcaccaccgatggactggatcaactttataaacaaatcaaaggcaaaggggtgactatgacggccctgttggctaaagctgtggctctggccttgaaaaaacatcccattgtcaacgccagctacactgaccaaggcatcatctaccacaaggatgtcaacattgctctggccgtagccatgcccgatggcggtttaattactccggtgttgcaaaatgcagaccaagtagatatctactccctctcccgccgatggaaagaattggtggaacgggcccgggctaagcagttacagcctgaagaatacagcactggcactttcactatttctaacctgggtatgtttggggtagaccgatttgatgccattctaccgccgggtcaagggggaattttagcggtgggtgcttcccgtccccaagtagtggccaatgaggaaggtttgattggtaccaaacgacaaatggcggttaatgtaacctgtgaccatcgggtaatttatggggcccatgccgccgctttcctgaaggatttggctgtcattattgaagagaatgcccagtctttgactatgtaa

SEQ ID NO: 26463 - DNA, 2343 bp, Synechocystis sp.
atggttcaactttccccgacccctgcatcaaccctgacttacaaagacgcaaatgggcaaaatcgtactgctagcttgaccctcgacgtggggggcatgaaatgtgccggttgtgtggcggcggtggaaagacaattggatcaactaacgggagtgacggacagttgcgtcaatttggtcacagcggtggcggtggtgcgttatgaaccggaaaagattcaaccccaggcgatcgccgaacatttgagtcagcggggatttcccagtcagattcgtcatggccatggcgctatccctgcgacgataggggaaaaagagacaagggaaaacgttaactggggtttgaccattgccctggtgttactgctcctatcggggttggggcatctaagccattttggtggccccatgattccctttttccatcaccccatatttcattggagcttggcaaccctggcgatcgccataccggggcgggaaatttttcttgatggttggcgaggtttgagatttggccatgccaacatgaacactctggtggctttggggactggcagtgcgtacctcaccagttgcattgcctgggcttggcctggacttggctgggaatgcttttttgatgagccggtgatgttgttggggatgttactactgggcagaaccctggagagtaaagcaaggcaaaaagccaaatctgcgttgacagaattattggctttgcaaccatccctagctcggttagtggggcggggagaggaccaaggagaaactggcattgaaattcctgtggaacaggtgcgggtgggggaatgggtacaggtgctccccggggaaaaaatcccggtggatggcattctggtggcgggaaaaaccctggtggacgagtccttgttaaccggtgaatccctaccagtggcgaaaaatgttgatgatgccgtcattgcgggagcttggaatcagtccggagccattattattgccgctacccacattggagcagaaaccactttggctcgcattatccaactggtggaaacggcccaaacccaaaaagctcccatgcaacgattggctgatcaagtggcgggctggtttgcctatggggtgttggcgatcgccttggtaacgttaggcttctgggccatggtggggcaatccttatttcccgaaatggtggcggataccggactttctccccttttgctagctctcaaattgagtgtttccgtcttggtggtggcttgtccctgtgctttaggtttagccacccccacagcgattttggtgggcaccagtttgggagcagaacagggcattctgatcaaagggggtaacattctcgaaattcttcaacgcaccacggtgatggccttcgacaaaacgggcaccctcacccagggtaatttgcagttaaccgatgcggtgccagtggctgatattactgggattgaattattaaccctagcggcttctgtggaacagggaactcgccatcccctcgcccaaggcttaatctccagtgcccagggtctggaactattgccggtggaaaatatcgaaacggaagcggggcaaggggttcagggttggtaccaaggcgatcgcctgttggtgggaaatcaacaatggctcatggaacagggggtaatgggggaacctcaatggcaaacagcggtggatcaactgcttgaccaggggaaaaccgttatttttgtcgctcgcaatcagcaattacagggatttttagccttgcgggatactctccgaccggaagccaaggccaccattgcccaactgaaacaatggggtattgctcccttgctgttaaccggcgaccatcccgccattgcccaggcgatcgccatggaagtaggtatcgaggaatttcaagcccagatgaccccccaggccaaggtggccaaaatcaaggcaatgcaagggtttaaccctgtatcagtgatagcgatggtaggggacggcattaatgatgctccagccctggcccaggccgatgtaggcatttccctctccggggcgacagcggtggccatggaaacagccgatgtggtgttaatgcgctcccatctttccgatgtgctcaaagctttgaccctaagtcgtagcacagtggctaaaatcaagcaaaatctcctctgggctttgggctacaatctccttgccattcccctggccgctggggcattcttgcctagttttgccattgtgctgactccggcgatcgccgcggctatgatggccagtagttccattgtggtggtgttgaatgccctagctttgcggtatcaattttcccgttcccttggtcaagatcccggttaa

SEQ ID NO: 26464 - DNA, 1434 bp, Synechocystis sp.
atgaagattttatttgtggcggcggaagtatcccccctagcaaaggtaggtggcatgggggatgtggtgggttccctgcctaaagttctgcatcagttgggccatgatgtccgtgtcttcatgccctactacggtttcatcggcgacaagattgatgtgcccaaggagccggtctggaaaggggaagccatgttccagcagtttgctgtttaccagtcctatctaccggacaccaaaattcctctctacttgttcggccatccagctttcgactcccgaaggatctatggcggagatgacgaggcgtggcggttcacttttttttctaacggggcagctgaatttgcctggaaccattggaagccggaaattatccattgccatgattggcacactggcatgatccctgtttggatgcatcagtccccagacatcgccaccgttttcaccatccataatcttgcttaccaagggccctggcggggcttgcttgaaactatgacttggtgtccttggtacatgcagggagacaatgtgatggcggcggcgattcaatttgccaatcgggtgactaccgtttctcccacctatgcccaacagatccaaaccccggcctatggggaaaagctggaagggttattgtcctacctgagtggtaatttagtcggtattctcaacggtattgatacggagatttacaacccggcggaagaccgctttatcagcaatgttttcgatgcggacagtttggacaagcgggtgaaaaataaaattgccatccaggaggaaacggggttagaaattaatcgtaatgccatggtggtgggtatagtggctcgcttggtggaacaaaaggggattgatttggtgattcagatccttgaccgcttcatgtcctacaccgattcccagttaattatcctcggcactggcgatcgccattacgaaacccaactttggcagatggcttcccgatttcctgggcggatggcggtgcaattactccacaacgatgccctttcccgtcgagtctatgccggggcggatgtgtttttaatgccttctcgctttgagccctgtgggctgagtcaattgatggccatgcgttatggctgtatccccattgtgcggcggacagggggtttggtggatacggtatccttctacgatcctatcaatgaagccggcaccggctattgctttgaccgttatgaacccctggattgctttacggccatggtgcgggcctgggagggtttccgtttcaaggcagattggcaaaaattacagcaacgggccatgcgggcagactttagttggtaccgttccgccggggaatatatcaaagtttataagggcgtggtggggaaaccggaggaattaagccccatggaagaggaaaaaatcgctgagttaactgcttcctatcgctaa

SEQ ID NO: 26465 - DNA, 3129 bp, Synechocystis sp.
atgacagaatcgttgagtcccttactgccggaaattagtatcgccctggtgctggaacaactaaggcgtttatgtcggcaaaattgtcaaagccattggtattgcttacctggtgcgccttgggagatttctgattggcaaacttatccattgggtaaagttaacgagaagggttatttaatttgggaaaaaggcgaaaaaacccaatggtttgcccaaacttttaccgtgcctaaagctttggcggactatcctttagatggtttgacattgcggttagctttaacttggtgggccaaggatgctcaaatttttgttaatggcgagttagttcaagctggggatttatttgattctaaagctagagttttgttaactgataactcccaaattggtcgaacatttaccgtagctttaaagttaactagttccggccatgacattggtggattgatgcagtcccaattaatttttgagcggaaatatcctgacctagatccgggttttattgctgacgaaattgaagttctaagcttatatttagctcaatttgaatcagaaagactagctcaattaagtaaaactttagaagcaattacttggaataaaatttcagatcaagaacaatttgatcaatcattactgcaacttcgccagcggttactactgttaactgaaggactaaaacaacaacaaataaatttactagggcatgcccatctagatatggcttggttatggcagttggaggagacttgggaagtaggagaaagaacttttcaatcagtcattaatttacaaacagagtttgctgatttagtgtttggccacaccagtccggttttataccaatggattgaagagcatctaccggcattatttgagcaaattcaagtagcaattaaaaaaggaaactgggaacttttaggaggcatgtgggttgaaccagaagtaaatattattagcggtgaatccttagcccgtcaatttctttatggccagaggtattttgaagcaaagtttggtcaaattagcaaagttgcttggcttcccgatagttttggtttttgtggtcagttgccccaaatttttcatcaaagtgggatcgattattttgttactgggaaactccactggaacgatactaattcctttccccatggggctttccactggcgatcgccggatgggacagaaattttcacagtaatgtctccccccaacctagctggagtaatggataatcaacccttacctatggctaattatgctaatcgttggcaagagcaaaccggacttaaggaatgtctttggttgccgggggtgggagaccatggcggtggccccagtcgggatatgtgggagatgaaggaacggtggcaaaattcggaatttttcccaactattaacacagccaaggctgaacattttttagctggcattaaacagaagttacaatcagatcagtcttttcctatttgggaaagggaattatatttggaattgcatcggggctgttttactgttcatgctgaccaaaaactttataatcgccagtgtgaacatttactctatgaagcagaactttggagtagttttgctaattggttaggcggctatagctaccccaaagaaaaactagaactagcttggaaaaaagttttactaaaccagttccacgatattttgccagggacttctattcctgaggtttttgttactgctaatcaagcttggcaagaagtttaccaaactactaataaaatcattaatcaagcactaaaacatctcagtgatcagattaattatcctagttatcaccatgattcaaccgaacgagagacaccactattagtttttaatcctctccattggtcacaaagtcagcttgtggaaattcccattcaagaaggcaagcattatcaagtttatgatggtcaaacaaaaacgttggttaatagtcaaattacagcggaaggtagtctaatatttttagttgactcgccacctttgacttgtaagtactattggttaaaaacaaaagagcctttatccaacagtcagcaacttgaatctttcagtcaagaccctattttgaataatggtttactcaaagttgaaattagtttggataatggggaaatagccagcatttatgacttagctaaccaacgccaagttttggctggccatggcaatcagctacaatttttccgcgaccaagggcaatattgggatgcctggaatattgatcccaattacgagcaatatcctttatcttctgcaaaattgatcaattaccaatggctggaacaaggtcccctgcattggcgcttaagggtggtcaaaaaatttcagcaatcggtttttacccaggactattgcttaaccaaagattctccattactagaaattaaaactgaagtggattggcaagaaacccacgtgatggtgaaagcagcttttccgatcgctttgcaaagtgaattttttactacggaagctccttgtgctgtggttgatcgcccaactaatccccaaactgagacagaaaaagcccaatgggaagtaccccaccaacattggttttccttaactgatcaaacggaaaattatggggttagtttgcttaataattgtaaatatggttgtgatgtgaaagataatttaatgcgcttaactcttctgcgtagtagcgtgtggccagatccaagcgctgaccggggtaaacataaatttagttattacttttatccccatcaaggaaattggcaatcggcaaaaacggtagccgtgggttatggtatccatcgtcctttgcggacctattttcctgaaaatttcaaccccttatcaagtcaaaaattattatctccgggagagccctggttaaaccttggcagcgataatctttgtttaatggctctgaagttaagggaagattatcctgatcaatgggtattgcgatgttacgaaatgtcaggagaatcagcccaattagaagtaatcacagcttttgaccatagggttaaaacaaggctaaatttgttggaggaagcccaaccagaggaaaataataaccatgttaatccctggcaaattgttagcgtctgcttagcctatgactaa

SEQ ID NO: 26466 - DNA, 1911 bp, Synechocystis sp.
atgggaaaagttgttgggattgacctcggtactaccaattcctgtgtggctgtaatggaagggggtaaacccactgttatcgccaatgcagaaggttttcgcacgaccccatcggtggttggttatgccaaaaatggcgatcgcctagtggggcaaattgccaagcgtcaagcggtgatgaacccgggcaatactttttattctgtcaaacgattcattggtcgtaaatttgatgaaattaccaatgaagccaccgaagttgcctacagcgtagttaaagacggcaacggcaatgtgaaactagattgcccagcccaaggaaaacagtttgccccggaagaaatttctgcccaagtgctgcggaaattggtggacgatgccagcaagtacctaggggagaccgttacccaagccgtcatcaccgttcctgcctactttaacgactcccaacggcaagccaccaaagatgcgggtaaaatcgccgggatcgaagtcctgagaattattaacgagcccaccgctgcctccctagcctacggtctggataaaaaggataacgaaaccattctggtgtttgacctagggggcggtacttttgacgtctccatcctcgaagtaggggaaggggtatttgaagtattagccacctctggggatacccatctgggaggggacgacttcgacaaaaaaattgtcgatttcctggccggtgaattccagaaggccgagggcatcgacctccgtaaggataagcaagctctacaacggttaaccgaagcggccgaaaaagccaaaatcgaactttccggcgtgagccaaacggaaattaacctgcccttcatcactgccacccaggatgggcctaaacatctagacaccaccctgtcccgggccaagtttgaagaaatttgctccgacctgattgatcgttgtggtattcccgtggaaaatgccattcgggatgccaaaatcgataaatctgccctggatgaaatcgttcttgttggcggttccacccggattcccgccgtgcaagaagtggtaaagaaaattcttggcaaagatcccaaccaaggagttaaccccgatgaagtagtggccgtcggagctgctatccaagggggtgtactttctggggaagtcaaagacattctgctcctggatgtttctcccctctccttgggcgtagaaaccctagggggcgtcatgaccaaaatcattccccgcaacaccaccatccccaccaaaaaatctgaaaccttctccaccgctgtggacggtcaaagcaacgtggaaatccatgtgctccaaggggaacgggaaatggccaatgacaataagagcttgggaaccttccgcttagatggtatcccccctgctccccggggcgtacctcaaatcgaagttactttcgatattgatgccaacggtattttgaatgtcactgctaaagaccggggtacgggcaaggagcagtccatcagcatcaccggggcttccaccctgcctgatacggaagtagaccggatggtgaaggaagctgaatccaacgccgccgctgacaaagaacgtcgggagaaaattgaccgcaaaaaccaagcggattccctcgtttaccaagcggaaaaacaaatcaccgagttgggcgataaagtgcccgccgctgataaaatcaaagcggaaggtttaatcaaagacctgaaggaagctgtagcccaggaagatgatgccaaaatccaaacggtgatgccggaactacaacaggttctctacagcattggttccaatatgtaccaacaggctggagcagaggctggggtaggcgctcccggtgctggccctgaagcgggaactagcagtggcggtggcgatgatgtcatcgatgcggaattctctgagccggagaaatag

SEQ ID NO: 26467 - DNA, 2313 bp, Synechocystis sp.
atgacctacaccatcaacgctgaccaagtccatcagattgtccataatcttcaccacgatccctttgaagtgttgggctgccatcccctcggggaccacggcaaggtcaatcaatgggtcattcgtgcctatttacccacggctgaagcggtaacggtgttgcttcccaccgatcgccgggaagtgattatgaccacggtccaccatcccaacttttttgaatgcgtgttggagttggaagaaccgaagaattatcaattaagaattaccgaaaatggccacgaaagggtaatttatgacccctatggttttaaaactcccaaactgacggattttgacctccatgtgtttggggaaggcaaccaccaccgtatttacgaaaaactcggtgctcacctgatgacggtggatggagttaaaggggtttattttgctgtgtgggcccccaatgcccgcaacgtttccattttgggggatttcaacaactgggacggcagattgcaccaaatgcggaaacgcaacaacatggtgtgggaattatttatccctgagttgggggtgggcacttcttataagtatgagattaaaaactgggaagggcacatctacgaaaagactgacccctacggtttttaccaagaagtacgccccaaaaccgcttccattgtggcagacttggacggttaccaatggcacgacgaagattggttggaagctaggcgcaccagcgatcccctgagcaaacccgtttccgtttacgaactccatttaggctcctggttgcacactgcctacgacgaaccggtgaaaactttgcacggggaaggggtgccggtagaagtgtccgaatggaataccggggccagatttttaacctattacgagttggtggataaactaattccctacgtgaaggaattgggttacacccacattgagttactaccgatcgccgaacatccctttgatggctcctggggttatcaagtgactggttattacgcccccacttcccgctttggcagtcccgaagactttatgtattttgtcgatcaatgtcacctcaacggcattggtgtgatcattgactgggtgccggggcattttcctaaggacggccatggcctagccttttttgacggaacccatttgtacgaacatggtgatccccgcaaaggtgaacataaggaatggggcactctcattttcaactacggccggaacgaagtgcggaacttcctggtggccaatgccctattctggttcgacaaatatcacattgacggcatgcgggtggatgcggtggcctccatgctctacctagactattgccgagaagaaggggaatgggtggccaatgagtacggcggccgggaaaacttggaagcggcagactttttgcgccaggtaaacagcgttgtttacagctacttccccggtattttatccattgcggaggaatccacctcctggcccatggtgtcctggcccacctacgttggcggcttgggctttaatctgaaatggaatatgggttggatgcacgacatgttggactatttcagcatggacccctggttccgccagttccatcaaaacagcattacgttcagtatgtggtacaaccacagcgaaaattatatgttggccctgtcccacgacgaagtagtgcacggcaaaagcaatatgttgggcaaaatgcctggggatgaatggcaaaagtatgccaacgtcagggctttattcacctacatgttcacccatcccggcaagaaaaccatgtttatgagcatggaatttggccagtggagtgagtggaatgtgtggggtgatttggaatggcatttgctcaattttccaccccatcaacaactaaaacaattcttcactgagttgaaccatttgtataaaaatgagccggctttatacagcaatgattttgatgaatcgggttttcaatggattgattgcagtgataatcgccacagtgtagtttccttcattcgtcgggccaaaaatagcgcagaatttgtggttaccatttgtaattttacgccccaaccccatagccattacagagtgggtgttccggtacctggtttctacactgaattattcaacagtgatgcccgacagtacggcggcagtaacatgggcaatttaggtggaaaatggacagaagaatggtctttccatgaacaaccctactcgttggatttatgtttaccgcccctatcggtgttggtattaaaactaagccaaaatgctgaggaaaatactgtgccagcggaagaggctagcaacatagcttag

SEQ ID NO: 26468 - DNA, 1365 bp, Synechocystis sp.
atggcgatcgccactattaatccggccacgggccaaacggtgcagactttcatcgcccatagtcaggtggaagttaatgccaagttggatttggcccaggaaacattccaaagttttcgccatttaccttttgctcaacgggggcaatggttaagaaaggcggcggatatcctcgaacaacggcgggatgaatgggccgccctgatgaccctggaaatgggcaaatcgatcccacaggcgatcgccgaagtgaataaatgtgccctggtctgtcgtttttatgcggacaaagccgaggaatacttagccgatgaagtggtgaccaccgatgctagccagagtttcattgcttaccagcccctgggggtaattttggcggtgatgccctggaatttccccttttggcaggtgtttcgttttgcggccccagctctgatggccggtaatgtgggtctgctcaaacacgcttccaatgtgccccaatgtgcgttggcgatcgccgaaattttccaaaccgccgggtttcccgaaggagcgtttcaaaccctattgattggaggcaaagtggccagtgagttgatggccgacgaccgcatccaagcaggaactttaaccggtagtgaacccgctggagctagtttcgccagcgccgccgcagggcaaattaaaaaaaccgtgttggaattgggcggttccgatcccttcatcgtcctcgaagatgcggatttagaccaagccctaaaagtagctgtgccagcccggatgcaaaacaacggccaatcttgcattgccgctaaaagattcattgtccaagccagtgttgctgaggaatttttccaacgtttaaccaaagcattccaagctcttaaagtaggagatcccagcctctcaaccaccgatattgggcccctagctacccctgatattttggcggacattgttgcgcaagtagaacaaaccattgctgctggagcccactgtcgttgtggcggccaagccctagaccaaccgggaaattactatcctcccaccctgctcaccgacgttccccccaacgcccctacctaccgtcaggaattttttggccccgtggccctcggatttactgtcgataatttagaggaggcgatcgccttggccaatgacattccctttgggttgggggccagtgcatggacaactaacccggaaaatcaacaaaaactaatccggggcatagaagccggggctgtattcattaacggtatgactaaatctgacccccgcattccctttggaggcatcaagcgctctggctttgggcgggaacttggccgcatgggcattttagaatttgtcaatgctaaaaccgtttggattgcttag

SEQ ID NO: 26469 - DNA, 1230 bp, Synechocystis sp.
gtgaagttttgttgtgaagggcgatcgccgggtgcggccctggatagtgccttctattttgttgatgttgatctgatttacccccatctagccatgcgtgttgccctgtttacggaaacctttttgcccaaaattgatggaattgtcacccgtctgaagcacacagtggaaaatctgcaacgccaagggcatcaggtattggtcttttgtccagagggggggctcaaggaatataaaggggcaaaaatccatggagtgaagggcatgcctttacccctttacccagaactaaaactggctttcccgtcgccccaaattaaacaggccctgctgaaatttcaaccagacctaatccatgtggtcaatccagcggtattgggcttgggaggcatctattacgctaaaaatttgcatattcccctagtggcttcctatcacacccatttaccccaatatttgcaacattatggtctaggggccctggaaggggtgctgtgggaactgttaaaactggcccataaccaagcggaattaaatctttgcacttcctccgccatggtgcaggaattagtcaaccacggcattgaacgggtggatttatggcaacgaggggtagatacggaactgtttcagccccacctgaaatcggcccaaatgcggcaaaaactgtcccagggtcaccctgacgatcccctatttttatatgttggtcgggtttcggcggaaaaacaaatcgatgaaattaagccagtgctcgaggccattccccaggcccggttggcgatcgtgggggatggacctaaccgaaaaaatttagaagcccattttgctggcactaatacctattttgccggctatatgcagggattagagttggcggcggcctttgcttccgctgatgcgttcatttttccttcccgtactgaaaccctgggcttagtacttttggaagctatggcggcgggctgtcccgtggtagcggcggcctctgggggcattttagacattgtcaccgatggtgaaaacggttacctgtttgatcccgctgtggcagggggagtggtgcaagccacccaaaggttaatgtccgcccctggcgatcgagaactcttgcgacaaaacgctcggcaagaagcggaacgatggggttggccagcggccaccagacaattggtggactactaccaactggtagcctatggggaaaatgacgctccgttagcggcttag

SEQ ID NO: 26470 - DNA, 1449 bp, Synechocystis sp.
gtgcaatttaacgtagctattatgactaagcgaacttttggggtaattggactagcggtaatgggggaaaatcttgccctcaacgtggaaagtcgaggctttcccatcgccgtgtttaaccgttcccccaacaaaactgagaaattcatggccgaacgggctgtgggcaaagatatcaaagccgcctacaccgtagaagaatttgtccaactgttggaacgcccccgtaaaatccttgtaatggtcaaagctgggggacccgtggatgcagtgatcaatgagttgaagcccctgttggaagaaggggacatgatcattgatggtggcaactccctttatgaagatacggaacgtcgcaccaaagatttggaagccaccggcctgggctttgtcggcatgggagtcagtggaggggaagaaggcgcattactgggtcctagtttgatgcccggtggtaccccggccgcctacaaagaattggaacccattctgactaaaattgccgcccaggtggaagaccccgataatcccgcctgtgtgacttttattggcccagggggagcaggacattacgtcaaaatggtccacaacggcattgagtatggcgatatgcaactaatcgctgaagcctacgacatcttgaaaaatggcctcggcttgagcaacgaacaactccacgaagtttttggccaatggaatcaaaccgatgagttaaactccttcctgattgaaatcagcaccgacatttttgctaaaaaggatcccgaaaccggaggccatttaattgactacatccttgatgccgccggccaaaagggcacaggacgctggacggtgatgagtggtttggaattaggagtgcccattcccactatttacgccgccgttaacgccagggtaatgtcttccctcaaagaagaacgggtggccgcttccggtcaactgtcgggtcccagtaaaacctttagtggggacgtagaagcctggattcctaaggtgcgggatgccctctattgctcgaaaatgtgttcctatgcccagggcatggccctaattgccaaagcttcccaggaatttggctacgacgttaacctgccggaaattgcccgcatttggaaagggggttgcattatccgagctggctttttagacaagatcaagaaagcttttaaagacaatccccagttgcccaatttacttctagctccggaattcaagcaaagtattttggatcgccaggggccatggcgagaagtgttgatgctggccaatgaaatgggcattgcagtgccggcctttagttcctcgttggattactttgacagttaccggcgggcggtgcttccccaaaacctgactcaagcgcaacgggattactttggggcccacacctatgaacggactgataagccgaggggagaatttttccacacggaatggcttgattga

SEQ ID NO: 26471 - DNA, 1527 bp, Synechocystis sp.
atgaaattggcctattggatgtacgctggcccggcccacattggcaccctacgcatcgccagttctttcaaaaacgtccacgccattatgcacgctccgttgggggatgattatttcaacgtcatgcgctccatgttggaacgggagcagaattttacccctgtcaccaccagtgtggtcgatcgccaagtgttatcgaggggttcccaggaaaaagtggtggacaacattgtccgcaaagatggggaagaaacgccggatttaattgtgctgacccccacctgtacctccagcattttgcaggaagatttggccaattttgttgaccgggcccagatggatgcccactgtgatgtacttttggcggacgtgaaccattaccgctataacgaattgcaagctggcgatcgtacccttaagcagattgtcgagttttacatcaaaaaagcccggaaacagggtaatttagccacggaaaaaacagctaagccatcggtgaatttaattggcttcaccaccctaggtttccacaatcaacatgattgcaccgagttaaagcgattaatggcggatctgggcattgaagtaaacctgattttgccggaaaaagccacggtggatcaattggctaaaattccccaagcttggtttaacctctgcccgtaccgggaaattggtttgatgacagcggaatatttgcaagaagaatttgcccagccctacgtggacattacccccatgggagtggtggaaacggcccgttgtatccgcaaaatgcaacaggtgttaaatcaacagggtttcgacgttaactacgaagatttcatccagcaacaaacccgtcacgtctcccaagcggcctggttttctcgctctatcgactgtcaaaatctcacgggcaaaaaagcagtggtctttggggataatacccatgcggccgctatgaccaaaattttggcccgggaaatgggtatccacgttgtgctagcaggaacctattgcaaatacgatgccgattggttccgagccgaagtatctgaatactgtgacgaagtgttgatcagtgaagacaacggggcgatcgccgatgccatagccaggattgagccggcagcaatttttggcacccagatggaacgccatgtgggcaaacgcttggatattccctgcggtgtgattgcggccccgatccatatccagaattttcccctgggctacaaacctttcctcggttacgaagggacaaaccagattgccgatttggtgtacaactccttcaccctgggcatggaagaccatctgttggaaattttcggcggccacgacaccaaggaagtgatcaccaaaggcatttccagtgactctgatctaggctggcacagcaccgcccaagcagaattgaataaagtgccagggtttgtgcggggtaaagttaaacgcaacacagaaaagtttgcccgagagcggggcctatcggaaatcaccctggaggttatgtatgccgccaaggaagccgtgggagcttaa

SEQ ID NO: 26472 - DNA, 1407 bp, Synechocystis sp.
atgaatccctcctcttctccttcccaatctacggctaacgttaagtttgtcctgctgatttcgggggtagcagccctgggggggttcctgtttggctttgacactgcggtgatcaatggggcggtggcggccctacaaaaacattttcagacggacagtcttttaacaggtttatctgtatccttagctctgttgggatcagcactgggagcctttggggcgggaccgatcgccgatcgccatgggcggattaaaacgatgattttagcggcggtgctgttcaccctcagttccattgggtcgggtttacctttcaccatttgggattttattttttggcgggtgttggggggcattggggtgggggccgctagcgttattgccccggcctacattgcggaagtgtcgccggcccatctgcgggggcgtttaggatctttgcaacagttggccattgtttctggcattttcattgccctgctcagtaattggtttattgctttgatggcggggggatcggcccaaaatccctggttgttcggtgcggcggcctggcgttggatgttctggacagagctaattcccgccctgctctatggagtttgcgctttcctgatccccgaatctccccggtatttagtcgcccaagggcaaggggaaaaagcggcggctattttgtggaaagtggaagggggagacgtgcccagtcgcattgaggaaatccaggcaacggttagtctcgaccataaaccccggtttagcgatctgctcagtcgtcggggaggattattgcccattgtctggattggtatggggttgtcggcactacaacagtttgttggcattaacgtaattttttattacagtagcgtgctctggcgatcggtgggttttaccgaagaaaagtctctgttaatcacggtaatcactggttttatcaatatcctcaccaccctagtggcgatcgcctttgtggataaatttggccgtaagcctttgttgctcatgggctccattggtatgaccattaccttgggcatcctttccgtggtgtttgggggagcaacggtggttaatggccaacccaccctgacgggggccgctgggataattgctttggtgacagccaatctttatgtatttagttttggtttttcttgggggcccattgtttgggtcttgctgggggaaatgtttaataacaaaattcgagcggcggccctatcggtggcggcgggggtacagtggattgctaactttattatttccactacttttccgcccctattggatacggtgggtttgggccccgcctatggtttatatgccacttcagcggccatttcaattttctttatctggttttttgtgaaggaaactaagggtaaaactctggagcaaatgtga

SEQ ID NO: 26473 - DNA, 1044 bp, Synechocystis sp.
atgggaaagagttacctcatgggcgttgctgttcaagtcaaacaactccgaaaaaagtacggtgctatccctgcggtgaaggacatttcctttgcggtgcccaggggagagatatttggtttacttggtcccaacggtgccggtaagaccaccactatccgttgcttatgtactctagccaaaccagacggaggggaactgtggattgatggcgtaaacgtattaagcgatccccgccaggcccggcgccgtttaggctatgtggcccaggaagttgccatagataaaatcttaacaggtcgagaattgttgcaactacaagcttccctctaccatcttgatgccattagctctcaaaaacgcatcgaccaacttttagatattttgggcttaacagcctatgcagatcagaaaactggaacttattccggcgggctaaaaaaacgtttggacctagcagcaggtttactccatcaaccaacggtgttggtgttggatgaaccatcggtggggctagacattgaaagtcgctttattctctgggaatttttgcgccaattgcgagatgcaggcactacggtagtaattacaagccattacctggaggaaattgatgccctagccgatcgcctagccatcattgaccagggcacagttatcgccaccggcacccccacggaactaaaagaccgggtagggggggacagggtcaccctcagaattaaggaatttacggcagaccaggaagcagaaaaagctagccaaattctccgctccctagctttcgttcaggaagtgattgtcaaccaagcccaaggcaattccctcaatctggtggtgacgccccagagtaatcccctcagtcagatcgaaaaagccctactcgctgacggtttaccgattttcagcttggcccaatcccgacctagtttggatgatgtgtacctagcggccaccggcaaaaccctgatggatgcggacttggccgctgctgcccaacgggatctcaaagcagaaaaaaaacaagcgatgaaagctagttaa

SEQ ID NO: 26474 - DNA, 603 bp, Synechocystis sp.
atgacagaggtattaagggtaggacagccggcaccggatttcaccgccacggcgatcgtcgatcaaagcttccagaccgtcaaattaagcacctaccgtggtaagtacctggtgctgtttttctatcccctagatttcacctttgtctgtcccacggaaatcattgcctttagcgatcgccatagcgaatttactgccctagatacggaagttgtgggcatctccgtagacagcgaattttcacacctggcctggattcagaccgaacggaaaatggggggcatcggcaacattaactatcccctagtgtcagatctcaaaaaagaaattagccaagcctataatgtcctcgaacccgatgcaggcattgccctgcggggactattcattattgaccgggaaggcatcttacaatacgccaccgtcaacaatctctcctttggccggagtgtggacgaaactctgagggtactaaaagccattcgccatgtgcaatctcaccccaacgaagtttgcccagtggattggcaggaaggagacaaaaccatgatccccgacccggaaaaggctaagacctacttcgagacagtggcggaaccttag

SEQ ID NO: 26475 - DNA, 885 bp, Synechocystis sp.
atgactgccgtacccccatcctgccaaatccttgacggtaaagccctcgcccaaaaaatgcagggggaattacaacgggacattgcccaactggtggcccagggccatcgatcgccggggttggcggtgttgatggtgggggacaatccagccagtgccgtttatgtccgcaataaggaaaaagcctgtgaaaaattgggcatggtttcctttggcaagcatttttccgctgatacggaccaggaaacattgacggcggcgatcgccagtttgaatgaggatgaacgggtggatggcattttggtgcaattgcccctaccggatcatctcgatgcagtcaaactattacacaccattgatcccagtaaagatgcagacgggttgcatccagtcaatttgggtcatttggtgcggggagaagagggtctaaggagttgtactccagcgggggtgatggctctattggcggaatataaccttgatttaacgggcaaaaatgcggtggtgttggggcgcagtattttggtgggcaaacccctggctctaatgttgctagagaaaaattgcaccgttaccattgcccattctcgcacccaaaacttggccgatatcacccggcaagcagacatcctcgtagcggcgatcggtaagccggaatttgtcaccgccgatatggtcaaaccaggggcaatcgtggtggatgtgggtattaaccgtcttgatttaggagaggggaaatcgacactggtgggggacgtggattttgcgggggttgcgcccgtggccagttacctcacccctgtgcccggtggcattggccccatgacggtgactctgttgttagctaacactgtggctagttatcggcaacggttaggtatttaa

SEQ ID NO: 26476 - DNA, 1416 bp, Synechocystis sp.
gtggtgatacgatcaggcaaaactaatttaaatcctccctgtgctctaatggccccatcctcgtcctgtgattgcataattgtcggctcagggttgtcgggattgatcgcggcccgtaatttatctcgggttaactattctgtcttagttattgaagcccaggaacgcttggggggcagaatgtatggagaatatttgccatcgggacaatggattgaccggggaggccaatgggtgggccctacccaggatcgttttctggccttgcttaatgaatacaacatagaacgttttcccagtcctgctgatggcttaaaggtattgttatttgatgggaaacgttacgagtttgatggtttttttcaaggagtgttccaaggggaagcgccgaaaataagctctgatgaatggaatgatgccatggtggcatgggaaaaatttaatacccttgcccaaagtctggacgagcaacatcccgaagctacgccagaaaacaaaaagttagacagtcaaacctttgccgattggattaaagaaaatacccatacagcattcggccattggtatttttcctatatgtgtcgtgctgtggggtttttaggccccgccgagccttctcaggtatctcttttgcacatcctatggggccataaatctgcctcccaaggggaaaatccagaagcagaactattacatggtggggcgggacaaattcctcaaaaaattgccgctgaattggggaattccatcctcttaggggaaccggtcatacacattgcccaggacgacaaaggggtagaggtgaccactacaacaggaaaatatcagggaaaattcgccattgtggcaaccccgccccatttggccggaagaattacctatagtccccccatgcctcctctccgccagcaactcacccaaagagtacccatgggcacctgctgtaagcttttgatttcctacgatcgccctttttggcgggagaaaggtttagccggtattggcttgggtaacaccacctggatcgaattatgtgctgatagttccgatccaaccacgggagtgggagtaattgcttccttcgtagttggcgatcggtatggaaaatggattgccatgggcgaagcggaacgccgtcaaggagtactgtcagatctggctctgtactttggcgaggaagctttatctcctgagacctacgatgaagttgattggcccagtgaacaatgggttgggggagggtatgccgcctttatgcctcccggagtctggacaagttttggccaagccctgagcgcccctgtaggtcgtattcattgggccgggacggaaatagccccccgctgggctggcttttttgatggtgcaattcgtactggggaagcggcggctaaagccattatcggtctactttag

SEQ ID NO: 26477 - DNA, 729 bp, Synechocystis sp.
gtgcgaaaaatcattattgcgggcaattggaaaatgcataagacgcaggcggaggcccaagcgtttttgcaggggtttaaacctttaatcgaagatgcggcggaaagtcgtgaggtggtgttgtgtgttcctttcaccgatttgagcggcatgtcccaacaactccatggcggtagggtccgcctaggggcacaaaatgtccattgggaagcgagtggggcctacacaggggaaatttcagcggctatgttgacggaaatcggtattcattatgtggttatcggccacagtgaacgacggcaatattttggggaaacggacgaaactgccaatttgagagtattggcggcccaaaaggcgggcttaattcccattctgtgtgtgggggaaagtaaggcgcaacgggatgccggagaaacggaacaggttatcgttgaccaagtgaaaaaaggcttggtgaatgtggatcaatctaacctagtcatcgcctacgagccgatttgggccattggtacaggggacacctgtgcggcaacggaagccaatcgggttattgggctgattcgggaacagttaactaattcccaggtcaccatccagtatggcggttcggtcaatgccaacaatgtggatgaaattatggcccaaccggaaattgatggagccttggtgggaggagctagtctggaaccccagagctttgcccgcattgttaattttcagccctga

SEQ ID NO: 26478 - DNA, 2466 bp, Synechocystis sp.
atgtttgaacgctttacagaaaaagccattaaagtaatcatgcttgctcaggaggaagctcgtcgcctcggacataacttcgttggcacggaacaaattctgctcggcttgattggcgaagggactggcgtcgccgccaaggttctcaaatccatgggggttaatctcaaagatgcccgcatcgaagtagaaaaaattatcgggcggggatcgggctttgtggccgtggaaatcccctttactccccgggccaagcgggtgctggaactttcccttgaggaggctcggcaactgggtcacaattacattggcaccgaacacctgctgttgggtctgattcgagaaggggaaggggtagctgctcgggtcctagaaaaccttggggttgatctctccaaagtccgcacccaggtgatccgcatgttgggagaaacggccgaagtagctgccggtggtggcagtggtggtcgcaccaaaacccctaccttagatgagtttggctctaacctcacccagatggccgccgaagggaagttagacccggtggtaggtcgccaaaaagaaattgagagggtgattcagatcctcggccgccgcaccaagaataaccccgtcctgattggggagccgggggttggtaaaacggcaatcgccgaaggtttggcccagcgcattgccaacaaagatattcccgacatcctcgaagaaaaacgggtcgtcaccctggacatcggtctattggtggccggcactaaataccggggggaatttgaggaacggctgaaaaaaatcatggatgaaatccgccaagccggtaacatcatcctggtgattgacgaagttcataccctaatcggagccggagccgccgagggggcgatcgacgctgccaatattctcaagcccgccctagcccggggagaattgcaatgtattggtgccaccaccctggatgagtaccgcaaacacattgaacgggacgcagccctggagcgtcgttttcaaccggtgatggtgggggaaccctccgtggaagaaaccatcgagattctttacggtctgcgggaacgttacgaacagcaccacaaactgaaaattttggacgaagccctggaagccgccgccaaactttccgaccgttacatctccgaccgcttcctgcccgataaggcgatcgatctaattgacgaagctggttcccgggtgcggttgattaattcccaattgccccccgccgccaaggagttggacaaggaattgcgacagattcttaaagaaaaagatgatgctgtccgcaaccaggacttcgagcaagccggggaactcaaggaccgggaagacgaaattaaaaaacaaatccgggcgatcgcctcttccaaaaaagcggaaggggataacggcgagccggaagtgacctccgaagaaattgcccacatcgtcgcctcctggacaggggtgccggtgaacaagctaacggaatccgagtcagaaaaactgttgcatatggaagataccctccatcaacggttaattggccaggaagatgcggttaaggccgtttcccgcgctatccgtcgggccagggtcgggctgaaaaatcccaaccgtcccattgccagctttattttctccggtcccactggggtaggtaaaaccgagttgaccaaagctctggcggcttacttcttcggttccgaggaagccatgatccgtctggatatgtcggaatttatggaacgacacaccgtttccaaattaattggttcccctccgggttatgtgggctacaacgaaggcggtcagttgacggaagcagtacgtcgccgtccctacacggtggtgctgttcgacgaaattgaaaaagcccaccccgacatcttcaatatgcttctgcaaattttggaagatggtcgcctcaccgatgccaagggtcgcacagtggatttcaaaaataccctgttgatcatgacctccaacattggttccaaggtaattgaaaaaggtggcggtggtttgggctttgactttgccgatgaccaagcggagtctcagtacaatcgcattcgttccttggtgaatgaagagttgaaaaactacttccgccctgagttcttgaatcgtttggatgaaattatcgtcttccgccaattgaacaaggaggaagtcaaggaaatttcggaaattctcctacgggatgtgtttgcccggttggtggaaaaagaaatttctctccaggtcaccgacaagttcaaggagcgcattgtggaagaagggttcaacccagcctacggtgcccgtcccctccgtcgggccattatgcgcctgttggaagacgtgttagccgaagaaattctttccggccgcctcaaggaaggtagccaagcgctggtggacattggtgaagacaaccaagtggtggtcatccccggtgaaacgagggaactgattgcccccggcgttgaataa

SEQ ID NO: 26479 - DNA, 1080 bp, Synechocystis sp.
atggctcttgtaccaatgagactgctgttagaccatgcggcggaaaatggttatggcattcccgctttcaacgtcaacaacatggagcagatcatttcgatcatgcaggccgctgatgaaaccgacagccctgtaattttgcaagcttcccgtggtgcccggagctacgctggggaaaatttcctgcgccatttagttttgggggcggtcgaaacctatcctcacattcccattgccatgcaccaagaccacggcaatagccccgccacttgctattccgccatccgcaacggtttcaccagtgtgatgatggacggttccttggaagctgacgccaagacccccgctagctttgagtacaacgttaatgtaaccgctgaagtagttaaagtagcccactccgttggggccagtgtagaaggggaattgggttgcttaggttccttggaaactggtcaaggggaagctgaagacggccacggttttgaagggaagttagaccactcccaactgttgaccgatcccgaagaagcagtggaattcgtcaacaaaacccaggtggatgccctcgctgtggcgatcggtaccagccatggtgcctacaaatttacccgcaaacccaccggtgaagttttggccatcagccgcattgaagaaattcaccgcctgctgcccaacacccacttggtaatgcacggttcttcctccgttccccaggaatggatcgacatgatcaacgaattcggtggtgctatccccgaaacctatggtgtgcccgtggaagaaattcaaaaaggcatcaagagtggtgtacgtaaagtaaacatcgacaccgataatcgcttagccatcaccgccgctttccgggaagccgctgctaaagatcccaagaactttgatccccgtcacttcctcaagccttctatcaaatatatgaagcaggtttgtgccgatcgctatcaacagttctggactgctggcaatgcctctaaaatcaagcaattgaccttggatgactacgccgctaaatatgccaaaggtgaattaaccgccacctcccgcacctccgttgctgtgtag

SEQ ID NO: 26480 - DNA, 1236 bp, Synechocystis sp.
atgcccggtggtgtcagttccccggtaagagctttcaagtccgtcggcggccagcccattgtttttgaccgagtagaaggggctcagatttgggacgtagatggtaatcaatacattgactatgtgggtacctgggggccggccatttgtggccacgctcaccccgatgtaatcagcgccctcaaacaagctttggataaaggcaccagttttggtgctccctgtgcccaggaaaacgtactggcggaaatggtcattgatgctgtgcctagcattgaaatggtacggtttgtcaactccggtaccgaagcctgtatgtccgttttgcgcttgatgcgggccttcactggacgggaaaaaatcattaaatttgagggttgttaccacggccacgccgatatgttcttggtcaaagctggttctggggtggcgaccctcggtttaccggattcccctggggtgcccagtaacacaactaaagcaacattgactgctccttataacgatctagaggcggttaaagctctgttcgtggaaaatcctgacagcattgccggggtaattctcgagccagtggtgggtaatgccggttttatcctccccgatgcgggctttttggaaggtttacgggaactgaccaaggagtatggtgctctgttggtttttgatgaggtgatgacaggttttcgggtttcctacggtggtgcccaagcccggtttggcattactcccgatttgactaccctcggtaaggtgatcggtggtggtttaccagtaggagcctatggtggtcgggaagaaattatggccatggtggctccagccggccccatgtatcaagcgggtaccctgtccggcaacccgttggccatgacggcgggtattaaaaccctggaaattctgcaaaagccaggatcctacgaatatttggataagatcaccaaacggctagtggatggtttactagctgcggctcaggatgcgggccatgaagtttgtggcggttccatcagtgccatgtttggaattttctttgctcctggccctgtcagaaactatgaagatgctaagttggccgacaccaataaatttgcccgtttccatcggggtatgttggaaagggggatttatctagctccttcccagtatgaagcgggttttccttccctagcccacacccaagaacagatcgatcagaccattgccgtcgctaaggaagtatttgctactctctga

SEQ ID NO: 26481 - DNA, 1317 bp, Synechocystis sp.
gtgcttcaagttgctactcctaccgctaccgaagaaacccagacggtcattgaaattgaaggccgggcctccctaaaaggggaagttcgcatcagtggggctaaaaattccgctttggccatcatggccggcaccatcctttgttccgacgactgtcgtcttagtaatctgcccgctctggcggatattgacaaaatgtgccaaattttggcggccattggggtcaatctagaacgggatggcgatcgcctcgtagtggattccagtaatgtgggccatggccctgccccctatgagttagtgtcccaactgcgggctagctttttcgtcattggccctttactgtcccgtttaggcatgaccaaagtacccctgcctgggggatgcgccattgggactcggcccgttgatctccatgtgcggggtttgcaggccatgggagcagacgttcacatcgagcatggggtagtcaatgccagcatcaagggccacagccgtcgtttgaccggagctaaaatttatctggattatcccagcgtaggggccacggaaactatcctcatggccgccaccctagcggaaggagaaacagtaattgataacgccgcccgggaaccggaaattgttgatttggccaacttctgccgttccatgggagcccaaatccggggggatggttctagccgcattattatcaacggggtggaaaaactccacagcaccgactttcccattattcctgatcgcattgaggccgctacgttcctctgtgccggggccatcacccattccgaaattagtcttttccctgtggtgccagatcacctcgcctccgccattgccaagttgcgggaaattggccccgaagtggcgatcgatgccccggatcgggtgcgtttgattccccgggatctgcgggggacagatatcgaaactttgccttaccccggttttcccaccgatatgcaagcccaattcatggccctgttggcagtgagtgagggtaatagcgtagtcacggaaaccgtatttgaaaaccgtctccagcacgtagcggagttacagcggatgggggccaacattaagctcaaaggtaatgccgcctttatccaaggagtgcctttcctttccggtgcgccggtcatgtccacggatttacgagcttcggcggccctggtaattgcggggttagcggcggaaggcaaaaccattgtccaaggtctgcgccatttagaccggggttatgaggacattgaaggcaaactgcgcaaactgggggctaagttaaccaggattgaacagcccgtcactctttaa

SEQ ID NO: 26482 - DNA, 1401 bp, Synechocystis sp.
atggtaaattcccaccgccttgaaaccgacagtatggggtccctggaagtccaagccgatcgcctgtggggagcgcaaacccaacgttccctgatgttttttgacattggtagcgatgtgatgccgccggatttaattcgggcctttgccatactcaaaaaggcagccgccattaccaatcaggatttgggtaaattaccagcggacaaggcagagttaatcattacggcagcggacgaaatcattgccgggcagtggttagaccatttccctctaaggatttggcaaacgggcagtggcactcaaaccaacatgaacgtgaacgaagtgattgccaatcgggcgatcgccatttgtgggggagaattgggcagtaaaaatcccatccatcccaatgaccacgtcaacatgtcccagtcgtctaacgatacttttcctacggcgatgcacattgcggcggtggcaggtttacaaaccaagttgattcccagtttgcaagctctgagagatagcctgaatgaaaaagcggaatgttttgcaggcatcactaaaattggccgcacccatttgatggacgcagtgcccctaacgttagggcaggaattttccggttacgtggcccagttagaccaagggctgacccaaattaattattgtttacccggtcttttggaattggccctggggggaacggcggtgggtacagggttaaatagtcatccccaatttgctaaaaaagtggccgaagaaattgcccagttaactggttataccttcatttctgcccccaacaaattcgccgccctagctggccacgaggcgatcgcctttgccagtggcgtgctgaaaagtattgccgcttccctgatgaaaattgccaatgatttgcgctggatggggtctgggccccgctgcggcttgggggaattagccttaccagccaatgaaccaggttcttcgatcatgcccgggaaagtaaaccccacccaatgcgaagccatgaccatggtttgtgtgcaggtaatggggaacgatgccaccattggttttgcggccagccaaggtaattttgagctcaatgtttttaagccagtgattattcataatttcctccattcgttacatttactcagcgatgcttgtgctagttttcgccaacatttagtggtgggattacaagtaaacgaaagcaaggttaaagactttttggacacctctttaatgttagtcaccgccctcaatccccacattggctacgacaatgcggccctcgtggctaaaactgcctttgcccaaggcattaccctcaaacaagccgcggtggatttaggtttactcaccccagcccagttcgacgcttgggtcgttccagagcagatgattgccccgattgctgactag

SEQ ID NO: 26483 - DNA, 1185 bp, Synechocystis sp.
atgagtctgaattggattagtcgcgccgatcgcctacaagccttacccccctatgtttttgcccgcctcgatgagttgaaagccaaggccagggaacagggcctggatttaattgacttgggcatgggcaaccccgatggcaaagccccccaaccgattatcgaagcggcgatcgccgagttggaaaacccagaatcccacggttatcccccttttgaaggcacccagagcttccgtcagagcattacccgctggtacgcccgccagtatggggtggatttagaccccgattccgaagcgttacccttaattggttccaaagagggtctgggtcatttagccctagcctacgttaatccaggggatttagtactcgtgccgactccctcctatccggcccatttccgaggccccctcattgccggggcggaaatttatccgatcatgttatcggcaaaggatgactggttaatccaactggaccaaattcccgaggcgatcgctcaacgggccaagatcctttattttaactatcccaataatcccaccaccgccaccgctcccagggaattttacgaagccatcaccgattgggcccgccattaccaaatcatgttagtccatgatctgtgttatgcagaattggcctttgacggttatcagcccaccagcttattagaaattcccggtgccaaggattttagtgtggaattccataccctttccaaaacctacaatatggccggttggcgggtaggttttgtcgtgggaaatcaagaaattattcaaggtttgagaacgctgaaaactaacttggattatggaatttttcgagtcgtacaaaaagcagcagaaacagccctcagtttgccagaaagttacattgaagtagtgcgaaagcgctatcaagaacggcgggactttgttattaatggcttgagtaaattgggttggtctattaccccttcccaagccaccatgtacctttgggttccctgtcccgtgggtatgagttccactgattttgccttaacggttctagaaaaaaccggtgtggtgatgacccccggtaacgcctttggagaagggggagaaaggtacgtccgcttaagtttaattgccgatggcgatcgcctgggggaagcattacagcgcattgaacaggcaggcattcgttatagttga

SEQ ID NO: 26484 - DNA, 1182 bp, Synechocystis sp.
atggtcagtgttgaccgattcctgcttactgataactgttcactgaaccctagacccaacaacataaccgctatcaagatttttatgaaggctctcattctctccggtggcaaaggaactcgcttgcgtcccctcacctacaccggggctaagcagttggtgcctgtggctaacaaaccaatcctctggtatggcattgaggcgatcgccaaagctggcattaccgacattggcattattattagcccagaaacgggagaggaaattaaaactatcaccggcaacggagaaaagttcggtatccagattacctatattttgcaatccgaaccattggggttggcccatgcagtgaaaacggcggcagactttctccaagattccccttttgtgatgtatttaggcgataacctaattcaagaccacctagagcaattcctcgcccattttcaggctaaatccctcgattccttgattctactgcggcgagtgtccaatcccagcgcctttggggtggccaccgttaatgaccaaggcaaagttttagccctagtggaaaaaccagagcatcccccttccaacttggccctagtgggactttacttttttgccccgaccattcaccaggcgatcgccaacattgagccctctgcccggggagaactagaaatcaccgatgcaattcaatatctgatcagccatgattatcgggtggaatccctacaactaaaaggatggtggctcgacaccggtaagaaagacgacctgctggccgccaatcagattatcctcgataccctagtggaaaaaaacatccaaggcaccgtagacgatcaaagcaaaatctccggtcgggtaaccattggcccccacagtcaaattatcaacagcgtcatccgtggccccgtggcgatcggccccaactgtcatctggaaaactgcttcatcggtccctatagcagtattgccgagggagttaaaatcagggatgcagatcttgaacatagtgtcgtgctccaaggagctagcattgtggccatccaacaaagaattgtcgatagtgtcatcggcaaaaacgccaaaatttttcccgctccccgccgtccccaggctttgcgcttcctgattggtaatgattcccaagtggaactaattggaccctcttcctatccccaggactaa

SEQ ID NO: 26485 - DNA, 1884 bp, Synechocystis sp.
atgaaattttcctggagaactgccctactttggtccctacccctgttggtagtcggctttttcttctggcaggggagctttggaggggcagatgccaacctcggttccaacactgccaacacccgcatgacctatggtcgcttcctcgaatatgtggatgctggccgcatcaccagtgtggatttatatgaaaatggccgcacggcgatcgtgcaagttagcgacccagaagtagaccggaccctccgttcccgggttgacctccccaccaatgccccggaattgattgcccgtttacgggactccaacattcgccttgattcccaccctgtccgcaacaatggcatggtttggggttttgtgggcaacttgattttccccgtgcttttgattgcttccctcttttttctcttccgccgttccagcaacatgcctgggggccccggccaagccatgaactttggtaaatccaaagctcgcttccaaatggatgccaaaaccggtgtcatgttcgatgatgtggccggtattgacgaagccaaggaagaattgcaagaggtggtaactttccttaaacagcccgaacgctttactgcagtgggggccaagattcccaaaggagtactcttagtgggccctcccggtaccggtaaaactctcctcgccaaggcgatcgccggggaagccggagttcctttcttcagcatttctggttccgagttcgtagaaatgtttgtcggcgttggtgcctcccgggtgcgggacttgtttaaaaaagccaaagagaatgccccctgtttgatcttcattgatgagattgatgccgtgggtcgtcaacggggtgctggtatcggtggtggtaacgatgaacgggaacaaaccctcaaccagctactaaccgagatggacggttttgaaggcaatacgggcattattatcattgccgccactaaccgccctgacgtgctagattctgccttgatgcgtcccggtcgtttcgatcgccaagtgatggtggatgcccctgactactctggtcgtaaggaaattttagaagtccacgcccgcaataaaaagttagcaccggaagtttccatcgactccattgcccgccgtactcccggttttagtggggctgacttggccaatttattgaatgaagccgccattctcaccgcccgccgtcgtaaatccgctatcactctgttggaaattgatgatgccgtggaccgggtggtagctggtatggaaggcacccccttggtggacagcaaaagtaagcggctaattgcttatcacgaagtaggccacgccattgtgggcacattgttaaaagaccatgatcccgtgcaaaaagtcacccttattcctcggggccaagcccaaggtttgacctggttcactcccaacgaagaacagggtttaaccaccaaagcccaactgatggcccgtattgctggagcaatgggcggtcgagccgctgaagaggaagtttttggcgatgacgaagtaaccactggggctggtggtgacctacaacaggtaactgagatggctcgccagatggtaactcgttttggcatgagcaaccttggtcccatttccctggagagttcaggtggggaagtattcctgggtggtggcttgatgaaccgttctgaatactccgaagaagtagccacccgcattgatgcccaagtacggcaattggctgaacagggtcaccaaatggctcgcaaaatcgtccaagaacaacgggaagtggttgatcgcctggtggatcttttaattgagaaagaaaccattgatggggaagaatttcggcaaattgtggcggaatacgccgaggttcccgtcaaggaacagttaattccccaactataa

SEQ ID NO: 26486 - DNA, 1659 bp, Synechocystis sp.
atgtctaaacttatttcctttaaggatgaatccagacgctctttggaagcggggattaatgccctggctgatgcggtgcggattaccctcggccccaaaggtcgcaatgttttattagaaaagcagtacggtgctccccagattgtcaacgatggcatcaccgtagccaaagaaattgaactgtccaacccggaagaaaatgctggagctaagctaatccaggaagttgcttccaaaaccaaggaaattgctggggatggcaccaccaccgccactattattgctcaagctttagtgcgggaaggtctgcgcaacgtcgccgccggtgctaatcccgtggctctccgtcggggcatcgaaaaagttaccactttcctcgttcaagaaattgaggctgtggctaaacccgtggaaggttcggcgatcgcccaagtggccaccgtatcctccggtaacgatcccgaagttggggccatgattgccgatgccatggacaaagtcaccaaagatggcgtcatcaccgtggaggagtccaaatccctcaacaccgaattggaagtggtggaagggatgcagatcgaccggggctatatttctccctacttcatcaccgatagcgatcgccagttggtggagtttgataatcctttaatcctcatcaccgataaaaaaatcagtgccattgcggaattggttcccgtactggaagctgtggcccgggccggtcgtcccctgttaatcattgcggaagacattgaaggagaagcccttgctaccctagtggtcaataaagcccggggtgtactcaacgtggccgccattaaagcccccgcctttggcgatcggcgtaaagctgtgttgcaagatatcgctatcctcaccggtggtagcgtcatttccgaagacattggcctgagcctcgacaccgtcagcttggatcaattgggccaagccgttaaagccactttggaaaaagacaacaccatcctcgtcgctggggccgacaaacgggcttccgctggagtcaaagagcggattgagcagttgcggaaagaatatgctgcttctgattccgattacgacaaagaaaaaatccaagagcgcattgccaaactagccggtggtgtagctgtgattaaagtcggggccgcaacggaaaccgaactcaaagaccgcaaactccgcattgaagatgccctcaatgccaccaaagccgcagtggaagaaggtattgttcccggtggtggtacaaccctaattcgtttagcgggcaaaattgaaagctttaaagcccaactcagcaacgatgaagagcgggttgccgccgacatcatcgccaaagccctggaagctcccctgcaccagttggccagcaatgctggggtagagggttccgtcattgtggaaaaagttaaagaagctactggcaatcaaggttacaacgtcatcactggcaaaattgaagacctgatagccgctggcatcatcgaccccgctaaagtggtacgttctgctctgcaaaatgccgcttccattgctgggatggtgttgaccactgaagctttagtagtggaaaaacctgaacctgcggctcccgctatgcccgatatgggtggcatgggcggaatgggtggtatgggcggcatgggcatgatgtaa

SEQ ID NO: 26487 - DNA, 1065 bp, Synechocystis sp.
atgcgttttcgatgttacttaatatttagtatatttagtgactcgctcttgggagcaggattttttcagggaggaaaaagagcaatggttgtgtcaactccgatcgccgctgaggaaaagccaccgattcaggccaatgtggtggaaacttgggaaattagcaaaatctaccgcaccggcttttggatgaatcagaaggtggagtcccttaaacctttgtccattgccgtacagcaaggggaaacctttggtttactgggtcctaatggagcaggtaaaactaccctgttaaaaattcttttgggggtaattcgtgccagcggtggccggggtactctactaggcaaacccatcggcgatcgccagactaaacaacgggtgggctacctaccggaaaatgcctacttttatgactttttaaccgcttgggaatttttggattacatcggcagtctgtttcaaattgggaaacaggaacgacaacggcgcattctggccatgtgtgacctggtggggttagcccaaaaaaccgccaaaaagaagcaattgcgacaatattccaaaggtatgttgcaacgggtgggcatggcccaggcattgattaacgatcctgaagtcgttttcctcgatgaacccatgtccggtttggaccccctggggcgctaccaagtgcgggaaattattctttccctcaaggaacagggcaaaaccatctttttcaactcccacattttggcggacgtggaacaaatttgtgaccgcattgccattttggcgcggggggaattgctgtgcagtggttctttggcggaagtgttaggtaatgacgaaggctatgaagtggtgctcaagggaggagaagaagaggcgttgggtaaatatctagccaatttaagtcaggaacaggatgtttggcacggccattaccaaggggatgtccaagctctagtggatgcgttacccagtcttaatgcccgtttgatcagcatgaacctggcccgcccttccctggaagattatttcatccgccaactgcgagaacggggtatcaccaccagccagtga

SEQ ID NO: 26488 - DNA, 1479 bp, Synechocystis sp.
atggccattttctcccccgtcaacgccgttaccgatattattccccagctcgaaaaaattgttggccaggatggagtaattaaacgcaaagacgagctattcacctacgaatgcgacggtttaacgggttatcgacaacggccggccctggtggttttgccccgcacaacggaacaggtagccacaatagtgaaactttgtcacgatcgccaaattccttggattgccaggggggctggcacagggttatcggggggagccttgccgggggccgatagcctattgattgtcaccactcgcatgcggcaaattttggcagtagattacgacaaccagaccattgttgtccagccgggggtggtgaataactgggttacccaaaccgttagtggggctggcttttactatgcccctgatccttccagtcagattgtctgctccattggcggtaatattgcggaaaattccggtggagttcattgtttgaaatatggcaccaccaccaaccatgtgctgggcttgaaactggttattcccgatggctccattgtggaagtaggggggcaagtccccgaaacgccgggctacgatttaaccggtttatttgttggttccgaaggaaccctaggcatcgccacagaaatcaccctaaaaattctcaaaaccccagaatctatctgtgtcgtattggcggattttctttctctcgaagccaccgcccaatccgtggccgatatcattgcggcgggcatcgtcccagcgggcatggaaattatggacaatttcagcatcaatgcggtggaagacgtggtggccaccaattgttaccccagggatgcggcggccattttgttagtggaactggacggtctgcccatcgaagtggaattaaaccaagccaaagtagaagaaatttgccgcaacaatggagcccgcaacacggcgatcgcctacgaccaagaaacccgcctaaaaatgtggaaaggaagaaaagcggcctttgcggcggcgggtaaactaagccccagttactttgtccaagatggtgtggtaccccggactcaattggtacagattttaagcgacattaatgatttaagtaagaaatatggctttgccattgccaatgttttccatgccggagacggtaatttacatcccctaattttgtatgatcaaaaagtaccaggagcctgggaaaaagtggaagaattggggggagaaatccttaaacgctgtgtggaattggggggaagtttatccggagaacacggcattggcattgataaaaattgctttatgcccaatatgttcaacgaagtagatttagaaacaatgcaatgggtcagacaatgttttaatcctgataacttagctaatcctggtaagctttttcctaccccccgcagttgtggagaagtggccaatgcccaacggcttaacctaggccaggacaagaaaatggaggaaatttattga

SEQ ID NO: 26489 - DNA, 1170 bp, Synechocystis sp.
atgcgactaacccagcgagttagccaagttgtgccttccatcacccttgaaattacggcaaaggccaaggcaatgcggactgagggcattgatgtgcttagctttaccgctggggaaccggattttaccactcccccccacattgtggaggcggccaaattagccttggatgaagggaagacccgctatggccccgccgccggagaaccggccctccgtcaggcgatcgccaaaaagttacgggaaaagaataatttgccctacgaggcggccaatattttggtgaccaatgggggtaaacattccctgtttaacctaatgctagccatgattgagcagggggatgaggtaattattcccgccccctattggctcagttatccagaaatggtgcgtttagccgaaggaaccccagttattgtcaacaccacagcggccacggattacaaaatcaccccagagcaactacggcaggccattacctccaaaagtaagctgtttgtgctgaattctccttccaatcccaccggggcagtttacactcctgccgaaattagggctttggcggcggtgattttggaatatgaggatttatacgtagtttccgatgagatttatgagcgcattctctacgatggcacagagcacctcagcattggtgcggtgaacgacgagattttccaacgcaccatcattagtaacggttttgccaaaagttattccatgaccggttggcgggtgggttacctggcgggggaattacccttaatccaagcctgtagcaccatccagggccatagcacctccaacgtttgtacctttgcccagtacggggcgatcgccgctctggaaaatccccaaacctgtgtggagaccatggtcaaagccttcacagaaagacgacaggtgatagtggaaggcatcaatcaaattgcagggctgagttgtcctaatccgaaaggagcattttatgtttttgtggacattgctaaaacggggcttaattccctggagttcagtgcccgattattagaatcccaccaggtggcggtgattcctggagcggcgtttggagccgatgactgtgtgcgtttttcctacgctaccgatatggacaccattaaacagggtttggccgagttagagcggtttgtcagcactttggcttga

SEQ ID NO: 26490 - DNA, 1194 bp, Synechocystis sp.
gtgaattatatgatgactgataacgaagtgtttaaagaaggcctagccggagtccccgccgctaaatcgagggtgagccatgtggatggcaccgacggtattttggagtaccggggcattcgcatcgaagaattagccaaatccagtagttttatcgaagtagcctatctgctcatctggggtaaattgcccacccaggcagagatcgaagagtttgagtacgaaattcgcacccatcgacgcattaagtaccacatccgggacatgatgaaatgttttcccgaaacagggcaccccatggatgccttgcaaacttcagcggcggccttgggattgttctatgctcgacgggccttggatgaccccaaatatatccgggcggcggtggtgcgtctgttagccaaaatccccaccatggtggcagctttccacatgatccgggagggtaacgatcccattcagcccaatgataaattggattacgcttccaacttcctttacatgctgacggagaaggagccagacccctttgccgccaaagtgtttgatgtgtgtttgaccctccatgctgagcacaccatgaatgcgtccaccttttcggcccgggtaacggcttctactctcacggatccctatgcagtggttgcctcggcggtggggactttggcggggccgctccacgggggagccaacgaagaagtgctaaatatgcttgaagaaattggctcagtggaaaatgtccgcccctacgtggaaaaatgcctggccaacaaacagcgcatcatgggctttggccaccgagtttataaagtcaaagacccccgggcaattattttgcaggatttggctgaacagttatttgccaaaatgggccacgacgaatattacgaaatcgcagtggagttggaaaaagtagtggaagaatacgtgggtcaaaagggcatttaccccaatgtggacttctattccggtttggtttaccgcaagctagacatccccgccgatctgtttacgcccctatttgcgatcgccagggtggcgggttggttggcccactggaaggaacaattatcagtcaataaaatttaccgtcctacccaaatttacatcggtgaccataatttatcttatgttcccatgacagaacgggtagtttccgtggcccgcaatgaagaccccaatgcgattatttaa

SEQ ID NO: 26491 - DNA, 975 bp, Synechocystis sp.
atgtctgacacacaaaataccggccaaaaccaagccaaggctcggcagttactgggcatgaagggggccgccccgggggaaagttccatttggaaaattcgtcttcagttgatgaagcccatcacttggattcccctgatctggggggtggtctgtggggccgcttcttccgggggctacatctggtcagtggaggatttccttaaagccctcacctgtatgttgttgtccggcccgttaatgaccggttatacccaaaccctcaatgatttttacgaccgggacatcgacgccatcaatgaaccctaccgacctattccttccggggccatttccgtgccccaggtggtgacccaaattttaattctgttggtggctggtattggcgttgcctacggcttggacgtgtgggcccagcacgattttcccattatgatggtgctcaccttggggggagcctttgttgcttatatttactctgcaccaccgttgaagctaaaacaaaatggctggttgggtaactatgctctgggggctagctacattgccctaccgtggtgggcgggccatgctctgtttggcaccctcaatcccaccattatggtcttgaccctaatttatagcttggctggtttgggcattgcggtggttaacgatttcaaaagtgtggaaggcgatcgccaattggggctcaagtccttgccggtgatgtttggtatcgggacagcagcttggatctgcgtgatcatgatcgacgttttccaagcgggtattgcgggatacctgatttatgttcaccaacagctttatgccaccattgtgttgctattgctcattccccagataacttttcaggatatgtattttctccgtaatcccctggaaaatgatgtcaaataccaagccagtgcccagccatttctagtttttggtatgttagccaccggtctggccctaggccatgcggggatttga

SEQ ID NO: 26492 - DNA, 2079 bp, Synechocystis sp.
atgggcaaagtcattggcattgatttgggaaccaccaacagttgtgcttctgtgttggaggggggcaaacctattgtgattaccaacacggagggaggccgtaccacccccagcattgtgggtttcaccaaaggttcccagcggttagtggggcaattggccaagcgtcaatcggtgaccaatgcggaaaatacggtgtacagcatcaaacgctttattgggcgacgctgggatgacacggtggaggaacgttcccgggtgccctataactgcgttaaggggcgggacgataccgtcagtgtgtctattcgcggacaatcctatactccccaagaaatttccgccatgattttgcaaaaactgaaggcggactctgaggcttttttgggggagccggttacccaggcagtgattaccgtgccggcctatttcaccgatgcccagcgccaagcgacgaaggatgcagggacgatcgccggtttggaagtattgcggattatcaatgagccaacggcggcggctttggcctatgggctagataaacaggaaacggaagagttaattttggtgtttgacttgggggggggcacatttgatgtttccctgctacagcttggtaacggagtatttgaagtgctatccacctctggtaataaccatctggggggggatgattttgataattgcgttgtccagtggatggcagaatcctttaagcaaaaggaaaatattgacttaagcaccgataaaatggcgattcaacgactacgggaggcggcggagaaggccaaaatcgaactctccagcatgctgaatacgaccattaacttgccttttatcaccgcagatgagtcgggacccaaacacttggaaatggaacttgcccggagccagtttgaggagttaactaagcaattactagaagatactagggttcccctcacccaggcattggacgatggtgagatcagggccagtgatgtccaccgagttattctggtgggaggctctacccgtattccggccattcaacgggttattcaagaattttttcccgacagtcagttagagcgttccgttaacccagatgaggcagtagctttaggagccgctattcaagctggggtcattggtggcgaggtggaggatgtgttgctgttggatgtaacgcctttatccctgggtttggagaccctaggggaggtaacaacaaaaatcattgaacgcaataccaccattcccactagtcgctcagaagtgttttccacagcggtcgacggacaaacatcggtggaaatccatgttatccagggggaaagggccatggccagggataacaaaagcctgggtaagttcttactggcggggattcctcccgctccccgggggatgccccaaattgaggtcagctttgaaattgatgttaatggtattctcaaggtttctgcccaggaccaaggcacaggcaaggaacagagtattgtgattagccataccggtggcttgagcggcggagaaattgaaaagatgcgccaggaggcgcaacagtatgccgcccaggatcaattgcgtctgcggatgatggaactacaaaaccaagcggatagccttttccacacctacgagactacactccaggaaagcggtgaactagtgcgggaagaactcaagtcttctggcaagcagaagaaggaccaattggcgatcgccttacggacccccaatacgccggtggagaaattgcagaccttggtggaggaattccggcaaattattttactgattggtacggaagtctatcaacagggcaaaggggctgctagtaatgaatttgccaattttgttcagggcactagcagtgggacaagtcaaatgattgaatccctggaaaccaatttgaatcctatccaagcgtcctcgggcatcaccatgacaccgggcactatgatcaatggcaccgtcaatcccggtgggatggattatgtggaaactgctccagtgtacggtctagatgacggggaggaatttgactttgacgctgatgaaactgtttacagtgactatgaagcgatcgattag

SEQ ID NO: 26493 - DNA, 1287 bp, Synechocystis sp.
atgacccccagcctattgcctccccgcctcaatctgccccatgttgaagtgttgcctaatggtttgaccattattgcggagcagatgccggtggaagccatatcttttcagctctggttgagggtgggttctcgctgggagggagatgaaattaacggtactgctcactttttagaacatatggtgtttaaaggtactccccgcctggccatgggggaatttgagcgggccattgaatcaaggggggcgggcaccaatgcggccaccagccaggattacacccagttttacttcacctctgcgccccaggattttgagcatttggcccctttacagctggatgtggtgctcaatcccaccattgccgatggaccctttgaacgggaacggttagtggtgctagaggaaattcggcgatcgcaggatgatccccagcgacgcatttttcagcaggtggtgcagttggcttttcccggcactccctatgctcgccctgttttgggacggcgggaaattatcgaaaatctccaagctcaacaaatgcgggatttccacgcccattggtaccagcccccagccatgacagtgacggtggtgggcaatcagtccgttggtaatttggtggaaactgtagcccgcagttttgccgattgttaccgggtcaaatccccttcccaaaccctaatgcccccgctggttaatattccgccgcctttcactaaggtagaaacgaccacggtggtggatgacagtttgcaacaggcccgtctaattttgctctggcgatcgccagggttagaccagtttgagaaaactttgcccctgggggtcttagcggtgattttgggtcggggaagagtgtcgcgtttgtttagggaattgcgggaagaaaagggtttagtgacggcgatcggtgccagtaattccacccaggctacccagggtatgttctacatttcggcccagttaccagcggaaaatattcccatggtagagcaatacatcctagaccatattgagcgactacaaaatgaacccattccagaaaaggatttagaacgcatccgcacccaagtggccaatcgttttattttcggtaatgaacgccccggcgatcgggctaatttatatggttattactacgcccaaattggcgatttagaaccggccttgacctaccccgtgcaaattcaagctttaacggccgcagatctacaaaaatcagcccaaacttacctgtcccccactgcctacggcaaggttattgctttaccagcagaggattga

SEQ ID NO: 26494 - DNA, 1347 bp, Synechocystis sp.
atgcaattcgccaaaattttaattgccaatcggggagagatcgccctacgcatcattcacagttgcgaagaattgggcattcccaccgtggcagtccactccaccatcgatcgccatgccctccacgtgcaactagccaacgagagtgtgtgcattgggccaccccccagcaataaaagctatctcaacattcccaatatcattgccgccgccctcacccgcaacgccactgccattcaccctggttacggatttttagcggaaaatgcccgctttgctgaaatttgtgccgaccatcaaattactttcatcggccccagccctgaagccatcaccgccatgggggataaatccaccgccaagaaaaccatgcaaaagtccggtgtgccctgtgtgcctggcagtccgggcttgattgagtcggaagcaacggccctaaaaattgcagcggaaattggttacccggtaattattaaagccacagctgggggcggcggtagggggatgcgcctcgtccaggaagaaaaggattttctcaaactgttccatgcggcccagggggaagcaggggcggcctttggcaatccaggggtttacctggaaaaattcattgaaaaaccccgccatattgagttccaaattttggccgatagccacggtaacgtagtgcacctgggggaaagggattgttccatccaacggcgacatcaaaagttactcgaagaagcccctagtccctttttgactccccacttgcggaaaaaaatgggggaggcggcggtgaaagcggccaaatccattaactacgtcggagccggcacagtggaatttttggtggatggtaacggtaatttctactttatggaaatgaacacccgcattcaggtggagcatccggttacagaaatgattaccggctatgacttgatttcggaacaaatccgcattgccatgggagaaaaactccgcttccgccagtccgacgtggaaattcgtggccatgccattgaatgccgcattaatgctgaagatcccaaacaaaattttcgcccccaccccggcaaaatcagtgcttatctcccccccggtggccccggagtccgcattgattcccacgtttacaccgactatgaaatccctccctactacgattccctgatcggcaaattaattgtttgggctggcgatcgcccttcggccatcaagagaatgcagagagccttgcgggaatgcgccatcactggagtacccaccacattggaatttcaccagcgcatactacaaaccccagcttttctggccggggatgtgtacaccaatttcatcgaagagcatttaacaccctag

SEQ ID NO: 26495 - DNA, 1263 bp, Synechocystis sp.
atgactagcgacgatgccgcggccggtttagtaagggttctcgatgctgcccagggagctttccttgccctcgattcctatggcggtaatgatcggagtcgggcggtgttggccatggcggaggcgttggaacgttcctttgcccaaattttggaagccaataccttggacttggtggtgagtcgggaaatgtccgtggcggattgtctctgtgaatggctcaagctcaccccggaaaggttgcaaaacacagtgactatcctgaagcgtttggcttccctgccggatcccctccagcgagttatggcttccccctaccaatttaacctggcccagacctattgccagttaatgcccttgggggtggtggccctggtctatgaatcctttcctgaattggcagcgatcgccgcgggcttttgcctgaaaacggggaacagtctagttctaagaagttgcggtgcttcgagccattccacggcggctatttgcgaaatattgcgggaaggtttactggatgcggatttaccagtggatagcgttagccatattcccagcgaaacctcacccaatgtgcaggacttggtaggcaatgccagccagctcaatttggttattccctatggccgccccagttttgtggaacaaattagccaacaatgcactcccccggtcttgaaggccgccatgggcaactgttacctctactggtctagtaaaggggacttggaaatggtgcgccagatgatcattgacagccatgtgggccatccagatccggtcaatgccattgaaaaagttttggttagtccggggcaaaatccagcgcccttggtacgcctattgaacaacttgcaggccaagggctttaagctccggggggacgctgaactctgtgagcaatttcccgaccatctcaccctagctaaggagaatgaatggggtaaagcttacctggacaggacagtggcctttcgcactacccaaaacctgaaaacggcgatcgcctggatcaatagccatagcagtggccacggggactgtattgccacggattcctaccaggaaagtcgccaattttccatgggggtggacagcgccctggtttatgtgaatattccgccctatttttgtcgtaatccccgccatggggaatcattatttttgggagtatcgagccaaaagggtcaaaggcgcggcttaattgggctagaagcatttatgacccccaagcaaattgtccagggagaaagtcgcagttga

SEQ ID NO: 26496 - DNA, 2247 bp, Synechocystis sp.
atggccaccaccgtacaactcagcgaccaatccctccgtcagctagaaaccctcgccatccacaccgcccacctgattcagccccacggtttagtggtggtcctgcaggaaccagacctcaccatcagccaaattagcgccaactgcaccggcattttagggcgatcgccagaggatttgttgggcagaaccctaggggaagtgtttgatagctttcagattgatcccatccagagtcgcctaacggccggacaaatcagcagcctcaaccccagtaaactttgggcgcgggtcatgggggacgactttgtcatttttgacggggtttttcatcgcaacagtgacggtttattggtatgtgaactagagccagcctacacttccgataatctgcccttcctcggtttttatcacatggccaacgctgccctgaatcggttgcgccaacaagctaatctacgggatttctacgatgttattgtcgaagaagtccgccgtatgactggctttgaccgggtgatgctataccgctttgatgaaaataaccacggtgatgtcattgccgaagataaacgggatgatatggaaccctatttgggcctgcactatcccgaatcggatattccccaacccgcccgtcggctatttatccacaaccccattcgagtaattcccgatgtttatggtgtggcggtgcccctgaccccagcggttaaccccagcaccaaccgagcggtggatttaacagaatccattctgcgcagtgcgtaccattgccacttgacctatctgaaaaatatgggggtaggagcgtctttaaccatttccctaattaaggacggccatctctgggggctcattgcctgccaccatcaaacccccaaagtaattccctttgaactgcgtaaagcctgcgaattttttggtcgggtggtgtttagcaacatttccgcccaggaagatacggaaaccttcgattaccgggtgcagttggcggagcatgaagcggttttattggacaaaatgaccacggcggcggattttgtcgaaggattaactaatcatcccgatcgcctgttgggattaacgggctcccagggggcggccatttgctttggggaaaaattgattttagtaggggaaaccccggacgagaaagcagtgcaatatttactgcaatggttggagaatcgggaagtgcaagacgttttcttcacctcttccctctcacaaatttatcctgatgcagtgaattttaaatccgtggccagtggcttattggccattcccattgcccgtcacaactttttgctctggtttcgccctgaagtgttgcaaacggttaattggggcggtgacccaaatcatgcttacgaagctacccaggaagacggtaaaatcgagctccatccccgccaatcctttgacctctggaaagaaattgtccgactccaatctttgccctggcaatcggtggaaatccaaagtgccctggccctgaaaaaggcgatcgtcaacctcattttgcgccaggcagaagaattggcccagttagcccgcaacttggaacgctccaacgctgatttaaagaaatttgcctacattgcttcccatgatttacaggaaccgctcaaccaagtgagcaattatgtacaactgctagaaatgcgctacagcgaagctctagacgaagatgccaaagacttcatcgattttgctgtgacaggggtttccctgatgcagactttgattgatgatattttgacctacgccaaggtagatacccagtatgcccaactaactttcaccgatgtgcaagaagtggtggacaaagctctggctaacctgaagcaacggattgaagaaagtggagcagaaattgaagtgggttccatgcccgcagtaatggcggatcaaattcagctcatgcaggtattccagaacctgatcgccaatggcatcaagtttgccggggacaagtcacccaaaattaaaatctggggcgatcgccaggaggatgcctgggtgtttgcggtccaagacaacggcattggcattgacccccaattcttcgagcggatttttgtcattttccaacgactccacaccagggatgaatataaaggcaccggcatggggctagccatttgcaaaaaaatcatcgaaggccaccaagggcaaatttggctagagtccaacccaggggagggctccacattctacttctccatccccattggcaactaa

SEQ ID NO: 26497 - DNA, 2028 bp, Synechocystis sp.
atgagcaactccccgtctgttcttacagagctattgcaggctttacccaatctgcgggcccaaacctacttcaagtcttccctcacggccttgtcccacgccatggaagaccaggtactagcggaaagtacagcgggcaatcccctgatcattgcggcttttcagcgggagagattttatcgtcaagaagcccaccgttatcgacgtattgccgataagagcagtcaggtttacgtgctctccgctccggagacggaatttaaacacaactccggcatttacgaaaccattgcctttactcctgaagacagcctcgcccaggaatggcatttgattgtcattggcgatcgttatgccagttgtctaatttgtcgagaacgaccgacccaggataaatgggatagtaaccgccgttttgaaggtgtttggacctttgatcgccaggtgagtcgagttgcagcccaactattgctacaacggattttagcctaccgtccagagttacaagccaaaatcgaggaggcgacccaaacctggctccagccttcctgcactgttcccccccggggcattgacgataaccctgatccctttgtacaacggttaatcacctatctccaagctggacagtataagttaatcaaagccaatcgtaatttgcaggacaaagaagagcgggagagactgcttaactccatcacaggggcggtgcgacgttcccttgatcccgaggaaattatgcaggtggcggtggaaaaactaggccaaggtttgggcatttgccgttgtgtgatttaccgctgtagtgctgatgatacagtggcgaccattaaccatgaattcctcggtagcggtgttggttccatcaagggttatccctggcccctcaaagataatcccctttttcaggaggtggtggtcctcaaggaggcgatcgccatcgacaacatcgaccgagatccaaggttaggggaaccggagccttctacgggggaagtgaaaaccctggtgaagagttgtgccattctgtcctggatgttagtgccaattttttatcgggaaaggttgctgggcatgatggaatttcaccactgtggtcctgcccccacggagtgggaggacgatgcccttaccctagtggaaggggtggccacccaaattggggtagcactgatccaagcagaatcctatgccaacctacaggaattgaatgagcaattagctgccctagaccgcactcggtctaacctggtggccattacagggcatgaactacgcacccccctttccactatccaagtgtgtttggaaagcctggccacggagccggatatgccccaggaattgagacaggtaatgttgaacactgccctggaagatgcggagaggatgcgcaaactggtgcaggactttctcacgctatctcaactggaaagtggacgagtggaatggaacgcagagccaatttccctagaagaatgtgtggagctttccttgagccatatccgagcccacaatcggggccaggaagtacctgtcattgtcaatcaggtgaatggcgaaactcccatggtggaggcggacggggaatggttagtggaattgttgaccaagcttttggataacgccatcaagtttacccccaccaatggtaggatttccatcgctgtcgatcgcccgaatccgtcccaattggaagtcaccatcaccgatacagggcgaggtattgagcctaaccgcttggaaaccgtgtttgaccgtttttaccaagaagaaggagctttacgccgcagtcgggggggcactggcattggcctggccatctgtcgccaaattgttagcggttggggaggggaaatctgggccgcttccgatggcaaaaaccatggcacccagttccatttcaccgttcctattgttatgccggaaaatccaaatcttggcgtggaagaagttgccccgaaaaagcgtaaagcaacctccccccgcattgcatcccggagcaaaaagaaacagaagttttcctga

SEQ ID NO: 26498 - DNA, 1302 bp, Synechocystis sp.
gtgacagttaaaattggtttactcggtctaggtaccgtcggcagtggcacagtggaaattttgcaggatccgcagggtcgtagtcccctgctcaaagccattgaggttaaagcagtgggggtgcgttccttggataaaccccgccaagtaaatttgccgccggaggttttgaccaccgacctagaagccattgtcaccgatcctgacattgccattgtggtggagttgatgggaggattggaacccgctagatccctcattctccaggcgatcgcccataaaaaacacattgtcaccgccaacaaagcggtcattgcccgttacggcccagaaatttacgaagcggccaatcaacacggcgtttatgtcctcctggaagcggcggtggggggcggcattcccatcattaagcccctcaagcaatccctgggaggcaaccgcatccaaagtatcgtcggtattctcaatggcaccactaactatattctttcccgcatgaccagtgagggggcggattttgacgaggtattaacggccgctcaacaattgggttatgccgaagcggatcccagtgccgatgtggatggattggatgcggcggacaaaattgccatccttgcttccctcggttttggcggccgggttaaacgggaagatgtggcctgtgaaggcattagatccgttagtgcggtggatattgcctacgccgatcgcctgggctttgtgattaaactactggcgatcgccgatggtaatgcgggggaagattcagaagcattgcaactgcgggtacatcccactttaatcgccaaggatcatcccctcgccagcgttaatggagtttacaacggtgtgttggtgactggagatcccctggggcaagtaatgttctacggtcggggagcgggagctggccccactgccagtgcggtggtatccgatgtaattaacattgttggcattattaccagcagtgacgaaaatcctgcccttgatcccctgctcagttgcacccaccaacactactgccaggtttcccccattgaagatctagttacccgtttttattgccgcttcctctgtgctgacgtgccgggggtaattggccatttaggcatgggttttggcaaccacggggttagcttagaatccctagtgcaaattggcttcaccgatggctgtgcagaaattgtcgtcgttacccatgatgtgcgggaaggggattaccgggccgccctggaggaaattagccaactagaagcagtgaaggaaattcctagtgtgatccgggtgctgtcctaa

SEQ ID NO: 26499 - DNA, 996 bp, Synechocystis sp.
atgactatttctttggaagccgatttaaaatccctgcaacagtctgcccaggcggcgatcagcggttgtgacgacctggatgggttggataaattgcgggtgcaatacctagggaaaaaaggggaattgtccctgattcttaaaggtatgggtaaactttctgcggaggaaagacctaaatttggggcgatcgccaatgaggtaaaagaggcactccagcatgatttggaatcccgcaaagccaatctacaaaatgcggcgatcgaagctcagctagcggcggaaactttagatgtgaccatggcgggcagttaccgtccccagggccgtcgccatcccctcaacagcaccgttgaccgggtgttggatatttttgtcggtttgggctacaccgtcgctacggggccccaagtggaaacggattattacaactttgaagcgttaaatattcccgctgaccaccccgctcgggatatgcaggataccttctttttaaaagatggtcgtctgctccgtacccacacttccccggtgcaaatccgttacatggagaagcatgatccccccatccgcattgtggcccctggtcgagtttatcggcgggatacggtggatgccacccactctgctgtatttcatcaagtagaactattggcgatcgataaaggtttagctttcacccatttgaaaggcaccattcaggcttttatcaaacaaatgtttggggaagcattgccgattcgctttcgggctagttattttccctttaccgaaccctcagcggaagtggatgtgcaatggcagggtaaatggctagaggtgatgggctgtggcatggtggaccccaacgtaatggaagcagtgggttatgacccggaagtttacactggctttgccgcaggctttggggtagagcgatttgccatggtgttgcaccaaattgacgatattcgtcggctctataacagtgatctgcggtttctgcggcagttttaa

SEQ ID NO: 26500 - DNA, 810 bp, Synechocystis sp.
atgaacgaatccccggcgcaaccattaactgaaaccatccccgtctttactacccagaacctagatatctattacggtagccaccgggcagtgcgggacgtttccctgactattcctaaaaataaaattactgctttcattggcccctccggttgcggtaaaagtaccattttgcgttgctttaaccgtttgaatgacctgattgaaagtttccgactagagggcaaggttctttaccatagccaagacctctactcgcctaatattgatgtcactgcggtgcggaaatatattggcatggttttccaaaagcctaatcctttcccaaaaaccattttcgataacgtggtgtacggtgccagggtcaatggctacaaaggcaatttggaagagttggcggaagattccctccgacgggccgccctctgggacgaagtgaaagataaattaaaagccagtggtttttccctttccggtggtcagcaacaacgactttgcatcgcccgggcgatcgccatgcaaccggaagtattgttaatggatgaaccctgctcagcgctagaccccatttctaccctgaaagtggaagagttgatgaatgagttgaaggaaaactacaccatcatcatcgttacccacaatatgcaacaggccaccagggtggcggattacactgctttttacaacgcagaagccacggacaaaggcaataaagtgggctatctggtggaatttgaccgaactggcaaggtgtttggtgacccccaggaacaggaaaccaaggactatgtcagtgggcgctttggttaa

SEQ ID NO: 26501 - DNA, 855 bp, Synechocystis sp.
atgttcaacgggtttaggtttaacggtaatcgtattggcgatcgccgttggttttgtggtggcggaggtgagcctgtgacgggaaccaatgtgcgggccatggaccggagccaagaaaaggaagcaattaagtcacccataccaccggcaattagggtgcgggaattatcctttgcctatggcggacaaactccagtactaaacaatttagcttggcaagtcgccccaggggaaaggctaggcattattggccataacggttgtggcaaaactaccttatttttactgctttgcggactgttaaaagctagcgctggcaccatccagttattgggccaggccctggaagcgggaaaatttttgcctgaagtgggtttcctgtttcaaaatcccacagaccaactatttgctacctccgtttgggatgacattgcctttgggccacaaaatatgggcttatccccggctcaagtgacggagagggttaaccaagcggcggagttaactggcattacttctttgttagatcgtctaccccaacatttatccgggggggaaaagcaaatggtggcgatcgccggtttgttagccatggccccgaaaattttactctgtgatgaacccaccgctagtctggatattaaagcccgccgtcagttgattaactttttggggcagttccagcaaacgttactaatttcctcccacgatctggaatttgtgctggaagtctgcaaccgggtcataatcattgaccaagggcagattgtcgccgacggcccggcccaggaaattatggccgaccaaaccctgatggaaagccatggtctggaaaaaccctattctctccgttaa

SEQ ID NO: 26502 - DNA, 1302 bp, Synechocystis sp.
atggttatttccccaagcctttctgccctccacaccctggcccacaatgctcgtcaagcggccctccatctgggtagtttaaacaccgccgaacgtaatcaggcgatcgccgccatagctgatggtttaacggccgctatgccagaaattttggctgccaaccaggaagattgtgcggctgcggaagccatgggcattgccaaacccctttataaccgtctgttgttgggggaaagtaagctcaaaagcaccattgcgggggtgaaggatgtggagcatttacccgatcccttgggccaagttaccctccaccgccaattggacgagggtttagtgttaaagcgggttggttgtcccctaggggttttgggggtgatttttgaagcgcgtccggaggccctaatccaaattagtagtttggcgatcaaatccggcaacgccgtaattctcaaagggggtcgagaggctacccgctcctgtcaagttttgactgaagtgattcaaacggccttggcgaaaaccgttgtgagtcctgaagcgatcaacctactcaccaccagggaggaaattcgggaattattgggtctgaaccagtatgtggatttgattattccccggggttccaacgaatttgtccaatacattcaacaaaacacccaaattcctgtgttgggccacgccgatggtatttgtcatctttatctggatgctcaagctgatcttagtaaggctatccccatcacagtggatgccaaaacccaatatcccgccgcctgcaatgccattgaaactcttttagtccaccaggcgatcgccgctgaatttttaccacccttggcccaggcattgggggaaaaaggggttagtttgcggggagatagtggaactcaaaaattaattgactgtgaacccgccaccgaagcagattggtgcaccgagtatagtgatctaatcctctccatcaaaattgttgattccctcgaagcggcgatcgaccatattaaccagtacggttctaagcacaccgatggcattattagcgaagatttaaccgccgcagagcagttttgtcagcgggtggactccgccggggtttaccacaattgcagtacccgctttgccgatggtttccgttatggttttggcgcagaggtgggcatcagtacccagaaaatgccgccccgggggccagtgggtttggagggtttggtcacctataagtaccaattgtggggccatggtcacattgccgccacctatactggccagggagcaaaagcttttactcaccttgatctttaa

SEQ ID NO: 26503 - DNA, 3318 bp, Synechocystis sp.
gtggcgatcgccgataaagcctatacaatgattgggatcgaaatccccatcacgtctcggacagttttacctatgccacgccgcaacgacttaaacaaaattatgattttgggggctggccccattgttattggtcaagcttgcgaatttgattattcgggcacccaggcgtgtaaggcgttgaaggaagaaggttatgaagtggtgttggtaaactccaacccagcatcgatcatgactgacccggagttggcggatcgcacctacattgagccgctcattccggaaattgtggaaaaaattattgaaaaagaacggccggacgcagttttacccaccatgggggggcaaacggcattgaacctggcggtatctctgtctaagtccggggtgctggaaaaatatggggtggaattaattggggcgaaactgccggcgatcgaaatgggggaagaccgggaattattcaaggaagccatggcccgcattggggttcccgtttgtccatcgggcatcgccagtagcatcgaagaagctcggcaggtggcccatgaaattggttcctatccgttaattattcgccctgcttttacgttggcaggtacggggggcggcattgcctacaaccaagaagaatatgaggagatggtgcaatacggcttggatcagtcccccatgtcccaaattctggtggaaaaatccctgttgggctggaaggaatacgagctggaagtgatgcgggatttggccgataacgtggtcattatctgctccattgaaaactttgaccccatgggggttcacactggggattccattaccgttgctcccgcccagactttgaccgataaggaatatcaacggctacgggactattcaattgccattattcgggaaattggcgtggaaacaggggggtcaaacattcagttttccgttaacccggccaatggcgatgtgattgtgatcgagatgaatccccgagtctcccgttcttcggccctggcttctaaggccacgggtttccccattgccaaatttgcggccaagttagcagtgggctataccctcaacgaaatttccaacgacatcactaagaagactcccgcttcctttgaacccaccattgattacgtggtgaccaaaattccccgctttgcctttgaaaaattccctggggccgagccaattttaaacacccaaatgaaatccgtcggggaagccatggccattggtcgtactttccaagaatctttccaaaaggcgttacgttccttggaaacaggacggttcggcttcggttgcgatcgccatgagactttgccgacgctgtcccatttgcgttcccagttgcggactcccaacccagagcgggtcttttctttgcaccatgcgtttaatttgggcatgacagtggaagaaattcatgagttgacggcgatcgatccttggtttttagacaaactagaggatttggtcaaaacagaaaaatatatgaaacaacggagtttaaaagacctcacggccgcagatctgcgctacatcaaacaacagggctttggcgatcgccagatagcctttgccaccaaaaccacggaagacgaagtgcgggcctaccgcaaatccttgggcattacccccgtgtataaagtggtggacacctgtgcggcggaatttgaagccttcaccccctactactactccacctacgaaccggaagagtgcgaagtattgccatcggacaaacccaaagtgatgatcctggggggggggcccaaccgcattggccaaggcattgaatttgattactgctgttgccatgccgccttttccctcagtgatgcgggctatgaaaccatcatggtcaactccaacccggaaaccgtttccaccgactacgacacgagcgatcgcctctattttgagccgttaacgaaagaagacgttttaaatattattgaagcggaaaacccagtgggcatcattatccaatttggtggtcaaacgcctttgaaactggcagttcccctgcaaaagtatttaaacagtcccgattgccccgtgcagactaaaatttggggcacttcccctgactccatcgacaccgctgaagaccgggaacgatttgagaagattctccacgagctggaaattagccaacctcccaacggcattgccagggattatgaagagtccagagtggtggccaaccgcattagttatcccgttgtggtgcgcccttcctacgtgctagggggaagagccatggaaatcgtctattccgatgaagaattagaacggtacatgacctatgcggtgcaaattgagccggaccaccccattttaattgacaagtttctggaaaatgccattgaagtggacgtggactccctcaccgatagcaccggcaaagtggtcatcggtagcatcatggaacacatcgaagaagcgggcatccattccggggactccgcctgttccattccctacaccagcctttccgataacgttctgaccaccatccgccaatggacagaacaattggcccgggccttaaacgtggtgggtctaatgaatattcagtacgcagtgcagggggaccaggtttatatcctcgaagctaacccccgggcttcccgcaccgttccctatgtcagtaaagccaccggccgtcctttggccaaaattgcttccctggtcatgtccggcaaaaccctagaagaattaggggtaacggaggaatttattccccaacacgtggccgttaaagaagccgttcttcccttcagtaaattccccggggcggatactttgctggggccagaaatgcgttccactggggaagtcatgggcattgacagcgactttggtaaagcctttgcgaaggcagagttgggagcgggggtaattttagccaccaccggaacggtatttgtgtccatgagcgatcgcaccaaagaggcggcggtgcccgtagtgcgggaattaattgacctgggctttaaggttgtcgctacctctggtacccaaaaagttctgcgggaacatggcattgaaggggtggaagtggtgttaaaactccacgaagggcgaccccacgtcattgactggatcaaaaacggccaaatccaatttattatcaacacccccagcggcgaggagtcccagttggatggccgcaccattcgccgggctgcgttggattataaattgcccatcatcaccacgatcgccggaggaaaagccaccgttgccgccctccgcagtctgcaggatcaccctttagacgttaaagcattgcaggattatctaggctag

SEQ ID NO: 26504 - DNA, 537 bp, Synechocystis sp.
atggcggcccagatcattgaaattctttccccggaggaaatccgacgtacccttacccgtctggcttcccaggtaattgagaaaaatagtgacctgtcggagttggtcttactggggatctacaccaggggagtacccctcgcccatcagcttgcccagcaaattgaaatgttggaacaagttaaagtccccgttggggcgatcgatgtgactctctaccgggacgatttaaaacggatcaaaacccgcaccccggctaaaaccaaaattcccctcagtttgactggcaaaagggttgtattggtggatgacgtaatttataaaggccgcactatccgggcggcactcaatgcggtgacagaatatggtcgtccccaggtaattcgtttattaactttggtagaccggggtcatcgagagttacccatccatcctgattttgttggcaaaatcctgcctacagcggcggaggaacaggtgaaagtatatttacaggatcccgatggtcgggacacggtggagttaattaaaggttaa

SEQ ID NO: 26505 - DNA, 705 bp, Synechocystis sp.
gtgaccattgcttcttcccattccatcaataacggcatgaacaccggtaaattagtgaatcagctttcctccctacctgaccgtaatacccacaatgggcaagaggtgaaatatcatcccgaaaatgttgagttgaataaagaaaaaatgatggacgcggtgcgcgtcatgttggagtcagtaggggaagatccggaaagggaaggcttgctaaaaacccccaaacgggtagcagaagcaatgcaatttttgacccagggttatgaccaatccttggaaaaattagtcaatggcgccatttttgacgaaggtcataacgaaatggtattggtgcgggacattgattttttcagtttgtgtgaacatcacatgttgccctttatgggtaaggcccatttggcttatattcccaaccaaaaagtagtgggactgagcaaactggcccgcatcgtggaaatgttttcccgccgtctccaggtacaggagcgtctcaccaggcagatcgccgaagcagtacaggaaatcctcgatccccaaggtgtggcagtggtgatggaagccacccacatgtgcatggtaatgcgtggtgtacaaaaaccaggttcctggacagtgaccagtgccatgattggttctttccaaaatgaacaaaaaaccagagaagagtttttgaacctgattcgccatcaacctaatttctattaa

SEQ ID NO: 26506 - DNA, 1452 bp, Synechocystis sp.
gtgactgtccgtgtccgcattgcccctagccccactggtaatctccatattgggactgcccgcaccgccgtttttaattggttgtttgctcgtcacaccggaggcactttcattctgcgggtggaggatacggatttggaacgctccaaggcggaatatacggaaaatattcagtccggtttgcaatggttgggcttgaattgggacgaagggccttttttccaaacccaacggctggatcattaccgcaaagcaattcaacagttgctggaccaggggttggcttaccgttgctactgcactagtgaagaattggaacaaatgcgggaagcccaaaaggctaagaaccaagctccccgttacgataatcgccaccgcaatttgactccagaccaggagcaggctttgcgggctgaaggtcgtcaaccagtaatccgttttcgcattgacgacgatcgccagattgtttggcaggatcaaatccggggccaggtggtgtggcagggcagtgatttgggtggtgatatggtcattgcccgggcatcggaaaatcctgaagaagcctttggccagccattgtataacctggcagtggtggtggacgacattgacatggccattacccatgtgatccggggggaagaccacattgccaataccgctaagcaaattttgctctacgaagctttgggaggtgcggtgcccacctttgcccatacgccgttaattttgaaccaggagggcaaaaaattatctaagcgagacggggtaacttccatcgatgatttccgggccatgggttttctgccccaggcgatcgccaactatatgtgcttgctgggctggactcccccggattcgacccaggaaatttttactttggcggaggcggcagagcaatttagtttggagcgggttaacaaagctggggctaagttcgattggcaaaaattggattggatcaatagtcaatatctccacgctttaccagcggcggaattagtgcccctattgattccccacttggaagccgggggccatcaagttgatccggatagggatcaagcctggttggtaggtttggccactctaatcggccccagtttgactaggctcaccgatgcggccacagaaagtcaattactctttggcgatcgcctggaactcaaggaagatggacaaaagcaattggctgtggagggagctaaagcggtgttagaagcggcgttaacctttagtcaaaacacacccgagttaactttggatgaagccaaaggggaaattaatcgtttgaccaaggaattgggtctgaaaaaaggcgtggtgatgaaatccctccgggctgggctgatgggcactgtgcaggggccagatctactgcaatcctggttgttactacagcagaaaggctgggctacaacccgtctcacccaggcgatcgccgctgaataa

SEQ ID NO: 26507 - DNA, 1509 bp, Synechocystis sp.
gtggctaataaatttgagaccgttaaggcaaccaaagatggtttggctgtccgggctgagttggaacattttgcccagattggttgggaaaatatccccgaagaggaccgggatctgcgcttgaagtggttaggcatttttttccgccctgtcacccccggcgagtttatgctccgttttcgtattccccacggcttgctcaccagtcagcaattacaggtcattggcgacattattaaccgctacggcgatcggggcaatggggacatcaccaccaggcaaaatttgcaggtccggggcatcaaaattgaagatattcccgatatttttagcaagctggaaagctgtggtctaacctcggtccagtccggcatggataatgtccgtaacatcacaggctctccggtggcagggttggaaaaagatgaattgattgataccagagacctggtgcaaggggtacaggacatgatcaccaatggtggtcggggcaatccggaattcaccaacttgcccaggaagtttaacattgccatcgaaggaagccgggataattctgtccacgcagaaattaacgacgtggcttttgtcccagcctatcgggagggaattctcggttttaacgtagtggtggggggctttttctcttcccgtcgttgtgaagccgctattcccctcgatgcttgggtgcaaccggatcagcaggtggtggatttatgccgttctatcttggaaatttaccgtgaccatggtctgcgggctaaccgtcaaaagtcccgcctaatgtggctaattgatgaatggggggtggctaaattccgggaagaagtggccgctaagttgcctttccctctgttaacagcggctcctaaggacgaattagattgggataagcgagatcatttaggggttcatccccagaaacaagccgggttaaattacgtgggtctccatgtgccggtgggccgtctctatgccaatgacttttttgaactctcccgtttagcagatacctatggaagtggggaagtgcggctgacggtggaacagaatttaattttggtcaatgtccctgacgaaaaactggaggctttgttggcggaaccgttattaactaagtttcgagttgacccccacaatctgcaacggtcagtggtgtcctgtacgggggcgcagttttgcaagtttgccttgattgaaacaaaaaatcgagctttggccatggtggcggctttggaaaaagagttgacggtgcctaagcccgtgcggatccactggactggatgtcccaattcctgtggccaaccccaggtggcggacattggcctgatgggaaccaaagtgcggaaagatggcaaaacagtggatggtgccgatgtttatctggggggaaaagtgggtaaggatgcccatttgggtacctgtgtccataagagtattccctgtgatgaactgcagcctttgttagctcagattttgattgaacaatttggcgctgtgcggcgttga

SEQ ID NO: 26508 - DNA, 1314 bp, Synechocystis sp.
gtgaaaactgtagttggtaagcataacccgaaggtcggtggttcaaatccgcctcccgccattaaaaaaaaagaaaaaaattccccccgccggataatggttggggggtttgttttattcaatctaaagtttatggctactggttccactgcctacacttggctagacgatgctctagaaactattcagcgggcccattggcatcgccatccccagataattacccaagggccagggccagaaattaagttggaggggcaacggctagttaattttgctagcaatgattatcttggcttagctagccatccccacctaaaaacagcggccattaaggcgatcgccgaatggggaaccggcagtacaggttcccggttgctgagtggccaccgtcagctccatcaagacttggaacaggccattgcccgctggaaggggacggaagccgctttggtgttcagttctggctatttggctaatttgggcaccatcacggcgttggtgggtaaacgggatttgattttagcggacgaatataaccattccagtctgaagcgtggagcccagttgagtggagccaaggtaattaactatgaccatgggtgcccagaggttttgaccgatctattaatgaaacatcgagacaatcaccgtcgttgtttgattctcagtgatggggtgttcagtatggatggcgatttatgtcccttgccccagttagtggcgatcgccgaagaatttcaaagcatgttgctagtggacgatgcccatggcactggcactatgggaaaaatgggcacgggctgtcgagaacactttcagttaccggtgggagattggattcaggtgggaaccctcagtaaagctctggggagcctggggggttatgtggctggtagtgcatctttgatagattttctgcgcaatcgagctgccacttggatttataccaccggcctttcaccggctgacaccgccgctgccctggcggccatccaactgatccaacgggaaccagaacgcattgtccaactccagctcaacgttgattacctagccacagggttggaaagtctgacaaaattaaactttcggcgatcgccaattaattcccccatcctctgggtaggggccgccaatccagccatggctctggaaatggccaagcatttacgagaacagggcatttttgccccggccattcgtccccccacggttccccacagtcgaatacgtttttcggtcatggccacccactccccagggcacattgaccaactattagaagtactggaccactattaccccaattag

SEQ ID NO: 26509 - DNA, 975 bp, Synechocystis sp.
atgaatattttggagtatgctccgatcgcctgtcagtcctggcaggttaccgtggtcggcgctggcaatgtggggcggacccttgcccagaggttagtgcagcaaaatgtcgccaacgtagttttgttggacattgtgccaggcttaccccagggcattgccttggatttgatggccgcccagagcgtggaggaatacgacagcaaaatcattggcaccaatgaatacgaggccaccgccggctccgatgtggtggtaattaccgctggtctaccccgcaggcccggcatgagtcgggatgatttgttgggcaaaaacgccaacattgtggcccagggggcccgggaagcattgcgttattcccccaacgccattttgattgtggtcaccaatcccctggatgtaatgacctatttggcctggaaagtaactggtttaccttcccaacgggttatgggcatggcgggggtgttggactcggctcggctcaaggccttcattgcgatgaaattaggggcctgtccttctgatatcaacaccttagtgctgggcgggcacggagatttgatgctgcccttgccacgatactgcaccgtcagcggggttcccattaccgaattaatacccccccaaaccattgaagagttggtggagcgtacccgtaacggtggggctgaaattgccgccttactacaaacgggcacagcctattatgcgccggcctcttccgctgcggtgatggtggagtccattttacgcaatcagtctagaattctccccgccgccacctaccttgatggtgcctatggattgaaggacattttccttggagtgccctgccgtttggggtgtcgaggagtggaagatattctcgaagtgcaattaacccctgaagaaaaagctgccctccatctttctgcagaagcagttcgccttaatattgatgtggcgttggccatggttagcgacggttaa

SEQ ID NO: 26510 - DNA, 1962 bp, Synechocystis sp.
atgtcagataccattgaatccatcctgcaggaagagcgactgtttgatccccctacagaatttagtgagcgggcttacgtgcgtagtgggcgggagtatgagcaactgtacagccgggcggccagcaatccggagaagttttggggtgagctggcggagcaggaattacattggtttaaaaaatgggaccaggttttggattggcaacctccctttgcgaaatggtttgtggggggtcagttaaatatttcccataactgtttggatcggcacttaaccacctggcggcgcaataaggcggccattatttgggagggggaaccgggagattcccggataattacctatgcccaactccatcgggaagtgtgtcagtttgccaatgccctgaaaagtttaggcgtgcaaaaaggtgatcgggtagcaatttatctgcccatgattcccgaagcggcgatcaccatgttggcctgttcccgtatcggtgcgccccatagtgttgtgtttggtgggtttagtgcggaagccctgcgggatcgattagtggatgctgaagccaaattggtcataactgccgacggtggttttcgtaaagataaggcgatcgccctgaagcaggaagtggataaggccctggaacacggtgcccccagcgtggaaaacgtcatcgtcgtgcaaagaactaaagccgatgtgaccatgacggcgggacgggaccactggtggcacgaactccaacctcaacagtcggcccattgcccagcggaacccatagacagtgaagatatgctgtttattctctacacctctggcagtactggcaaaccaaaaggcgtggtccacaccaccgggggttacaacctttacacccacatgaccaccaaatggatctttgacctcaaagatacggacgtttattggtgtaccgctgatgtgggttggattacgggccacagctacattgtttacggccccctgtccaacggtgcaacaacggtaatgtatgaaggggtgccccgcccctccaaccccggttgtttttgggacgtaattgaaaggtatggggtgaatattttctacaccgcccccaccgccatccgagcctttattcgcatgggggaagccgtacccaacgccagggatttatcctctctccgtttactgggcactgtgggggaacccattaaccccgaagcttggatgtggtaccaccgggtcattggcggcggtaaatgccccattgtcgatacctggtggcaaacggaaaccggcggcattatgctcactcccctacctggagctatccctaccaaacccggttcttgtaccaaaccttttcccggcattgtggcggaaattgttgatttagatggcaatcccgtcgagtcagaccaagggggctttttagtgattaaacaaccttggcccagcatgattcgggatgtgtacggcgacaccgatcgcttccgccatacctattgggaacatattcaacccaaggagggacaatatctctactttgctggggacggggcccgccgggataaagacggttatttttgggtcatgggccgggtggatgatgtgattaatgtctctggtcaccgtttaggcactatggaaattgaatcggctttggtttcccatcccctcgtagcggaagcggcggtggtgggtcgccccgatgaattgactggggaagccattttcgcctttgtttctctggagggtaacgctgaacccagtgaagagttgaaaaaagatttggtcaagcacgtcactgaagaaattggggcgatcgccaggccagcggaaatccgtttcaccgatgtgttacccaaaacccgttccggcaaaattatgcgtcgtctgttgcggagtttagcctccgggcaggaaatttccggggacacttccaccctggaggaccggacagtgctggacaaattacgggagggctaa

SEQ ID NO: 26511 - DNA, 957 bp, Synechocystis sp.
atgttaaacccattaaacattgaatacctatatttaagcaaactttttgacaatagtttaatcgtttttaacaagcgccaattattccgttttttcgttaggttttttttcatgactgctgctcttcccaacgattccaagcccaagttgactccagcttggactgtgatcttcttttttacctccattcatttggtggccctgttggctttcctgccccagtttttcagttggaaagcagtggggatggctttcttgctctatgtaattaccggcggcattggcattactttaggttttcaccgttgtatttcccaccgcagtttcaatgttcctaaatggttagagtatattttcgtaatctgtggcaccctagcctgtcaggggggcgtatttgagtgggtcggcttacaccgtatgcaccacaaattttctgacaccaccccggatccccacgattctaataagggtttttggtggagtcacatcggctggatgatgtttgaaattcctgctaaagctgatattccccgctacaccaaggatatccaagacgataaattttatcaattttgccagaataatctaattcttatccaggtcgccctaggcttgattttatttgccttagggggctggcccttcgttatttggggcatttttgtccgcctagtgtttgttttccacttcacttggtttgtcaacagtgccacccataagttcggctacgttagccatgaatccaatgattattcccgcaattgttggtgggtagcattgttaactttcggtgaaggttggcacaataatcaccacgcctatcagtactctgctcgccatggtttgcaatggtgggaagtggatttaacttggatgaccattaaattcctatctttgctggggttagccaaggatattaaacttcctccggaaactgcgatggccaacaaagcctag

SEQ ID NO: 26512 - DNA, 1029 bp, Synechocystis sp.
atggcaaaaactcccattttggtcaccggtggggccggttttatcggtgccaactttgtttaccattgcgttcaaacctgcggcgatcgccgtattgttgtcctcgatgccctcacctatgctgggaaccgagccactttagcaccattggaaaaactgcccaattttcgctttgtccagggagatattggcgatcgccatttggtggatcaactattgagggaagagcagattgagaccatagcccattttgcggcggaatcccatgtggaccgttccatccttggccctggagcctttgtacaaaccaatgtggtgggtactttcaccctgttggaagcttttcgagaacattggcaaaggcggggaaacccagcccaatttcgctttctccacgtttccaccgatgaagtttacggcagtttaacccccaatgaaccgggtttttcggaaaccaccccctattcccccaacagtccctattccgcttccaaggccggcagtgatcatttggtgcgggcctattttcacacctacggcttgcccactttaattactaattgttccaacaattatggcccctaccaatttcccgaaaagttaattcccctcatgtgcctcaacattctgcgtggggaaaagttgccggtgtatggtgacggtcaaaatgtgcgggattggctttatgtcacagaccactgccaagctctggacttagttttgcaccaagccttgccaggggcaacctacaacattggcggcaacaatgaagttaaaaatattgaattggtagaaattttatgcgacttgatggacgaattagctcctgatttaccagttaagccggcacgacaactgattagctatgtgaccgatcgccctgggcatgatcgccgctacgccattgatgccagcaagattaaacgggagttgggctgggaaccaaaagtaacagtggaacggggcttaagacaaacagtgcaatggtatttagaccatgaagcctggtggaggcccctgttgggttag

SEQ ID NO: 26513 - DNA, 639 bp, Synechocystis sp.
atggcaactattttccgcacttggagttatcagtatccgtgggtttacgccctagtttcccgcctagcgactttgaatgtggggggagaagagcgtttccatcaattgccattggagaatttagcaatttcaccgggacagaaggtgctggatttgtgttgcgggggtggccaagccactgtttacctagctcaatctggagccacggtggtggggctggatgcttcccccaaggccctgggcagggcgaaaattaatgtaccccaggcgacctatgttcagggtttggccgaggatttaccctttggggaaggggaattcgacctagtgcacaccagcgtcgccctgcacgaaatgactccggcacaactacagagcattatcagcggcgtacaccgtgtgctcaaaccaggaggaatttttgccttagtggatttacatcgccccagtaattggctattttggccgcccttggcaatttttatgggcctgtttgaaacggaaaccgcctggcagttaattaacaccgatttagggtcattactggaccaagctggtttcacagttgttcgtaagcatctctatgcggggggcagtttacaggtaatccaggccagagcaaataagactgttaactaa

SEQ ID NO: 26514 - DNA, 1164 bp, Synechocystis sp.
atgggtcgtgttggggtcttactgctaaatcttggcggaccggagaagttagaggatgtacgccccttcctttttaacctgtttgcggatccggaaatcattcgtctcccttttccttggttgcaaaaacccctggcatggctgatttctaccctacgggcgaaaaaatcccaggccaactacgccgaaatcggtggtggttcccccctgttgcagattaccgaagcccaagcctccgccctcacgacccgtctggaacgccttggccaggatgcaaaagtgtacattggcatgcgctactggcacccctttacggaggaagccgtcgaaaaaattaaaggcgatcgcctgcaacggctggtgattttgcctctatatccccatttttccattagcactagcggctccagtttccgggtgttggaggaaatgtggcataacgaccccagtttgcggcaattggactatagcctgatcccctcttggtacgaccatccgggctatctccaggccatggcggatttgattgctcaagaattaaagaaattccccaatccagaccaagcccatattttcttcagtgcccacggtgtgccccaaagctatgtggatgaagcgggagacccctaccaggcagaaattgaagcctgtacccgtttgataatgcggactctcgatcgtccgaaccaatacacgttggcctaccaaagtcgggtggggccagtggaatggctcaagccctacacggaagaagctctgcaaaaactgggggcggagggcattgacgatctattggtggtgcccattagctttgtgtcagaacatattgaaaccctccaggaaattgacatcgagtatcgggaaattgccgaagaagccggcattgataattttcagcgggtaccggccctaaacacccatccagttttcatcgacgccttggcccagatggtgatggattccctcaacgatcctccctgcacctttgaaacggtgccccatcccaaaaagaacatgaaaatgtatccccaggaaagatgggaatggggtttgactacggcggcggaagtatggaatggtcgcctcgccatgttgggtttcattgccctgttggtggagttgatcagcggccagggcccgttgcattttgtcggcttgctttag

SEQ ID NO: 26515 - DNA, 738 bp, Synechocystis sp.
atggaaattgtttgcaaaatacaacgacaactaactgatggcgatcgccattggcagaattattatttggatgttgatccccaaaccagcatcctaaattgtttaaatcagatcaaatggcaacaggatggcagcttggccttccgcaagaattgccgtaatgccatctgtggtagctgcgccgtgagggtgaacgatcgcccggtgttggcctgcaaagaaagtattaaaagcttgggccagtggttagccgaaagtaaccaggaaaataccggagttttcaccatcagtcccctggggaatttacccgttattaaagacttggtggtggatatggagaaattttttgccgggttagatgcggtttatccctatttgattaataagcaccaaggggaaaaaggagcagaattttcccaatccccagagcagcgggctgccctcaacgatgtgagcaattgtgttctttgtggagtttgttattccgactgcgacgccaaaaagaaaaacgaaaattttgtcgggccccatgccctagccaaagctaaccgtttgattttagataatcgggatatggccactaaggcccgcctcgaagccctgggcaaagataaacagggggtgtggggatgcaacaactgccgcatgtgtagtgattcttgccccactggggtggctcctctgtcccagattgaagccttaaaaattcgtttatttgacttgatggatcccctttaa

SEQ ID NO: 26516 - DNA, 1479 bp, Synechocystis sp.
atgactaatactttgactagtaccttcgctgaccttggtctttctgaaaaacgttgtcaactcttggccgacattggctttgaggctcccacccaaattcaaactgaagccattcccctgcttttgagcggccgggacatgctggcccaatcccaaaccggcacggggaaaaccgccgcctttgccctacctttgatggaccgcattgacccagagggggacttgcaagccttaattttgacccccacccgggaattggcccagcaggtggcggaagcaatgaaggacttttcccacgagcgccgtctatttattttgaatgtgtacggtggtcaatccatcgagcggcaaattcgcagcctagaacggggtgtgcaaattgtggtgggcacccctggacgggtgattgacctaattgaccgcaaaaaacttaaattagaaaccatccaatgggtggtgctggatgaagcggacgaaatgctgagcatgggcttcattgacgatgtgaaaaccattctgcgtaaaactccccccaccaggcagaccgcttgtttttctgccaccatgccccgggaaatcaaagaattggtcaaccaatttttaaatgatcccgccctggtgaccgttaaacagacccaatccacccccacccgcattgagcagcagctttatcacgtgccccgcggttggtctaaggctaaagcgctacaaccgattctggaaatggaagatcccgaatccgccattatttttgttcgtactaaacaaaccgccgcagacctcaccagtcgtttgcaagaagcgggccatagcgtggatgagtaccacggcaacctgagccaatcccaacgggagcgtttggtgcaccgtttccgggatggcaaaattaagctggtggtggccacggacatcgccgcccggggtttagatgtgaataacctcagccatgtggtcaactttgatttacccgataacgctgaaacctacattcaccgcattggccgcaccggtcgggctggtaagactggtaaggcgatcgccttggtggaacccattgaccgtcgtttactgcgatccatcgaaaaccgtctgaaacaacaaattgaagtttgtaccattcctaaccgttcgcaggtggaagccaagcggattgaaaaactgcaggaacaactcaaggaagccctgaccggtgagcggatggcctccttccttcctttagtgcgggaattgagcgatgagtacgatgcccaggcgatcgccgctgctgctttacagatgatctatgaccagagctgtccccattggatgaaatccgattgggaagtgccggaagttgatttcaacaagcccgttctccgtcgtggccgcaatgctggcggtggccagaacaaaagtgggggtggttaccaaggtaaaccgggcaaaccccgtcgctccagcggtggccgtcgtcctgcctatagtgatcgccaacagtaa

SEQ ID NO: 26517 - DNA, 1056 bp, Synechocystis sp.
atggggaatgaaaaagctagagtcggtatcattggcgcgtcgggctatggcggcattcagctagtacgtttattgttggaacatccccaggtggaattgacctacctagcggggcacagcagtgcaggcaagccctacagtgatctttatccccatttaacccaccgggtaaacctcaccatcgaacccattgacctagaggcgatcgccagccgttgtgatgcggtgttccttggtctgcccaatggtttagcctgtgacatggccccggcattattggccaaaggttgtaaagttttagatctgtcggcggactatcgtttccgcaatcttaacacctacacggaatggtacaaaaaggatcgtcaggaccaagccaccaataaccaagctgtttacggcctgccggaattgtaccgggatgctattagggatgcccaactaattggttgccccggctgttatcccaccgccagtttactagccctttccccgttgctgaaacagggtttcattgtgcccgaaactgccattattgacgctaagtccggtacttccgggggaggtagagaggcaaaagttaacatgctcctagcagaagcagaaggatctttgggggcctacggagtagctaaacaccgccatacccctgaaattgaacagattgccagtgatttggccggtacggagctaagggtacagttcacgcctcacttgatccccatggtgcgcggtatcctagccaccgtttatgccaccctgcgggatccgggtttggtgcgggatgatctgatcaccatttacagtgctttttaccgggcttccccctttgtgaaaattctgccccacggggtttacccccaaacgaaatgggcttgggggacgaatctttgctacattggcatcgaagtggacccccgcactgggcgggtaattgtcctttccgccattgataatctggtcaaaggccaggcagggcaggcagtgcaatgcttaaacctcatgatgggttgggaagaatccttaggcttgccccaactggctttttatccctag

SEQ ID NO: 26518 - DNA, 1629 bp, Synechocystis sp.
atgatcaccaccgatgttgtcattattggggcggggcacaatggcttagtctgtgcagcctatttgctccaacggggcttgggggtgacgttactagaaaagcgggaagtaccagggggggcggccaccacagaagctctcatgccggagctatccccccagtttcgctttaaccgctgtgccattgaccacgaatttatctttctggggccggtgttgcaggagctaaatttagcccagtatggtttggaatatttattttgtgaccccagtgttttttgtccggggctggatggccaagcttttatgagctaccgttccctagaaaaaacctgtgcccacattgccacctatagcccccgagatgcggaaaaatatcggcaatttgtcaattattggacggatttgctcaacgctgtccagcctgcttttaatgctccgccccaggctttactagatttagccctgaactatggttgggaaaacttaaaatccgtgctggcgatcgccgggtcgaaaaccaaggcgttggattttatccgcactatgatcggctccccggaagatgtgctcaatgaatggttcgacagcgaacgggttaaagctcctttagctagactatgttcggaaattggcgctcccccatcccaaaagggtagtagctccggcatgatgatggtggccatgcggcatttggagggaattgccagaccaaaaggaggcactggagccctcacagaagccttggtgaagttagtgcaagcccaagggggaaaaatcctcactgaccaaaccgtcaaacgggtattggtggaaaacaaccaggcgatcggggtggaggtagctaacggagaacagtaccgggccaaaaaaggcgtgatttctaacatcgatgcccgccgtttatttttgcaattggtggaaccgggggccctagccaaggtgaatcaaaacctaggggaacgactggaacggcgcactgtgaacaataacgaagccattttaaaaatcgattgtgccctctccggtttaccccacttcactgccatggccgggccggaggatctaacgggaactattttgattgccgactcggtacgccatgtcgaggaagcccacgccctcattgccttggggcaaattcccgatgctaatccgtctttatatttggatattcccactgtattggaccccaccatggccccccctgggcagcacaccctctggatcgaattttttgccccctaccgcatcgccgggttggaagggacagggttaatgggcacaggttggaccgatgagttaaaggaaaaagtggcggatcgggtgattgataaattaacggactatgcccctaacctaaaatctctgatcattggtcgccgagtggaaagtcccgccgaactggcccaacggctgggaagttacaacggcaatgtctatcatctggatatgagtttggaccaaatgatgttcctccggcctctaccggaaattgccaactaccaaacccccatcaaaaatctttacttaacaggggcgggtacccatcccggtggctccatatcaggtatgcccggtagaaattgcgctcgggtctttttaaaacaacaacgtcgtttttggtaa

SEQ ID NO: 26519 - DNA, 1020 bp, Synechocystis sp.
atggaattcgactatcttcatttatacgttgacgattatcagtcagctcatcgttgttatcaacgtcaatggggtttcacttgcgtaaataaaattattactgaccaaggaattactggcatctaccaacaggggcaaatacttctgctaatttcggcatcggaatctagtttgagtagatatgccgactatctccagaaacatccccccggcgtaggtgaagtcgcttggcaggtggccaattggcaaaaaattcagcatcaattatcagaattacagatagaaaccacaccagttattcatcctctgactaaagcagaaggattaacttttttgctctggggagatgtgcaccatagcatttatcctgttcgttctgagctaaatcagaataaaacattgcatggtgttggtttaacgaccatcgaccatgtggtgctaaacattgccgccgatcaatttacccaggcttcccaatggtatcaacaggtgtttggctggtcggtgcagcagagttttactgtcaatacgccccattctggtctgtatagcgaagccctggccagtgccaatgggaaagtccaatttaacctcaattgtcccaccaataacagttcccaaattcaaacttttttagccaataaccatggggctggtattcaacatgtcgctttttccactacgagtattacgcgaactgtggctcatctgcgggaaaggggcgtaaattttttaaaaatccccactggctattatcaacagcaaagaaacagtagctattttaattatgcaagtttggattgggataccttacagtgcctagaaattttgctggatgatcaagataatacgggggagcgattactgctacaaatttttagtcagccttgctatggagtaggcactctattttgggaaattattgaacgccgccaccgggcaaaaggatttggtcaaggaaactttcaagctctctatgaagcggtggagactttagaaaaacagttagaagtgccataa

SEQ ID NO: 26520 - DNA, 1371 bp, Synechocystis sp.
atgaatactgctaaaactgttgttgctgagcaaagggacttttttcgtcagggcaaaactaaatcagtccaagatagattaacagctctagcaaaattaaaaacgcaaattcaagcccaggaagaggaaattattaaggcccttaagcaagattttggtaagcccacctttgaaagctatgtaaacgaaattttgggggtaattagggaaattaattattatcaaaaacatcttcagcaatggtctaagccccaacgggtaggtacgaatctgatggtttttcctgccagtgcccagttaagaccagaaccccttggtgtagtgctaattattagcccctggaattatcctttttatctttgtttaatgcccttgatcggggcgatcgccgctggaaattgtgtggtggtaaagccgtcggaatatactccagctattagtggggtaattaccagattaatccaaaatgtattttccccggcttgggcaacagtggtggagggagatgaaaccattagccaacaattgttacaggaaaaatttgaccatattttctttaccggcagccctagggtgggtcggttaattatggcagctgcggcagagcaattaaccccagttacgttggaattggggggtaaatctccctgtgtggtggatagggaaatcaacctccaggaaacagccaaacgcattatgtggggcaagctagtcaatgctggccaaacctgtgtggcaccggattatttattggtggagcaatcctgcttagaacaacttttaccagctttacaacaggcaattcagatgcttttcggggaaaatccagcccatagccctgactacactcgcattgttaaccaacaacaatggtcacggttagttagtttattaagccatggcaaagtaattacaaggggagatcataacgaaggcgatcgctacattgccccaactttaatcatcgatccagatttaaattctcccttaatgcaagaggaaatatttggcccaattttgccaattttaacttatcagagtttgtcagaagcaatagattttattaacatcaaacctaaaccattggcactttatttttttagcaataatcggcaaaaacaggaggaaattttgcaatctaccagttccggtagtgtttgtttgaacgatattttgcttcatttaactgtgacagacttaccctttggtggggtgggagaaagtggtatgggacgctaccatggcaaggctacttttgacacattgagcaattataaaagcattttacgacgacccttttggggggaaactaatttacgctattctccctatggcaaaaaaatgaatttaatcaaaaagttgttctcctag

SEQ ID NO: 26521 - DNA, 999 bp, Synechocystis sp.
atggcatcaacagatttcaaagactattaccaaattttgggagtgaccaaaaccgcttcagaagctgaaatcaaaaagcagtttcgtaaattagcactgaaatatcatcctgacaaaaatcctggggataaggcggcggaggaaaaatttaaggaaattagcgaagcctatgaggtgctttctgaccccgaaaaacgccagaaatatgaccaatttggccgctattggcaacaggctggcacggcaggacaacccagtggcagctacggccctggagtcggcgtggattttggtggctttgactttagccagtacggcaattttgacgaatttattaatgaactgttgggacgcttcaatacccccggtggcggcggtcagagaacttcctacagctattccaccggcggccctggctttaatgactttggtggttttggcaatgcccaggcccccgcaggcgatcgggaagcaaccctacagttaactttggcggaagcttttcggggagtggaaaaacgtctcaacttaggggaagaaatggtcactgtgcggattcccgccggagcgaaaaatggcagtcgagtacgggtgaggggcaaaggtatggccagtccttacggtcaaaggggggatttgtatctcaacttgcaactgaccccccatccatttttccaatttgaaggggataacctggtctgtgaattggcgatcgccccggacgaagcggtgttgggggccgatattagtgtaccgacccccgatggcatggtgcgaatgaaagtcccggcaggagtcaaatccggccaatccctgcggttaaaagggaaaggttggccgaaccctaaacagggccgtggtgaccagttagtacgcctaatcatcactgctccgaaaaatcccagcgccattgaacgggaatgctatgaaaaaattcaggcgcaacggacagaaaatccccgccaagcggtggaaaaatacgccaatttgttggcatag

SEQ ID NO: 26522 - DNA, 633 bp, Synechocystis sp.
atgccggagtcatccaccccttccctgctgatccccaactttcccccccgggcggcggcggtacatcgagttaccaaagaaactgatgtgcgggtgagtttgaatttgatgggcagtggtttgtgccatgtggctacgggggtgccttttttggatcatatgttgcaccagattgcctcccacggcttgattgacctggaagtgaacgccaccggagatattgaaattgacgaccaccacactaacgaggatgtgggcattacccttggtcaagccttagctgaagcccttggcgatcgccggggcattaatcgttttggtcatttcattgctcccttggatgaagctttggtgcaggtgaccttagacttttccgggcggccccacctcagctatggcctacaaattcccacggaacgggtgggtacctacgacacccaattggttcgggaattttttgtggccgtggtgaaccacagtcaaatgaccctccacatccgccagcttgacggcattaattcccatcacattatcgaagcgacctttaaagcctttgctcgggccatgcgtatggcgatcgaggttgacccccgtcgggctgataccattcccagttccaaaggggttttatag

SEQ ID NO: 26523 - DNA, 738 bp, Synechocystis sp.
atggcaatgcttctttcctccccctccagtgacctagtcaccatgacaccagcggaaccagtggtggccatggaaaatctcagtcatttctacggcactggcaatctccgcaaacaaattttatttgatatcaatctccgattggacgaaggggaggtggtgatcctcaaggggccttccggttcgggaaaaacaacattgttgaccctgatgggggggttacggtcggcccagagcggtagtttgcgggtgtttggtcaagagttaaatggagcaaaaaaacaggatttggttcaggtccgccgtcacattggctatattttccaagcccacaatttgctcgaatccctcactgctaggcaaaatgtacagatggccatcgaactacacccccaatacaatgctcaacaggcgaaagagttgtccattgccatgctggaggcggtgggactaggagctcacattaactacaatccccacaatctttccggtggacaaaaacaacgggtggcgatcgccagggcattagtaagtcatcccaaaatgattttggccgatgaaccaacggcggccttggacagtaaatcgggccatgacgtggtggagttgatgcgaaaattagcccgagagcaggggtctactattttgattgtcacccatgacaaccgcattttggacgtggcagacaggattattcaactcgaagatgggcaactttgtgccgacccaggggagtga

SEQ ID NO: 26524 - DNA, 969 bp, Synechocystis sp.
atggaacaaccgatgaaacccacggtgatcatcaccggagcctcctccggggtgggattatacggagctaaagctttaattgacaaaggttggcacgtgattatggcctgccgcaatttggataaaacccagaaagtagccgatgaattgggttttcccaaggattcctacaccatcatcaaattggatttgggctatctggacagtgtgcgccgctttgtcgcccagtttcgggaattgggtcgtcccctcaaagctctggtttgtaatgcggcggtttattttcctttgctggacgaacccctctggtcagcggatgactatgaactttctgtggcgaccaaccacctggggcactttttgctttgcaatctgttgttggaagatttaaaagcctgtcccgatgcagataagcgtttaatcattttgggcactgttacggccaacagcaaagaactagggggtaaaattcccatccccgccccgccggatttgggcaactttgaagggtttgaagcgggctttaagaaacccattgccatgattaataacaaaaaattcaaatcgggcaaagcgtataaagatagtaagctctgcaatatgctcaccaccagggagttgcaccgtcgcttccaccaagaaacgggcatcgtttttaattctctctatccgggctgtgtagccgatactcccctattccgcaatcactattccttgttccgcaccatttttccctggttccagaaaaacgttaccaaaggctatgtcagccaagaattggcaggggaacgggtggccatggtggtggccgatgacaaatttaaggattctggggtgcattggagctggggcaaccgtcaacaagcgggccgggaagcctttgtgcaggaactttcggaacagggaagcgatgcccaaaaagctcagcgcatgtgggatctaagcgaaaagttagtgggtctggtttag

SEQ ID NO: 26525 - DNA, 1002 bp, Synechocystis sp.
gtgtctgccgtgagccgtatcgctactttaacacgtcaatcgatgctgtctgccttatctgacaacaatcgcttacgtcttttttccggatcatccaacccatctttatcccaagaagtggcccgttatttgggcatggacatcggccccatgttgcggaaacggtttgccgatggagaactctacattcaaatccaggaatccattcggggcggtgacgtttatctgatccaaccctgctgccatccggttaacgataacttgatggaattgctgatcatgatcgatgcctgccgtcgtgcttcagcccgccagattaccgccgtgttgccctattacggttatgcgagggcagatcgtaaaaccgctggtcgggaatccatctcggccaagttagttgctaatctcatcaccggtgccggggcccaacgggttttagctatggacctccactctgcccagatccagggttattttgacattccctgcgaccacatgtacggttcccccgttattatcgactacctaaaaagtaagcaactaactgacttagtggtggtttcccccgacgtgggaggggtagcccgggctcgggcctttgccaaaaagttaaacgatgcccccctggccattattgataaacgtcgtcagagccataacgttgcagaagtattaaatctcataggtgacgtggacggaaaaaccgccgtgctagtggatgacatgatcgacaccgctggtactttgtcggaaggctcccgtttgctccgggcccagggcgctcgtcaggtctatgcctgtgccacccatgctgttttctcggagccggccatcaatcgcctttctggtggcttgtttgaagaggtgattgttaccaataccattcccgtgcctgacgatcatcattttccccaactgactattctttccgtggctaatttaattggggaagcgatttggcgcatccacgaggaaagctccgtcagcagtatgttccgctag

SEQ ID NO: 26526 - DNA, 1743 bp, Synechocystis sp.
atggccgcccccagcgtcaagcagttacttcgttatttaactccccattggcgggcgatcggagctggaacctttgcgctatttttggccaatgccctgggggtttacattcccattttgatgcgggatagtattgacgatttaatgcccccctttgaggcatcggacgtagctcgcattgtggtgctaattgttgttctcgcttccctaatgtggtttatccgcatggcctcccgcattctaatttttggggtgggaagacaggtggaatacgagctcaaacagaaaatttttgaccatctgctcaagttagagcccctctatttcaccgaaaataccattggggatttgattaaccgggccaccagcgatgtggataatattcgtcgcttggtgggttttgcggtgttgagtttgatcaacactgtttttgcctatgccctgactatcccggccatgtttgccctccacattcccctcaccttgttggcggtttctgtttatccgctgatgctgatgagtgtcaatcttttcagcggtaagttgcgagattatcaattggaggtgcaggaagagttgtctgccctgagcgaactggtgcaagaggatatgagcggcattagtttaatcaaaatttattcccaggaagataacgaacgacaggcttttcagacgagaaaccaaaaattgctccaggcaaacctgaagctggcccgcattagaaattttctttttcccctcattgagggtctggcttacctcagtttgctcattttgctggcctttggcactggcttaattcaagatggcagtatcaccattggggacttcattgccctgatcattttggtggaacggttggtatttcccactgccctacttggttttaccatcaccgcctaccaacggggagaagtgagcattcaacgggtggaagctattttccataccactccgaaaattttaacggtgccccaacctctgccctttagtccggctcaggccaccggaaaaatcaccgcccgcggcctgaactattgctaccctggtagcgacctgccagcgttggagcaagtggactttactgtttatcctggagaaatggtggccattgtggggcctatcggttccggtaaatctacgttggttaatgttttaccccgtttgttggatattgcccctggtcaggtgttcattgatgactacgacatcacccaaattgccctcagcgatttacgctcggcgatcgcctttgtgccccaggaaagttttttgttcagcaccaccattgccgaaaacattgcttacagtgatcctagtcaaactgacacggcgatcgagcaggcggcccaccaggcccatttagaccaggaaattgctaactttccccaacattaccaaaccctagtgggggaaagaggcatcaccctgtccggtggccaaagacagcgggctgccctagccagagctttaattcttgatgctcccctgttggtgctagacgatgccctttccagcgtggataaccagaccgccacccgcattttgcattacctggcccgccgcaataacacggtactctttgtttcccatcaactttccgccgctgcccaagcggaccgcatttttgtcatggaccatggccgcattgtccaaacgggcagccatgaagaactactgcaacagtcaggactttatcaatccctgtggcaacaaaatgagttagaaaaggttttaagttga

SEQ ID NO: 26527 - DNA, 1452 bp, Synechocystis sp.
gtgccagccctgattaacccggtgaagtttatgagacccctaagtcatcgcaccaaaattgtggccaccattggccccgccagtagttcggtagaggtgatacgtcagatggtggatgcgggcatgaatgtggcccggctgaatttttcccacggtagttatgaggaccatgccaccatggttcgcctactacggtcagtggagcaggaaatggacacccccattacccttttgcaagatttacaggggcccaaaattcggattggtcagttgccggggggagaaaagcaactgcgggaaggggaaaaagtttctttggtgccggtggaaattggcgatcgccatcctggagcggtgggcattgactatccccatttggcgacggaggcaaaagtaggggaaagaattttattggacgatggtttactggaaatgaaagttgtgtccattcaagatccagaggtaatttgtgaagtggtgaccgggggcatcctcaaaagtcgcaaaggggtcaatctaccgggtttagtcctaaccctaccttccatgacgaccaaagacaagcaagacttagaatttggtttgagccaaggcattgactgggtttcccttagttttgtccgcaaaggggaagatatccacacccttaaacaatttctcgctgaacggggccatcctgatctgccggtcattgccaaaattgaaaaaccccaggcgatcgataatctagaagaaatcgtggcagtttccaacggcattatggtggccaggggggatctgggggtggaagtaaacccagaaaaggttccccgtttgcaaaaggaaattattcggcgctgtaacgtgcgggccattccggtcatcaccgctacccaaatgctagatagcatgattcaaaattcccgacccaccagggcggaagccagtgacgtggccaacgctattttggacggcaccgatgcggtgatgttatcgggggaatcggcagtgggacaatatcccgttaaatcagtgcaaatgttgcgaaaaattgccgaagagacggaagtgggtctacatcttgttaataatcccccaatagaaaatacggaaacccatgccctaagtgaagcgttagtggtaattgacggaattctagatttaaaatacattgtcacgttcaccacctcaggttttacttctctcctcgcttccaaccaaagaccgtcggtgccggtgattgctttcactccctcagaaaaggtttaccatagcctcaacttagtttggggtattattccctttttaattaacgaagaatttgacacctttgaggatttaatccaacaggcggaggtactactgcgggatagaaaaatggtggaaaagggcgatcagttgctaatcatggcgggaattcccactaaaatacccaggggcactaatttcctcaagattcaccgtatttcttaa

SEQ ID NO: 26528 - DNA, 1521 bp, Synechocystis sp.
atggttaaaaatcaaggggcttggctatctcggggactgtggagcgtactgatttggggcgctatggcaacggtctgccgagcagaaactattccctttaccctgctccagcttaacgatgtgtatgaaattgcccccattgataacggccgttggggcggtttggcccgggtggctaatttacgccaacagctagaacaagctgatccccacacctacaccgtgttagcaggggatttcctcagtccttctgccttgggcacagccctttacaatggcgatcgcctggcggggaaacaaatggtggcggtgttgaatgccatggggttagactatgcagcggtgggaaaccatgaattcgatgttaatgcccaacaatttcagcaacggattacggagtcagattttcagtggttatcggccaatattgctgatggtaccggcaatcagtttgagggcatcaaaccctacgaaattttaactattcctggaacggaagggggagaattaaaagtgggcattttggccctgaccattgacagcaatgcggtggactatgtcacctacagcgatcccatcgccacggcccgccgctacatagacaatccccaaggggaagtggatgtttgggtggccctgacccacctgtccctggcccaggatttggccttggcccaagctattcccgaattagatctgattttggggggccatgaacacgaaaatatccagcgcaaccatttaattatcaagcccgacagttctgcaagttgtccccaggccaaaacgccaatttttaaggccgatgccaatgcccgcacggtttacattcaccaattaacctacgacacgaaccggcaatgtttacaaattaattcccaactgcaacccatcactgcggcgatcgccagtgatccggccaccgaaaaagtggttcagcaatggcaggaaattggctttaatgcgtttcgtcaacagggatttgaaccaatggccgttgtggtcaactctcccatcgccttagatgccctcgatgcccatgtacgcagtggctccaccaatctcacccggttaattaccagggccatggagcaggaaaaccccgatgtggccatggtgatgtttaacggtggcatggtgcgccttgatgatctcctcagtgccggagccatcactcaatacgatattattcgcctcctaccttttgggggtcgggtagtgacagtggagatacaaggggatttgttacaaaaagttctggcccagggagaaaaaaatagtggtaccggtggttatctccagctagggggcatggctcccaacagtattgagccaagcaaaacttaccgggtggcgttaatggaatatttgttaagcggtcaggaggtgggcttggattacctgacgacaaatacccctgggttgaaggtgattaactatggccgggatattcgctcgattttggtggattatctacaaaacaatgcccagcaagcttttaccgatttgggggagttgtga

SEQ ID NO: 26529 - DNA, 735 bp, Synechocystis sp.
atgttaaatatagaaaataaagtaattgtcatcactggagccagtagcggtattggtgaagccaccgcgaaactgctcgcccaaaatggtgcaaaagttgttttggggggacggcggatagacaagctagagaagctaattaaacagattcatgcatctggtgggacagcagaatttaaaacggttgatgtcaccgatcgccacgatgtaaaagcatttgttgagttcgccaacgacaaatttggccgtgtcgatgtcatctttaacaatgctggcgtgatgcccctgtcgccgatgaatgccctgaaagtcgaggaatgggacaacatgattaatgtgaatattcgtggcgtgcttaatggcattgcagcgggcttgccaattatggaagcgcaagggggcgggcaaatcatcaatactgcctccattggtgcccatgtggtagtgcccactgcagcagtttactgtgcaaccaagtatgcggtttgggcaatttctgaaggactgcggcaggaatcacaaaacatccgcgtcaccaccatctctccgggagtcgttgccactgaacttggctctgatatcaccgatgagtcatccaaaggcttgttagaagaacttcgcaaaaccgcccttacctcagaggcgatcgccagagccgttttatacgctgtttcccagccggacgatgttgacgtcaatgaaatcatagtccgaccgacggccagtacgttttga

SEQ ID NO: 26530 - DNA, 2166 bp, Synechocystis sp.
atgacccaatcttcaccgctcaaaactcagcaaatgcaagtcggcggcatggactgcactagttgcaagttaaaaattgaaggtagcttggaaagattgaagggagtagcagaggcctctgtcacggtggccacgggacgattaactgttacctatgatcccaagcaggtcagtgaaataaccattcaagaacggatcgccgccctgggttacacccttgcagagccaaaatcatctgtaacgcttaatggtcataaacatccccactcccatagggaagaaggccatagccatagtcatggtgctggtgaatttaatctgaaacaagaactactgcccgtcctgacggcgatcgccctctttaccattgctattttgttcgagcaaccgttacacaacacgccaggtcagattgctgaatttgcagtgattattcctgcctatctcttgagtggttggacagtgctcaaaacagcgggacgcaatattctcagagggcagatttttgatgaaaactttttaatgacgatcgccaccttgggggccttggcaattcatcaactccccgaagccgtggccgtgatgttgttctttcgagtgggagagctatttcaagaatactccgttgggcgatcgcgccgttccatcaaagctttactggaagcacgtcccgataccgcgaacttgaagcgcaatggtacagtgcaacaagtttcccccgaaacggtacaggttgatgacttaattttggtaaagccgggtgaaaaagtgcccctggatggcgagattttagggggaacttcacaggtagatacttcagcactgactggcgaatcggtgcccggcacagttaagcctggagataccattcttgcaggcatgatcaaccaatcgggtgtgttgacaattcgagtcaccaaactatttagtgaatcttcgatcgccaaagtgctcgatctggttgaaaatgcgtctagcaaaaaggcatccaccgagaaattcatcacccaatttgcccgctactacactcccgttatcgtctttctttcgttagccgttgccctgttaccacctctgttcatccctggggcggatcgagccgattgggtttatcgtgccttggttctgttggtgatttcctgtccctgtggattggtgatcagcattccgctcggctattttggtggcattgggggagccgccaaacatgggattttgatcaagggatctacctttttagactccctcacggccgttaaaaccgttgtgtttgataaaactggaaccttaaccaaaggcacatttaaggttactcaggtcgttaccaaaaatggattttctgaatcagaattgttaaccctagccgcaaaagccgaatcccattccactcatcccattgccctatcgatccgcgaagcttatgcccagtcgatcgctgactctgaagtggccgactacgaagaaattgctgggcatggcattcgagccgttgtgcaaaatcaagtcgtcattgcgggcaatgatcgccttttgcatcgagaaaaaatcgatcatgatacctgtgacgtagccggtacagtggttcatctcgccgtagatgggcgctatgggggctatattctgattgccgacgaaattaaggaagatgcggttcaagcgattcgagacctaaaacgcatgggagttgaaaagaccgtgatgctgaccggggatagtgaaatagtagctcaatccgttgcccagcaaattggtttagatgcctttgttgctgaattattgccagaagaaaaagtcgatgaaattgagcaactgctagatccttcaggtaaagcaaaactggcatttgtaggagatggtattaatgatgcccccgtgattgcccgagccgatgtcggtatagccatggggggattgggctccgatgctgccattgaaacagcggacgtggtgttgatgaccgatgcgccctcgaaggtggccgaagcgattcatgtggcccgcaaaactcgtcaaattgttgtacagaacattgtcctagccctagggattaaagcactttttatcgccctgggcaccattggcttggcaaccctctgggaggcggtgtttgcggatgtgggagtagcactgttagcgattttgaatgctactcggattgctaagtaa

SEQ ID NO: 26531 - DNA, 2373 bp, Synechocystis sp.
atggtcatgaatcaaaataatagaccatacattattgtcactaatcaaggtcaaagcttacccccttttgaattaactaaaagtaaacatattttaggtcgagattcccaatttgccgacctgatagtccccactgattggagcattattagtcgttgtcaagctactttagtagaagatcaaggtaattactttatttatgacggcgatcgcctcaatcccagcagtaacaagctatttattaatcatcatttaatcacccatgatattggctacccattacagaatggagatgttattaagattggacaaaatattaatattcttattactattaaatattttactcccaatggctctagccctaccaatttaacatcgctattatccatcaatttaaagcaaaaatctgtggttattgggcgggacgaaactgccaacttacaattactttcctccgcagtttcccgccaacatgctgtcctggattatttagagccaaatacctatcttttacacgattacagcaccaatggtgtttacgttaatggcactaaagtcaacggtaaaattctgattaacaccgccgccatcatcaaaatagttccctacaccctggtattacaaaacgatcaattattcattgccgacaccggggataatattcgccttgatgcccgcaatatcgtccgcactgttcaaggtaatcagagcgaagaaattacactccttaaccaaatttctttgcccattgaaccaggtcaattggtagctttagtggggggaagtggcgcaggcaaatcgacttttatgcggactttattaggtattgaacctactacgtctggcacagtttatttgaacggtgaagatctgagaaataattttaacctttaccgtaatcaaattggttacgtgccccaaaaagatattatccacagttccctaaccgtagaggaagctttgcggtatgcggctaaattaagattaccccaagatgcggatattgacgaaattgttgagaaaaccttgggccaaattgaaatgcaggaacgtcgccatgttctggtcaaaaaattaagcggcggccaactcaaacgggtatccatcggcgtggagttactggtggatccgaaattatttttcctcgatgaaccgacatcgggtttagatcctggtctagataaaaagatgatgcaattattacgaaagctagcggatcagggacgaactattgtgttggtaacccatgccaccggcaacattaacctatgcgatcgcctggtgtttttaggccaggggggcaatttgtgttatttcggcacttttagcgatgcttgccaattttttaacctccataatggtgattttgctgatgtttatattcaattggataatcaatcagcagtgatcaaagccgcccaacgctatagccggtctagctatcaacatcagtacattgatcaacggttgggggtgagtaattccgctgttgccgcccctagacctagtcctcccagggtatctcccctgcgccaaacctggattctgtgccaaagatactggcaaattatggctagggatccggtcaatatcggtatttccattgccaccgcccccattggcattttattaatcgatctggcgatcgccactagggaaccatttattctgggtagtgaagcggatcccaaacttgcgcccctagctcagaccgtactattagtatttagctgtgccgccatctgggttggtctcgccagttctctccaagaaattgtcaaagaaaatgatatttacagccgagaaagattagttaatcttaacctgttcgcctatattgcttctaaggtgacagtattgtcaggattagcgcttttgcaaacccttgctatggtggtgattatcctcattgccttcgaccatccccagcctcccctattgccctggggtttggggctaattatcaccagttatctcacccttttcagttctatttgcttaggcttaatggtatctaccttggtcaaaagtgaaacccaggctaacaccgctctacctattttgctactgccccaaatcatcttctccggcgtactgttccaaattaaaggtgtgagtcaatatctttcttggtttatggtcagccgttggtctatcggtgcctatggcacattattagacatcaacagtctagtgccagagccagtcatttttcccgatggtaccgtattggaatctccttttaaagccaccctagtttacgaccctagttggaataatcttttggtcaactgggaaattttattactccaaggttttgtttgcctcgtagttattttcctgttcaaaaaaagagaggatattatttga

SEQ ID NO: 26532 - DNA, 2838 bp, Synechocystis sp.
atgaaagcttgttgctattttttcatctctatgcctccatctgcttcttttcagggccaacctttgattacctggcatactctttctgcagatcaagtcgtcagtgacttacatggcgatcgccaacaaggattaagccagcaacaggtggctgaaaatttgcaagtttatggaaaaaacgagttgatagaaacgggggggagaacttcctggaacattttagttgatcagtttacaaacattatgttgttgttgctgatcgctgttgcagtgatttcggccgcaattgatatttatcaagcccaacaattgggtaaatttatttttcctaaagatgcagttgctatttttaccgttgtattactgaatggtattttggggtatgtgcaggaacggggagcggaaaaggccctagcagccctcaaagacctatctacgtccagggtgcgagtcattcgagagggcaaaaccaccgaagtggaatccacggagttagtaccgggagacctgattctgctagaagcaggggttaaagttcccgctgacggtcgtattttagaaggggccaatctccaaattcgtgaagccgctttaacgggggaagcagaagcggtaatgaaacagggagatgtgctgttacccgccgatagtgccttgggcgatcgcctaaatttagtttactccggcacagaagttgtccagggccggggcacagtgatcgtgaccgcaacgggcatgaagacagaattaggaaaaattgcctcagccctgcaatctgtagaaccggaacccactcccctccaaaagcgcatgacccaattgggcaatgtgttagtcagtggttctttgatcttggtggcgatcgtcgttgtggggggaacgctcttcaaaccggatttgtttatgcagttggttgaagtatcccttagtatggctgttgctgtggttcccgaaggactacccgctgtaattaccgtcaccttagccttggggacccaacgcatggccaaacgcaatgcgctgattcgtcaactgagtgcggtggaaaccctcggttccgtaacgaccatctgctctgataaaacgggcactttgacccaaaataagatggtggtgcagtctattattagcgatcgccatcgtttagtggttacaggggaaggctataatcccgtcggtgagtttcaagcaggggagggagaagatttaaagattgaaaatatccccgaaattgaaaaattattaatggcatgtattctctgcaacgatgccattttacaaaaggaaaatggacaatgggcgattttaggcgatcccacggaaggggctttattggccttagcgggtaaagcaaatatttttaaacacgaacaggaacaatattttccccggataacagaatttcccttttcctcagaacgcaagcgcatgagtgtcattgtccaagatgggcagggaaaaattaacacccccgacagttatgtgatgtttgtcaaaggttcccctgagttaatcctagaacgctgtacccacattcaagtcggaagcgaaatcttacccattagtaaagaaaagcgtagttatattctcgaaaaaaataatgatttagccggccgtggcctacgggtattgggctttgccagcaaagtttggacaacgttacctgccaacaccactgatgacattgccgaacaagaattaacttggttggggctagtgggaatgttagatgctccccgtccagaagtgcgagatgccgtggctaaatgtcgggccgccgggattcgacccgtgatgattactggagaccaccccctcaccgcccaggcgatcgcccttgatttgggcattgcggaaccaggggcaagggtcgttaccagtcgggatttagacaattgcagtgaaaaagaactagcggaaattgttcatacagtcagtgtttatgccagggtttcccccgaacataaattaaaaatcgtccaaaccctccgcaaacaacatgaagtcgtagccatgaccggggatggagtcaatgatgccccggcgttaaaacaagctgatattggggtcgccatgggcatcacgggaactgatgtcagtaaggaagccagtgacatgattttattggacgataactttgccaccatcgtctcagcggtggaagaaggtcgtgttgtctacactaatatccgccgttttatccgctatatcctgggcagtaatattggcgaagttttaacaattgcggcggctcctttaatggggttgggaggcgttcccctctctcccttgcaaattctttggatgaacctggtcaccgatggagttcccgctttagccctggccgtggaaccaggcaaagcaaccgttatgcaacagtcccccaaagacccccaggaaagcatatttgcccggggtttgggttcttatatggttcgtcaaggtttgatattggccattgtgaccattgtgctgatggtgtgggcctacaactatacccccaaccatttagagggcggactttcccccaatcgctggaaaactatggtatttaccaccctctgcttagcccagatgggtcatgccctcgccattcgttctttgaccagtttgaccgttgaaatgaaccttttttccaatccttttttgctggtggctgtggtcgttacctctttattacaactgttattgatttatgttgaaccgctgcgggcattttttggaacccattatttacctgccaacgaactgtgggtttgtgttggcttcagtgccctaatttttatctggatcgaattagaaaaagtctctgttcgactgtatagtagtttcaaataa

SEQ ID NO: 26533 - DNA, 1287 bp, Synechocystis sp.
atggctggatcactgtttgccgatgccagtaaaagattagaaaaagccctgaaatatgtggccatttccgacgatgccggggaaaggctgaaatatcccaaaaccagtctcagtgtttccattccggtgcggatggacgatggctctttaaaaatctttcccggttaccgagtgcgctacgacgacaccagggggccaggcaaagggggcgtgcgctaccatcccaacgtcaccatggatgaggtgcaatccttagccttttggatgacctttaaatgtgccctgttaaatttgcccttcggaggagctaaggggggcatcaccctcaatcccaaagaactcagccgagcagaattggagcgtttaagtcggggttacatcgaggcgatcgccgattttattggcccggacatcgacattttagccccggatgtttacaccaatgaaatgatgatgggctggatgatggaccaatacagcatcattcgccgcaaaattagtcccgctgtggtcaccggcaaacccgtcaccatggggggcagtcaaggtcgcaacacggccaccggcactggagctttttacatcatgcagggcatgctacccaagtttgaccaatatcccgaaaataccaccgttgctgtccagggtttcggtaatgcgggtatggtggtagccgaatgtttataccaagatggctacaaagtggtggccatcagtgattcccaggggggcatttataacgaacaaggcatcgatattcccgctgtgattgattacaaacaacggcatcgcactttagcgggtatgtactgtgaccaagccatctgcgatttaggggaaaatcaacaaatcagtaatgccgagttactagctctggacgtggacgtgctcattcccgccgccttggaaaatcaaattacccgcgacaatgcagaccaagtcagagctcgctacatttttgaagttgctaatgggcccaccaccaccgccgccgatgatattttggctagcaaaggtatctatgttttccccgatattttggtcaatgctgggggggtgacggtgagctactttgaatgggtacagaaccgcagtggactttattggagcgccaaggaagttaacgatcgcctgaaggaaaaaatggtggaggaagcggaacatgtgtggaacattacccaggaattggatgtgaatgtgcgcactgcagcctatatccacgcccttaaccgcctgagcgaagctatggatgctaaggggactagggattattaccaggacagctag

SEQ ID NO: 26534 - DNA, 1155 bp, Synechocystis sp.
atgggcacaaaacgtattggaattttgaccagtggtggtgattgtcctggcctcaatgccgtcatccgagcagtggttaaggcctcagctcttaaggggtgggaggtttatggtattccctacggcaccgatggttttgttgaagttgcccacggaaaataccaggcagaggatttactgttaactaaacatggctatgctctgcccgggatgctcaaaggcttagatgtattgcaatttctcagcggtagtgttttagggtccttaagtaagggacatccagagcaaccggcgatcgccgaagccattctcaagggttatgccatacttgacctggaagcactaattgttattggtggcgatggtagtttagacattatttatgatttagcccaaaaaggtaattggcatattattgccattcccaaaaccattgacaatgatgtgccctttacggatctggcagtgggatttagcactgcggtggatattgttacccaagccttatacgacctgacttttaccgccgctagccatgaacgcattatcattgtccaggtcatggggcgggatgcggggcatttgactctccatgcaggcattgccggcggagctgatatcattttaattcccgaaattaccccttgtttgacttctgaaattatccgcaattgttgttatcaactaatgaatttgcggaagtctggccgccattttgctttaatagttatttcagagggtgtccacgatcaaaataataagaaaaataaacatatcgccgactacttagcagaagaaatcagtgaaaccagtcaacacctttgcgacattaaagatcccgctttttgcgatctaataagtctagacattcgagccacaaccctgggtcatttacaacggagcgggacccccctatcgttcgatcgcctcttggccacggtgtttggaattagggcagtggagttgatcgaacaggaaatttatgaccaggtggtgatctggcgcagtgggaaggtggaacacgctgaccttaaaccaattatcagcatcattaaagaatgtcaccaggaaaatcgctgtcctttcccggtggatagggatggttttatggttaaaacggccaagtcattgggcatatacctaggagaagactaa

SEQ ID NO: 26535 - DNA, 2163 bp, Synechocystis sp.
atgagctattcatcaaaatacattttactaattagtgtccatggtttaattcggggagaaaaccttgagttgggcagagatgccgacaccggcgggcaaaccaaatatgtgctggaactggcccgggccttggtaaaaaatccccaggtggccagggtggatttgctgacccgtttaattaaagatcccaaagtagatgcagattatgcccagcctagagaacttattggcgatcgggcccagattgttcgcattgagtgcggcccggaggaatatattgccaaggaaatgctctgggactatttggataattttgctgaccatgccctggactatctcaaagaacagcccgaactgcccgatgtcatccatagccattacgccgatgcgggttacgtgggcaccagactttctcaccaattgggtattcctttggtgcacaccggacattccctgggtcgtagtaagcgcacccgtctcctgctcagtgggattaaagccgacgaaattgaaagccgttacaatatggcccgccggattaacgcggaggaagaaaccctaggatcagcggcgagggtgattaccagtacccatcaggaaatcgcagaacagtacgcccaatacgactattaccagccagaccagatgttggttattccccccggcactgatttagaaaagttttatccccccaaagggaacgagtgggaaacgcccattgttcaagagttgcaacgatttctacggcatccccgtaagcctattatcctcgctttgtcccgaccggatccccgcaaaaatatccataaattaattgcagcctatggccagtccccgcagttacaggcccaggccaatttggtcattgtggcgggcaatcgggatgacatcacggatctagaccaggggccgagggaagtactgacggatttactgttgaccattgaccgttacgatctctacggcaaagtggcttaccccaaacagaatcaggcggaggatgtgtatgctttgtttcgcctcactgctttatcccagggagtatttatcaatccggctttgacggaaccctttggtttaactttgattgaagcggcggcctgtggtgtgcccattgtggccacggaggatgggggcccggtggatattatcaaaaattgtcagaatggctatctaattaatcccctcgatgaagtggatattgcggataaattgctcaaagtactaaacgacaaacaacaatggcaattcctttctgaaagtggtctagagggagttaagcgccattattcttggccttcccacgttgaaagttatttagaagccatcaacgctctgacccaacagacttcagtgctgaaacgtagtgatttaaagcggcggcggactttgtactataacggtgccctggttactagtttggaccaaaatttactgggggcattacaggggggattaccgggcgatcgccagacgttggacgaattactggaagtgctgtatcaacatcgaaaaaatgtcggcttttgcattgccactgggagaagattggattcggtgctgaaaattttgcgggagtatcgcattccccaaccggatatgttgatcaccagcatgggcacggaaatttattcttccccggatttgatccccgaccagagttggcgcaatcacattgattatttgtggaaccgtaacgccattgtgcgtattttgggggaattacccggtttagccctccaacccaaggaagaactgagcgcctataaaattagctatttctacgatgcggcgatcgcccctaacctagaagaaattcggcaactgttgcataaaggggaacaaaccgtaaataccatcatttcctttggtcaatttttggatattctgcccatccgagcttccaaaggctatgctgtgcgttggttgagccaacagtggaatattcccctggagcacgttttcaccgccggaggatcgggagccgacgaagatatgatgcggggtaacaccctttccgtcgtcgtggctaaccgtcaccatgaggaactttctaatctaggggagatcgaaccgatttatttttccgaaaaacgttacgccgccggtattctggacggtctggcccattaccgcttctttgagttgttagaccccgtttaa

SEQ ID NO: 26536 - DNA, 1170 bp, Synechocystis sp.
atggtaatggaaacagcctttagccgtatggatttggttcagtctccggttattcccgtggttggacagtggattgtcgattcccccggtacgatttccctgggccaaggggtggctttttatcctccccctaacgaggtggccgtggcggtgcgggaaagtctggagcaaactcctctgcatcagtatcagccagtggcgggcataccaagcctaatttctgctttaacggaaaagttgcgacgggataacgatattaacctgtcttccgaccaagctgtggtagtaacggctggggccaatatgggttttttaaatgcagtgctagccattacggaggtgggagatgaaatcattctcaatacgccgtactacttcaaccatgaaatggcggtcagaattgcggggtgtcagccggtgttggtgcccactgatgatcaatatcaactccaactggacctcattgcccaggcgatcgccccccggactagggcggtggtgaccatttcgcctaataatcccaccggggccatttatccagaggcagatttgcgggcggtgaaccaactgtgccaggagcggggtatctaccacatccacgacgaggcctacgattattttgcctacgaccagactccgattttctcccctgaggccatgggggatagtggaggccataccatttccctctacagcttttcgaaggcctatggcatggccggttggcgggtcggctatatggtcattcccctggaactattgctagcggtcaaaaaaattcaggataccaatctgatctgcccggtggtggtttcccaatatgccgcccttgcttgcttacgggtgggcaagaattattcagcccaatttttaccggagatggctgcctgtcgccagcaactattagaaaccctaggtcaattgtctgactattgtcgtttagtggtgccccagggggctttttactgtttgctggaagttaatagccccttgacggatttagagctagtgaaaaggttaattgatgaatttaaggtggcggtgctaccaggttccacctttggcgtggattcgggttgctatctccgtattgcctatggtgctctgcggcaggccacggctagcgttgccattgccagactggagcagggtctaaaaagtatctgttga

SEQ ID NO: 26537 - DNA, 1506 bp, Synechocystis sp.
atgactgtttccccttcctacgacgcaatagtaatcggctccggcattgggggattggtcaccgccacccagttggtatccaagggtttgaaagtattggtactagagcgttacctcatccccggcggcagtgctggttattttgagcgggaaggttatcgctttgatgtgggggcctcaatgatttttggtttcggcgatcggggtactactaacttattaaccagggccttagccgctgtgggacaggcattggaaactctccccgacccagtgcaaattcattaccatttgccgggggggctagaccccaaagttcatcgggagtacgaagcttttttacaggagttaatcgccaaatttcctcaggaagcccagggtatccgccgcttctatgatgaatgttggcaagtatttaactgcctcaacaccatggaattgctctccctggaggaaccccgttacctgatgcgggtattttttcagcatccgggggcatgtctgggtttagtgaaatatttaccccaaaatgtgggggacattgcccgccgccatatccaagacccggatttactgaaatttatcgatatggaatgctattgctggtccgtagtgccggcggacttaacccccatgatcaatgccggcatggtcttttccgatcgccattacgggggcattaactatcccaaggggggcgtgggacaaattgccgaaagtctagtagctgggctagaaaaattcggtggcaaaattcgttacggagccagggtaaccaaaattattcaggaaaataaccaggcgatcggggtggaactggccaacggtgaaaaaatttatggccggcgcatcgtctccaatgctacccgctgggataccttcggggcgttaacgggagatcagcccctacctgggaaggaaaaacggtggcgcagaaattatcaacagtcccccagtttcctcagcttgcatctgggggtagaagcggatctattaccagaaggaacagaatgtcaccacattttgctggaggactgggatgatttagaaaaggaacagggcaccatttttgtctccattcccaccctcctcgaccccagcttggctcccgacggttaccacatcatccacaccttcacccccagttggctcgaatcctggcaaaatctttccccccaggaatacgaagccaaaaaagaagccgattctggtaaattaatcgaccgcctggaagccatttttcccggacttgatcgggcactggattatatggaaatcggcaccccccgtagtcaccgccgctttttagggcgacaaaatggcacctatggccccatcccccgccgtcgcttaccgggtttactgcccatgcctttcaaccgcaccgccataccgggcctatattgcgttggcgatagtacttttccaggccagggtttgaacgccgtcgctttttctggttttgcctgtgcccatcgcctagcggtagatttgggggtacggtga

SEQ ID NO: 26538 - DNA, 1053 bp, Synechocystis sp.
atgacagaagcaaatgatttgccctaccttctgcgggtagccaggggcgaagtggttaaacgtccccccgtgtggatgatgcgccaagccggccgttatatgaaagtttatcgagatctgcgggataaatatccgagtttccgggagcggtcggaaaacccagacttggccatcgaaatttccctccagccctggcaagcgttccaacccgatggggtgatcatgttttcggacattttaactcctctgcccggtattggcattcccttcgacatcatcgaaagtaaagggcccatcatcgaccctcccatccgtacccaagcccaggtggatcaactccatgccctagatccggaatcaagtctgcccttcatcaaaactattttgggaacgctacggaaagaagtaggcaaccaatccactgtgttgggttttgtgggtgctccctggaccctagcggcctatgccattgaagggaaaagctccaaagattataaagtaattaagcaaatggccttttctgaaccggccattctccacagtttcctcgataaaattgccgaggcgatcgccgtttatgtccgttaccaaatcgactgtggtgcccaagtggtgcaattattcgattcttgggccggccaattaagcccccaagattacgacacctttgccctgccctaccagcaaaaagtggtcaaactggtcaaagaaatccatcccgatacaccgttaattctttacatcagcggcagtgccggaattttggaacgcatgggtaaatccggggtggacattgtcagtgtggactggacggtggacatggccgacgcccgccaacgcctgggcaaagagatgaaagtccaaggcaatatggaccccggcgtactatttggttcccaggacttcatcaaagaacggattttagacacggtgcggaaagcagggcagggggggcatattttcaacctcggccacggtgttttggtgggcaccccggaagataacgtccgcttcttctttgaaacagctaagcaagtggatcaattactgtaa

SEQ ID NO: 26539 - DNA, 1002 bp, Synechocystis sp.
atgggtcacaaatacgatgtctatggcatgggaaatgccctggtggatatggaatttgaggttaccccagagcagttggccagcctaggcattgataaaggggtgatgaccttggtggaagaggccagggaaaatgaattaattgcccaattggcccaacagcgtggcaagcaaagcagtggcggatcagcggccaatactctggtgtccctggcccaactggggggtacgggtttttatgcctgcaaagtgggtaaggatgaagcgggagccttttacctccaggatttgaacgattgcggcctcgataccaatccccaccatgaaaccgctggcgaaggcattacgggcaaatgcttagtgtttgtcacccccgatgctgaccgcaccatgaatgcttttttgggcattagtggcagtttgtccgtaaccgaaatggattggtctgctttaaaacagtcccaatacctttacctggaaggctatctggtcacttcccccagtgccaaagcggcctgcattgaagccaaggcgatcgccgaacaatccggggtgaaaacctgtctatccctatccgatcccaacatggccaaattttttcaagacggtttaaaggaaatgctggggtcaggggtagatctactattcgccaatgaagcggaagccctggaaatggccggtacttcagacctcaaccaggcgatcgcctactgtaaaagtattgccaaaaactttgccctgaccaggggcggagcaggctcactaatttttgatggtgagaatttattgaccattggcacccccaaagtccaacccatcgatacggtgggagcgggggatatgtacgctgggggatttttatatggcctaacccatggcatggactatgaaaaagctgggcaattggcttcggaaacagccgccaaagtagttacctgttatggtccccgcctagacacagaaattctgcaagagattttacagtctgttcaagcagtttag

SEQ ID NO: 26540 - DNA, 1410 bp, Synechocystis sp.
atgctctccactgaaatgccccttccaaccaccggaagcaccttattaaaaaccccggcctccccctcccccaaccaaaatcttttaccgttgacggccgttattaataaaaacggtgaactagaaattggtggttgctccgtcccagccttggtggaacagtttggttctcccctctacattttggatgaaaccaccctgcggcaagcggcccagcagtatcgtcaatccttccaagcccactatccgggttccagtcaagtaatctacgcttccaaagcctggagttgtttagccgtagtggcgatcgccgcccaggaagggttgggatttgatgtcgtatccggcggggaattattcaccacggtttcagccctgaagcaattaggctgggacgaagctgagattgcagaaaaaatttacttccacggcaataacaaatcggtgcaggaactccaagaggcgatcgccattaactgcaccatcattgtcgataactggttggaactggaaaccctgaccaaactagcggccgactcaggggcaccggtaaagattatgttgcgcctcaccccaggcatcgaatgccacacccatgaatatattaaaacggggcatctggacagcaaatttggctttgatcccaaccaactagaagcggttttcacctacattgcccaacaaccctcactccattgtctcggactccatgcccacatcggctcccaaatttttgagcgtcaaccccacaaagatttaggggaagtgttagtgcaatggtttaccaaaggcttgacctacggcttgcccctgacggaattgaacatcggcggtggcctagggatttgctacaccgaaagtgatgatccccccagtatcgaagaatgggcccaagtggcggccatctccgttgccaaagcctgcgatcgccagaacatcccctaccccaaactgattgctgagccgggacgttccctggtggggtctgcctgtgtaacggcctatcgggtgggagggcgtaaagttgtgcccaatattcgcacctatatttccgtcgatggcggcatgtccgacaatccccgccccatcacctaccaatcggtgtatcgcgttgccctagccaaccggatgaacgacgaaattaccgaaactgtcaccgtggccgggaaacattgtgagtccggcgatattctcgttaaggatgtggccctacccgccgccgaaccaggggacattatggtagtggctgccactggtgcttataaccacagcatggcttccaactacaaccgtttaggtcgccccgccgctgtactagtaaaccaaggacaagcaaacctgattctgcaacgggaaacctacaccgacctattgcgccaggattgtctacccaaccgtctactgtcctaa

SEQ ID NO: 26541 - DNA, 945 bp, Synechocystis sp.
atggaaactattcgccttggccccaacggcccctccattgctcccctgggtttgggtacttggtcctggggagacaccctgttttgggcctacggtaaggactttggcccgcaagaagtagagggggcttttcatgcttccctggaggccggagttaccttaattgacactgctgaaatttatggttttggggaatcagagcgcctcattggccgtttttgccgagaaaaaacccaaaaagtggaaattgcgactaaatactttcccttgccatggcgttggcagcgttctgacatcactaaagctttaactgccagtctggaacgtttgcaaatggacaccatttgtttgtatcaaatccattggcccctagaattttggctcaaaacaccggatttcatggccgtgttggccgccgaggtcaaaaagggtcgtatccaggccgtaggagttagtaactattccgcccagcaaatggcgatcgcccacgaatgtttagcagcccaaggcattcccctcgctagcaatcaagttccctattctttgctcaaccgggagattgaaagcaacggtattttgacccaggcccgccagctcaacgtcactattttggcctatagtcccctagctcaggggctactcaccggcaaatatcgccccgaaaattctcccagtctccagggtgcccgccgtcttgacccccgttttagtaccaaaggattgcgaaaattagctcccttacttaccctcttggataccctggcagataaacatgacaaaacccctgcccaaattgccctcaattggctcatagcccaaggaaatgttattcccattccgggggcaaaaaatgcttcccaagctcaacagaatgccggagccttggggtggcagttaaacccagaggaaattgaacaattgcgaagtgctgcccaaggtatttaa

SEQ ID NO: 26542 - DNA, 927 bp, Synechocystis sp.
atgggcattaaggcgttggcgggcagggatctattggcgatcgccgatttgaccatcgaagagatgaaatcactcttgcagttggcggcggatcttaaatccggtgtgctcaagccccactgtcggaaaattctcggtttactgttttacaaagcctccacccgtaccagggtttccttcaccgcggccatgtatcaactgggagggcaggtattggatttaaaccccagcgtgacccaagtgggtcggggagagccgattcaggataccgctagggtattagaccgctacattgatatcctggcggtgcggactttcaaacagacagatctgcaaacctttgctgaccatgccaaaatgcccatcatcaatgccctgagcgacttggagcatccctgccaaattttggccgatttacaaaccatcaaggaatgtttcggcaaattggaaggcttaacggtgacttatctaggggacggcaacaatgtcgcccattccctcattctcggtggggtaatgatgggcatgacggtgcgggtggctaccccgaagaactatgaacccttggcagaaattgttcaacaagcccaacaaattgcggctccagggggaaaagtggaactaaccgacgatcccaaagccgccgcccagggaagtcatatcctctacaccgatgtgtgggccagcatgggccaggaagatttagccgacagtcgcattcccattttccagccctaccagattaaccaagaactccttgccttggccgatcccgaagccattgtgctccactgtctgccggctcaccggggggaagaaattactgacgctgttatggaaggcccgcaatcccgactgtgggaccaagcggaaaatcgcatgcacgcccaaaaagccctcatggtggcccttttgggtttagtttaa

SEQ ID NO: 26543 - DNA, 1134 bp, Synechocystis sp.
atgcctggggattattaccaaacgcttggagtgacgcgggatgctgataaagatgaaatcaaacgagcctaccgtcggttagcccggaaatatcatcctgacgttaataaagaaccaggagcagaggaaaaattcaaagaaattaaccgagcctacgaagtgctatcggagccagaaattcgtcaacgctacgatcaatttggtgaagcgggggtcagcggtggcggtgcccagggcttcgatgtgggcaatatgggcgattttgccgacatttttgaaaccatttttggtggctttggcggtggcatgggcggccagcagcggggtcgtcgtcgagccaatggtcccaccaggggggatgatctacggctagatttacagttaactttccaggaagctatttttggcggcgaaaaagaaattcgcattccccacctggaatcctgtcaggtctgtgagggcactggggccaagcccggcactggggttaaaacctgtggcacctgtaatggcgctggacaagtccgtcgggccacccgcaccccctttggtagttttgcccaagtttccgcctgtcctacctgtaacggcagcggcgaagtcattgaacagaaatgtgaagcctgtaacggggtcggccgcaaacaggaaacgaaaaagctgaaaattaccattcccgccggagtggatgatggtacccgtttgcgggtgggtaaagaaggagatgctggtttacggggtggtcccgcaggggatctgtacgtcttcctgatggtggaaacggataagcattttgtccgggaagggatgaatattcgttccaatttggaagtgagctatctccaagccatccttggttgtcgtctggaagtggacacagtggacggtaaagcagaattgactatccccgccggcacccaacccaacaccgtcttaaccctggaaaataaaggggtgcccaaattaggcaacgccaccattcggggcgaccatctaatcacggttaaggtacaaattcccacccggattaactcggaagagcgggagctattggaacgattggccactatcaaaggagaaagccacggcaaaggtggattagaaggatttttagggggattattccataaatga

SEQ ID NO: 26544 - DNA, 1338 bp, Synechocystis sp.
atgcccaaatacgactcccatctgaaatgttctttttgtggcaaatcccaggagcaagtccgtaaattaattgctggccctggcgtgtacatttgtgatgaatgtgtagaactctgtaacgacattttggatgaggagttgttggatgtaccccctgcctcaaccggggaaagggatgggacaggtcaaaaacaaaaaaaatctggtcagccccgtcgccgtcttaccctagaagaattacccaaaccaacggcaatcaaacagtacctggatgaatatgtaattggccaagatgaggctaaaaaggtgctttccgtcgctgtttataaccactacaaaagattaaacctgctggagcgcaatcaagagattgatcccggcgatgcagtggaattacaaaaatcgaatattcttctagtgggccccacggggtctgggaaaaccctacttgcccaaaccctggcgaaaattttagaagtgcccttcgctgtggccgatgccactaccctgacggaagcgggctacgtgggggaagatgtggaaaatattttgttgagactgctccaggtagcggatttggatgtggaagaagcccagcgaggcattatttacattgatgaaattgataaaattgcccgcaaaagtgagaatccttccattactagagatgtgtccggggaaggagtacagcaggctttgttaaaaatgttggaaggaacggtggccaatgtgccgccccagggaggcagaaaacatccttaccaagactgtattcaaattgataccagtaatattctcttcatctgtggtggtgcttttgtcggcttagaaaaggtaatcgaacaaaggtttggcaaaaaatccatgggctttgtgcggccgggagaggggccaagtaaggaaaaaagaactgccgatgtgctccgtcaggcagagcccgatgacttagtcaaatttggtctgattcccgaatttattggtcgtattcccgtgatggcctgccttaaccccttggatgaggatgctttaattgctattctgacccagccccgcaatgccattgttaaacagtatcaaaccctattgggtatggaccatgtggagttggattttcaacccgatgcggtgcgggcgatcgccacggaggcccaccgtcgtaaaaccggagctagggcgttacggggcattgtggaggaattaatgctggatgtgatgtatgagttgccttcccgggaagatttaacccactgcttgatcactagggaaatggtggaaaaacgctccacagcagaattattgctccatccttcttccttacctaaaccggaatctgcttag

SEQ ID NO: 26545 - DNA, 843 bp, Synechocystis sp.
gtggatggttcagcgtttaaaggctgtgacttggtgttggcttccgccggtggttccacttccaagcgttgggcagaggaaattaccaaagccggagcggtgatggtggacaattccagcgcttttcgcatggtgccggaagtgcccctagtggtaccggaaattaatcccgaagcggcccaaaaccaccaaggcatcattgccaaccccaactgcacgacgattttaatgggggtagccatctatcccctgcatcagctccaacctattaaacgcattgtggtggccacctaccagtctgccagtggggccggggccatggccatggaagaagtgaagcaccaaagccgggacatcctggagggaaaaattccccaagctgagattttgccctatcctttggcttttaacctctttccccacaactcccccatcacagctaaccactactgtgaggaggaaatgaaaatggtgcaggaaacccggaaaatctttgccgcagaagatatacgcatcacggccacctgtgtgcgggtacctgtgctccgggcccactcagaagcggtcaacttggaatttgccaccccattcccggtggaattggccaaaacggcgatcgccaaagctccgggggtaaaactggtggaggattggcaaaaaaattatttccccatgcccatggatgccacaggccaggacgacgtgttggtaggacgtattcgccaagatatttcccaccccaatggtttggacctgtggttgtgcggtgatcaaattcgtaaaggggcagccctcaatgcggtgcaaatcgccgaattattggtggagcgggggtggctgtag

SEQ ID NO: 26546 - DNA, 906 bp, Synechocystis sp.
atggctgattttgtaagcacttccccctttggccctgtgttaactgcgatggttacccccttcaatgccgatggtggggtggattatggggtagcggaaaaattggctgaccatctcatcacccatggcagtgacggcctggtggtctgtggcaccacgggggaatctcccaccctttcctgggaggaggagcatgagctatttcgggtggttaaacaaaccgtcggcgatcggggttccgtcattgccggcactgggtctaactgtacccgggaggccatggaagcaacccagattgcggccaagttgggagtggatggttccctccaggtagtgccctactataacaagcctccccaggaaggtttattggcccatttccaggcgatcgccaattgtgcgccggagttgcccctgatgttgtacaacattcccggcagaacgggccagagcctagccccggaaacggtttaccgtttagcggaagtggaaaacattgtggccatcaaagaagccaccggcagtttggagcaggcttccctaattcgggcccatacccccgatgattttgccatctatgccggggatgatgtgctgactcttcctttattggccgtgggaggggccggggtggtcagtgtggccagtcatctggtcggcgatcgcctgcaggccatggtgcagcattttgcccagggagcaacggcccaagccctcgaaatccatttacagctaatacccctatttaaaattcttttctgcgccaccaatcccatcccagtcaaaacagccctgggactccagggttggcccgtaggatcgttcagacctcccctttgtgctctgtcccctggccacaccgaacagttacgagacgtactaagggatttagccttacttccctag

SEQ ID NO: 26547 - DNA, 887 bp, Synechocystis sp.
ccgtttggcctgccctgggttttggttttgcggaattgggggctgtgaccaaatatgcccaaccagggaatgaccgtccccgtctgtttcgtttgccacaagaccaagcagtgttaaaccgtttgggggccaacaatgagggggccgtggccatggcggcaaaattaaaacacacctgggactactatccccgtaccattcccattggcatcaatctttgtaagtcgaaaattactcccctggaccaagcggtggaggattacgtttttagttttcagaccttggccccggtggcggactattttgtggtcaatgtcagttctcccaatacccctgggttacgcagtttgcaggagtctgacgagttgccccgcatttttgctggcttgcaatcggctaaccattggcaaaaaccccttttggtaaaaatttctccagatctgtcctgggaggcgatcgccgtcattatcgacctagtcaaagaacataacctctcaggcatcgtcgccaccaacaccagcaccaggcgatcggggttgaagacaaaaattttgccccaaacaggtcaacccatagaacaggaagctggcggactgagtggtcaacccattcgagaccgagccacagaggtaatccgctatatctatcaacaaactggcggcaccattcccatcatcggcgtgggggggattttcactgctgaggatgcctgggaaaaaattcaagcaggggcgagtttcctacagatttataccggctggatttatggcggtccttgggtagtctccgatatcttgcagggcttgggggaaaaattagcggctgggggcttttcccatatcagtgaagcagtgggaatagatacaataggcaaggccccagagtaa

SEQ ID NO: 26548 - DNA, 1278 bp, Synechocystis sp.
atggagaaggttgaccaagcaaaattgttcctgggtttagactttggtacgtccggggcgagggcggcggtaattgatcaaaataaagagttaatttggcaggaaaaagtccagttttcccaggttcccggcccccaattggttaccatctggcgggaaagtttgtttcatcttttagatcaaattcccgatgaactaagcagtcaaatccaggcgatcgccattgatggcacttcctccacggttttactgttggatagccaaggcaatgggttaatggagcctctgttgtataacgatgaccggggcaaagaagttaagcatttattatcagcaatagctccagcagatcatttagtgcaaagtgctacttctagcctagccaaactgctttggtactcccaacaaccggagtttgaacgagctaattacttttgtcatcaagcggattggttagcaagtttgctccatggtggcagacccgttagtgattatcacaatgccctcaagctgggctacaatccccacaatttaacctatcctgattggttaaaaaatgcttcttggtttgcccttttacctccagtaattgcccccggtaaagcaatttcccgcttatctcccagcattgccaacgcagaaaaattccctaaaaattatttggtttgtgccggcaccacggacagcattgctgcttttttagccagtggcgcaacgcaaccaggggaagcggtcacttctttgggttccactctggtgctgaagttactaagtgaaaagccagtgacggatctagctagcggtatttatagccatcgtctaggcgatttatggttaacggggggagcttccaatgcggggggagcagtgttacaacattatttttcgtcaacgcagttaacagcattaagtgccaaaattaatccccatcaacctagtgacttagattactatccccttttgcaaccgggggaaagatttcccattaatgaccctaatttattaccccgcttggaacccagaccagagaatgatgcaatttttttacaaggtttattggaaggtttagctcgcattgaagcccagggttatgaaaagttgcaaaagttgggggcaacaaccttaacaaaggtgtttactgctgggggtggggcacagaatttaacttggcaaactattcggcaaaatttgctccaggttccggtacaaaaatccgttcagtcagaagcggcctatggttctgcttgtttagctagaagtagtaaatcttgggaatga

SEQ ID NO: 26549 - DNA, 2610 bp, Synechocystis sp.
atgtcgtttttaacctttgataccgagtccaaccaacggaaaagctttgaactgcccggtgctaagccccactacaatccagatcgcccggggcaggtaaatcatatttttttggacttgaaaatcaacctggaggaacggcatttacagggagtttgtcgcatcgccctcacgccggtgcgagctggcattgagcaattgacgttggacgcagtggacttgaaaattgcctgggtcttaattaagggggtgagccaaagctttgactatgacggggaaaaattaaccatcaacccattgcaacccctgggaacggaaccggtcaccctggaaattcagtacgaattgaaaaatccccgccggggcatttattttatccagcccgatcgccattaccccgataagccggtgcaagtgtggacccagggggaagatgaagattcccgctattggttcccctgttttgattacccaggacaattggccacatcggaaattcgggtgcaggtagccaaaccccatcgggttatttccaacggcagtttaattgagcaaaaagatttaggcaatgagcaaattttccactggtcccaaagtcaaattcaccctacctatttaatgaccctggcgatcggagactttgccgaaatagtagatcattatggcgatctgccagtgcgctactacgtggaaaaaggaagggaagccgatggacaacggagcatgggcaaaactccccgaatgatcgagttttttaaccaaacttttggttatccctatgcctaccccaactatgaccaagtttgcgtggcagatttcattttcgggggcatggaaaacacttccaccaccctattaatggaccggtgtttactagatgaacgggcggcattagataaccgcaatacggaaagtttagtagcccatgaattggcgcaccaatggtttggggatttagttgttgttaaacattggtcccatgcttggctcaaggaaggtatggcttcctatgctgaggttttatggacagaccatgaatatggccaggatgaggcggcctattacctgttgggggaagctcgtaactatttagcagaggatagttcccgctaccgtcgtcccattgttacccacgtttatcgcgaagccattgagctttacgatcgccatttgtatgaaaagggagcctgtgtttaccacatgatccgggcggtgttgggggatgagctattttttagagctgtccatacttttgtgaatgaccatgcccatggcactgtggaaactgtggacttactgcgggccattgaaaaggctacgggctttaatttactctggctgtttgatcagtatgttttccggggcggtcaccctgaatttaaagttagttacagttgggataatgacaataaattagccaagttaacggtgacccaaacccaagccaaggctaatagtgaccacaaagatttgtttaacctaaaaatccctgttgcttttaattttttagacggagaaaaagttaccagtcaagttattcctttacaactcaaagaacgggagcaggttttttattttcccctaacccgtaagccagattttatcagttttgaccagggcaataatttccttaaaaccgtagaattagcctatcctttaacggaattaaaagcccaatgtacccatgaccccgatcccattgcccgcattcaagcggcgatcgccattggcaaacaaggcggtttggaagcggtggaatttttaggcgaaagattgcaaaaagaagctttctggggtgtgcgggtggagattgccgagcaattagcgggtattaacctggaacaagcgggaacggcattaatcaatggtttagacaaaaacgaccaccccaaagtgcggcgggcgattatttcagccttagccaaggtaaaaaccgaagctagttacgaagctttgaaaaaatgtttgacccaaggagaaaccagttattacgctgaagcggcagcggcgacggccctgggtgccctcggcactggtctgctcaaaaataacgaaggggaaattattcaacaattgacagaagttttaaaaaatcgctccggctggaatgaagttgtccgttgtggggcgatcgccggtttgagccaactgaccacttctgcccaagcggtggacgcaattttagcctatactgccaatggtacgccccaacccctgcgtttagctgccattcgagctttaggtgctgtttccatcggtcaatccccggaaaagttaacggagattctggaacgactaacggcgatcgcccaggaagaatttttcctcacccaagtttctgttacttctgcccttggccaaatggaaacccccaaggcgatcgatatttcgcaaaatcttgccaaccaaacccccgatggtcgggtgcggcgcatggcggaagaggcggttaaaaaagtccaagccaaaattggcagtgacgaaaaaattaaaaatttgcaaactaacctggaaaaactccaacaggaaaatcaagatctccaaagtcgccttgctaaattggaaactgtgattaaagcatcaaccgatacatccgtcacgaacctttag

SEQ ID NO: 26550 - DNA, 1014 bp, Synechocystis sp.
gtgactagagtagcaattaacggatttggacggatcggacgcaactttctccgttgctggctggggcgcaccgatagccagttagaagtagtcggtatcaacgacacctctgatcccagaaccaatgctcaccttttgcgctacgactccatgttgggtaagttggatgcggacatcagtgccgacgaaaactccattaccgtcaatggcaagactattaaatgtgtttccgaccggaatcccctcaatttgccctgggcagaatggaatgtagatctagtcatcgaagccaccggtgtttttgttacccatgaaggggccaccaagcacgttcaagccggagccaaaaaagttttaatcactgctcctggcaaggggcccaacatcggcacctatgtggtgggggtcaatgcccacgaatataagcacgaagaatacgaagtaattagtaacgctagttgtactaccaactgcctcgccccgatcgccaaagtaatcaacgacaattttggcatcatcaaaggcaccatgaccaccacccacagctacaccggagaccaacggatcctcgatgctagccaccgggatctacgccgggcccgggctgctgccgttaacatcgtgcccacctccaccggagctgccaaagcggtggccctggtaattcctgaactgcaaggcaaattgaacggtattgccctgcgggtgcccacccccaacgtttccgtggtggatttggtagtacaagtagagaaaaacaccatcgctgaacaggttaacggagtgctcaaagaagcagccaacaccagccttaaaggagtgttggaatacaccgatttggaattggtttccagcgacttccggggcacggattgctcttccactgtggatggtagtctgaccatggtaatgggcggtgacatggttaaagtcattgcttggtacgacaacgaatggggctattcccaacgggtggtggacttggctgaaattgtggctaaaaactggaaatag

SEQ ID NO: 26551 - DNA, 1662 bp, Synechocystis sp.
atgggggcaaatcagttcgatgtggtggtggtgggctccggagcggcaggcctttatgcctgtctttgtttgcctggtcattaccgtgtggctctggttaccaaggcggaactgaaaacgggggccagtgattgggcccagggagggattgcggccgctattgccccgacggattctccccaatctcactacgaagataccttagctgctggagcgggtttatgtgatggggaagcggtggatttcctagtgaatcatgccccccaggcgatcgccgagttggtgcagttcggtgttagttttgatcgccatgggcagcatctggctttaacgttggaggcggcccattcccaaccgagggtactccatgcggcggacactacggggcgggccattgtttcgacgttgatgggacaggtgcaagctcggcccaatgtggaaattttttcccaggcgatcgccctgtctttaaatattgagccaacaacgggccattgtcggggcattcaggtttttgtcaatcaaaccattgaaactttccactcccgagcggtgttattggccaccgggggcggcggtcaagtgtttgcccaaactaccaatcccaaagttagtactggtgacggcattgccctcgcttggcgatcgggggcccaggtgcgggatttagaattctttcaatttcatcccaccgctttaactaaaccgggtgtgccccattttttgatcagtgaagcagtgcggggggaaggggcccatctgctcgatcgccaggggaaaagatttgcttttgattaccatcccaggggagaactagctcccagggacgtggttagtcgggcaattttccaacatttagccaatacagaaaaagatcccacccaagccactgtttttttggatctgagtcccattgagccggagcgcatccaaaggcgttttcccaatattattcgccgttgtttgcactggggggtggacatttttcgtgaaccaattcccgttgccccagcggcccattattggatggggggcattaccacagatattaattgtcaaaccactattccaggcttgtatgcgttgggggaaaccgccagcactggggtccatggagccaatcgcctggccagtaattctctgctggaatgcattgtttttgctagtcaattaagaaatttgagcttaccgccccttgcctccagtgactccaacgttaatcaatcgataaaggaaattcgactagacaccaccaatgacctagccctcctaaaccattggcgcagtgaattacctcgcttgatgtggcaaaccgccggcatttgtcgccaagctgaaactctccaaatggcgatcgccaaattggaacaatggcaagaacaatggcagcagctcagcagcagtaagcttttagctcacctaccagaggatcaaaaaattagcctaagtggcccagggctgaatgaatttatgcagttgtgggccgaaacccataatctgctggatatagcacaattaattttgactagtgccctctttcgggaggaaagccgggggggacattatcggttagattgtcctgataccaaaagagaatggcaaagccacactgtcattgaaggaacgagggtttttctccaacccagccagagtcaagactaa

SEQ ID NO: 26552 - DNA, 1803 bp, Synechocystis sp.
atggcattaatcgttcaaaaatttggcggcacttccgttggcactgtggagcgtattcaagcggtggcccaacgcattaaacgaactgtgcagggaggcaactccctggtggtggtggtgtcggccatgggaaaaagcaccgatgtgttagtggatttagcccaacagatttcccccaatccctgtcgccgggagatggatatgttactttccaccggggaacaggtatccattgctttgctgagtttagccttgcaggaaatagaccagcccgccatttccctcaccggagcccaggtgggcatcgtcaccgaggccgaacatagccgggcccgcattctagaaattcgtcccgatcgcctggagcaccatttaagggaagggaaagtggtggtagtggctggtttccagggcatcagtagcgtagaacatctagaaattactaccctgggacggggcggctcagacacctctgccgtggccctggcggcggcattgaaagcggatttttgcgaaatttacaccgacgtaccgggtattctcaccactgatccccgtttagtgccggaagcccaactgatggcggaaatcacctgtgacgagatgttggaattagccagtctgggggcgaaagtactccatccccgggcggtggaaattgcccgcaattatggcattcccttggtggtgcgttccagttggagtgatgaaccgggcacaaaagtagtggctcccccggtgcaaaaccgttccctggtagggcttgaaattgccaaggcagtggatggggtggaatacgacgccgatcaagccaaagtcgctctgttgcgagtgcccgatcgccctggggtggcatcaaaattatttcgggatattgcccaacaacaggtggacattgatttaattattcaatccatccatgacggcaacagtaatgacattgctttcactgttgtcaaagatttactcaatacagcggaagccgttaccagcgccattgccccggccctacgcagttaccccgaagcggatcaggaagcggaaattattgtcgaaaaaggcatcgctaaaattgccattgccggagccggtatgatcggtcgtcctggcatcgccgccaaaatgttcaaaactttggccgatgtgggggtcaacattgaaatgatttccacttcggaagtgaaagttagttgtgttattgatcaacgggacgcagaccgggcgatcgccgctttatccaatgcttttggggtaactttatctccgccgaaaaaccaaacggacacttcccatttaccagcggtgcggggggtagccctggaccaagaccaggcccaaattgccattcgccacgtacccgatcgccctggcatggcagcccaactgttcaccgccctagcagaagccaacatcagtgtggacatgattatccaatcccaacgctgtcgcattaatcaaggcaccccctgccgggacattgcttttatggtggcggaaggggatagcagtcaggctgaggcgattttgcaacccctgatcaaagattggctcgatgcggccatagttgtgaacaaagccattgccaaagtcagcattgtcggttccggcatgattggccatccgggggtggcggcccacttctttgctgccctggcccaggaaaatatcaacattgaaatgattgccacgtcggaaatcaaaatcagttgtgtggtgccccaggatcggggagtggatgctttgaaagctgcccacagcgcctttaacttagctggcacgaaaaccgtcactgttccagcttag

SEQ ID NO: 26553 - DNA, 2142 bp, Synechocystis sp.
gtggtttatccacaaacctttttcctgcgacttaaacctttccgtttttccatcaccatgacccacaccgccgttgccaatccgctccttcaaggccgggacttgcctgcctttgacaaaattcaacccaccgatgtggagcccgcagtgactaccctggtgcaggaattagaagcccaattaactgagttagaaaaatctgtgcagcccacctgggaaggattggtggaacctctgacggccctggaagaaaaactgagttggacctggggcaccgtttcccatttgatgggggtgaaaaatagccccgaattgcgccatggctttgaacaagtgcaaccgttagtggtaggtttcattagtcggttggggcagagtcgtcccctttatgaagcctttgtggccctgcgggatagcgctgaatggggaaatctagaaccagcccagcaacggattgtggaaagtaatatccgggaagcggaactagggggcgtaggtttaacgggggaaaaacgggacaggtttaacgccattcaattggaattagcggaactggccaccaaattttccaataacgtgttggatgccagccaagcgtttgagttgaaactgaccaccaaggaagaaattgccggcttgccaccgagtttattggctttagccgcccaaactgcccaacagaaaggggaagacaatgctactcccgaggagggcccctggctaattaccttggactatcctagctatcttccttttatgaaatatagccaacgggaggatctgcgggaaaaggtttaccgggcgtttattcgtcgggcagcggatgggcagtgggataaccatcccttaattgagagaattttggcgctacggttggaaaaagcccagttgctaggttttgaaacctatgcagagttaagtttgtcccgcaaaatggcccccaatgtggccgcagtggaaaaactgttggaggagttacgggttcccagttataaggcggcggagcaggaatttgccgatctacagaaatttgctggggtggaagagctacaccattgggatacggcctattggtcagaacggcaacgggaacaggaatttgattttgatgcggaggctctgcggccctatttccccctaccccaggtactggaaggattatttgccttggctaagcgactatttggggtcaccattcaagccagtgaagaagaggttcctgtttggcacccggatgtgcaatttttccgagtgttggatgaatcgggcacggcgatcgccagtttttatttagatgcctacagtcggccggcggaaaaacggggcggtgcctggatggcggattgcttaaaccggggtcaggaattaatcaatgggcaaaaatccctacgtttgccagtagcttatctaatttgtaaccaaacgccgccggtgggggatcagcccagcctgatgactttttacgaagtgactaccctgttccatgaatttggccatgggttgcagcatttactaaccaccgttaattacagcggtgcggcgggcatcaataatgtggaatgggatgcggtggaactgcccagtcagtttatggaaaattggtgctatgaccccaccaccctgtttagtttggccaagcattaccaaaccggggagactttgccccaggcggaatacgaaaaaatcctcgccacccgcaactttatgaccggctctgccatgctccggcagattaacttcagcctgctggatttagaactacaccaccgttaccgtcccgacggcccggaaaccattgagcaaattggcgatcgcctggcgaaaatcaccaccattttgcctcccctgccggaaaatgctttcctctgctcctttggccacatctttgccgggggctatgccgccggttactacagctataaatgggcggaagtactcagtgccgatgcctttgccgcctttgaggaggtgggcttagacaatgaagctgcggtgcaaactacgggtaaacgttttcgagaaacggtgttggccttggggggaagcttagcgcccgcagtggtctttgaaaaattccgggggcgacaaccgcaaactgctccgctgttgcgtcataacggtttgttacccagtgcaacctga

SEQ ID NO: 26554 - DNA, 804 bp, Synechocystis sp.
gtgtccattcaactcggtatcatcggcggtggagtaatggctgaagccatcctggcccgcttaatcgcagaaaagacctatgccccagaagaaataattgtgggggagccccacggtgcccggcgggattatctccaaaaaacctatcaagttcgggtttcccccgataaccaagaggcggctaatgtttctgaagtgctgctgttggccgtcaaaccccaggtgctagaccgggtgctagccagtttagcaggaggagccaatcgtcccctggtaatttccattttggccggggtttctctgcaaagaattcaaaagggttttcccgaccatgccatcatccgggccatgcccaatacccccgccaccgttggggccggtatgacggcgatcgccgcgaataaaatggtggagccggatcagttggctaaggctaaggccatcttttcggcggtgggcaatgtggtggaggtgccggaaaatttaatggatgcggtgacgggggtttccggttcgggaccggcctacgtagctttgatgatcgaagccctggccgatggtggtgttttggccggattacccagggcgatcgcccaaaaattggctttgcaaacagtgttgggcacagcggagttaatcaaggaaacggaggagcaccctgcccagattaaagataaagttaccagtccggggggcaccaccattgctggggtagcggtattggagaagatgggttttcgttccgccatcatcgaagcagtgcgggcggcctatcgccgttcccaggaattgggcaaaaaataa

SEQ ID NO: 26555 - DNA, 2088 bp, Synechocystis sp.
atggaagggcagtcaatcgaactagaactaagtgtcatggcaatgccggagttaatcgacagtactgaagcaggccataccgccggggtgaaaactgattccaatccccaggcgatcgcccaagaccgtcgttggaccattgacgacagcgaaaacctctaccgcatcactggttggggggaaccttacttttccattaatgcggccggccatgtgaccgtttctccccaggctgaccatgggggagcgttggatttgtacgaactggttaagggtttgaggcaaagaaatattggcttgcctttactgttgcgcttttctgatattctggctgaccgcatcaatcgcctcaatgcggcctttgcccggggcattgcccgttaccgctatcccaacacctaccggggggtttatcccattaagtgcaaccagcatcgccacattgtggaatccctggtgcgctacggcactccctataattttggcttggaagccggttctaaaccggagttgatgattgccctggctatgctccaaccccaggagaacccagagccggatcaacaaaatcagcctttactaatttgtaatggttataaagaccgggaatatattgaaaccgccttgctagcccgtcgtctggggcatcggccgattattgtggtggagcaggtagcggaggtggccttggccatcgaaatttccagcaatctgggcattaagccaattttgggggtacgggccaaactgagtacccagggcatgggccgttggggcatttccactggcgatcgggctaaatttggtttaaccatcccggaaatgttgacggcgatcgagcaactgcgccgagctgatatgttggacagtctgcaattgctccattttcacatcggttcccagatctcttccatctctgtgatcaaagaagcgatgacggaagccagccaaatttttgtccagttggccaagctgggggccaatatgcgctacctggatgtggggggcggactaggggtggactacgacggttccaaaaccaatttttacgcttccaaaaattacaacatccagaattacgttaatgatgtgatttcggcagtgcaggatgcctgtgtggccgctgaagtgccctgtcctgtgctgattagtgaaagcggccgggcgatcgccagccatcagtcagtactcatttttgatgttgtggccaccaatgacattaatccccccttgcctaaggtgaagggcaaagaccatgccattttgcgtaatttgatggaaacctgggaaaccattacggtggataattaccaagaggcgtaccatgatgtggaacagtttaaaactgaagccattagtttatttaactttggttatttaggtctgaaagaaagggctaaagcagaggagctttattgggcttgttgccgcaagattttacaaatttgccgtcagcaagaatacgtccccgatgatttggaaaatttggaagttaacttggcttctatttactacgccaatatgtcggtgtttcagtcggccccggattcctgggcgatcgatcaacttttcccgattatgcccatccaccgtttggatgaagaacccacccagcggggcattctggcggatattacctgcgacagtgatggcaaaattgaccaatttattgacctgcgggatgtcaaatcagtattggaattgcatcctttaatagaagtgcatcagccagggactccccccagggtggaaccctattatttgggcatgtttttggtgggggcttaccaagaaattatgggtaatttacataatttatttggggacatcaatgtggtgcatattcagatgaatccgaaaggttaccaaattgaacatttagtgaggggggataccatcgccgaagtgttgggctatgtgcagtacgatcccgaagatttgctggaaaatatgcgccgctactgtgaacaggccatggaagataaacgtatgagcttggaggaagcccaattattgctggaaaattacgagcgcagtttgttgcaatacacctacctcaagcccacttcaggcatccacaccagctaa

SEQ ID NO: 26556 - DNA, 1275 bp, Synechocystis sp.
atgtggttgattcggcggcggccgggcaaaggagcacagccttggataagactccaaggacttaactttttcccactacggccgaatggtcctattccagctaccttgcaatatatcattatgccaattgctgcggcgaaaccggcccttcttgtccttgcggatggcaccccttatcccggttggtccttcggggccgatggtaccacagtgggagaggtggtattcaacacgggtatgaccggctaccaggaagtgatgaccgaccccagttattgcggccaaattgtcacgtttacctatcctgagttgggcaacaccggagtcaatgcagaggacgaggaatctatccatccccatgtaaagggggtagtggcccgcaacatcacccgccgccccagcaattggcgatcgacccaatccctaccggactatttggtagaacataaaatcatcggcatttacggcatcgacactagggccctgactcgcaagttgcgttccatcggtgccatgaacggcggcatctctacggaaatcttggaaccggaagccctgttgcaccacatccaagcagctccttccatggccgggttaaatttggttaaggaagtgaccacccatgaagtttacgaatggactgattccaccaatgaccattggcagtttgggccagtggcagaacaacagggacaaccgcccctcaccgtggtggcgctggactttggcgttaagcgtaatatcctgcgtcgcttagctagttacggttgtcgtgtgattgtggtacctgctagcacctccgctgctgaaattctccagtacaaccccgatggcattttcctttccaatggccctggtgatccctccgctgttgaagaaggtattgtcaccaccaaagagttattggcggctaaaaagcccatgtttggcatttgcatggggcatcaagtgttggggttatccctgggagcggagacctttaagctcaaatttggtcatcgagggctcaatcaaccctgtggcctggagcaacaggtggaaattaccagccagaaccatggttttgcggtgacggaaggttccctggccgaagaagtggaaattacccatttcaacctcaacgataaaacggtggcggggctacgccataaagaattgccctttttctcggtgcagtaccacccggaggccagccctggaccccatgatgccgattatctgttcgagaagttcgtcaagttgatgcgacaacaaaaggcagaagtcgccggttag

SEQ ID NO: 26557 - DNA, 873 bp, Synechocystis sp.
atgccttccatcaccggtaaaactaagctccttggtgtgatcggttatcctgttggtcattccttatcccctgtgatgcataatgcggcgctccaggccatggccagtgattatgcatatgttgcctttcccattgctccagaggatttaaccatcgccatagcagggttaggagccagtggagtccagggattaagcgtgaccattccccataagcaagtggtgatgccattgttgacccagataaccgaaaccgctcggcaagtgggggccgtgaatactctctggcgggatggccatggctggcagggaaccaatacggatgttgagggttttttggctcccttgttggagttaaagcaagattggtcagggaggacggcggtgattctcggctatggtggagccgcgcgggccgtggtggtgggtttaacccaattgggttgtccagaaattattgtggtgggtcgcagtcaagaaaaattagctcagttcgccaacagttggacggaccccaaaattaagcaagctctgcaagttctaccctgggaagctctatctaccgtgatccccaaagcaagtttattgattaacagcacccccgtgggcatggctccccaccctaagcaatcccccctggatcaatcccttgtggaaaaactaccgccaacggcgatcgcctatgatttgatttatactccccgccccaccaggtttttacaacatgctcaggagcggggtctagtgaccattgatggagcagaaatgctagtgcaacagggagccgccgccttgaaaatttggctacaacaggaagtgccggtggacgttatgcgccaagccctactccatcacttagaaaaatctgcctga

SEQ ID NO: 26558 - DNA, 1047 bp, Synechocystis sp.
atgaacaactatttccctcgattgaaacaattttctgcccctgctacattttttttgaccgttgcttgcctagtttatccaggcgagaatgcccacgctaatgccagcacccctaacccatacacagttgctcaaactacggccagtccgtcggtggcagtggaaaatctgagcggttttcaaggcattatcactgccctcaacatcacccctgatggtaaatatttggctgtggctacggcggataaccaaatcaccctgattgatttagctaaccaagaagtggtttatagccaaaggagtcccgtcaataattttgctgatttagccattagtgccgatggtcaatggttggcgatcgccgctgacaataatgttgatgtgcgccgggttcgggatggcatgagggttgaaaccctggttggccacacggataaggtcagtggtgtggcctttagtcccgacggagaaactattgtgagcgttagtggtggcgatcgcaccattcgcatttgggaaagggcatcgggcaacttgatacaaaccctagcggataacctcggccctactaccagcgttgtgttcacccccgacggcagtcaatttatcaccggggcgatcggccaggaccgcaccattaaattttgggatgccaacacctttgaattactgggcacttctccccaacagccaggtttcatcaacggcttagctgtgacccccgatggcagaaaactggtaggagcggtgcggaattttgttaaagcttggaacttagccgatgccaaagagttgttttccgtcagaggccccagtttagaaattaataccatcgccgtttcccccaataatcgctgggtagctactgcgaacaaagaaggaaccattatgatcttcgatttagccaacggcaaacaggttactaccctgaggggtcaccaaggctgggttctttccctagcttttagtcccgacggcaataccctctacagcggtgcggaggacaaaaccgtaaaaatctgggacctcagtgcccttgcccgataa

SEQ ID NO: 26559 - DNA, 1410 bp, Synechocystis sp.
atgactgttgctcaacaagccccttctgcccttaactttgactgtgaaaccggcaactaccataccttttgtcccattagttgcgtatcttggctttatcaaaaaattgaggatagttttttcctcgttattggtactaaaacctgtggttatttcctacaaaatgccatgggggtaatgatttttgccgaacctcgttacgccatggccgagttagaagaaggagacatttctgcccagttaaaagactatgaagaactgaaacgactttgcctacaaattaagcgcgatcgtaaccccagtgtgatcgtctggattggtacctgcaccactgaaattatcaaaatggacctggaaggtttggctccccagttggaagcggaaattggcatccccatcgttactgcccgagccaatggtttagattatgctttcacccaaggggaagatacggtgctggcttccatggcccataaatgccctacttcagcccaggtgcaaggggaagataaggaagaacgcaacgccattcaaaaattattgacctttggtcgtaaagctgaccaggaaaaagttgaatcggaatatgtggatcatcaaccgctagttttgtttggttctctgcccgatccagtggtaacaaatttaacgttagagttgaagaaacagggagtgaaagtatctggttggttgcccgccaaacgctatacggaattgccggtgattgatgagggttattatgtggccggggttaatccttttctgagtcgtaccgcaactactttgatgcgtcgccgtaaatgtaaattaattggcgctccatttcctattggtcccgatggcaccagagcttggattgaaaaaatctgttctgtactgggtattgaaccccagggtttggaggaacgggaagctcaaatttgggcaagtttagaagattatatccagttaattcgcggtaaatctgtgttttttatgggggataatttgctggaagtttccctagctcgtttcctcattcgctgtggcatgacctgcccagaaattggcattccctatatggataaacgttaccaggcggcggagttggccttgctggaaaaaacctgctctgacatgggagttcccttgccaaatattgtggaaaagccagacaactacaatcagattcaacggattaaagctctgcaaccggatttagtcattaccggcatggcccacgctaatcccttggaagctcagggcattaacaccaaatggtcggtggaatttacctttgcccaaattcacggttttaccaatgctcgggatattttggaattagcaacccgtccgttgcgtcgtaactcccaattaggagaattaggctgggataagttgattgctaaagacgttcctgctcaggtttaa

SEQ ID NO: 26560 - DNA, 1299 bp, Synechocystis sp.
atgttaagtaaagtccccgccaccattgaagaaatcgccgcccgggaaattttagactccaggggtcgccccaccatcgaagcggaagtccggctggaaagtggggcccacggcattgcccaggtgcccagtggtgcttccacaggcagttttgaagcccatgaattgcgggacggagaccccaaacgctatgacgggaaaggggtagaaaaagcagtacggaacgtgacagaaaaaattgccccggtggtggaaggcctggatgccttcgatcaaatggcggtggatcaggccatgattgaccgggatggaacggacaataaaaaagaattgggggccaatgccattttgggggtttctttagccaccgctaaggccgccgccgctgagctagccattcccctctaccgctacctgggaggccccctggctaacgtactgccggtaccgatgatgaacgtgattaacggtggggcccatgccgacaataacgtcgattttcaggaattcatgatcatgccggtgggggcagaaacctttaaagaagctctgcgctggggggcggaagttttcgctgtgttgggcaaagtgttgaaagaacgaaaactgctctccggtggggtgggggacgaagggggttatgctcccaatttgacctcgaatcaacaggccctagatattctcatcgaggcgattgaacaagctggttacaaacccggtagtcaaattgccttggccatggacattgccgccagtgaatttttcaaaaatggtcagtatgaatacgacggtggttcccattctccccaggaattcatcgactatcaggccaagctagtgagtcaatatcccattgtctccattgaagacggtttgcacgaagacgattgggaaagttggaagggtttaaccacttccctgggcaccaaaacccagttggtgggggatgacttgatggtgaccaacccggtgcgtctgcaaaaatccattgatttgggagttgccaacgccattttgatcaaactcaatcaaatcggcactttgagcgaaactttagagaccatttccctagctactcgccatagttaccgttctgttatttcccatcgctccggtgaaacggaggacaccacgatcgccgacttggccgtggccaccagggtagggcaaattaaaaccggttccctttgtcgttctgagcgggttgctaaatataaccgtttactccgcattgaagatgaacttggcgatcgggccgtttatgcccctaaaattggcctgggtcccaaacattcttaa

SEQ ID NO: 26561 - DNA, 1704 bp, Synechocystis sp.
gtgtctaagcccctgatcgccgccctccattttttacaatttttgtatatgacaagcagaattaatcccctcgccggccagcatccccccgccgacagccttttggatgtggccaaacttttagacgactattaccgtcagcaaccggacccggaaaatcccgcccagttagtgagctttggtacctctggccatcggggttctgccctcaacggtacttttaatgaagcccatattttggcggtgacccaggcagtggtggactatcgccaagcccagggcattacggggcccctttatatggggatggatagccatgctctgtcggaaccagcccagaaaacggcgttggaagtgttggccgctaaccaagtagaaacttttttaaccaccgccacggatttaacccgtttcacccccactccggcggtatcctacgccattttgacccacaaccagggacgtaaagaaggtttagcggacggcattattattaccccttcccacaatccccccactgatggaggctttaaatataatcccccctccggtggcccggcggaaccggaagcgacccaatggattcagaaccgggccaatgagttgctgaaaaatggcaataaaacagttaaacggctggattacgagcaggcattaaaagccaccaccacccatgcccatgattttgtcactccctatgtggccggtctggcggacatcattgacttggatgtaattcgttcagcgggcttgcgcttgggagttgaccccctggggggagccaatgtgggctattgggaacccattgccgctaaatacaatttgaacatcagcttggttaatcccggggtagatcccacgtttaaatttatgaccctggattgggacggcaaaatccgcatggattgttcttccccctacgccatggccagtttggtgaaaatcaaagaccattacgacattgcctttggcaacgacaccgacggcgatcgccatggcattgtcacccccagcgtgggtttgatgaatcccaatcattttctttccgtggccatttggtatttgtttagtcagcggcaacagtggtcagggctgtcggcgatcggcaaaaccctagtcagcagcagcatgattgaccgggtgggggccatgattaatcgccaagtttacgaagtgcccgtgggctttaaatggtttgtcagcggtttgctagatggttcctttggctttgggggtgaagaaagtgccggggcttcgtttttgaaaaaaaatggcaccgtttggaccaccgacaaagatggcaccattatggatttattggcggcggaaatcaccgctaaaaccggcaaagatcccggcctccattaccaggatttgaccgctaagttaggtaatcccatttaccaacgcattgatgcccccgccactccggcccaaaaagaccgcttgaaaaaactgtcccccgatgacgttacagctacctccttagctggggatgccattactgctaaattaaccaaagcccctggcaaccaagcggcgatcggtgggttgaaggtgaccactgcggaaggttggtttgcggcccggccctccggcacggaaaatgtttacaaaatctatgccgaaagtttcaaagacgaagcccatctccaggctattttcacggaggcggaagccattgttacctcggctttgggctaa

SEQ ID NO: 26562 - DNA, 2202 bp, Synechocystis sp.
atggtatcgcttaagcaaaatttacttggtgtaaaaaatcgcattacttgcatggctaaatatcaatgggttcaacaacagagtggtgaggactgtgcggcggcaagtttggcgatcattgcaaagcatcacggacgcaatatcagaattaatcgaattagggcgctggtggggactcgccaagggggaaccactttactcgggcttaagtatggggcgcaggaactgggctttataacctcagccatccaagcagaaccggaaattctcgacgaattggatgagtgggctttaccggcaattattttttggaagggatatcatttcgttgttttgtacgggcaggaaaaagataaatacgtcattgcagatccggcgatcggggttcgttatttagaccgccaagaggtaattaaggggtggcaagggggcatgatgctcctattagagccagatcccaaaggatttatttctcaacttgatgaagatcctgttcatcccgttgataatctgctcaaacgactgtgggaatatcgagaaatttttggcaaattatttcccctgaatttggccgtcggtattttttccttatctacacccttattacttaaatttttaacggatagcgttctgactaaatcagatacccaaaaattaacctgggttgccattggcgttattttgattacagtggttaatgctatttgttcatttttacaatccaatctcgttgcctcctttgcggaagaattgcaaaaaggtctcaagctagaatttggcctgcaaatcttgaatttgcccattacctaccatgaagcccgtcgcagtggtacggcaattcgtcgtctttccgatattcaacggattaatttattagtttctcagttagttattgatctccccatcaagacatttattggtcttgtggcccttggttttatcgtcttttatagttggcagttagcggcaatcgtggcggcgatcgggggcattatgaccttatcaaccattgcttttcagcccattgtccgccagacaacctatcgttccatcactatggcgggggaaaatgctggactcctggctgaatcatttaatggagccttggccaccaaaacaacggcggcttctccccaattatggctagaaattcaacatcgcttgcaacgggaatttaagcttaattaccgcactgctcaaattcgcattatcaacaatactttttcgcaattaatggcggggataggcacagtaattatgctgtggtatggcagtgttttggtttttggcaatcaactcagcatcggtcaacttatcgctatctatggtctgcaacaaagttttttacttttgattacaactttagtgcagttttttaccgatttcacccaagttaaagctatcactcgactcctggcggagttatttgagtacgaaccagaaaatcaaggggatgatctcaaagaccccattgaaatttctccccaggacgacattgattgtcaaaacattagtttttattatcccggtcgagtcaagttgatagaagatttgtccgttaccatccccggcggcaaagttgtcggccttatcggaaaatcaggctgtgggaaaagtaccttagcaaaaattttaaccggtctttattcagtgcaagctggggaaattaacattgggaaccatagtctcggggatttttccttgatctgcctacgaaaacaggtagtgttagtttcccaagatgcttttttcttccatcgttccattattgacaatttccgtttaagctcaccagatattactttggagcaagttatatcagcttgccaaatcgcccaagcccatgaatttgttagtcaatttccagagcaatatgaaacaattctcggtgcggtggcggcaaatatttccggaggacaaaaacaacgcttggcgatcgccagggcaattgtaaacgatccagcggttttgattctagatgagtcaacagctaatcttgatccggtgacggaagctgaagtactcaatagtttgctgaccaagcgccaaggaaaaacaacgattttaattagccatcgtcctaaggttatcaattgtgcagattggattatatttttagaatcgggaaaggttaaatttagcaatacaataaaaaaatttcgttctgaatttggaaatgcctctgattttttatccccttaa

SEQ ID NO: 26563 - DNA, 840 bp, Synechocystis sp.
atggcccttagctttagtaaataccacggtctcggcaacgactttattttggtggataaccgccaaagtacggaaccctgcttaaccccagaccaagcccaacagttgtgcgatcgccattttggcattggggcggacggggtgatttttgctttgccggggcaggggggaacggactacaccatgcggatttttaattccgacggttcggagccggaaatgtgcggcaatggcatccgttgtttggccaagtttttggcagacctagaaggggtggaggaaaagacctatcgcatccacacgttggcgggggtaattacgccccaactgttggccgacggccaggtcaaagtagatatgggggaaccccaattattggcggagcttattcccaccaccctagcgccagcgggggaaaaagtggtggatctgcccttggccgtagcggggcaaacctgggcggtgacctgtgtgagcatgggtaatccccactgtttgacctttgtggatgatgtggacagcctcaacctgactgagattggtcctttgtttgagcatcacccccaattttcccaacgtactaatacggagtttatccaggttttaggaagcgatcgcctgaaaatgcgggtctgggaacggggagcgggtattactctagcttgtggaacaggggcctgtgccacagtggtggcggcagtattgaccggccggggcgatcgccgttgcacggtggaattacccggtggcaacttggaaattgaatggtctgcccaggacaatcggctttatatgacggggccagcccagagagtcttcagcggccaggcggagatttga

SEQ ID NO: 26564 - DNA, 3021 bp, Synechocystis sp.
gtgaaaaccctagcctacgctaaccctgctgatctattcgcctttcccttggatgacttccaacaagaggcgatcgccgccctggaccaagaccagtcagtggtagtgtgtgcccccacaggttccggtaaaacggtagtcggagaatatgccatctatcgagccattgccaggggaaaaagggttttttatactacgcctttgaaggccttgtccaatcaaaaaattcgggatttccaggaaaaattagagaagttaggcctagaaaatgcggcccaactagtgggcttaattaccggtgatacggtgatcaatgccgatgccccggtggtggtaatgaccacggaaatttttaggaatatgctctacgaaacccccattggggaagtaggcacttctttggaggacgtggaaacagtggtgtttgacgaagtccattacatcagcgaccggggtcggggcactgtgtgggaagagtcaatcatttattgtcccagcaccattcaactggtgggtttgtccgccaccattggcaacccggaacagttgaccgaatggattaatcaagtccgcactggggtttccctgaaagtattacgccagggagagcaacgtaatgattcccccccctgtgtgctggtcaattccgatttccgtcctgtgcccctcacctttcactacagcacccgcaaaggtttatttcccctgttgaatgagaaaaaaacgggagttaatactcgcctattgcccaaggctgggaataaaaatacccgttctggtaaaaatcgccgcatgcgccgggaggattgtccctatcccctgttggtgatgcaacagctacaggaacggaatttgttgccggtaatctatgtaatttttagtcggcggggctgtgaacaggcggcccaatccctggaagatttatctttggtggaaccggcggagcaggaaagtatccaactgcaactactggattttttctttggcaaaaatcccctactgcggcagaagttggaacgggatttggccaatggtttgccggatttagtccaagcggtcgttgcctatttggatcatccccaggacagtgaagcggcccaaagacttttgactgcgttggcgatcgatccagaaggtatgttcaaactctggggttggattgcccaatcttctcccatgactaggttcgagcagattgaaccccttttacggggcattgcggtgcaccacgccggcattttgccagatatgaaaaccctggtggaaaagttatttgagcagggcttgatcaaagtggtatttgccacagccaccctctcggcggggattaatatgcctgctcgcaccacggtgatttctgccctatccaaacgtaccaatgaaggtcatgccatgctcagtccttcggaatttttacaaattgcggggcgggctgggcggcggggtatggatacggagggccatgtaattacggtgcaaactccctttgaaggggccaatgaggcctcttacttagctctagcggaggcggaaccgttaaaaagttggtttaccccttcctatggcatggtgctgaatctgttgcaaaaacatgatttggaagaagtaaaaagtttgctggaacggagctttgccgaatacttggcccagtttgccctggaacccactaaggtggcgatcgccgaaacggtgaaaaaattatcccaattggatattaagttggcaggcattggggaaaaggatttacgcagttacgaaaaattccgggggcgactgcgggaagaacaaaggttgctgaaaattctggaagaacaggcggaaaaagaacgaaagcaacagttaaaggatcaactcaaaaccctggcaccgggtcagcttttatatctcaaaggtcgccacgtcaaaatccatcaacctcgtttagcggtcattgttgcccccctggcccccgcccataatttgccccaatggtgctgcctgggcagtgataaccgttggtatcatgtcactgtgggggatatttatgcggtgcccattggtaatctgtccccagcccaatggcagcatttaaccccgcccccagcggaacttttggctcccggtaaatcggtgaagggagatgaggaaacattggcgatcgccgcaggcctagacccccaaacctatcccttagaacccagcccagaactggtagaacaacaggccagggtagaccatgtggaaaaactgttggcagtacatcccctggctagccaaaaacatcccggcaaacttttggagcagttccaccaacggcaagaactacgtaaaaccctaagcaaacgacaacaggagtatgatcgcctacaatcccgtcaatcctactattggcaggagttcctagacttaattgacattttgcaggaaatggaagccctggaggaatatacccccacactgttgggggaagtggccgccaccctgaggggggaaaatgaattgtggttgggtttggccctgatttccggcaaattcaacgatttggaaccagaacagttggccgccgccgccagtgccctcattacggaaactccccgttccgatgcttggactgatttcaagccttcccctgtagtgttggccgctctccgtcccagtaatgatttgtttggcctattattttgccttaaacaccctcaacctccccttgccctctggcaggctatgacggtggcggatcatttgcaacggcttaatctctgggatctacgacgtaaattgatcaaagctcaaaatcaacgggcgatcgccattcccctttggttggaagtggattttatgggcttggtggaacagtgggcattgggcatggagtgggaaaacctctgccgccagaccagtttggatgagggggatttagtccgacttttccggcgcacggtggatctgctttggcaaattccccaggtgccccacctttccccccgactaaaacggaatgctcgcattgcggtgcaacaaatgaagcgttttcccctctaa

SEQ ID NO: 26565 - DNA, 1977 bp, Synechocystis sp.
atggcagtactcgaaaaaggcaatatcacaatccataccgagaatattttcccgattattaaaaagtctctctacactgaccatgaaatctttttaagggaattaatttccaacgccgttgatgccattagtaaacggaaaatggctgcttttgccagcgacggctctggagaagtgcccgatccccaaattacactggtagtggataaggtgaataaaaccctttctattaccgataacggcattggcatgaccgccgatgaagtgaaaaagtacatcaaccaagtggctttctccagtgcggaggagttcattgaaaagttccaaaagtctgccaatgatttgattggtcactttggtttgggtttctattccgctttcatggtgtcccaaaaagtggaaattgacaccctttcttaccaagagggggcccaggcggtgcattggagttgcgacggttcaccggaatttgaactgacggattccgatcgtcagcaggtaggaaccacagtcaccctaactttgctggacgatgaacaggaatatttggagactggtcgcatccggcaattggtgaaaacctattctgactttatggcagtgcccatccgctttgaaggggaaacgctaaataaacagcgggccatctggaaggaatcaccccaaaatttaaccaaagaagattacctggagttttaccgctatctttaccctttccaggaagatcccctgttgtgggtgcatttaaacaccgattatcccttcttgctcaatggtattctctattttcccaaattacgccccgatgtggatgtgtccaaagggcaaattaaacttttctgcaatcaagtttttgtcagtgaccattgcgaagaagtcattcccgaatttttgatgccgctccggggggtaattgatagtcccgatattcccctcaacgtttcccgcagtgccctcactaatcaccgcactgtgcgtcgcattgctgattacattgccaaaaaagttggcgatcgccttaaatctttgtacgacgaaaatccggcagaatatctcaaatgttgggaagacattggtacctttgtcaaatttggttccctgcgggaagataaattcaaacaacaagtagaagatttattgctctaccgcaccacctataaagccacagcagaaagtacggaaccaaaggtagaagttctgaccgaagatggtgatgcctgggctgaaactaaccagagtgacggggttaatccctacgaaaaagaaggttacaccagcctgaaacgttatttggaacgcaataaagaacgccacgaaaatcgagttttttactgcaccgatcaagctacccaagccacctatgtggaactgtataaaaaccagggtattgaggtcctatttatggattctttcattgacactaattacttcattcctttcctagaaaaagaatacagtgacgtcaaattttcccgggtagattcagaactggatcaaagtttgattgaagaggataaagccagcgacattgtggaccccgccaccaacaaatcccgcagtgagcaaatcaaagaaatctttgaaaaggccctcaataatcccaacatcaacatcaaaacccaatcattaaaatccgacgatccccaatctacccctccagccatggtacttctaccggaagccatgcgacgcctccaggaaatgactgccatgatgcaacagcaggcgatggctttcccggaacaacatgtgttagccattaacaccaaccaccccctaattaaaaacattctttccctcagccaaggcggtattgtcactggcagtggggaatctccctcagcagaattagcaaaatccctttgtcaacatgtttatgacttggcattgatggcccaaaaaggttttgatgcggagggcatgaaaggtttcattgaacgctctaatgcggtattaacccgtttgaccaaacagtaa

SEQ ID NO: 26566 - DNA, 1320 bp, Synechocystis sp.
gtgtgttgttggcaatcgagaggtctgcttgtgaaacgtgtcttagcgattatcctgggcggtggggccgggacccgcctctatcctttaaccaaactcagagccaaacccgcagttcccttggccggaaagtatcgcctcatcgatattcccgtcagtaattgcatcaactcagaaatcgttaaaatttacgtccttacccagtttaattccgcctcccttaaccgtcacatcagccgggcctataatttttccggcttccaagaaggatttgtggaagtcctcgccgcccaacaaaccaaagataatcctgattggtttcagggcactgctgatgcggtacggcaatacctctggttgtttagggaatgggacgtagatgaatatcttattctgtccggcgaccatctctaccgcatggattacgcccaatttgttaaaagacaccgggaaaccaatgccgacataaccctttccgttgtgcccgtggatgacagaaaggcacccgagctgggcttaatgaaaatcgacgcccagggcagaattactgacttttctgaaaagccccagggggaagccctccgggccatgcaggtggacaccagcgttttgggcctaagtgcggagaaggctaagcttaatccttacattgcctccatgggcatttacgttttcaagaaggaagtattgcacaacctcctggaaaaatatgaaggggcaacggactttggcaaagaaatcattcctgattcagccagtgatcacaatctgcaagcctatctctttgatgactattgggaagacattggtaccattgaagccttctatgaggctaatttagccctgaccaaacaacctagtcccgactttagtttttataacgaaaaagcccccatctataccaggggtcgttatcttccccccaccaaaatgttgaattccaccgtgacggaatccatgatcggggaaggttgcatgattaagcaatgtcgcatccaccactcagttttaggcattcgcagtcgcattgaatctgattgcaccattgaggatactttggtgatgggcaatgatttctacgaatcttcatcagaacgagacaccctcaaagcccggggggaaattgccgctggcataggttccggcaccactatccgccgagccatcatcgacaaaaatgcccgcatcggcaaaaacgtcatgattgtcaacaaggaaaatgtccaggaggctaaccgggaagagttaggtttttacatccgcaatggcatcgtagtagtgattaaaaatgtcacgatcgccgacggcacggtaatctag

SEQ ID NO: 26567 - DNA, 1011 bp, Synechocystis sp.
atgattaaagcctacgctgccctggaagccaacggaaaactccaaccctttgaatacgaccccggtgccctgggtgctaatgaggtggagattgaggtgcagtattgtggggtgtgccacagtgatttgtccatgattaataacgaatggggcatttccaattaccccctagtgccgggtcatgaggtggtgggtactgtggccgccatgggcgaaggggtgaaccatgttgaggtgggggatttagtggggctgggttggcattcgggctactgcatgacctgccatagttgtttatctggctaccacaacctttgtgccacggcggaatcgaccattgtgggccactacggtggctttggcgatcgggttcgggccaagggagtcagcgtggtgaaattacctaaaggcattgacctagccagtgccgggccccttttctgtggaggaattaccgttttcagtcctatggtggaactgagtttaaagcccactgcaaaagtggcagtgatcggcattgggggcttgggccatttagcggtgcaatttctccgggcctggggctgtgaagtgactgcctttacctccagtgccaggaagcaaacggaagtgttggaattgggcgctcaccacatactagattccaccaatccagaggcgatcgccagtgcggaaggcaaatttgactatattatctccactgtgaacctgaagcttgactggaacttatacatcagcaccctggcgccccagggacatttccactttgttggggtggtgttggagcctttggatctaaatctttttccccttttgatgggacaacgctccgtttctgcctccccagtgggtagtcccgccaccattgccaccatgttggactttgctgtgcgccatgacattaaacccgtggtggaacaatttagctttgatcagatcaacgaggcgatcgcccatctagaaagcggcaaagcccattatcgggtagtgctcagccatagtaaaaattag

SEQ ID NO: 26568 - DNA, 1203 bp, Synechocystis sp.
atgggtcgcgccaagaaagtcgttctcgcctattccggtggggtagatacatcggtttgtattccctatttgatgcacgaatggggcgttgaggaagttattaccctcgcggcggatttgggccagggggatgaactggggccgatccaggaaaaagccctgcggtgtggtgcggtagaatccttggttattgacggcaaggaagaattcgttaaggagtatgcttttcgttctatccaggccaatgctctctacgaaaaccgttatcccctctccacagccctagcccggcccttaattgccaaaatgctggtggaagcggcggaaaaatacggtgccgatgcggtggcccatggttgtactggtaagggcaatgaccaagtgcggttcgatatcagcattatggccctaaaccccaatttgaaggtgttggccccagcccgggaatggaaaatgagccgggaagaaaccatcgcctatggggaacggtatggcgtagaatcccccgtgaaaaagtcttccccctacagcattgaccgcaacattctcggccgtagcattgaagcggggcctctggaagaccccatgaccgagcccacggaagaaatttatctgatgaccaaggcgatcgccgacaccccagatgaaccggaatatgtggacatcggctttgaaaaaggtattcccgttagtttgaatggggtgatgctagaccccgttaccctggtggaacgcctgaacgaaattgcggggaaccacggggtaggccgtttggatatggtggagaaccgggtggtggggattaaatcccgcgagatttacgaagctccggctttgctagttttaattgatgcccaccgggatctggaaagtttgacccaaaccgccgatgttacccactataaaaacaccgtcgaagaaatttatagtcagttaatttaccggggattatggtacagccccctcaaagaagccctggatgcttttattgtcaaaacccaggaacgggttacgggcatggtgcgggtgaaattcttcaagggcaatgccaacgttgccggtcgtaaatccgattactccatctatgatgcggaattggccacctacggcatggaagaccaattcgaccataaggcggcggaaggctttatctatatttggggcttacccaccaaagtttgggcccagaaaatgcgcggttaa

SEQ ID NO: 26569 - DNA, 1068 bp, Synechocystis sp.
atggttgtcagcaccgttaatcccacagcgcccatgcctgtgacccccatttttaaccccactggcaacgattccgtcgagaaccgcaccatttggtttggcaacactaccaacttgatgcagttgaatgatgtccgctacaactgggcagtgggattgtatcaacaaatgcgggagaacttttggattccccagcgcttagacattacccaggatgtcaccgattactggaatttaaccaacgaagagcgttatgcctttgatggtattttgtcctatttaacctttcttgattctgttcaaacctgtaacattccccatttaaaaagtagcgttaccgcgccggaaattagcctgtgtatggcggagcaaatttcccaggagggtatgcataaccaaagctaccagtacatgatcgagacgattattcccacggaaaagcgggataaggtgtacgaattttggcgcacagaccgggtgttaaaggaacggtgcgagtacattgccatgctctaccaaaaatatgtcgatcatcccacccaggagaattattttattgccttgatggcggactatttgctggaaggattatatttttacaacggttttatttacttctataaccttgcttctcgtatgttgatgccgggttctgcggacatttttaagatgatcaaccgggatgagttgagtcacgtgcggctataccaaaagctaattcccgaagccatgcaggtcttcacccactccacggatcagatttatgaaatgtttgataaggcggtggagtttgaatgtcgctggactaaccacattgtcggtaataatattctcggtattacggaatctagtacggaacagtacactaagtatcttgctaatagtcgtctacgggcgatcggtttagatcccctttacacggatgctcgctacgggaaaagtccctacacccacttggagcgtttttccgacacgaaaaaagaggctcacactaaggcgaatttctttgaagcaacggtgactagttatgtgatgtcttctggggtatccggttgggacgaaatttag

SEQ ID NO: 26570 - DNA, 693 bp, Synechocystis sp.
atgtcaagccgttctgcggggcggaattcccccatccttcctttgatgagccactctgatttgcctttggctaacgctgtccccctcgataaaattcgctacaacgaccagggattagtgccggcgatcgcccaagactatttggacggcacggtgttgatgttggcctggatgaacgaagcagccctggcgaaaaccctagccacgggacaggtgtggtattggagtcgttcccgccaagaactatggcataagggagcaacctccggccactttcaaaaacttttgggcatccgctacgactgcgacagcgacgcattattactgaccattgagcaaaagggggacattgcctgccacaccggggaacggagttgtttccatcaactggacggccataaatcccctcccccagcggatatgttgacggaattggctcgggtcattggtgatcgccgggatcaccccacccccgaatcctacacctgtaaattattggcggggggagataataaaattctcaaaaaaattggcgaagaaagtgcggaagtggtcatggcttgcaaagatgatgacccggaagccatcgccggagaggtagcggatttgttctaccacaccctggtggccctagcccatcacaacgttgatctacgggccgtttatcgcaagcttggcgatcgtcgccgttaa

SEQ ID NO: 26571 - DNA, 1953 bp, Thermotoga maritima
atgacggttcagcagttcataaagaagcttgtgaggctcgtagagctcgaaaggaacgcggaaataaacgcaatgctcgatgagatgaagcggctctcgggggaggaaagagagaaaaagggtcgtgccgttctgggtctcacaggaaaatttataggagaagaacttggatatttccttgtgaggtttggaagaagaaagaagatagacacagaaatcggtgtgggtgatcttgttctcataagcaaaggaaaccccctcaagagtgattacacgggaacggttgtggagaaaggagagcgtttcatcacggtagcggtcgataggcttccatcgtggaagctcaaaaatgtgaggatagacctctttgcgagcgacatcacgttcagaagacagatagagaacctgatgacgctttcttcggaagggaaaaaagctcttgagtttctacttggaaagaggaagccagaagagtcgtttgaagaagagttcactcccttcgatgaaggattgaacgagagtcagagggaagcggtttcccttgccctcggaagttctgatttctttctcatacacggccccttcggcacgggaaagaccagaacactcgtggagtacataagacaggaagtagcacgtggaaagaaaattctggtcacagcggagagtaaccttgctgtggacaacctcgtggagaggctctgggggaaagtgtctctggtgagaattggccatccttcgcgcgtgtcctctcacctgaaggagtccacactcgcacatcaaatcgaaacaagcagtgagtacgagaaggtaaagaagatgaaggaagaactcgcaaagttgatcaaaaaaagggacagtttcacaaaaccttcaccgcagtggagaagagggctcagcgacaagaagatcctggagtacgcagagaagaactggagtgccaggggagtttccaaggaaaagataaaggagatggcagagtggataaagttaaacagccagattcaagatatcagggacctcatagaacgcaaagaggaaataatagcgagcaggatagtacgggaagcgcaggttgtgctttcaaccaattcgtccgcagctctggaaatactatcgggaatagtcttcgatgtggtagttgttgacgaggcctctcaggcaactatcccaagcatcctcattcccatatcgaaaggcaaaaagttcgtcctcgctggggatcacaaacagcttccacccacgatactctcagaagacgcgaaggatctttcgagaacactgtttgaagaactcataactcgatatcccgagaagtcttctcttctcgatacccagtacagaatgaacgaacttttgatggagtttccgagtgaagaattttacgacggaaaactgaaagcggccgagaaagtcagaaacataacgctcttcgaccttggagtggagataccgaactttggaaagttctgggatgttgttctctccccaaaaaacgttctggtcttcatagacacaaagaacagatctgacagatttgaaaggcaaaggaaagactctccctcgagagagaatccattagaagcacagatcgtgaaagaggttgtggaaaagcttctctccatgggggtgaaggaggattggatcgggatcatcactccctacgatgatcaggtgaatctcataagagagttgatcgaagcgaaagtagaagtacacagtgtggatggttttcagggaagggaaaaagaggtcatcatcatctcatttgtgcgttcgaacaaaaacggtgaaatagggttcctcgaagatctgagaagactcaacgtctcactcacacgggcgaaaagaaaactgatagcaacgggagattcgagcacgctctctgtccatccaacttacagaagatttgtagagtttgtgaaaaagaagggaacttacgtgatcttttga

SEQ ID NO: 26572 - DNA, 771 bp, Thermotoga maritima
atgctcgaaggcaaggtggcagtcgttacaggtggaggtcagggaatcggagccgcgatcgctcagctttttgcggaaaacggcatgaaggtagtcatagcagagatagacgaagaagcgggcgttgaaagagaagagatgttgagagaaagagggctggatgtcacattcgtaaaaacggacgttgcagatgaaaactccgtgaagaacatggtgagaaaaaccgtcgaaatatacggcggggtagacgttctggtgaacaacgcagccgtcatgtccgtgaagagcatcttcgaaagacctctcgaagaatgggagagagtgatcagggtgaacctcacggggccttacatctgttctcgatactgcgcggaagaaatgataaaacgcggtggcggagtgatcataaacatagcaagcacaagggcatttcagtcagaaccagacacggaaccctactcagcttcaaaaggaggccttgtggcactcacgcactccttggccgtgagtctttccagatatcacataagagtggtgagcataagccccggctggatagaaacatcggaatggaagaagaagtccctgagaaaaaaacccgatctgagacccatcgatcacgaacagcacccggctggaagagttggaaatcccttagatattgcccatctctgcgtctttctcgcggacgacgaaaaagcaggtttcataacaggcacgaacttcatcgtcgatggtggtatgacggtgaagatgatatacgaggagtga

SEQ ID NO: 26573 - DNA, 1551 bp, Thermotoga maritima
gtggagaggtgttctgttttgagaataaaaagacttcccgagagcctcgtcagaaaaatcgccgcgggtgaggtgattcacaatccatctttcgttctgaaagagcttgtagaaaacagtctggacgcgcaggccgacaggatagttgttgagatagaaaacggtggaaagaacatggtaagagtatccgacaatggaatcgggatgaccagagaagaggcacttctggcaatagaaccttacacgacgagcaagatagagagcgaggaagatctgcacaggatcagaacttacggtttcagaggtgaagcgcttgcttcgattgtgcaggtcagcagagccaagatcgtgacaaaaacggaaaaagacgcactcgcaacacagttgatgattgctggggggaaagtggaagaaatctcggaaacccacagggataccggcaccaccgttgaggtgagagatctcttcttcaacctacccgtccggagaaaatctctgaagtcctctgccatcgagttgagaatgtgtcgtgagatgtttgaaagattcgtccttgtacgaaacgacgttgattttgtattcacctcagatggaaagatagtccattcctttccaagaacacagaacatctttgaaagagctctcctgatccttgaagatctgagaaaaggttacatcacgttcgaagaggaattatccggcctgaggataaagggaatagtttcatcccgcgaggtgacaagatccagcagaacgggagagtatttctacgtgaacggtcgttttgtggtttccgaagaactccacgaagtactcatgaaagtttacgatcttccaaagagaagctatcccgtcgcggttcttttcatagaggtaaatccggaagaactcgacgtgaacatacacccttcgaaaatcgtggtgaaatttctcaacgaagaaaaggtgaaaaagagtttggaagaaaccctcaaaagaaatctggcacggaaatggtacaggtcggttgcgtacgaagaaatatcctcccgtgcgctgagcgtggcagaagcaccatcccacagatggtttttggtcaagggtaagtacgctgtcgttgaagtggaagatggtttgctctttgtggatcttcatgctctccacgaacgaacgatttacgaagaaatcctttcgaaaaaaagctgggggaaaagacgggtgaaaaggaacataacagttgtgctatcaagggaagaaaaacaaaaactggaagaatacggattctcctttcaaggagaagaaggagctttgaaagtcattgaaatccctgagttcctcaccgaagacgttgtggaggaatttttcagggacttcccagttgatgaaaaactgaaggaaagaatagcccttgccgcttgtaaacttgccactaaatccggagaattcgacgaagagatcgcatcgaaactgctggatgtctttttcaagaagcggtttgaaagatgtcctcacggaaggccgatttctttcaagatcagctatgaggacatggaccgatttttcgagcgttaa

SEQ ID NO: 26574 - DNA, 363 bp, Thermotoga maritima
atgatcttggtgaagaaattttcttttgaagccgcacacaatctgaccaggtaccttggaaagtgtgagagactccacggtcacacctacagactcgttgttaagatagaaggtcctctgaacgaagaagagatggtcatggattttgccgagctgaaaaaaatcgtcgaagagctggttatttctaaactcgatcactcgtatctcaacgacatgttcgaccagcccaccacggaaagagtagcgatatggatatgggatcagctctcaaaagagatggaaaaacgcggtgtcaggctccacgagatagaactgtgggagacagaaacgagcggtgttgtgtacaggggtgagaaggtttga

SEQ ID NO: 26575 - DNA, 1746 bp, Thermotoga maritima
gtgattttgagtccggagaagtttctgctaaggtacgctaaaaaatactggtatctttttcttgtaggaactgtactatctctgattctcacagtgatggaaatcctcccaccccgtttgatgaaaacggcgatagataagtttcttgtggaaagtactttatcttcgtttgagcgtttgaacggtattgtaataacggcctttataattttaggaattcgcgtcctttcctttctggtggggtttgcgagttcttatgtaacaggatacgcaggctcaaggatagtccttctgatgagaaaagatgtgttttcccatgtcatttcacttccgtattcttttttcacaggaataccttccggagtagttaccaccaggatcgttaacgacacacagaatatccaggagttcttctcttctgttgtgaccagtgtgattatggatgttctccttttgggagcggtcgttgtttctctcgtccagctcagtcgtgagctttttggccacgtctattaccttttgcctttgatcgtcatttcgatcctcctgttcagatacttcgacaggagggcttatcgtaaggtcagaaccaacctcgcccgcctcaacgccttcctggcagagcatatagcgggtatcaacgtgacaaaaatcttgaatctggaaaaacacaaagaaagggagttttccacagtggccacagagtattacaggtccttgatggagcagctttacgttttcggagtctttcgtccccttatggattttctctactttctgggagtgagtcttgttttatggtacggtgccaggtatatcgcgaataaaacccttggattcggttctctgtacgcttttgtatcttacctcgatatgttcttcaggcctctcagagacctttctgagaagtacgatataatccagaactccatggcatcctccgagaaaattttgaacctcttaaaagaagaaccagaggtcataggaaatccaaatggaccgaataagatttcaaaaggtcgtgttcgttttgagaacgtgtggttttcgtacgacggaaagaactgggtgctgaaggacataaacttggattttcaaccagggaaactgtacgcgatagtgggagaaacaggtggtgggaaatccactctcatgagcctgataaacggtctttacataccacagaagggaaatatattcatcgatgagattccgcttctggagtacaatttaaaactcgtgagaaaacagatagcagctgtcccgcaagatgtgctgctgtttagcggtacgatcctcgataatatcaggcttttcgatgagagcataccagaagaacgggttctcgaagcactgaaaagagttcatgctctggatataatagagaggttacccggaggtgtttattacgaaatagtcgaaagaggaaccactctctcagcaggcgaaagacaactcatagcgctcgcgagggccgttttatttgacgcgaagatcttcattcttgatgaagcgacgagcaacgtggatgttataacagagacaaagattcaggaagctttagaagagctttcgaaagacaggacagtgataatgatcgcacacagactctctactgtgaaagacgtcgatgaaatagtggtagtccacaatggtaggattgtagagaaaggcaatcactatgaactgttagagaagagaggattttactacaacctttacaagatacagttcgaaaatgcgtag

SEQ ID NO: 26576 - DNA, 1020 bp, Thermotoga maritima
atgaaggtggtaacttttggagagatcatgttgagactctcaccaccagatcataagaggatcttccagacagacagcttcgacgtcacctacggcggagcagaagcgaacgtagcggcttttcttgctcagatgggactcgatgcgtactttgtgacaaaactaccaaacaacccgctgggggacgctgcagcaggacatctcagaaagttcggtgtgaagacagactacatagcaagaggtggaaatcgaataggtatttacttccttgagataggggcttctcagagaccgagtaaagttgtctacgacagagcacactctgccatttctgaggcaaaaagggaagacttcgactgggagaaaattttggatggtgcgagatggttccacttctcaggaattactcctcctcttggaaaagaacttcctctcatccttgaagacgctttgaaagtcgctaatgaaaaaggtgtgacggtgagctgtgatctaaattacagagcaagactctggacaaaagaagaggcacagaaggtgatgattccattcatggaatacgtggatgttctgatcgcaaacgaagaagacatagaaaaagttcttggcatctcggttgaaggtctcgatcttaagacaggaaaactgaacagagaagcgtacgcgaagatagcagaagaagtcactaggaaatacaacttcaagacggttggtatcactctcagagaaagcatatccgcaactgtgaattactggtccgtcatggtttttgaaaatggtcagccccatttctcgaacagatatgaaatacatatcgtggacagagtgggagccggagacagctttgcaggagctctcatctacggaagtttgatgggatttgactcgcagaaaaaggccgaattcgcggcagccgcttcctgtctcaagcacacaatacccggggattttgtggtgctcagcatagaagagatagagaaactcgcgtccggtgctacctccggtcgagtggaaagataa

SEQ ID NO: 26577 - DNA, 1044 bp, Thermotoga maritima
atgaaaatattaccttctgtgttgatccttttgttgggatgtgttccagttttcagctctcagaatgtatctctgagagaactcgcagaaaagctgaacatctatattggttttgccgcaatcaacaacttttggtctctttccgacgcagaaaagtacatggaagttgcaagaagagaattcaacatcctgacccctgagaaccagatgaagtgggatacgattcatccagaaagagacagatacaatttcactcccgctgaaaaacacgttgagtttgcagaagaaaacgacatgatcgtgcatggacacactcttgtctggcacaaccagcttcctggatggatcactggtagagaatggacaaaggaagaacttttgaacgttcttgaagaccacataaaaacggtggtgtctcatttcaaaggtagagtgaagatctgggatgtggtgaacgaagcggtgagcgattctggaacctacagggaaagcgtgtggtacaagacgatcggtcctgaatacattgaaaaagcgttcagatgggcaaaagaagccgatccagatgcgattctcatctacaacgactacagcatagaagaaatcaacgcaaaatcgaacttcgtctacaacatgataaaagagctgaaagaaaagggagtacctgttgatggaataggatttcagatgcacatagactacagagggctcaattatgacagtttcagaaggaatttggagagatttgcgaaactcggtcttcaaatatacatcacagagatggatgtgagaattcctctcagtggttcggaggagtattatttgaaaaaacaggctgaagtttgtgcgaagatcttcgatatatgcttggacaaccctgcagttaaagcgatccagttttggggattcacagacaaatactcctgggttcccggctttttcaaagggtacgggaaagcgttgctcttcgatgagaattacaaccccaagccttgttattacgcgataaaagaggtgctggagaaaaagatagaagaaagaaaatga

SEQ ID NO: 26578 - DNA, 1266 bp, Thermotoga maritima
ttgggtaaactggtcgttcagggtggcgccgttctcgaaggagaagtggagatatcgggttcaaaaaacgctgctcttccaataatggcagcagcgattttgtgtgatgaggaggtaattctcaaaaacgtaccgagactccaagatgtcttcgtcatgatagacatcctgagatccattggattcagagtggaattcgaggagaacgaactgaagatcaaaagagaaaacgatatctcacaggaagtgccttacgaacttgtcaggaagatgagggcgtccttcaacgtgctcggtccgatcgctgtgagaactggaagagcgaaggttgctcttccaggtgggtgttccataggagtcagacctgtggactttcatcttgaaggcctcaaaaaaatgggattctcgataaaagtggaacatggctttgttgaagcctgctttgaaagaagaatcgattatgtgacgattacccttccttttccaagcgttggtgccacggagcacctgatgaccacagcggctctcttaaaaggtgcccgtgtagtgattgaaaacgccgcaatggaacctgaaatcgtagaccttcaaaatttcataaacagaatgggtggacatattgaaggagccggaaccagccggatagtgattgaaggcgtggagaaaatgcagggagttgaatacagcatcattcccgatcgaatagaagctggaacgtacctggtagccatcgcagcaagtcgtggaaaaggtctggtgaagaatgtaaacccggatcacctcacaaacttttttgagaaactggaagaaacaggggcgaaacttaaagttcttggaaacgaagtagagatcgaaatgagagaaagaccaaaagcggtggatgttacaacgaatccgtaccctggttttcccacggatcttcagcctcagatgatggcgtatctatcgacagcgtcgggagtctcggttataaccgaaaacgtcttcaaaacgaggttcttacacgtggacgagttgaaaagaatgggagcggacatagaagtttctggaaacgtcgccatagtgaaaggcgttgaaaaactcagcggtgcccccgttgagggaacggatctcagggcaaccgctgcccttctcatagcgggaatcatagcagatggagtcactgagataagcaacgtcgaacacatattcagaggttacgaagatgtcatagacaaattcagtgaactgggagcaaaaatcgagtatgttgaaaaagaaaattga

SEQ ID NO: 26579 - DNA, 1164 bp, Thermotoga maritima
atgttcaaaatttcgttctatcttccaacggagatcattttcagggtgggagcggtggacgaactggaagaaagggcaaaaaagctcggaaaaaaggcattgattgtgacaggacgatccagcactaagaagaccggccttttgcagagggtggtagatcttctcaagaaagcgggagtggaaagtttcgtcttcgacaaaatagttcccaacccgatatcggatcacgtcgatgaggctgcagaaatcgtgagaaaagagaagatagatttcatcataggacttggtggaggaagtcccatagacagcgcaaaagcgatctctatcaccgctccgaacgaaggaaagttctgggattacgttcccgtaggtggtggaaagattccagaaaaatccatccccgttgttgctatacccaccacacacggaacgggaaccgaggcagacccatttgcggtgattacaaatcctcaaacgaaagaaaaagtgggaataggctatagaaacacctttcccgttctctcccttgtggatcctgaagtgatgaagacactaccgaaagaccagaccgcgtacacctctatggatgcgttctatcacgctatagaagccttcctcaacgtgaatgcgaatccttactcggatgttcttgccctggacgccatgaaaagaatcgtgacttaccttcccgttgcttacgagaatggagaagatatggaagccagaacgaatctcgcctgggccagtactgaagcaggaattacagagactctgactggtgtgatcgcaaaccacgcgctggagcatggtctcagtggtttctatccagaaataacccatggtcttggtctgtgcatcacaggtccgtacctgttcgagtacatcttcgatcacgcctacgagagactcgccatcgttggaagggaagtgtttggcgtttacgaaacagacgatagaaaagctggaaggctcgctatcaagaaactgagagacttccaggagatgttcggtctcaacaagagactcagtgaactgggtgtgaaaaaagaggatattccaaagatggcagaaaccggctacaggatactgaatggagtggttgtcgtaactcccggtaacctaaccgcaaaggatatggaggagatattcaacaggtgttactga

SEQ ID NO: 26580 - DNA, 1563 bp, Thermotoga maritima
gtgtttcccctcctcgctttccggggtgatcgaatggagatactgaaagcaaagggcatagtgaaaagattccctggagttgtggctgtggacaacgtcgattttgaggtttacgaaaacgagattgtctctctgataggtgaaaatggtgctggtaaatccaccctcataaaaattctgacgggtgtcctcaaacctgatgcgggagaaattctggtcaacggcgaaagggtagaatttcactctccggtcgacgcgttcaaaaagggcataagtgttatccatcaggagctgaacctgtgcgacaacatgactgtggcggaaaacatctttctcgcctatgaagctgtcaggggacagaaaagaaccctttccagtagagttgatgagaactatatgtacacaagatctaaagaactgctcgatctcatcggcgccaagttctctccagatgctctggtgagaaacctcaccaccgcccagagacagatggtggaaatatgtaaggcactggttaaagaacccaggatcatcttcatggatgaacccacatcgtcgcttactgtcgaagagacagaaagactcttcgaaatcatagaaatgttgaaaagtagaggtatttctgttgttttcgtttcacatagactggacgaagttatgaggataagtgacaggatcgttgtgatgagagacggaaaaagaatcggcgagttgaaaaaaggagaattcgatgtggacacgatcataaaaatgatggtaggacgtgaagtggagtttttcccacacggaatagagaccagacccggagaaattgcccttgaagtcagaaacctgaagtggaaggataaagtgaagaatgtttcttttgaagtgagaaagggagaagttctgggattcgcgggacttgtgggggctggaagaactgaaacgatgctcttggtgttcggagtgaatcaaaaggaatccggagacatatacgttaacggaaggaaagttgaaataaaaaatccggaagatgctattaagatggggataggactcattcctgaggacagaaaacttcaggggcttgttttgagaatgactgtgaaggacaatatcgtgctcccatcactgaaaaaaatcagcagatgggggctcgtgctcgatgaaagaaaagaagaagagatctcagaagactatgtaaaaagactctccataaaaacgccttccatttatcaaataacagaaaatctatcaggtggaaaccagcagaaagtggtccttgccaaatggctcgccacgaacgcggatattctgatcttcgacgagccaacacgcggaatagacgttggtgcaaaggcagaaatacacaggatgatcagagaactcgccgcacagggcaaagctgtgatcatgatctcttcggaactcccagaaatactgaatctcagcgatagaatagtcgtcatgtgggaaggtgaaatcacagccgttctggacaacagagagaaaagagtcactcaggaagaaataatgtactacgcatctggacagaaaaaacagaacgggagggtcgcataa

SEQ ID NO: 26581 - DNA, 1479 bp, Thermotoga maritima
atgaacctgtacgtgggactcgatgtgggaacgaccggtgtcaagggaattcttgtgaacgagaagggagagattcttgcaacagcgaatgaaagactaaccatgttcactcctcagcctgcctgggcggagcaggatcccctctcctggtgggaggcggtgaaaaaaatactgaaaaacctctccgaaagatcgaaagaaatgggcggcaaaataagagcgatctctaccagcgggcagatgcacagtcttgtggcaatcgatgacaacggtaaagtcctgagaaacgctatcctctggtgcgatcagagaacatacaaagagtgcgaagaagccacccagatcctcggcggagaggaaaacgttctcaagctcgtcggaaatcccattttgcccggtttcacgctcccaaagatactctggatccgaaagcatgaacctgagatctacggaaaaatttcaaaaatcatgctgccaaaagatttcataaactacatgctcaccggtgaggtgaaaacggagcattccgacgcctccggaacggtgatgtacagtgtgtcaaagatggaatggaacaaggacgtattgaaagaactcaacataccggaaagtgttctcccagagataataccgtcgaacggcgtggttggaaatgtgaaacctgaagtagcgtcggatctcggtctctccgaagacacgcttgtgataggcggaggagccgacaacgcctgtgcagctcttggaatagccgtcgtagaaccgggtgacgtgatggtgagtcttggtacttcaggaaccgttctggcacccacaaaagggaatcagcccgatccaaagggtagagtacatttctttgcacacaccgttccagaaacaagataccacatgggtgtgatgctctccgctacctattcactggagtggttcaaggaaaaattcctgagcgaagattacgaaacaatcaacgaagaggtggataaaattcctgcaggatcaaacgggataatcttcctgccgtatctcaacggtgaaaggacaccacacagagatccattcgcgaggggtgttttcttcggtatatcctcgtacaacaccaagtgggatatggtgagagccatattcgaaggcgttgccttcggtatcaaagattcgttcgatatactgagagaactcaaggtggttctcaacagtgtgagaattacaggaggaggttcaaagagcagggtatggaacaaaatgctcgcagatatgacaggattgagaatacaaaaaccagccgtggatgaaggggcgtcttacggtgcagcgatcctcgcagtgtctggctcaatgggagaaaatcccgcgaaaatttcgaaagaatggtttcgcgtgaagagttacactgaccctgctgttgaaaacacagaaacctacgaaaaactacacgagaaattcaaaaaactctacacatctctcaaagagatgttcagatcttga

SEQ ID NO: 26582 - DNA, 2484 bp, Thermotoga maritima
atgaaattgtccgatttgatctcaaggtggatcgacgttgaaccttcaaaaaatgctcagataattctcagagacaggtatttcatgaaggatctggatgggaattatctggaaacgaaatgggaagatgtggcaagaagggtggcgagagttgtagcaacagcagagcttctgaacccatcgtacaagaagaacgaaaaactcgacagaataaaggaatgggaagacatcttcttcagagttttgaaagcgagactcttcattccaaacagtcccaccctcttcaacgcaggactcggtgtgaagcacgatctcctgtggaaacccatcgatcagatgacactagaagattacgaagaaatttacagatcgagaaatcatcttcatatgctctccgcatgcttcgtagtacccgtcggcgatagcattgaagagattttcgaagcggtgaaagagtacgcgctcataacgaaagtgggaggaggagtgggaagcaacttttctgagttgaggccgaagggcagctttgtggcaggcacacacggaaaagcgtccggtcccgtttctttcatgcacgtcttcaactccgccatctccgttgtgaaacagggttacagaaggcgcggggcactgatgggcatcttgaacataaaccaccccgacatagaagaattcatagacgcaaagaaagaaaacacgggagaagcggtgctgaacttcttcaacctctctgttggatttccaatggacaagaaagagattctgaaactctacgaagaagatggcgaactcgagctttcccatccaagaagcacgatcaggaagaaggttaagatcagagaactcttcagaaagatcgctacaaatgcctggaagagtggagacccgggacttgccttcctcggagagatgaacaaatactatccactctacccgcacagaaagatcaactcgaccaacccgtgcggtgagatcgggctttcagattacgaagcctgcaacctcggttccatcgatgttgcaaagttctacaacaatggttttgtggatttagaagcgcttcaggaactcgttcagatagccgttcgtttcctcgacaacgtcatcgacgtgaacgtgtttcctatagacaagatcacaaaagcagtcaaagagagcagaaggctcggtcttggaataatgggatttgccgatctcctctacaagctcgaaattccttacaattctcaggaagctcgtgatttcgcggccaatctcatggctttcatagcgctccacgcgcatagaacttcctatgaactcggaaaagaaaaagggaacttcccgctccttgagatctcgaggtacagaacggaagacaatttcgtgcctttcgctatgggtatgagcaactacgacgatgaaataagagaagtcatgaagatgacaaaagagtttagaagaaacgtcgctcttctgacgatcgcacccaccggttcgatctcgaacatagcggacacttcgtcgggactggaaccaaacttcctcctcgcgtacaccagattcgtgacgaaggaagacggaacgaaagagcctcttctctacgtgaaccaggtgctcagagagaaattgaatccggagattctcaagaggatagagaaagaactcatagagaagggaagcttgaaggatatcccggatgttccagagaagataaagaaggtcttcgtagtcgcactcgatatagatccaatggatcacctcctcatgcaggatgccttccagaggtacgttgataacaacatctccaaaacgatcaacatgcctcagagcgcaaccgtggatgatgttctcaacgtgtaccttgaagctctcagaacaaacgttaggggcatcaccgtgtacagagacggttctttacaaacacaggtgctgacgaaagccttgaaaacaccggaggctccaaaggttcagttcttcgtcgtcgatgagaagctgaagctccatccgagaccgagaaaagatactctcagaagcgtcacgagaaagtacaagaggcccgatggcaccacttacataacgatatccttcgacgacacaggagaagcggtggagatattcatttccaacggcagtgagatggccgaagcgataggaagactctcctcaatagctctcagagcgggagtttccatagatgaaatagtagaacagctttcgaaggtgaaaggagagtactgcaagggtctagctgaagaaatcaagaaagcgcttgaagacttcgcaaaactgtggctcagaacgggtgaagaagcaccagagagtgaggaagaaccgatcgaaagagaaaagttcatagtggcgcacaacctcagatggcaaagcggttactacgtggatgacgaaggaaacgtgtactgtcccgtttgtctctcaaagaattccctgataaagcaagagggatgcgtgagctgtaagaactgcggctggtcaaagtgtgagtga

SEQ ID NO: 26583 - DNA, 618 bp, Thermotoga maritima
atggtcagagtgaaaatctgcgggataacgaacctggaagatgcactgttttctgtggagagtggtgctgacgctgtgggattcgttttctatcctaagagcaaaaggtacatctctcctgaggatgccaggaggatttctgttgaattacctcctttcgtttttcgtgtgggggtctttgtgaacgaagaaccagaaaagattctggatgtggcctcttatgttcagctgaacgcggtccagctacatggagaagaaccgatcgaactgtgcagaaaaatagcggagagaatcctggtgataaaagcagttggagtttcgaacgaaagggatatggaacgtgctttgaattacagggaatttccgattcttctcgatacgaagacaccggagtatggaggaagcggaaaaacgttcgactggtctctgatcctcccgtacagggaccggttcaggtatctcgtgctatcgggaggtttgaatcctgagaacgtcagaagtgcgatagacgtggttagacctttcgcggtggatgtgtcttccggtgttgaggcctttccgggaaagaaagatcacgattcaataaagatgttcattaaaaatgcaaaggggttgtga

SEQ ID NO: 26584 - DNA, 1821 bp, Thermotoga maritima
atgtgcggaatagtggggatggtcggtgagaatttgaaactcgaagatcttgtgacatcacttcagaagctcgaatacagaggttacgattcagcgggtatcgcttatttgggtgatagtttcggagtgtacaaaaagaagggaaggatagatgttctaaagaacggactcaaacaaaagctgaacgatagattcttcgttgggatcgctcacacaagatgggccacacatggtgagccgaacgatatgaatgcccatcctcatatggattgtaaggaagaaattgcggtggttcacaacggcataattgaaaattatagagaaataagggagtttctggagcaacgaggacacgttttttcgtcggaaacggataccgaagtgatcgctcatcttgtggaagaagagttcgaaggcgatctgcttgatgccgtcctgaaagccgtcaagaagttgaaaggagcctacgcgatcgcggttgttcacaaaaatgttcctgacaccattgttgctgcaaggaaaggcagtccccttgttgccgggattggaagcggtgtggggattctcgcgtcggatgtgactccccttttgaggtttacaaaagacgtcgtttttctggaagacggcgacgtgatggttttgagaaaggatggatttgagatttacaacacggacggggtgaagcagcagaggagagtttaccacgttaactgggatgaaaaagcggcagagaagggtggatacaaacacttcatgtacaaggaaataatggaggatccgcaagctcttgtgaatgcactcgttggaagagtgaagaacgatcgaccattttttgaagagctcgagtactacgaagagcttctaaagaatgcagatagaatccgtgtggtgtcgtgtggaaccagttactatgcagggttggtgttcaaatatttcctggaaaatcacacggatatagatgttgaaatcgaggtctcttctgaattcagatacaagaggcctcacataaaggaaggagatgttctgatagccatctcacaatctggggaaacggcagatacccttgaatctgttagacttgccaagaaacacggtgcaaagatcgtttcaattgtgaacgtggtaggttccacactcgatagggaatccgatgtgacgctcttcatgaacgcgggtcccgaaataggagttgccgcgacgaaaacctacgtggctgaacttgcggtgttgtatctcctcgggctgaagataatggagataaacggctactgggatagggaagcagaagagattctggacaagctcgttcgtatgccagaacttctggagaacgtgctgagaaaggatcctcagataagggagctttctgaaaaatacaaagattacaggaacttcatgtacataggaagaggatacggttatcccactgcactggaaggcgctttgaaactgaaggaaataacgtacatacatgccacagcctatcaggcgggcgaactcaaacatggtcccatagcccttctggatgttgattttccagttttcgctgtgatgccggacgatagtctgttcttcaaaaccaagagcaacgtgatcgagtctaaatcgaggaatgcacctgtgattgttctgggaacggagggtaacagaagtctcgaagagatcacaggtgatatcattcatgttcccccaacccatgagagtctctatccgctcatgatggctccggttatacagctgtttgcttatcatatagcggatttgaaaggactggatccggataagcccagaaatcttgcgaagagtgtcactgtggagtga

SEQ ID NO: 26585 - DNA, 819 bp, Thermotoga maritima
atgaagaaggagaaagttgaagaaagaatacgcgagattttgaggcctggatgggatcttctcacagaagaagccatgctgtactccgcgacggttggaggaaagaggatccgtcctctcctcgtcttgacactgggtgaggatttgggagtggaagaggaaaaacttctcgatgtggcggtggccgttgaactctttcacacggcttctctgatacacgatgatcttcccccaatagataacgcggattttcgaagagggaagccttcttgtcacaggacctatggtgaagatatcgcccttcttgcgggagatggtctgttcttcctcgctttttctcagatatctaaaatcggaaattcaaagatttttgaagagttttcggaaacggcctacaaacttcttttgggggaagcgatggatgtggaattcgaaagaagaaagatggaagtctcgcaggagatggtggagagaatgtacgctttcaaaacgggagcgctatttgctttctgtttctcagctccatttatcctgaaaggaaaggatcacaccaagatgaaactcctcggagagaagttcggggtggctttccagatatacgacgatctgaaagacattcttgggtctttcgaaaaggtgggaaaggacctcggaaaagacacagaaaaagtgacgcttgtgaaaaaggtggggattcagaaagctcgtgagatggccgataagtattatgaagaagttttgaaaggtatcgaatcagaaggtctctttcgcacgctgtttcttctgaaagaactcaaacagatggtggaggagagatga

SEQ ID NO: 26586 - DNA, 1293 bp, Thermotoga maritima
atggcatacctcgaagttctcaggtatctctaccacaaaagacctatgggaaaggtgaaaccaggtcttgagaggatctcaatgctactttcaaagctgggaaatccccatctggaatacaaaaccatacacataggtggcacgaacggaaagggttctgttgcaaacatggtcagtaacattctggtatctcaagggtacagagtgggatcatattactcccctcatctgagcacgttcagagaaaggataaggttaaacgaagagtacatatccgaagaggacgtggtgaagatctacgaaacaatggagccgattctgaacgagctcgacaaagaagaaatattctccccaagcttttttgaagttgtaacggcgatggcttttctctatttcgcggaaaaaaacgttgacattgccgtcctggaagttggtcttggaggcagactggacgcaacgaacgtggtgttccctctttgttccaccattgtcacggtggacagagatcacgaaaaaacgttgggatacaccatagaacagatcgcatgggaaaaatccggaataataaaagaaagagttccccttgtgacaggggaaagaaaaagagaagccctcaaagtgatggaagatgttgcccgaaagaagagctcaaggatgtacgtcatcgacaaggatttttccgttaaggttaaatctctgaaacttcacgaaaacagattcgattactgtggggaaaacaccttcgaagatctcgtcctgaccatgaacggtcctcaccagatagaaaacgccggtgttgccctgaagactcttgaagcaacaggacttccgttgagcgagaaagcaatacgcgaaggcttgaaaaatgcgaagaatctgggaagatttgaaatcttagagaaaaacgggaagatgtacatcctcgatggagcgcacaaccctcacggagcggaaagccttgtcagaagcttgaaattgtacttcaacggcgaacccttgagcctggtaataggtattctggacgacaagaaccgggaggacattcttcgaaagtacaccggaatcttcgaaagggtcatagtcacccgtgttccttcacctcgtatgaaagacatgaacagccttgttgacatggcaaagaaattcttcaaaaacgtggaagtcatagaagatcccctggaagcgatcgaatctactgaaagagccacggttgttacaggatcactgtttctagtgggatacgtaagggagttcctgacaaccggaaagataaatgaggagtggaaactatga

SEQ ID NO: 26587 - DNA, 1215 bp, Thermotoga maritima
atgaacacaggtgaaatgaagataaactgggtttccagatacatgccccttctgaacaaaatcgccgaggagtattcgagagaaaagccgctgtctggtttcaccgttggaatgagcatacaccttgaagcaaaaacggcctatctcgcgattactctgtcaaagcttggagcgaaagtggtgatcacaggaagcaacccactttcaacacaggatgatgtggcggaagcgctcagatcaaagggaataaccgtttatgcgagaagaacacacgacgagagcatctaccgggaaaatctcatgaaagttctcgatgaaaggccagacttcataatagacgacggaggagatctcacggtgatttctcacaccgaaagagaagaggttctcgaaaatctcaaaggggtatccgaagaaaccacgacgggtgttagacgtttaaaggcattggaagagacaggaaaattgagggtgcccgttatcgctgtgaatgattccaagatgaagtatctcttcgataacagatacgggacgggtcagtccacatgggacgccatcatgagaaacacgaaccttctcgttgctggaaaaaacgttgtggtggcgggatacggttggtgtggacgagggatcgctctccgtgcagcgggactaggagccagggtgatcgtgacagaagttgatcctgtaaaggccgtcgaagcgatcatggacgggttcacagttatgcctatgaaggaggccgtgaagattgccgactttgtgataacggcctcaggaaacaccgacgttctctcaaaggaagatatcctttcactcaaagacggggcagttctggcaaacgctgggcatttcaatgtggagattccggtgagggtactggaagaaattgcggttgaaaagttcgaagcacggccgaacgtgacaggatacactctggagaacggtaaaacagtctttcttcttgcggagggaaggctggtcaacctggcagcgggagatggccacccagtagaaataatggatctgtcctttgcacttcagatcttcgccgtgctttatcttcttgaaaatcacagaaagatgtcaccgaaggtttacatgctcccagatgaaatagacgaaagagtggccaggatgaaactggattctctgggagtaaagatagatgagctgacagagaaacagaggaggtatctgagaagttggcagtga

SEQ ID NO: 26588 - DNA, 1290 bp, Thermotoga maritima
atgagggtgaaatacttcggaaccgacggaataaggggaatctttggtgaaacactcacagatgagctggccttcaaggtgggcaaagcgctgggagagattgtcggagaagggaaagttatcgtgggaaaggacacgagggtttcgggggattcgctcgaagcggctatttccgctggcctcacgtccatgggggtggacgttcttctgtgcggcattcttccaacgcccgcggtggctctcctcacgaggatcaccaggtcgttcggtgttgtcatttcggcttctcacaatcctccagaatacaacggcataaaggtgttgaagggtggatacaagataccggacgagatggaagcagagatagagaagagactggaaaacgggagtttcttaacccgctcggttgtcggcaggacaaaatcgtttagagaaggaagggacatgtacatcggagcggtccttgaaatgttcagggatctcgatctcacaggtgagatggtatccctggaccttgcgaacggtgccacaacgacaactgccagagaggtttttgaattccttggagcgaaagtagaggtgttcaacgattcccaggacggactcctcataaatcaaggatgcggagccactcatcccaggtttttggccgaagagatgaagaacgggaaggtgggattcaccttcgatggtgatggagaccgtgtgatagctgtagacgaagaaagaaacgttgtgaacggagataggatcatagggatcctcgcagttgggttgaaagaagagggacgtctaaacagcgataccgtggtgggcaccgttatgacgaatggaggcctcgaagattttctcaaagaaaaagggataagacttcttcgaacgaaagttggagacaaatacgttcttgaaaagatgctcgaaagtggagcgaatctgggaggagagagatccggtcacataataatcctcgacagaagcactacgggagatggtttgataaccgctttggagctgatgagagtcctcaagcgatcgggaagaaagctttctgatttcgcgaaggagataccagattatccgcagatcacaaagaacgtaaggagaacggagcgaatgtctctcgaaaatgagaatctgagaaagatcgttgaagagagcacttccaggggctaccgtgtggtgataagaccgtccggtacagagcccgttataagaatcacggttgagggaaaagacagagaggagatagaaaagatcgtggaggagatttcaagggttctcgagagttga

SEQ ID NO: 26589 - DNA, 2463 bp, Thermotoga maritima
atgtttgataagttctcggagaagacagctcagatatttgtaacagcccaggaggaggcaaaagaactcgggcattcgtacgtcggaacggagcaccttctgcttgcaattctaaaagtagatagaagcccggccgtcgaactcctggaagaaatgggagcctcgtactccaaggtgagatccgagatcatctccatggttggcatggggatgagaggctttgtcccttctcctcagatgactccaagagccaaaagagtgactgaactcgcatacgaagaggcgaagattcttggaagtgacaagataaacccggagcatcttctccttggtattctgagagagggagaagggattgcaatacacattctgaggaaactcggagtagatatcgctactctgagaagagagatcatagatatctactcctactcctcgaacaaaaatctggagtatgaggaagaggaggattacacttacagaagcgtgaagcaacttgaaggcttcggtgtgaatctcacagaacttgcagctaagaaagaactcgacccagttattggaagagaagaagaaatagagagagtgatgcaggtcctcgtcagaaggaagaaaaacaatcctgttctcataggagatcctggagttggaaagacagcgatagtcgaaggtctggctcagaggatagtcgctggagatgtgcccgagatcttgaaaaacaaggtgatcttctctcttgacgtggcagcgctggttgcgggaaccaaatacagaggtgaattcgaaaagaggatgaagaagctccttcagatcgtgaccaaggataagaacattatcctcttcatagacgagatacacaccatagttggtgctggatcggctgagggagcaatcgatgctgcgaacattttgaagcctgctctcgcacgtggagagataagctgtataggtgccaccacaccggacgaatacagaaggtacattgaaaaggatgcggctctggagagaaggtttcagaagatatatgtgaaagaaccaactgaggaagaaacgctcgaaatattgaaaggtttgaagagaaaatacgaagcgcatcataaagtgatttataccgacaaggctctggaggcggccgtttacctttccaagagatacataaccgatcactatctacctgacaaggcgatcgatgtgatagacgaggcaggtgccagagcgagattgaaggtgttcgtgcttcctccagaactgaaggatatgaagctagaactggaaagaataagaagcgataaggagctcgctgttctgaaccaggattacgaaaaggctgcacaactgaaagaagaagagatggagctggaggcggaatacagaaaaaggtacgcagagtggagaagacgcgcagaaacagctgtggtaaaggtggatgtagacgacgtggctgaagtggtgtcttcctggacgggtgttcctctcagaaagatcgaggaaacagaagtcgaaaagcttctcaatctcgaagaggctctccaccagagaatcgttgctcaggacgaagccataaaagctgtagccagggccataagaagagcaagaagcggtttgaaggatccaagaaggccgataggtgtgttcctgttcctcggtccaacgggtgttggaaagacagagcttgcaaaggcgctcgcagagtacctgttcggggatgaaagggccctcatcaggttcgacatgagcgaatacatggagaggttctccgtttcgaggctcataggagcacctccaggatatgtgggttacgaagagggaggtactctcacggaaaaagtgagaagaagaccgttctcggtgatcctgttcgacgaaatagagaaagcacatccggacgtgttcaacatactgctccagataatggacgatggaagactcacggattcccagggacgtgaagttgatttcaggaacacgatcatcatcatgaccagcaacatcggaagctcttacatcaacaaatccaagagaactcttgggtttgtgggtgacaacaacgaagagaaggaattcgagaaaataaaggatctcgttctggaagaggtgaaaagaacgttcagacctgagttcctgaacaggatcgatgaaacgatcatattccatccgttgaagaaggaacacatcgaacagatcatcgacatactcttgagagacctcagaaagagactctcggagaagaacatgaagcttgtactgacaaagagtgcaaaagagttcctggtcgaaaaaggattcgatccggtgtacggagcaagacctctgaagagggccatacaaagatacgtggaagatcctctctctgaggagatcctgagaggcaagttcaacgaaggagatacgatcgtctgtagggctcgcaaagatgctcttcgattcaccagaaagggtgaaaagaaggagaaggtggtccagtga

SEQ ID NO: 26590 - DNA, 516 bp, Thermotoga maritima
gtgatgataaaggtgctgatagacgaagagactctcaagaagagaatcaaggaactggcacgggaaatagaagagtactacctgggtaaaacagacaccatacacgctgtatgcatcttgaagggatccatacacttcttcagcgacctcatgttgaacataaggaaactgaacgtcaaatactctttcattcatgtctcgagctatcagggtacctcttcaacgggaaagattagagtgaaatcctggatcgatgaatcgatacacgatgaatacgtgctccttgtggaagacatcgttgacaccggtctcaccttgcagcacatagtccgatacctgaaaaaatacaatccaagagatttcaggatagtgagtctcatagaaaaaaccgtccacgatcatggaattcctctggacttcgtgggattcagagtggatgataaattcctggttggttacggtctcgacatcgatgaaaaataccgaaaccttccctacataggctatgtggaataa

SEQ ID NO: 26591 - DNA, 1401 bp, Thermotoga maritima
gtgcgaagtacaaagatcgtatgtacggtcggaccaagaacagacagctatgaaatgatagaaaagatgatagaccttggagtgaacgtcttcagaataaacacctcacatggtgactggaacgagcaggaacagaaaatactcaaaataaaagatctgagagagaaaaagaaaaaacccgtagccattctgatcgatcttgcggggccgaagatcagaaccggatacctcgaaaaagagtttgtggaattaaaagaaggccagatcttcactctcaccacaaaggaaatacttggaaacgaacacatagtctcggtgaatctcagctctcttccaaaggacgtgaagaaaggagacaccattctgctgagcgatggagagatagtgcttgaggtaattgaaacaaccgatacagaagtgaaaacagtggtgaaagtcggtggaaagatcacacacaggagaggtgtgaacgtaccgacggccgatctttcggtggaatccataacggacagagacagagaattcataaaactcggaacgttgcatgacgttgaatttttcgctctttcttttgtgagaaagccagaggacgtgctcaaggcaaaagaagagatcagaaaacacggaaaggaaatacctgtaatctccaaaatagaaacgaaaaaggctctggagcgtctcgaggagataataaaggtgagcgatggaatcatggtcgcacgcggtgacctgggagtggagatacccatagaagaagtccccatcgttcagaaagaaatcatcaaactctccaagtactactccaaaccagtcatagtcgcaactcagatactcgaatcgatgatagaaaatccgttccccacgagggcagaggtcaccgacatagccaacgccatcttcgatggagcggacgccctgctcctcacagcggaaacagcggttggaaaacatcccctggaagccataaaggtgctgagtaaagtagcaaaagaagccgaaaaaaaactggaatttttcagaacgatagaatacgataccagcgacatatctgaggctatatcacacgcctgctggcagctctctgaatctctgaacgcgaagctgatcatcacacctaccatatccgggagtaccgctgttcgtgtttcaaagtacaacgtttctcaacccattgtggccctgacaccagaagagaaaacctactacagactttctctcgtgaggaaggtgatacccgttctcgctgaaaaatgttcccaggaattagagtttatcgaaaaagggctgaagaaagtagaagaaatgggtttggcagaaaaaggggatctggtggttctcacttccggcgttccaggaaaggtgggaacgacaaacaccataagggtgttgaaggtggattga

SEQ ID NO: 26592 - DNA, 960 bp, Thermotoga maritima
ttgaagaagatagcagtacttacaagcggcggagacgcacctggaatgaacgcagctgtgagagccgtggtcaggtacggtgtcaggcagggactggaagtgatcggagtgagaagaggttactcaggcctcatcgacggcgattttgtaaaactcgagtacaaagatgtggcaggaatcacagaaaagggaggaacaattctgagaacttccagatgtgaggagttcaagacagaagagggcagggaactcgctgcgaaacagataaaaaaacatggtatagaaggactcgtcgtcataggtggtgaagggagtctcaccggcgctcatcttctttacgaagaacacaaaatacccgttgtcggtataccagcaaccatagacaacgacattgggttgactgacatgtgcataggggtggacacgtgtttgaacacggtgatggatgctgttcaaaagctcaaagacaccgctagctcgcatgagagagctttcattgtggaagtcatggggaggcattccggctacatcgctctcatggcgggactggtgactggtgcagaagccatcatcgtaccagagattccggtggattattcacagctcgccgatagaattctcgaagaaaggagaagaggaaagatcaacagcataatcatagtcgctgaaggggcagcgagtgcctataccgtcgcaagacacctcgaatacaggataggctacgaaacgaggatcaccatactcggacacgtacagagaggtggttctccaacggctttcgacagaagactggcactgagtatgggagttgaagcggtcgatgctcttctggacggagaggtagacgtgatgatagcgctccaagggaacaagttcgtgagagttcctataatggaagcgctctccacaaagaaaacgatcgacaaaaaactttacgaaatagcacatatgctttcatga

SEQ ID NO: 26593 - DNA, 375 bp, Thermotoga maritima
ttgaagatgaaaaagtacacgaaaactcacgaatgggtgtcgattgaggacaaagtagcaacggttggaataacgaatcacgctcaggaacagctcggcgatgtggtctacgtggatcttcctgaagtcggcagagaggtgaagaaaggggaagttgtggcgagtatagagtctgtgaaagccgcagcggacgtgtacgctcctctcagtgggaagatcgtggaagtgaacgagaaactcgatactgaacctgaactcataaacaaggatccagaaggagaaggctggcttttcaaaatggaaatatccgatgaaggcgaactcgaagatcttctggatgaacaggcttatcaggaattctgtgctcaggagtag

SEQ ID NO: 26594 - DNA, 1317 bp, Thermotoga maritima
ttgaaggacatcctgaaagagctgaaaaagaagttgagtgaagaagatttcaataaattcaacggaagagtcacacgagtggtaggactcactgtggaatcgaaaggtccagacgcttttctaggagaaatgtgtaagatctcacttcaaaacggtaaaaacgcactcgcggaggtagttggtttcagggaagaaagtgttattctcatgccctacgaggatgtctccgggttgaagatgggctgtgaagtcatcagaactaacaaagtactcgaagttggtgtcagcagaaagatgatcggaagggtgttcgatggtctgggacgtccaatagacggaaagcccttcgttccggaagacagatatcctctgatcaacaaccctccaaaccctctaaaaagacgaagaataaaagatcctttaccggtgggtatacgatcaatagatggtttcataaccataggcaaaggccagagaattggaattttcgcgggcagcggtgttggaaaaagcacacttcttggaatgatcgcacgaaacacgacggcggacattaacgtgctggccctcatcggggagcgcggaagagaggtcagggaattcatagagagggaccttggagaggagggactgaagcgatctatactggtggtctcaacttccgatcagcctgcccttgccagagtgaaatctctcctcaccgccaccagtatagcggaattcttcagagatctgggatacgatgtccttctgatggtggactctctcaccagatgggccatggctcagagagaagtggggctcgcagtgggagaacctcccaccaccaggggatatccaccaagtgtctttgccggccttccaaaaatactcgaaagggcaggaaactcagataaaggcagcataacagcgatttacaccgtgctcgttgaagcggacgacttcaacgaacccatttccgacactgtcagatccatcgtagatggacacataattctttcgaggagacttgccgaatcgaatcactacccagcagtcgatgttcttgcaagtgtgagccgattgatgaacgatatcgtcaccgaagaacacagagaggcggcgaaccgcctccgatcgctgatgtcggcttatgaatccgcaaaagatctgattgaaatcggtgcttacaagagtgggaccaatccactcgttgacaaagctgtggaaatgaaagacgagatcgattcctttctgaaacagggtgtctttgaaaaagcttcattcgaggaaacccttcagaaacttctggatctatacctgagatctcttgactaa

SEQ ID NO: 26595 - DNA, 939 bp, Thermotoga maritima
atgagaatcgatctttcccttaaacccacacctgttcagtttctcaaaagactttcggaaaaatacgggttcaacatctacgttaaaagagacgatctcacagagcttgtgggatcgggcaacaaaatcagaaagctggagtatcttctatgggaagctcttaaaaaaggagcaacgactgtcttcacctgtggaggtcttcagtcgaaccatgccagagcaacggcatacgtttcgagaagatacggcttgaaacctgttctcttcctcagaaaaggggagaaggtactgaacggaaatcttctcctcgacattctcctcggtgctgaaatagtggaggtatccccggaagagtacgaacgcatcgatgagatcttcgatgttcacaaaaagatgagagaaaagaaaggtgaaaaggtgtacgtgatacccgaagggggatcgaactcccttggagcctttggctacttcaatgcggtgctggagatgaaagatcaattgaacctcgaatctttcgatgctattgtgtgtgctgttggaagtggtggaaccatagcgggcttgtcagctggaatttcctttctggaatatcacgtacccgtagtgggtgtgaacgtcaccacgaaaaactcggattattttgtggggaaggtgaaaagaataattagtggtatggaagagtacggcctgagagtcaacgaaaccgttttcgaagtggtggacgattacagagggccgggatatgcgattccgtccagtgaggatgtggagatcttgaaagaagtagcttcgatagaaggcatcatcctcgatccggtctacacggcaaaagccttcagaggaatgatcgaaatgttcagaaactcagaaaagaacgttcttttcatccacacggggggaatattcggtctgttcgcgcagagcaggaggttggtataa

SEQ ID NO: 26596 - DNA, 1113 bp, Thermotoga maritima
atgagggtgcttggattgattcttgctgggggaaaaagtgatcgtttgtggcctctgacgaaggtgagagccagtgcggcggttcctgtgtttggaaagtacagggctatagacttcactttgagcaacatggtgaattccggcatcaggaaagtgggtatccttactcagtacaatccaaggagtttgatggaccatctgggttctggaaaggaatgggacctcgatcggaaaagcggaggattgttcattctccagccctacgttgggccgaacagagaagtttggtacaggggaacggcggatgccatcttccagaatatgaccattctaagaaggggcgaggaagatcacgttttgataggttcgggagatcacatctacaagatgatctacagggatcttttcaactaccatctaaaaaagggagcggacataactctcgtagttaaagaactcgatgaaacgtacaacttgagtgaatatggaatagttcagctcgacgatgacatgagagtggtggagatagaagaaaaaccggcacatccaaaagggaacatcgcgtttcttggggtttacttcatgaacaaagagctgctcaaggagcttctttatgcaacggttccccaggggaagtacgatcttcttctcgacatagtgattcccaacctcgacaggttgaaggtctacgcttacaggttcgatggttactggagaaacgtaaagaagggaataaaagagtactacaggataaacatggatatattgaaaaaggaagtgcgcgatgagctcttctacagaaacggtaaggtttatacgaagctgaaggatcttcctcctccaaaattcacgaccacggctgttgttgagaattctttgattgcagatgggagcatagtttctggtacggtgagaaattctgtcattttcagaaacgtgcggataaaagtcggggcagtagtagaaaattccatcattatggagaacaccgtcgtggaggaaggagcagttctgagaaacgtgatcctggacaagaactgtatcgtgagagaaggtcgtgtcatcgaaggagacacagagttacctgttttcgaaaaaagagcagttttgtga

SEQ ID NO: 26597 - DNA, 1272 bp, Thermotoga maritima
atgggaaataccgttgcgatgatactggcgggtggtcaggggacgcggctcggagttctcacggagagaatagcgaaacctgcggttccttttggagggaaataccgtctcatagattttactctgagcaattgtgtgaattctggaatctatagggtaggagttttgacccagtacagaccccatgttctctcgaaacacataggtattggaagaccctgggatctggacagaaaggacggaggggttgaaattcttccaccttacgtcgggaggcacgagtctgactggtacaaagggactgccaacgccgtctatcagaatctcgaatttctcgaagaaaacgatgcggaactcgtcctcatcctctcaggagatcacgtgtacgccatgaattacaacgatctcatagattaccatctgctcaaagaggcggatggaacgatagcctgcatggaagtgcccatcgaagaagcgagcagattcggtatcatgataacggacgtggatgggaggatcgtcgattttgaagaaaaaccggcaaaaccccggtcgaacctggcatctctgggaatctatgtcttcaactatgaattcctgaagaaagttctcatcgaagacgagaacgatccaaacagttcccacgattttggaaaagacgtgattccaagaattttgagggaaaatctcggttctctctacgcgttcagattcgacgggtactggagagacgttggtacgctcagatcttactgggaagccaatctggagcttgttcttccagtgccgcctttcaatctctacgatccaaactggaggtttttcacccacaccgaagagatgccgcccgcttacgtagctcctggttcgaaggtttccacctccctcgtgagtgaaggagcagaggtttatggcaacgttttcaactccgttattttccagggtgtgaagatcggtagaggaacagtggtgaaaaattcagtcataatgaccagaactgagataggagagaactgttatctggaaaacgtgataatagcggaaaatgtaaaaataggaagcaacgtcaggatgggagtgggtgaagacgctgaaagcaaactggatccaaaggtgtactcgggtcttctgacagtggttgggatgaattctgtgattcccgacgacatggtgataggaaagaactgtgttataggtattggtgtaagacctgaagacttcaaatcgaaaactttagaatcgggagattatgtgatagtcagggaggagtag

SEQ ID NO: 26598 - DNA, 1902 bp, Thermotoga maritima
atgagtaagaaagtgaagaaatatatcgttgttgaatctcctgccaaggcgaagacgatcaagagtattcttgggaatgagtacgaagtattcgcttcgatggggcacatcatagaccttcccaagagcaagttcggtgtggatctggaaaaggatttcgaaccggaattcgcggtgataaaagggaaagagaaggtagttgaaaagctgaaggatcttgcaaaaaaaggcgaactgctcatcgcttctgatatggatagagaaggggaagccatagcctggcacatagccagggtaacgaacacactggggagaaagaacaggatcgtgttctctgagatcactcctcgtgtgataagagaagccgttaagaatcctcgagagattgacatgaagaaagttcgtgcgcagcttgcaagaaggattttagacaggatcgttggttattctctgagtccggttctctggagaaacttcaaatccaatttgagcgctggtagagtccaatcagcaaccttgaagctcgtttgtgacagagagagagaaatcctcaggtttgtgccaaagaagtaccacaggatcaccgtcaatttcgatggtctcacagcagaaatagatgtgaaagaaaagaagttcttcgacgctgaaacgttgaaagaaatccagagcatagacgaactcgttgtagaagagaaaaaggtttctgtgaaaaagtttgcgcctccagaacccttcaaaaccagtaccctccagcaggaagcgtattctaaactgggtttctccgtttccaaaaccatgatgattgcccagcagttgtatgaaggcgtggaaacaaaagatgggcatatcgcgttcataacctatatgagaacagattcaacgcgtgtttcggactacgcgaaagaagaagccagaaatctgataacggaggtctttggagaagagtacgttggttcaaagagagaaaggagaaagagcaacgcaaaaatacaggatgcgcatgaggcgattcgtcccacgaacgttttcatgacacctgaagaagcgggaaaatacctgaattctgaccagaaaaaactctacgagttgatatggaagagatttctcgcatcgcaaatgaagccttctcaatacgaggaaactcgttttgtcctgagaacaaaggatgggaagtacagattcaagggaacggtgctgaagaagattttcgatgggtacgaaaaggtgtggaagacggaaagaaacacgggagagtttcctttcgaagagggagaatctgtgaaaccggtggttgtaaaaatagaggaacaggaaaccaaaccgaaaccaaggtacacagagggttctcttgtaaaagaaatggaaagactcggtataggtcgtcccagcacatatgcgtccacgataaagcttttgctgaacaggggttacataaaaaagatcaggggctatctctatccaacgatcgttggaagcgttgtcatggattatctggagaaaaagtactctgatgttgttagcgtttccttcacagctgaaatggaaaaggacctcgatgaagtcgaacagggtaagaaaacagacaaaatcgttctgcgggagttttatgaatccttttccagtgtgttcgacaggaacgacagaattgtggttgattttccgacgaaccagaaatgttcgtgtggaaaggaaatgaggctctcttttggaaaatacggcttctatttgaaatgcgagtgtggtaaaaccagaagcgtgaaaaacgatgaaattgcggtcatagacgatggaaaaatattcctggggaggaaagacagtgagagtggctctcctgatgggaggagtgtcgagggaaagggaaatctctctgagaagcggagaaagggtaaaaaaggctcttga

SEQ ID NO: 26599 - DNA, 2646 bp, Thermotoga maritima
atggcaaagaaatacgtgtacttcttcgcaaacggtaaggcagaaggccgagcggacatgaaagatatcctcggtggaaaaggtgccaacctcgcagagatgaccaaccttggaattcctgttcctcccggattcaccatttccgcagaggtctgtaagtactactacgaccacggaagaacttatccagaagaactgaaagaacaggttgaagaggcaatgaggagactcgaggaggttactggaaaaaagttcggtgaccccaacaatccactccttgtttccgtcagatctggtgcagccatttcaatgcctggaatgatggacaccgttctcaatcttggtctcaacgatgagacagtgaaaggattagcaaagctgacgaacaacgaaaggtttgcctacgacgcttacagaagattccttcagatgtttggtgatgtggttctgaagatacctcacgagaaattcgaaaaggcactcgaagaactcaagaaggaaaaaggtgtgaaactcgacaccgaactggatgcagaagacctcaaaaaactcgttgaaagatacaaacagatctacaaggaagagggaaaagaatttccgcaggatccctggaaacagctctggcttgcgatcgatgcggtgttcggtagctggatgaacgagagagctatcaagtacaggcagattcacggaatcaaggaaggagatctcctcggtacggccgtgaacatcgtcgcgatggtgtttggaaacatgggagaagactccggaacgggtgtcgccttcacaagagacccgaacactggagagaagaaaccttacggagagttcctgcccaatgctcagggtgaggacgttgttgcgggtatcagaactcctctcaaacttgaagagttgaaaaacagaatgccagaggtctacaatcagctccttgaaataatggacaaactggaaaaacactacagagatatgcaggacatcgagttcaccgttgagagaggaaagctctacatcttgcagacaagaaatggaaagagaacctctcaggcagctatcaggatcgccgttgacatggtccacgaaggactcatcaccaaagaggaagctattctcagagtgagacctgaagacgtcgaacaggtgcttcatcctgtgttcgatccaaaagaaaaggcccaggcaaaagtcatcgcgaaagggcttcctgcatctccaggtgccgcaacgggtaaggtcgtcttcaacgcgaagaaagctgaggagctcggcaaagcaggtgaacaggtcattcttgtgagacctgaaaccagccccgaagacgttggaggaatggccgctgcgcagggaattttgacctccagagggggaatgacctctcacgctgccgttgtcgcaagaggaatgggtaagccagcagtcgtcggagcagaatccatagaagtccatcctgaggaaggttacttcaaagtgggagacgtcgttgtaaaagaaggagaatggatctccatcgatgggactaccggtgaggtcctccttggaaaagtaacaacaataaaaccacagggccttgaaggacctgtcgcggagcttctgcagtgggccgatgagatcagaagactcggtgtgagaaccaacgcagacataccgagagacgcggaagtcgcgagaaaattcggtgctgaaggaatcgggctctgtagaacagaacacatgttcttcgaaaaggacagaatacccaaggttagaaggatgatcctcgcaaagacaaaagaagaaagagaaaaggctctggacgaacttctgccacttcagaaagaggacttcaagggattgttcagagtgatgaaaggacttccagtcaccataaggctcatagatcctcctctccatgaattcctgccgcaagaagatgaacagatcaaggaagttgccgagcagatgggagtctcctttgaggaactcaagaacgtcgtggagaatctcaaagaactcaacccaatgctcgggcacagaggttgtaggctcaccatcacctatcctgagatcgctgtgatgcagaccaaagcaataattggagcggccatcgaactcaagaaagaggaaggaatagatgtaatacctgaaatcatgattcctcttgtgggacacgttaacgaactcaggtacctgaagaagatcatcaaggaaacggccgacgctctcataaaagaagctggtgtcgagctcacttacaagatcggaaccatgattgaagttccaagggccgctgttaccgcccatcagatagcggaagaagcagaattcttcagcttcggtactaacgacctcacacagatgacctttggattcagccgagacgacgttggaaagttcctgcctgagtaccttgaaaagggcatcctcgaacacgatccattcaagacgctggactacgacggtgttggagaactggtgaggatgggtaaagagaaaggaagaagcacaaggcccgatctcaaagttggagtctgtggagaacacggtggagatccgagatccatactgttcttcgacaaaattggactcgactacgtttcctgttcgccgtacagagtacctgttgccagacttgcagcggctcaggcagctctcaaaaacaagaaataa

SEQ ID NO: 26600 - DNA, 948 bp, Thermotoga maritima
gtgacaatgccttatgtaaagaacacgaaagaaattctggaaaaagccagcaaagagagatacgctatcggtgcattcaatttcaacaacatggaatttctccaggcaattcttgaagccgctgaggaagaaaaagcaccggtcatcgtcgctacatcggaaggagcgataaagtacataggaaagggcgatatagaaacaggagcaaaacttgccgttgaaatggtgagaacttacgctgaaaaactttcagttcccgtcgcactccacctggaccacggaagagactttaaagttatcatggctgccataaaagcgggttactcttcagtgatgatcgacgcttcgcatcttcccttcgaggaaaacctcagagagacgaagaggatcgtggagatagctcacgcggttggtataagtgtagaagcggaactcggaaaactcaagggaatagaggacaatgtggtggaaaaagagtccgtgctcgtcgatccggaagaagcaaaggtatttgtgaaggaaacagaagtggatttcctggctccagccattggaaccagccacggtgcgttcaagttcaaaggggaagcacagctcgactttgaacgactgaagaaagtgaaagaatacacccagataccgctcgttcttcacggagcttccatggtaccgcaggatattgtgaaactggcgaacgaatacggtgccgagctttccggtgcgaaaggcgttccggaagacatgctgaagaaagctatagaacttggtatcaacaagataaacacagacaccgatctgagaatcaccttcgtcgcgtatctcaggaaggttctctcagaagacaagtctcagatagatcccagaaaaattttcaaacctgtcttcgaacaggtgaaagaaatcgtcaaggagagaatcagaatattcggatccagcggaaaggcgtga

SEQ ID NO: 26601 - DNA, 1491 bp, Thermotoga maritima
atgatagatctcaagcagtacgagttctggtttctcgttggaagtcagtatctttacggtctggaaaccctgaaaaaggtggagcaacaggcaagtaagatcgtggattcactgaacgatgaccccatcttcccttcaaagatcgttttaaagccggttttgaagagttcttctgaaatcacggaaatctttgagaaggcaaacgcagaccccaaatgcgcaggggttatcgtctggatgcacactttttccccatcgaagatgtggatacggggactctccataaacaaaaaacccctgcttcaccttcacacgcagtacaacagagagattccatgggatacgatcgatatggattacatgaacctgaaccagtccgcacacggagacagagagcatgggttcatacatgcaaggatgagacttccaaggaaagttgtggtgggacactgggaagagaaagaagtcagagaaaagatcgcaaagtggatgagagtggcctgtgcgatacaggatggaagaatgggacagatagtcaggttcggtgacaacatgagagaagtcgccagcaccgaaggcgacaaagtagaagcacagataaaactcggctggtccataaacacttggggagttggagaacttgcagagagagtgaaagccgttccagagcgcgaagtagaggaacttctcaaagaatacagagaaaaatacatcatgccagaggatgaatacagtctcaaagcaataagagagcaggcgaaaatagaaattgctctgagagaatttttgaaagaaaagaacgctgttggtttcaccaccacgttcgaggacctgcacgatcttccacagcttcccgggctcgcggtccagagactcatggaggaaggatacggttttggtgcagaaggtgactggaaagcagcgggattggttagagctatcaaggtaatgggaacgagtcttcccggcggaacttcttttatggaagactacacttaccacctcactcccggaaatgaactcgttttaggggctcacatgctcgaggtatgtccaacgatagcaaaggaaaaaccacgaatagaggttcaccctctcagcatcggcgggaaagcagatcctgcccgtcttgtcttcgatggtcaggaaggaccagccgttaacgcatcgatcgttgatatgggcaacaggttcagactcgttgtgaacaaggttttatccgttcccatagagaggaagatgccaaaactcccgacagccagggtcctctggaaaccgctgcctgatttcaagagggcaactactgcatggatactcgctggaggatcacaccacactgccttctcaacagccattgacgtagaatacctcatcgactgggcggaggcattggaaatcgaatacgtcgtcatcgatgagaatttggatctcgaggacttcaaaaaagaactgagatggaacgaactctactgggggcttttgaaaagatga

SEQ ID NO: 26602 - DNA, 1455 bp, Thermotoga maritima
atgtcctacaggatagtggtggatccaaaagaagttgtcaagccgattagcagacacatctacggtcatttcacggaacatctgggaaggtgtatctacggcggaatttatgaagaaggttctccgctctccgatgaaaggggtttcagaaaggacgttctggaggctgtaaagaggataaaagttccgaacttgagatggcccggtggaaacttcgtgtcgaactaccactgggaagacggaataggtcccaaagatcagaggcctgttaggttcgatctcgcctggcaacaggaagagacgaatagatttggaacggacgaattcattgagtactgtcgtgagataggagcagaaccttacatcagtataaacatgggaactggaacactcgacgaagctctccactggcttgaatactgcaatggaaagggtaatacctactacgctcaactcagaagaaagtacggtcatccagaaccttacaacgtaaagttctggggaataggcaacgagatgtacggggaatggcaggtaggccacatgacggcggacgaatacgcaagagccgccaaagaatacacgaaatggatgaaggttttcgaccctacaattaaagcgatcgccgtgggctgtgacgaccccatatggaatctcagggttcttcaagaagcaggtgatgtgattgacttcatatcctaccatttctacacagggtccgacgattactacgaaacggtctctacggtttaccttctcaaagaaagactcatcggagtgaaaaagctcattgatatggtggatactgctagaaagagaggtgtcaaaatcgcccttgatgaatggaacgtatggtacagagtgtccgataacaagctcgaagaaccttacgatctcaaagatggtatctttgcatgtggagtgcttgtacttcttcaaaagatgagcgacatagtcccacttgccaatctcgcacagcttgtaaacgcccttggagctatacacaccgagaaagacggtctcattctcacacccgtttacaaggcttttgaactcatcgtgaatcattccggagaaaagcttgtcaagacccatgttgaatcggagacttacaacatagaaggagtcatgttcatcaacaaaatgcctttctctgtcgagaacgcaccgttccttgatgccgccgcttccatctcagaagatggcaagaaacttttcatcgctgttgtaaactacaggaaagaagacgctttgaaggttccaatcagagtggaaggtctgggacagaaaaaagccaccgtttatacactcacaggtccggacgtgaacgcgagaaacaccatggaaaatccgaacgtcgttgatattacctccgaaaccatcaccgttgacaccgaatttgaacacacgtttaaaccattctcttgcagtgtgattgaggtagaattggagtaa

SEQ ID NO: 26603 - DNA, 1521 bp, Thermotoga maritima
atgtacctcatcggaagtgatataggaactcaggggacgaaatccgtcattgtgaacgaaaaaggagaagtactcgctgaggctttcagagagtacgaagtcataactccaaaaccaaactgggcagaacagtggcctgatgtctgggttaaagcagtctttgaaactgtaaaagaagtggtggagaaatctggggtatcgaagaaagaaatagctgggattgccattagcgggctctacggtggatcgggcattccagttgacaggaacatgcaacccctcagaccctgcctcatctggatggacagaagagcggtgaaagagacggagtgggtgaaacagaacgttcccaaggaaaagctcttcgaaatcacaggaaattacgtggattcgtactttggctttacgaaaatcatgtggatcagaaacaacgaaccagagatctgggaaaagatctacaagttcatcactcctaaggactacgtgatctatcaaatgacgggagaagttgtcatcgactattcctctgctggaaacctgggtggtgtttttgacatcagaaagctcacctggtccaaggagatgtgcgatgttctcggaataccaattgagtttctccccgagagaatagtgaagtcttctgacgtggttggaagagtgacgaaagaagcttcagaattgtgcggactccttgagggaacacccgtagtggccggtggaatagacgctccagttgcccagctttctgccggtgcacttgaggagggagaacacgttgcgatggtgggtacttccacctgctggggaacggtccacgacggttcgaaactggctttcgggcttgtgaattatccttatgtggtttacgacactgaaaggatctacacatttggagggtccgctacaacgggggctctcgccaggtggtttaaagaacagttcggtgagagcgagacaatcgtcggtgaaagaactggcatctcaccgtaccagctctttgacaaggaggtagcaaacatccctgctggaagcgagggtatcatcgttcttccatacttcatgggtgaaagatctccgatatgggatcctaccgcaaggggtgtgttctttggggtcactctctatcacaagagagcacacctctacagggcactaatggaaggaggagcgtatgccctgagacacaacatggaagagggtttgaaagctggtttgaaactgaacgacgaatgctggatcgtcggtggcgtttccaagtcttctgtgtgggttaaaatattcgcggatgttactggtttcaagatgaggcaggttgcaagccttgtggaggctccttacggagatgccttccttgcgggactcggaacaggcgttatagacaagcccgagagaataaaagagtgggtgaaatacagagatcccgtggagccagatccggagaacaagaagatctacgacaggtactacgaaatatacagagagctctatgagagaacaaaagacctgatggcgaggttgtga

SEQ ID NO: 26604 - DNA, 1734 bp, Thermotoga maritima
atgaaaacactcgccagatatttaaagccgtactggatatttgccgttctcgcaccgcttttcatggttgtagaagtgatatgtgatctttcacaacccactcttttggcacgtattgtcgacgaaggaatcgcgcgtggagacttttctctggttttgaaaacagggatcctcatgttgatagtggcactgataggtgcggtgggaggaataggctgcacggtcttcgcgagctatgccagtcagaactttggagccgacttgaggcgagatctcttcagaaaagttctgagtttttctatttccaatgtgaacagattccacacttcatctttgataacgcgtctcaccaacgacgtcacgcagcttcaaaacttggtgatgatgcttctcaggatcgttgtcagagcgcctcttctctttgtgggtggaatagtcatggcagtgtctatcaacgtgaagctttcttccgttttgatctttttgatacctcccatcgttctcctctttgtgtggctcactaagaaagggaatcctctttttcgaaagattcaagagagcaccgacgaggtcaacagagtcgtgagagaaaatctcctgggtgtcagggtagtgagggcctttcgaagagaagaatacgagaatgagaactttcggaaagcaaacgagtctctgagaagatccatcatcagtgccttttcactcattgttttcgcactgccccttttcatattcatcgtgaatatggggatgatcgccgtcctgtggtttggaggggttctcgttagaaacaaccagatggagataggaagcatcatggcatacacgaattacctcatgcagatcatgttctctctcatgatgatcggaaacattctcaatttcattgtaagagccagtgcttctgcaaagagagttctcgaggtgttgaacgaaaaacctgcgattgaagaagcggacaatgccttagcacttccaaatgtggaggggagcgtttccttcgaaaatgtcgaattcagatacttcgaaaacaccgatcctgttctcagtggagtgaacttctccgttaaaccaggatcactcgttgccgttctgggtgaaacagggtccggaaagagcaccctcatgaacctcattccaagactcatcgatccagaacgtggacgtgtggaagtcgatgaactggatgttcggacggtgaagctgaaagatctgagaggtcacatatctgctgttcctcaggaaaccgtgctgttttcgggaaccatcaaagagaacctgaaatggggaagagaagacgccacagatgatgaaatcgtggaggcggcgaagatcgctcagatacacgatttcataatcagtctgcccgaaggatacgattctcgcgtcgaaagaggggggagaaacttctcgggaggtcagaaacagagactctctatagcccgtgctcttgtaaaaaaaccaaaggtactgatactcgacgactgcacgagttcagtggatcccataactgagaaaagaatactggatgggttgaagcgatacacgaagggatgtacgaccttcatcatcactcagaagatcccaacggctcttctcgccgataagatcctggtccttcatgaagggaaagtagcgggatttggcacccacaaagagttgctcgaacactgcaaaccctatcgagagatatatgaatcccagtttggaaacggggtgatgaacgatgcctga

SEQ ID NO: 26605 - DNA, 1797 bp, Thermotoga maritima
atgcctgagatcagaagaaggccacacggaccaattttagaaaaacccgcactgaaaaatcccacggccacgttgagaagactcctcggttatctgagacctcacactttcactttgatcatggtctttgttttcgtcaccgtttcttccatacttggtgttctctcaccgtatctcataggaaaaacgatcgatgttgtcttcgttccgagaagattcgatcttcttcccagatacatgctgattctcggaacgatttatgcgcttacgtctcttctcttctggcttcagggaaaaatcatgttaacgctttcccaagatgttgtttttcgtttgagaaaggagcttttcgagaaacttcaaagagttccggtcggcttcttcgacagaacacctcacggagacatcataagcagagtcataaacgatgtggacaatataaacaacgttcttggaaacagtatcattcagttcttctcgggaattgtgacactcgcaggtgctgtgatcatgatgttcagagtgaatgtgatcctttcactcgtcacactctcaatagttcccttgaccgttctcatcacgcagatcgtctccagccaaaccagaaaatacttctacgaaaatcaaagagtcctcggccagctcaatgggatcatagaagaagacatctccggcctcactgtgataaaactcttcacccgtgaggaaaaagagatggagaagttcgaccgggtgaacgagagtctcagaaaggtgggaacgaaggctcagatcttttcaggtgttctcccccctctgatgaacatggtcaacaacctcggatttgccctgatcagcggttttggaggatggctcgccttgaaagacataatcacggtgggtaccatagccactttcataggttactcaaggcagttcacaagaccgttgaacgagctttctaaccagttcaacatgatccagatggcgcttgcgagtgctgaaagaatatttgagattctcgatctggaggaagaaaaagacgatcctgatgctgtggaactgagagaagtcagaggagaaatcgagttcaagaatgtctggttctcctacgacaagaaaaagcctgttcttaaagacataacctttcacataaaaccgggtcagaaggttgcactggtgggtcccacagggtccggaaagacgacgatcgtgaatctgttgatgagattctacgacgtggacagagggcagatcctcgtggatggtatagatataagaaaaataaagaggagttctctgagatccagcataggcatcgtccttcaggatactattttgttttccaccaccgtgaaagaaaacctcaaatacggaaatcctggcgctaccgacgaagaaataaaagaagcagcgaaactgacacattccgaccacttcataaagcacctgcctgagggttacgaaacggtcctcaccgacaacggtgaagatctgagtcagggtcaaagacagcttcttgccataacaagagctttccttgcgaatccaaagatcctgatactggacgaagccaccagcaacgttgacacaaagacggagaaaagcatacaggcagccatgtggaaactcatggaggggaagaccagcatcatcatagctcacagattgaacacgataaaaaacgcagatctgatcatcgttttaagagacggagaaattgtggagatgggaaaacacgatgagttgattcaaaagcgaggcttttattacgagctcttcacaagccaatacggtctcgttgtagaaaaagaatga

SEQ ID NO: 26606 - DNA, 1260 bp, Thermotoga maritima
gtggctgaaagattggggatactcgttggtggagggccggcacctggaatcaacagtgtgataagttctgttaccatcgaagctataaacaacggactcgaagtgatcggaatatacgatggattcaaacacctcgtagagggaaaaacgaatatggtgaaaaaactttccatcgaagatgtctccagaatccacatcgaaggtggatccattctcagaacctcgagggtgaatcctgccaaatccgaagaaaccctcgagaagacagttcagactctcaaaaagctcgggataaagtatcttgttactatcggcggggacgacaccgcgttctccgcgagcaaagtgtgtgaaagatcgaagggcgaaataaaggtggtccacgttccaaagactatagacaacgatctccctcttccggagaacatgcccacgttcggtttcgaaacagctcgtcacgtagccacagagctcgtctacaatctcatgcaagactcaagaacaacgaacaggtggtactttgtggccatgatgggaagagaagccgggcacctcgctctcggcgttggaaaagcggcgagtgcaacgatcacgatcattcctgaagagttcaaagagggagtgacgctcgaagaagtgtgcgacgttcttgatggagcgattctcaagagaaaactcatgggaagagacgatggagtggcggtcataggtgaaggtatcgcagaaaagatggatcctgaagaactcgccaacattcccggtgtgatagtcgaaaaagacccacacggacacctgagacttgcagagatcccgctcgccaccattctgaaacgggcgatcgagaggagatacgctgaaagaggtgaaagaatccacatcgtcgatgtcacaataggatacgaactcagaagcgcacgccctatacctttcgacatagtatacaccagaacactcggttacggtgcagtgagatttctccttggagactattccgatctccctggcgggatggtgtgcgtggttggtggcagaatcaagattcttcccttcgacgctttcatggatccaaagaccggaaggacaaaggtgagagtggtggatgttcgatcggaagattacagagtagcaagaaaatacatgataaggctggaaaagaaagatctcgaagatcccgaaactctcgaaaaactagcaaagctcgcaaagatggaacctgaagaattcaaaaagaaatactggcatacgacagagcttccataa

SEQ ID NO: 26607 - DNA, 1257 bp, Thermotoga maritima
atgggtaagacactcgcagaaaagatcttttctgaacatgttggaagagacgtgaaagccggagaaatcgtactcgcgagagtggatatagccatggcccaggatggaacaggccctctgatgataaacgaattcagagaactcggtttcaaagaagtgaaggtcccgaaggccttcctcttcatcgatcacgcttctccgagcccgaggaaagagctttcgaactcgcagaagatgatgagagaatttggaaaagagatgggagtcaaggttttcgatgcgggagacggaatatcccatcaaatcctcgcggaaaaatacgtgaagcccggcgatctggtagcgggtgcggattcgcacacctgcactgccggtgggctcggtgctttcggaacaggaatgggttccacggatgttgcgatcatcttcgggcttggacagaactggttcaaagtacctgagacgatcaaagttgtggtgaacgggaagctacaggatggagtttacgcgaaggacatcattctcgagatcgcgagaattctgggaagcgacggcgcaacttacaaagcgttggagttccacggaagctgtatcgaaaatatgaatgtggaggacagactcaccatctccaacatggcggtggaagtgggagcgaaagcgggtctcatgccctctgatgagaagaccagagaattcctgaaaaagatgggaagagaggaggacttcagagagttgaaagcagatccagacgcggtttacgagacagagatagagatagatgccaccacactcgaaccactcgtctctttgcctcactatgtggacaacgtgagaaaggtgagcgaggttgaaaaggaaaagataaagatagatcaagttttcataggaacctgtacgaacggaagactccaggatcttgagatcgctttgaagattcttgagaaacacggaaagcatccggatgtgaggctgatcgttggtcctgcttcaaggaaggtctacatggacgcccttgaaaagggaataatcaagaaattcgttgaacttggagcggcagttataccacctggctgtggcccgtgtgttggaattcacatgggtgttcttggagacggagagagggtactttccacgcagaacagaaacttcaagggaagaatggggaatcccaatgcggagatatacctcgcttctcctgcaacggcggcagccaccgcggtaactggatacatcacagatccaagaaggttcatttga

SEQ ID NO: 26608 - DNA, 1248 bp, Thermotoga maritima
gtggatgaactcctcgagaaggcgaagaaggtacgagaggcttgggatgttctgagaaacgctacgacgagggaaaagaacaaagcgataaagaagatagccgagaaactcgatgagaggagaaaagaaatcctcgaagcgaacagaatcgacgtggaaaaggcccgcgagcggggtgtgaaggagtctctcgttgacagactcgctctgaacgataaaagaatcgatgagatgataaaagcgtgtgagacggtgattggactgaaagatcccgtgggagaagtgatcgattcttgggtgagagaagacggactcagaatagcgagagtgagggttcccatcggtccgatagggatcatttacgaatccaggccgaacgtcaccgtggagaccacgatcttggccttgaagagcggtaacaccatactgctcaggggcggatccgacgctttgaactcgaacaaggcgatagtctcagccataagggaggcgctcaaagaaaccgagattccggaaagctccgttgagttcatcgagaacaccgacagatccctcgttcttgagatgatacggctcagggaatatctctcccttgtcattccacgtggtggatacggcctcatcagctttgtgcgtgacaacgcgaccgttccggtactggaaacaggtgttggaaactgtcacatcttcgtcgatgagagcgccgatctgaagaaggctgttccggtcataataaacgcgaagacacaaaggcctggtacctgtaacgctgcagagaaactgctcgttcatgagaagatagcgaaggagtttcttcctgtgatcgtggaggagctgagaaaacacggcgtcgaagtgagaggctgtgaaaagaccagagaaatcgtgccggacgtggtaccggctactgaagatgactggcccaccgagtatctggacctcatcatcgccatcaaagtggtcaagaatgtggacgaggcgattgagcacataaagaaatattccacaggacattccgaatcgattctgactgaaaactattcgaacgctaaaaagttcgtttcagaaatcgatgccgcagccgtttacgtgaacgcttcgaccagattcacagacggcgggcagttcggtttcggtgccgagatcggaatcagcacccagagattccacgcaagaggtcccgtggggctcagagagctcaccacgtacaaattcgtcgttcttggagagtatcatgtgagggaatga

SEQ ID NO: 26609 - DNA, 948 bp, Thermotoga maritima
gtgaatgttctctgcaccggtgaaatcctcattgatttcatctcagaggacaaaggaaagaacctttcacagagtgagctcttcagaaagaaagcgggaggttctcccctgaacgtcgccgttgctctcaaaagactgggaagagaggtttcttttctcggaaaacttggaggagaccagttctccgagttcctacttgaggtgatgaaaaaagaaggcatagacacaacacacatcatcttcgattcttcttgtaagactaccctcgcttttgtggcaagagacgctcagggaaatccggatttcgtcttcttcagagaaaaaccagccgatacgaatctgagaccggaagaagtgaacatcgaccccgcacaattttctttccttcacatcggatcatactctcttgccgttgaaccatcgagaagcgcctatttgaaagtgatggaaacgtttttggaagaagggaagcccgtctcttacgatccgaacgtgagaccctcactgatagaagacagaaacaccttcgtgaaggactttctcgagatctcttcgaaggtagatatcgtaaaactcagcgacaaggatctggaatacatcttccaggaagatttagaaacggccgttgacaaaattccgatcaaggaaaacggcctgctttttgtgaccatgggagaaaggggatgtcttgtgaagttcaaaggagaaaaacgtatggttccttctttcaaagtaaaacctgtggatgccacggggtgcggagactcgttcacagccgctgtgatacacaagtatctggagaaaacacctgaaacgatcgaagacgctgtcgagataggaaagttcgccaacgccgtcgccgctatcgttatcacaagagtaggcggtgtagatgctatgccggtgttagatgaagttgaaatgtttctatcaaatcaggaacgttga

SEQ ID NO: 26610 - DNA, 774 bp, Thermotoga maritima
gtgaatattcttgaaaagcttttctctttgaaaagaaaggtagctctggtgactggtggaggacagggcatcgggaaggccatcgcccaggcgctggcagcggcgggtgcagctgttttgatcatggacataaacgaagaaacagccagaagaacggtcgaagagataaaagagaaaggtggcgaagcagatttctatgttggggatgtgacgaaagaagaagattgttttggagcggtcaaaaaggcgctggataggtgggggaaactcgacataggagtcaacaacgcgggaataggagactggtgtgaagcggagaattatccggttgagaagtggaaaaaggtcatagacgtgaatctggttggggtgtttctttccgcaaaagcggagttccacgctatgaaggaaagaaaatacggaaagatcataaacatcgcgtccatgtccggacacatcgtgaacaaacctcagaagcagacagcttacaacgcttcgaaagcgggtgtgatccatctcaccagatctctggccgccgagtgggccccgtacggaatcagggtgaacagcataagccccggatacatcagaacacctctcatagaatctccaaacgtgaaagatcttgttcccctctggctcgacatgatccctcttggaagactgggagaggtggacgatctgataggagctgctatcttccttgcaagtcccgcctcagattacatgacagggcacgatcttgtgatagacggaggctacaccgtctggtga

SEQ ID NO: 26611 - DNA, 954 bp, Thermotoga maritima
atgaaagtacttttgatagaaaaacccggtgttgcgagtgttgtggagaaagagatacccgttcccggtgaagatcagaccctcgtgaaagtactcgcgtgcggtatctgtggaaccgactacaagatattctcaggaggcaccaacgccaactatccagttgttccagggcatgagatcgtcggcgtcgttgaaagatcgggtgttttcgaaaaggggcagatggttgtgatcgatcccaacagatcctgtgggaagtgtgactactgtagaaaaggtatgtctcagttctgtgaaaaccttcaggcaacgggcgtgacagaaccaggaggatttgcggaatacgtgctcgtggagaactcacaggtttatcctgtgagaaatgtacccgcagagagagccgttttcgcagaaccgctttcctgtgttctcgaaggagtgaagatggtgaaacatggattctacgacagaatcctcgtagtcggagcaggtagtataggtgtgatttttggtctgatcttcaagaaaatttttccgggtgcagaaatagtccttgcggagaaagacgagaaacgtgcggaatacgttgtgcaaacttttggattgaaagtggatgaaccaaaaggagagtacgatcttactgtcgagtgttctggtacggtggaagggttcaaaacttgctttgaacacacaggaaaaggtggaatgctccttcagttcagcgtcatctccaaagacaagatggttgagatctcaccgttcgagatctaccgaaaggagatgaaaatactcgggtcctatctcaatcctttcacaatgaaagaagcggtgaagatcatagaatctggagagtttcccttcgaaaaacttgtcaccgatcgtctggatcttgaaggggtgaaagaatacctgtcgtctcacaaaaaggcattgatgaagggaattttttcttaa

SEQ ID NO: 26612 - DNA, 2295 bp, Thermotoga maritima
atgcgtttcacggaagggctttggagattgagagagggggtacagttgttcaggccagaacaggtgtacgaatactcctgcgatggaaagaaactgatccttcgatcgccgtttcggagggtggagcaccggggacagacgcttcagggtccggtcttcgagatcgagatctcctctccgtttgaaaacgtaataagaattcggttcagacatttcaagggagtactcgaaaagcccccgtactacgaaatctaccaggacgaaagcttcacaccggatatcaaagaaacagaaggaagttttatcttcacctcaggaaaggcaaaagcgatcataaggaagaatcccttcggtgtggaattcttttacgaagatcgtttcctcacgaaatcggatctgggatacgccgtggcaccagaagggaggttctgtcttgaaagactccatctgagcgtgggagagatgatctacggtctcggagaaagattctcagctttcgtcaaaaacgctcagagagttgtcatgtggaacgaggacgccggaacgatctccgatatgacctacaagaacatcccgttctatgtgagcatcagaaaatacggtgtctttgtgaacgatcctggaaaggtggacttcgaaatcgcaacagaacatgtggaaaaggtgcagttcagtgtgaaaggagagactctggactatttcatcatcgccgggaaagatctgaaagaagttctggaacgctacacacttctcacaggacgaccagaacttcctcctgcctggagtttcggactctggctcaccacatccttcaccacacagtacgatgagagaactgtgatggagttcgtggatggcatgagagagcgtgacataccccttcatgtctttcacttcgactgcttctggatgaaggagtttcactgggtggatcttgagtggaacagggagaacttccccgaccctgaagggttgttgaaacgtctcaaagagaagggcctgaaggtgtgtgtctggataaacccctatgtctctcagttttcgagtctctttgacgagggaaaagaaaagggttatttcctgaaaaaaccagacggagatgtctggcagacggacgactggcaaccaggaatggcgatcatcgatttcacgaatccggaagtcagaaagtggttcgcttcaaaactggaaagattgatagatatgggagttgactgtttcaagacggactttggagagaagattcccacagatgtggtctattacgacggatccgatcctgagaagatgcacaactactacacctatctgtacaacaaagtggtcttcgaaaccattgagagaaaactcggaaagagaaacgctgtcgtcttcgcaaggtctgcaacggcagggagtcagaaattcccggtccactggggaggagattgtctggcttcctatgagtccatggcggaaaccttgagaggaggtctttctctggcactgtgcggtttcggtttctggagtcacgacatcggaggattcgaggacatcacaacaccggatctgtacaagagatgggtggcattcggtcttctgtcatctcacagcaggctccacggaaattcgatgtacaaggttccctggaacttcgatgaggaagcggtggaggtgctcagatttttcacgaaactgaagtgcaagctcatgccctatatattcgccagcgcagtcgaagtacatgagaggggaatccctgtcatgagacccatgattcttgagtttccagacgatcccacctgtctctatctggacagacagtacatgctgggagaatcactccttgtcgctccgatcttcagcgagacgggagaggtgacctactaccttccagagggagtctggactcactttctcaccggcgagagggtagaaggaggaagatggagaacagaaaaatacgactacttcggactcccactctttacaagaccgaactccataattccgacagggtccgtcgatgacaggccggattacgattacgcagacggtgtcacattgaacgtttttgaaatttcaaacaaaacagcgcatgtttacaacacacggggcgaggtggaattgagtgtgaaagtagagagaaaaggaaacgagatacacgttgaggtcctgaaggactccagaaaaccatggaagctgctgttctggaacgaaaggcttgaagctgtggaaggagctgagacaagagaactagaaaaaggaacagaggtggttctcagcttccagagagcgattttaaagacaaaatga

SEQ ID NO: 26613 - DNA, 2019 bp, Thermotoga maritima
gtggtaaatccgaaacttcctgtgatctggtacggaggagactactacccggaacagtgggacgaggaaacgttcgaaagagatattaggatgttcaaagaagcaggtatcaacgtggtcaccatcggggttttctcatggagtcttatccaaccagacgagaacacctacgatttttcgttctttgaaaaagtaatggatcgcctgtacaaagaaggtatctacgtctgtcttgcaactcccacatccgctccccctcactggatgacgcagaaataccctgaaatccttttcacagacgtgaacggtgtaaagcgagaaaagggaggcagacagaacttttgccccaacagtgagaagtacagatattttgcaagaaacattgcagagaaactcgcagaacatttcaaggatcatcctgctctcgttctctggcacgtgaacaacgaatacctgaactactgctactgtgatatctgcagggggaagtttcagaactggttgaaggaaaagtacggcacactcgatgaattgaacagaagatggaacacacggttctggtcccagaccttcaccgcctgggaagagattcctgttccaacaacgaggagtgttctcgtctggagaaaggacaggtatcaatctgttcttccagaactttatctggattacagacgcttcatgacacagagtatgctcgagtgtttcctggaggaatacagggcaataaagaaacacactcccgacatacccgtcaccacgaatctgattgcggcaactttcaaggagtggaactatttcgaatgggcgaagcatatggacgttgcagcatgggacaactatcccggttacaaagaagatttctccgtgatttctttgagacactctctgatacgctgtttgaaagaaggaaaacccttcgtcctgatggaacagtctccttcgcaggcgtgctggagatggtacaatccccagaaaagacccggagagatgaggctctggagttatcacgctctcgctcacggtgctgaaacgctcatgttctttcagctgagacaatcaaaaggaggagtagaaaaattccacggggctgttatcacacatgtcgacagtccgaacacaagggtctttcaggaagtgaaaagagtgggagaagagataaagtccttatcggatattctcgacgcaagggttgtctcacagacagcccttctgttcgattgggaaagctggtgggcgatggaagacaccctgacacctagcgtagacttcaggtatttaaacgaagtgcagaagtacttcaaggcacttgtgaaaaccggccttggagtcgatgttgttgggaaagatcagaattttgaaaggtacagagtcctcgttgctccggtgctttatatggtgggcaaagaacttgcacagaagctgaaagattacgtctcgaacggaggaatcttgatcctcacaacaatgagtggtattgtcgatgaagacgatcaggttgttctgggaggttatccaggttatcttcgcgatcttatggggggctatgtggaagaaatagatgctttgccacctgaagagaagaacgaaatcttgatgtttggcaagaggtacgaatgtagtttggtgtttgactacataaaaaccaccaccgcggaagtactcggaagatttggaagggactattacatgaacgaacctgccgtgttgagaaacaactacggcaaaggatgggtttactacgtaggctcttccacgtctttcgatcttgtatgggatcttgtgaagttcatggagagagaacacaatctcagagcagagatcgcaccgccagatgatgtagaagtgataaagaaaatcaaaggggaaaaaattttctacttcctcttcaatcattcccatgaactacagatcgttgatttgccggaaggaatgttcagggatctgatcaaaggaaatttgtatgagaaaaaagtaaaattgcaaccgctcgatgttctgatccttctaaaagaatga

SEQ ID NO: 26614 - DNA, 2181 bp, Thermotoga maritima
atgagcgatcagaaaacgatggaggatcgtgctgcgaagaatgaggagataaagaagaccttcactgtgacaggaatgacgtgcgccacctgcgcgaaaaccgttgaaaaggccctgaaaaaactcgacggggtgaagttcgcggctgtgaatcttgccacttcaacggggttcatagtggcagagaaagagatatccttcgaggaaatcaaaaaagctgtggaggaagtaggatacggagtaacaacagaatctccagaagatgtggaaagaaagcgatacgaagagtcgaagagaaatctgattcttgcctggcttgtcacggcccctcttgccctcctcatgatctatcacatgtttgtttctgaggtaccttatttcacctggatagaggttttcgcgggtgcgttcgttacgttctacgtgggcagaggaacgatcagaggagcatggatagccctcacacacaaacacacaaacatggacacgctcatcttcttcggtgcggtgacttcttgggtgaccgctcttcttgacagtgtgggacttcctgtaatgtcctttggtgccatcggtgcgatgatcgttgcgttccacatcacgggacgtttcatagaatcttacctgcgcgacagggccagcaaagaaatcaaagcccttctgaaacttcaagcaaaagaagcccgcgtcatcaccgacgaaggagaagtgatgatgccgatagaggcggtgaaagagggtttcatcgtgctggtaaaacccggtgaaagaatccccgtggatggggtgatcgtggaagggcagtcttcgatcgacgaatctgtggtcacgggtgaatccataccggttttgaagaaagaaaacgatgaagtgatcggtggttctttgaacgtatcgagtcctatcaaaataaaagtcacaaaggtaggagaagacacctttttgtctcaaatggtcaaattgattcaggaagcgcaaggttcgaaggtaccgatccaggctctggccgacaggatcaccatgtggtttgttcccacgatcatcgtcctcgctataaccagcgctctggtgtggtacttcaattacgaacggttccttccttttgtagaaaaggcaagagaaatcttcccttggatcatacaaaccagtgacccgttgaccttttccatcttcgtctttgttgcaacgattgtcatagcgtgtccgtgtgctctcggtcttgcaactcccatggcgcttgtaactggaacgggacttgcggcaaagaagggccttctcataagaaacgccgaggcgattcagacatcgaaggatgtaggggtagttctcacggataagacgggaacgctcaccgagggtagtccgaaggtggtggatcacaatctctccgctgaactgatcagaatagttgcaagtatagaaaggaactcgaaccacccgctcgcgaaggcaatttctgagctatctcaggatgtggtcgaagtggaaagcgtggaggaaatcccaggagaaggggtaagggcactctacggaggagaggagtatttcgtcgggaaacctctggattactcaaagtacgagtctcttttggaggaaggaaagaccattgtcgaggtgagaagaaacggtgaagttgtgggatttctcgcaatagaagatccaatccgagaagacagtcccgaggccgtgagaagactcaaagagatgggaatagaacctgtcatgataacgggagacaatgaaaagaccgcaagggcggttgcgagacgccttggaatagagaagttccatgcaggtgtgaagccttctgagaaacttgatcttgtaagatcttaccaggcacagggaaagaaagtcgcgatggtgggagacggcatgaacgatgccgctgctctgaaaggagcagatgtcggaatagcgataggttcaggaacagaccttgctatcgacagtgcagacatcatcataacaaagggtggcatatcgaaagtcgtcgatgcgatagaaatatcgagaaagacgttcaaaatcataaaacagaatctcttctgggccttcttctacaacgtgatagctattccaatggcgatgatgggactgcttcatccggtgatcgcagaactcgccatggctttcagttccatcaccgtgaccctcaattctatgagggtgagagagtga

SEQ ID NO: 26615 - DNA, 756 bp, Thermotoga maritima
atgaatttccagggaaaagtggttttaataacaggagcaggttccggtattggaaagaaagcagccgttatgttcgcagaaagaggggcaaaagtagcgatcaacgatatctctgaagaaaaaggaaaagaaactgtggagctgataaagagcatgggaggagaagctgcgtttatcttcggagatgtagcgaaagatgcagaacagatagtgaagaaaacggtggaaacgttcggaaggctcgacatcctggtgaacaacgctggcatcgtaccttatggaaacatagaagagacttcggaggaagattttgataaaacaatggctgtgaatgtcaaagggccttttcttctctcaaaatatgccgttgagcagatgaaaaagcagggcggaggagtcattgtaaacgtttcctccgaagcaggactcataggaattccaagaaggtgtgtctacagtgtttcaaaagctgcactcctgggacttacaagatctcttgccgtcgattacgtcgattatggaatcagggtcaacgcggtgtgcccgggtaccactcagtctgagggactcatggcgagggtgaaggcttctccaaatccagaagaactcctgaaaaaaatgacctccaggatccctatgaagagactgggaaaagaggaggaaatcgccttcgcgatcctctttgcagcgtgtgacgaagccggatttatgacgggcagtatcataaacatagatggaggttctaccgctgtatga

SEQ ID NO: 26616 - DNA, 813 bp, Thermotoga maritima
gtgctggagctgaaacctccccttgttcttctctccggtcctgccggctttggagagtatctgaagctcatggatcacagatacgtgggcggtgttttgctgaaaaccgtcacgctccatccgaaagaaggaaaccccactcccagaatggcagacagcgatttctacgtgataaacaggatcggactggaaaaccccggaatacacgcgttcgttgaaaacattccggaacttcccgttcccatgatcgcaagtctcggcggtgattctttcgaggagtatctggaagtggcccgtgtgttcaaaaaggtagcggacagattctatgcggtggagttcaatttctcctgtccgaacgtgaaagaaggaggactctccatagtcaaaaacgcggaagagtggaagaaactcctgaacacacttagaaaagaacttcccgactccttcttgatagcgaaagtgggagtagagggtatctttgtggaagatgccgcggaatttgtgatgaaaacagggtgggacggaatcacgctcgtgaacacggtgaggggactgcattttgaaaaagacacgatgatcttaggaggactttctggtcccgtgctgaaaccgatcgccctcagggcagtgtacgaagtgaagaaaagattcccagaactctttgtgatagcaagcggtggtgtgtactccgtgaaagacgcagaagaattcctgaaagtgggagcggacgtgataggagtcggaagcgctctcttcaaagatcccggtgttgtggaagaaattggaaaatatctgctggaggtgaaaagatga

SEQ ID NO: 26617 - DNA, 1017 bp, Thermotoga maritima
atgatagtcgttttgaaacccggttccacagaagaagatataaggaaggtggtgaagttggccgagagttacaacttgaagtgtcacatttccaaaggtcaggaaagaacggttattgggatcatcggggacgacaggtacgtggtggcggacaagttcgagtcgctggattgcgtggaaagcgttgtgagggtgctcaaaccttacaaactcgtttctcgtgagttccatccggaggacacggtgatcgacctcggagatgtgaagataggaaacggctacttcaccatcatagcgggaccgtgctcagttgaaggcagggaaatgctcatggaaaccgcacactttttaagcgaactcggtgttaaagttttgaggggaggggcctacaagcctcgaacatctccttactctttccaaggactcggagaaaaggggctggaatacctgagagaggctgccgacaagtacggtatgtacgtggtgacggaggctctcggagaagacgatcttccaaaagtggccgagtacgctgatatcattcagataggagcgagaaacgctcagaacttcagattgctctctaaagcgggaagctacaacaaacccgttcttctgaaaaggggtttcatgaacaccatcgaagagttccttctctccgctgaatacattgcaaactctggaaacacgaagatcatactgtgtgaaaggggaatcagaacgttcgaaaaggccacgaggaacacactcgatatatccgctgttcctataatcagaaaggaatcccatcttcccattctggtggatccgagccactctgggggaagaagagacctcgttattccactctcccgggccgctatagcggttggagctcatggaatcattgtggaggttcatccggagccggagaaggcactttcggatggaaaacagagtcttgacttcgagctcttcaaggaactggttcaggaaatgaagaaactcgctgatgccctgggggtgaaggtgaattga

SEQ ID NO: 26618 - DNA, 1233 bp, Thermotoga maritima
gtgctgagcgttcctccggacaaatccataactcacagggctctcattctgtccgctttggcggaaacggaaagcaccctgtacaacctcttgaggtgtctcgacacagagagaacccacgatattctcgaaaaactcggtacacgttttgaaggcgattgggaaaagatgaaggtctttccgaagcccttcgctgagccaatagaacctctcttctgtggaaactccggaacaaccacgaggttgatgagtggagttcttgcttcatacgagatgttcacagtgctttatggggatccttctctctccagaaggccgatgagaagagtgatcgaacctctggagatgatgggagcgcgtttcatggcgaggcagaacaactaccttcccatggccatcaaaggaaatcacctttccggtatcagttacaaaacaccggtggcgagcgctcaagtgaagagcgctgttcttctggcggggctcagagccagcggacgaacaatcgttatcgaaccagcaaaaagcagagatcacacggaaaggatgctcaaaaacctcggtgttcccgtcgaggtggagggaacacgtgtggttctggagcctgctaccttcaggggtttcacgatgaaagtccctggtgatatctcgtcggctgctttcttcgtggttctcggcgccattcatcccaacgctcgaatcacagtaacggacgttggcctgaatcccacccgaacgggactcctcgaagttatgaaactcatgggagccaacctggagtgggagatcacggaagaaaatcttgaaccgataggaactgtgagggttgagacatctccaaacctgaaaggtgtggttgttcccgaacacctcgtacctctcatgatagatgaactgcctcttgtggcgcttctcggtgtttttgcggaaggagaaacggttgtgagaaacgcggaggagttgagaaagaaggaatccgacaggataagggttctggtggaaaacttcaaacggctcggtgtcgaaatagaagagttcaaagatggtttcaagatcgttggaaagcagagcataaaaggtggatcggtggatccagaaggcgaccacagaatggctatgctcttttccatagcagggctcgtgagtgaagagggggttgatgtgaaagatcacgaatgcgtggcggtgtctttcccgaacttttacgaactgctggagagagtggtgatatcatga

SEQ ID NO: 26619 - DNA, 762 bp, Thermotoga maritima
atgaaattctgcatcatagggtatccggtgagacacagcatatcaccaaggctttacaacgagtatttcaaaagggcgggaatgaaccactcgtacggtatggaagagataccacctgaatctttcgacacggagataagaaggattctcgaagaatacgatggtttcaacgcgacaattcctcacaaagaaagagtgatgcggtacgtcgaaccatctgaagatgcgcagagaataaaagccgtgaactgtgtctttcggggaaagggatacaacaccgactgggttggcgttgtgaaatcgctcgagggtgtagaggtgaaggagcccgttgtcgttgtgggagcgggcggagccgcacgtgccgtgatctacgctctcctccagatgggcgtgaaagacatctgggtggtgaacagaacgatcgaaagggcgaaggctctcgattttcctgtgaaaattttctctctcgatcagctcgacgaggttgtgaaaaaggcgaagagtctcttcaacaccacttcggttggtatgaagggagaggaacttcccgtttctgacgattcactgaaaaacctgagccttgtttacgatgtgatctacttcgacacaccacttgttgtgaaagcaagaaaacttggtgtgaaacacatcataaagggaaacctcatgttttactaccaggcaatggagaatctgaagatatggggaatatacgacgaggaggttttcaaagaagtgttcggggaggttctgaaatga

SEQ ID NO: 26620 - DNA, 1131 bp, Thermotoga maritima
atgaaactcacgatagcgggggattcccatggaaaatacatggttgcaatcctggaaggtttgccttcggggataagggtggatgaggaactcataaggagggatcttttcagaaggagaaactgttacggcagaggaaagagaatgaagatggaagaggacgcgttcgagatcgtttcggggttgtggaagggcatcacaacgggtgcaccggtgacgatcctcattcccaacagggcgggaaaccctgtgaaagatgttcggagtgttccaagacccggtcacatcgattacgctgcgtgggtgaagtacaaacttcccgatctgaacatctacgtggagcggtccagtgcaagatggacggtggcgctcacggcggcaggctccctcttgaaaagcctcctcaaagagttcggtatcgaggtactgggatttgtcacaagacttggaaatgtcgaggcaagggacattccaggtgatttcgaagagttgaagagaagaagggatgaatccgtggtgttctgcccagatcctgaggcaacgaaagagatggtcgccgagatcgacagggcgaaagaagagggaaacaccctcggcggcaaggtgaaggtcattgcaagaggtgtcccggcaggcatcgggagctactccgatcttttcaaaaagctcgactcgaagataggttctctcttttttgccattcccgctgtgaagggagtggtgattggaagtgaagaaatgtggtacggcttcgactatctggatgaattcgaactggaagacggcaagataaagagaaaaacgaacaatctgggaggaatagaagggggcatcaccaacggagaagacgtgtgggtgaacgtctctgtgaagcctattcccaccacgggaaagccgttgaaatccgttgatctgagaacgatggaaccagcgaagacaccgtacgtgagatctgacgtgacggccgttcctcctgcttctgtcgtgtgtgaagccgcgctcgctgtggtgatctcggacgctttgctcgaacatctgggcgatggaaacatcgacgacctgaaaaggaggttcgagaatgagaatcttcctcgttggaatgatgggttctggaaagagcactatcggtaa

SEQ ID NO: 26621 - DNA, 1479 bp, Thermotoga maritima
atgagaatcttcctcgttggaatgatgggttctggaaagagcactatcggtaaaaggatttccgaggtgctcgaccttcagttcatagatatggatgaagagatagaaagaagagagggaagaagcgttcgaaggattttcgaagaagacggtgaggagtacttccgcctgaaagaaaaagaacttcttaaagaacttgtggaaagagacaacgtggttgtggcaacgggtggaggtgttgtggtcgatccagagaacagagagcttttgaagaaggaaaagactctctttctctacgctccccctgaagtgttgatggaaagagtaacaacagagaacagacctcttctgagcgaaggaaaagagagaatacgggagatctgggaaaagagaaaacagttctacgcggagttcagaaggatcgacacctccaggttgaacgagtgggaaacaaccgcactcgttgtgctggaggctctggacgagaaagaaatctcaacgatagaaaaaccacacctggtgaagatcatcctcggtggcttcaagagggtgagaaacgaagagctggttttcaccacggagagggtggagaagatatacggaaggtacctcccggagaatcggcttctttttccggatggagaggaagtgaagacgctggagcatgtctccagagcgtactacgaactcatccgaatggactttcccaggggaaagaccatagcgggtgtcgggggaggtgctctcaccgacttcaccggctttgtagcgagcacgtttaaaagaggagtgggactttctttctatccaacaacacttctggctcaggtggacgcttccgttggtggaaagaatgccatcgatttcgctggagtgaaaaacgtcgttgggactttcagaatgccagactacgtgatcatagatcccaccgtcacgctttccatggatgagggcaggttcgaagagggagtcgtggaagccttcaagatgacgattctttcgggtcgcggggtagaactcttcgatgagccggagaagattgagaagagaaatctcagagttctcagcgagatggtaaaaatctccgttgaagagaaagcgaggatagtgatggaagatccctacgacatgggtttgaggcacgccctgaatctgggacacacactcggtcatgtgtacgagatgctggaaggggtacctcacggtatagcagtagcatggggcatcgaaaaagagacgatgtacctgtacagaaaaggaatagtgcctaaggaaaccatgagatggatcgtagaaaaggtcaaacagatcgtaccaattcctgttccatccgtcgatgttgagaaagccagaaatctcattctgaacgacaagaagatcctgaaaggttccagagtcaggcttccttacgtgaaagaaatcggaaagatcgaattcttggaggtcgatccgctcgagcttctggaggtggtagattga

SEQ ID NO: 26622 - DNA, 435 bp, Thermotoga maritima
ttgaaagtactcgtggtgaacggacccaacttgaacatgctcggaaaaagagacaaaaacatctatggaaacttttctcatgaggatcttgtgaagatgatagaagattggggaaggaaaaacggtgtggaagtggaggtctttcagtcgaaccacgagggaaaaattttggatagactgcacaggctcgatttcgatggtcttgtgataaacccgggggctttcacccactacagctacgccataagggatgccctggagatcgtgaaggtgccgaaggtggaggttcacatatcgaacatacacaggagagaagagttcagaagaaggagcgtcacggctgaggtgtgcgacggtcagataagcggacttggtgtgtacggttaccttctggctctggagtacataaagaagaaactggaagaactcacctga

SEQ ID NO: 26623 - DNA, 1326 bp, Thermotoga maritima
atgataggctatcagatctacgtgagatctttcagggatggaaacctcgacggtgtgggagatttcaggggattgaaaaacgctgtttcctacctgaaagaactggggattgactttgtctggctcatgcctgttttttcctccatatcttttcacgggtacgacgtggtggatttttattctttcaaagctgagtacggtagtgagagagagttcaaagagatgatcgaggcattccacgacagcggaataaaagtcgttcttgaccttcccatccatcacacaggctttctccacacgtggttccagaaggcgctgaaaggagatccacactacagagattactacgtatgggcaaacaaagagacggatctggacgaaagaagagagtgggatggagaaaagatctggcatcccctggaagatgggaggttctacagagggctctttggacctttctcacccgacttgaactacgacaacccgcaggtattcgatgaaatgaaaagactggttctccaccttctcgatatgggagtggatggtttcaggttcgatgcagcaaagcacatgagagatacgatcgaacagaatgttcgcttctggaagtactttctttccgatttgaagggcatcttcctcgcagagatatgggcagaggccagaatggtggatgaacacggcagaatatttggctacatgctcaactttgacacatcccactgtataaaggaagctgtatggaaagagaacacaagagttctgatagagtcgatcgaaagggccgttatcggcaaagactacctcccggtgaattttacttcgaatcacgacatgtcgaggcttgcaagctttgaaggaggcttcagcaaagaaaagatcaaactttcgatttccattcttttcactctcccgggagttcctctcgtgttctatggggatgagcttggaatgaagggagtttaccagaaaccgaacacagaagtcgtcctggatccgttcccgtggaacgagagtatgtgcgttgagggacagaccttctggaagtggcccgcgtacaacgggcctttctctggtatctccgtagaataccagaagagagatcccgattcgattctttcacacactctgggatggacgagattcagaaaggaaaaccagtggatcgatcgggcaaagctcgaatttttgtgtaaagaggacaagtttcttgtgtacagactctacgatgatcagcattctttgaaggtgtttcacaatctttcaggggaagaggttgtctttgagggagttaaaatgaagccttacaaaacggaggtggtttga

SEQ ID NO: 26624 - DNA, 1791 bp, Thermotoga maritima
atggcagaaaagaaagaattcgttgtgggaatagaccttggaacgacaaattctgttatagcttggatgaaaccggacggtacagttgaagtgataccgaacgctgaaggaagcagggtcacaccatccgtggttgcgttcacaaagagtggagagatactcgtaggagaacccgccaagagacagatgatactcaatcctgaacgaacgataaaatccataaagagaaaaatgggaactgattacaaagtgagaatagacgataaagaatacactcctcaggagatcagcgcgttcattctcaagaagctgaagaacgacgcggaagcgtacctcggtggtgaaataaagaaagccgtcatcacctgtcccgcttacttcaacgatgcccagagacaggcaacgaaagaggctggaatcatagcaggtcttgaggtcttgaggatcatcaacgaaccaaccgcagcggccctcgcttacggactcgataaagctggaaaagaagagaaagtgctggtttacgacctcggtggtggaacgtttgatgtctccatactcgagataggagaaggtgtgatcgaggtcatcgcgacagctggtaacaaccacctcggtggagacgacttcgatcagaggctcattgactggatggcagaggaattcaagaaacagcacggaatagatctcagagaagacagacaggcgcttcagagattgagagacgctgccgaaaaagccaagatagagctttcaacgaagatggaaaccgatgtgagtttgccgttcatcgctgtctctccgagcggacagcctctgcaccttgaaatgagaatcaccagaagtctcttcgaatcgctcacaagagatctcgttgaaatgacaagaggcccaatcgaacaggcactgaacgatgcaaagctctcaccacaggatatcgacgaaatcatactcgtcggcggtatgaccagagttccaatggtgcagaggttcataaaggagttcttcggaaaagaacccaacaagagcgtcaacccggacgaagcagttgctatcggagcagcgattcaggcggcgatactcgcaggcaccgaaggagcaaagggaagagatatcgttctcgtcgatgtaacaccactaacactcggaatagaagtcaaaggcggactcttcgaaccgataatcccaagaaataccaagatacccgtgaggaagagcaagatcttcacaacggttgaagacggtcagaccgaagtagaaatcagagtctatcagggtgaaaggccgattgcgagggaaaacatcttccttggaagcttcaaactcgttggaattccaccggcaccgaggggtgttcctcagatagaggtcacgttcgacatagacagcgacggaatagtccacgtttccgcaaaagatctcggttctggaaaagaacagtccatggtagtcacaggaagacacaagctctccgaagacgaaataaagagaatgatagaagatgcgaaaagatacgaagaacaggacaaacgtctcaaagaagaaatcgaactcaagaacagagcagacgatctcgcatacagcgtagaaaagactctgaaagaacacggagataagataccagcggatctcaagtccagacttgaagacatgatcagagaactcagagacgcgataaacagaaacgacataccaaaagtgaagatgctcttcgatgatcttcagaaggaaagcatgaagataggagaatacctatacaaatctgcaactggtggagaaacatcaaatcagtaa

SEQ ID NO: 26625 - DNA, 1350 bp, Thermotoga maritima
atgtacgatgctgtgatcataggaggaggacccggaggttacgtctgcgctataaaactcgcacagcttggaaagaaggtcgcacttgtcgaaaaagatgccctcgggggaacctgtaccaacaggggatgcattccaacgaaggcgatgctcacagtctcccatctcatggatgaaatgaaagagaaagcttcaaagtacggcttgaaagtctcaggagtcgaatacgacgtcgccgccataatgaaacacgttcaaaagagtgtgatgatgtcaagaaagggaatagagtacctgctgaaaaagaatggggttgaagtcttcaaaggaacggccgtcgtggaaaacaagaacacggttgttgtccaggaaacgggagagaaactggaagcaaagaatcttgttctcgcacacggatccgttccctccgtgttttctcccttcgatatcgacggagtctggacgagtgatgacgtgttcaatttgaaagaatttccaaagtcgcttgtgatagtgggcggtggtgtcatcggagttgaattcgcgacgtttttcggttctttcggtgtggatgtgacgatcgttgagatcgcagaacacatcctcccctatgaagactcagatgtggcagaagaagtgaaaaaggccctcaaaaggaagggtgttaagatcctggaaaaaacaaaaatttcctccctgagcaaagtcgatgacggctttgaagtcgcactcgaaaatggagaaacccttaaggcagaaaaggtcctgctcgccgcaggaagaaagcccaacataccggaggacgtgaaagctctcggagtgaagatagaaaaaggagtcgtcactgatagcaggatgagaacgaacgtggaaaacgtttacgcgataggagatatcagaagtggaatcatgctcgctcatgtggccatgtacgagggaatagtcgctgcaaagaacatcgcgggagaagaggaagaaatggattactcggccgttccgagtatcatcttctcctctccggaagtggcatctgtcggtgtgagagaaaaagacgtgaaccccgaagaagttgtgatctccaagttcccagtctccgcaaacggaagggcaagaacgatgcttgaaaacatagggtttgccaaggtcatagcggacaagaaagacggaacggttctcggcatgagcatcgtttcaccatcggctaccgatatgatcatggaaggtgtcatagccgtgaagttcaggatgaaagcggaagatctggagaaagccattcacccgcatccgactttgacagaaaccatactcggggctcttgaaggggtctcaggaaaacccattcatctgtga

SEQ ID NO: 26626 - DNA, 906 bp, Thermotoga maritima
atggtagtattacattcaaaggggggattttttctggagattttgaaagtcgttgatctgaagaaacactacggtgacgtgaaggccgtggacgggataagtttcaccgtggagcgtggaactgttttctcctttcttggacccaacggtgcgggaaaaaccacgaccgttgagatactcgaaggtctcagaaagaaagactccggggagatctactatttcggtgagagaaaggatgtcttggatagagaaacgaagagaaaaattggtgtgtgtctccagaaaagtgcgttttttgaaaacctcaccgtttgggaaaccctcaaattgttccgcgggctgtacggaacgggattggatctcaaagaagtgatgggattgttttctcttgaaaacatagagaaaaaaatggtgaaaacactctctgggggccagcttcagagactcgcagtggctgtggcgttcatcaacgatccggagattgttttcctcgacgaaccaacgacaggtcttgacccacaggcgagaaggcagatatgggacaccatagaacacttcaaaaatcttggaaagaccatctttctcaccacccattacatggaagaggcagagagactatctgaccacgtctgcatcatagaccacgggaagatcatagcagaaggaactccttcctctctcataagctcttccgggctgaaaaccgtcgtcgagtttgactgtgatcaggacgtgaacgtgagatacttggagaaaaaagagaaccactacgttgtggaaactgatgccccagaagaactcataaaagatctcctgaaaaattggaacgtttcaaacatcgtgataagaaaaccgaatcttgaagatgttttcctgaagctcacaggcagggatctcagagaatga

SEQ ID NO: 26627 - DNA, 1188 bp, Thermotoga maritima
atgagggctgtcaggcttcacgcgaagtgggatccaaggccggagtttaagctcggtccaaaagacattgaggggaaactcacctggctcggtagcaaggtttggagatatccggaagtgagggtggaagaggtaccagaaccaagaatcgaaaaacccacggaaatcataatcaaggtgaaagcctgtggaatctgtggaagtgatgtccatatggctcaaactgatgaagaaggttacattctctacccaggtctcaccggttttcctgtcactttgggtcacgagttctcgggagttgtggttgaagcgggaccggaagccataaatagaagaacaaacaaaagattcgaaattggggaacctgtctgtgcggaagagatgctctggtgtggccattgcagaccgtgtgcggaaggatttcctaaccactgcgaaaatctcaacgaacttgggttcaatgtggatggagcgtttgcggagtatgtaaaagtggacgcaaagtatgcgtggagtctcagagaacttgaaggagtgtacgaaggtgacagactattcctcgcaggaagtcttgtggagcccacatctgttgcttacaacgctgtgatcgtaagaggtgggggtatcagaccgggcgacaacgtggtgattctgggaggaggtcctattgggctcgcggccgttgcgatcctgaaacacgctggtgcttcaaaggtgattctttctgaaccttcggaggttcggagaaatctggcaaaagaactcggagcggatcacgtgatagaccccaccaaagagaattttgttgaggcggttctcgattacaccaacggccttggagcaaaactctttcttgaggctactggagttcctcagctcgtctggcctcagatagaagaggtgatctggagggctcgcggtatcaatgccacagtggcgatcgtagcgcgggccgatgcaaaaatacctctcaccggtgaggttttccaagtgaggagagctcagattgtgggatctcaaggacattcgggacacgggacatttccacgtgtgatcagcctgatggcatccggcatggatatgacgaagatcatatccaaaacggtttcaatggaggagatacctgaatacataaagagacttcagactgacaaatctttggtgaaggttaccatgctgaacgagtga

SEQ ID NO: 26628 - DNA, 1095 bp, Thermotoga maritima
atgataacaaccaccatatttccaggtagatatgttcagggggcaggtgctatcaacattctagaagaagaactttctcgttttggagaaagggcatttgtggtgatcgatgattttgtggacaaaaacgtgctaggagaaaatttcttcagctctttcacaaaagtcagggtaaacaaacagatctttggtggagagtgttcagacgaagagatagagcgactttcaggtcttgttgaagaagaaacagacgtggtggtgggcataggtggcggaaaaacactcgataccgctaaagcggtcgcctataagttgaaaaagcctgttgtgattgttccaactattgcctctacagatgctccatgcagcgccctttccgtgatttacacaccaaacggggaattcaaaagatacctgtttttgccaaggaatccagatgtcgttctggtagacacggagattgtggcgaaagcccccgcgaggtttcttgttgccggaatgggagatgcccttgccacgtggtttgaggcagaatcttgtaaacagaaatacgctccaaatatgacgggaagacttggttcgatgacagcctacgcgctcgcaagactttgctatgagacacttctagaatacggtgtacttgcgaaaaggtcggtggaggaaaagtctgtcacacctgcccttgaaaaaatcgttgaggcgaacacccttttaagtggtctgggattcgaaagtggaggactggcagctgcacatgctattcacaacggtctcaccgttctggaaaatacccacaagtatttacacggggaaaaagtggccataggagttctcgcatcactgtttttgactgacaaacccagaaagatgatcgaagaggtctactccttctgtgaagaagtgggattacccactactctggcagagataggacttgatggtgtttcggacgaggatctgatgaaagtggctgagaaagcctgtgacaagaatgaaacaatacacaacgaaccccaacctgtgacatcaaaggatgtgtttttcgccctaaaagcagcagacaggtacggaaggatgagaaaaaacctcacttga

SEQ ID NO: 26629 - DNA, 1413 bp, Thermotoga maritima
atgcctaccatagtatttgtaggagcggggagtgtgaggtacacgatcaagctggtaggggacctggcgaagacaccggatttgtatgggtcaagactggtactgatggacatcgacgaagaaaggttgaaagcaacgtacattctcgtcacaaagtacctcagagaactgaatgcagagtacacagtggaacagacgacaagccttgaggaggcacttgaaggggcagattttgtcatcaacacagccctctacagggcaccagggcacgaagacggatacgtacactacgagatcatgagggaagtaggggagagacatggctactacagagggatagacagccaggagctgaacatggtctcggactactacacactcagcaactacaaccacctgaagatgagccttgatatagcaaaggcagtggagaagatagcaccgaatgcgtggatactgcagacggccaatcctgtttttgagatcacacaacttgtgaagaggcttacgaaggcaaagatagtgggtttctgccacgggtatgcgcacgtgttccaccttgcgaaagtactcggtgtggagccagaggaattagactggcaggtagcaggggtgaaccatgcgatatggatgaacaggtttagatgcagaggggaagatctctatccgaagctggacgaatggatagaggagaacgcatcgcgatgggaaccgaagaatccctgggatgtggacttttcacctgcagcgatagacatgtacaggttctacgggatgtacccgataggggatacggtgaggagtgggacatggaaataccactacgatcttgagacgaagaagagatggtacgggaagtttggagggatagacaacgaagtggaaaggccgaagttctacgagagtttgagggagcagaggaagaggctgatggaacttgcgaaagaagtggagaaagatccgacgatagagctgacgaaggtgtggcctgaggtgttcacaacaggcagtgagagtgtagaacagcacatacctttcatcaacgcgcttgtgaacgacaagaaggcgaggcttgtattgaacgtagagaacagaggggtgataaaggggataccggacgatgtaatggtggaggtgccggtggtagttgataaagaggggatacatccggagaagatagagcctgatcttacagacaggatcaagaagttctacttacttccgaggatactcaggatggagtggacacttgaggcgttcatatctggtgacaggagggttcttgaggagatcctcgtcagggatccaagaaccagatcctacgaacaggccgtcgctgttattgatgatatccttaacctccccttcaacgaggaaatgaagaagcattactcaaaagtaggaaagaattga

SEQ ID NO: 26630 - DNA, 1410 bp, Thermotoga maritima
gtgaaatctcatattggtctcatcggtcttgctgtgatgggtcagaatcttgcactgaacattgcgaggaaaggctacaaagtttcggtttacaacagaacagcacagagaacggaggaatttgtgaaaaatcgtgtaacgaatgaagagatagaacctcattacgatatcgaaagcttcgtgaagtctctcgaaagaccaagaaagataatcttaatggtaaaggcaggaaaacccgtggatgatacgatttctcagcttcttcctcacctcgaaccaggtgatttgataatagacggtggtaattcccattacatggataccgaaagacgcttcaaggaactctctgaaaagggaatacttttcctcggtatgggagtttctggtggtgagtacggggctcttcacgggccttctctcatgcctgggggaagtagagaagcgtacaacctggttgaggagattcttttggaaatagcagcgaaaacagaggatggaccatgctgtacatacgttggtgaaagatcagcgggccactttgtgaagatggttcacaacggcatagaatacgccatcatgcaggcgatagcggaagtttatcacattatgagagatgttttgagcctatcatctgaagaaatgtccagtatctttgaagagtggaacagaggagaactcagctcgttcctggtggagatcacctacaagattttgagaaagaaagatgaagaaacaggaaaaccgatggtcgatgtgattctggacaaggcggaacaaaagggaactggaaagtggacatcccaagcagcccttgacctcggaatacctaccccttccataaacctggcggtggttgaaagggtgatttcccatttcaaagacataagaacaaggctttcgaaactgtataataagagaagaagcgctactcagggtagcgaggaatttttgagagatctccgaaactctctcttctttgccatgttcatggccttttctcagggcatgtggttgatcgcagaagcatcgaaagagttcggctatggggtgagcctctcggaggtgctcagaatatggaagggtggatgtatcataagggcgaagttgatagacacactcagaaggtacatatctaacgagaacgcgtatttgctggagaacgaagaagtgatgaatctattgaaaggcaaaatcgattctctaaagaacatattgaaggcgtccatagagaacgaaatccccgttcctgttttgagttcctcttacaactacttcatgagtcttaccgaagagagactgccggcgaatctcatacaggctcaaagagacttcttcggagcacacacttttgagagagtagacagagaaggtgtgttccacatcaactgggaggaaggagagataggatga

SEQ ID NO: 26631 - DNA, 768 bp, Thermotoga maritima
gtgaaagaggtgttcgatctcagggggagggttgccctcgtaaccggtggctctcgtgggctgggttttggaatcgctcaggggctggcagaggccggatgttcagtggtcgttgcaagcagaaatctggaggaagcatcagaagcggctcaaaagttgacagaaaaatacggtgttgaaacgatggctttccgatgcgatgtttcaaactatgaggaagtgaaaaaacttttggaagcagtgaaagagaaatttggaaagctcgatacggtggtcaacgctgcggggataaacagaagacatccagcggaagaatttcctctcgatgagttcagacaggtgatagaggtgaacctttttggaacttactacgtgtgtagggaggccttttcactcctgagagaatccgataacccctctatcataaacataggatctctcaccgttgaagaagtcaccatgcccaacatatccgcgtacgctgcttcgaaagggggcgtagcttctctcacaaaagctctggcgaaggaatggggaaggtacggcataagggtgaatgtgatagcgccgggctggtacagaaccaagatgacagaggctgtgttcagcgatccagaaaaactggactacatgctcaagaggataccccttggcagaacgggtgtaccagaggatttgaagggtgtggcagtcttccttgcttccgaagaggcgaagtacgtgactggacagatcatatttgtagacggtggttggactgcgaattga

SEQ ID NO: 26632 - DNA, 1431 bp, Thermotoga maritima
atgatagcggccatagacattggaacagagagcgctcgtcttatgttcaaaagtaacggtgagtggaaagttctgaaaaagtcatatagaatcttctttccatcacccgaggcggcagaacaggacccgaatgagatcttttccgctgttttcgatcttttaaagcaagtacccaacgaggacgaggttctctacgttggtatgagctctgtgttccacagcatcatcggtcttgatgaaaatctcaatccggttactcccctcctcaactgggcagatagaagatcctttcgggaaaaggaagaactggagaagaagtacggtgtcaggttcttttacgaaaaaactgcgtgcccgctccatccgatgtactggccttcgaagatcctgtggatgaagaaaaactcgaatgcgaaaaagttctgttcgataaaagcttacatcgtcaacaagatgactagagaatttgtggaagagctttctctcgcatctggaaccggtatgatgaacatacattccctcgaatgggacggggaaatcctggagatcacgggagtgaggaaagaagatcttcctgagatcaaatcaccttacacacagttgagggtgaaggatgaaatagcgaaagagctcggcttcaagaaagtctacctggtcctcggcggtggagacggagtgatgacgaacgtaggagtgaacgtgatggatcctgattcagccaccgtgacgatcggaacgagcggcgcgtttcgtgttgtcatggacagaccggtgatcgatcgggaggggatttccacctggtgctatctgatcgatgaggagaactacgttctcggcggggcgataaacaacggtggtatcgttctcatgtggctgagggacatcatgaaattcaaagactacaacgatatcatagaagaagcaaaggagtctccagctggtgcgaacggactggtattcctgccgtttctcaacggggaaagggcaccgcactggagagaaagatacaggggcgttctggtagggctcacttcctctcacagaaggagtgacattgcaagagcggcactcgagggaatctgcttcaggataaaggacatacacaacgcggttaaaagagtgggaagtgttgatcccaatcgaatcgttgcgacgggaggtttcaccagctctccgtactgggtccagctcttatcggacgttcttggaaaggatataatcgtcacaaacgtggagaatccttccgcttttggagcctacgtaatggctttgaaatcgctgggagaagatgtggaaggctttatcgaaaaagaggttcgggtagagcgggtgtttcaccctgattctgaaagaaacgcggtgtacgagagactgtacaatgattataagttcctgtacgaaaaactcgtggactattattacaaggagtag

SEQ ID NO: 26633 - DNA, 1377 bp, Thermotoga maritima
gtgagaaaggaacgcgattacctcgggaaactggagatagaaggcgaagtctactatggaatacacacaaagagagccctcatgaacttcccatccacgggtgaaaagctcgacgaaactttcatctgggcctatttcatggtgaaaaaagcctgcgcccttttgaacacagagcttggttatctggacgaacgaacaggaaacgccattgtgaaagcctgtgacgaatgggaagacctgaaaaaacacgtggttgtggatccactctctggtggggctggaacttccataaacatgaacgtaaacgaagtgatcgcaaacagggctacggaaatactcggtggaaagaaaggagaatacctggtcgatcccatagaccacgtgaacctgcaccagtccacaaacgataccttcccaacgagtgcgaaaatcgccaccatcgtgaaactcagaagactcatagatgaagtgataaaccttcaggagaagattcaggagaaagagaaggagttctactccatcagaaaaccgggaagaacacagctcatggatggaccgcccatcatgttagggcaggaattcggtgccttcgcggatgccctcgcgagagacagatggaggctctacaaagtcgaagaaagaataagaagtgtaaacatcgggggaacggccatcggaacgggagttggggcgccgaaagactacatcctcaagatcgtggaaaaggtgagagaagtgacgaaagtgaagattgctaaagcagaaaacctcatagacgccacgcagaactgggacgtttttgccgaggttcatggtcttttgaaatcccttgctgtgaacctctacaagatttcaaacgacatcagactgctgggaagcggaccaaacaccgtgatcggggaactgattcttccagctgtgcaggcgggaagctccatcatgccaggaaaaataaacccggttgtttccgagtacgtaatgcaaatctgtcatatggttttcggtcacgacatgatcctgaaccatgcctgcgcgcttgggaatttagaactcaaccagttcgctcctctgatagttcacctcacactgaaatctctcacactcctcacaaacgcctgtagatcactcgccagctacatctcaaaaataaaagcgaacaacgagcggtgtgaggaacaccttcgaaggtctgtttcgaacctcacacctttgataaagttgtttggatacgaagcggtctctgaagcaataaaaaaagcgaattgggacataaagaaagccgttgaaattctatcccaggagaaaaacattcctgtcgaagagatactgaaggttctcaacctcaaaaagatgacggggcttggctactccttgtaa

SEQ ID NO: 26634 - DNA, 3792 bp, Thermotoga maritima
atgaaagagatctcttgcggtaggaggacgagggtttctttcggcaagagccgagagcccctgccaattccagacctcgtggagatccagaagagttcctaccgaagattcctcgaagaaggtttgcttgaagtcctcaagaaattttctcccatttattcgcaggcgacccgctcagatttgagaaaatcagacagaggatttgctctcgagtttgtttcaaccagaactggagaacctgccatcgatccccttgaatgtaaagcgaagggtctaacctacagtgttccgatatatgcgacggctcgccttaccgacatgaaaagcggtgagatgaaggaagaagaagtgttccttggctacattccctacatgacggatcgtggaacgttcataataaacggagcagaaagggttgtagtcaatcagatagtggtttccccagggctttacttctcgtctgagtacatagacagagaagaatacggcgggtactttctcccttctcgaggtgcatggctcgaagtcatcctcgatccctacgatggagttctttacgcgggccttgacggaaagaaggtcaaccttttcctctttctgaaaacgatcggttacgaaaaagatgaggatatcctctccctttatcccacctatctggatgccgacgatgaagacagtctcctgctccacgtgggctccattctgctcgaagacatctacgatggtggcaggaagatcgctgaaaaatgggatatcctgaccaaagatctcgcggaaaggattctgatgatagatgacataaatcagataaaaatagttcatccaatagctcaaaatacatttgaaaagatgctggaagtggtgtcttcctcgagcgaagagggagaggaagaagaggaaaagacaaagatttacggtttaaacgaagtcaccgttgtggacgcatatctggaaattttcaggagattgcgacccgaagaacttccaagaataaacgcggcaaaaaggtatctgcacgacctcttcttcaatccggaaaggtacgatctttccgaggtgggaagatacaaagtcaacgaaagactcagaaacgcttacatcaggtacctcatagaggttgaaggggaagatcccgaagaggcgaggaagaaggtttacaacgaaacttctctcgttctgaaaccacttgatatagtcctcgcttccagaattctcttcgactactttgagagaagatatgtcaacgattttgaaatagattcctacgagttgaagaatctgatcagaatcttcaaggaagaatacttggaaaagagaaaaacggctccctacgatctcagaaaacttgtatctgtgttccggagaaattacggagtaacatctgatctcggtgtgtttgctgctatcaggtatgtttccaacataaacaaagagcttccttcgatacctttcgatacgaaggatcacctcgggaacaaacgtgttagaaccgttggagaactcgttcagagagagttcgagagattgttcgcaagggcgcagaaggccattcaggaaagactcacactcataaactctttgagtaaggtttccattcagagccttataaacataaaatccatcatatcaacggtcaaccagttcttcgcgatgaaccagctttctcagttcatggatcaggtgaatcctctgtcggaactcactcacaaaagaagggtttctgctgtcggacccggtggattgagaagagaatccaaagtcttcgaagcaagaaacgtgcactactctcagtacggaaggctgtgtcccattgaaacacccgaaggcgcgaacataggattcataacatctctggctatatacgctaaaatcgatgaatacggatttctcatgactccttatagaaaggtagtcaatggaaaagtaacggatgaagtggtctatctgagggccaacgaagaagaagagtacaaaatcatacctgccaccacacccgtggatgaagagggcaacataataccagagagagtagtggctcgaatgggtgaagatatcaggcttgttcccaaagaagaagtagatttcatggatgtatcgacgaagcaacccttcagtgtctcggcttcactcattccgttcctcgaacacgacgacgccagccgagccctcatgggttcgaacatgcagaggcaggccgtcccacttctgaaaacagaagcacccctcgttggaactggaatggaatgggaagcagcgaaaaattctggttatgttattctcgcagaacacgatggaatagtgaaagaggtcgacgctgccagagttgttgttcacagaacggacgagaatggaaatctcatgtacgacgataaaggcaatccagtggttgatgaatacagacttctaaagtttgtgagatccaaccaggatacgatgataaatcaaaaacccatcgtgaacgaaggcgattttgtgaagaagggtgatcccatagccgacggtccggcaaccgacatgggagaactggcacttggaaggaacatcctcgttgccttcatgccatgggaaggttacaactacgaggacgccatccttgtgagtcaggagcttctcgaagaagacgtcttcacatcgatccacatagaagtttatgaaactcaagcaagagaaacgaggctcggtcctgaagagatcaccgctgatataccgaacgtgagcaaagaacttctgaaaaatctcgatgagaacggaatcatcagagttggagcgtacgttgtgagtgactatggagtgggttctcaggcgatactggttggaaaagtgacgccgaaaggcgaaggagacacaacacccgaagaaaagatcatcagatccgtttttggtgaacgcggaagagacgtgaaggatacatctctcaggctgcctcacggggttgagggaagagttataagggtcgatgtttacgatcaaaacgatatagcagaactgggagcgggagttttgaaactcgtcagggtgtacgttgcctcaagaaagacgctcgacatcggagacaaactcgcaggacgccacggaaacaaaggagtcgtttcaaacatacttccaaaagaagacatgccgttcctacccgatggaacaccggttcagatggtactgaacccgctgggaataccttcacgtatgaacgtcggtcagattctggaaacgcaccttggatggctcgccaaactaactggaaaatggttcgcaactcctgtgttcgaaggggcgaaagaagacgaaattctcagaccgctctacgaagaaaggaagaagagaggccttcaccttggagacgacgaaaacaatccgaatggaaaagtggttctcagagatggaagaacgggagaacccttcgacaatcctgtggtggttggttacatgtacatgctgaaactcatccatatagccaaagaaaagattcacgcaaggtccacaggaccgtactctctcattcaccagcagcctctcggtggaaagtctcacttcggtggacagaggcttggagaaatggaggtctgggctctggaggcctatggagctgctcatactcttgcggagatgctcaccataaaatccgacgacataaaaggaagaaacgaagcctataaagccatactgaagaacatgaatatacctgaacctggtgttcccgaaagctttagggttctcatcaaagaactcagaggtctcgcgctcgatgtgagactctacgatgagaacggtaacgagatagatatcgacaagtactga

SEQ ID NO: 26635 - DNA, 708 bp, Thermotoga maritima
gtgataaaggtatcccaactcacggttcgatacggagaactcaaagcggtggaggatctctccctggaggttcaaaggggagagatcctctcccttgtgggaccatccggatgtggaaagacaaccgttgtgaaggctatcctgggactgattccctacgagggaaagatagagattttcacttctcgtcttggatactgtcctcaaaaggatgtgctgttcgactggatgaccgtctatgaaaacgccgtgctcccactcgttctcagaaaagaacagccgccatcgaacataaaagaactgttcgaacgattcggtctttctggctttgaagagaaaaggccgtaccagctgagtggcggtatgagacagaaactgtcccttctgagggccgttttatcgggagaggagcttctcgtactcgatgaacccttttcttcggttgacgcctacactcgaaagaaactccagatatggctttctgagatcgtacacaggatgaaaagcacagtcgtactcatcactcacgacgtggaggaggcggtcttcctttcagacagaatattgatcctctccgatcgccccgcaaggattttgaaggaaatacgcgtgccgttttcaaagccaagaaccataaaaactttctccgatcctcgtttttcagaaatagaagaagaggtgctggagactctcatgaatcaaccctga

SEQ ID NO: 26636 - DNA, 279 bp, Thermotoga maritima
atgatgaaagtgatacctctcggtgaaagactcctcatcaagcccatcaaagaggaaaagaagacagagggaggaatcgttcttccagattccgcaaaagaaaaaccgatgaaggcagaggtcgtagccgtgggaaagatcgatgacgacgaaaaattcgacatcaaagttggagacaaggttatttactccaaatatgcgggtacagaaataaagattgatgatgaggattacatcatcatcgatgtgaatgacatactcgcgaaaatcgaagagtga

SEQ ID NO: 26637 - DNA, 1617 bp, Thermotoga maritima
atgccgaagattctgaagttcaatgaagaagcgagaagagcactcgaaagaggtgtggacaaggtcgctaacgcggtaaaggtgactctcggaccaaagggaaggaacgttgttatcgaaaaatcgtggggttctccaacaataaccaacgacggtgtttccatagccaaggagattgagctcgaggacaaattcgaaaaccttggagctcagctcgtgaaagaggttgcttccaaaacaaacgatgttgccggtgacggtacaacaacggctacggttctcgcacaggctatgatcaaagaaggtctcaagaatgttgcagcgggtgccaatccaattctcctcaagagaggtatagacaaagccgttgagaaggccgttgaagagatcaagaaggtttccaagaaactttccggtagggaagacatcgcccatgttgccgccatatctgcgaacagcgctgaaataggagaactcatcgcagaagctatggacaaggtaggagaagacggagtcatcactgtggaagattccaaaacactcgaaacatacgttgaattcaccgaaggtatgcagtttgacaggggttacatttcaccgtacttcgtcacggatgccgagaagatggaagtcgttctgaaggaacccttcatactcatcactgacaggaagctcagcgctgtgaagcctctcattccgatccttgaaaaagtcgctcagaccggaaaaccacttctcgtcatagcggaagacgttgaaggagaagttctgacaacacttgttctcaacaagctcaagggtactctccagtcctgtgctgtaaaggctcctggattcggtgaaagaagaaaagccatgcttcaggacatagcgatactcaccggaggtcaggtggcaagtgaagagctcggaatcaatctcgaggatctcaccctcgaagatctcggaagagccgatcttgtgagggtcaagaaagatgaaaccatcataattggaggaaaaggtgatccggaggctatcaagaagagaatcgctcagatcaaagcccagatagaggaaaccacatccgagtacgaaaaagaaactctccaggaaaggatggcaaaactcgcaggaggagtagccgtcataaaggttggagcggccaccgaaacagagctcaaggaaaagaaacacagaattgaagacgcactgagcgccacgagagcagctgtcgaagaaggaatcgttccaggtggaggagtaacactcctgagagcaagaaaagccgttgaaaaggtcatagaagagctcgaaggcgacgagaaaataggagcccagatcgtttacaaggcactctcagcccctattaagcagattgctgaaaacgcgggatacgacggagcggtgatcattgagaagatactttcgaatgacgatccagcctatggattcgacgcactcagaggagaatactgcaacatgtttgaaagaggaatcattgacccagcaaaggttacaaggagcgccctgcagaatgctgcatccatcgctggaatgctcctgacaacggaagtgctcatcgttgaaaaacccgaggagaagaaagaaacaccgagcatgcctgaagaattctga

SEQ ID NO: 26638 - DNA, 735 bp, Thermotoga maritima
atgggggcagtggttgtaaaggatctgagaaaaagaattggaaagaaagagatcctgaagggaatttcttttgagatcgaagaaggagagatctttggtctcataggaccgaacggtgcgggaaagaccaccacactcaggatcatctccacgctgatcaagccttcctccggaatcgtcaccgtatttggaaagaacgttgttgaagaaccacacgaagtgagaaagctgatcagctaccttcccgaagaagcgggcgcctacaggaacatgcagggaatcgaatacctgagattcgttgcgggtttctacgcttccagctcaagcgagatagaagagatggtcgaacgggcaacggagatcgccggtctcggtgaaaagataaaagacagagtctcaacctacagcaaaggtatggtgagaaaactcctcatagcgagggctttgatggtgaatcctcgtctcgccatcctcgacgaacccacctccggcctcgatgtcctcaacgcaagagaagtgagaaagatattgaaacaggcatctcaggaaggtctcaccatactggtctcttctcacaacatgctcgaagtggaattcctctgtgatcgaatagcgctgattcacaacggaacgattgtggaaacgggaaccgttgaagaactcaaggaaaggtacaaagcacagaacatcgaagaggtcttcgaggaggtggtgaaatgttcggaaaacttctga

SEQ ID NO: 26639 - DNA, 1047 bp, Thermotoga maritima
atgaaattgggcatactcgaaaagtacagaagatttcttcccgtaacagacaaaacccctatgctctctttgaatgaagggaacactcctctcatacctcttgtgaacatgagcagggaactcggaataaacatctacgtgaagtacgaaggatccaatccgacggggtccttcaaagatagaggaatggtcgttgccgtcgcaaaggcactggaagaaggctcgaaagccatcatgtgcgcttcaacggggaacacctccgcatccgctgccgcgtacgccgcaagggcaggaataaaggcgatcgttctgataccagaagggaagatcgcactcggaaagctggctcaggcgatgatatacggcgccgtggtgcttcaggtgagagggaatttcgacaagtgtctggaactggtcaaggagatcacatccaaatatcccatcacactcgtgaacagtatcaatccctacagactcgaaggtcagaaaacggccgcttttgagatagtcgacgagctcggagatgcaccggactaccacttcatccccgtgggaaacgcgggcaacatctccgcttactggatgggatacaaggagtattatcagcatgggttctccaccaaactgccgaagatgatgggattccaggcggaaggggccgcccccatagttcgcggtcatcccatagaaaacccggagacggtcgccactgcaataaggatcggtaaccccgcgaactgggaaaaagcggtccgggcacgcgatgaatcgggtggagacatcgacatggtgagcgacgaagaaatactgcgcgcacagagactcttggctcagaaagaagggatcttctgtgagcccgcatccgctgcatcgatagcggggcttttgaagaagcacagacagggaatcttcaggggtggagagatcgttgtgtgtaccctcacagggaacggtttgaaagatccgaacatcgtcatctcacagcttgaacccccaaggatcatagaaggaagagtagaagagattctggaggtactcgacatatga

SEQ ID NO: 26640 - DNA, 2220 bp, Thermotoga maritima
atgagaacatatcgatcctttaaaatgttcacaaactcttcccaaggagtgagaaaagtgcgggtaggaatcgcagggcttggaactgtgggtggcagtatataccgcatactgaaagaaagaggaaatgaaatagaaaaaaggatcggtgaaaagttcatcatttcgaaggtgataaatcgctctcctcaaaagtacgaactgcttggtgttccgaaagaggagatagctttcgatttcgatgacctcattttgaacagcgatgtggttgtagaagcaataggtggaacggatgtggcggtcgatcttgtgcgacgtgccttggagctggggcgaatcgtcgtaactccaaacaaaaatctcatctccgaatacggcaacgagttctcagagtacataaaaaaacggaagcttttcttcgaggcatccgtgggtgggggtattcccatcatatctctccttcaggattatctgatctttcagaaagtcaccaggatacgcggaataatgaacggaacgacgaactacatcctcacggagatgagcaagggaagacatttcgaagaagttctgaaagaagcacaggaacttggctatgctgaagctgatcccacaaacgacatcgaaggttacgacgtggcgtacaaggtctccgtcttagctggtgtggtaacgggaaggtttccgggcataaacagcgtgcagttcgagggcataaccagaatagatccggagtatctaaaagagatcgttcgctccggaaaaaagctgaagctgatcggggaactcgatttttcaacaaacagatacgaggtacgtttgagagaagtgacaccagaggatccgttcttcaacgtggatggtgtagacaacgcgatagaagtttcaactgatctcgctggagattttctgctgaagggaaggggagcgggtggatatcccaccgccagcgccgtgatagcggatcttttcagagtggcgaaatacaaggtgctcggcggtgccgagaagttctcggttgtggtgatgaagttcggtggagccgctatctccgatgtggaaaaactcgagaaagtggccgagaaaatcataaagagaaagaagagcggtgtgaagcccgttgtcgtgctttccgccatgggagacaccacagatcacctgatagaactcgcaaagacgatagatgaaaaccccgacccgagagaactggatcttctcctctcgacgggagaaatacagagtgtggctctcatgagcatcgcactcagaaagagaggctacaaagcgatctctttcactggaaatcagctgaagatcataaccgacaagcgttacggatcagcgaggatcatcgacatcaacacggatatcatttcgaggtatctgaagcaggatttcatacccgttgtcgccgggtttcagggtataaccgaaacgggggatatcaccacacttgggaggggtggctcagatctcacagcgatcgctctcgcttactcactgggagcggatttgtgtgagctctacaaagacgtggacggggtgtacacggcggatcccaggatcgtaaaagacgcgcgggtgataaaagagctctcctgggaagagatgatcgagctctcgagacacggtgcccaggtgctgcaggcgagagcggcggaattcgcgagaaagtatggtgtcaaggttctcataaagaacgcacacaaagaaactcgtggaacccttatatgggaggggacaaaagtggagaatccaatcgtcagggcggttacctttgaagacggtatggcgaaggttgttctgaaggatgtaccggacaaacccggtgtcgcagcacggattatgagaactctctctcagatgggagtgaacatcgacatgatcatacagggaatgaagagcggggagtacaacaccgtggcgttcatcgttccggagtcccagcttggaaaactcgacatcgatcttctgaaaacaagaagcgaagcaaaagagatcatcattgaaaaaggactcgcaaaggtctccatcgtaggggtgaacctcacttcaacaccggaaatctccgctactctctttgaaacactggcgaacgaggggatcaacatcgatatgatcagtgcatcgagcagcaggatttctgtgatcatagacggaaaatacgtggaggatgccgtgaaggcgatacacagcagattcgaactggacagggagtga

SEQ ID NO: 26641 - DNA, 1254 bp, Thermotoga maritima
atgacactcgcagaaaagatactctctcaaaaagcgggaagaaaggtggaaccgggagaatttctccttctggagccggacatcgctctcgcgaacgacataacggctccgcttgcgataaagaagttcaaggagtacggtggaaagaaagtgaagtatccagacagagtggtgctcgttccagaccatttcacccccaacaaggacataaagtccgccatgcaggtgaagatgatgagagaatttgccagagagcaggggatcgaaaagttcttcgaaataggcaggatgggtattgaacacgtgctgcttccagaagaaggaatcgtgaaatccggagatctcgtggtcggtgcggattcacacacctgtacctacggagcccttggagcgtttgcgaccggagtggggtccaccgacatcgcgggcttctatctcataggaaaggtatggttccgtgtccccgagagtataaaggtgactcttcgcgggaagttcaaggatctggtgactgccaaagacctcgtgttgaagctcatctcgatactcggtgtagatggagccaactacaaggcgatagaattctctggaccgggtgtgaaagagatcagcatggacggccgttttaccatttcgaacatggcgatcgaggcgggaggaaagacgggactgtttccggtggacgagatcaccattgcctacgaaagagaaagaggcatagaagtggaagagatgtacccggacgaagacgcaaaatacgtgagagaagtggaaatggacctttctgagctcgaacctcaggttgcatatcccttcctcccatccaacgcgaaggacgtttccgaagctgagaaagagagaataaagatagatcaggcggtgataggaagctgtaccaacggaaggatagaagatctcagacttgccgcgcagattctgaagggaaggacagtatcaccggacgttcgatgcatcataattccgggatcccagaaggtttacaaacaggctctcaaagaaggactcatcgacatattcatcgacgcgggctgcgccgtttccacgcccacatgtggaccctgtcttggcggacacatgggagtgctcgcagaaggagaggttgcgatctccacaacgaacaggaacttcgttggaaggatgggacatccgaacagcaaggttttcctggcatctcctgcagtggcggcggccagcgcaataaaaggatacatcgcagatccgagaaagctgtga

SEQ ID NO: 26642 - DNA, 3300 bp, Thermotoga maritima
atgccgaagagagaagacataaagaggatcctcgttataggatccggtccgatcacaatcggtcaggctgcggagttcgactattcaggtacccaggccctgaaggctctcaaaagcgccggctacgaggtgatcatagttaactccaactccgcgaccataatgacagatccggagttttccgatgccgtttacatagaacctctaacggtggagttcctcgaaaagattattgaaaaagaaagaccagatgccctgctccccaccctcggaggacagaccgccctgaatctcgctgtggaacttgccgaaaggggaatcctcgataaatacggcgttcagttgatcggcgcaaagctcgagtcgataaagaaggccgaggatagagaactcttcaaggaaaccatggaaaaggcaggccttgaggttctgagaagcagactcgtgaacaacctcgccgatgcactggagacggcaagagaattcggctaccccgtcataataaggccgagtttcacccttggtggaacaggtggtggaatcgcgttcaacgaagaagaactgagagacatcgtgacaaagggtctcatagaaagtccggttcacacggtcctcatagaggagtcggtcctcggctggaaggagtacgaactcgaagtggtgagagacggagctggaaacttcattgtggtgtgttccatagagaatctcgaccccatgggaatacacaccggagattccataacggtggcacctgcgcaaacactcacggacgttgagtaccagagaatgagggacgcagcttacaaagtgatcgatgcgatcggtatagaaacgggtggatcgaacatccagttcgctttggatccagagaccggtagaatggtcgtcatagagatgaacccaagggtctccaggtcatccgcactggcatcgaaggcaacgggctatcccatcgcgaaggtcgcagctctccttgccgttggtttcactctcgatgagataccgaactacatcaccggcaaaacgatggccgcctttgaaccctccatagactacgtcgtggtgaagataccgagattccagctcgaaaagttccccggggctgacccaagactgaacacccagatgaagtccgtaggagaagtgatggcgataggcaggaccttcaaagaagccttgggaaaagccctcagatcccttgaactcgatgccgctcccaaactggatcttgaacacataagagaacaccttgcaaatccaacgccggaaaggatctcctacgtcttcgccgcgttcaggaacggaatggatgtagaagaggtgcacgaactcactaagatcgacagatggttcctcagagagatgaaagcgtgtatagagctcgaggaagagctgaagttgaagaaattcgatgtggagatcctgaagaaagcaaaacagtggggatactcagacagggaaattgcggagatatggggtgtttcagaaaaagaaatcagaaagatgagagaagacaaccggatctttcccgtctacaagatggtggacacctgcgccgctgagttcgaggcacagaccccgtattactactccacctacaacggcgtggagaacgaagcggtaccttcagacagagagaagatcatgattctgggatccggtcccaacaggataggtcagggaatagaattcgactacacgaacgtccacggagtgtggtccttccaggaagaaggatacgaaaccataatggtcaactccaaccccgaaaccgtttcgactgactacgacacttcagacaggctttacttcgaaccgctcaccgttgaagatgttctggagatcgtgaggaacgaaaaaccgaagggagtggtggtggcattcggcggtcagacaccactgaagatagcaaaatacctcgtagaagagagggtgaacatcataggaacgagcttcgaatcgattgagatcgccgaagacagggaaaaattcgctaagcttctgaaacaaatcgggttgaagtgccctccatttggaacggcatcgtccgtggaagaagcgttgagggtagcagagaatcttggataccccgttcttgtgaggccgagctacgtgctcggaggaagggccatggccattgtggacactcctcaggaactcgaaatgtacgtcaaggaagcggccgttgtctcaccgggataccccgttctgatagacaaatttcttgaagacgcgatagaactcgacgtagatgtcgtgtcggatggaaaatacgtgtggatagcaggattgatggagcagatagaagaagccggagtccattcgggagattccgcgtgtgttctgccccctgtgagtctttctgagaaactcgtggaagagatagaggaaaccgtttacaagcttgtaaaagcgctgaaggttgtgggagttgcgaacatacagcttgcggtgaaagacgaggagatctacatcatagaggcaaatcccagagcatcgagaacagttcctttcgtgagcaaagcgatcggaatccccgtggcgagaatcgccgccaaaatcatggtgggaagaaacctgcccgagctcctttctgagtacttcccatatcccacaagaccaggggtaaaagttgataaactgggagagagtgagatcctcccaactccctggccgaagatgttctctgtgaaagaggtggtgataccgttccataagttcccgggaacggatgtacttctcgggccagagatgcgctccacaggagaagtgatgggaatcggtgaagatttcgcagaggcattcgcgaaggctcagatagccgccggaaaccccctgccaacaacgggagccattctcgcaaccgtcgcagacaaagacaagagggaagccgttcctctcttggctcacctcgcagacatgggctttgagatatacgcaacaagaggaacggcaaaggctctgcagtcacacggtgtggaagtgaaggtggttccaaaggtgggagaaggaagaccggacgtgatagatcttctggagcagggaaagatatcccttgttgtgatcacccagtccagtgatgaacctgcgctcgtcgccgtctctcatggaaaggaacccttcaaagttgaaggaagaagaaccgtcggatacatgataagaaccacggcgctgaagaggaagatcccatacctgaccacagtcgagtcactcagagcagcggtggcggcgatcagaaagatgaagaaaggctctatcgtgaaggtgagaagactcaccgacacatggaaaatgtga

SEQ ID NO: 26643 - DNA, 1179 bp, Thermotoga maritima
atgtccaaaaaagcacttctcgctttagaagacggttcgtttttttttggacagagtctgggtgcagagggtgaaacttttggtgaactggtcttcaacacgggaatgacaggctatcaggaagtcctcaccgatccctcctacaccggtcagatcgtcgtcatgacctacccggaaataggaatctacggagtgaacgacgaagacgtagaatcagatggaataaaagttgccggttttgttgtctacagaagcgtggataccccttccaactggagagccaccatgtctttccccgattacttgaaaaagtacaacatcgtggccatagaaggagtggacaccagagcactcaccaggaaaattcgagtgaaaggtgctatgaaaggtgccatatcgaccgttgatctcgatccggattcccttgtaaaacgggtgaaagaaagccccagtatcgttggaagggatttagccggtcttgtttcaccgaaggaagtcatcgtagaaaacccggaaggagatttctcagtggtggtactcgattccggtgtcaaatggggtattctcagagacctgaagagagtgggagcaaaagtgatgagagttccttacagtgttgatatagacgacatcaaaaagctgaatcccgacggtgttctgatctcgaacggtcccggtgatcccgccgcccttttgaaaaccatcagattgatcaaagaccttctgaaagaagaaattccactcgcggggatctgccttgggcatcagctccttggcctcgccgttggtggaaggacttacaagatgaaattcggtcacagaggcatcaaccatcccgttaaagatctgagaaccggtcgtgttctgatcacaacgcacaaccacggcttcgctgtggatccaaagagtttcggccttccagaactgggaagcgaggatcaggacgcgaacgttctcacgaaaaatcttcagaagatatccgtcctcgaaggaatcagtcctcagggaataaaagtcgagatcacccacatctccctgaacgacggaacgatggaaggaatgaggctggttgattatccagccttttctgttcaatatcaccctgaagcctctcccggacctcacgatgccaagtacttcttcgaagaattcaaacgcctcataaaggaggtaaggtaa

SEQ ID NO: 26644 - DNA, 768 bp, Thermotoga maritima
atgacaatcggtatcgtcggtgttggtaacatgggttcgatcttcgcagagaaattttcgaaggaggccgaaaggattctccttgttgaaaaggacagtgaaaaactctctcgattcaatgctcctccatacgaaattgccgatctggaaaaagttcgtgaggcagatctgatagtcctcgcagtcaaacctcaggacgctcccatcgtgcttagcgcattgaaaggtttcgacggaatcctgctctcgatagttgccggcttgaaaatcgaagagataagaaagtacggtattcacaaggtggcaaggattatgccgaacgttgctgtgagagtgggagaaggggtgctcgccaccgccttcagcgctgatatgagccttgaagaaagagaactcgtcaaatcactccttgagaaactcggtttcgtcgttgaaatagaggaaaagctcttctcagccgtcactgccctcaccggaagtggccccgctttcatcttcgtcgtggtggaggcgtttctcgacgctgcgctgaagatgggcatcccactcgacacggcgaaagaacttgtttataggctcttcaaaggttccgcggagcttttaacagagacgggcgaacacccggctctgtggaaacacagggtgagttctccagccggaacaaccatagaaggactcatcacaatggagaggttcgctgtgagaagcggtgtcatagaatctctgatctcttcttacagaagagcgctcgaactggaggaaaagtga

SEQ ID NO: 26645 - DNA, 1833 bp, Thermotoga maritima
ttgaacaggtctaacatctggaatctactgttcacgatactcataatagtcacacttttctggctcgccagatttttctacgtcgaaaactcacctgtgtctaagcttagctacacgagttttgttcagatggtcgaggacgaaagaagcgtggtctcagaagttgtgatcagggacgacggagtactgagagtttacaccaaagacggtagagtttacgaagtggacgctccgtgggccgtgaacgattcgcagctcatagaaaaactggtttcaaagggaataaaagtctcgggagagagaagcggaagcagctccttctggataaacgtcctcggcactctcataccgacgatactcttcattgtcgtgtggctcttcatcatgaggagcctctctggaaggaacaatcaggcgttcacgttcacaaagagcagggcaacaatgtacaaaccctctgggaacaagagggtcaccttcaaggacgttggaggagcggaagaagccatagaggaactcaaagaggtagttgaatttctgaaagatccctctaaattcaacaggatcggcgcaaggatgcccaaggggatcctccttgtagggcctccaggtaccggtaaaacgctccttgcgagggcagttgcgggcgaagcgaacgtgccgttcttccacatcagcggttctgacttcgtggagctctttgtcggagtcggtgccgcgagggtgagagatctgtttgcacaggcgaaggctcacgctccatgtatcgtcttcatcgatgagatcgatgccgttggaagacacaggggagcgggacttggaggaggacacgatgaaagagagcagaccctgaaccagcttctcgtggagatggatggattcgattcgaaagagggcatcatagtcatggcggccacaaacaggcccgatatcctggaccctgcacttttgaggcccggaaggttcgacaagaaaatcgtggtcgatccacctgacatgctcggaagaaagaagatactcgagattcacacgagaaacaaaccgctcgcggaagacgtgaatctggagatcatagcgaagagaacgccgggattcgtcggggcggatctggaaaacctcgtaaacgaggcggcgcttcttgcggcgagggaaggtagagacaaaatcacgatgaaggacttcgaggaagccatagacagggtgatagccggacccgcaagaaagtcgaagctgatcagcccgaaggaaaagcgcatcatagcgtaccacgaggcgggacacgccgtggtatccaccgtggttccaaacggggaacccgttcacagaatttccataatccccaggggatacaaagccctcggatacacgcttcatcttcctgaggaggataagtaccttgtttcaaggaacgaacttctcgacaaactcacagctctactcggaggtagagcagcagaagaggtggtctttggcgatgtgacgagtggggcagccaacgatatagaaagggccacggaaattgcgaggaatatggtgtgtcagctgggaatgagcgaagagctcggacccctcgcctgggggaaggaagagcaggaagtctttcttggaaaagagatcacacggctcagaaactacagtgaagaggtagcgagcaaaatcgacgaagaagtgaaaaagatagtgacgaactgctacgagagggcgaaggagataataaggaaatacaggaagcaactggacaacatcgtggaaatactgctggagaaagaaacgatagagggagacgagctgaggcggatactgtccgaggagtttgaaaaggtggtggaatga

SEQ ID NO: 26646 - DNA, 1305 bp, Thermotoga maritima
gtgttgaaagaaaaacttctgagcaaaacggcccttctcggagtgatcggcctcgggtacgtgggactcccgctcgccgttgaaaaggcaaaagcgggatacagggtgctggggttcgatatccagaagaagagggtcgacatggtgaaccgcggggaaaactacataggagacgtggtcgacgaagacctcaaagatctcgtggaaaaaggtatgatcagggccaccacagatttttctgagatgaagaactgcgacgtcgtcacgatatgcgttccaacaccgctcgggaagtacaaggaacccgacctcacctacgtcataaatactgcaaaggagattgcaaagtacctccacagagaaatgcttgttgtgctggagagcaccacctacccgggaaccaccgaggaggtcgtcctgcccatcctggaatccaccgggctgaaagtcgggaaggatttttatctcgccttcagtcctgaaagggtggatcccggaaacaaaatttacaaaacgaagaacacgccgaaggtagtcggtggtgtgacggaaaaatgcacggagcttgcgaagatcctctatgaaaacgtgctcgaggcacccgttcacaccgtctcttcaccgagggcggcggagatggcgaaggtgctcgagaacaccttcagactggtcaacatctccctcataaacgaagtggccatcgtcgcgcgaagaatgggaatcaacatctgggaagtgatagacgctgctgcaacaaagccctttggattcatgcccttctatcccggacctggtgcgggagggcactgcatcccgatagatcccttctacctcgcttacaaagcgaaggagtacgacgtgaggctcgacctcgtggagatggccggtgaaataaacgacttcatgcccgagtacgtggtgatgagagttcaggacatcctgaacgagagaaagaaacctttgaacggctcgaaagtgcttcttcttggagtcgcgtacaagggtgatatagacgacacgagggagtcgcctgcgctgaaggtctgggaccacctcgaaaagaagaaagcggtagttgaattcttcgatccttacgttccggaagtgaagagaggagacaggattcaccgacgggtcgaactcactgaagagtacctgaaaggcgtggacatcgtggtgatcacgaccgcccacaagaacggagttgattacgacttcgttgtgaagaacgcgcccgtggtcttcgacaccaaaaacatcacaaaagacgtgaaagaaaacagagacaagatcatcctgctttga

SEQ ID NO: 26647 - DNA, 1041 bp, Thermotoga maritima
atgatggggaaaacagagtacttggattattacagtgggaagagagttcttgtcacaggtggtgctggagcggttggatcgaatctggttagaagactgttagatttaggagcttttgtgatagttatagataacctgagttccgggtatacctggcttcttcctcaagatgccccgaatctgctgttcatagagggtgatataacaaacgatgtcgacttaaagagagtgttcaacgaggaaccggagataatatttcaccttgcggcattttttgccaatcagaattccgttgattatcctgaaaaggatctttgggtaaatggatttggcactttgaaacttctggaatacaccagaatatatgggaaagttgaaaggttcgtctatgcatcttcaggctgttccatttatcctagcgatgctcccatgcctttcaaggaagatctgcctatatcctcctggatgagcacgccttatcagattacgaaggctctgggggaactttactgcaattacttctacaaaatgtacgacattcccattacaaaagcacgcttcttcaactcctttggccccggcgaagtccctggacagtacaggaacgttatcccaaatttcatatactgggcaatgcttggtaaaccgttacccatcacaggtacgggtgaagagacgagggatttcacttacgtaggtgatattgttgacggattgttgaggatgggatattacagagaagccataggtgaggctttcaatctcgcagccggaagggaagtgaagataaagtatctcgccgagaaagtgaacgaactcaccggaaataccgctggtattgttttcaaaccacgaagaaaatgggataccaagccaagaatgctcgcatccaacgaaaaagcaaagaaagtccttggttttaatcctgatccagatttcgacggaaggctcgctgagactgtagaatggtttaagcaaaattgggaacttataaaaaaatctgctgaatttggaccaggcgtcagctcggctgtgaggtga

SEQ ID NO: 26648 - DNA, 246 bp, Thermotoga maritima
gtggcgagcagagaggagatcttttcaaaggtgaagagcataatctctgaaaaactcggagtggatgagtcacaggtcacagaggaggcaaaactcatagacgatctcggtgcggattccctcgacctcgttgatctcgtgatggatttcgaaagcgagttcggtgtaaaggtggatgacgccgatcttgaaaagatctcaacggtcggcgacatcgtcagctacattgaaaagaaattggggtga

SEQ ID NO: 26649 - DNA, 915 bp, Thermotoga maritima
ttgcctggaaaacgaagaggttttttcgttgtttttttaataacgtttctgatactcgtgattctgttcatgtacggctacatctcctttgaaataaacaggctgtacggtggaagggtgtctccttttgaagactggaagagttatatcgcttttcttgcttccaaagttccgtttttgaaggacagaatcagctatcagcctcttaaagcggaaagtcccgctgagtactactcgagaatctatcagaggtacatcgagatatacaaccagaagatagacgaattgatcagcaaagaaaaagaactcgaagagcaggcgaaggtgctggaagctcaaagaaacgttgttgagaagatgatcgaagagattcaatccctaaagaatcaattgctcgaggagaaaaacaggctggaatcttacaagaagcaggtggacgaactcgtcaacgtgcttttgaacactgatccaagaaatctcgcaagcgcgctcaacgaagtggacgatgaaacactcgctgtgatctttaaaagaaccgatccagagtatgctggagagtttctcgaagcgctctccggtgtcaatccacagaaagccgcacgggtgatggaactcatggtgggtgtggagagtaccattgaaaggctcgaaacgctggtcaaacaggctcaggaagcggtgaaacagataaccgaaaaagaatctcagcttttccagaaagaagcgtacctgaaggcagtggcggatgctctgaacaacatcacaccagaggtagccgtcgatttcctgagaagagagaaggtggatccagaaaccttgagaacggttctttccatgatggaccgggaacacgcttctgttctggttcagtacatagttcagaacgctccggatcttctggaggagagaaagtga

SEQ ID NO: 26650 - DNA, 1002 bp, Thermotoga maritima
atggcaagagtggctattaacggtttcggtaggataggaaggctcgtctacaggatcatctacgaaagaaagaatcccgacatcgaagtagtggctattaacgatttgacagacaccaagacccttgcacaccttctgaagtacgactccgttcacaagaagttccccggtaaagtcgagtacaccgagaactctctaatcgtcgatggaaaagagatcaaggtcttcgcggaacccgatccttcgaaactgccctggaaggacctcggtgttgacttcgtgatcgaatccaccggtgtcttcagaaacagagaaaaggcagaacttcacctgcaggctggagcgaagaaagtcatcatcacagcgcccgccaagggagaagacatcaccgttgttatcggttgtaacgaagaccagctgaaacccgaacacaccatcatttcctgtgcgtcctgtacaaccaactccattgcacccatcgtgaaggtgctccatgagaagtttggaatcgtcagcggaatgctcacgactgttcactcttacacgaacgaccagagagttctcgacctgcctcacaaagatctgagaagggcaagagcagctgcggtgaacatcattccgacaaccacgggtgccgcaaaagcagttgcgctcgttgttcctgaagtgaagggcaaactcgatggtatggctatcagggtacctactcccgatggatccatcaccgatcttacagttctggtcgagaaagaaaccacggtcgaggaagtcaacgctgtcatgaaagaagccacagagggaagactcaagggaatcatcggatacaacgatgaacccattgtgagcagcgacatcattggaacgacgttctccggtatcttcgatgccacaatcaccaacgttatcggtggaaagctcgtgaaggtggcttcctggtacgacaacgagtacggatacagcaacagagttgtcgatacactcgaattgctcctcaagatgtga

SEQ ID NO: 26651 - DNA, 1965 bp, Thermotoga maritima
atggaaaaaatgaccataagagatgttgatctgaaaggcaagagagtcataatgagagtggacttcaacgttccagtgaaggatggggtcgttcaggacgacacgagaataagagccgcccttccaacgataaagtacgctcttgaacagggtgcaaaggtgatactcctgtcccatcttggaaggcccaagggagaaccttcaccagagttcagcctcgcacctgtcgccaaaagactctctgagcttcttggaaaagaagtgaagtttgttcccgctgttgtcggtgatgaggtgaaaaaggccgttgaggagctcaaagagggagaggttctcctccttgaaaacaccagattccacccgggagagaccaagaacgatcctgaactcgcgaagttctgggctagcctcgccgatattcacgtgaacgatgccttcggaacggcgcacagggcacacgcttccaacgttggaatcgcacagtttattcccagcgtagcgggattcctcatggaaaaagagataaagttcctttccaaggtgacttataatccagaaaaaccgtacgttgtggttcttggaggagcaaaggtatctgacaaaatcggcgtcatcacgaacctcatggagaaagccgacagaattctcataggtggagccatgatgttcaccttcctgaaggctcttggcaaagaggttggatcgtccagggttgaagaagacaagatcgacctcgcaaaagaactcctcgaaaaagcgaaagaaaagggtgttgagatcgttcttcccgttgatgccgttatcgctcagaagatcgaacccggtgtggaaaagaaggttgtcagaatcgacgacgggatacccgaaggatggatgggcctcgacataggacccgagacaattgagctcttcaagcagaagctctccgatgcaaaaaccgttgtctggaacgggccaatgggagtcttcgaaatagacgatttcgctgaaggcacgaagcaggtcgcacttgcgatcgcagcgctcacggaaaagggagcgatcaccgttgtgggtggaggagacagcgccgcggcggtgaacaagttcggtctggaagacaaattctcccacgtttcaacgggcggaggggcttctctcgaattccttgaaggaaaagaacttcctggtattgccagcatcgcggataaaaaaaaaataactcgtaaactgatcctcgctgggaactggaagatgcataaaacgatctcggaagcgaaaaagtttgtgtcgctgctcgtgaacgaacttcacgacgtgaaagagttcgaaatagtggtctgtcctccgttcacagctctatctgaagtgggggaaatactctctggtagaaacatcaaattgggagctcaaaacgttttctacgaagaccagggagcgttcaccggggagatttctcctctcatgctgcaagagatcggcgttgaatacgtgatcgtgggacattccgagagaaggcgtattttcaaagaagacgacgagttcataaacaggaaagtgaaagcggtgcttgaaaaaggtatgactcctattctctgcgttggagaaacactcgaggaaagagagaaagggctcactttctgcgttgtggaaaaacaggtgagagaaggtttctacggtctcgacaaagaggaagcaaagagagtggtaatagcttacgagccagtctgggcaatcgggacaggaagggtggcgacaccacagcaggcacaggaagtacacgcgttcataagaaagctgctctcagagatgtacgacgaggaaacagcgggatcgataaggattctctacggtggaagcataaagccggacaatttcctcggtctcatcgttcagaaggatatagatggtggtctcgttggaggagcgagtctcaaagagtctttcatagaacttgcacgaataatgagaggtgtgatttcctga

SEQ ID NO: 26652 - DNA, 930 bp, Thermotoga maritima
gtggcttttcttctgactgccctgggaatagcgattctggtgatcggcgcaaattggctcgtcacgggagcgtcgtcgctggcgctgacactggggatctccaagttgatcgttggactttctgttgttgcttttggaacgtcccttcctgaactcgtttcttctctcgtttccgccagtaaaggatattccagtatagcgatttccaacgtggttggaagcaacatagcaaacgttggactctgcctcgggctcgctgccgttcttcgggctgtgccggtgaaaagaagcactgtgagatctgaaattccgttcatgatccttgcgaccatctctttcatcagtttgtttctgaaaaattattatctttcctggcacgatggggtggtgttcctttctttcatggtcatcttcatgtattacctgatcacatcagcgaaggaagtggtggaagaggaactggaggagataaaaccacagaagagtgttgcggtcagtcttttgatgatcgtggggggaatccttgctctctggttcggaggggaccttgccatagaaaacgcggtgaaaatagccgaaactttcggtctttctcaagcgtttataggtttgactgtgatagccgttgggacttctctgccggagcttgtggtgagcatcgtttcgacggcgaaaaaagagagtgacatcctcgttggaaacatcgtgggaagcaatgtcttcaacattcttctcatactgggagtgagttcgttctttggaagattgactgtggatgtcaactactctgtggatctctggtttcttttcataacgtcggcccttctccttgtttttgctgtctccaggaggagaatttctcgctttgaaggggcagttttcctaatcatctactctgtgtacgtttattttgtagtactcagaggttag

SEQ ID NO: 26653 - DNA, 1221 bp, Thermotoga maritima
atgaacatagcgatgttcagcgatacctacgctcctcaaataaacggcgtggcaacgtcgataagggtgtacaaaaagaaactgacggaacgtggtcacaaggttgtggtggtggctccttccgcccccgaggaagaaaaggatgtattcgttgtgaggagcattccctttcccttcgagccgcaacacagaatctccatcgcttctacaaaaaatattctggagttcatgagagaaaacaacgtccagataatacacagccactctccctttttcatagggtttaaagcgttgagggttcaggaggaaatgggattgccacacgttcacacgtatcacacactactgcccgaatacagacactacatcccaaaacccttcactcctcccaaaagattggtggaacacttcagcgcgtggttctgcaatatgacaaacgtggtgatcgctcccacagaagacataaaaagagaactcgaaagctacggcgtgaaaagacccattgaagtgttacccaccggtatagaagtggagaaattcgaagtagaagcacctgaagaattgaaaagaaaatggaatcctgagggaaagaaagtggttctctacgccggaagaatagctaaagagaagaatctggattttcttctgagagttttcgagagtttgaacgcaccgggcatcgccttcattatggtaggagacggtcctgaaagagaggaagtggaggaattcgcgaaggagaaaggactcgatttgaagatcacaggattcgtacctcacgacgaaattcccctctattacaaactcggagatgtctttgtttttgcttcgaaaacggaaacacagggactggtactcctggaggccttggcttccggccttcccgtggtggctctgaagtggaaaggagttaaggatgttttgaaaaattgcgaagcagcggttctcatagaagaagaaaatgaaagactcttcgccgaaaagataaaacacattctgaaaaacgatcgactcagagaagagctctcaacaaaggggagagaattcgtcagaaaggaatggtccgttgatcgattcgttcaaaggcttgaagagatatacacgagagcaatagaagaaggtcctgttgaaataaacacatctctcatgataaaggaattcgtcaagttcgaaaaattgaaagagttcttctcaaagatcgaagacagaatctggaggtga

SEQ ID NO: 26654 - DNA, 1416 bp, Thermotoga maritima
atgaagatctccatcatcggagcaggaagtgtgaggttcgcacttcagcttgtgggagacatcgctcagacggaggaactttcaagggaagatacacacatctacatgatggacgttcacgaaagaagactgaacgcatcttacatcctcgcaagaaagtacgtggaagagctgaactctcctgtgaagatcgtaaaaacatccagtctggatgaagccatagatggagcagacttcatcataaacaccgcctatccttacgatccgaggtaccacgacagcggctctcaaagatgggacgaggtcacaaaggtcggtgaaaaacacggctactacagaggaatagacagtcaagagctgaacatggtttccacttacacctacgttctttcttcttatcccgacatgaagctcgccctcgagatagcggagaagatgaaaaagatggcacccaaagcgtacttgatgcagacggcaaatcccgtcttcgagatcacgcaggcggtgagaaggtggactggtgcgaacatagtggggttctgccacggtgttgccggggtttatgaagtcttcgaaaaactcgacctcgatccggaagaggtagactggcaggtcgccggggtgaaccacggtatctggctgaacaggttcagatacagaggagaagatgcatacccgcttcttgacgagtggatagagaagaagctaccagagtgggagccgaagaacccatgggacacacagatgtctcctgccgcgatggatatgtacaaattttacggtatgcttccgataggtgacaccgtgaggaacggcagctggaagtaccactacaacctggagacgaagaagaagtggtttggaaagttcggcggtatagacaacgaagtggaaagaccgaaattccacgagcaactcagaagagcaagagagcgcctcataaaactcgcagaagaggttcagcaaaacccaggtatgaaactcacagaggaacatcccgagatcttcccgaaaggaaaactcagcggagaacagcacattcctttcatcaacgcgatagcgaacaacaaacgtgtgaggctctttctgaacgtggagaaccagggaacactcaaagactttcccgatgatgtcgtgatggaacttcccgtctgggtggactgctgtggaatccacagagagaaagtggaacccgatctcacccaccggataaagatcttctatctgtggcccaggattctgagaatggagtggaacttagaagcatacatctcgagggacagaaaggtgctcgaagaaatcctcatcagagatccaaggacaaaatcctacgagcagatcgtgcaagtgctcgatgagatcttcaacctgccgttcaacgaagagttgaggagatactacaaagagaaactctga

SEQ ID NO: 26655 - DNA, 1416 bp, Thermotoga maritima
atgattctgtttggaacgggtggaattcgaggcgtgatgaggaaaggggaattcgacgaagaaacggtgaaaagagcctctctgagcaccgccctctggctgaaagagaaaggtcagaaaagcgtggtgatcgcttacgacacgagaaagaactccaaggagttcgcagagctcgctggcagagttttcgccggtgaaggtatagaagcctacgtttttcctgaacctaccccgacaccggttctttccttcgctgtaagatacatgaaaacgggtggaggtgtggtcatcaccgcgagccacaatcccccggaatacaacggctacaaggtctacacctgggatggtgtacaagcgatacccgaatacaccaatgagatcaccgagatatacaaaaaagtcgatctttcccatgtgaaagagggagaaatcaagtttgtaccccctgaagtgaaagagagctacataaaagctgtactcgaaatcgtctcaaatctcccgatgaagaccgatctcgatatcgcctactctccgcttcacggaacaggagcaaactacgtgcctgaggtcctgaaaagactcggattcaaagtcagactcgtagaagaacagatgaaacctgatccaaacttctcaaccgttcccacaccgaatcccgaggaagacgaagcactcgttctcctgaataaaaaaggagctactctgggactcgccacagacccggactgcgatagagtgggagtggtcttcaaagggcgaagactcacaggaaaccaggtaggtgtccttctcacagactttctcctggatcatgtgaaagtggaaaatcccctcgtgataaagacgatcgttacaacggacatggtgagaccgatctgcgaagagaaaggtgccttcctggaagaaacgccgactggattcaagttcataggacacctgatagaggaacacaccaaaaaaggtgacaggaacttcgtcttcggtttcgaagaaagctgtgggtaccttgcgggaaaccacgcgagggacaaagacggtgtggtgggcagtgtgctctccgctgttgccttcagcaactacgatccttacgagaagctcgaagaactctaccagaagtacgggtactacatggaaaagctcatcaatttcaaatttgaagatgttgacagagcggttgaaatatacagatccctgaagaactacgatggtatcatagattattcaaagggttacggaaacgttattccgaacgagaccatagccttcgtctttgaaaaatcaaggatcttcgtgagaccttcgggaacagaaccgaaactcaaggtttacatccacgtgagaggagacacgagagaagaagcggaggaattgatgaaagaaagcgaaagcaagataaaggagatcctgaagctgtga

SEQ ID NO: 26656 - DNA, 783 bp, Thermotoga maritima
gtggacagtgaaagaagggagctgatttctttgatagttgcaagggggctaaccaggaagttcggggatttcaccgcggtcgatcacatcgatctttcggtgaggccgggggagatatacggctttttgggaccgaacggtgcggggaaaaccaccacaataaagatgctcaccggagttttgaaaccaacggaaggagaagtggaaatcctcggcatgaaaatgagcacccacgagatcgagataaagaagagtatcggtgtgataccagacgagccaaagatctattcgcatctgacggggaaggagtttctggatttcatcatcgagatttacgatctgaaagaagaagagatcgataagaggatagcggagctctgcgaggccttcaaagtggattatctcggaaaaagggtcggtgagatgtcccacggtatgaaacagaagctcatgctggtcagcgttttcatgagaaagccgaaggtgatatttctcgatgaaccgacggtagggctcgatgcgaagagtgcaaggatattgaaactccttttgagaaagtacgctgacgagggagccgcaatatttctcaccacccacatattggagatcgcagaaaagatgtgcgataggataggcattataaacaagggcagactgatagcggaaggtaccatggaagagctcagaaagctcgccggtcagaaagaagccagtctggaggatctgttcctccagctcaccgcggagggagaagagatagaagagatcataaaggagctgtga

SEQ ID NO: 26657 - DNA, 882 bp, Thermotoga maritima
gtgagagcgtttgtctttcccggacagggatcgcagtactctggaatggcgaaggatttttccgtttacgagtcttcgaaagaaatattcgaaagatcgaaaaaggtactgggctttgatatcacggagatcatgaacggtgacgaagaaacattgaaactcacagagaacgcccagccttcgatctacataacgagttacatcgcttttctcgagctggagaagagaggtatcctgcccgatgttgtggcaggacacagcctcggagagtacaccgccctggcagtggcaggagtctacgatttcgagacggggctttatcttgtgagaaaaaggggagagtacatgtcgaaggcactggaaccggggaaaggcacgatggccgctgtcatagggctcaacattgaaaccatagaagaagtggtgaactctatcgaaggggtttacatagcgaactacaattcccacgatcaggttgtgatcagtgggttgaaggaatcggtggaaaaggcaatggagattctcaaagagaaaggagctcgccgtgtcgtggaactcatggtttcaagcccgtttcacacaccgtttctggagtacgccagggagaaaatgaaggaagaagtggagaaggtggacttcaaaaagccgagatggcccatcgttatgaactcgacagcaaaaccaacggaaaatcctgaagagataaagaggaacataatcgaacagattacagggccggttctgtggaaacagtcggttgacaccatgaaaaaaatgggagtaaccgagttcgttgaagttggtccaaagaccgttttgaaaaacctgtgtagaagaatgggagcgaacgcaaagcacttcacggaaattctttcagaatga

SEQ ID NO: 26658 - DNA, 414 bp, Thermotoga maritima
atgaacatagattacgtgaagtcgatccttccgcacaggtatccatttctcctagttgacggtgtgatagaagaatcagaagacaggatcgtcgccttcaaaaacatcagcatttctgatcccgtcttccagggacatttcccggagtatccgatatacccgggtgttctcatcgtagagggccttgctcagaccgctggaattctccttttgaagagtgtggaaggaattcctctgtttctcggaatagacgaagcgcgtttcaagaaggaggtacgtccgggtgacaggctgatctacgaagtgagaaagctcggtgaaaaactcggcacggttcaggtggaaggagttgcaaaggtcgatgacaaaatcgtggcgaaagccaggcttttgctgggggtgaaaaagaaatga

SEQ ID NO: 26659 - DNA, 1239 bp, Thermotoga maritima
ttgaagcgggtagttatcacgggtatgggtatcgtgagtccctttggtgttggaaaagagagaaatttagaaggacttagagaaactaaagtaacgatagatcgaatatcttcttttgatgcttctaaccttcccgtccagatcgccgcagaggtgagagatttcaaaccggaggagtacataaatccgaaactggtcaggagaacagaccgtttcgttcacttcgctctggtcagcgcgaaagaagctgtggaagacgccggtataaacttcgaaccgtacgccgacaggacagccaccatcataggatccggcatgggaggatttctgacgctcgacagcgagaacaacaaattcctgagtcagggtccaagcagagtcagtccgttcctgattccgatgatcctcatcgatatggcttccggtgtcgttgcaatggaatacggactgaaaggaccgaacttctcttctgtaagcgcctgtgcttcatccctccacgcggtagctctcggtgctctcctcataagacacggatacgcggatgtggcagtcgtcgggggaaccgaggcaacgattgctccacttcccatcaccgggtttgccaacatgagagcactctcaaggaggaacgacgatccaaagcgtgcttctcgtccgttcgataaagacagagacggctttgtgatgggtgaaggcggtgcggttctcatactcgaagccgaggaagtggcaaaatcgagaggagcgaaaattctcgcggagatcaagggagtgggtatgacggacgacgcgtaccacttcagtgctccagatccagagggcagaggggcagcagaagccatgaaactcgccctgaaagaatccagtctggctgtcgaagacatcgactacgtgagctgtcacgccacaagcacaccagcaggtgatgaagcggaactcaaagcgataaagaaagtccttggagaacacgtaaagaacgtcgccataaactcttcgaaagcccttataggacatctccttggtgccgccggtgcttccgaactcgttcttgccatccttcagatgcagaactctttcgtccacggcatgccgaaccttgacaatccgatcgacgaagcgaaaggaaccggccttgtcggtaaagaacccgttcagatggagatcaaaaacttcataaagaactcctttggtttcggcgggcacaacgtgtccatcgtggtggggaggtatgaatcatga

SEQ ID NO: 26660 - DNA, 648 bp, Thermotoga maritima
atggaaggaagaattcctctcataggtgaagagttcccaagagtggaagtaaagaccactcatggaaaaaaggttcttccggacgacttcaggggaaagtggttcgttctcttcagccatccggctgatttcactccggtgtgtaccaccgagttcgttgcgtttcagaagaggtacgatgagttcagaaaactcaacacggaactcataggtctcagcatcgaccaggtgttttcacacatcaagtggatcgagtggatcaaagaaaaactaggagtcgaaatcgaatttcctgtcatagcagatgacttaggagaagtttccagaaggctcggattgattcatcccaacaagggaacaaacacggtgagagccgttttcatagtcgatccgaacggaatcataagggccatcgtctactacccgcaggaagttggaagaaacatcgatgaaattctcagagcggtgaaagcccttcaaacgtccgatgaaaaaggagttgccattcctgccaactggccaagcaacgagctcataaacgattctgtgatcgttcctccggcaagcagtgtggaagaagcaagaaaaagactggaatcgaaagatttcgagtgctacgactggtggttctgttacaaaaaggtataa

SEQ ID NO: 26661 - DNA, 1188 bp, Thermotoga maritima
atggagaacttcgtcttccacaatcccacgaagatcgtctttggaagaggaacgattccaaaaataggagaagagataaagaacgcgggaatcagaaaggtgctgttcctatacggtggtggatcgataaagaaaaatggcgtttatgatcaggttgtcgattcactgaaaaagcacggaatagagtgggtagaagtatctggtgtcaagccgaatccagtcctttccaaggtccacgaagccgtcgaggtggcgaaaaaagaaaaggtggaggctgttcttggtgttggtggaggaagcgttgtggattctgcaaaagcagtagcggctggtgctctctacgagggcgacatatgggatgcttttatcggtaaataccagatcgagaaagcccttcctattttcgacgtgctcacaatctcggcgacaggaacggagatgaacggtaacgctgtgataacgaacgagaaaacgaaggaaaaatatggagtgagttcgaaggctctctatccaaaagtatccataatcgatccttctgttcaattcactcttccaaaagaacaaacagtttatggagcggtggatgcgatctcacacatcctcgagtactatttcgatgggagcagtcctgagatctccaacgaaatagcggaaggtactatcagaacgatcatgaaaatgacagaaaggttgatagaaaaaccggatgactacgaagcaagggcaaatctcgcgtggtctgcaacgatcgctctcaatggaacgatggcagtcggaagaaggggcggagagtgggcttgtcacaggatcgagcactccctcagcgctctttacgatattgcacacggagcgggtctcgccattgtgtttccggcgtggatgaagtatgtgtacagaaagaatcctgcgcagttcgaaaggtttgcgaaaaaaatcttcggatttgagggtgagggagaggaactgattctgaaagggatagaagctttcaaaaactggctgaagaaggtaggagctcctgtgtccctcaaagatgcgggaatcccagaagaagacatagacaagatcgtggacaacgtcatgcttcttgtggaaaagaatctgaaacctaaaggagcgagtttgggaagaataatggtgctcgaaagagaagacgttcgtgaaatattgaaattagcggcgaaatga

SEQ ID NO: 26662 - DNA, 1110 bp, Thermotoga maritima
atgaaaaaagaaaagaaggattactacgaaattctcggtgttcccagagacgccacacaggaagaaataaaaagggcttacaagagactcgtaaaagagtggcatccggatcgtcatccggaaaacaggaaggaagccgaacagcgttttaaggaaattcaggaggcctacgaagtcctcagcgacccacagaagagggctatgtacgatcgtttcggatacgtgggagaacaacccacgtatcaggaaacagaatctggtggcttcttcgacgatatattcagagactttgaaaacatcttcaacagagatatattcgacgttttctttggcgaaagaccacaccaggaagaaagaagagaatacgcccgaagaggcgaagatataaggtacgaaatagaagtaactctctccgatttgatcaacggagcggagatacccgtggaatacgaaaggtacgaaacctgtccgaggtgtggcggaactggcgtagaacccaacgctggatacatggattgtccaagttgtggtggaacgggaaggatcagagaagaacgaagatcgttctttggttacttcgtcagcgagagaacctgtgagaggtgtggcggcacagggaagattccacgggaatactgccacgagtgtggtggaagcggcagagttctcagaaaggtcagaagaacggtgaaaatcccaccaaatgtggaagatggtactcatcttagaatcactggcggtggaaatgcgggatattacggtggaccttacggtgatctgataattatcgtccgtgtgaaaccagatcccagattcaagaaatccggttcagatctcgtgtatgatgtcacaatagactaccttcaggctatcttgggaacaaccgttgaagttcctcttccagaaggcggtacgacgatgttgaagattcctccgggaactcagccggaaaccgtcttcaggttgaagggaaaaggccttccaaacaggtatggaaggcgcggagatctcatcgtgaacgtgcacgttgagataccaaagagtctctccagagaggaaagaaaagtcctcgaagaactggcgaaaaaacgcggagtcacgatcggttag

SEQ ID NO: 26663 - DNA, 1068 bp, Thermotoga maritima
gtgaagaaagcgatagttctgtgtgccggaaaagggacaagactcagaccgctcacattcacaactgccaaacaccttatccctatcgctaacaagcctattctcttctacagcctggaaaacatcgcgcgagccggtatcgaagaagtgggaatcgtggttagtcctcacaacgccgaagagtttaaaagcatagttggtacaggcgaaaacttcggcctcaggatctcttacatcattcaggaagaacctaagggccttgcacacgccgtctgggtttcacgggaatttctcggagacgaggatttcatgatgtatctgggggacaacctcattctcgaagatctgggaaaattcgtgaaagattttgaaaattcggactatgccgcttcgattctactatcgccggtcaaagatccaacccgtttcggtgtagctgtaatggaaggtgacagagtgataaaggttgtggaaaaacccaaaactccccccagcaatctcgccatcgtgggactctatctcttcagaaacaagatcttcgaaggaataaagaacataaaaccttcctggaggggagaactcgagataacggacgccatcgaataccttattgagaagggtgaaaaagttcggggttacatcgtttacggttggtggaaagacactggaaagccagaagatctgttagaggcgaacaggaagatcctgatggagacaaccgaagaacttctcggagaaatggatgacaagtcctccatacaggggcccgtgagaataggaaaagcgtcgaaaatcgtcaattctgtgatcagaggtcccgcggttataggagagaattgtttcataaagaactcctacgtagggccctattcctcaataggaaacagagtgatactcgaagattgtgaagtggaaaacagcatcgtgatggatgaatgctctataacaggtgtggaaaaaagaatagactcttccatattgggaaagggagtttctgtgaaaggatcgcagaagagaccggcgagcttgaatctcatcctggggaacatgagtcgggtggagctttaa

SEQ ID NO: 26664 - DNA, 1284 bp, Thermotoga maritima
gtggaaatcgtggatgtaagagcaagagaggttctggattcgagaggaaaccccaccgttgaagcggaagtcgtgcttgaagacggaacaatgggaagagccatcgtaccctctggtgcctcaacgggaaaattcgaagccctggaaatcagagacaaagacaagaagagatacctcgggaaaggtgttctgaaagcagtagagaacgtgaacgaaaccatagctcctgcactgatcgggatgaacgcattcgaccagccactcgttgacaagacattgatagaactggacggcaccgaaaacaaatctaaactgggtgccaacgccatactcgccgtttctatggcagttgccagagcagcagcgaattaccttggattgcccctctacaaataccttggaggagtcaacgcgaaggttctgccagtacctctgatgaacgtgatcaacggtggacagcacgcagacaacaatcttgaccttcaggaattcatgattgttcccgccggatttgacagcttcagagaagctttgagggcaggagcggaaatattccacacgttgaaaaagatactccacgaagccggtcacgtgacagcggtcggagacgagggtggattcgctcccaatttgtcttccaacgaggaagccataaaagttctgattgaagccatagagaaagcaggctacaaacccggagaagaagttttcatagctctcgactgtgcggcatcttccttttacgatgaggaaaagggagtttactacgtcgatggtgaggaaaaatccagcgaagttctcatgggatactacgaagaactggtggcgaagtaccccatcatatccatcgaagatccgttcgcggaggaagactgggatgcatttgtggaattcacaaagagagtaggaaacaaggttcagatcgttggagatgacctttacgtgaccaacgtgaaaagactttccaaaggaatagaactcaaagcgaccaactccatactcatcaaactcaatcagataggcaccgtcacggaaactctcgacgcggtggagatggcacagaagaacaacatgacagccatcatttcccacagatccggagagagtgaagacacgttcatcgcagaccttgccgtggcaacgaacgctggtttcatcaagacaggttccctctccaggagcgaaaggatagccaagtacaaccagcttttgagaatcgaggaagaactcggaaaagtggcagaattcagaggtttgaaatctttctactctataaagagataa

SEQ ID NO: 26665 - DNA, 1293 bp, Thermotoga maritima
atggactggaagaaatacggttacaacacaagggctcttcacgcaggttatgaaccacccgagcaggccacaggatcgagagcggtccctatatatcaaacgacttcttacgttttcagagactctgatcacgcggcgagactcttcgcactggaagaacctgggttcatctatacaaggattggaaatcctaccgtctcagttcttgaagaaagaatagccgccctggaagaaggggtgggagccttagcggttgccagtggacaagccgctataacttacgccattttgaacatcgcgggcccaggagatgagatcgtcagcgggagcgcgctgtatgggggaacgtacaatctgttcagacacactctctataaaaaatccggcatcatcgtgaagtttgtggatgagacagatccaaagaacatagaagaggccatcaccgagaaaacaaaggcggtgtaccttgaaactatcgggaatcccggtctcacagtgccggactttgaagcgatagcggagatcgctcacagacacggtgttcctttgatagtggacaatacggtagctccgtacatattcaggcccttcgaacacggtgccgacatcgttgtttattcggccacgaaattcatcggaggacacggaacatcgataggcggtctcatcgtagacagcggaaaattcgactggacgaacggaaagtttccagaactcgtggaaccagatcccagctaccacggtgtgagttatgtggagacgttcaaagaagcagcctacatagcaaaatgtagaacccagcttttgagggacctgggaagctgtatgagcccgttcaacgcgtttctgttcatcctcggacttgaaaccctcagcttgaggatgaagaaacactgtgaaaacgcactgaagatcgttgaatttctgaaatcgcatcccgccgtgagctgggtcaactatccgatagctgaaggcaataaaaccagagaaaatgcgctgaaatacctcaaagaaggatacggtgcgattgtaacgttcggtgtgaaaggcggaaaagaggcgggaaagaagttcatagacagtctcacactcatttcccacctcgccaacattggtgatgcaagaactctggctattcatcccgcttcgacaacccatcagcagctcacggaagaagagcagttgaaaacgggtgttactccggatatgataagattgtctgttggaatagaagatgtggaagatatcatagccgatctggatcaggctctcagaaaatctcaggagggatga

SEQ ID NO: 26666 - DNA, 1461 bp, Thermotoga maritima
atgaaagtggtattcgtttcttacgaggtttttccgttcgcgaaagtaggaggattggcggacgttgctggaactcttccaaagtacttgaagaaacacggggtggatgtcacgatagttatgccgaaacacagaatcgttgaaaaaaatgcggagaaatttgggtatgagatcaagaaagtagccgaaagtctctctgtttctcatgtcaaaaccgatcaaaagttcgatatatatgaatccgttcttcccggtagcgatgtgaaaacgtatttcgttgccaacgattactatttctctgcggaagatgtctacgcggggccagatcttggtgaacaggcgattttcttctgtgcggccactctggatctggtaaaacatcttgatttgaagcccgatatcgtccatgtgaacgactggcaaaccgctttgatccccgtctatttgaaaactgtgtacagggacgatccttacttttccagaacggccacggttttgacaatacacaaccttggataccagggcgtgttcgatccaaagtacctctcttttgcaggccttcccgattatgtttacactatcgacggtcttgagttctacggacagctgaatttcctcaagggcggaatagtgttcagcgatgtgataaacacggttagccccacttacgccgaggaaattcagacggaagagtatggtgagaaactcgatggtgtactgagaatgcgctcgaaggatctctacggtatattgaacggaatagattacgagctttataacccagccacggacagatacatttacgtcaactacgacgtgaatcgtcttgaactcaagtgggaaaacaaggtgaagctccaggaagaactgggacttcccgttaacaaggaaacggctgtagccgggttgatcagcaggctcgtccctcaaaaaggtctggaccttctggttgatgtgatggattatctgacgctctttgatcttcagatcgttgttctaggaacaggagatgaacagtacgagaacgctttcagaaagttccaggaaaggtatccagacaaagtatcagcgaacataaagttcgatgtcgagctggcgcagaagatatacgccggtgcggacatattcctcatgccgagcagatacgaaccgtgcggtttgggacagatgttcagcatgagatacggaacaatccccgttgtgagatacacgggaggcctggcggatactgtgaaagaatacgatccacaatcgatggaaggtacgggttttggattcaagaagtacgattccgctcatcttttgaaggctgtttcgaaggctttgcacttttactacagggaaaaagatcattggaggagaatcatgacaaatgccatgaacacggatctgtcctgggacaggtccgccaaagagtacgttgatctttacaaaaaagcccttgcaaaggttggaaggtga

SEQ ID NO: 26667 - DNA, 1011 bp, Thermotoga maritima
atgcccgaattcagaaaagatcccattataaaaagatgggttatcatagccaccgagagagcgaaaaggcctcatgattttgcaagaacgaaagtagaagaagtgcgggaaggtttctgtcccttcgattacggtaatgaacacaccacaccaccggagattttcgccttcaggcctgcagacacggaacccaacacaccgggctggtgggtgcgtgttgttccaaacaagtttccagcggttgatcccaacgcacctttgagaaaatacggaagaggtatgtacgatgcagctatggggtttggttaccacgatgtggtcgttgaaactcccgatcacaattctcaccttgccgttatggattacaagaacgtggaagaagtcatctgggcttacaagatcagatacgaacagctcatgaaggatgagagaataaaatacatactgattttcaaaaaccacggaagggacgcaggagcttctctcagccatcctcacagccagataatcgcgctccctatcatgccaaagagggttcaagaagaactcgacggttctaaggaatattacgagtacaaggaaagatgtcctttctgcgatatcatagacgaggagaaaagagaaagggagagaatcgttgaggagaacgatcacttcattgctctggagcccttcgccgccagatttccgttcgaaacatggattcttccaaagaggcacatgaacagctttcacctgatatccgaggatgaagttgggtcccttgcaaaaatcctaaagaacgttctctacaggatatacgccgctttagataatccgccctacaaccttttgatccacaccgcccccacgagtctcgaaggcaaggattattaccactggcacatagagatattcccaagattgacaaaagtagcgggcttcgaatggggaacgggattctacataaacacagtacccccggaagatgccgctagatatctgagagaagtcagtttagagcaagtttga

SEQ ID NO: 26668 - DNA, 1080 bp, Thermotoga maritima
gtgtgggaattctacatgcccacggatgtcttttttggagaaaaaatcctcgagaagagaggaaacataatagatcttcttggaaaaagagctttggtagtaaccggcaaatcttcttcgaaaaagaacggatctctcgatgatctgaaaaagcttctcgacgaaacagaaatatcctacgagatcttcgatgaagtcgaggagaatccgtctttcgacaacgttatgaaggctgttgagagatacagaaacgattctttcgatttcgtcgtgggactcggtggaggaagccctatggatttcgccaaggcggtggccgtacttttgaaagagaaagatctttccgtcgaagatctttacgatagagaaaaagtgaagcactggcttccagtcgtggagataccaaccaccgctggaacgggtagtgaagtcactccgtattccatactcaccgatccagagggaaacaaaagaggttgtacactcatgtttccggtgtacgcgtttctcgatcccagatacacctactccatgtcagatgaactgaccttatcgactggagtcgatgcgctttctcatgcggtcgaaggatacctttctagaaagagtacgccgccttccgatgccctcgcgatcgaagccatgaagataattcacaggaatttaccgaaggccattgaaggaaacagagaagccagaaagaagatgttcgtggcctcctgccttgccgggatggtgattgcgcaaactgggaccacactggcgcacgctctgggttatcctctaacaacggagaagggaataaaacacgggaaagcgacaggtatggtactaccatttgtaatggaggtaatgaaagaagaaattccagaaaaggtggatactgtgaatcacatattcggcggcagtcttttgaaatttctgaaagaactcggactttacgaaaaagtggcagtttcctctgaagaactggagaagtgggtcgaaaagggttccagagcgaaacatctcaaaaacacgccgggtaccttcactcccgaaaagatcagaaacatatacagggaggcactcggggtgtga

SEQ ID NO: 26669 - DNA, 765 bp, Thermotoga maritima
gtgggaaatatttacaagcgattcgcacgagtttttcacgaggggccgtacacatcgttctcgagaagaatagcgaaaaatttcgccaagattctggaaaactttcatattcgaggaaaaaaagtgctggatgtggcctgtggagaaggaacattcgctgtggaaatcgccaagcagggcttcaaagtggtgggagttgatctttcatccgagatgctgaagtttgccagaaaaagagcaaaggaagaaagcatctctgtggtttttttgaaaaaagacatgagagaactcgattttcacgaagaatttgatatcgtcacctgctggtttgacagtctcaactatctgctggattacaaagatttgaagaaaacttttgagaaagttcatgaagctttgaaaacaggtggagcgtttcttttcgatatgaacaccgtttatggacttctgatggccaatcaggaaggccccgtgtacattcagcaggatggaaaggatatcttcgaagttcaaactatagagttcgatctggaggaatccgtcgccaccttctatgtgaccgttttcgaaagaaaagaagaggagctgtgggagagattcgatgagatacacagagaaagaggctacagagtgaaagaaatcgcgtctgcactgagtgaaacgggctttgtgttttctttttatgaagatctcctcagcaagtcacctctgaccagctacagtagaagactgtggtgcgctgcgaggaaggtgagcgcaggatga

SEQ ID NO: 26670 - DNA, 1320 bp, Thermotoga maritima
atgacaattgagaccatcaaaagaatcatcgaagaggagaatgttcgattcatcaggctgcaattcaccgacatcaacgggaccttgaagaatttagagataacgccggatgtttttctcgaatcctgggaggacggaatcatgttcgacggttcatccatcgagggttttgtgagaatcgaagagtctgatatgtacctcaagcccgtcctcgacaccttcgccgttcttccgtggacggtcgatggtgcaaagagtgcaagagtcatctgtgacgtttacactccagatggtaaaccctttgagggagatccccgttacagactaagaagaatgatggaaaaagcagaacagctgggttacacaccgtatgcgggtcccgagatggaatttttcatccttcccatcaacgaaaaaggagaacctgttcctgagtttcttgaccatggaggatatttcgatcttctgccgctcagtaaagtcgaggagatcagaagggacatcgcgatagctctcgaaaagatggggatcactgttgaagcaacgcaccacgaagttgctccctcacagcacgaggtggacttcaggtacgacactttcctgagaaccgccgacaatgcccagaccgtgaaactcgtcatcaaaaccatggcaatcttccacggatatcatgcaaccttcatgcccaaacccttctacggtgtgaacggatcgggaatgcatgtccacatgagtcttttcaggggtgacaaaaatgccttctacgatcccgacgatcctcttgggctttctaaagaactcagatacttcgttggtggtatattgaagcacgccaaagctctcgcagccgtcacaaatcccacgataaacagctacaagagactcgttcccggttacgaagcgcccgtttacatctcctggtcagttggaaacagaagcgccctcatcagaattccaaaggcaagaggaaaagcgacaagattggagtacagatcacccgatccatcctgtaacatctatcttgccttcgcggctatcctcgcggcaggtctggacggtatcatcaacaaaatcgagcctcccgcgccggttgaagaaaacatttaccacatgacgtctgagagaagggaagaactcaacatagaatcgcttccaggatcactgaaagaggctgtcgaagaactcaagaaagacgatgttataatagatgcactgggagaacatatattcgaaaaatttgtggaggctgccgaaaaggattggaaggaattcagcacctacgttacaaactgggaactgcagcgctacttgtatctctga

SEQ ID NO: 26671 - DNA, 1479 bp, Thermotoga maritima
atgtacgttctcgcaatagatcagagtacctctggtacgaaagctattatattcgatgagaaaggaggaattgttcacagggtaacggtgtaccacaaacagtactatccaaaaccaggctgggtagaacacgatcctgaggagatctttcgaaacaccttagatgcatgcagaaaagtcattgaagaatcgggtataaaaccgctcgagatagaagctctagctattacgaaccaaagagaaacaaccatcttgtgggagaagaaatcagggaaaccagtctacaacgctgtggtctggcagtgtcagagaggggcttctctctgtgaagagataaagaaaaggggattggaagggaagataaaagaaaaaacaggactcgtagttgatccttatttctctgccagtaaaatcaggtggattctggacaatgtggaaggcgtaaaaaacaaggcaaagcaaggagaaattgcttttggaacagtggacagctggctgatctggaaattgactaaaggggaagttcatgcaacagacttttcaaatgcgagccgcacacttcttctcaacattcatgaactgagatgggatgaagaagtactggagatctttgaaattccacctgaaatcctccctgaactgaaaagttcagattctgtcttcggttacaccgatttgggatttttaccgaaaaaaattcccatagtcggtgtcatgggagattcttctgccgctctctttggacagggaggattctattcaggggatataaaggttacctacggtacagggagttccaccatgttgaacataggggaaaaaccaaatgtatcagattcgcccattgtgtgctctgttggatgggtcgtaaaagagacttccagttatgtactcgagggtaacattcattcagcaggtgacacaattgtttggttaaaggaaaaactcggaatcataagcgatccctctgaaacagaaaaaatagcactctctcttgaaaacaacggaggggtttatttggttcctgccttcgttgggcttggggccccgtactggcgaagtgatgtgaaagcggctattctggggcttcaaaggaatcatggaaaagaacatgttgttcgagcggctttggagtccatagcctatcaagtgagagatatcttcgaggagatggtcagaatatccagtaaggaacccaccgaggtcagggcagatggaggaatcacaagaaacagatttcttatgcagtttcaggcggatattctgaacataccagttttagtaagcaacatagaggaagtatcagcgagaggagtagcttttgttgctttgcttcatctcggagcgttcagcgatcttgaagagataaggcaaaagataacttacagggaaaaatacgaaccccggatgggtgatgaattacgggaaatgtactatgaagggtggaaaactgctatcagaaaactactcaccgagtga

SEQ ID NO: 26672 - DNA, 900 bp, Thermotoga maritima
atgtttctagtgatttccgtcgtggggagttcaaacatagatatcgttctgaaggttgatcacttcacaaaacctggtgaaacccagaaagcgatagagatgaacgtttttccgggtggaaaaggggcgaatcaggctgtaacagtcgcaaaaattggagagaaaggatgccgttttgtaacgtgcattggaaacgatgattactctgatctgctcatagagaattacgaaaaactcggaataactggatatataagagttagtcttcctacaggaagagcgttcatagaagtcgataaaacaggacaaaacaggatcatcatctttcctggagcgaacgccgaactgaaaaaagaattgattgattggaatacgctctctgaaagtgatatccttctccttcaaaacgaaattccttttgaaaccaccttggaatgtgcgaaaagattcaatggaattgtgatctttgaccccgcacccgcgcagggaataaacgaagaaatctttcagtacctggactatctcacaccgaatgaaaaagagatcgaagccctgtcgaaagatttcttcggtgagtttttgacggttgagaaagccgctgagaagtttctggaactcggcgtcaagaatgtgatagtgaagctcggtgacaaaggagtacttcttgtgaacaaaaatgaaaagaaacactttccgaccttcaaagtaaaggctgtggacacaacagcggcgggggacgtgttcaatggagcttttgccgttgctctgtctgagggaaaaaatcccgaagaggcggtaatctttggaacggcagcagcggccatatcggtaacaaggttgggagctcaaagttctattccagcgagagaagaagtagaggcgtttttgaagaatttatga

SEQ ID NO: 26673 - DNA, 861 bp, Thermotoga maritima
atgcaggttccaaaagttactttgaacaacggtgtagaaatgcctattctgggatacggagttttccagataccaccagaaaagacggaagaatgtgtctatgaggctataaaggtgggatacagactcatcgacacagcagcatcgtacatgaacgaagagggagtgggaagagcgataaaacgcgcgattgacgaaggaattgtcagaagagaggagctcttcgtcacgaccaaactgtgggtgtcggatgttggttacgaatccacaaagaaggcttttgaaaagtctttgaagaaactgcaactcgaatacatagatctctatctaattcatcaaccttttggagatgtacactgtgcctggaaagctatggaagaaatgtacaaagatggattggtaagagccataggtgtgagcaacttctaccctgatcggttgatggatctaatggttcatcacgaaattgttcccgcggtgaaccagatcgagatacatccgttttatcagagacaagaggagatcgaattcatgagaaattacaacatccaacctgaagcttggggtcctttcgctgagggaagaaaaaacattttccagaacggagtgctcagatcgatcgcggaaaagtacggcaaaacggttgcacaggtcattctgagatggctcactcagaaaggaatcgttgccattcccaaaactgtgagaagagagaggatgaaagaaaacatcagcatcttcgattttgaactcacacaggaagacatggaaaagattgcaacgctcgatgaagggcagagtgcgttcttctcccacagggatcccgaggttgtcaagtggatttgttcactgaaaagatga

SEQ ID NO: 26674 - DNA, 1251 bp, Thermotoga maritima
atgccggagaaaagcctctacgagatggcagttgaacagttcaaccgtgccgcatcactcatggatctggaatcagaccttgcagaggttctcagaagaccaaaacgtgttttgatcgttgaattcccagtgagaatggatgacggccacgtcgaagtcttcacaggataccgtgtgcagcacaacgttgcgagaggtccagccaaaggtggtatcaggtaccaccccgatgtcacactcgatgaggtgaaagccctcgcattctggatgacatggaagactgctgtgatgaatctgcctttcggtggagggaagggaggagtcagggtagatccaaagaaactctcaagaaacgagcttgaaagactctcaagaaggttcttctcagagattcaggtgataataggcccgtacaacgacatacctgcaccagatgtaaacacgaacgcagatgtgatggcgtggtacatggatacatacagtatgaatgtgggtcacaccgttttgggaattgtcacaggaaaacccgtggaactgggaggatcaaagggtcgtgaagaagccacgggtcgtggtgttaaggtgtgtgcagggcttgcaatggatgttctgggaatagatccaaagaaagcaacagttgccgttcagggatttggaaacgtgggtcagttcgccgctcttttgatttctcaagaactcggatcgaaagtcgttgcggtgagcgacagcagaggcggtatctacaatcccgaggggttcgacgtggaggagctgatcagatacaaaaaagaacacggaacggtcgttacatatccgaagggtgaaagaataaccaacgaagaacttctggaactggatgttgacattctcgtccctgcagctttggaaggtgctatccacgctggaaacgcggaaagaataaaggcaaaagccgtggtggaaggagcaaacggtcccacaacacctgaagccgacgaaatcctgagcagaagaggaattcttgtggtaccagacatactcgccaacgccggtggagttacggtttcttactttgaatgggttcaggaccttcagagcttcttctgggatttggatcaggtgagaaacgcccttgaaaagatgatgaaaggagcattcaacgatgttatgaaagtaaaggagaaatacaacgtcgatatgagaacagcagcttacattcttgcgatcgatcgagttgcgtacgccacgaaaaagagaggtatctatccgtga

SEQ ID NO: 26675 - DNA, 882 bp, Thermotoga maritima
gtgtcggtagttgaggtgagagatctcaccaagtactacggaaagtccagaggagtggaaggtgtaactttctcagttgaagaaggagagatattcggcttcatcggaccgaacggtgcggggaagacaactaccataaggcttctcctcggtttgatctttccggattctggtctggcagagatttttgggaaagacgtcctgaaagaaggaaaagaaatcagaaagaacgttggctacattccaggtgaggtgagcttttacccggaagtgactgtggaggaatttctcaggtactccgccagtttctatgaaaaggtagactgggattatgtgaaggaactctgcggtgttttttcgctcgacacgaaaaaacgtatcaaggaactctccatgggaaacaaaaagaaagtggctatcgttcaggctttgatgcacagaccgaaacttctcatcctggacgagcccacgaatggcctcgatcctatcgttcaaaacaccttctttgaaattttaaaaaacgagaaagaaaaaggtacgaccgtgttcttttcctcgcacatattaagtgaggtagaaagactttgcgatcgcgttgcgatgataaaggatgggagaatcatcagggtggaaaaggtggagaatctcaaaggggaaagatacaaggtggtccgtgtcaaaggtgaaaatctggaaaaactgaaagatctggctgaagtgaatcgactgaagtttgaaaacggcacggcggagtttctcttttcaggaaacgttgaaagactcctcgaaattcttcgaagtttgaaactgtccgatttctgggtggaagaaccttctcttgaagagatattcatgtcctactatcgggagggagaagaatga

SEQ ID NO: 26676 - DNA, 594 bp, Thermotoga maritima
gtgatgacgctctatccggtggtggttcaggagagaacaacgggtgaggtgttgatgctggcctacgcgaacgaagaggctttggagctcaccaagaaaacgggatacgcgcatttcttctcgagagagagacagaaaatctggaaaaagggagaaacctctggaaacacgatgagagtggttgaaataagaagggactgcgatgacgatgcttacctgtacatcgttgattttccagaagataaggtggcgtgccacacgggaaacagatcctgctttttcaaggtggagcacaggtttgaagaaacgggctctcccaccttctggcttgagctgtacagactggtgagaaaaagaaaagaagagatgccagagggatcctacaccgtaaaactctttaaagaaggaaagggaaagatcgcaaagaagttcggagaagaagcagtcgaggtgataactggctaccttcaaaacgacagggaaaacctcgtctgggagatagccgacatgatgtatcacctcaccgtcctcatggccgacgctggtgtcactgtccaggatgtcatgagagaactcgaaaagagaagaaagtga

SEQ ID NO: 26677 - DNA, 762 bp, Thermotoga maritima
atgctcgctaaaagaataatcgcgtgtctcgatgtgaaagacggtcgtgtggtgaagggaacgaacttcgaaaacctcagggacagcggtgatcctgtcgaactgggaaagttctattccgaaattggaatagacgaactcgtttttctggatatcaccgcgtccgttgagaagaggaaaaccatgctggaactggtcgaaaaggtggccgagcagatcgacattccgttcactgttggaggaggtatccacgacttcgaaacggcctcggagctcattctccgtggtgcggacaaggtgagcataaacacggcggctgtggagaatccttctttgatcacacagatcgctcaaacttttgggagtcaggccgttgtcgtggcgatagatgcaaaaagagtggatggagagttcatggtcttcacctactccggaaagaagaacacgggcatacttctgagagactgggtggttgaagtagaaaagagaggagcaggagagatcctgctcaccagtatcgacagagacggcacaaaatcgggttacgatacggagatgataaggttcgtgaggccactaaccacacttcccatcatcgcttccggtggtgcgggaaaaatggaacatttccttgaagccttcctggcaggtgccgacgctgcccttgcggcttctgtctttcacttcagagagatcgacgtgagagaactgaaagagtacctcaaaaaacacggagtgaacgtgagactggaggggttgtga

SEQ ID NO: 26678 - DNA, 588 bp, Thermotoga maritima
atgacggtagaaagattggaaaacggtgtgatcgttcagagaaacaccaacgagatcgagatttccataacgctcgacacggtacacggaaaactcgaaggaagcacgggggtgaattttttcgatcaccttctgaacaccttctgtcattactctggcctgggtctcagggttagcacttgcgaaagcaaagacggcatccttcaccacctgatagaggacttcggtatttcactggggcttgcattcagggagcttttcgactacacgaaagtgagaagattcggtgaagccaccgttcccatgaacgaagcgctggtgggatgctacgtggatctttccggaaggcccttcttccagaagaatttcgaattctccgttgaaaagatagaggacatgcccgtcgagggattcgaggagtttatgtgcggatttgtgaaccacgcaaggatcacggttcatttcttcaaattcttcggaaagaacgaccaccacatctctgaatctgccatgaaatcttttggactagcgattgccaaggctctggagagttcagaaaaaaagaccaccaagggtgtgatagattga

SEQ ID NO: 26679 - DNA, 1008 bp, Thermotoga maritima
gtgaatcctctcgatttgattgcaaagagggcgtatccgtacgaaaccgaaaagagagacaaaacctaccttgcgctgaatgaaaatccgtttccctttccagaggacctcgtggatgaagtgtttcgacgattgaacagcgacgccctgaggatctactacgactcccccgatgaagaattaatagaaaagatactctcatacctcgacaccgattttctttcgaaaaacaacgtctctgtgggaaacggagcggatgagatcatctacgtgatgatgctcatgttcgaccgttccgttttctttcccccgacctacagctgctacaggatctttgcgaaggcagttggagcgaaattcctggaagtgccgctcacgaaagatctgaggatacctgaggtgaacgtgggagaaggagacgttgttttcattccgaacccgaacaatccaacgggccatgtcttcgaaagagaggaaatagaaagaatcctgaaaacgggtgccttcgtcgcgctggacgaagcctactacgaattccacggagaaagttatgtggattttctgaagaaatacgaaaatctcgctgtgatcaggactttctcgaaagcgttttccctggcagcgcaacgtgtcggatacgttgtggcctcggagaagttcattgacgcttacaacagggtgagacttcctttcaacgtgagctacgtctcccagatgttcgcaaaggtagctctcgatcacagagagatctttgaagaaagaacgaagttcatcgtggaagaacgcgagaggatgaagagtgctctcagggaaatgggataccgaatcaccgactccagaggaaacttcgtgttcgtattcatggagaaggaagaaaaagaaagacttctcgaacacctccggacgaagaacgtcgctgttcgcagtttcagggaaggtgttagaatcactatcggaaaacgcgaagagaacgatatgattctgagagaactggaggtgttcaaatga

SEQ ID NO: 26680 - DNA, 1287 bp, Thermotoga maritima
atgattctaatgaacaatcccggggataaagaagtgctcagactattgaaacaaaggatggaatctgtatcgcaggtggaagagaccgtaaaagaaatcatcaggagagtgaaagaagaaggagacagagccctcgaggaattcctcaaaaggttcgagaagcacccggtgggcatcgagaaccttcgtgtcacagagaaggaaatatcggaagcccaagtagaggaagaattcgttgaaacgataaaaatcgtgatagaagacctgaaggaattccatcgaagacaggaggaaagatctttctttttcacgacgaagggtggaagcttcctgggagagatggttgttcctctcgagagtgtgggaatctacgttcctgggggaaaggttccgtacttttccacgctcctcatgtgcgcggttcccgctatcgttgctggtgtggaaaggatcgctgtcacaacaccaccgaatgaaaacggaggcatctctccatacatcctgaaaacctgcgaaatcctcggtctgaaggagatctaccggatgggaggggctcacgcggtagccgccctcacatacggcacggaaacagtgaaacccgttgacaagatcgtgggacccggtggagtcttcgtcacgctcgcaaagaaacacgtttacggagacgttggaatcgattccatagcgggtcccagcgagattgcgatcgtgacagacggcagtgccgacctggatctcatagccgcggatttcctctcccaggcagagcacgacgagaacgcgatgagtgtggtgataaccacttcgaaagaagtcttcgaaaaattacctcaggtcattgaaagacacctggaagctcttccagaagagagaagaaaaacggccaggatttcaacggaaaatttcggtaccatcatcttgacggacagtctgaaaagggcctttgagatctccaacctcatcgcccccgaacatctggaggtcctcgtggaaaacccgtttgagccactgggacacataaagaacgcgggatctgtctttctcggaaagtacacctgtgagtctgtgggagactacggtgcgggaccgaaccacgttcttcccaccttcagatccgcgaggttctcctcaggactcagggtttccgatttcacgaagaagatattcatcacacacctctccgaagaagatttcagaagaaagagcgagctttactcgaagatggcgcgctgggaaggttttgaagcccacgctcgggcgatagacgtcaggagggaaaagctgtga

SEQ ID NO: 26681 - DNA, 711 bp, Thermotoga maritima
atggacgttttgaggtgcgagaacctcaaaaagaggttcggcagaagatacgtcgtgaacggagtgaatctggagtttcacaggggtgagatagtcggtcttctcggtcccaacggagccgggaagaccactattttcaacatgattcttggtgtcgttgtaccgacttcgggaaagatcatcttcagggatgttgatataacgaagtttcccgtttacaggagagcaagactcggtatcacctatcttcagcaggagacttcgatcttcgggggcctcactgtgagggaaaacatagacctcgtgcttcgcttccatgagaaagataaagaaaaaagagaaagaaaaatagaagaactcctccacgaattccatctgaaacacctcgagaatcaacccgcgagctttctttccgggggagagaagagaaagctagaactcgcaagaatgatgtgtttgaatcccgctttcattctgctcgatgaacccttcagcggaatagatccgaagactgtgaaagaaattcaaaaaatgaccctggaattgaagcagaaaaatttcggaatcgtcatcaccgaccacaacgtcgatgaactcgttgaaatcgctgacaggatctacgtcatctacaagggagagatcctcgccgaaggttctcctgaaagaattttggaagacgaaacagtgagggaggtgtacctcggaacgtga

SEQ ID NO: 26682 - DNA, 1692 bp, Thermotoga maritima
atggtaagaccgcaacgaaacaagaagagatttattcttatcttgaatggagtttggaatcttgaagtaaccagcaaagacagaccaatcgccgttcctggaagctggaatgagcagtaccaggatctgtgctacgaagaaggacccttcacctacaaaaccaccttctacgttccgaaggaactttcacaaaaacacatcagactttactttgctgcggtgaacacggactgcgaggtcttcctcaacggagagaaagtgggagagaatcacattgaataccttcccttcgaagtagatgtgacggggaaagtgaaatccggagagaacgaactcagggtggttgttgagaacagattgaaagtgggaggatttccctcgaaggttccagacagcggcactcacaccgtgggattttttggaagttttccacctgcaaacttcgacttcttcccctacggtggaatcataaggcctgttctgatagagttcacagaccacgcgaggatactcgacatctgggtggacacgagtgagtctgaaccggagaagaaacttggaaaagtgaaagtgaagatagaagtctcagaagaagcggtgggacaggagatgacgatcaaacttggagaggaagagaaaaagattagaacatccaacagattcgtcgaaggggagttcatcctcgaaaacgccaggttctggagcctcgaagatccatatctttatcctctcaaggtggaacttgaaaaagacgagtacactctggacatcggaatcagaacgatcagctgggacgagaagaggctctatctgaacgggaaacctgtctttttgaagggctttggaaagcacgaggaattccccgttctggggcagggcaccttttatccattgatgataaaagacttcaaccttctgaagtggatcaacgcgaattctttcaggacctctcactatccttacagtgaagagtggctggatcttgccgacagactcggaatccttgtgatagacgaagccccgcacgttggtatcacaaggtaccactacaatcccgagactcagaagatagcagaagacaacataagaagaatgatcgacagacacaagaaccatcccagtgtgatcatgtggagtgtggcgaacgaaccagagtccaaccatccagacgcggagggtttcttcaaagccctttatgagactgccaatgaaatggatcgaacacgccccgttgtcatggtgagcatgatggacgcaccagacgagagaacaagagacgtggcgctgaagtacttcgacatcgtctgtgtgaacaggtactacggctggtacatctatcagggaaggatagaagaaggacttcaagctctggaaaaagacatagaagagctctatgcaaggcacagaaagcccatctttgtcacagaattcggtgcggacgcgatagctggcatccactacgatccacctcaaatgttctccgaagagtaccaagcagagctcgttgaaaagacgatcaggctccttttgaaaaaagactacatcatcggaacacacgtgtgggcctttgcagattttaagactcctcagaatgtgagaagacccattctcaaccacaagggtgttttcacaagagacagacaacccaaactcgttgctcatgtactgagaagactgtggagtgaggtttga

SEQ ID NO: 26683 - DNA, 1401 bp, Thermotoga maritima
atgcctaccatagtatttgtaggagcggggagtgtgaggtacacgatcaagctggtaggggacctggcgaagacaccggatttgtatgggtcaagactggtactgatggacatcgacgaagaaaggttgaaagcaacgtacattctcgtcacaaagtacctcagggaactgaatgcagagtacacagtggaacagacgacaagccttgaggaggcacttgaaggggcagattttgtcatcaacacagccctctacagggcaccagggcacgaagacggatacgtacactacgagatcatgagggaagtaggggagagacatggctactacagagggatagacagccaggagctgaacatggtctcggactactacacactcagcaactacaaccacctgaagatgagccttgatatagcaaaggcagtggagaagatagcaccgaatgcgtggatactgcagacggccaatcctgtttttgagatcacacaacttgtgaagaggcttacgaaggcgaagatagtgggtttctgccacgggtatgcgcacgtgttccaccttgcgaaagtactcggtgtggagccagaggaattagactggcaggtagcaggggtgaaccatgcgatatggatgaacaggttcagatgcagaggggaagatctctatccgaagctggacgaatggatagaggagaacgcatcgcgatgggagccgaagaatccatgggatgtggacttttcacctgcagcgatagacatgtacaggttctacgggatgtacccgataggggacacggtgaggagtgggacatggaaataccactacgatcttgagacgaagaagagatggtacgggaagtttggagggatagacaacgaagtggaaaggccgaagttctacgagagtttgagggagcagaggaagaggctgatggaacttgcgaaagaagtggagaaagatccgacgatagagctgacgaaggtgtggcctgaggtgttcacaacaggcagtgagagtgtagaacagcatatacctttcatcaacgcgcttgtgaatgacaagaaggcgaggcttgtattgaacgtagagaacagaggggtgataaagggaataccggacgatgtaatggtggaggtgccggtggtagttgataaagaggggatacatccggagaagatagagcctgatcttacagacaggatcaagaagttctacttacttccgaggatactcaggatggagtgggcacttgaggcgttcatatctggtgacaggagggttctggaggagatcctcgtcagggatccaagaaccagatcctacgaacaggccgtcgctgttattgatgatatccttaacctccccttcaacgaggaaatgaagaagcattacggcagttga

SEQ ID NO: 26684 - DNA, 1431 bp, Thermotoga maritima
atggctgtgaaggtcctctcgatcgatcttggagcaacgaacggaaagatctacgaggtggagttgaaagacaggttgacggtgaaagaaataaagagattcagaacagaaggaacctttcttcctgggaaggatagagaacacttcgtgtggaatcttcccgggttctacgaggagataaagggtgttcttgaggcctctgacgcacaatccgttggggtggatacatggggtgtggattttgccttactcgacgaaaacggaagactcgtatctcttccctatcactacagagatgtgagaacgaagggagtcatgaaaaaggccttcgaagtggttccaaaagatgagatattccagagaacgggtatacagttcatggagataaacacgctctatcagctgtattccatggtgctctcgaacgatccgttcttgaagacgacaaagcaccttctgatgatccccgacgtgttcaacttctggctttctggagagatggtgagtgagtacaccatcgcgagcacttctcagtgctacagcgtgccggatggggaatgggcgtacgaccttctcgaaaaactctccattcccactgagatctttccaaaggtggttccgccgggtaccatcctgggaaaatgcagagtgaaaaaaggtataaacgtgatcgccaccgcctgtcacgacaccgcttccgctgttgttgctgtaccgcttgaaggggaaggaatctacatcagctctggaacgtggtttcttgtgggaacggagctggaaagaccacttctgagcaaagaggcactggagagaaatttcacgaacgaaggtgggtacgggaagatcaggtttctaaaaaacgcaacgggcatgtggcttctggaagagtgtaacagaatctggaagaaggattattcggagatcatcgaatcggtcaggaatgtccctggtttccaggcgtttctcgatcccgatagagaagagtttctccaccctggaaacatgccggagaggatcagaaattatcttgaaagaacgggccagaaaatcctggagaggatcggagaaatctcccggctcatcttcgaatcccttgcgttcaactgcagatggatcgtggagcagatcaaagaactcaccggcaaaagatacgggaaaatccacgtggtgggtggagctgtgagaaacgatcttttgatgagtttcatagccagtgcgacggggaagacggtggtggcgggtcctgtggacgccactcccatcgggaacgcactcgttcagctgatcaccctgggagcgatagcaaacatcaacgaagccagaaagatcgtgaaagaatccttcgaattgaaaacgttcgagccgaagaatccggagttgtggagcgaaaagtacgaagaatggagaaggtacaaggggatgagagtgtga

SEQ ID NO: 26685 - DNA, 1296 bp, Thermotoga maritima
atggtagaaaggtattcgctgtcaccgatgaaggatctctggacggaggaagcgaagtacagaagatggctggaagtggaactggcagtgacgagggcgtacgaagaactgggaatgattccgaagggagtcacagagaggataagaaacaacgctaagatagatgtggaactgttcaaaaagatagaagagaaaacaaaccacgatgtggtggcgttcgtcgaaggaatcggctcgatgataggagaagactcgagattcttccactacggtctcacctcgtcagatgttctcgacaccgcaaattccctcgctctcgtggaagcggggaaaatcctgttagagtctctaaaagagttctgcgacgtgctctgggaagtcgcgaatcggtacaaacacactcccaccatcggaagaacacacggagtccacgcggaacccacctcctttggcttgaaggtccttggatggtactccgaaatgaaaaggaacgttcagcgccttgagagggcgatagaggaagtttcttacggtaagatcagtggagctgttggaaactacgcaaacgtaccaccggaggtggaggaaaaagcgctttcgtacctgggcttgaaacctgaacccgtctccacacaggttgtaccgagggatcgtcacgctttctatctgtccacgctcgcgatcgtggcagcggggatagaaaggatcgctgtcgagatcagacatcttcagagaacggaagtgctcgaggtggaagaaccgttcaggaaaggtcagaggggctcgagtgccatgccccacaagaagaatcccatcacctgcgagcggctcacgggactttccagaatgatgagggcgtacgtcgatccttcccttgaaaacatcgcgctctggcatgagagggacatttcgcactcttccgtcgaaagatacgtttttcctgacgccacgcagactctttactacatgatcgtcacggccacaaacgtggtgaggaacatgaaagtgaacgaagaaagaatgaagaagaacatagatctcacgaaaggtctcgtgttctcccagagagtcctgctgaaactcatagagaaaggactcacgaggaaagaggcttacgatatcgtccagaggaacgctctgaaaacctggaattccgaaaaacacttcctcgagtacctcctcgaggatgaagaggttaagaaactggttaccaaagaagagctcgaagaactcttcgatatctcttactacttgaaacacgtagaccacatcttcgaacgctttgaaaaggagtga

SEQ ID NO: 26686 - DNA, 1194 bp, Thermotoga maritima
atgaaccgtgttgtggtgggtcttcaatggggagacgaaggaaagggcaaggtggtaacgtatctttccagatatcacgatatcgtggcgagattttcaggtggagcgaatgccgggcacactgtgaattacggagatttcaaggtgatacaccacctcctcccttcggccgatttcacaaaaaacagaggaatcgccataggaagcggggttctcctggatcctcaggtgctgacagaagaattgagggaattgaaagagaaatttcccgattattcaggtgaaatcttcatctctgagagcgcacacgtggttcttccagtgcacaaagaaatggacaggataatagacgaagtgttgaaaataggcactacgaaaagaggaataggtcccgcttgtgctgacagggttatgagggtgaacgtgagagttgcagagctcggcaacgaagaaaaactcagatatttcctcgaaaagaatctctctttgaagaagatctacggggtggatttcgacgcagagaaaatgatgggagatctttccaccttctatgagacaataaaagacttcgtcgtttcaccggtccagttgaaaagaatcctcgaagagaagagcgttctcttcgaaggaacacagggggtccttctagatctggacgtgggaacgtacccgtacgtcacgagcatgaactgttcctcctcaggcgtgagcgcgggaatgggctttcctgtggaagtagatgaagttttaggcgtcttcaaggcgtacacaacacgagtcggagaaggtcccttcccgacggagctcacaggagaagaaggagagaagttgagaaaagcgggacacgaatacggttccacgaccggtcggccgaggagatgcggctggctcgatctgccgctcctcaggtacgccattgagatctccggtgtcgactctctggtcatgaccaaggcagatgtgctgaacggttttgaaaagatcaaggtctgcgtgcgctactccgatggaagagatctcgtttcactcagagatctggaaaagaaagagcccgtctacgaagtcttcgatggctggaaatctctggaagacaagaacttcgagcgctttgttgatttcatagaaagagagacaggaagaccggtaaggtacatatccacaggtgaaaaactcgaggatatagtggaggtgtga

SEQ ID NO: 26687 - DNA, 942 bp, Thermotoga maritima
gtgtctgtgaatctgaaagggagatctcttctcactcttcttgatttttctcctgaagagatcagataccttctcgatatctcaaagcaggtgaagatggagaacagatccaaactgagaaccgaaaggttcaaaggaatgaccctcgccatgatcttcgagaaacgatcaacgagaacgagactcgcctttgaaaccgcttttgcagaagaaggaggacatccgatctttctttcaccgaacgacatacaccttggagcaaaagaatctctcgaggacaccgcacgcgtccttggaagaatggtggacgccatcatgttcaggggctacaaacaggagactgtggaaaagctggctgagtactccggtgttcccgtgtacaacggactcaccgacgagttccacccaacgcaggcgctcgccgacctgatgaccatagaggaaaattttggcagattgaagggtgtaaaggttgttttcatgggggacaccagaaacaacgttgcgacctccctcatgatcgcctgtgcgaagatggggatgaatttcgtggcgtgtggtcccgaagaactcaagcccagatctgacgtattcaaaaggtgccaagaaatagtgaaagaaaccgatgggagcgtttctttcacatcgaatctggaagaagcactcgcaggtgccgatgtcgtctacacagacgtgtgggcatccatgggtgaggaagacaaagaaaaggagagaatggctcttttaaaaccttatcaggtgaacgagagagtgatggaaatgacgggtaaatcggaaacgattttcatgcactgcctccccgcggtgaagggccaggaggtcacctacgaggtaatcgagggaaaacagagcagggtctgggacgaggcggagaatagaaagcacaccataaaagcggtcatgatagcaacactgctgtga

SEQ ID NO: 26688 - DNA, 594 bp, Thermotoga maritima
atgttcataacgttcgagggaatagacggatccgggaagagcacacagatccaacttctggctcaatacctggagaagagaggaaagaaagtgatcttgaagagagagccgggcggaacggagacgggggagaagatcagaaagattcttctggaggaagaagtgactcccaaagctgagctcttcctgtttctcgcctcgagaaatctccttgtgacagaaataaaacagtacctttccgaaggatacgccgttcttcttgacagatacacggactccagtgttgcataccagggttttggaagaaacctgggaaaagagatcgtggaggagctgaacgatttcgccacggatggactgattcctgacctgactttctacatagacgtggacgtcgaaacggccctcaaaagaaaaggagagctcaaccgctttgaaaaaagagagtttctcgaacgtgtaagggaaggctacctcgtgctcgccagagaacatcccgaaaggatcgtggtgctggatggaaaacgctccatagaggaaatccacagggacgtggtgagggaagttaaaagaaggtggaaactcgatgtttag

SEQ ID NO: 26689 - DNA, 1200 bp, Thermotoga maritima
atggagaaagtcaaagtcaaaaatcctattgttgagcttgacggtgacgagatggcacgcgtgatgtggaagatgatcaaagaaaaactcatccttccctatctcgacatccagctggtttacttcgatctcggaataaagaagagagacgaaacagacgatcagatcacgatcgaagcggcaaaggccatcaaaaagtacggtgtcggtgtcaagtgcgcaacgatcaccccggatgcggaaagagtgaaggaatacaacctgaagaaagcctggaagagtccaaatgccaccatcagagcgtatctcgatggaacggttttcagaaagcccatcatggtgaagaacgtgccaccgcttgtgaagcgctggaagaaaccgatcatcataggaagacacgcctacggtgacatatacaacgctgtggaagcaaaagtagaaggcccagcagaagtggaacttgtggtgagaaacaaagaaaacaaaacactcctcgtacacaaattcgaaggaaacggtgttgtcatggcaatgcacaacctggagaaatcgatcagaagcttcgctcagtcgtgtataaactacgctatctctgaaaaggtcgacatctggtttgcgacgaaagacacgatctccaaggtgtaccatgcgtacttcaaagacatattccaggaagaggtcgacaaaagaaaagaagaactcgaaaaagctggagtgaactacagatacatgctcatagatgatgcggctgcgcagattttgagaagtgagggcggcatgctctgggcctgtatgaactacgaaggggatatcatgtccgatatgatcgcctcaggattcggcagtctcggcctcatgacgtcggttcttgtctctcccgatggggtctacgagttcgaggcagcccacggcacggtgagaagacactactacagatatttgaagggagaaaagacctcgacgaatccaaccgcatcgatcttcgcgtggacaggtgctataaggaaaaggggagaactcgacggaacaccggaggtgtgtgaattcgcagacaaactggagaaggctgtgataaacaccatagaatccggtgtgatcacaaaggaccttcagcctttcacagaaccaccgatcgacaagtatgtcactctcgaagagttcatagacgaagtgaagaagaatctcgaaaaattactgtga

SEQ ID NO: 26690 - DNA, 1491 bp, Thermotoga maritima
atgaagtgcagtctgggattggagaaatgtccggatgataccctccggtgttttccaaagatcgaacaacctttcggaattgtgatcttcggtgcttctggtgacctcacaaaaagaaagctcattcccgctttgaacaggttgttcgaggcaggtattctgcccgaacgctttttcgttctcggtgcggcacgaacgaaaatggacgataagaaattcagatccagattcgatgccaaccctgattttttggaacattgcagttacatcagcgtggattatcaggatcctgagagcttcaaacagttgaaaaacaccatcgagactctcataaaaaggatcgattccagcaatctggtcttctatctcgctgttcctccggatctttacatccctattctggaaaacctctcgaaaactggattgaacgaaaaacctgcgcgcgttgtgatcgaaaaaccgttcgggaaagacctggaatcggccagaagactggaagacactcttcagaaatacttccaggaagatcagattttcagaatcgatcattaccttggaaaagaaaccgttcagaacatactggtgttcaggtttgccaacttcatattcgaggaaatctggaacaacaagttcgtggatcacgttcagatcacgatggccgaagacataggtgttgaacacagggcaggatacttcgaaaacgtgggactcctcagggatatcttccagaaccacatgcttcagatcctcgcactgatcgccatggaacctccttcttctttcaatggagagaatttcagaaacgagcgggtgaagcttctcagatcgatcagaccgttccctgtggaggaactggaaagctggatcgtcagaggccagtatggaagaggggttgtgaacggaaaagaagtgccggcttacagagaggaaccgggtgtggccaaagactccaacgtggaaaccttcgttgccatgaaactcttcatagacaactggagatggagcggtgtacccttctatctgaggtccgggaagagactccccaagaaaataaccgaggttgctgttgttttcaagaagattcctcattcgatctttgccggtgtaccttctgatgaactggagccgaacacgatagttttcaccttgcagccaaacgagggaatctctcttgagtttcaggtgaaaaggccctgtcccggcatgtttccacagcttctcagtatggacttcagatacgaggattactttggagtgaaactgcccgacgcttacgaaagactccttctggacgtgatacttggagatcctacacttttcatgagaagagacgacctcgaagtttcctgggaacttctcgatcccgttctcaaagcctgggaaaacgatcccgttcgcttttcaccttatgtgtatccggcgggaacgtggggaccgagagaagccgatctactcatagaaagggacggtagaaaatggagaaaactgtga

SEQ ID NO: 26691 - DNA, 714 bp, Thermotoga maritima
ttggaactgggcatcagggataagggagtactcgttcttgcggcgagcaggggtattggaagagctgtagcggatgttttgagccaggaaggagcggaagttaccatctgtgcgagaaatgaagaacttttgaagagaagcggccacagatacgtcgtctgcgatctcaggaaggatctggatctactgttcgaaaaggtgaaagaggtggacatcctcgttctgaacgcaggaggaccaaaagcgggattcttcgatgaacttacgaatgaagatttcaaagaagcgatcgacagcctctttttgaacatgatcaaaattgtgagaaactatcttccagcgatgaaagaaaagggctggggaaggatcgtagccatcacttctttctccgtgatctcaccgatagaaaatctctacacatccaattctgcgaggatggccctcaccggatttctaaagacactctcttttgaggtggcaccgtacggtatcacagtgaactgtgtggcaccgggctggacggagacagagagggtgaaagagcttctcagtgaagaaaagaaaaaacaggtggaatctcagatccccatgagaaggatggcaaaacccgaagagatagccagtgttgtggcatttctctgttccgaaaaggcctcttatctaactggacaaaccattgttgtggatggtgggctttccaaatttccgctctaa

SEQ ID NO: 26692 - DNA, 678 bp, Thermotoga maritima
ttgaaaaagggagttctgttcgatttagacggaacgattctggatttcgaaaagagcgaagatcaggctctgaaaagaaccttcctgaagtacggaattcctctcaccgaggatcaggtgtttttgtacagagagataaacaggaaatggtggaaattgcttgcagaaggcaaggtgtcgaaggatgtcgttgttgttgccagattcgaagaatttctgaaaacactgaacatcccactggatccaaggaaggttgcaaaagattatctggagtttctctctgaagaagcccatttccttccaggtgcagaagaattcctcgaaagactgaaaaagaaagatcttcgaatggctgttgtgacgaacggagtcaggttcgttcaggaaaaaagaagcaggaagctaaaactcgacagattcttcgagttcgtcctcacctctgaagaagcgggagtcgaaaaaccagatccacgcatcttctggttggcactcgaaagaatgaaattgaaaaaagaagaagtcctctacgtgggagacgatttcagcagtgatctcgagggtgccagaaacgccgggatagatttcgtgctcttctcatctgacggtgactcctctggagatttcccagtcgcaaggaatttcaaagaactggagaagatcgtagaagagttcctgtga

SEQ ID NO: 26693 - DNA, 3513 bp, Thermotoga maritima
ttgagactgaaaaaactctacttaaaaggttttaaatcctttggaagaccttccctgataggtttctccgatcgcgtgaccgctatcgttggtcccaacggtagcgggaaatccaacatcatagatgccataaagtgggtgttcggtgaacaatcgaagaaagaactccgcgcgagtgaaaagttcgatatgatctttgctggatcggagaaccttccaccggctggctctgcctatgtggagcttgtctttgaagaaaacggagaggaaataaccgtggcccgtgagttgaagagaacgggagaaaacacttactacctcaacggaagcccggttagattgaaagacatcagggatcgcttcgcgggtaccggtcttggagtggatttctattccattgtgggacagggacagatagacagaatcgttaatgcctcacctgaagaactgagattgctgctggaagaggcggcgggtgtttccatatacagagagaagaaaaaggaaacagagctgaacctcgaaaggacgaaagcgaacctcgacagggtgaaagacgttctgtttgagcgcgaaaggcagatgaaatctctctacctcaaagccaaacgcgctgagaggttcaaagagtacacggcccagctcgaggaacttcaaaagatctactacggaaacgttttgaagagagaaagaaaaaaactggagttctaccaggaagaagaaaagaagacaaacgagaagataaagaacatccagaaagaactggtggaactggagacgaagtggagcaccctgagaagtgagttcggagagatggaccaggaaatagaacgctacacgaaactcctcgaagactacaagaaaagacagaacgacctcgtggagatgaaaggattctactcttcaaagctcgcagacagtgaaaacaagtacgtggaattgtccaccaggctcgatgaactggagaagcgaagagaagagtacaaaaaacgtcttgaagagatggagtacatattcaaaggagtgatgggagactacgagaggaaagcgaaagagctcgaaaagttcgaaaaagagaaagaaaatctcctttcgagattcaacgataaggagaaagagtttctgagggtcagagacgaaatctccaagttagaaaagcagatactcaaactggagaacgaacttttgaggataggagaaacgctcgaagacctcgaaaagaggagaaaaataacagaaaatcagatactaacgaggagaagagagctcgaagataaaaagaacgagttcaaagagatatccaggcgtgtggaagaactcgatgaagaggagaaaaaattgacagaagaattgaacgctgttcgtgaaagactggaagagatcgagggagagatcagaagggtcaatctggaaatagacgcgaaagagaagagattgagagagatccagttcgaaaaagaaatgatcgagcgtgatatgcgagagtaccgtggattctcgagggcggtgagggcagtcttcgaagaaaaggagcgctttcccggacttgtggacgtggtttcgaatctgatagaggtggatgaaaagtattccctcgctgtgagcgtgcttctcggtgggacggctcagaacatcgtggtgagaaatgtggatacagcgaaagcgatcgtggaatttttgaaacagaacgaagcgggaagggtgaccattcttccactcgatctgatagacggttcattcaacaggatatccggtctggaaaacgaaagaggatttgtggggtacgctgttgatctggtgaaatttccttcggacttggaagttctgggaggatttctctttgggaattccgtggtggtggaaacactagacgacgcgatcagaatgaagaaaaaataccgcttgaacaccagaatcgctaccctcgacggtgaactcataagcggaagaggagccataacaggaggaagggaagaaagatcgagcaacgtgtttgaaagacgcataaaattgaagcacctggagcaggagatggaagaaacagagagacaaatcgcagaaaagagggacgaactggccagtctgaagacagaacaggaaaacctgaaaaatcaggaagcgctcgttcagagggaactgttcgaactctccaggaaatcgtcttcgaccaaaaccgttctgtccgagatcttgagatctatcaatcagcttcaggaagaggtggaaaatctggagaagctcctggttgagtacagggcaaaagaggaaggactgaacgcgagaagagaaaagatcttcgaggagatcgacgagctgaagcagaacagagaaaacctccaaagatcgctgaccgaatactccgaagaactcgagaaagaaaagaagattctcgatgaactcaacgaaaagatcttcacgctcagggcagaggttggaaatcttttggaaacaaaagatcgatacgaaaaggaaatgcgcgacacgggaaaaatgatagaacgcattgcccgggaaacagaagacataaaactgcagatgacaagccttgaggaagagatggaaaactacagaaagttcataagagaacacgaaagagaaatcgagcatttgaagaaagaaatggacagtgtgttcgaagccatgaaacttcacagatcaggtaaagaagaaaagatgcgagagcttcaggaagtagaaaacaggatggacgaactgaaggaagaaaaggaaagattgagaaatcacctccaccagatagatctggctcttcaggagaccagattgaagatagcaaaccttttggaggagttctctggaaacgaagaggacgttgaagagctcgacgaagaaaagctcgaggagatttacagacagataaaagatctggagaacaaaataaagtacctcggtcctgtcgatctcacggcgatagacgagtacgagaaactccgtgaagagtacgaggaaatactgaaacagaaagaagatctcgaggaagcaaaacgaaaactcgaagagatcatagaaaaaacggatcgagaagcggagagcttgctcttcgacgtttaccagagggtgaacgagagtttcaacaggttcatttctctgctcttcttcggtggtgaaggaagactcaacatcgtttctgaagccaagagcattctcgatgcgggttttgaaatatccataagaaagccgggaagaagagatcagaagttgagtcttctttcgggtggcgagaaggcgctcgtgggactggctctgcttttcgctctcatggagataaaaccgagtcccttctacgtgctcgacgaggttgattctcccctcgatgattacaacgcagagaggttcaagaggctcctcaaagagaactcgaagcacacccagttcatcgtgatcacacacaataaaatcgtgatggaagcggccgatcttctacatggggtgaccatggtgaacggtgtgtcggccatcgttccggtagaggtggagaaaatactggaggtgtag

SEQ ID NO: 26694 - DNA, 1053 bp, Thermotoga maritima
atgaaagtgaaggcaccaggaagaataaacatcatcggggagcacaccgactacaacgatggttacgttctgccgtttgcggtgaatagatacgtgtttctctcgatagaaggttcagagagattcatcttccactcagaaaacgtaaacgaaacggtggagatggaaaagatagagaaactcaacaaatggacggattacatctctggagtcatcgcttcttttgaaaaaaggggctacagggtgtctcctgttaaaatctccgtttcttccaatcttcccataggagcgggtctttccagttccgccgctctcgaggtggcgaccgcttacgcgatttcagaatatttcggtttcaacgttccgaaactcgaactcgtaaagatcgctcgtgaagccgaagtggagttcgtgggggtcaggtgtggcatcatggaccagttcacggccgtttttggaaagaaagaccacgcgatctttctggacacgatgacgctcgagtacgagtacgttcctctgaaattggagggttacgagatcaacctcgtcgactcgaacgttaaacacgagctctcctcttcggagtacaacagaagaagacaggagtgcgaagaggtactgaaaacgcttgagaaaaagagctttcgagaagtgacaaaagaagatctcgaaagactctcaggcaccctgagaaaacgtgcccagcacgtgctcgaagaaaacgaaagagtcctgaaaagtgttcaggctttgaaagaaggagattttgaaacccttggaaaactgctcttttcttctcacgagagtctcagagacctgtacgaagtttcctgcgaggaaacggatttcatcgtggattatttgagaggaaaggaaggtatcctcggtgcgaggatggtcggtggcggattcggagggggagtgatcgttctttcaaagaagggggcttttgggaagataaaagaagagctggtggagtcttacaggaagcgtttcgggatagatctcatcttccacgagatagagagttcagacggtgttcaaaaaatctaa

SEQ ID NO: 26695 - DNA, 957 bp, Thermotoga maritima
atgatggaactcaggtacaatccgctcacagatgaatgggtgatcgtttctgcagccacacagaaaagaccggtacaaccatcgaagacggagtgtcctatctgtgttggaggcctcgaacttcccgaggagtacgatcttgtcaccttcgagaacaggtatccttctctgaaaaaagatccacctcctgtgaactggaaagagaagggacctttcaggaaagaagagtcccgcggtgtctgcgaggtggtcgtctacacctcggatcacaacacagcacttcctggaatgcctttgaagcagatagaaaagctcgttgagatgtgggtggacagaacaagggacctttctcagcacgactttgtgaaatatatcttcattttcgaaaaccgcggaaaggaagtcggtgcttcccttccacacccgcacggtcagatatacgcgttccccttccttccaaagagaatagaagtgaagataggcgcgatgagaaaatggtacgaagagaaaaggaagtgccccatctgcgaggtcctggagagcgaaggagaggagagaaaagtttacgagacggaacatttcctcgctctcgttcctttctacgcacgctttccgtacgaagtgcacatctatccgaagagacacgtgagtactcttctggagttttcgaaagaagaaaagaaagagttcgccaaagttctcaaggtggtgactgcaaaatacgacaaactcttcgatcaggagtttccctacatgatgatgttctttcaggcaccgttcaacgaagaggacgtgtctcacttcttccacttccacgtggagttcaacccaccgaagcgagacagagataaactgaagtggatggcgagtgtcgagacgggtacatgggcgttcataaaccccgtcgttcccgaagaagcagcgagacaactcagagagacggaggtggaaatatga

SEQ ID NO: 26696 - DNA, 3264 bp, Thermotoga maritima
gtgaagaatatgccctacgaatgggaaaacccacagcttgtgagtgaaggaacggagaagtcacacgcttccttcataccctatctggacccgttcagcggggaatgggagtaccctgaggaattcatctctttgaacgggaactggaggtttctcttcgcgaaaaatcccttcgaggtgccggaggatttcttttcggagaaattcgacgactcgaactgggatgagatagaagttccaagcaactgggaaatgaaaggatatggaaagcccatctacacgaacgtggtttatccatttgaaccgaaccctccttttgttccaaaagacgacaatccgaccggggtgtacagaaggtggatcgagatacctgaggattggtttaaaaaggagatctttctgcattttgaaggtgttcgatccttcttctatttgtgggtgaacgggaagaagatcggtttcagcaaagacagctgcacgcccgctgaattcagactcaccgatgttctaagaccagggaagaatctgatcaccgttgaggttctgaagtggagcgatggaagctatctcgaagatcaggacatgtggtggtttgcggggatatacagggacgtttatctgtacgcgctgccgaagtttcacatcagggacgtgttcgtgagaacggatctggatgaaaattacagaaacggaaagatctttctggacgtagagatgagaaatctcggtgaggaagaagaaaaagaccttgaagtaacactcatcacaccggatggagacgaaaaaacactcgtgaaagagacagtaaagccggaggacagagtcctttcctttgcctttgacgtgaaagatccgaagaagtggtccgcggagacacctcacctgtacgttctgaagctgaaactgggagaggacgaaaagaaagtcaacttcggattcaggaagatagagataaaagacggaacgcttcttttcaacgggaaacctctctacataaagggagtgaacagacacgagttcgatcccgacaggggtcatgcggtgacagtggagagaatgattcaggacataaagctcatgaagcagcacaacataaacacggttcgcacatcacactatccgaaccagacgaagtggtacgatctgtgtgactactttggactctacgtgatagacgaggcaaacatcgaatcccacggtatagactgggatcctgaagtgacccttgcgaacagatgggaatgggagaaggcacatttcgacagaatcaaaaggatggtcgagcgcgacaagaatcatcccagtatcatcttctggtctctcgggaacgaagcgggagatggagtgaatttcgaaaaagccgctctctggataaagaaaagagacaacacgcgacttatccattacgagggaacaacaaggaggggagaatcgtactacgtcgatgttttctctctcatgtatccgaagatggacattcttcttgagtacgcttcaaagaagagggaaaagcccttcatcatgtgtgagtatgcccacgcgatgggaaacagtgtgggaaatctgaaggactactgggacgtgatagaaaagtatccgtaccttcatggaggttgcatctgggactgggtggatcagggaataagaaagaaagacgagaacggaagagaattctgggcgtacggtggtgacttcggtgacacaccgaatgacggaaacttctgtataaacggtgtggtactgcccgatagaacacctgagccggaactttacgaggtgaagaaggtctatcagaacgtcaaaataagacaggtatcgaaagacacttatgaggtggaaaacaggtatctattcacgaaccttgagatgttcgatggcgcctggaaaatcagaaaagacggagaagtcatcgaagaaaaaaccttcaagatcttcgctgaacctggagaaaagcgtctcttgaagataccactcccagaaatggacgattctgagtatttcctcgagatcagtttctccctttctgaggataccccctgggcagaaaaaggccacgttgtggcgtgggagcagttccttctgaaagcaccggcatttgagaaaaaatccatttcagatggagtgtcactcagggaggatgggaaacatctcaccgttgaagcaaaagacacggtgtacgtcttctcaaaactcacaggccttctggagcagatccttcacagaagaaaaaagatcctgaaaagtcccgttgttcccaacttctggagggttccaaccgacaacgacatcggaaacagaatgccacagaggctcgccatctggaagagggcatcgaaagagagaaaactcttcaaaatgcactggaaaaaggaagaaaatcgtgtttctgtccatagtgtttttcagcttccgggaaacagctgggtgtacacaacatacaccgttttcggaaatggagacgtcctagtggacctttctctgattcccgctgaggatgtaccggagattccaaggattggctttcagttcacggttcctgaagagttcggcaccgtggagtggtacggaaggggaccgcacgagacttactgggacagaaaagaaagtggtcttttcgcaaggtacagaaaagctgtcggtgagatgatgcacaggtacgtcaggccccaggaaacggggaacagatcggacgtgagatggttcgcgctttccgatggtgaaacaaaactctttgtgtcgggcatgccgcagatagacttcagcgtctggcctttttccatggaggatctcgagagggttcagcacataagtgaactcccggagagggacttcgtcaccgtgaacgtggacttcagacagatgggccttggaggagacgacagctggggtgcgatgcctcatctggagtacaggcttctaccaaagccgtatcgcttttctttcagaatgaggattagcgaagagattccatcctggagggttcttgcggcgatccctgaaacgctccatgttgagatgtcctcagaagacgtgatacgcgaaggagacaccctgagagtgaaattttcccttctgaacgacactccactgagcaaggaaaaacaggtggttctctttgttgatggaaacgaatactcggtgaggcgagtggtgattccacccttcaagaaggaagagctggtgttcaaagtagaaggattgaagaagggtgaacatctgatacatactaatctgaacacgagaaaaactatctacgtgaggtga

SEQ ID NO: 26697 - DNA, 1950 bp, Thermotoga maritima
atgctcggcgtctgttactatccagaacactggggaacagagaaagttgaagaagacttcagaaggatgaaagaactcgggatagagtacgtgaggattggagagttcgcctggagcaggatagagtcggagcgtggaaagttcaactgggactggctcgacaaaacacttgagctggcagagaagatggggctcaagatcgtactgggaactcccacagccacacctccgaagtggctcatcgatgaacacccggagatccttcccgttgataaagatggcagggtgaaaaattttggttccagaagacattattgcttctccagccctgtttatagagaggaagtgaaaagaatcgtcaccataatagtgaaaagatacggaaaacacccggcagtcgcaggctggcagacggacaacgagtacggctgtcacgatacggtgaggtgctactgtccgaggtgcaaaaaagccttccaaaaatggctggaaagaaagtacgagggagacataaagaaattgaatgaagcgtggggaacagtgttctggagccaggagtatcgatccttcgacgaaatagagcttccgaatctcacccctgccgacccgaacccgtcgcatcttctcgactactacaggttagcctccgaccaagtggtggaattcaacaagctccaggtggagataataagggagtattcgccgggaagattcatcacacacaatttcatgtccggtttcacagattttgatcattacaaactctcgaaagacctggatttcgcaacctgggacaattacccgctcggacacaccctcgtttttctgagaatgaagggtgagacaaaaaatccgttcgacagagtgggacacccggacatcatctcattctcgcacgatctgtaccggggagtgggcagaggaagattctgggtgatggaacagcaagcaggacctgtgaactgggctccttacaatctctggcccgccaagggagcggtgagactctggacgtggcaggcgttcgcacacggtgcggaggtggtctcctacttcagatggagacaggcaccttttgcgcaggagcagatgcactctggacttctggcaccggattcagcaccttaccctggataccacgaggtaaagcaggttttcgaggagctcaaaaacatcgatatcaatgagcccgtggaaagcgaagtggcacttgtcttcgattatgaaacggcgtgggtcttctccatacaaccgcacggcgagggggtgaactacatcgatcttgtcttcagattctacagtgccctcagaagactcggtctgaacgtggatatagtaccccctggatcttcactggacggatacaaaatgatcgttgttccaagccttgccatcgtgaaggaggaggttctggacacgttcaaaaaatacgacggtcttctcgtacttggcccaagaagcggaagcaaaacagagacattccagataccaccagaaatgcccccaggtcttctcaaggagatcatacccgttgaagtgagacaggttgaaagccttggagataatgttgagacacttgtttggaacggtaaggaataccctgtctcgatatggagagaggatgtggaccccaccatcacggaagtgatcgcaagattcaaagatggttttggagccatctttcgaaaggaaaacgtcttctaccttgctttctggccgaatggagactttctcgtagatttctttgaagcactttcaaaagaatcaggaattgaaacgaaaaggatgccagaaggagtacgcattcaaaggagaggtgaatatgttttttctttcaatttcacctctgaggaggtagatttagaaataccaacgaaagttcagatagttctaggagatcaaaagattcctccctatggactgctgatatggaaggaaaacgaacgctga

SEQ ID NO: 26698 - DNA, 1947 bp, Thermotoga maritima
atgaaagaataccggataagacccagggaagcgaatctttcttttctggaagatctggatgaggaacagagaagagcagtcgttgaatcagagggaagatgcatcgtaatagcaggcccggggtctgggaaaacccgggttatcacgtacaagatcgcctatcttctggcgaacggtgtggatccttccaggattcttctggtcacgttcaccagagcagcggcgcgggaaatggtggagagggcaaaggcggtgaccggaagagagctttctgagatgctcgccggaacgttccatcatgtgtgcaaccacttcttgagaaagtacgcaccttacgtgggtttggaacgaaattactctatcctagacagagaagacgcggagagcctcatgaggcatgcaagaagcaagtacctcgaaagaaagagtaaagaagagagaaaaaactttccccagccctctgttttgatggctatatattcttacatgaaaaatactctcaaatctttgagggaaagtatcgtagtgaagaatccaaagtttctggacttgaaggaagaaatctcggagatcttcgatctctacgagcaggaaaaacgctctcagaacgtggtggactacgaagaccttctcttctacgcttacagactcttcgaagagaacaaagaaataagagatcgagaggcggaaagattcctttggatactcgtggatgagttccaagacaccaactacgttcagtacaagatagtggaacacctctcgtcgaaacacggcaacatcctggcggttggagacgacgcccagagtatttactcctttcgaggggcaagatacgaaaacgtcgaggatttcataagagttcccggaacgaagatcttcaagatccagacgaactacagaagcacggaaagtattgtgaaattcataaacgccatgctcccgagaaaatccgttccaaaagaactgaagccggtaaagaaagatggcatgaaacccgttgttgtcaagacctgggatagatatgaagaagcgaggttcgtgtctcagaggattctcgagttaatagaagaagggttcaaaccagaagaaatcgccgttctctacagatcacattcgcactctctggaacttcagatggaactcgttcgaagtagaatagatttccgtgtgctgtctggtcccagattcaccgagagcgcccacgtgaaggacgttctttcttttctcagaatcgttcaaaatccgagagacaaatccgcctggttgagggctgcaaaactcttctacgggatcggtgacagaacggcttcgaagatagcggatctcgccagcgcttacgtggaagaaggtctggatcccttccaggaactgaagaaagtgagtttcagtggtgagtacagcaggtttatcgatattctcgatcagatcagaaagctcgattctcctggggaaatgatagagcgcgtcctgtcttctttttattccgaatatctggaagcgaggtatcctgatttccgtgaaagggagatggatctggaaaggctcgttgaaatagcgtctcgctacacaagtctcgaatccttcctgacggatcttgctgtgacggaaaacgttgaaatagaaagagaaatctctcaaaaagagggaaaggtcactctcaccaccgttcatcaggcaaaagggctcgagtggagagtcgtttttgtcatctctgtgaatcccggagactttccgaattatttcgcgatatccgaagggaatctcgatgaggaagagaggatcttctacgttgccataacaagagcaaaggaacagctgtatatttcctaccaggtcaccggaacctcctacccataccgcggaaacaggttcatcatgagaagcggagagaatttcattgacagaataccgcttgaactcgtcgagttttgggaagtgaaatga

SEQ ID NO: 26699 - DNA, 651 bp, Thermotoga maritima
atggaagcggtgattttcgacatggatggagtgctcatggacacagagcctctctacttcgaagcttacagaagagtcgcggaaagctatggaaaaccttacacggaggatctccacaggagaataatgggagttcctgaaagagaaggtcttcccatcctcatggaagctctggagataaaagattctctggagaacttcaaaaagagggtccacgaagaaaaaaagcgcgttttctctgagcttctcaaggaaaatccgggtgtaagagaggcgctcgagttcgtaaagagcaaaagaataaaactcgcgctcgcaacctccacaccacagcgagaagcgctggagagattgagaagactcgatctcgaaaagtacttcgacgtcatggtgttcggtgatcaggtgaagaacggaaagcctgatccagagatataccttctcgttctggaaaggttgaatgtggtcccagagaaggttgtggtcttcgaagactcaaagagcggtgttgaagccgcaaaaagcgccggcatagaaagaatctatggagtcgttcactctttgaacgacggtaaagcgcttcttgaagcgggtgcggttgctctggtgaaacccgaggaaatcctgaacgttctcaaagaggttctttaa

SEQ ID NO: 26700 - DNA, 1134 bp, Thermotoga maritima
atggtatccaggagaatatcagagattcccatatcgaaaaccatggaactcgacgcgaaggccaaagccctcataaaaaagggagaagacgtgatcaatctaacggctggtgagccggattttcccacaccggaacccgtcgtggaagaagcggtgagatttctccagaaaggagaagtgaaatacacagatcctcgtggtatctacgaactcagagagggtatagcgaaaaggataggcgagagatacaaaaaagatatctcaccggatcaggtcgtggtgacgaatggagcgaaacaggctctgttcaatgctttcatggcccttctcgatcccggtgacgaagtgatcgtgttttctcccgtctgggtcagctacattcctcagatcatccttgctggtggcacggtgaacgtggttgagacgttcatgagtaaaaatttccagcccagtctggaagaggtggaagggcttcttgttgggaaaacgaaagccgttcttatcaactcgccgaacaatcccactggtgtggtgtacagaagagagttccttgaaggacttgtgagacttgccaagaagaggaatttctacataatcagcgacgaagtctacgattcccttgtttacacggatgaattcacatcgatactcgatgtttctgaaggattcgaccggatagtttacataaacggcttctcgaagtctcactccatgaccggctggagggtgggttacctgatatcgagcgaaaaagtagcgaccgctgtgtcgaagatccagtctcacaccacctcctgtatcaacacggtagcacagtacgccgccttgaaggctctggaagtggacaactcttacatggttcagacctttaaagaaagaaaaaatttcgtggtggaaagattgaaaaagatgggtgttaagttcgtggaaccagaaggtgcgttctacctctttttcaaagtccggggtgacgatgtgaaattctgtgaaaggctcctcgaagaaaagaaggttgcactcgttccaggatccgcttttctgaagcctggatttgtgaggctttcttttgccacatctatagaaagacttacggaggcgctggatagaattgaagacttcctcaattctcgttga

SEQ ID NO: 26701 - DNA, 1734 bp, Thermotoga maritima
ttgaagacttcctcaattctcgttgatttcctgaagagaaactggcacaaataccttctcggtgttctttcactcatcgcggtggacctccttcaagtctacattccacgtgtcatcggaaagatcgttgacatgctgaacacagaaacgatgaacttcgatacactcaaaataatgttgttttgggtgatggccgccgcgagcgggatgtttattggaaggttcttctggagattcttccttggtggcactgcaagaaagtttttcctcgagacatcgaacaagatgttctcaaagctgctcagtctcactcccggtttcttcgatcgaatgaaaagcggtgaactcatggcaaggttcaccaacgatctgagccttctgagaagagtgctcggccagggtgcgatactcttcttcgattctttcatcatgatcgtgatggtctttttcttcatgataggtaacgtgggttggaagctctcctggatcagctttgcgccgcttttgcttcttgcccctgtttcgatgagctttggacgactcatacacagaaaagtatcggaagttcagagatccttctcggaactttccgggttcaccgaagaaacgatttcgagtgtgcgcattgtgaagagcttctcggtggaagacgtctcattcaagatatttgaaaacagggcactcaaaaactacgaagacactctcagtgcaatcaaagtctccagcgttttcaggcccctcatcaatcttatcgcttcgaccgcttttttcctcgcccttctctacggtggaagagccgttataaacgggaagatctctctcggtgatttcatagccttcaattcctaccttggaatgctcgtctggccgatgatggcctacggtttcatggtggatctgttccagaggggaagagcggctatgagacgtctggacacgatcttcaccgctcaacccgaagttaaagaacccgagaagccgatcaggatagatcactttgaaagttttgaagtgagaaacctgacctacagataccccggaacagaacgtgaagttctgaaaaacgtcaccatgaagataaacaggggagaaatgataggcatcgccggcagtgttggaagtggaaagtccacgatagcaaagcttctcgtgaagctctatccggtggaaaggggaaagatattcataaacggtgtggacataaacgacgtttcttcggagaatatcagatccatcgtcactctggttccgcaggaaacgtttctgttctcagacacggtgagaaacaacataacggtcggtttggaaaacgtcgatgagaaaaagatcgaagaagtgacaaaacttgcggccgtctacgacgatatcatgagctttccagaaaaattcgacacgatcgttggggaaagaggtgtgacgctttcgggcggtcagaaacagagaatcaccatagcccgcgctctcataagagatttcgaagtttacatattcgacgactgtctctcggccgttgaccctgaaaccgaagagaggatcatagattcgatcagaaaaggaatgaaaggaaaaacgatcgtcgtcataacacatcgattgaaggtgttgaaaaacgccgacaggatatatgtcttgcacgagggaagagtgatagaagagggcactcacgaggaattgatgatcagggatggcatgtacagtagaatgtacagaaaacagctcatcgaggagggatag

SEQ ID NO: 26702 - DNA, 1140 bp, Thermotoga maritima
atgaacacagacgacattctgttttcttacggagaagaagacattcctttgaaggcgctgtcgtttcccatcttcgaaacgacgaatttctacttcgacagtttcgacgagatgtcgaaagccctcagaaacggagactacgaattcgtttacaaaagaggaagtaatcccacaacgagactggtggagaagaaactcgcagcgcttgaagagtgtgaagatgcccgcctcgttgcctctggaatgagcgccatttcgctttccatccttcatttcctcagctcgggagaccacgtcgtgtgtgtggacgaggcttactcctgggcgaaaaagttcttcaactacctttcaaagaagttcgatatagaagtcagctacgttcctcccgacgcggaaagaatagtcgaagccatcacgaagaagacgaagctcatctacctcgaaagtcccacgagtatgagaatgaaagtgatcgatataagaaaggtcacagaagcggcaggagaactcaagataaaaaccgtcatagacaacacctgggcgtcgccgatctttcaaaaaccaaagcttctgggagtggatgtggtggtccactctgcgacgaagtacatctcaggacacggagacgtgatggcaggagtgatcgcaggagacgtcgaagatatgaagaacatcttcgtggatgaatacaaaaacatcggaccggttctctcgcccatagaagcctggctcatcttgagaggtcttagaacgctggaactccgtatgaaaaagcactacgaaaacgctcttgtggtgtctgacttcctcatggatcacccgaaggtcctcgaggtgaactacccgatgaatccaagatcaccgcagtacgaactcgcttcctctcagatgagcggtggctcaggactgatgagcttcaggctgaaaacggacagcgcagagaaagtcaaagagttcgtcgaaagtctgagggttttcaggatggctgtgagctggggaagtcacgagaaccttgttgttccaagggtggcttatggagactgcccgaaaaaagacgtgaacctgataagaatccatgtgggtctcggagatccagaaaagctcgtggaagatctggatcaggcactcaaaaagatttaa

SEQ ID NO: 26703 - DNA, 1248 bp, Thermotoga maritima
atgagaattgcggtgataggtgggggaagcagctacaccccggagctggtgaagggacttctcgacatttccgaggatgttcgcatcgacgaggtgatcttctacgacatcgacgaagaaaagcagaaaatcgtcgttgatttcgtgaagagactcgtcaaagacaggttcaaggtgctcataagcgacaccttcgagggtgctgtcgtggacgcgaagtacgtgatctttcagttcagacccggcggactcaaaggtagagaaaacgacgaaggcattccgctgaagtacggtctcataggtcaagagacaacgggggttgggggattttcagcggctttgagggcgtttcccatagtagaagagtacgttgataccgtgagaaaaacatcgaacgcgaccatcgtaaacttcaccaacccatccggccacattacggagttcgtgagaaactacctcgaatacgaaaaattcataggtctctgcaacgttcccataaacttcatccgggagatcgcagagatgttctcagcaaggctcgaagacgtgttcctgaagtactacggcctcaaccatctgagcttcatagagaaggtcttcgtaaaaggtgaagacgtgacggaaaaggttttcgagaacctgaagctgaagctctccaacataccagacgaggatttcccgacgtggttctacgactcggtgagactcattgtgaatccttacctgaggtactacctgatggagaagaagatgttcaaaaagatctccacacacgagctcagagcaagggaagtgatgaagatagagaaagaactcttcgagaagtacagaaccgctgtcgagataccggaggaactcacaaaacgcggtggcagcatgtattccacagcggcagctcacctgataagagacctcgaaaccgacgaaggaaagatacacatcgtgaacacgagaaacaacggctcgatcgagaacctcccggatgattacgttctggagatcccgtgttatgtgagatccggcagggttcacacgctctcgcagggaaaaggagatcactttgctctttctttcatccacgcggtgaagatgtacgagcgactcacaatagaagcgtatctgaagagatcgaaaaaactcgctctaaaggctttgctttcccatcctctcggacccgatgtggaggacgcaaaagaccttctcgaagagatactggaggcgaacagagaatacgtgaaactggggtga

SEQ ID NO: 26704 - DNA, 2205 bp, Thermotoga maritima
ttgaaggcttacgcgttcggttttccgaagataggagaaaagagggaattcaaaaaggctctggaggatttctggaagggaaagatcacggaagaacagttcgaggaagagatgaacaaactcagaatgtacatggtggaaaactacagaaagaacgtcgatgtgattccttcaaacgaactttcctactacgactttgtgctcgacacagcggtgatggtgggggcagttccggagaggttcggtgagtacagaggactttcaacgtacttcgatatggcgcgcggtggaaaggctctggaaatgaccaaattcttcaataccaactatcactacctcgttccggaaatagaaaccgaagagttctatcttctcgaaaacaaacctcttgaggattatctgttcttcaaatcgaagggaatagaaacagcaccgtgggtgataggtcctttcactttcctgtacctttccaaaagaaacggcgagtggatcagaagaccaaatcaaatggaaaaactgctggaaagcctcgtttctgtttacaaagaagtattcgaaaagctcgtggaaaatggctgtaaggagattctcgtgaacgaacccgctttcgtctgcgatcttgaaaaggcccactgggatctgatactgaacgtgtaccgtgagctttcagaatttccactgactgttttcacctattacgacagcgtttccgactacgaagcgtgcgtctcccttccggtgaagagacttcacttcgatttcgtttcgaacgaagaaaatctgaaaaatctcgaaaaacacgggttcccggaagacaaaaaactcgtggctggtgtgataaacggccgccagccctggaaagtggatctcagaaaggtggcatcgctggtagaaaaactcggtgcgagtgccatctcaaattcctgcccactctttcatcttccagtgactctggaactggaaaacaatctgccaggcggattgaaggaaaaacttgcctttgcaaaagaaaagctcgaagagctaaaaatgttgaaagatttcctggaaggcaaaacatttgaccttcctaacgtgtcttttgaagatttcgcggtggacctccaagctgttgagagggtaagaaatcttccagaagattcgttcagaagggagaaagaatacaccgagcgcgacagaatccaaagagaaagactgaaccttccactctttccaacaacgaccattggctctttcccgcagactcctgaagtgagaaagatgagatcaaaatacagaaagggagaaatttccaaagaagaatatgaagctttcataaaggaacagataaaaaaggctatagaacttcaggaagaaataggactcgacgttcttgtgcacggtgagtttgaaagaaccgacatggttgagttcttcgctgagaagttgaacggcatcgccactactcagaacggctgggttctctcctacggttcgaggtgttatcgcccaccaatcatatacggcaccgtcacacgaccagaacccatgacgctcaaagaaatcacctacgctcagtctctcacggaaaagcccgtcaaaggaatgctcacaggacccgtcaccatcatgagctggagctactacagggaagacatcccagagagagaaatagcctaccagatagcccttgcgataaacgaagaagtgaaggatctggaagaggcgggaataaaaatcgtgcagatcgacgagcccgcgttcagagaaaaagcacccatcaaaaagagtaaatggcctgagtacttcgaatgggcgataaacgccttcaacctggcggccaacgcgagaccggaaacacagatccacgcccacatgtgctactcggatttcaacgaaataattgagtacatccaccagctggagttcgacgtgatcagcattgaggcttcgaggagtaaaggtgagatcatttctgcctttgaaaatttcaagggatggatcaagcagatcggtgttggtgtttgggacatccactctcctgctgttccctccatcaacgaaatgagggaaatagtcgaaagagttctcagggtactgcctaaggagctgatctggattaatcccgactgcggtctcaagacgagaaactgggacgaagtaattccatcgctcagaaacatggtagcgcttgcaaaggagatgagggaaaaatttgaaagttga

SEQ ID NO: 26705 - DNA, 672 bp, Thermotoga maritima
atgaagttggcaaaaaaatactacgctgtaagaaaaggaagagttcccgggatctacaaaacctggaaagaggcggaagaacaggtaaaaggtttcccgggagccgagtacaaaagttttgaaagactggaagacgcgaaagcctatatggaaggaaagaacgagtgcatctgtccagaactggacacagagacgatgatcgcctacgtcgatggaagttacgatgaggtgtgcggatctggaattgttttgtgctatagaggaaaaaaggaagaatactacttctggacgaacatcgaggagttcaaagactcaagaaacatcaccggtgaaattatggcggcactctttgcgatggattacgctctcaaaaagggagcgagaaaactcgttctcaggtacgaccttgaaggtctggaaaagtgggcaacggaggagtacaggacaaacaagctggtaacgaaggtgtacagacactactatcgaaaattctgtcagatgggactgaaggtggtattcgaaaagataaaaagccactccgggaacttctgcaacgacgaggctgacagtctggcaaagaaagccagcaaaaaagaatcaaacgtcgagtggatgccggaggattttgagagtataataagaacactgactaaaaaaggaggatgtttatga

SEQ ID NO: 26706 - DNA, 1716 bp, Thermotoga maritima
atgaaatttttctcagcaagtaacgtcagagacgatatcaaaaaattcgagaggaaatacaaaaggtactatccgatcttcttgttactggagagcctgtttttaaccaccaacgttctcactccacttctcataaaaaagaccatcgacagtgcgttctacaggggttctgtagaagaagtcgctctgttttccatactttattttgtcgttcttgtgtctcagtccttcatcatgtacagactgaacttctcagttgcgaaacacctgctgaacgcatcacgggctaaggaatcaaagggggtttatgcgaaaatcctgacacttccactatcttttctgaactcgaaaaacaccggtgattatctttcgatcttcatgagggatattccgaaggtggcctcgggggtttatcttgcgaggcttcagtttttcttcaatctgggattttttcttgttgttctttcgcttctgttcattctgaatgtgaaacttgcccttgtggttctggcgagcatcgttctgttttttgtatcgacttcaatcctgaaaaagatggtcatcaggacatctcagagagatcaggaagcctaccagagatttttgaaaagatccagagaagtggtggaaggaacaccggttctcaaacagttttctggccttttgtttctcagagatttcctcgattcaagtgccagagagtggagcagggcaagcatcatccacagcacggtaaacgaactttcgaacaggaacatcgagatgaacagatgggtcgggagtaccattgtccttgccttcggtgtttaccttctctggaagggtgagataagtgttggaacgcttctggcttttgaatcctatatgaactggatatacgacatcgtcagaatggcactcacaggtctgacgacgtttttctctacagttccaaactgggaaaattttacaagagtgttttccctgccctttgaaagagcaagcggaatagatcttgaaaggttcgaaaaactgcagttgaaaaacgtgcattttaaatacgatgaaacacctgttctcactggtttgaatttcgagataaactccggggataagatcgcaattgtggcaagatctggtgcaggaaagagcacgctcgtttctcttttcaacaggctactgtctcccacagagggtgaaattctcataaacggtgttcccatcgaacagtactctcttcaatcactcagaagaaacatcgttcttgttcgatcgaacgatattttgttcgacaccactatcaaaaacaatatcaccctttttgaagacttcccagaagatgagatcgaaaatgttctcaaaatgtgtgagtgtgactttgttaaggaactggaaaacggaatagacacggttgttggagaaagagggacaagactctcagatggtcagagacagagaatcgtccttgcaagggccctgataagaaagccgcaggttctgattctggacgaggttacatctggtgttgacagcgaaacagaggaaaagatccttgaaaaaattctgaatgagatcgagacggtgatcatcgtctctcatagactttctaccataaaaaaggccagcagaatcattgtactgaacgatggaagggtggaagctgaagggacccacgaagaactcatgaagaaatctcctctctacagagaaattgtgaagagccagctgatgagatga

SEQ ID NO: 26707 - DNA, 1173 bp, Thermotoga maritima
ttgaacagaaacctccttcttttcgcctccggttcgttcgtttcgctgatcggcaccaggatctatcaagttgcactggcatggtggctctactcgaaaaccggctcgagcgaatacgtgggcctcttcatgatatcctcttttcttcccgccataatagtgagtcccttcgctggaacggtggtggacaggcacagcagaagaaacatgatggttgtgatggatattctcaggggagttctgttcatgtatctgtttctcatggaatatttctcagagttaacgatggcgcttcttctgatcgtcaccgttcttgtctccgtgttcgattctttcttcaatccagcagttgattccctgcttcccgatctggtcagaaaagaaaacctggtcagggcgaattcactctacaggttgctgaagaacctctcaaaaatacttggacctgcccttggaagcctccttctgaaggtagtgggacttgcaggagtgattctcataaattctctgtcctttttgatttcaggaatctttgagatgttcataaaggttgaagaaaagcatctgaagaaagtgtcgaaggaaagaaatatgtggcaggacataaaatctgctcttttgtacataagatcggtgaggttcatcctggtgacgatactggtcattgccatcatgaacttcttcacaggttcaatgcacgttctgctacctgaacacgtctcgaaactgggaaagagcgagtgggtctatggaacgttgatgagtatgctgtcgtttgggggactgatagtcacatttctgatggcaacgataagaacaagagccagcgtgaaaaccctgggtttgaatctggtggggtacgggctggctgttttcgtgtttgccatgacgggtaaccattggcttatgtttgccatgtatttcctcattggaatctttcaaacccttttcaacataaacgttatcacactgcttcaactggcaataccggaggaaatgaggggaaagatcttttccctgatctcagccgtatctttctcgctactgcccgtttcctatggtttctttggatttctctccagttacgttgcaacggcgcacatcttcataaccacttccatggcgctcatcgcaggaggcgtgctgatttctcttcagaggtttgaggggtga

SEQ ID NO: 26708 - DNA, 780 bp, Thermotoga maritima
atgagaatgaacatccagaaacacggagaagactggaaaggtacagttgtgatcgtacacggtctcggtgaacactccgggaggtacagaagacttgtgagagaattcgtttcagagggtgttcaggtggtcacattcgatctaccaggtcacggcaaatctcccggaagaagagggcaccttcgttttgatgacgtttttaaaatattgaacgagatcacgaaagatctggaaaggttcgtgctctttggtcacagtctcggtggattgatagctatcagattcactcagatttttcagccagagaaccagaaagggttggtggtgtcggcccccgctatcctgcttccagatacccattctccggtccttgaattcatggtgaggtttctgtccttttttgttccattcctcacgatgagcaacgggataaacccgagcgatctttccaggaacagagaagcggtggaagcgtacataagagatcccctcgttcacgacaggatctctttcaagctcgcttcagatatgctctcccatatgaaaaaggttctcaaagacgctgaaaggataaaggttcctgttctcatttttcacggaactgatgacagggtggtgtcttttgagggaagcaagaagtttttcgaagcactgagcacagagaaaaaactggtgagctttcctggaggataccatgaactttttgaagatccagagcaccagaaagagtttttcaaaacgatagtcgagtggagtctcgaaaaactcggagggaaataa

SEQ ID NO: 26709 - DNA, 1410 bp, Thermotoga maritima
ttggtaagggtgagattcgcaccgagccccactggctttctccacgttggaggagctcgaaccgctctgttcaactttcttttcgcacggaaagaaaaaggaaagttcatcctcagaatagaagacaccgatttggagagatctgagagggagtacgaagagaagctcatggaatctctcaggtggcttggtcttctgtgggatgagggaccggacgtgggaggagaccacggtccatacaggcagagcgagagagtggagatatacagagaacacgctgaaaggcttgtaaaggaggggaaggcctattacgtttacgcttaccctgaagagatcgaagagatgagggagaaactcctctctgaaggaaaggcaccacactactcccaggagatgttcgaaaagtttgatactcccgagagaagaagggaatacgaagaaaagggtttgaggccggctgtgtttttcaagatgcccagaaaagactatgtgttgaacgatgtggtgaaaggtgaagttgtgttcaagacaggagcaattggggattttgtgataatgagaagcaacggtcttcccacctacaatttcgcctgtgtggtggatgacatgctcatggaaataacacacgttatccgtggagacgaccatctctcaaatacactgagacagctcgctctctatgaagcgtttgaaaaggctccccccgtttttgcgcacgtttccaccatactgggacccgatggaaaaaaactgagcaagagacatggagccacttctgtggaagcgttcagagacatgggatatcttccggaggcgcttgtcaactatctggcacttcttggatggtctcacccagagggtaaagaactcctcactctcgaagaattgatttcttcgttttctctggacaggctcagcccgaaccctgcgattttcgacccacagaagttgaaatggatgaacggttactatttgaggaacatgccgattgagaagctcgcagaactggcaaagccgttctttgagaaagccgggataaaaataatcgacgaggagtactttaaaaaggtattggagatcacaaaagagagagtagaggtgctttcagaatttcctgaagagtcccgcttcttctttgaagatccagcacctgttgaaataccagaagaaatgaaagaagtgttttcacagctcaaagaagagctccagaacgttcggtggaccatggaagaaatcacacctgtcttcaagaaggtactgaaacaacacggtgtaaagcccaaagaattctatatgacgttgagaagagttctgactggtagagaagaaggtcctgaactcgtcaacattattcctcttcttggaaaggagatctttttgagaagaatagaaagatctctggggggatga

SEQ ID NO: 26710 - DNA, 606 bp, Thermotoga maritima
atgaaactctatctcataagacacggcgaaaccatctggaacgaaaagggtctgtggcagggagtcacagatgttcctctcaacgaaagaggaagagaacaggcaagaaagctggcaaacagcctgaaaagagtcgatgccatttactcgagtcccctcaaaagaagcctcgagacagcagaagagatcgccaggcgctttgaaaaagaaatcatcgtcgaagaagatctgagagaatgtgaaatatcactctggaacggtctcacagtggaagaggctatcagggagtatcctgtggagttcaagaagtggtcatcggatccaaattttggaatggaaggtttagaatccatgagaaatgtacagaatcgcgtagtgaaggcgatcatgaagatcgtctcacaggagaagttgaacggttcagagaacgtggtcatcgtatcacactctctgtctttgagagctttcatctgctggatcctcgggcttcctctttaccttcacagaaatttcaagctggacaacgcgtccctcagtgtggtggaaatagagagcaaaccgaggcttgttttgttgaacgatacgtgtcaccttaaggaatcttga

SEQ ID NO: 26711 - DNA, 816 bp, Thermotoga maritima
ttggtcgaaaatatcggcagcggttctgctgaacttgtttcttacgcaaaactgaatctctacctggatgtgcttggaaaaagatccgacggatatcacgaaatagtgggattgtttcagacgatttctcttcacgacacactaactgtggaaatctgtgatagaggtttctatctggaaagcagcgtagctctgccctcggacaacacgatcaaaagagcctgggagatgttcaggaaaaacacaggaaaagaattcggtctcaaagtcacgttgaaaaaggagatcccagtaggctctggcctcggtgggggaagctctaacgctgcagcggttctcagatatcttggtgaagttttcaaaatacctcttgaagaccttctgaatatagcagctcaggtgggaagcgatgtacccttttttctttacggaggaaccgctcttgtgagaggaagaggagaaatcgtggagaaactcgaggatatcgaaggatactctgttgatttgttcttcccgggcattcactcttcaacgaaagaaatgtatctgtctctcacaccagagatgtacaggaaaggacccggcagggtagaggaactgcacagggcttaccttgaaagaaattacgaaaagataaaggaactctcttacaacgtgtttgagaaggtgttcttagagaaacacccggaggtaatggatggactgagaaactttggcgatggttccatagtgaaaatgatgacgggaagcggaagtgtctttttcgctctatatcctctggacaagggaaattactcgtttgtgggaggtgtttaa

SEQ ID NO: 26712 - DNA, 522 bp, Thermotoga maritima
gtgtttaagttggatctcaaacgcttcataagagatataccggatttcccgcagaaaggcatcgtgtttcgcgacataacccctcttttgagaaatcaggaagccttcaaagaagcgatcgacagaatgtgtgaactcgtttttgacagggagttcgatctcgtggtggctcccgaagcgaggggtttcatccttggagccgctatggcgtacaaactgggaaagggtttcgttccggtgagaaaaccgggaaaactcccgtataaaactgtgtacgaagagtatcagctggagtacggcactgaacagctccatatacacgaggatgccatagagaaaggccagaaagtgctcatagtggatgatgtactcgcaacggggggaacagcggaggcactcataagactggttaaaaaactcggtggggaagtggtttctctcgctttcctcgttgagctttcatacttggaaccaagaaagagactggaaggttacgatgttaaaactctgatagtctactga

SEQ ID NO: 26713 - DNA, 2376 bp, Thermotoga maritima
atgttcaatctggaagagtacacggaaaaggcgcagaaagtaatgatgagcattcaggatataatgacccgatacagacaaaaccagctttccagtgagcacatactgctcgcgattctggaagaaggaaacaacgttggtgtagaacttctgaaggagctgaacgtggatataaacaggctcaaagatgaggtggaggtgttcattgggaaatacggggttagagtccctgaaggagcatctgtttctcagattttcataactccggacgcgaggcatgtcattgaaaaagcgagagaagaagcgagaagaatgggagattcaaaaataggaaccgagcaccttattttggggatggtcctgtcacctgattccacggccttccgaatcctctcgagatacggtgtaacacctgagagagtctacgaagcaataaggaagatcagatcaacgggtaaaacagatgaagcagagaacgtggaagcgctcgctcgcttcacagtggatctcacacagctagcccgcgaaaaaaagctcatgcctgtagtggatcgtgaaaaggaaatcagaagggtgatacagatactgtccagaagaacgaagaacaatccggtcctcataggagacccgggggtgggaaagactgctgttgtcgaggggctcgcccagagaatagttgaagggaaagtccctctgtttttgagaaacgtcagagtcttgaaactcgacatgggcagattggtggcagggacccgtttcagaggagattttgaagaaagactgaaacgtcttcttgatgaattgaagaggaaaaaaggagaagtaatactcttcatcgacgaggtgcacacggtggtaggagcgggagcagccgaaggtgctctcgacgccgcgaacataatgaaaccagaactcacaacgggagagattcagataataggagcaaccaccgttgaagagtacagaaaatacatagagaaagacagggcgcttgagagaagattccagccggtcatggtggaagagccgacggtcgagcagacaattgaaatactgaaaggattaagaaaggtctttgaagaacatcatcacgtgaagataacggatgacgctctggaagccgcggcgaaactctccgcacgatacataaccaacagattcctcccggacaaggccgttgatctgatagacgaagcggcagcgtacgtgcgtcttgaatcctcgtacccttcagaagaactcctgaaactcgaagaagagatcaaaaaccttgaagacaaaataaacgacgccgttgtgaagggagagtacgaagaagcggcaaagctgaaggtcgaactccagaaattgaaaaacgaatacgaagaaaaaaggaaaaaacaagaaaaggtggaaccggttgtcgatgagaacgttgtggcaaagatcgtggaacagtggaccggcattcccgtgtctcgaatcatggaatccgaaagagagaaactcctgaaactcgaagaattcatccaccagcgcttggtgaatcaggaggaagccgtgaagatagtggcacggaccataagacgtgcaagggtcggtatcaagaatccgagaaggcccatcggtgtctttctgttcctcggaccaacgggcgtgggaaagacagaactcgccagaactctcgcagacgtgctcttcggcagcgaagacgccatgatcaggctcgacatgagtgaatacatggagaaacactccgttgccagactcataggagcacctccgggttacgtgggttatgaagagggagggcagcttaccgaggctgtgagaaaaaggccttacagtgtgattctcctcgacgaaatagaaaaggcgcatccagacgtattcaacatcctgcttcaagtgttcgaagacgggcgattgactgatggaaagggaaacaccgtggacttcagaaacaccatcatcatcatgacgagcaacataggaagtgagaagatcctcgaaatgtcggaaaacggtgtgagaattgagatagaaaaagaactgcgaaacaccttcaaacccgagttcctgaacagaatagacgccatagtttacttcaaaccgctcacgatggaagaagtgaagaagatagtggaaatcatggtgagacagctccaggaaatactgaaagagaagaacatctccatcgagcttacagaaagagcgaaggagtacctggcagaagcgggttacgtgccatctctcggtgcaagaccgcttcgaagaatcatagaactcgaactcgagtcgatgatagcggataaaatactggaaggagagataaaagaaggagacagggttctggtcgacgcggacgaatacggtctgaagatagagaggaggtga

SEQ ID NO: 26714 - DNA, 813 bp, Thermotoga maritima
atggatgatttgaaaaccagagtcataaccgcgagtgtcgtagcacctttcgttgttctgtgtttcgtgagttacgaaagtctaataggactcgtctctgctatcctcattctggccggctacgaactcatcacacttgaaatgaaagagcgtgatgcacgatttttctatgtgatactccttgctctgtatcccgtcctctacggtcttgtttttgaggaacccacgcagccgctgtcgatcctcttcataactggagtggttttctctctgataacagacaaagatccttcgcaggtgttcaagacagtcgctgccttttcgatcgctctcatctacgttaccttcttcctcagtttctttcttccgatttatcgggattttggtgccgcgaacgctcttctcgttctcacctccacctgggtgtttgattccttcgcatacttcacgggtttgaaatttggaagaacgaggatctctcctcgatacagtccaagaaagagccttgagggagtgataggaggattcctgggtgttgtcatctacacctttttgtatcgactcgttgtgaatgatctgctctctgtgaacgtgataagtttcagaacgttccttcctttcgccgcaacggtcgcgattatggacacctttggtgatatttttgaatcggctttgaaaagacactacggtgtcaaagattctgggaaaacccttccgggtcacggagggatgcttgacagaatagatggactgctctttgttgctcctgtcagctacatcgtgttcaaaatcttagaaggagtggtgcgatga

SEQ ID NO: 26715 - DNA, 921 bp, Thermotoga maritima
atggcgagatacagagtgcacgtgaacgatcctctcgataaagaggcaacacagcttcttatgaacaaagaggaactcgaagtcacatcggaacacctagaaaaagacgaattgatgaagatcataccggaagtcgatgttcttgtcgtcagaagcgccactaaagtcacagccgacatcatagaggccgggaaaaatctgaagatcatcgccagggcaggcatcgggctggacaacatagacgttcaaaaagccaaggaaaaaggaataaaagtgctcaacacaccaggtgccagcgctccatccgtggcagaactcgcgatgggtttgatgcttgcttgtgctcgccacatagcaagagctactgtatctctcaaagaaggaaaatgggaaaaaaaagcactcaagggcaaagaacttcttggaaaaacactgggactcatcggatttggaaacatcggacaggaagtggcaaaaagagcccttgcctttggaatgaaaatcatcgcttacgatcccgcgaaacctgaaacagatctacctgttgaatacgtggatctggacactcttttcaaagaaagcgacttcatttccctgcatgtgcctctcacagaatcaaccaggcatatcataaacagagagagtatcgcgaagatgaaagacggtgtcatcatagtaaacacggcccgtggaggaacaatcgacgaagaagccctgtacgaagaagttgtgagtggaaaagtctacgctgcagggctcgacgtcttcgaagtggaaccaccaacagatgaaatcagaaggaaacttttgagcttggacaacgttgtcgccactccccacataggtgcttccacagcagaagctcaaagaagagttggaatagaactcgtggagaagattttcaaagaactgggaatttga

SEQ ID NO: 26716 - DNA, 984 bp, Thermotoga maritima
atggaagacattatcgtcgtggaaaatctggtgaaaaagttcggagatttcgaagcggtcaaaggagtcagcttctcagtgaagaaaggagaaatcttcgcttttcttggtccaaacggtgcgggaaaaaccaccaccattcacatgctcaccacgcttctaaaaccgacgagtggaaaggcatgggttgccggtcatgacgtgctgaaagaacctcgagaggttagaagaaaaatcggtatagtctttcaggatcaatcactggacagagagctcaccgcgtatgaaaacatgtacatacacggaaaaatatacggctacggtggagaaaaactcaaaaagagaatccttgaacttctcgagttcgtggaacttctggagttcaaagacaaaccggtcaaaacgttcagtggtggcatggcaagaagactcgaaatagctcgctccttgatacatgaaccagaagttctctttctcgacgaacccactattggtctcgatccacacacaagagcgcatatgtgggaatacatctcgaaaatgaaaaaagaacacaacatgacaatctttctcaccacccattacatggacgaggcagaacagcttgctgacagagtggcgatcatagatcacgggaaaatcatagcactcggaactccaaccgagttgaagagaatggtcggaaaagagattatctacgtgagattctctgaagccgttgaatgtctcgaaggcgacttcatagagtcgtgtagaaaactccccgatggaaggctggagctgaatgtggaagattctggaagggcgataccaaagattttcgaactggcacagcagaagggtttgaaaatagaagaaatcacctatcataaacccacgctcaacgatgttttcctccatctcacaggaagggagctcagagaggaaggaccggagaactctttcaaaaccatggcaagaatgagaatgaggatgaggaggtaa

SEQ ID NO: 26717 - DNA, 1299 bp, Thermotoga maritima
atgttcaagccgaattatcactttttcccgataacaggctggatgaacgatccgaacggtttgatcttctggaagggaaaatatcatatgttctatcagtataatcccagaaaacctgagtggggaaacatctgctggggccacgcggtgagcgacgatctcgttcactggagacaccttcccgttgctctatatcccgacgatgaaacacacggagtgttctctggaagcgctgtcgagaaagatgggaaaatgtttctcgtgtacacctactaccgcgatccgacacacaacaaaggagaaaaagaaacccagtgtgtggctatgagtgaaaacggattggatttcgtaaagtacgatggaaacccggtcatatctaaacccccagaggaagggacgcacgccttcagagacccgaaggtgaacagaagcaacggtgagtggcgaatggtactgggatctggtaaagatgagaagattggaagagtgcttctctatacctcagatgacctttttcactggaagtacgagggtgtgatcttcgaagatgaaaccacaaaagaaatagagtgtcccgatcttgtgagaattggagagaaagatatcctcatatactcgataacgagtacaaacagcgttctgttttccatgggagagttaaaggaaggaaaactgaatgtcgaaaagcgggggcttctcgatcacggaacggatttctacgctgctcaaactttctttggaacagacagagttgtagttatcggatggcttcaaagctggttgagaacagggctttacccgacaaaacgagaaggatggaacggtgtcatgagtcttcctagggagctgtatgtagaaaacaacgagttgaaggtgaaaccggtggatgaactcttggctctcagaaagagaaaggttttcgaaactgcaaagtccggaacatttctgctggatgtcaaggaaaacagttatgaaattgtgtgtgaattcagcggagaaatcgaacttcgaatgggaaatgaatctgaagaagtggtgataacgaagagtcgagacgaattaatcgtggatacaacgagatctggtgtttcaggtggagaagttagaaagtcgacagtcgaagatgaagctacaaatagaatacgagctttcttggattcgtgttctgtagaatttttcttcaacgactccatagctttttcctttaggatccatccagagaacgtttacaacattctttctgtcaaatcgaaccaagtgaaactcgaagtctttgaactcgagaacatatggttgtga

SEQ ID NO: 26718 - DNA, 1449 bp, Thermotoga maritima
atgaaatatgttctctctctcgatcaaggtacaacaagctccagagcgatcgttttcgatgaaaaaggaaacgtggtatcgaaagtcaacaaagaattcagacagatctatccaagaccggggtgggtagaacacgatcccgtggagatttgggaatcacagatcgaagtggcaaagaaagctatcgaagaagcagggataaaaccagaagacatcgccgcaataggtatcacaaaccagagggaaacaaccatcgtctgggacaaaaacaccggaaaaccagtttacaacgccatagtctggcagtgtagaagaaccgctcccatctgtgatgagctgaaggaaaaaggatactcagagttcattcgagaaagaactggtcttgtcatcgatgcgtacttttctggaacaaagatcaagtggattctcgacaacgtcgagggagtgagagaaaaggcagagaaaggagaagttctctttggaacagttgacacctggctcatatggaatctcacaggtggaagggttcacgtcacggactattcgaacgcttccagaacgatgatcttcaatatccacaaactcgattgggacgatgaaatcctggaacttctaaacataccgagggcaatgcttccacaggtgatgccgtcgagtcacgtgtacggttacacagcaaaggatatcttcggagtggaaatacctatagctggagacgcaggggatcaacaggcggcactgtttgggcaagcctgcttccagccaggcatgttgaaaaacacttacggaacaggatgtttcctcctcatgaacaccggagaaaaagcctttgaatcgaaatccggtcttctcacaaccatcgcgtggggaataaacgggaaggtttactatgccctcgaaggcagcatattcatcactggcgccgctgtgcaatggctaagggacggtctgaagatcatctcaaacgccgcagaaaccgaagaactcgctacaaaagtgccggacaacggaggagtgttcttcgttcccgccttcgtcggactcggtgctccctactgggacatgtacgctcgaggtttgatcataggcataaccagaggtaccaccagagagcatatagtgagggccgttcttgagtcgatcgcctaccagacaagagacgtggtagaggtcatggaaaaagacagcgatataaaggtggaaaccctccgggtcgatggtggagccgttgtgaacaacttcctgatgcagtttcaggctgacatactcggggttcctgtggagcgccccgttgtaaacgaaacgacggcacttggagctgcttaccttgcagggctcgcagttgggtactggaaagatcaggaagagatagcttctctctggcaactcgacagaagatttgaaccttctatgaattccgaagaaagagagaggctgtattcaaaatga

SEQ ID NO: 26719 - DNA, 1440 bp, Thermotoga maritima
atgaaggctgtcgtcataggtggcggagtgtttggttctctgatagcgcgagagttaactaagtacgacctagaagtgaccctcatagagaaaaatctggacgtgggctggggtgtgacaaaggcgaattccgctgtcgttcacgctggttacgacgatccacctgaaagcgttcgtgcacagttttgcgcgtcaggcaatgcaatgtacgaagatctctcgaaagagctggattttgatttcaaaagaattggatctttcgtagtggcgttcaacgatgaggaattgaaagaactcgaacgtctcctaaaacaaggcgaagaaaacggtgtcccaggtttgaccatcctggaaagagacgaagttctttccatggagccgaatctgaacccagaggtcaaatatgccctctacgctcccactgctggcatcacagaaccatggatggttgccatagcagccgtggaaaacgccgtccagaacggattgaaactcgttcttggagaaagcgtcgttggctttgagaaagtcaacggtcgagtgaggaaagttcacaccagcagaggtgaatacgaagcggatatcgtgataaactgcgctgggctccacgcagacgagatagcaaagttggccggtgcagagtacgttcccctgcatccgagaaaaggcgaatacattctccttgataagaaacttcagggtctggtcaaaagggtcatattccccacacccactaagatctcgaaagggatactcgttcttcccacagtcgatggtggaatccttctgggaccaactgccgaagaccttcccgaagagatgaaagacagacccataaccaccagagaaggtctcgaaaaagttcgagaattcacaagaaggcttgtaccttccctcgatttctccctcgtggtgaaaaccttctcagggctgagaccggaaagtccacaaaaagacttcttcataaaagtgagcgagacggtgaagaacttcgtgaacgttatggcaacaagatctcctggtctcacagcagcgccggcggtggcaaagtacgttgttgaagagttgatccaggaaaaaatgagaattcctcttgagaagaaaaaagacttcaaaccggaaagaaagagaatcgttcactattcggaacttccactcgaagagtggagaagggaaatagaaagagatccacgtgcgggaagactcgtttgcttctgcaacgaagtgacagagaaagaaatagtagaagctatcagaagaggagcaaggacactcaacggtgtgaagttcagaacaagagcgatgttcgggagatgccaggggggcttctgcatggctcgaattctcaagattctggagagagaactcggtgtggatatgtcggaaataaagatgaaatcggagaacagctgggttgtgaacgggaaggtgagagaatga

SEQ ID NO: 26720 - DNA, 663 bp, Thermotoga maritima
atggggtttcaaatagcaatagacggtcccgcagcgtctggaaagtccacaatagcaaagcttcttgctgaaaaactcggcttcgatcatctgaacacgggagcaacgtaccgtgccgttgcagtttatctgcacgaaaaagggctcagttcctcttccgctgaagaagagatcgaaaacgtgctgaaagatctgaagatagactatgtgaacggaagagtctacatcaacggagaggattacacagaaaagattcaaagtccagaggcgggggttcttgcctcaaattttgccaggcttgaagttgtgagaaggcacctggtcagaatccagcgggaaatatgtgacgacaaaaacatcgtggtcgagggaagggatataggaacggttgtgcttccaaacgctcacctgaagatatttctcacagcgtctctggaagcgcgcgtagagagaaagttgaaagagtaccagaaaagaggtctaaaggtcacaaaagaagaagttgaaagagaactcatctcgagggatgagcaggattccaagcggaacgtagccccattgaaaccagcggaagatgctgtgatcatagacacaaccagtatgagtgtggaagaagtgctcgacaggatcctaaaactggtcagggagaggatgaacacttga

SEQ ID NO: 26721 - DNA, 831 bp, Thermotoga maritima
atgggacttaagagattcaaaccggttaccccaggaaggcgtttcatggttatctccgatttttcggatatcacaaagacagaacctgaaaagtcgttgctcgcacctctcaagaaaacaggtggaaggaatcatcacggaagagttactgtaagacatagaggtggcggacacaagagaagatacaggataatagatttcaagagatacgacaaagcaggaattcctgcgaaagtactggctattgagtacgatcccaacagatcagccagaatagcgcttctcctttatgccgatggagaaaagagatatattctggctcccaaaggtgtgaacgtgggagacactctcatgagcggtcctgatgcggaaataaggccagggaatgcacttcctcttgagaagatacctgtcggtacccttgtccacaacgtggaattcacacctggcaagggtggccagatcgcaagagcagccggtacgtactgccagatcatggcgaaggaaggaaattacgctctgctcagaatgccttctggagaactgagaaaggtacacatcaaatgctacgccaccgtcggtgttgtgggcaacgaagatcacaagaacgaagttcacggaaaggctggaagagtgagatggcttggtagaaggccgcatgtcagaggagttgccatgaacccggtggatcacccgcacggtggtggtgagggaagaggtaaaggtcaccacccaacgagtccatggggactgccaaccaagggttacaagacgagacgtggaaagagaccttctgacaaattcatcgtcaggagaaggaacgaagtgtaa

SEQ ID NO: 26722 - DNA, 1161 bp, Thermotoga maritima
atggacatcctgaggaaagtggcagagattcatgggacacccacctacgtatacttcgaggaaacactgcgaaaaaggtcacgtcttgtaaaagaggtcttcgagggagtgaatctccttccaacgtttgccgtgaaagcgaacaacaatcctgttcttttgaagattctaagagaagagggtttcggcatggacgtggtgacaaagggggaactcctcgcggctaaactggcgggagttccttcccataccgttgtatggaacggcaacggaaagagcagggatcaaatggaacactttttgagagaagatgtgagaatcgtcaacgtggattcgttcgaggagatggagatctggagagaattgaacccggaaggcgtggagtatttcatcagggtgaatccggaggtcgatgcgaagacacaccctcacatctccaccggcttgaaaaagcacaagttcggaataccactggaagatctggattcgttcatggaaagattcagatcaatgaacataagaggtctccatgttcacataggatcgcagataacccgggttgaaccctttgtggaagccttcagtaaagttgttcgggcttctgaaaggtatggattcgaagagatcaacatcggcggcggctggggaataaactacagcggagaggaactcgacctgtccagttacagagaaaaggttgttcctgatttgaagagattcaaaagagtcatcgtcgaaataggaaggtacatcgtagcaccttctgggtatctgctcctcagagtggtgctcgtcaaaagaagacataacaaggcgttcgttgtagtcgatggtgggatgaatgtcctcataagaccggcactttattccgcatatcacaggatctttgtgctcggaaaacagggtaaagagatgagggcagatgtggttggtccactgtgcgaaagcggtgacgtgatcgcgtacgaccgggaacttccagaggtcgaaccgggtgacatcatcgctgtggaaaacgcgggagcttacggttacactatgtcgaacaactacaactcgaccacacgtccagctgaagtgctcgtcagagaaaacggaagaatttctctgataagaagaagggaaacggagatggatattttcaaagacgtggtgatgtga

SEQ ID NO: 26723 - DNA, 1206 bp, Thermotoga maritima
atgaacgtggtggttcaaaaatacggaggaagctccgttgccacaccggagagaataaagaacgtcgcgcagagaataaaaaagaaagtggacgaagggtacaaagttgtggtcgttgtctccgctatgggaaagacaactgacaacctcataaaactcgcaaaggagatctctccaagaccggattcgagagaactcgatatgcttcttgcaacgggagaacaggtttccgccgcgctcctttcgatggccctgaaagatctcggagtaaaggccaaatctttgaacgcgttccaggtgaaaataaaaaccactccgcatcacacgagcgctcgtatcgtggatatagatgacagtgtgatccgggaaaacctgaaagattacgatgttctcgtcgtaacgggctttcagggtgtgaacgaacacggtgatctgaccacactcggtcggggcggttcggatacatctgccgtggcgcttgcggcaaaactcagagtgccgtgtgaaatctacagcgacgtggacgggatatacacctgcgatccgcgtgtccatccgagagccaaaaagctcgcttacatcacctacgacgaagctctcgagcttaccgctctcggtgcgaaagttcttcactcaagatccgtggaaatagcaaagaagtatgggatacccatctactgtgcatcttctttcaccgaagaggagggaaccatggtggtagaaagacttccggagtggctggaagaacccgttgtaacaggagcgacaatttctcatggtcaaataaaagtttccatatctttcctcccaaaggatgtgaagtacatcacggccattttcgaggaagttggaaaaagggctctgaacgtggacatgatctcccttgtcccttcgaacggaaaggttttcctctccttcacgattctcgaagaccacaaagaagatctggacgaagcgctcaaagaggctctcagggatgtggaagggtggaaatccacctacgaaggaggttttgccaaactctccatagttggagtgggaatgagaacgagtccgggcgtggccgcaaggttttttgaagcgctggaaagagcgggagtcacaccggagctcgtcacaacgtcggagataaagatctcctgtcttgttcctgaagagaaagcggaagaggcgctgaaatcggtgatcgaagaattcgaactgtga

SEQ ID NO: 26724 - DNA, 651 bp, Thermotoga maritima
atgaagtacggaatagtcggttattccggaaggatgggccaggagatccagaaggtcttctcggagaaagggcatgaactcgttttgaaggtggatgtgaacggtgtcgaggagctggattctccggatgttgtgatcgacttttcttcacctgaagcgcttccgaaaacggtggatctgtgtaaaaaatacagggctggcctcgttctgggaacaactgccctgaaagaagaacatctccagatgttgagggagctttcgaaagaagtacccgttgttcaggcttacaacttctccattggcataaacgttctgaagaggttcctctcggaactcgtcaaagtcctcgaagattgggatgttgagatcgtggagacgcaccaccgcttcaaaaaggacgcaccctccggaaccgcgattcttctggagagcgcactgggaaagagtgttcccattcactcgctgagagtgggtggtgttccgggagatcacgtggtcgtttttggaaacataggtgagacgatcgagataaagcacagggcgatttcgaggactgttttcgccataggagccctgaaagcggcggagtttcttgtgggaaaagatcccggtatgtacagtttcgaagaagtgatctttggaggtgagtga

SEQ ID NO: 26725 - DNA, 885 bp, Thermotoga maritima
atgttcagaggagtaggaactgctatcgttacaccattcaaaaatggtgagcttgatcttgagtcttacgagaggcttgtcaggtatcagctcgaaaacggcgtcaacgcgttgatcgtccttggaacgacaggtgaatcaccaaccgtcaacgaagacgagagagaaaagctcgtttccagaactctcgagatcgtcgatgggaaaatccctgtgatcgtgggagcgggaacgaattccaccgaaaaaacgctgaaactcgtcaagcaggcggaaaaactcggagcgaacggagttcttgtggtcaccccgtattacaacaagcccacacaggaaggactctatcagcactacaagtacatctctgagagaacggatctcgggatcgttgtttacaacgtgcccggaagaaccggtgtgaacgttctcccggaaactgctgcaaggatcgctgcggacctcaagaacgtggtgggaataaaagaggcgaacccggatatagaccagatagacaggacggtatcactgacaaaacaggcaagaagcgatttcatggtgtggtccggcaacgatgatagaacgttctatctcctctgcgcgggtggagacggcgtcatctctgttgtgtcgaacgtggcaccgaaacagatggtagaactctgcgcagagtacttcagcggaaacctcgaaaaatcgagggaggttcacagaaaactcagacctctcatgaaggcactgttcgtggaaacaaatccgataccagttaaagccgctttgaatctcatgggattcatcgagaacgagctgagactaccgcttgtacctgccagtgaaaagacggtggaacttctcagaaacgttctcaaggagagtggattgctatga

SEQ ID NO: 26726 - DNA, 711 bp, Thermotoga maritima
gtgtgctattcggccaatgggaacaccttcctcatagttgacaacacgcaaaagaggatacccgaagagaaaaaaccagattttgtcagggaaaacgtgggcgatctggatggagtcatattcgtggagctggtcgatgggaaatacttcatggactactacaaccgcgatgggagtatggcggccttctgtgggaacggcgcaagggccttttctcagtacctcatagacaggggctggatcaaagaaaaagaattcacttttctctctagggctggagaaataaaggtgatcgttgacgacagtatctgggtgaggatgccgggtgtttcagaaaagaaagagatgaaggtggatggttacgaaggatatttcgtcgttgtgggcgttcctcatttcgttatggaagtgaaaggaatcgacgaactggatgtggaaaaactcggaagagatctcaggtacaaaacaggcgcgaacgtggatttctacgaggtacttcccgaccgcctcaaggtgagaacatacgaaagaggagtggaaagggaaacaaaagcctgtggaacgggtgttacgtctgttttcgtcgtgtatcgagataaaacaggggcaaaagaggtgaagatccaggttccaggaggcacactctttctgaaagaagaaaacggagaaatctttctcaggggggatgtgaaaagatgttcagaggagtag

SEQ ID NO: 26727 - DNA, 984 bp, Thermotoga maritima
atgaaggtgaaagtaggagttgttggtgccacgggagaagttggaagaacgatggtaaaagtactcgaagaattcaacgttcccgtcacggagctcaggctcttcgcttcggaaagatctgtgggtaaagaaattgaattcaaaggtgagaaattcaaggtcgagcttctcacggaagaatcgatgaaatggaagtgtgactacttcctgttttccgcgggtgccagtgtttccagaaagttcgctcctatcgcagccgaaaacggagtgaccgtgatagataactcttctgctttcagaatggagaaggaaataccccttgtggttccggaggtgaacgcttaccttctcaagggatacacaggaataatagcaaatccgaactgttcaacgattcagatgatcctttccatctacaaacttcacgaagtttacggaatagaagagatctttgtgtcgacgtatcagtccgtctccggcgctggtcataaggggatagaagaactccttgctcaagaaagaggagaaaacgtgatgaaagtcttcccaaaacccattcacagaaacgtcattcctctcataggtgatatccaggaaaatcttttctctcaggaagagatgaagatggtgaatgaaacaagaaaaattctgaacgactactcgataagggtgtatccaacaacggtgagggtgcccgttctgtacggacactctgaagcgatcatggtgaggctcaagaaaccctacgagtctctcgaaaaggtgagagaagtcatagcttctggagaagacgtggtggtgacggacgatctcataacaccggtggatgtcgcaggaaagaacgaaacttatgtttgccgactcagagcgaccgatgaaagatccattcttttctggaacgtggcggacaacatccgtgtaggggctgcgaccaacgccgtcagaattctcctgaagcacgctgagatgaacggaaaggtgtga

SEQ ID NO: 26728 - DNA, 825 bp, Thermotoga maritima
atgaggtgggcagttcttctgatggtggtgttttccgctctgctcttttcctccgaggtggttctcacgagcgttggtgcaacggacatttccttcaacggatttccagtcaccatggaactcaacttctggaacgtgaaatcctatgaaggagaaacgtggctcaaatttgatggagaaaaggttgagttctatgcggatttgtacaacatcgttcttcagaatccagacagctgggtgcatggatatccagagatctactacggttacaagccctgggcggggcacaacagcggtgttgaatttcttcctgtgaaggtgaaagatcttccggatttctacgtgactcttgattactcgatctggtacgaaaacaacctgcctatcaaccttgccatggagacgtggatcacgagaagtcccgaccagacctctgtttcttcgggtgacgcggagatcatggtttggttctacaacaacgttctgatgcccggcggtcagaaagtggacgagttcactacaacagtcgagataaacggcgtgaagcaggaaacaaagtgggatgtttactttgcaccgtggggatgggattaccttgctttcagactgacaacaccgatgaaagaaggaaaggtgaaaatcaacgtgaaggacttcgttcagaaagccgcggaagttgtcaagaagcactcaacgagaatagacaatttcgaagagctgtatttctgcgtctgggagatcggaacggagtttggagatccgaacacaacagcggcgaaattcggctggactttcagggacttctctgtcgaagttgtaaaataa

SEQ ID NO: 26729 - DNA, 1317 bp, Thermotoga maritima
atgaagatagaattcgacgttgtcgtcgttggtgctggcccttctggtctgtcctgcgcatacgttcttgccaagaatggtctcaaagttgcggtcgtggagaaaggagaatatccgggttccaaaaacgtgatgggaggggttctctacgtacatcctctgaaagagatcatgccagattttctggaaaaagcggcaaattcgaaagctcttgaaagaaacgttatagagcagaacctttggctcctcggaaatgaaggtgtcatcaagatcggtcacagaaacgtggaatggaaagaaaatccgaatgcattcactgttttgagggcaaactttgacagatggtttgcccaggaggtggaaaaagcaggtgccctgatcataccaaaaaccaaggtggaagacttcctgaggaacgaaaaaggagaaatagcaggcgtggtgacctcgagaccaaagggagaaatacacagcaaggcggttgtgatcgcggagggtgtgaatcccatcctcacgatgaaagctgggctcaggaaggaagatctgaaaccacacatggtggccgttgctgtgaaagaggtgatcagtgttcctgaagatgtggtgaacagggtcttcggtgtggagggaaacgatggagcaacgatagaacttcttggaagctggtctgaaggtatgttcggaatgggatttctttacgccaacagatcttccgtatctctgggttgtggggttctccttgaagatctcagaaaaaagaagatcaagccgtatcaacttcttgagaatttgaaaaatcaccctgtcatttccgatatgctgggagaatacagaaacaacacgatggagtatctggcacatttgatacctgaaggtggatactacgcgatgccgaaggtctatggagacagggttctggtctgtggagatgcggcaatgcttgtgaactctatacatagagaaggatcgaatcacgcgatcacatcgggaagactcgctgctgaaacacttctcgaagcttttgaaaagggagatttttctgaaaaaattctgaaaaattactacctcagattgaaagaatccttcatattgaaagacctggaaaagtacaaagatctcatgcccactatggaaaagaaccaccagttcgtggaaatctatccggatcttgcaaacgatgctttgaagagatttctacaggttgacggaactccaaagtgggacgttcaaaaacagatcgcggacatggtactttccaggagaagtttgattggaatctcccttgatctgctcagattctggagagctgtgaggtga

SEQ ID NO: 26730 - DNA, 900 bp, Thermotoga maritima
atgacgaaaaacaagctgaaccaaaactcctatgaactggaaaaagtcaaagaacgcatcgaacagattctttcccaattctttccagaacagataatgaaggatcttccgctctacggaaagatgttgagagtgagactttcgatactttctttcaaaaatagaggagtagagatcggtgaagatgcgatatcttctcttgcagctctcgaactcgttcaccttgcctcactcctccacgacgatgtgatcgatggtgctcgttttagaaggggaaaagagacgataaatttcatgtacggtgataaagcagcggtggcagcgggggatcttgtacttgtcagtgcgttccatacggttgaagagataggaaataacaaactgagaagagcttttttgaatgtgatcgggaaaatgtcggaagcggagctgatcgaacagctgagtcgatacaaaccgattacaaaagaagaatatcttcgcatagttgagggaaagagcggtgcgcttttcggtctggcgttgcagcttcccgcattactcgagggggaactcggagaagatctttacaatctgggggtcaccattggaaccatttatcagatgtttgatgacatcatggattttgctggaatggaaaagattggaaaagacggatttctcgatctcaaaaacggcgtcgcttcttttccattggtgacggcgatggagaagtttccagaagccagacagatgtttgaaaaccgtgattggagtggattgatgtcatttatgagagaaaaagggattctgaaagaatgtgaagagactctgaaggttcttgtgaagaatgtgataatagagaattcatggttgagagattttgtggatgggatttttaaaatcaaaatctcttcatga

SEQ ID NO: 26731 - DNA, 273 bp, Thermotoga maritima
atgaaggctctgaaaataagagttgaggggatcgttcaaggagtgggctttcgatatttcacaagaagagttgcgaaatctcttggtgtgaagggttacgtgatgaacatggatgatgggtctgttttcatacacgccgaaggtgatgaaaatgcccttcggcgttttttgaatgaggtagcgaaaggcccacctgcggcggttgtgacgaacgtgagtgtggaagaaactacgcctgaaggatacgaggacttcacgatcaagtattattaa

SEQ ID NO: 26732 - DNA, 1269 bp, Thermotoga maritima
atgagaatagacgaaatagttgaaaaatacgtggacagaaaaactcagagaaggtttctcatcctcacttctatcgcctggatgttcgatgctgccggtgttatgcttctttcttttgtgcttccttacgtgataaaggaatggaatctcacctctactcagggagctaccatagcaagtgctaccttccttggaatgctttttggagcgctttctgtggggttcgtggctgaccttcttggaaggaaagtttccaatctgttctttttcatcgtaacgatcaccttcacttttctgtccggcttttcctcatcgttcgaaactcttttagttctgagaggcctttcgggttttgggtatggaggcttgatgccttcgttcaacgcgtatcttgcagaattcacgagtatcagactcaggggaaggtatcttgtgcttctggagtcgagctgggcggttgggagtatactgataggactcttcgcagtgaatgttctcccgaactggagatgggtcttctggatcttctccatcgggtacctttttgttccggtgtttcttaggatgcccgaaaccccaaagtacgcgtttttgaagggtggaaaagaagcgctggagaggtctctgggtaaaagagtggaggaagaggtggagcttccaaaaaaagagaaagttcccatcctggctcttttgaagagggaacatttgaaagacacagttgtgatctggatagcgtggttcgttgtgagcttcgtgtattacgctctgttcacctgggctcccaggatcttctcctcgctgggtgtgagtgttgtcaaatcttcctggttcacattctacatgatggtggcacagcttcccgggtacctttcggcagcctacttcatagaaaaatggggaagaaaggcttctcttggtgtttacttcataggaacaggacttgccgctctgctgtgggccaacgtgagaggagatgcttcgcttcttgcagctgctttggtcctttctttcttctgtcttggagtgtggggactggtctacgcttacacaccggagctgtatcccacgtcgctcagggggactggaaacggagcagcgggagtatgggcaaggatagcgggtataatagctccttactacacaggcttcatgatggagaaaggaaaaagcatcgcggaaaccctcgcatggatctccgcgatggcaatgtttgccggtgtgatcgttctgatatttggaagagaaacaaaggggaaatacgtggattaa

SEQ ID NO: 26733 - DNA, 1407 bp, Thermotoga maritima
atggcaaagggttcgaaaggattcattgtgagtattatgggacctgttgtggacgtgaaatttcccgaagaggaactcccggatatatacaacgccctcgaagttgtaaatccccaaacggggcagaaggtagtgctcgaggtggagcagctcatcggcgatggagttgttagaacggtggctatggattcaacagacggtttaaccaaaggtctggaagtggtagatacaggagctcccataacagcacctgtggggaaagaagtccttggaaggatcctgaacgtgataggtgaacctgtcgacgaagcaggagaaataaaagccaaagaaagatggcccattcacagaccagcccctgagcttgtggaacaatccacagagatagaaatcctcgagaccggtataaaggtgatcgatcttctcgctccgttcccaaagggcggaaagatcggtttcttcggaggagcgggcgttggaaagaccgtgctcgttatggaactcatcagaaacatcgcaatagaacacaagggattttcagtgttcgcaggtgtcggggagagaacaagagaaggtaacgaactctggctcgaaatgcaggaaagcggagttcttggaaacaccgttctcgtttttggccagatgaacgagcccccgggagcaaggttcagagtggctcttaccgccctcaccatcgctgagtacttcagagacgtagaaggaagagacgttcttctcttcatagacaacatattcaggtttgtccaagctggaagtgaagtctcggcacttctcggaagaatgccgtctgctgtgggatatcagcccaccctcgcaaccgatatgggagaacttcaggagagaatcacttcgacgaggagaggttccatcacatccgttcaggccatatacgttcctgcggacgacataaccgacccggcaccggcaaccaccttcgcccatcttgatgccactgtggttctgtcacgaagaatagcagaacttggactttacccggcggttgatcctctcgactcctcctcgaaaattctggatccagcgatcgttggaagagagcattacgaagtggcaagaggtgttcaggaagttcttcagagatacaaggaccttcaggatattatcgccatactcggtgtggaggaactctctccggaagacaaacttgtggttcaccgtgccagaagaattcaaaggttcctcagccagccgttccacgtagcagaaaggttcacaggtcgtcctggaagatacgtacccattgaagaaacaattagaggattcaaggagattctcgacggaaaactcgacgatgtacctgaacaggcgtttctcatggccggaaacatcgacgaagttaaagaaagagcaaaagaaatgaggagttga

SEQ ID NO: 26734 - DNA, 822 bp, Thermotoga maritima
atgctacagataaagagaaagataaacgcaacacaatcactgatgaagatcacgcgcgctatggagatggtagcgcgcgcaaaggtgagaaaaatagagtcggagtatcaaaaattcaagcccttctacgacgaagtgaaaagattgtgggcgctggttccagcggaatctctcgatccgatcttttttgaagaagggaacagagacctgatcgtggtgataacaagcgatatgggactgtgtggttccttcaacagtgaaatcttgagagaggcagaaagagtgatctccgaatccagggatccacacctcatactcgtaggtctcaaagccataaaccatttcaaggacggaaaagtgttgaaaatgtacgacagattctacgaaatacccgactttagaaacggctctacgatcgtggaagatattctcaattttctcgatgggaaacccgcgagagtcagagtgattttcagccgattcaaaaacgttcttatacagaggccagaagtgcacgaacttcttcccatcaaaaaggaagaaaaaaagagagaagacttcgaatacgaaccacgcctagagcaaattgctccgctgatctttcattactatctctcggccacactcatggaactcatgtttcagacgaagataggagaatactacgcaagacagaacgccatgaagaacgccacagacaacgcccaggaagtgatcagggagctgacactggcgtacaacaaagcgcgtcaggcttcgatcacccaggaactcatagagatcgttacgggagcagaagctctgaaggaaatagaaaaatga

SEQ ID NO: 26735 - DNA, 1512 bp, Thermotoga maritima
ttgaggataaatcctggagaaatcacgaaggttctcgaagagaagataaaaagtttcgaggagaagatcgatctcgaagacactggtaaggtcatccaggttggagacggtatagcccgtgcgtacgggttgaataaagtgatggtgagtgagctcgtggaattcgtcgaaactggagtcaaaggagtcgccttcaatctggaagaggacaacgttggtatcatcatactcggtgaatacaaagatataaaagagggtcacaccgtcagaagattgaaaaggatcatagaagtaccggttggagaagagctcctcggtagggtggtcaatccgctcggagaaccgctcgatggaaagggcccaataaacgcaaagaacttcagaccgatagaaataaaagcccccggtgtcatctacaggaaacccgtcgatacacctctccagacaggaataaaggcgatcgactccatgattcccatcgggagaggccaaagagagctgatcataggagataggcagacgggaaaaacggccatcgctatagacaccatcatcaaccagaaaggacagggtgtgtactgcatttacgtggcgataggtcagaaaaagtccgctattgcaaggatcatcgataaactcagacagtacggagccatggagtacacaacggtggttgtggcctccgcttccgacccggcatctctccagtacatagcaccgtacgcgggctgtgccatgggagagtacttcgcatattccggaagggatgccctcgtggtctatgacgatctttcgaagcacgccgtcgcctacagacagctctcacttctcatgagaaggcccccgggaagagaggcttatcctggggacatcttctatctacactccagactccttgagagggccgtcagactgaacgacaaactcggtggaggatccctcacggctctacccatcgttgaaactcaggcgaacgatatatccgcctacattccaacgaacgtgatatccatcactgacggtcagatatacctcgagcccggattgttctacgccggtcagagacctgctatcaacgttggtctgtccgtttccagggttggaggatctgcgcagataaaagcaatgaagcaggtcgccggtatgttgagaattgatcttgcacagtacagagaactcgaaacgttcgctcagtttgccacagaactggatccagctaccagagcccagatcataagaggacagaggctcatggaacttctgaaacaggaacagtacagtcctatgcccgttgaagagcaggtcgtcgttctcttcgcaggtgtcaggggatacctcgatgatctcccggtggaagaagtcagaagattcgagaaggaatttctcagatttatgcacgaaaagcaccaggatatcctcgacgacataaagacgaagaaagaactgacttcggaaacggaggaaaaactcaagaaagccattgaagaattcaaaaccactttcagggtgtga

SEQ ID NO: 26736 - DNA, 948 bp, Thermotoga maritima
atgtctttctcaaacgaaatgaaagttttttctgggaacgccaacagacctctggctgagaagatagcgaattacctcaaccttcaactcggtgactgtgaggtcggaagattcgccgacggagagataaacgtccgcataaacgaaacagtgaggggacacgatatctttctcattcagcccacctcgcctccggtgaacgagaacctcatggaacttctcataatgatcgacgcgttcaagcgggcatcagccaacaccatcgccgtcgtgattccctactacggatacgcgagacaggataggaaggcaaagggaagggatcctatcagtgccaagctggttgcaaacctcatcaccgtggctggagcaacccgcgttctgacggtggatctccacgcggaacagatacaggggttcttcgacattcccgttgacaatctctggagctaccccgtcttcgcagaggaactcctcaaaagagaaaacatcgtccctgaggaaacagtggttgtgtcaccagatgttggtggtgtgagaagggcaaggagaatggccgaaagactcgggacatcgcttgcaattctcgataaaagaagaccaagtgacaacgtcgcggaagtggtcaacataataggagaagtcgaagataaagtggttattatgttcgatgatataatagatactgctcactctatagtgaagggtgcagaagcactgaaaaacgcgggtgcaaagaggatcatagcctgtgcaacgcacggtgtcttttccgatagagctctggaaagaatagaaaattcctcgatagacaccgtatacataaccgacacgatatatcacgagaatcttccagaaaaggttaaggtgatctcggtagcgaatctcataggagaagccatcatgcgaataagaaaacatctgtctgtgagcacgctcttcagatga

SEQ ID NO: 26737 - DNA, 2364 bp, Thermotoga maritima
ttgtcgaaaaaatcgaaagataccgaaaagagcttcaaaatacttgagaaatacgccagtcagcaggaaaaagagctggagatacctgacagcttgccgtgtattcctttgagaaacggaatgggagtctttccaaacaccgttgttcctttttacgtgggaaggaccggctctctcatagcgctcgaagaagccatggaaaagtacaacagacttcttctggtggtcaatcagaaagatccatccgttgagataccagaaccggaagatctctacaaagtaggaacggtcgtgaaggtgcttcagataatgaagcttccagatgacacgttcaaggtgctcgtggaagggctggagagagctcaaatagaggaattcgtctcgactgatcctttcttcctcacgaagataaaaatactgaaggtgaaatacagaaaaacgaagaaactcgaagcacttatgagaagcgtcaaagacaaggcagtcagatatttcaatctgacccacaggttccctcaggagacgctcgttacccttaaagaaatgcaggatccggacaaactggcagacttcgttgcttcgattcttcctgttcctctggagacgaagcaggaactcctcgagacggttcatccgcttgaacgtctcgagaagatactctcaatactggtgaaggaaatcgagattctcgagatagaagaggaaattgagaaaaaagtgaaagacagaatagagaagacccagagagaatacgtgctccgcgaaaagctcagagctataaaagaagaactcggagtggaagaggagctggagatcaaggaactctacgagaaggtagaaaaaggtgattacccggactacgtgaaggaaaaggcctacaaagagattcagaggctcgagaagatgtcgccctacagcgccgaggcgacggttgtcaggacctatctcgactggcttctgaaccttccctggaacgttgctaccgaggatagactcgacataaaagaggcgaggaagatcctggataagaaccattacgggctcggagaagtcaaggagagaatactggagtatctcgtggccaggaagttttcaaagaatctcaaggctcccattctctgtcttgtggggcctccaggagtggggaagacgtcgctaggcagaaccatagcggaagcgatgggaaggaagtttggaagaatgtcccttggaggtctcagagacgaggcggaaataaagggacacagacgcacttatgtgggtgcgcttccgggaagaatcatacagatcataagaaggctgggaacgaagaatcctgttattctgctcgacgaagtggacaagatggggatcagttttcagggtgatccggcgtctgctttgctcgaagttctcgatcccgaacagaacaaggatttcgtcgatcactatctcgaagtacccttcgatctctctcaggtgctgttcattacaactgcgaacgtgctccacaccattcctcccgcactgagagacagaatggagatcatagagatacccgggtactcggatccagagaagtaccacatagccagggactacataataccgaagattgcacggtcttatggtctgtcaaaggtgatgtttactcctggagcgatcaaaaagatcatcagggagtacacaaaagaagcgggtgtgagaaatctcgagagagtcatagaaaaggtgataagaaaaagtcttgtgaagggcgagaagaagtctttcaaaataaccactaaagatgtcgaagaactgctcgggcctcctgttttcagggaggaggagattttggaagaagacacagtgggagcggtcacaggtcttgcctggactccagttggtggaagtgttctcatcgtagagagtctgctgcttccaggaagaggcaacctcattttaacaggaaacatgggtgacgtgatgaaagaatctgccagaatagccctcagtgtggtcaggaagatgtgtggagaagaatgcagagaggtcttcgagaagaacgacatccacatccacgttccagaaggagccgttccaaaggatggcccctccgccggcataacgatcacagtggccctgtactctgccgtcaccggtaaaaaagtcagaagggatgtagccatgacgggtgagatcacgttgaggggtaaaatactcccggtgggagggataaaagagaaattgctcgcggcaaagagagccggcataaaaaaagtaatccttccttcgagaaacagaccagacgtggaaaagataccgaaggaatatctgaacgggatggagatcgtttactgtagtgaaatacaggaagttctcaaggaggccattgtgaggtga

SEQ ID NO: 26738 - DNA, 1584 bp, Thermotoga maritima
atgaaacgggattttctcggcagaaccctcgcagtcatagaagatctgagcgtggaggagcagatgttcctctatgaaaaaaccagggagctcaaacagagatggtacagcggagaggatgtatcggatttcaggataaagaagagaaacgttggaatatacatcgttttcgttgaaccaagcacgaggacgaaagaatccttcataaacgccgcgaagtttcactcgggcccgaacgtgaaggtgaacgttttcgattcggaacattcctctttcaacaaacaggagagctacacggacaccttctccatgctcacaggctacagcgactactccatattcgttgtgagaacaagactcgagggagtctgcagactcctggaaagaagaatatcagagttcgcaagcaggaacggtatagaagtaccctcttttataaacgcgggtgacggaaagcacgagcatccaacacaggaacttctggatgaatacacctttctcgagcagaacggttttgacaactcgttcatacatgtggcactcgttggtgacctgcttcacggccgaacggttcattctaaagtgaacggcttgaagatattcaaaaatgtgaaggtggatcttgtggcaccggaagaactcatgatgcctgagcattacgtagagaagatgaaaaagaacggttttgaggtcaggattttctcttcgatcagagagtatctcgaccagaaagatgtggcaaagatctggtactttacacggcttcaactcgaaagaatgggagaagacattctcgagaaggttcatgttctgagagaagcagtcactttcaaaaaagagtatctggacgcactgccggaaggagtgaagttctatcatccgcttccaaggcacaaggtttatccgacgataccgaactttctggacacacttcctctgaacggatgggaaacacaggctaggaacggttactgggtgaggatcgtgcttctttccatgtttggtggagcgctggaagcacctttcgatacctcgaagaaagaagaaaaaccagaagaagacttcataatccccgctcccatcacacacggatcaaagggggttcaaaaggaaggaaagagaggcataaaacccatcgaaaacggaacggtgatagaccacatagccaagggaaagacaccggaggaaatctactcaacaattttgaaaataaggaaaattctgagactctacgatgtggacagtgcggatggtattttccggtcgagcgatggaagcttcaagggttacatcagcctgccggatcgttatctctccaagaaagaaataaagaaactctcggcgatttctccgaacaccacggtcaacatcataaaaaacagcacggttgttgaaaagtacagaataaagcttccaccaacgatctatggattcgaagagctccgatgcaaaaacgagaactgtatcaccaatcccgcacacggtgaaaatgcttcaccttcctttgtgagaaacgaaaaaggacagttcatatgcgagtactgtgaaacaccgcattctttcgaagagatctggagtatttga

SEQ ID NO: 26739 - DNA, 1188 bp, Thermotoga maritima
atgagaagacttttcaccagcgagagcgtaacagaagggcatccggacaaaatcgccgaccagatttccgacgccatactcgacgccatgctcgagcaggatccaaggagcagggttgccgttgaaacactcgtaacaacagggcttgtcatcatcgcgggagaggttaccaccagagcttatgttgagatccccgatatagcgagaaagaccattctggagataggatacacgagggcgaagtacggattcgatggggaaacctgcggagtgctcaccagcatccacagtcagtctcctgacatagctctcggtgtagacaaggcgctcgaggtcaaaacaggagaggaagtggctgacgagttcgaggcgctcggagctggcgaccagggaatcatgttcggctacgccaccaacgaaacccctgagtacatgccccttcccataactctcgcccacaaactcgccatgagactcgctgaggtcagaaagaacgggactcttcctttcctcaggccagatggaaagacacaggtgaccatagaatacgaggacgacaaaccagtccgtgtcgacacagtgcttatttcaactcagcacgatccggatatctcccaggcagatctgagagaggcgataatagaacacgtcataaatcctgtgattccagaacagtacagggacgacaaaatgaagatactggtgaatccaacgggaagatttgttcttggaggtcccatggccgacacggggctcacagggagaaagatcatcgttgacacttacggtggttgggtaccccacggcggaggggcgttcagcggaaaagatcccacaaaggttgacagatcggctcactatatggcaagatatgtagcgaagaacgttgtggctgcaggtcttgcggacaagttcctcatacagctttcttacgctataggtgtcgcgaaacccgtttccataatgatcgacacgtatggaaccgcgaaggtggatgaagacaaacttctcaaggtgatcactgaactgttcgatttcagaccgggtgcgatcataaagaaactgaatcttttgagacctatttacaggaaaacagccgcctacggtcactttggaaggaacgaagaggaattcacatgggagaaactcgacatggtagatgagttgaaaagagctttcaatatgtaa

SEQ ID NO: 26740 - DNA, 2382 bp, Thermotoga maritima
gtgaaggtaactcccctcatggaacagtacctgagaataaaagaacagtacaaagattccattctgctgtttcgactgggagatttttacgaggcgtttttcgaagacgcaaagatcgtttcgaaggttctgaacatagttctcacaagaaggcaggacgctcccatggcgggcatcccgtaccacgcgctgaacacctacctgaaaaagctcgtcgaagcgggctacaaggtggcaatctgcgatcaaatggaagaaccttcgaagtcgaagaaattgatcagaagggaagtcacgcgcgttgtcactcccggctccatcgtagaggatgagtttctcagcgaaacgaacaactacatggccgttgtctcagaagagaaaggacggtactgtacggttttctgtgatgtctcgacaggtgaggtcctggttcatgaaagttcagacgaacaggaaactttggacctgctgaagaattactccatttcccagatcatctgtccagagcacctgaaatcttctttgaaggaacgctttccaggtgtttacacagaaaccataagcgagtggtatttctcagatctggaagaagtggaaaaagcctacaatctgaaagacattcatcatttcgagctttcgccccttgcgctgaaagcccttgcggcgctgataaagtatgtcaagtacacgatgatcgcggaagatctgaatctgaaaccccctcttctcatctcccagagagactacatgatactcgattccgcaacggtggaaaatctttctttgattcccggtgacaggggaaagaatcttttcgatgtgctgaacaacacggaaactcctatgggggctcgtcttttgaaaaagtggattctccaccctctggtcgacagaaaacagatcgaagaaaggctcaaggctgtggaaagactggtgaacgacagggtgagcctggaggagatgaggaaccttctttcgaacgtgagggatgtggagcggatcgtttcgcgggtggagtacaacagatccgttcccagggacttagtggcactcagagagacactggagatcatcccgaaactgaacgaagttctttcaaccttcggtgtgttcaagaaactcgctttcccggaaggactggttgatctgcttcgaaaagccattgaagatgatccggtgggaagccccggcgagggaaaagttataaagagaggattctcatctgaactcgacgaatacagggatcttctggaacatgccgaagagaggctcaaagagttcgaggagaaggagagagaaagaacaggcatccaaaaactgcgggttggatacaaccaggtttttggttactacatagaggtgacgaaggcgaatctggataagattcccgacgattacgaaagaaaacaaacactcgtcaattctgaaagattcatcacacccgaattgaaggagttcgagacaaagataatggccgctaaagagagaatagaagaactggaaaaggaactcttcaaaagcgtgtgcgaagaggtgaaaaagcacaaagaagttctccttgagatctcggaggatctggcaaagatagatgcgctttcgacgttagcatacgacgctattatgtacaactacacaaaacccgtcttttcagaagacagactggagatcaaaggtggaagacacccggtcgttgaaaggttcacacagaattttgttgaaaacgatatttacatggacaacgagaagagatttgtggtaataacgggtcccaacatgagcgggaagtccactttcatcagacaggtgggtctcatatccctcatggcgcagataggatcgtttgtgccggcgcagaaggcgattcttccagtgttcgacaggattttcacgcgaatgggtgccagagacgatctcgctggtggtagaagtacgttccttgtcgagatgaacgagatggcgctcatccttctgaaatcaacaaataagagtctggttctcctggacgaggtgggaagaggtacaagcacccaggacggcgtcagcatagcctgggcaatctcagaggaactcataaagagaggatgtaaggtgctgtttgccactcatttcacggaactcacggaactcgaaaaacactttccgcaggttcagaacaaaaccattctggtaaaagaagaaggcaaaaacgtgatattcacccacaaggtggtggacggtgtggcagacagaagttacggaatagaggtcgcaaagatagcgggtattcctgacagggttataaacagagcctatgaaattctggagaggaatttcaaaaacaacacgaagaaaaacggaaaatcgaacagattcagtcagcaaattcctctctttcctgtttga

SEQ ID NO: 26741 - DNA, 741 bp, Thermotoga maritima
atgaggcttgaagggaaagtgtgtctgatcacaggggctgcaagcgggatagggaaagccaccacgcttcttttcgcacaggaaggagctacggtgatcgctggcgatatctcgaaagaaaatctcgactctcttgtgaaagaggcagaaggacttccggggaaggttgatccctacgttttgaacgtgaccgacagggatcagataaaggaagttgtggaaaaagtcgttcaaaagtacggtcgaatcgatgttctggtgaacaacgcgggaataacaagggatgcgcttcttgtgaggatgaaagaagaagactgggatgcggtaataaacgtgaatctgaagggtgttttcaacgtgactcagatggtggtgccctacatgatcaaacagaggaacggttcgatcgtgaacgtctcctctgtcgttggaatatacgggaatcctggtcagacgaattacgcggcgtcgaaggcgggagtcataggaatgaccaagacgtgggcgaaggaactcgctggaagaaacatcagggtgaacgctgtggcacccggattcatagaaacccccatgaccgaaaaacttccagaaaaagcccgtgaaacggccctttccagaataccgctgggaaggtttgggaagccagaagaggtggcgcaggttatactcttcctcgcatcggacgagtcgagttacgtcaccggacaggtgataggaatagatgggggcctcgtgatctga

SEQ ID NO: 26742 - DNA, 825 bp, Thermotoga maritima
atgttatacaaagaacttggaagaacaggagaagaaattccggctctgggtctgggcacctggggtatcggcggttttgaaacacccgattactccagagacgaagagatggttgagcttttgaagacggcgatcaaaatgggatacacacacatagacacggcagagtactacggtggagggcacacagaggaactcatcggcaaggcgataaaggatttcaggcgtgaggatcttttcatagtgtccaaggtgtggccgacgcatctgagaagggacgatcttttgcgctccctcgagaacaccctcaaacgactcgacacggactacgtggatctttacctgattcactggccgaatccagagattcccctcgaagagaccctttccgcaatggcagagggcgtcaggcaggggctcatcaggtacataggagtttcgaatttcgacagaagactcctcgaggaggccatcagcaagtctcaagaacccatagtctgcgatcaggtcaagtacaacatagaagacagagatccagaaagagatggacttctcgagttctgccaaaagaacggagtgaccctggtggcctactctccactgagaagaactcttctttcagaaaaaacgaagagaacactcgaagaaatagcgaagaatcatggagcaactatctatcagattatgctcgcgtggcttctcgcaaaaccaaatgttgttgccattccaaaggccggcagagtagaacatctcagggagaatctaaaagcaacggagatcaaactctccgaagaggaaatgaagctactggacagccttggctaa

SEQ ID NO: 26743 - DNA, 1908 bp, Thermotoga maritima
atggaaaggtttccctatgaaaaacttccagaaagcgaactcaaagagttgaaagaactcggaaggctctgccgtggcgacatactgaaaatgacctacatagctaactcaggccatcctggaggatccatgtcttcgatcgatctttatcttaccgtcttcaagtacgcaaaactcagacccgtcgatgatcctgcaagagacagaatcgtgatcagccatggacacacttctccgggtgtctacgcagctatggctcgtttggggtttgtcgatctcgatgaagtcctcgcaggattcagacaccccgcttccgtttttgaaggacacgtgacccgaggtgttgggatcatcgactggacaaccggaaacctcggtcagggtctttcagccggactcggttttgccctcgcatccaggttcacaggaaaagattaccacgtctttgttctcatgagtgacgcagaacaggcaaaaggacaggtggcggaggcaagaagagtggcgaaaaagtacggtgtcacgaatctcacagtgatcatcgactacaacgacgcccagatcagtggccgtgccagagacgtcatgcccgtgaacataaaggaaaactacttagcggacggctggagggtcatcgagatcgatgggcacgactacgaacagatctatctcgcactgaaagaagcggtagaagacgaactgaatcccgttgccataatcgccaaaacggtcatgggaaaaggcgtatctttcatggaaaacgaggtgaaataccacggaaagcctttgaacagagaagaactcgaaaaagccctcgcggaactcggaattgaaaacgatgttgatgtgtacatcgaaaaaagaaaacaacttccagtggaaaaacacaagaaagtctacaaaacttacccgatcaagatcgacacgggagagcccatcacctacacctcacccactgacaacagaagcgcattcggaaaagctattctggatctggtgaagaagaacgtaaacaatccagaaaccacacccatcgtcgctgtggactgcgacctgaagggatcggtcaaactcgacctgctcgacaaagagttccctgagagactcctggaagtgggcgttcaggaacacaacgctgccgctatggcgggggcactctccgcagagggtgtgatcacgttcttcgctgattttggtgtttttggaatttctgaaacctacaaccagcacaggctgaacgccatcaatggaacgaacctcaaagtcgttgtcacacactgcggactcaacgtgggagaggacggaaaaactcatcacggactcgactacgtttccgggccgatgaactggtacggtttcaaagtgatcgtccctggtgatcccaaccagacggatagagttgtcagatacgccgcgaaggaatacgggaacttcgtaatcgccatgggaagatctaagcttcccatcatcctcgatgaaaacgggaaacctttcttcggagagggttacaccttcgaatatgggaagatcgatgtcgttagaaaaggtgacgacgcggtgatcataacttacggttctacactctgtgaagccgtaaatgccgcagacgaactcaagaaagaaggagtaaacgtagccgttctgaatgtctcctgtccggtggatctcgatatagagaccttgaagatggtcgatggaaaacccgttctcgttgtggaggatcacaacgttttcacaggacttggaagcttccttggaaccacccttcttgaaaacggcatcatcccgaagaaatacgtgagagtaggtgttccagaattcgccgtgtccggcagttacacgatgctctacaaactctacggcctggataaagatggaataatttccagactcagagagatgctctaa

SEQ ID NO: 26744 - DNA, 816 bp, Thermotoga maritima
gtgtggatcgactgtaagacaatagctcgaagtatcgaggaaagaacgaaagagagagtagaaaagctcggtttcactcctaaactggtcagcgttgcgtgtacagatgatccatcggccctttcttatctgaaatctcagagaaaaaaagctgagaaactcggaatagcctttgaaataatgaacgtttctccagaggagatagtttccacgctgaagaaactcggatcggatgaaagtgtaaacggagttttcgttgcaaggccttttcctctggggctcgacgagaaagaaatcctttcctcagttcccgttgaaaaagacgtcgaaggtgtgaatcctgcgaacctcggacttcttctttacgacgaagagatctttcctccatgcacggctgaagccgctgtgagaatactcgaaagagagacaaacctctctggaaaaagagtcaccgttgttggaagaagtgtcaccgtgggaaagccgctcgctctgatgctcttgaagaaaggaagggacgcgaccgtcacggtttgtcactccagaacggtgaacctcgaagagataacaaaaaacagcgacatcgtggtggtagccgtcggtagagcacactttttgaagaagaacatggtaaaagaaggagcgatcgtgatagacgtggggataaattacgtagacggaaaactccagggagatgtcgatccatcggttgaagaaatcgccagagtgactcccgttccagggggtgtgggacaggtaacgaccgcactcctgttcgaacacgttgttagagcggcggagagacaaaggaaatga

SEQ ID NO: 26745 - DNA, 1827 bp, Thermotoga maritima
atgcttctggacgagatcaagagaatgagctacgatgagctgaaaagactggcagaagacatccgaaaaaggatcacagaagttgtcttgaagaacggggggcacctcgcatcgaatctcggaacaatagaattgacacttgccctctacagggtcttcgacccgagggaagatgctattatctgggacactggccaccaggcttacacacacaaaattctcaccggtcgtgacgatctgtttcacacgataagaaccttcggcggtctcagcggttttgtgacgagaagagagtctccactcgactggttcgggacgggccacgccggaacttccatagccgcgggccttggtttcgaaaaagcattcgagctgctcggagagaaaaggcacgttgtggtcgtcatcggtgatggtgcactcacctccggaatggcactcgaagcactgaaccagctgaagaatctcaactcaaagatgaagatcatactgaacgacaacggcatgtccatctcaccaaacgtaggagggctcgcctatcacctctcaaaattgagaaccagtccaatctacctgaaaggaaaaaaagtcctgaagaaagtcctcgaaaaaacagagatcggattcgaagtcgaggaagagatgaagtatctgagagacagtctcaaaggaatgatacagggaaccaacttttttgaatccctcggtttgaaatacttcggtcctttcgacggtcacaacatagagctactggagaaagttttcaagcggatcagagactacgattattcatcggtcgtccacgtggtaaccaaaaaaggaaaagggttcaccgccgcggaagaaaatcccacgaagtaccacagcgcttcaccatctggaaaaccgaaaatgctctcctacagtgagctgctgggacacaccctctcaagagtagcgagagaagacaaaaaaatcgtcgccataacggctgcgatggccgacggaacaggactttccatattccagaaagaacatcccgatcgcttcttcgatctcgggataacggaacagacctgcgtaacctttggagccgctctcggtcttcacggaatgaagcctgtggtcgccatatactctaccttcttacagagagcgtacgatcagatcattcacgatgtggctttgcagaacgctcccgttctctttgcgatcgacagatccggtgtggtgggagaagacggtcccacccatcacggcctgttcgacataaattatctgcttcctgtcccgaacatgaagatcatctctccgtcttctcctgaggagttcgtgaattcactgtacaccgttctaaagcacctcgatggccctgttgccattcgataccccaaagagtccttctacggtgaagtcgaatccctcctggagaacatgaaagagatcgaccttggctggaagatattgaagagaggaagggaagccgcgataatagcgaccggtaccattttgaacgaagttttgaagataccgctggatgtaactgtggttaatgctctcacggtgaaaccgctggacacagctgttctgaaagaaatcgccagggatcacgatctcattatcaccgttgaagaggccatgaaaatcggtggttttggatctttcgttgctcagagacttcaagaaatgggatggcagggaaagatcgttaatttaggtgtcgaagatcttttcgttcctcatgggggtagaaaagaacttcttagcatgctggggctggattcggaggggctcaccaaaactgtgctaacatatattaaggccagaagtagggaggggaaagtatga

SEQ ID NO: 26746 - DNA, 1230 bp, Thermotoga maritima
atgaaagagaaagtcgttcttgcatacagtggtggtctcgatacttccgtcattttgaagtggctctgcgaaaagggcttcgacgtgatagcttacgttgcaaacgttggacagaaggacgatttcgttgcaataaaagaaaaggccttgaaaacaggcgcttcaaaagtctacgtggaagacctcagaagggaattcgtcacagattacatattcaccgcactccttggaaacgccatgtacgaaggaaggtaccttcttggaaccgctatcgcaagacctctcatagccaaaagacaggtggagatagccgagaaagaaggagcacagtacgttgcgcacggtgcgaccgggaaaggaaacgaccaggtgaggttcgagctcacctacgccgctttgaatccaaatctcaaagttatctcaccctggaaagaccctgaatttctcgccaaattcaagggcagaacagatctcataaactacgccatggagaaagggattccaatcaaagtctccaaaaaaagaccctacagcgaagacgaaaacctcatgcacatttcccacgaagcgggcaaactggaggatcccgcacacatacctgacgaagacgtgttcacatggacagtctccccaaaggacgctccggatgaagaaaccttgctcgagatccatttcgaaaacggcattccggtgaaagttgtgaacctcaaagatggaacagaaaagacagatcccctcgaactcttcgaatatctgaacgaagtaggtgcgaaaaatggagtgggaagactcgacatggtcgaaaacagattcataggtataaaatcaagaggggtgtacgaaactccgggcgcgacgatcctgtggatcgcacacagagatctcgaaggaatcaccatggacaaagaagtcatgcacctgagagacatgctcgctccgaagttcgcggagctcatatacaacggtttctggttttctccagaaatggagttcctcctcgcagcgttcagaaaagcacaggagaacgtgaccggaaaggtgacggtatccatatacaaaggaaacgtcatgcccgttgcgaggtattcaccgtattcactgtacaatccggaactttcgagcatggacgtcgaaggaggattcgatgccactgactcgaagggcttcatcaacattcacgccctgaggttgaaggtccaccagctcgtgaaaaaggggtatcagagatga

SEQ ID NO: 26747 - DNA, 1020 bp, Thermotoga maritima
ttgatcagagctggaataataggtgcgacaggttacacaggactggagctcgtcagacttttgaaaaaccaccccgaagcgaagataacctatctgtcctcgaggacctacgccggaaagaaacttgaagaaatcttcccttcgacactggagaacagtattctcagcgagttcgatccagagaaggtctcaaaaaactgcgatgttcttttcacggcgcttccagccggtgcgagttacgatctcgtcagggagctcaaaggtgtgaagataatagatcttggcgcggattttcgtttcgacgacccgggagtgtacagagagtggtacggaaaagagttgtcgggatacgagaacataaaaagagtttacggacttccagaactccatcgtgaggagataaagaatgctcaggtggtgggaaatcccggatgttatccaacgagcgtcatcctcgctctcgctcccgcactgaaacacaatcttgtggatccggaaacgatactggtcgacgcgaaatctggagtttccggggcgggaagaaaagagaaggtagattatctcttctccgaggtgaacgaaagtctcagaccgtacaacgtggcaaaacacagacacgttcctgaaatggagcaggaactcgggaagatctcggggaagaaagtgaacgtggtgttcacacctcatctcgttcctatgacgcgtggaatcctctcgacgatatacgtaaaaacagacaaatccctcgaagagatacacgaagcgtacctcgaattctacaagaatgaaccgttcgttcatgttcttcccatgggaatttatccttcgacgaagtggtgctatggatccaaccacgtcttcatcggtatgcagatggaagaaagaacaaacacgctcatactgatgagcgcaatagacaacctcgtgaagggggcgtcgggacaggcagttcagaacatgaacatcatgttcggtctggacgagacgaagggactcgaattcactccaatatatccgtga

SEQ ID NO: 26748 - DNA, 1194 bp, Thermotoga maritima
gtgttcactcccaggggtttcaagttcgcaggagtacactgcaagataaagagaaaaagaaaagacctaggaatcattttctctgaagttccgtgcgttgccgcgggagtcttcaccaccaacgttgtcaaagcagcaccggtgatttacgacatggagatcctgaaaaagaatccaaacggtatcaaagcggtcgttgtgaacagcggtgtggccaacgcatgtaccggtgaacagggaatgatcaacgcaaggaggatggcagaaaaaacggctgaagagctcggtgttcccgttgaaagtgtcctcgtttcctccacaggggtaataggggttcagcttcccatggataaggtggaaaacggcatagaagaagcggcgagggtgctttcaaacgatcctcttccgtttgccgaggcgatcatgacaaccgacacaaaggtgaagatgcacagcaccaaggtgatgatcgatggaaaagaaatcaccgttctgggaatcgccaagggatccggcatgatccaccccaacatggcaaccatgctctcgttcataacgacagacgcaaaaatttctgaagaagccctgaaaaaactcttaaagctctcagtcgatgattcctacaacatgatagacgtcgatggagacacgagcacgaacgacatggtgatcgttctcgcaaacggtcttgcgggcaacacaacgatccagcccgaaacggatggtttctggaaactctacgaagccgttcacgaggtgaatcaggttctcgcggagaagatagtggaagacggtgagggagcaacgaaagtcatggaagtccatgtaatcaacgcccccgatataaagtcagcgagactgatcgccagatcgatcgtttcctcaaaccttgtgaagacagccatatatggggaggacgcgaactggggaagggtcatcgccgcggcggggtactccggtgcaacctttgatcctgagaaactcgacctgttcttcgaaagcgaggcgggaaggataaaggtggcggaaaacgggcagggagtatctttcgacgaggaagaagcgaagaagattctcagcgaaaagaagataagaataatcctcgacatgaaacagggaaaagagaccgcaaaagcgtggggatgtgatctcacggagaagtacgttgagataaacgggaggtacagaacatga

SEQ ID NO: 26749 - DNA, 849 bp, Thermotoga maritima
atgaggatcgacacggtcaacgttctcctcgaagcccttccatacataaaggaattctatgggaaaaccttcgtcataaagttcggcggcagtgcgatgaagcaggagaacgcaaagaaagccttcatccaggatataattctcctgaagtacactggaataaaaccgatcatcgttcacggtggagggcctgccatctcccagatgatgaaggacctcggtatagaacctgttttcaagaacgggcacagggtgaccgacgagaaaaccatggagatcgttgagatggtcctcgttggaaagatcaacaaagaaatcgtgatgaacctgaacctgcacggtggacgggccgttggaatctgcggaaaagattcaaaactcatagtggcagaaaaggagacgaaacacggagacataggttacgttggaaaagtgaagaaggtcaatccagaaattcttcatgcactgatagaaaacgattatatcccggtgattgcccctgtgggaataggagaagacggtcactcctacaacataaacgccgataccgcagctgcagagatagcgaaaagcctgatggcagagaagctcatcctcctcacggacgtggacggtgttctgaaggatggcaaactcatctccactttgacaccggacgaggcagaggaactgatcagagacggcacagtgacggggggaatgattccgaaggttgaatgcgccgtgtctgcagtgagggggggagtgggagccgttcacatcataaacgggggattggaacacgcgatcctgctggagatattcagcaggaagggtatcggaaccatgataaaagaactggaggggtaa

SEQ ID NO: 26750 - DNA, 1158 bp, Thermotoga maritima
atgtatctgatgaacacttacagcaggtttccagcaacgtttgtctacggtaaaggctcctggatctacgacgaaaaaggaaacgcgtatctcgatttcacttcaggaatagcggtgaacgtcctcggacactctcatcctcgactggtggaggccataaaggatcaggcagagaagctcattcactgttcaaatcttttctggaaccgaccgcagatggaactggcagagcttctgtcgaagaacacgttcggtggcaaggttttcttcgcgaacacgggaaccgaagcgaacgaagccgccataaagatagcgagaaaatacggaaagaaaaagagcgaaaaaaaatacagaatcctctccgcccacaattctttccacggaagaactctgggctccctcacagcgacgggacagccgaaatatcagaaacctttcgaaccactcgttcccggttttgaatacttcgagttcaacaacgtagaagatctgagaagaaagatgtcagaagacgtgtgtgctgtgttcctcgaaccgattcagggagaaagcggaatagtaccagccaccaaagaattccttgaagaggctagaaaactatgcgacgagtacgatgcacttcttgtgttcgatgaggttcagtgtggaatgggaaggacaggaaaactcttcgcgtatcaaaagtacggagtcgttccggacgttctcacaaccgccaagggactcggtgggggagtccccattggagctgtcatcgtgaacgaaagagcaaatgttctggagccgggagatcacggcaccacgttcggaggaaacccgctcgcctgcagggccggggtgaccgtgatcaaagagttgacgaaggaaggcttcctcgaagaagtggaagagaagggaaactacctcatgaaaaagctccaggaaatgaaagaagaatacgacgtggtagccgacgtgaggggaatgggactcatgatagggattcagtttagagaggaagtgagcaacagagaggtcgccacgaaatgctttgaaaataaactgctcgtcgttccagcaggtaacaacacaatcagattcttaccaccgctcacggtagagtacggagagatcgatctggcagttgaaacgctcaaaaaagtcctgcaaggaatttaa

SEQ ID NO: 26751 - DNA, 1443 bp, Thermotoga maritima
atgccatctgtgaagatcggtatcatcggtgcggggagcgcggtgttttctctgaggcttgtgagtgatctttgcaaaacgccgggactctctggcagcacggtcaccctcatggatatcgacgaagaaagactcgacgctattctgaccatcgcgaaaaaatacgttgaagaagtgggagcggatctgaaattcgaaaaaaccatgaatttagatgacgtcatcatcgacgcggattttgtgataaacacagcgatggtgggtggccatacctacttggagaaggtcagacagatcggtgagaaatacggctactacagaggaatagacgctcaggagtttaacatggtctccgactactacaccttctccaactacaaccagctcaagtacttcgttgacatagcaaggaagatagagaagctctccccaaaagcctggtacttgcaggcagcgaaccccattttcgagggaacaacccttgtgacaagaacggttcccataaaggcagtgggattctgccatggacactacggcgtgatggagatcgtagagaaactggggctggaagaagaaaaagtagattggcaggtcgcaggagtgaaccacggtatctggctgaataggttcagatacaacggggggaacgcgtatcccctccttgacaagtggatcgaggaaaaatcaaaagattggaaaccagagaaccccttcaacgaccagctctctcccgccgcgatagacatgtacagattctacggtgtgatgcccatcggtgacaccgtgagaaactcttcgtggaggtaccacagggatcttgaaaccaagaagaagtggtacggtgaaccctggggaggagcagattctgaaataggctggaaatggtaccaagacacgcttggaaaggtcacggagatcacaaagaaggtggcaaagttcatcaaagaaaatccgtccgtgaggctctccgaccttggaagtgttctggggaaagacctctcagaaaagcagtttgtgctcgaagtggagaaaattctcgatccagaaagaaagagtggagagcagcacatcccattcatcgatgcgctgctgaacgataacaaggcaagattcgtggtgaacataccaaataaaggtatcattcacggaatagacgatgacgtggttgttgaagtcccagcccttgtggacaagaacggaatccatcccgagaagatcgaaccaccgcttccagatcgcgtggtcaagtactacctgagacccagaatcatgaggatggaaatggctctggaggcgtttctaacgggtgacataaggatcataaaagaacttctctacagagatccaaggacaaagagcgatgaacaggtagaaaaggtgatcgaggagatcctcgcacttccagaaaacgaagagatgcggaaacattatctgaagagatga

SEQ ID NO: 26752 - DNA, 1422 bp, Thermotoga maritima
atgatgtacccgatgccgtcttgggtttacgacagtgtcgtgtatcagatctttccagatagatttttcatcggaaagggaaaaacggtggaagacaaaaaggatctgtacctgaagcggggaggagtcatagagaaatggggagttcctccccgcaaacttcccggtgctcagcacgtgaagatcttctacggaggagatctgtggggaatagccgagaaggtcgattattttgaagaacttggaatcaacgttctgtacctcactcctatctttttgtccgataccaatcacaagtacgacacgatcgattacttcagggtggatccacagttcggcggaaagagggcttttctgcaccttttgagggttctccatgagaggagtatgaaactcattctcgatggtgtgttcaaccacgttgggagtcagcatccgtggttcaaaaaagcgaagaaaaacgatccagagtacgtgaacagatttttcctttacaaagataggcacagatcgtggttcgacgttggaagccttcccgagctgaacgtggaagtcgaagaagtgaaggaatacattttgaaagttgtcgagcactacctgaaactggggatagacggttggaggctggattgtggccacgatcttggacctaccgtcaacctgtggatcaacatgaaagtgaaagagttctcagcggaaaagtacctcgtgagtgagatatggacttacccggcaggatgggatatggttgatggtctgatgaattacaacttcagaaaccttgtgcttagttatgtgaacggcgagacggattccataggttttcacctggaaagagcttacagggagacgaagaacatattcggttgctggaacatgcttgacagtcacgacaccccgagactcgccacaatggttcccgacagagacctgagaaaactcgctgtagttcttcagttcacttatcccggtgttccgctcgtttactatggaacagagataggtctcacaggtggagaagatccagagtgtcgtgccaccatggaatggaacagagagaaatgggatgttgatctgttcgagttctacaagaagatgatcagactgagaaggacggatccaggtttgcgctttggagagtttgtcttgctgaacgactcacctctcgcgtttctcagaaaggctcctcatcctcttcaaaacaccatcgtggtggtgaacccaggagaagagaaggtgctggttctctccattcccgacgggaaaattatgaacaccactccccttgtcgatgtgttcagcggagaaagattccacgttgacggcggggttgtgaagcttccccttctagcgagatctttcagaattctcaagcccgaggatctgagagtgggtaagtacagattgtacaagagagtttga

SEQ ID NO: 26753 - DNA, 1671 bp, Thermotoga maritima
gtgaaggttgtgaagaagccttttttactgcttgcttttgtgtttttactcttcctcacctcctgctttcaaacgtctatgagtcaatccctcgtttcaagtaatccacattcaaacagcacaaacacagatggtactagctccaaccttgaagaagtaaaataccccgtcgtctacgaaattttcattcgctctttttacgacagagacgggaacggagtgggagatttaaacggtgtttctcagaaagttgattatctgaaggaactcggcgttgacgctgtgtggtttatgcccttcaacgaggctgtttcataccatggatacgacataacagactactacaacgtcgagaaagactacggcaccatggaagatctcgaaaacatgatccaggtgctccatgagaacggaataaaggtaataatggatctcgtgatcaaccacacatccgatgagcatccctggttcaaagacgccgtggaaaacacgaccagctctccgtactgggactactacataatgagtcttgaagatcattctggtcaggatcactggcactggaagatcaactcaaagggtcaaaaagtctggtatttcggactttttggctataacatgccggatctgaaccacgacagtcagaaagtgagagaagaagtaaagaaaatcgtggatttctggatttccaaaggtgttgatggattcagaatagatgctgcaaagcacatatatggctggtcctgggacgatgggatacaggagtcggccgaatattttgaatggttcagagattatgtgctttccaaaaagcccgatgccatacttgtgggagaggtgttcagcggaaacacgtacgatctttctctatatccaattcccgttttcaatttcgccctcatgtacagtataaggaactacccagaagggcaggatggaatgatagaaaacaactgggttgaggagtctttcctgtttcttgagaatcacgatctccacaggttcttctcccatcttcaagaacattacaaaaagttctccgagtccgactacgagttcatcaaaaaacgtgctgctctctggtattttctgatattcacactgaaaggatctcctgttatctactacggcggtgaaattggaacgagaggtttcaagtggcacggtcctgtatatgacgagccggtgagagagccgatgcagtggtacgcaagcggtacaggagaaggtcaaaccttctggacaaaggaagtctacaaaaacgcggggataacctttggaaacgctgatgttgacggatgtatctatgacgatccttacgatggcttttctgtcgaagaacaggaaagcgatccgaagagtcttttgaatttcatcagattcattctcaacttcagaaaagatcacgacgccattttgaatggagatcaaacgatcttcagggactggaaaaacctcatagcgttctacagagaatcctccaacgaaaagctgttggtggtcttgaatccggatccagtctggcaaaacagcttcacttttgaagaaaacatgacgatgattctcgaggtagattttgaaaacttcatctggaacgagtcaaacgtgtctttttcagcgggtgaatccttcactgtggatcccatgaaagcgtacattttcaaaaagtga

SEQ ID NO: 26754 - DNA, 2532 bp, Thermotoga maritima
gtgaagactaaactctggttgttacttgttctcctcctttccgctttgatattctcagaaaccaccatcgtagtccactatcacagatacgatggaaaatacgatggatggaatctctggatatggcccgtggagcctgtgtctcaggaagggaaagcttatcagttcacaggtgaggatgattttggtaaagtagcagtagtgaaattaccaatggatcttacaaaggtggggatcatagtgaggctgaacgagtggcaggcaaaagacgtggcaaaagacaggttcatagagataaaagacggaaaggctgaagtgtggatactccagggagtggaagagattttctacgaaaaaccagacacatctcccagaatcttcttcgcacaggcaaggtcgaacaaggtgatcgaggcttttctgaccaatcctgtggatacgaaaaagaaagaactcttcaaggttactgttgacggaaaagagattcccgtctcaagagtggaaaaggccgatcccacggacatagacgtgacgaactacgtgagaatcgtcctttctgaatccctgaaagaagaagacctcagaaaagacgtggaactgatcatagaaggttacaaaccggcaagagtcatcatgatggagatcctggacgactactattacgatggagagctcggagccgtatattctccagagaagacgatattcagagtctggtcccccgtttctaagtgggtaaaggtgcttctcttcaaaaacggagaagacacagaaccgtaccaggttgtgaacatggaatacaagggaaacggggtctgggaagcggttgttgaaggcgatctcgacggagtgttctacctctatcagctggaaaactacggaaagatcagaacaaccgtcgatccttattcgaaagcggtttacgcaaacagcaaaaagagcgccgttgtgaatcttgccaggacaaacccagaaggatgggaaaacgacaggggaccgaaaatcgaaggatacgaagacgcgataatctatgaaatacacatagcggacatcacaggactcgaaaactccggggtaaaaaacaaaggcctctatctcgggctcaccgaagaaaacacgaaaggaccgggcggtgtgacaacaggcctttcgcaccttgtggaactcggtgttacacacgttcatatacttcctttctttgatttctacacaggcgacgaactcgataaagatttcgagaagtactacaactggggttacgatccttacctgttcatggttccggagggcagatactcaaccgatcccaaaaacccacacacgagaatcagagaagtcaaagaaatggtcaaagcccttcacaaacacggtataggtgtgattatggacatggtgttccctcacacctacggtataggcgaactctctgcgttcgatcagacggtgccgtactacttctacagaatcgacaagacaggtgcctatttgaacgaaagcggatgtggtaacgtcatcgcaagcgaaagacccatgatgagaaaattcatagtcgataccgtcacctactgggtaaaggagtatcacatagacggattcaggttcgatcagatgggtctcatcgacaaaaagacaatgctcgaagtcgaaagagctcttcataaaatcgatccaactatcattctctacggcgaaccgtggggtggatggggagcaccgatcaggtttggaaagagcgatgtcgccggcacacacgtggcagctttcaacgatgagttcagagacgcaataaggggttccgtgttcaacccgagcgtcaagggattcgtcatgggaggatacggaaaggaaaccaagatcaaaaggggtgttgttggaagcataaactacgacggaaaactcatcaaaagtttcgcccttgatccagaagaaactataaactacgcagcgtgtcacgacaaccacacactgtgggacaagaactaccttgccgccaaagctgataagaaaaaggaatggaccgaagaagaactgaaaaacgcccagaaactggctggtgcgatacttctcacttctcaaggtgttcctttcctccacggagggcaggacttctgcaggacgaagaatttcaacgacaactcctacaacgcccctatctcgataaacggcttcgattacgaaagaaaacttcagttcatagacgtgttcaattaccacaagggtctcataaaactcagaaaagaacaccctgctttcaggctgaaaaacgctgaagagatcaaaaaacacctggaatttctcccgggcgggagaagaatagttgcgttcatgcttaaagaccacgcaggtggtgatccctggaaagacatcgtggtgatttacaatggaaacttagagaagacaacatacaaactgccagaaggaaaatggaatgtggttgtgaacagccagaaagccggaacagaagtgatagaaaccgtcgaaggaacaatagaactcgatccgctttccgcgtacgttctgtacagagagtga

SEQ ID NO: 26755 - DNA, 3033 bp, Thermotoga maritima
gtgaaaggccgattgtggagaatgctctcagagattgttccgtatactgttctgagaagagaaagaatagaaagctggattttctccgatgatgctgttgagagaatcgtggatccttccttcgaatgggacttcagctccgctcccgtccggttcaggaaagagctagagcctttctccgtcgctggagagcagagggcctacctgaaactctggttcggtggtgaaacactcgttctgatagatgggaagccttacggtgagatcaacgagtatcataggatgttgaacatcaccccccttgctgatggaaaaccacacacgatagaagctcaggtgatgccaaggggtctctttggaaaaccagaaaagccggtgttcacggaagctttcttcatcgtcgttgatgaagcactgatgaaggtggtgaaaactctcgaactcactataaaaacggcagaagtgatagaagacgagtcgctttctaagaaacttctggacatctccgaggagtttctctcgaaagtatggatcccaagagacacaggtacctatctgatgacagcactggaggatccgggaataaaagatgagatcaaaaacacctggaacacaccggagttcaaagagttcacaggtgtgaagcttcctgaagagttgagaaatcagattctggaagagttcgaaaaattcaaagaaaagctggatagaataagaaaaaaccatccgggttttggaacgattcaccttgtggggcacgcgcacatagactacgcctggctctggccagttgaggagacgaagagaaagatcctacgcactttcgcaaactctgtgttgctctctaagctttatccggagttcgtttacactcagtcttctgctcagatgtacgaggatctcaagcaaaattcaccagagcttttcgaggaagtgagaaagctcgtagaagaggggagatgggagccagtcggtggcatgtgggtggagtcggactgcaacgttccatcgatagagtcgcttgtgagacagttctactatgggcaaaaattcttcgaaagagaattcgggaaaaagagcaaggtgtgctggcttccggatgtgtttgggttttcctgggtgcttccccaaattctgaaagaagccgggataaaatacttcgtcaccacgaaactcaactggaacgacacgaacgagtttccgtacgatctgtgccgctggaggggaatagatggatccgaagtgatctatttcagtttcaaaaatcccaacgaggggtacaacggaaagatagatcccgatacggtctacaaaacctggaagaacttcaggcagaaagatctcacaaacagagttcttctttcgttcggacacggtgatggtggtggcggtccaaccgaagagatgctggaaaattacgaggttctgaaggatttccctggactaccgcaccttgaaatgggaactgtggaagaatttttcaagaaggtggagatcgacgaagaactccctgtgtgggacggagagctttaccttgaacttcacaggggaacctacacttctcagttcaggacaaagaaacttcacaaagaagcggaagacagtctttatcttgcagagttgatctcggctttcacggataaagatttttcggacgaaatagacgaactctggaagattctgttgagaaacgaatttcacgatattctacctggatcttctataaaggaagtctatgaagatacagaaaaagagctcagacatgtgatagaaaaatcaaaagacatcgttatcgaatctctcaaagttctttcctctgagaacaaagatgttctaaccattttgaacgcttcatcgtttccaaagaagtgtcttttcttcctcaacgaagatctcgcgatttcctttgaaggagaagcactcttgaaacagaaaactcacgatggaaggtatgtgtacttcatagacagggagattcctccgttcacgaaagtagaactgaaagttcgcaaagccacgtctgaggaaactccaagtgagttgagagaaacaaacatcatggagaacgaatttctcagggtgcacgtcaacgatgacggaacaattcaaatctacgacaaagaactggacaggtacgttttcgaagagaagggaaacatcttgaaacttcataaaaacatccctgcttactgggacaactgggatatcgcagaaaacgtggaaaagacaggatataccctgagggcgaaaaacatagaaaaaatagagtctggccctgttcgagaagtgatccgtgttgaacatgaatcagaaggaagcaggatcacgcagcattacatcctttacagaaagagtagaaggctcgatatagaaacgaaggtagactggcacacaaggcgtgcgcttctcagagcctacttcccaacaactgttctgtcgagaaaggctaggttcgatatctccggtggtttcatcgaaaggcccacacacagaaacaccagtttcgaacaggcgcgtttcgaggtgccgtttcacaggtggatggatctttcccagacagacttcggcgtgtccattctgaacgacggaaaatacggtggcagtgttcatcagggtatcatggcgctttcactgataaaagcgggtattttccccgattttctctgtgacgaaggcgaacacactttcacctattctgtctacgtacaccctggagacagcttgagagatgttgtaaaagaatcagaagatctcaacagatctttcatcgttcatcgcggggtgttgaacctcccctctcctttactggagatctctcctcaaaacttccgtctcacctcactgagaagggtgaaggacaaaattgttctgaggcttgttgagatcttcggaacatcaggaaaactttccattaaactcccatggcatggtgaaatctatcagacgaacgttctggaagagaaaaaacagaaagtcaccttcccagtggtttaccatccgttcaagatctacacttttgttgtagaaggttga

SEQ ID NO: 26756 - DNA, 960 bp, Thermotoga maritima
atgaaaataggtatcgtaggactcggaagggttggttccagcacggcttttgcactcctgatgaaaggttttgcgagggaaatggttctgatagacgtcgataagaaaagagcagaaggagacgctctcgatctcattcacggaacacctttcacgagaagagcgaacatctacgctggagactatgcggatctgaaaggatcagatgtggtgatcgtcgctgcgggagtacctcagaaaccaggagagacgaggcttcagcttcttgggagaaatgcaagagtgatgaaagaaatagcgcgaaacgtctccaaatacgctcctgattcgattgtcatcgtggtcacgaatcccgtcgatgtcctcacgtatttcttcctcaaagagtccggaatggatcccaggaaggtgttcggttccggaacggttctcgacacagcaaggctcagaactttgatagcgcaacactgcggcttttctccaagaagtgtgcacgtgtacgtgataggagaacatggagattcagaggttcctgtgtggagcggtgccatgataggaggtatccccctacagaacatgtgtcagatttgtcagaagtgcgattcgaagatactggaaaacttcgctgaaaaaaccaaaagagccgcgtacgagatcatagagagaaagggagccacccattacgccatagctctcgccgtggccgacatagtggagagcatcttcttcgacgaaaagagagtgcttacgctttccgtttatctcgaagattacctcggtgtaaaagatctctgtatcagtgttcctgttacccttggaaagcacggagtggaaagaatcctcgaactgaacctgaacgaagaagaactggaagccttcagaaagtcagcttccatattgaaaaacgccatcaacgaaataacggccgaagagaacaagcaccagaacaccagcggttaa

SEQ ID NO: 26757 - DNA, 1167 bp, Thermotoga maritima
atgatggaatactggattagaagagcccttgaagtagtgaaaacgccttttcttcttttcgatctgtcggtcgtggaaaagaaatatctggagatgaaagctgctctcaaaaaagcggatatttactacgctgtgaaggcaaactcccacccgcgtattatatcccttcttgccaggttggggagtaatttcgatgtggcttccaagggggagatagaaaagctcctcgcacttggtgtggatgggaagagaatgagttttggtaacaccataaaaagagaggaagacatcgcgttcgcgtacaaaaacggtataaggctctttgcagtggatagtgagatggaagtggaaaaagtcgctataaatgctcctggaagcttcgtttttgtgagagtggaaacggatggtgcagacgcagactggcccctttccagaaagtttggaaccaatccagagcatgctcttcagcttctctcctatgcttcgaagatgaaactgatccccgcgggattgagttttcacgtgggatctcagaatttgaatcctgaaagctggaaaaaggcgatagagatcgcggggagagtgttcaaaaaagccatgagatccggtttgaatcttttcctcttgaacgttggtggaggctttcctgttcagcacacaaagccaattccaagtatggaagaaataggaaaggcaatcgaagaggcgatagacgaaaacctctggtttgtccacaatttgaaagtgatagccgagcccggaaggtacatggtcggagaagcaggctggcttgtcacaaaagtgcttttgaagagcgaaagatcaggtgaaaaatgggtttacatcgacgcgggagtatttcacgggctcgcagaaactatccaaaacttcgagtacgaaatcagagtcctcggaaaagaaagagaagagctcgaagagtaccatctggcgggtcccacttgtgacagcgtggatgtgatatacgacagaatctttcttccaaagagcatcactctgaacgaccttgtgtgcttcataaacgcgggggcttacacggttgagtacaacacccgtttcaacggaatagaacctccaaagatggttttcatcgaagaactcacggagatctcaatagaggagaaaatcaaaacacgagtgctggattga

SEQ ID NO: 26758 - DNA, 1464 bp, Thermotoga maritima
gtgttcatcaccggggctttttttgatatattagaagtcggaccaaaaaaaatcaggaggtgcttcgaattggtcagagtcaggttcgccccgagtccaacaggccatctccacgtaggtggagccagaaccgctctgttcaactggatgttcgcaagaaaagagggtggaaagtttatccttcgaatagaagacaccgatactgagagaagctcaagagaatacgaacagcagatcctggaatctttgaggtggtgcggtctcgattgggacgaagggcctgacataggtggagatttcggaccctatcgacagagcgaaagactcgagatctaccgagaatacgctgagaaactggtggaagataagagggcttattacgtggtttacgataaggaagatccctctaaagagctcttcacaacttacgagtatccccacgaatacaaggagaaagggcatcccgttaccataaaattcaaagttcttcccggaaagacttccttcgaggatcttctgaaaggctacatggaattcgataactccaccttagaagatttcatcatcatgaagtcgaacggatttcccacctataattttgcggtcgtggtggacgatcatctcatgagaatctcccatgtgtttcgcggtgaagatcacctttctaacaccccaaaacagctcatgatatacgaggctttcggatgggaagcacccgtcttcatgcacattccactcatccttggatcggacagaacgcctttgagtaaaagacatggcgccacttccgttgaacacttcagaagggagggcattttgagcagggctttgatgaactatcttgcacttctcggatggagagtggaaggagacgaaatcttcactatagaagagaaacttcagtcattcgatccaaaagatatttcgaacaagggagtcatattcgattaccagaaactcgaatgggtgaacggaaagcacatgagaagaatcgatctcgaagacctgaagagggaattcatcgaatgggcaaagtacgcgggaaaagaaatcccctccgtggatgaaagatacttctcagagaccctccgtatatgtcgggaaaaggtgaacacactctctcagctgtacgacatcatgtatccgttcatgaacgacgattacgaatacgaaaaggactatgtagagaaatttttgaagagagaagaagccgaaagggtgcttgaagaagcaaaaaaagccttcaaagatctcaacagctggaatatggaagagatagaaaaaacattgagagatctttctgaaaagggtctggcatcgaaaaaggtggtctttcagctcataagaggagcggttactggaaagctggtaacacccggtctttttgaaaccatagaggtgctgggaaaagaaagaacactgaaaagacttgaaagaactttacagttcttaaagaaaacctaa

SEQ ID NO: 26759 - DNA, 1527 bp, Thermotoga maritima
atgagaaagttcctggtgatccttctggctttgctgataaccgctctgcttcttggtgcaaggctcaccatccttcacgtcaacgacacacacggccatgcctgggcattcgatgagtatcgtaatcccggaattgggggccttgcaactatcgcaacgatcgtagaagaggtgaaaagggaagtcgagagtcagggtgggtacgtgatctttctccatgcgggagacctgaacaccggtgttccagagtccgatcttcaggatgccataccggacatcgttggattcaacatgatgggactcaaagccatggccgttggaaaccacgagttcgacaatccaagggaagtactcgaaaaacagatgaaattcgcagattttccgttcctttcagcgaacatagtaaaagaagatggtgaaccgttcttcaatccatacatcgtcgaagatctcggtgagctgaaaatcgccatcatcggcttcaccacagaagaaacggagatcctggaacccctctacctcgaaggtctgaagttcgaaaacgccctgaaagtggcccagaaaatagcacccgaattgaaaaaacaggcagatgttgtgatcgctcttgcgcaccttgactggggagagccgaagaaggaagacatcaccacgacacaccagctggcaggagttgagggaatagacgttgtgatagcagggcacagccacgtgcttggatctgacgttgtggacggaaagataatagcttcggccggagaatatggaaagtacgttggaagactcgatctggacatcgaagacggaaagatcgtggcgtggcactgggaagcgatacccgttaatttgaaggtgtacgaaaacgaaaagtacaggtacctcgggaagccgtacctcgaaaacagatacgtcgcaaaggctcttgaatacttcaagaaagtgggaaatgaaaaactcgataccgtcataggagagacgaagatctacctcgatggtgaaagagaacacgtcagatcgaaaagcacgaatcttgccaacctcatagtggacgccatgagatggaaagtgggggcggatatcgctttcacaaacggtggaggtatcagagcctctataaaacctggaaagatcactgtgagagatatactgacggttcttccgtttggaaacactctctacgtactggaactcaccggtgaacagatcatgaaagtgctcgagtacgccgctaccattccggaaggtaaaggtgcgttcctccaggtttccggcctcacttggaagagcaaagacggaaaagtcgtagaggttctcgtgaacggagagccgctcgatccagagaaaaagtacaaagtggtcacaaacaactacatggcaggtggtggagacggttatgtcatgttcaaagagtgggacggatacgacacgggatacctcatgtcagacgccgtcattgagtacatccagaatgttctgaacgggaaaatagaagagtacgacgattcgcagaggtacgtgagagagtaa

SEQ ID NO: 26760 - DNA, 3140 bp, Neurospora crassa
atggaggcggcgtttgcaaagcccgtcgatgaggtcctcagcacctttggtgtcgaccctaccaccggtctaagtgacgagcaagtagctcagtccagggctaagtacggtagaaatggtatgcgctttctctacaggattctttgaattcagcttcgttattctatcaatggcctttgctaaccgttctgcctgcctcagccattccagaggaacctccgacacccatctgggagcttatcttggaacaattcaaagaccagctggtcctcatccttctgggctctgccgccatctcgttcgtactcgcgctcttcgaagacgagggcggctggagcgccttcgtcgaccccgccgtcatcataacgatcctagttctcaacgctgttgtcggagtgtcccaggaaagcagtgccgagaaggcgattgctgctttgcaagagtattcggccaacgaggccaacgtggtgcgcaatgggcagattactcgtatcaaggccgaggatcttgtgccaggcgatgtcgttgacattgctgttggtgctcgcgtccctgctgactgcagattgatctcgattgagagtaacagctttgctgtggaccaggccatcttgaccggagaaagcgagagcgtcgggaaagacttccaggccgttgttagcgacgacaaggctgtcttgcaggaccaggtcaatatgctgttttcgggcacaactgttgtcactggtcacgccaaagccgtcgttgtcttgactggctccaatacagctatcggcgacattcacgagagcatcaccgcccagatctccgagcctacccccttgaagcaaaagctcaatgacttcggagaccagctcgccaaggttatcactgtcatctgcgttctcgtctggctcatcaacatccctaatttcgccgaccctagccatggaaactggaccaagggtgccatttactacctcaagatcgccgtttcccttggcgttgcggccatccccgagggtcttgcggtcgtcatcaccacctgccttgcccttggaactcgcaagatggcagctaagaacgccgtggtgagaagtcttccgtctgttgagaccctgggcagttgcagcgtcatttgctctgacaagaccggcactttgaccaccaaccaaatgagcgttaacaaaatcgtccatttcaaccaagatggtactgatctggaggagctggatgttgagggaactacctttgaacccaagggtgctatcatgtcgcagggcaagaaggttaccgaccttgctcaaaactccgctaccattcttcagttgaccgaagttgccgctctctgcaacgatgcccgccttgactaccatccctctaccggcactttctcgaacgtgggcgaagctaccgaaggcgccctccgcgttttgaccgagaagatcggcccctgcgccccctctgattgtcctcccaaggatcgcgttcactacgctagctcctggtacgagaagcagtatcagcgtcttgccacctacgagttttcgcgtgaccgcaagagcatgtctgtcttggttgagcgtgatggacagcagaagcttctcgttaagggagcccctgaatcgctcatcgaacgctgtactcacgctctcctcggtcccgatggcaagaaggtacctttggacagtaacatgtccgaactcctcatgaaggaggttgttgagtatggcaaccgcggtctgcgtgtgatcgcactggctagtctggacaacgttgctggtaaccctcttcttcacaccgccaagtctaccgccgaatatgcctctctcgaacagaaccttactctcatcggtctcgtcggcatgcttgaccctccgcgtcctgaagttgctgcttctatcaagaagtgcaaggatgcaggtattcgcgttgtcgtgattaccggtgataaccgcaacaccgctgagagcatctgccgtcagatcggtgtctttggatctaacgaggatttaactggcaagagctacactggtcgcgaattcgataaccttacccctagtgaacagctcgaggccgccaagactgcttctctgttctctcgcgtggagcctactcacaagtctaagctggttgatctcctccagtctctcggtgaggtcgttgctatgactggcgacggtgtcaacgatgctcctgctctgaagaaggctgatattggtgttgctatgggttccggtaccgacgtgtcgaagctcgctgctgacatggtgcttgctgatgataactttgccactatcgaagtcgccatcgaggaaggccgcgccatctacaacaacacccagcagttcatccgctacctcatctcttcgaacatcggtgaggtcgtctctatctttttgacggccgctctcggtatgcctgaggctctcatcccggttcagcttctatgggtgaacttggtcaccgacggtctccccgctaccgccttgtccttcaacccccctgaccacgatatcatgcgtcgcaaccccagaaagcgtgacgaggctctcatcggcggatggctcttcttccgttatctggtcattggtacctatgtcggtctcgccacggtcgccggttacgcttggtggttcatgttctactcggagggtcctcagatcagcttctaccagctatctcacttccatcgctgctctaccgagttccctgagattggctgcgccatgttctcgaacgacatggccaaggccggttcgaccgtctcgctctccatcttggtcgtcattgagatgttcaatgccatgaacgccctctcttccagcgagtctctcttgacgctccctgtttggaagaacatgatgctcgtctatgctatcggtctgtccatggccttgcacttcgcccttctctacactcccatccttcagaccctcttttcgattctccccatgaactgggcagagtggaaagccgtgatcgtcatcagtgcaccagttgtgtaagtccctagatccgtcttccatgtgatactttttgaacagtacgctaatactttgtctaggcttcttgacgaacttctcaaggccgtggaacgcaagtactttgtacagagcacccccagctcgacgtcctcagataagaagaaggatctctag

SEQ ID NO: 26761 - DNA, 734 bp, Neurospora crassa
tcttcctcactctccacagacggcggcgctgctgtcgccatggtcggaaaagactgtgtagctatcgcgtgcgacctgcgcctcggccttcaggcgttgacagtctccaacaactttcccaagatcttccagtacggcgacgtcttccttggacttaccggtctggcgacggacgtgtcgaccgtatcggacctgtttcggtacaaggtgaacatgtaccgacttcgggaggagcgcaacattgcaccccggacgttcgccaacctcgtgtccagcagcctgtacgagcgccgctttgggccctattttgtcagtcccgttgttgctggcctggatcccaagacgggcgagccgttcatctgcggctttgacagcattggatgcatcgatttcgcgaaggacttcattgtgagcggaacggcgacggagcagttgtttggcatgtgcgagaacttgtgggagccgaatttggtatgtaatctttgcgaaccccaacccgaccttccattaaaaccactcgttttggctgtttttgtgtgttgggttgtcatagtgagagcgtggtactgacgatgacaattacctaccagggacccgaggacctcttcgagaccatatcacaggctcttcttaacgccgtcgacagagatgccttgtcaggctggggcgcccatgtttacattatcgagaaggacaaggtcaccaaaaggctattgaagggacgacaggattaa

SEQ ID NO: 26762 - DNA, 928 bp, Neurospora crassa
gaaatcaacagcaagactttcctcgcccgcctctgcgagcaggctgagcgttacgatgagatggtcaccttcatgaaggaggttgccaagctcggtggtgagctcaccgttgacgagcgcaacctcctctccgttgcctacaagaacgtcgtcggcacccgccgcgccagctggcgcatcatctcctccattgagcagaaggaggagtccaagggctccgacaagcacgtcgccatcatcaaggagtacaggcaaaagattgagactgagcttgagaccgtctgcaaggatgtcctcgaggtcctcgacgaggccctcattccccacgccgccactggcgagtccaaggtcttctaccacaagatgtatgtatttcaggccaaacccctggccttggcgatagctgaccggtatccaaaaacaggaagggtgactaccaccgttatcttgccgagtttgcttccggcgagaagcgcaagaacgctgcgactgcggctcacgaggcttacaaggtacgagcttctgaaaattcgcgcgatttgctaccaatgcgcttttgctaactgggggtttcactgccatgcagaacgccaccgatgttgctcatactgagctcactcccacccaccctatccgcctgggtctcgccctcaacttctccgttttctactacgagattcttaactcccctgaccgcgcctgccacctcgctaagcaggctttcgatgatgccattgccgagctcgactcgctgtccgaggagtcttaccgcgacagcacccttatcatgcagctcctcagggataacctcactctctggacctcgtccgacaatggcgagcctgaggccgccgctgaggcccccaaggccgaggagaaggctgaagagaaggctgaggctgctgaggagaaggctcccgaggagcag

SEQ ID NO: 26763 - DNA, 1112 bp, Neurospora crassa
actgccacccgcactctccgcgctctgcgcacctcgactcgtcctgcgctcactgccgcgccccgcgctgctttccgccagggtggtcgtcgtctttactcttctgagcccgccaagtccggtggctccaacatttgggcttgggctatcggtgccggtgctctcggtgccggcggtctgtggtatctcaaccaggacggcgcttccgctacccccaaggttttcgctcccaagttcgacgactaccaggccgtgtacaacgagattgcctctcgcctcgaggagaaggatgactacgacgacggcagctacggcccagtcctcgtccgtctcgcatggcacgccagcggcacctatgacaaggagaccggcactggtggctccaacggtgccaccatgcgcttcgctcctgagtctgaccatggtgccaacgccggcctgaaggctgctcgtgacttcctcgagcctgtcaagggtaagctgctaccatccttaaatcgtggtatttcaacatactgacgtcccaaacagccaagttcccttggatcacctactccgatctctggatcctcggcggtgtttgcgccatccaggagatgcttggcccccagatcccctaccgccccggtcgccaggaccgtgatgctgctggttgcactcccgatggccgtcttcctgatgcctcccaggcccaggaccatctccgcaacatcttctaccgcatgggcttcaacgatcaggagatcgttgctctttccggtgctcacgctctcggccgctgccacgctgaccgctccggctttgacggtccctggactttctcccctaccgttttgaccaacgattactacaagctgctcctcgacgagaagtggcagtggaagaagtggaacggccctaagcagtatgaggacaagaagaccaagtccctcatgatgctccccgccgatatggccctcatccaggacaagaagttcaagcagtgggtggagaagtacgccgccgacaacgagctcttcttcaaggacttctccaatgtcattgtcaagctctttgagctcggtgttcctttcgccgagaactccgagcgctgggtcttcaagaccgtcaat

SEQ ID NO: 26764 - DNA, 1680 bp, Neurospora crassa
gccaagaccccaatcgtcactctcggcgccatctgggccggcgctgtcgtctcgccggccaacccgctctacaccgtcgaagagctcaccttccagctcaaagactcgggcgccaaagctatcgtcacgcaagctcccttcctcaagacggccgtcgaagcggcgaagaaggccggcatccccaacgaccgcatcgttctggtcggccagcacagcgacccttcgggaacgttcaagcatttccgcagtatcagatgcgttgacttccccacccgcttcaggaagaccaaaatcaacccggagaaggacctcgtgtttttggtctacagctccggcacgacgggcttgcctaagggcgtgtgcttgacgcatctgaacgttgtgtccaacatcttgcagatggccgatgttgatgggcggtattggtctgcgactggcgggctgaatggtgaaggtgataagttcttgggcgtgctgccgtttttccacatctatgtgagttctctctctctctctctctccgtcgagtcttgatcccaaaaaccaaaattggatctaatccgatgcaacaaccactattacagggtctcacctgcgccctgttcatgtgtctttaccttggctgggagatgttcgtcgtcgagcgctttgacctggaaaaggccctacaaacgatccaagaccagcgcatcaccgccttctacgtgtctcctccgatcgtgctggccttcggcaagagcccgctggtggacaagtacgatctcagcaccctcaaagtcatgcactcgggcgccgcgccgctgacgagcgagctcaccgaggccgtgtggcagcgtctcaagatcccggtcaagcaaggctacgggttgagcgagtccagtcccgtggtgacgtgccagactgtggatgagtgggccaagtttatgggttcttgcggcaagatgatgccgaatatggaggcgaagctggtggacgaggagggcagggaggttgccgatggtgaggtatgtactttttgtcctgatgtacatttgactgataagatgacgtgagattaacctggtataactgacaatgttggataggttggcgagctgtggatcaagggacctaatgtgttcaagggttactataagagtccagagcgcacaaaggaggccttttcagaagatggctacttcaagaccggagacatgttccacatcgataagtacggcaacatgtactgcgtggatcgtctcaaagagttgatcaagttcagtaagttgttcctttttctcacccggtacgtgaccgaacagacgtggactgatcactgattttatctttcttccagagggcttccccgtcccaccagccgaactcgaaggtctcatcctaggccacagtgatgtaacggatgtctgcgttattggtgtcgatgaccgcagccaggctaccgaagtgcctcgggcgtacgtcgtccttagaccaggcatcgaagccagcgatagcaaggcgcaggagatcatggaatatgtcgctaagcaagtcgctccccataagaagctccgcggaggtgttcggtttgttgcagaggtacccaagtcgcctagtggaaagattcttcggaggatgctgagagacaaggtgaagcaagaggagcgtgctgcgggatcaaagctctgaaaaaggtgtaat

SEQ ID NO: 26765 - DNA, 3249 bp, Neurospora crassa
atggaccgactcagcgcgtggaaggacaatgacgatgttcttcccttctaccaaaaatcccccggccagggcacctttgcgacccccgaggaaatcgagcagtcgcggtccggctgtaacacaccgcgacaccgcattacctctgctgaatcaagagtaggctgcaagccccacgccatcgtgaaagcccgggacgctgacagacgagcaaacagggcgtggctgacgacttctcctacatgacccccgccgaagccgccacccacctcgacacctctctgacccatggcttgactcccgccgaagctctctcgagactacacgattacgggccgaacgagatcccacacgatcctcctgagcccctttggctgcgattcgtcaagcagttccaagagccgctgatcctccttctcctcgcctctgccggtgcgtctatacttgttggaaacgtcgacgatgccgtcagcatttcggttgcggttaccatcgttgtgagcgtgggctttattcaggaatatcgttccgaaaagtccatcgaggcactcaaccatttggttcctaaccatgcgcacctggtacgaaaacatacgggggccaaaccggttgatggtgatgattcgtccgatattggcgatgttgctggctcggttacaccacccgaggatgttctggatgcgaaatcgtccaaggtcatggctgcgcaactggtgcctggagatctggttttgtttactaccggtgatcgcatacctgccgatgtccgagttaccaaggcaacagatttgacagtcgatgcttccaaccttactggagaaaatgagcctgtcagaattgttgccgaagcccgaactcgtcatggagccaccggtcctgccgccgacaaagataactcgaccaacgttgtatacatgggcacactggtgaagtctggatatgggcaaggggttgtctttgctactggaggaaacacacactttggtaccattgcgactagcgtatctggaactgaaagccctcgctcgcctctgcaactgtctatggacgatctcggctctcagctcagcaagatgtcttttgtcattatcgggctaatttccctcgttggctggctgcaagggaagaagctactcgaaatattcaccatctccatttctttagcggtcgcggccattcccgagggcctacccatcattgtcactgttactttggctttgggagtgcaccgcatggcaaagcataacgccattgtgcgcaagatgcccaaggttgagactctaggatctgtcaatgttgtgtgctcagacaagaccggtatgcctcaaaaagacttcacaaaagacgactcgaaactaactgtgactaggaaccttgaccacaaaccacatgactactgtcaagatgtggtttttcggtaccgacgacgctttggacgtggattccgatgatgaagctaccgagaccaaacccgaccccgccatgcttagaatcctccgtattggtaatatcgccaacaatgcccgtcttgccatgcagtataccgaaaatggtgctggggcccgcgccgttctctcctctactcaaggaaagaatgccccttccacgtatactcgctgggtcggccagcctacagacattgccatgctcgacttgcttgatcgctttaaggaacacgatgttcgcgattccattggaccgcgcgtgagcgagaccccctttagctccgaacgcaagtggatgggtgttactatcggctcggaaggtggtaaatcggacaaggaatttgcctatataaagggttctatcgacaaggttcttgatgcctgcgatacctatctttccaaggatggccgggagtttgttatggataccaacagacgtcaggaagcgatcgacgccgccgagaagatggcctcgcgaggtctacgtgttttggcctttgccagcggtcctgtcaccaaacccgccaagaacaagtcgcctgccacgaacactgtcgaagaacagtacagaggcctcacctttgctggtttggttggcatgagcgacccgccccgtcccggcgtttcgaggtctattaggaagttgatgcgtggctctgttaaggtgatcatgatcacgggtgatgctgagactacggccgttgcgattggaaaacagcttggtatgagtgttactacaccggctgtaggcacatcaggcgtcagatctgttctgcgtggagacgagatcgatgccatgacagatgaagagctggctgcggccatggatcataccaccatcttcgctcgcacgaaccccgatcacaagctcaagattgtcaaggctcttcagtcccgtggcgatattgttgccatgacgggtgacggagtcaacgatgctcctgctctcaagaaggctgatatcggcattgccatgggcaagcatggaaccgatgttgccaaggaggcagccgacatgatcctgaccgacgacgacttttccacaattcttcacgccatcgaagagggcaaggccatcttcaacaacatccagaacttcttgacgttccagctaagtacaagtgctgccgggttatctctcgtgcttctctgcacttgcttgggctacaagtcacctctcaatgccatgcaaattctttggattagtaagactccccctccatcttgcattctatcgatctctgctaactgcctctttccagacatcatcatggacggccctcctgcacagtctcttggtgtcgagtctgtcgataaggacgtcatgaaccgtcctcctcgtcgtagaggcgatgcagttctcacaaaccctctcattgcccgtgttcttacccaggctttcatcattatggtcggtacaatgctcgtttacaagcacgaaatgctcggggacggacaggttacccgtcgcgacactaccatgaccttcacctgcttcgtcctcttcgatatgtttaacgccctggcctgccgctcggagtctaagtccatcctccgcggcgaaattggtctgttctcgaatacgcttttcaactgggccgtctcgctcagcttggcagggcagttgcttgttatttactttccctggctgcaggaggtgttccagaccgaggcgctcggactccttgatttggtgtacctggtgttgctatgtagcacggttttctttgctgatgagctgagaaaatggtggaagtacggggcaaggaggcatatgggtgttaactatagccaggctgtatagtaa

SEQ ID NO: 26766 - DNA, 1409 bp, Neurospora crassa
atggtctctcgtcatggctctcgctatcccactggaggctcaaacgtggagtctttcggtgcccgtcttgccaatgcgactggcaagttcaacgctacgggcgaactcgagttcctgaacaattggaagtatcagatgggcactgagattctcgtccccagaggtcgccaggaactgttcgactctggtgtcctgcacgcttacatgtattcgtcgctctatgacccgaacaccaagattatcgctcgtacgacggtatgcatctggttgtccgtaaagacaagttatttagttgggtgctaactagagaaacatagacccaagaccgcatgctgagatctgctgagaacttcttggctggtatgttcggcctggaatggtaagttctttcccctccaagccccaccgccatgtgatgttgcgaacggttggagttagatattgattttgtacaggcccaacaatgtcaccctcgaagtcatcatcgaaggctccaatctcaacaactccttggcaggctatatgaactgtcccaacgaaagggaagacggccttggctctgcggcccgcgatatctgggtcggccactacttgcagaatggtacgcggattctggatgataaatggcctgagtaatatcagttgcacatggctaacttcatcaacttcagcaactgagcgtttctccaagctcgttacgggttataactggacgctcgatgacacttatgccgcccagaccttatgcgcctacgacacagtaagtcaagcgccacctcgctcctaccacttgtttcatatcaaactcacattttctgtaggtcgcaagcggctacagccgcttctgctccctcttcacctatgaagaatggatcggcttcggctattcccacgacctccaattctacggcaacaacgccttcggctccgagaccggccgcgccatcggcatcggttttcagcaggaagtcctcgcccgcctccaaaaccacaccatcccctactccgagacccaagtcaacgtgaccctcgacaacaataccgtcaccttcccgctcaaccagtctctgtatctcgatttctcgcatgacaccaacattgtctccatccttgcggcttttggattaacccagttcgaagaggaccttcccgccgataaatacccgggcgaacacaactttacggtatcgcacatgacgccctttggcgcgagactcgatatcgagattatcaagacgccaaagccgttgaaggctgatcggtcgggctatgaggatgagggagaggagacgaagtatgtccattttgtgctgaatcaacggacggtcccgttggggtggagccatccggagtgtgatgcggaaagggtggacgggtggtgtgagtttgaggcgtttttgaaggtgcag

SEQ ID NO: 26767 - DNA, 1086 bp, Neurospora crassa
ctcgccttcagccaaagaccactccccccaccatccaacgaggccctcctgtcctcggccggatataagcttccattacgaaccaaggggcgggacatcgtggaccaaaatggcaagcgcttcaagctctcgtcagtcaactggtacggcgccagcgacgagctttttattccgggtgggcttgacgtgcaacaccgcgacgtcatcgccagcacgatccgttcgcttggcttcaacagcgtgcgcatgccgtacagcgacgaaatggtcatttcgaacccggaagtcccgctgcgcctgttggcggcgaatcaggacctcgtgggcaagcgcgccctggatgtgtttgaagcgacggtaaccgccttgacggacgccgggttagccgttatcgtcaacaaccacatcaccacggcgacatggtgctgcggcgctgacccgtgcgatgctggctgggcaaacgatttccttcctggctcgctgtgccgggtacgacagacggaggcgcagtggattgaccactgggtgacggtgatgaaccgcttcgtcgacaatccgctggtaattggggccgatttgcgcaatgaggtgcgcgggctttggggcaccatgccgtgggagagatgggctgcggcggcagaacgagcaggcaatgccttgttggggataaactcggactggctgatcattgtgggtgggaccgagtccggtaacgacttgacgggcgtgaaacgtcggccggtcgagcttgacgtagcaaacagactggtgtattcggcacatgtctattcatggagcggttggggaagcatgggagggcggtattcgaagcgcacatatgcatccttcgtgaaggctatgcgtcagaattggggatacctggtggaagaaaatctggcgcctgtttggattggagagtttggggcacccgaccgtcctggcatcggtgatgcgaactactggcagaatctcctgagatatctcaaggcgattgacgccgactttggatactgggccatcaacccgcgcaagccaaaggacaacgagaaagagtcatactcactcgtcgaggatgattgggttacg

SEQ ID NO: 26768 - DNA, 1321 bp, Neurospora crassa
tacttcactgtcgacgatactcttctatacaatgccttccaccacgattttggcccgttccacatcggccacctttaccgcttcgccctgcagttccacgaaattcttggggccaaggagaacaaagacaggccggtagtgttctggagcagggccgatccacgcagtaggtcatctaagtccgcctcctcgagaacagcaaagattgctgaccaatgttaccttaggtcgtgccaatgcctcttgtctactagcttgctacatggttttgatccaatcgtggcctccgcatctagctcttgcgccggtcgcccaggttgacccccctctaatgccgttcagagacgccggctacagccaggccgactacggcatcacggttcaggacgttgtgtacggcgtttggaaggccaaggaggaaggctgctgcgtgttggagacattcgaccttgacgagtacgaaaagtttgagagagttgagcacggcgacttcaactggattacacccaacttcctggcatttgcctctcctcagcataccccggttgctcccacccccgaggggaccgagcagtggtcacttctgccaaagaccctagccgccgtcgacgcacatcctacgctgccgcagcccttcaaaaatgttctcaggcatttctcggagcgagacatcggccttgtcgtcaggctgaactcgcagctctacaatccctcatactttgaagccctaggaatcaaccacatcgacatgatctttgaggacggaacatgtcctaccctttcgaccgtacggaaattcatccgcatggcccatgaaaccatctctaggaagaagggcattgctgttcattgcaaagctggcctcggccgaacaggctgcctcatcggtgcctacctgatctaccgacatggatttacagcaaacgaggtcattgcctacatgcgcttcatgcgcccaggcatggtcgtagggcctcagcagcactggttacatctgaaccagggcatcttccgggagtggtggattgaggagcgggttgagcggaggctgcgcaaagaaatggcagccgctgccgccgccgccgctcaggctaacgggacagcgcatcccagcacccctgtccgtgccgtgtcgaagacgagtcttggtcgtagctctagcaaaaatggcgtgtccacaccctctaacagaggatcagttcggacaccgctaggcgagatcgatcgggagtcggcgcgtgacaatcatatcggcgtacaagaggattacctccccgcacctacgccaggacagccaaggaagacgcagcggggcgcagta

SEQ ID NO: 26769 - DNA, 1149 bp, Neurospora crassa
tccaagtcacatgccgaacagcttcgaccaaattaccgaccccgcttagagctgagcggccacactgctgccatcagccaggttcgaatatcaccagacggaaaatggatcgcctccgcctccgccgatggcagcgtcaagatctgggacgccaccacgggcaacaacctcgataccctcataggtcacatggccggagtctcatgcctggcatgggcaccggacagcaacactttggctaccggttcagatgacaaggccatccgcctctgggaccgggtgaccgccagtcccgcccacgcttgtggggacgaaagcaaccgtggccaaggaccacgagagtacattagaggtggcagccagcttgctaggacagcacgcggaggtagaacaggaatgggtccgctactgggacatcacaactatgtttactgcctcgccttttcgccaaaagggaatattctggccagcgggagttatgacgaggccgtatttctgtgggatgtgcgagctggtcggttgatgcgaagcttgcccgctcacagtgacccagtgagcggcatcggcttttgctgtgatgggacactggttgtcagttgctctacggatggactcatgtatgctttcccctgcccgaaaaaaaaaaaaaaaacacacgagcttcatggtgtatggttgctaatttttgtgtgtgtgcacagtcgcatatgggatacctccaccggccaatgtctccgaacgctcgtccacgaggacaatcccgccgtcaccaatgtttgcttcagcccgaacggccgcttcgtactcgcctttaacctcgataacagcattcgtctttgggactatgtttccggaaccgtcaagaagacataccaaggccataaaaacagcggcttttctataggcggaggttttggcgtggtgaccgacaacaaggatacacaggacgactaccggcatggtaatataggcaagccatttgtcgtgtcagccagtgaagacggagatattgtaatgtgggatgtggtgacgaagcaaatcgtacagcgtatcgagaaggcccacgagggggtctgtttctgggtggatgtcaacggcgacaccatggtaagttctgggcaggattgcaccatcaaggtttacaagaat

SEQ ID NO: 26770 - DNA, 936 bp, Neurospora crassa
caggattgggatgtcttaaagattctgggtaaaggcagctttggggtggtacgactcgttcgggaaaaatcccaatatcgtgatgaaggtcccaatggccgctctgaaacttggtccgaagctagcagcaagcaggtatacgccatgaaggttatacgaaagtcagacatgcttcggactagccaagagggtcatctaaaagccgaaagggactttcttgttgcatctgaaggctcaaaatggtacgtgctccaagtagcatcctgaaatctcagccgatactgactaggccgtaggattgtgccactcatcgcaagcttccaggacgctgccaatctctatcttgtcatggagtatatgccgggtggtgattttctcggacttttgattcgggagaacatcctacacgagtctgtagcacgattctacgttgccgaaatgatactatgtgtcgaggcggcacatgcgctcaagatcattcatcgtgatatcaagccggacaactttctcatctctgcctcaggtcatctgaagatcagtgacttcgggctggcattcgacggtcactggtcgcatgacgcctcatacttcaactgtcaccgatatagcttgctcaacaagttgggcatccacatcgagggtgatgaccaagacaaggccgaaggtcgcagtctgcaggccacaatgaaatgggcaagcggtattatgacggggatcgacaagcacgagaaaaaaaccacagatgatggagagccccttcttagctggcgtaatcgatgcggcaaccgcacttctgctatgagcgttgtcggcactagccagtatatggcgccagaagtcattgaagggaagaagtacgatgctcggtgtgactagtggagtatcggcattattcttttcgaatgtctctacggtcgtacgccgtttatttccgat

SEQ ID NO: 26771 - DNA, 1055 bp, Neurospora crassa
tcatcaatgcgctttggcttgcgcgcgcaatcgctaacaagcaatcccaaacagtcttcccttcgcatatacgtatggctgatcctgcttgacgccccaatcatcgaaaccgacacctacctttccctcattcatcgcggcgcatcccctgcctactcgaaaatccgcaatgatactttccgtacacttacgaccgatcctctctttcggcgccgcgttagcgaggccagtctaattcgattacttaacgccgtcgcctggaggttacacgatgcccgcggagaccgaacccgagaccatagcattgtcagtctttcgcgacgctcggcgccatcagaacccggaagtcgtccgggaactagtggtcacgacagcatcactgggtcgccggcatcgaaaagtcgagcgcgtgccttgaccttgaccactgaaggctccgaggccagtggtgtcgcctctgaaccgggtacctatgtacaaggaatgaacgtgctggccgcgcctttcttgtatgctgcacgtagcgaagccgaagccttcgtcgccttccaccagcttcttacgcaagagttacccggctatattcgcggcgccatggacggagtgcacaaagggctggcgttggttgacaaggtgttatcgatcgtggatccaaaactcagtctctacctgatgtccaagaacctttccgccgagatctatgcattcccctccgtactgacgttgtgcgcatgcacgccacctctgcccgaggtcctacgcttgtgggacttcctcttcgcatacggtccgcatctcaacattttgtgcatcgttgcgcagctgatcatgatacgcacaaagatcatggaatcgcctaggtatgacatccttccaatagataactcgtttctaaagtgggctttcaaatgctgacatgctggtccttgcccagtcctaacaaactcctccgatctttccctgcccttcaggctgatttgatcaagcggaccactttgaccgtgatacgaatgatacccgacgatgtctatgctgaaatcgtggttcatgccaag

SEQ ID NO: 26772 - DNA, 1308 bp, Neurospora crassa
gatgtgctcttcaacaatcccgttttcgccggtggcatgggcctcgccggccttggcgccgccgccgcctttggtcgccgggctgccatccgtggtgccggattactgaaacgtcagatgctggtcaatgtcgagatcagcaagcgtgatccttcctataactgggtccttgcctggctggcgctgccgcgagacaacaccggcttcatcgcccagcgactgacgcggctccgcaacctctccgtctctaccaccaccaagtctatcacccccggcaaggacgaaggaagctcgcacgcagatttccgcgtgcaacccggctttggccgccacatcatccggcacaaacccggcgtgtacatcgccgtgaaccgggagaaggcgagcacgactcagacggcaacgggcgagccgcacgagacgctgaccctcaccctcttgtggccgcaccgacatgtgctgggcgagatcttcaccgaggcgcaccagatggcgcaccgcttccacgaaggcaagacggtcgtctacacggcgaagcgcatggagtggatgccattgggcaagcccaggctcaagcggcctcttggtagcgtcattctcgacaagggcgttaaagagagcatcgtagacgatgtgaaggagttcttggcggcccagcagtggtacaccgacagaggcgtgccctaccgtcgtggctaccttctctatggcccgcccggtactgggaaaacgtcctttatccaggcgctcgcgggcgagttggattacagcgttgccatgatcaacctcagcgaggtcggcatcacggatgatttgctggctcacctgttgacccagcagcctgagaagagcattttggttctggaagatgtcgacgctgcgctcgtcaaccggagaccgagggattctgatggctacagcggcggcacagtgacgttttccggtcttctcaatgccctagacggtttggctgccggcgaaaaccggatagccttcctcaccaccaaccacatcgatcgcttggacccggccctgatccgccctggccgtgtcgacatgatgatgcgcattggcgaggcaaccaggcaccaggctgccgagatgtgggatcgctactatggtgacattgacacggaccattccggccgcgaaaggttcctcaacaggctagatgagctcggactctttggcgagaacaaccaggaccccgatgctcccaagagacatacctcgacggcggctatccagggtctgttccagttcaacaagaatgatatggaaggtgctattagaatggctgaaggcttg

SEQ ID NO: 26773 - DNA, 1868 bp, Neurospora crassa
tatgtctggcccgtcggccaccgaggactccaacttcgagtctttctcgttggctgctgcttgatggccatgaactttatccatgtgctgattccacgacaaatagggattgtcatggacagtcttgggggagtcaatcacaaggatccatggacacaggttctcatttttgcaggcctcaaactcactgcctccgaagctggtatttcgctgttgcgccagtggttatggattccagttgagagctactccacgtctcgcatatccacggctgcatattcgcatgttctcaacttatcgtccgattttcacgactccaagagctgttcagatatagagatggcgatcatgtcgggcaccagcatatcaaatatgcttgagtccatttgttttcaagctattcccatgctcattgacatgggagttgccttcatctacctctcggtcacattcggcccctacgagggtttcatcaccattgcgaccgcaaccgtcttctgttatattacggcgatcatgctgtcaggactaaaggaggttcggaggagccaagtgagcgcttactttgaggaacattacgtccgtcatgccgggattcagggctggtcaactgtcagctctttcaatcagatcggccatgaggaaacccgctattccgatgctgttaacaacaacgttgggcattatcggaaagtccttctggggtactacctggcttatgcgttccagtcgatggtcttactttgcggtcttctagctggggctttccttgctgtcagccagattacacaagggcaagcgactccaggccagttcgtgatgttgctgacctactggtctcagttggtttccccgcttaccttctttgcttcgcttgggaagagcatttcgggtgatctgattcgcgctgagtccctattggacatcatgcaaatgaagccgactgtcctcagcaaagaaggggcaccgccactcgactttcaaagaggacatgttcaattcgagaacgtatctttttcctacgacaagaaaaaaccgatattgaagagcgtcaactttcaggtagatcctgggacaagtgtggctttcgtcggggctacaggagctggaaaatcaacaatgctcaagcttctcgaccgcttctacgatgtaaccggtggctcaatcaagattgatgggcaagatattcgcaacgttgatctgtttaggtaagtacccatagcggatatctggtgggccgaggagctaataccaacgtgtagcttgcgagcccgaatcggtgtcgtaccgcagaatcctattctatttgatgacacaatcatgaacaatgttcgctacgcaaagctttcagccactgacgaagaggttcacgaagcttgcaaggcagccagtattcacgagcaaatcctgaccttcacagacggtaagtagataatctggtctgcgaagttggatctttgaagctaatagtgtcaaaggctatcagacccgtgtcggcgagcgtggtgtcaaactctccggcggcgagttgcaacgggtggctatcgcgcgtgccatcctcaagaggcctgctatcgtattgcttgatgaagccacgtctgcagtcgataccgagacagagcaaaatattcaggaagcactcggtaaactatgcaagggacgcacgacgttcattgttgcgtatgttttgataaaatcacaaccgttgtgtgccatactaacagagatttaggcatcgactatccactattatgaacgccgacaagattatggtcgttaccggcggagaaatcgtggaggagggaagccacgaagacctgatccgagcaaatgggaagtatgccgagctttggtccaagcagatcttc

SEQ ID NO: 26774 - DNA, 1298 bp, Neurospora crassa
cttatccacctcaagacgtacaaatattcggccgtcgacaagtcgcccgtctccaattacattcttaagccctacgtatgtttgccccaacacgagcgcctccctccgtctcgacattggaaaatacatcaaatgctaagattgaggcggtagtggaatgccttcgtcgagttcctgccactatgggttgcccccaacatggtgaccctgattgggttctcctttattgtggctaatgtcggcctcttattgatattcatgccagatctggtcggcccggtaagaccctcgaaactacccaaggcatcgagagcagtttcgttgctaaccgatgacatgatttaaccgtgtagggtccttcatggctatacttcagtttcgctttcggcctctttgcgtaccagacgatggacaatgtcgacggcaaacaggcgagacgcaccggaacctctagcggcctcggagagctcttcgaccatggcatcgacagtctcaactgcacactcgctagcttgctcgaaactgccgccatgggcctgggcactaccaaggccggtgtcttcactgcgctatgtccctgcctgcccatgtggttctcgacctgggaaacatatcacacccacaccctctacctcggatacatcaatggacctacagaaggaatcctgatcgcctgcttgctgatggcgatcagcgggtggtatggccctgaaatttggtccgaaagactagccgataacctccacctgttcagcttcctcgggttgaacgaagagaacctgggcgacacctcctttcaggacatttgggtctacttcctcattggcgccatgttcttccacattccgttttgcatcatcaacgtcgtcaatgcccgcctgtcgcgcaacgagcctcttcttccggtcttcctcgagtggacccctatcgtcgttttcacgctcagcgttggcacttggctctatagcccatactcgacattgatggatgagaaccacctggtccttttctgtgttaccatgagcttcgtctttggccgcatgaccacaaagatgattctcgctcatctcactaagcagcccttcccttactggaccgtcatgctctggcctttgatcggaggcgccctgattggaaacctccctcgtttcgggcttcctgctgtcacggcgcaattcgagcacctttacctgtgggcttacctggtgtttgccttcgtcgtctactctcgttgggcctggttggtcaccacgagcatttgcgacttccttggcatcaactgcctcaccatccccctc

SEQ ID NO: 26775 - DNA, 2496 bp, Neurospora crassa
atgaagctctcggctatcgcaacgccgctgggcttggccgctctggctatagcgtccaatgtcctcccccgcgacttcgattcgaacgattactatgttcttcatctcgatgcccgaacgtcacctactgaagttgccaggagcctaggattgtctcatgaggggccccttggtgaactccaggatcaccatctctttgttgggaggaaagccgagcacgatatcgtcaagagagaattgacggagcgccggcgccgaaaacgatcattaggcgacgagccccatgttctggatagtgttctcttttcagagaagcaaattttgcggaaaccttgggagaagcgcatggtcccccgaccagtaggaccctctagaaggggtctcttttccgatcaagaggttgactgggcagtcaagaagcaaaacgaagttatcgggaatttgggcatcagagatcccatattcaaggagcagtggcatcttttcaacactgtccagactgggcacgacgtgaatgttaccgggctttggctcgaaggcgtcactggaaaaaacgccaccgtcgccattgtcgacgatggcttggatatggaaaccgatgacttgaaagacaactactatgcccaagggtcatgggactttaacgacaagggtcctgatccaaagccccgattaagcgacgataaacacggaactcgctgtgccggtgaagtttcggccgggaagaacaaagcctgcggtgtgggagtagcatatgactccaggattgccggcctgcgtatcttgtcaaagctgatatctgacgctgatgaagccgttgctatgaactacgactttcagcacaatcagatttattcgtgctcctggggaccccctgatgacgggcagagtatggatgctcccggaattctcatcaagagggctatgctcaatgccgtccagaagggccgtggtgggctgggctcaatctatgtctttgccagcggcaatggtgcaggaaacggagataattgcaatttcgatggctacaccaacagcatctacagcatcaccgtcggagccgttgacagaaacggcgaccatccctattactctgaatcgtgttccgcgaatctggtcgtgacatactccagcggcggtggtgattcgatccacacgactgacgttgggaatgcttgttctgatactcacggtggtacctcagctgccgctccgctcgcagctggtatctttgctcttgttctgcaggttcgcccagatctctcatggagagatatgcagtatcttaccgtgaacactgctgttcctatcaaccttgacagcggcgagtggcagacgactgctattggcaaacaattcagccatatgtatggctacggcaaactcgacagctacgccattgttcaggcagccaagacctggaagaaggtgaagcctcaggcctggttctactctccttggatccatgtcaataaagcaattccccagggagacacgggagttgccgtcagctatgaagttacgcaggcaatgctggatgaggccaacgtcgagcgcctggaacatattacggttaccatgaacatcatgcatactagacgaggagatcttagtgttgatctcatcagccctaacaatctggtcagccatctttcggtcagccggaagaacgatgaggcccgcgctggctatgatgactggacattcatgagtgtcgttcactggtaagcgcacgcgttaccgcaattatccgaggtaatctttgctaacctgtacataaccaggggtgaaaccggcgtcggtaactggacaatcatcgttaaagacacccaaattaacagtcacgagggcgtcttcaccgattggcatctaaagctttggggcgagagcaaggacgcctccaaggccaaggtactcccgatgccgaccgaggaagacgacaacgaccacgccgccatccccacgaccaccctccccgctaccacgaccaccctaccacctcaacccatcgccaccgacaccaagcccagcaccgtgtccgaccatcccaaccgccccgtcaactcgaaaccaactcccaccgacgcccccaacccctcgcccacctctgacgaacaaacctcggagaccaccactcctgcaaacagcacctggctgccctccttcctgcccacattcggcaagtcagccgccaccatggtctgggtctacggctccgccgcccttatcggtgtcttctgcatcagtctggctgtctacttctggcttgcccggcgcaagcgcctgcgcaacaacccgcgtggcgactacgagttcgagctgctggacgaggaggaggccgagggtctggccggcggcggcagcagtgctgagaagcgcagggctggcgctggcggcttggcgggaggcaaaagaacgcgcggtggtgagttgtatgatgcgtttgctggcggtagtgatgatgaggatgctgatgatggggtttatcgtgatcgg

SEQ ID NO: 26776 - DNA, 1347 bp, Neurospora crassa
tcttcgtatcgcaatgccgtttacttcacaaactggtaggttatcaacgattagaaactccaggacgggcatacttactaaccgtcacaggggcatctacggtgccaacttccagcctcaacagcttcctgcctcacaaataacccacgtgctatattctttcgcagatatcaaaccagacggacaggtgtaggtctcacagtcctgacgatatagactttgaaaaggcactgactcctagcagagtatcttcggacacttacgcagaccttgagaaacgttatcctggcgactcgtggagtgaaccaggcgagaatgcctacggctgcgtcaagcaaatgtaccttctgaagaagaggaacaggaatatgaaagtcctcctttccattggaggatggacgtattcacccaagttcccaccagtcgccgccactgaggaaggacgacgaaggtttgcttcttccgccgtgaagcttgtgcaaggtgagtgagctccagggaacttctatcccgaggattagcacaaaaaagctctaacctaacccttcagattggggcttcgacggcctcgatatcgattgggaatatcctaccaatgcacgcgaggcacaagactttgtcctccttctccgggcctgccgacaagcccttgatgactatgcccggcaatacgcccctggctatcacttcctcatcaccatcgccgcacccgccggacctcagcactacggcgtcatggaccttcccggcatgaacccgtacattgactcctggcatctgatggcgtacgactacgccggctcgtgggattccaccacaggccaccaggccaacctcctccccagtcccaagaatcttctcacaaccagatttaacaccgatcaagccgtccgcgacttcgtccgccgcggcatcccagccaacaagatcgttctcggcctgccactatacggccgctcgttcgaaggcactgacggactaggtaagccgtacagtggcatcggcgccggcacgttggagccagggacctgggtttacagagaccttccgcgccccggagcgaaggaggagtacgacaacctggccaaggccacttatagctacgacgcattgtcgcgcgagctcatcacgtatgacaatgtcctgagcgctctggtgaagacgaagtacatcttccttaggggactgggtggtgcggtgttctgggaggcaagcggtgacaaaactggtgcggagagcttgattggaacgttggcgactcagatgaagaggctggatcagacgaagaatctgttggcgtatcccgctagtaggtatgctaatattcgggctggtgtgccagaatcc

SEQ ID NO: 26777 - DNA, 1662 bp, Neurospora crassa
aggggaaagcttacaatcaaggtcggagaggcacggggcttgaggaggtgccgagatccatatgtggtcgtggtctttcagcgtagcgagctgatttcgccaggccctcgccgtgcggctgagaatgacgatgacgccgcaatcgcagccgtccagacaggcggtatccctattcaacgtcaaagcagtgactccggccgaccgatggcaattcccatgcgaagtcggcagagtagcaacacaagtcttactgacttcaacacgtttcggaggcgcaactcgtcccaatctcggcggtctttcactaatcccacctgggacgctgaggccgttttgtaagtgacccgatacgtggggttatgcttaaaatactgacgagtctctagtgatgtggtagactcggacatgcttgtcgacatctccgtatatggccaagggccatctggtgaggagtttcttggacacgtcgacttccaggccaacaaagccgagccaatccgaggttggtttcccctgcaaggccatgccgacaccatggccgagaatgcgccgacgggcgaactttacgtcgaagcgcactaccagagagccgaacagaagcattttggtcccgaggacttccagattctccgacttattggaaaaggcacattcggtcaggtgtatcaggttcggaagaaggacaccggtcggatctatgccatgaaggtcctgtctaagaaggtgattgtccagaagaaagaggtggcacatacagtgggcgagcgcaacatcttggtccgtacggccatgtccgactcaccttttatcgtggggctgaagttctccttccaaacaccatcggatctttatcttgtgacggactacatgtcaggtggagagctattttggcacttgcagaaggatggcaagttcgaggagaagcgcgcaaagttctacattgcggagctcatccttgcgatccaacacctacacgaaaatgacattgtataccgcgatctcaagccagagaacatcctcctggacgccaatggccacatcgctctctgcgatttcggtctttccaaggccaatctgacgaagaacgacaccacaaacactttctgcggtacaaccgagtacctagcacccgaagttcttctcgatgaagctggttacaccaagatggtcgacttttggtctctgggcgttctcgttttcgagatgtgctgcggctggagtccattttatgctgaagacacgcaacaaatgtacaagaacattgcctttggcaaggttagattcccgcgcgacacactctctctagaaggccgaaatttcgtaaagggacttctaaaccgaaaccccaagcaccgccttggtgctaccgacgatgccgaggagttgaagaggcatgcctttttcgccgatatcgactgggatgcgctttccaagaagctcattacaccgccttttaagccgcagctcaagagtgacaccgatgtgtcatattttgaccccgaattcacgaatgctctcaacgccaacggatcactcaatgagcgtgcagctgcgctagccagaggctatgccacgtccactccgctctcaccttcggtacaagccaacttccaaggctttacgtttgttgacgaaagcgcgcttgaagagaacatgcacgat

SEQ ID NO: 26778 - DNA, 1131 bp, Neurospora crassa
gagagctacgaaatcaacttggagcacgattttgccgtcgatgggaacctcagcactacaattggttctaccgaagccgtggaaattggctctgacggtggcgttgcccgctcgcagaagatgaccgcggatgactttgagcccctacgatgtctgggcaagggaacgtatggtaccgttctactggtaaagcaacgtaccactggccgtctctttgcgcagaagcagttcaagaaagcatctctcgtggtgcacaagaagctggttgagcagaccaagacggaacgccagattctggaaagcgtcaatcgccacccttttgtggttaagctcttctacgcctttcaggatcaggaaaagttgtatctcattcttgaatacggccaaggcggtgagctcttcacccacctgaacaccgaaaagatgttttcggagtcgacggcagccttttacatggcggagatggttcttgccctgtcccatcttcataccaccctgggcgtcgtctatcgagacctcaagcccgagaactgcctcctcgactccgaaggccaccttcttttgaccgactttggcctttccaaggtggcgattgaatctgaggagtgcaattcgatgcttggtaccgtggaatacatggctcccgaggttatccagggcaagaaatacggccgctcggttgattggtggtctctcggtgcccttggcttcgacctgatgacgggcaatcctccgttccgtggagggaacaatgccaagatccaggagaatattgtcaagcagaagctcatcatgccctacttcctgactgcggaggccaaggacctgctgacgcggttgctgcgcaaggatccagccaagcgcttaggctcaaacatgcccaaggatttagacaccatcaagaagcaccggttcttccgcaagatcgactggaagaagcttgcggctcgtgaactcgagcctcctatccagcccatgattacggatccagagcttgcggagaactttgcgcccgagttcacagagctgagcctcagtccagttgtcagtcgcttggaggagcgatatgcggccgccgctgccaaggatgatctctttggaggattcagctttgttgcatcgaacagcctc

SEQ ID NO: 26779 - DNA, 1081 bp, Neurospora crassa
cagtggtactttacacccgacgaagtagcgagcacacccagcatcatagatggactctctgtgtcggaagagcgcctacgaagggccaaaggcgtcaactttatttttcaggctggcatcatgcttgacctcccgcaaatcacattgtgggttgccggcgtgttcttccaccgcttttacatgcgaagaagcatggtggaagagaagggtggcattcatcactacgtatgtcttttcatgtcctctaaccaattgttatggcgcccgtgttggaagtcgtgttcagcaaccaggatgtggccattcagttctgaggatgcgcaacatcaactaacccatttcatatatgcagaatatcgctgctacagcgctcttcctcgcgaataagacagaagaaaattgccgtaaaacaaaagatctgatcattgcggtcgcaaaagtcgcccagaaaaatacgaagctgatcatcgacgaacaaagtaaggaatattggcggtggcgcgacagtattcttaactacgaggaggtgatgctggagcagttgacatttgatctcatggtcgggattccataccacccactatacgagtttcttaacatgctagagcaggacattcctctgcagcaacaagaaagcagtcaaccgcagcaagatctctccaagcagaagcagcatctggttcgcaacaaggccttccgtaacgccgcttggacttattgcaacgacttgtgcctcacagtcctgcccttgctactcaatgcgcgcgacatcgccatcagtgccatctttttcgccgcttccatcctcaaggagaaagtagacgatgtcgacggggaggcctggtggaaataccttaagggggacgagggcaaggtgtgcatggctatggatgtcattaccgagttctataaggagaacccattgaggaaacaggataacaggatgtctccgtctcccacgttcaacctcgagagtactaggcgtagacttggaacggcatctagtcagcaggagggcgatggtactccgatggagacagaccgcagtacacagagccctaggagctccagtggccgccat

SEQ ID NO: 26780 - DNA, 2367 bp, Neurospora crassa
ttgacaaccacaggccatggctcgtttggcatcatccgaaaggtgcggcgcaaagccgacggcatgatcctctgccgcaaggagatcagttacctcaagatgtcgcaaaaagagcgtgaacagttgcacgccgagttctcgatcctctcgaccctacgtcaccccaatatcgtcggatactaccaccgcgaacatctcaaagctacccaagacctacatctctacatggaatactgtggcaatggcgacctgggccgtgttatccgcaaccttattaagaataaccagtacgcggaggaatcgttcgtctggagcatcttttcccagcttgtcaccgctttgtaccgctgccactacggcgtcgaccctccagaagtcggcaagactgtccttggtttgggctcaacagcaaggccaaaacctccttcgggtggcatgactattctgcaccgcgatctcaagccagagaacggtaggtgaccctgtgatacgtatgtggactggtctaacgtgctgcctcgtagtgttcctgggcgaagacaactcggtaaagcttggtgactttggactctccaaggtcatgcagtcgcacgactttgcctcgacctacgttggcacccccttctatatgtcgccggaaatctgcgcggcagagaaatacacgttaaagtcggatatttggtcattaggatgcatcatatacgagctttgcgcccgagagcccccattcaacgccaagacgcattaccagctggttcagaaaatcaaggagggtaagattgcgccgttaccttccgtttactcgggagaactctttgcaacaatcaaggattgcctgcgcgtgaaccccgatcgaaggccagatacagccacacttttgaacctgccgattgtacgtttgatgaggaaggaaaaggaagttgtggaattcagcaggactctcagaacgaaagaggagacccttaacaagcgtatccgcgagcttgacagcaagttgtccgcactcgaaaccgaaaaatcgtccattcgcgccgagatcgatgcctcactgaggagggaatgggaagtcaaggcgcggctggagattgaccgtttggtggcccaggaaatcgaatctctacaacaaaagttcgagcaggaggttcaggcgcgggtagaagcagagctacaacggcacgggagaggacccatgttcaacagtcatggccagcagggctcgttttcttcgactgctgctacattagtgtctgactacaacctgtcctcagtcggtagcggtgacggcgacttcccttctactacggacatcaccgatatctcgattgccgagtcgactgatggctctgacatcacaaagaaaatcccgcgaacacccttccacagagcgcagacatattcttccgcacccgctgaatctgtacttggcacgccaatggacattgaaatggcctcaccctcacctatcacgatcgcttccctctccctttcgccccgtcggatggctttgacaaaagcgccgaccacaaacccacggatgatctttggcgaggagccaacttctacagacaagagcaactgggaggttccaagagaaacagagatgatagactctggcgacgagtccgaagcggaggctctggttccttcaccgaaacgtatcactaaatccagcaagaaccctttcagtactgtcacaaccaggtcgaggccgtcgctcaactcgcaacaaaactccaatgttctcccaatccatggcttacgctccaaacagacattagccacccgctctaagacagttagtggagtttcgtcgataggacaacatccccttcgttccgcacccagcgccccctccctgcgagaccgcaaacccagcccaacccgacgactcagtaggataccatcggtaacgggcgtgggcagaagactcagcgcgaacaacatcaacaacagcagcaacggcggtagtgacgcgccatcctcgaccgtcacgtccaacataaccgtcagaacacgaggtctcaagcggatgtcgtccacatgcgatgaatcgtcgttcagccagcaacaaaacaaccaaccacaacagtcactgccacaagctccgcctcttaagaagatcggacttatggccgccaagaacattcgcggaagctcgctcgtcgagctgcaccaggctcgcgccggtggtaggcccatcagcgcgatcatttccaacgaagccaaactacgcgcctttaaggaacacgcgacaatcgcggcatcagcagtggacagcagcagtagcagtagcagcagtagcggacagtcgcaattaccgacccgaccacgatcacaaccccaaccgataaccgcaaactttgagca

SEQ ID NO: 26781 - DNA, 1464 bp, Neurospora crassa
ttcaaaaacgagatcattaggctggcacacactcttaggttaaaggggtggaggcgcattccgctcaacggtggtgagacgatctctgttgagcgactcagcggagcgctgacgaacgctgtgtatgtggtgtcaccgccccctgaatctattttgcctccgcaggagggtaagagacagccggaaaaggtcttgctcagagtctacggcccgcaagttgagcatttgatcgaccgagaaatcgaattgggcgttctcaagcgcctggcgagaaagaagattggccctcggttgctcggtacttttttgaacggccgcttcgagcagtatttcaactccaccacgttgacgccagagaatcttcgtgagcctgagacatccaaacaaatcgccaaacgcatgagagaactccatgacggcgttgagcttcttgagcatgaaaaggatgaaggtcctggtgtctggagaaactgggataggtggctcgaccaggctgagaagacggccatgtacctcgacagccaggttgcagcccagcttcaagaatccactcgccacaaggagacttggaagactaggggtttcgtctgcggtgtcgagtggcccgtgttcagaaagatggttcagaagtaccgcaagttccttgaggactattatggcagccctaccaaaataagggaaaagttggtctttgcccataatgatgttggtccaccgcatatcctgttattcactgagaaaaattattaaccaagaatctagactcaatacggtaacattttgcgcattcggcccgacgataagaagtcgcctttgctgcagcccgccaacgaacacaagcagttgatcgtcatcgattttgagtatgccggagcgaacttggccggcctggagtttgccaatcacttctccgaatggacctacaactatcacgaccctgttacgccacatgtttgcgacgctgccaagtatccaaccctcgaacagcagcggcggttcatcaaggcctacgtggaccaccagccgaagttcccttcggtacctggtgtatcaacaccatcggtgacaccgtcaagcgcggagacgcctaggcccggcatgcttcagagcaccaactcggcaagctccattgtggaattcatgttggacgcccgcgtgccgccaggtgggtggaaagaagaggacgcccgtcgtgaagccgagtcggagaagaggattaaggaactcttggaagaaacccggctctggcgggttgccaacagcgctcaatgggtggtatggggcatcatccaggcgaagattcccggactgaatgacggggcgaaagacgtggtaacggcgcccgcaggcagcgtgcctgacgaggagcttgaggcggaagaggaggctgatgcgttcgactacctgggctactcgcaggagagggcctttttcttttgggcggactgtgtacgccttgggctt

SEQ ID NO: 26782 - DNA, 2256 bp, Neurospora crassa
aaggttcgagcttcagtacgaaattacgatgtcgagatgcccgtcaacaccatccgggcctggactatcggcatgttgctttgcactatcggttccgctgtcaatatgcttctctcgttgcgaaaccctagcatctcgttgtcgactttggctatccaactcatagcataccccatcggcctgggctgggatctcatcttccccgaccgtgttttcaccgtattcggcatcaagttcaacctcaaacccggaccattcaacttcaaggaacatgtcatcattgttgtcatgtccaatgtacgtctggccttctgttatgttaagccagccgctaactccttcttccttaggctgcgtatggcggtggtgctttgtatgctactgatgtcattcttgctcaggagatctggtacaaacagtcattcggctgggcctggcaaatcctcttcggcatctcgacgctctgcactggctatgggcttgccggtttggcaagaaggttcttggtttggcccgctgccatgatatggcccgcggatctcattaactgcacactcttctacaccctccacgatcactcgccctcggatccggcaaggacaaatggttggtcaatcagccgataccgatggttcttgattgtcatggccggatcatttgcgtggtactggtttcctggctatctttttcagggactatcttggatgtgctggattacctggatctggcccgacaacgtcattgtcaatcagctgtttggcggacaaagcggatatgggctattccctatcactcttgtgagtggtttacaattactgggcgaaatcaatttcatgtgctgactctctttaggattggtctatcatctctgggtatctcctgtcacccctcgcgtcgccatttcatgcgatcgccaacgtcgtcggcggtgtcacgtttttcttcgttattgtctcccttggaatccaatattcgaatatatggtactcagcttatctgccagtccaagagtcgcactcgtacgacaacaccggaaagaggtacgtcgttttgcgcattcttaacgaaaacctgcatttcgacgaggccaagtaccacgcatactcgccgctttacctccccacccagtttgcccttgcatatgggctgtcttttgcagctgtcgcagccgtcattgttcacgttggcctctaccacggcaaggacatctggaatcagtggaagttggcccgtcatcaagaagacgatgtccacatgcgcctcatgaagaaataccgtgacgccgaggattggtggtatattatcctatttgccgtcatgcttggtatgtcctttgccgtggtgtgcgcctgggataccggctttccatggtgggcgtttatcatctgcatattgattccggtggtgtggaccattccgatcggaatcattcaggccattaccaatattcaattaggactgaacgtcttgaccgagtatgtcatcggctacatgctccccggccgccccttggtcatgatgatgttcaagaactacggttatctcgtcatgtcgcaggcgctctatttcattcaggatctcaagctcggccattacatgaaggtgccacctcgtgtcatgttttggtcccagctgatagcttcggtttggtccgccattgtccagatcgccgtcatgaactgggcgctcggggcaattcccgatatttgcacagacggccaggccaaccaattcgattgccccagtgccaaggtatttttcactgcgtccgtcatttggggtgcgattggaccggcccgcatgttctccggtaaagcactgtatagctctttacagtggttctggctggttggtgccgttgctcccgtgatttcgtggtttttcgttcgacggtatccgcgctcgctttggcgctatgtcaacttcccgctggtgtttggcggttcaggctggattccgcccgcaactgtttacatctactactgctggggcatagtcggcactgtcttcaactttttcattcgccgtcggaagacgggttggtggctgcagtacaactacctcacctcggccgcccttgacgttggccttttgctgtcgactctcgttatattcttttccctcacactatcacacaccaaagcgccagaatggtttggcaacacagtggctaagagcaccatggatacgaccgccacagcggtacagaaactcgttccgccaggagagatctttggacctcgcgaatggccatag

SEQ ID NO: 26783 - DNA, 1095 bp, Neurospora crassa
gcttattatgccgaggtcactgtgggcactccgggccagaaagtcagcgttgtgttggatacgggaagcagcgacctctgggttgtgagctacaaggcggatttatgcaccgacccttcaattcagcggcaatggggggattcgtgcgacaagacgtacaacccgaccaagagctcttcgtacaaggtcctagaggaggatagcttcgagatccggtacctcgacaatagcactgccgcgggtgactacattacggacgacctcaatattggcggagccactatcaagtctctgcagatgggctatgcgaccaagaccgtccgcggcgccggcatcttgggcgtgggctactcatccaacgtggcttcccaacaacgctaccccaacctgattgaccagttcgtcgcgcaaaagctcatcaccaccaaggcctactctctctacctcaacgaccgccgcagcgacacgggtagcatcctctttggcggcatcgacaaggacaagttcattggcgacctgtcgatcctgcccatttacctggccaaggggcaagccgagcccatccactttgaagtcgagatgcagagtgtctcgctcgccctgaccaagaacggcaagaccaccaagatcatctccaccgacccgtccctcagccaaacctcgaccatcgccatcctcgattccggcaccaccctctcctacctgccctccaagatcaccgaccagatccacaccaaactctccgtctacgtcgacgaaatctggaccggcctgactttcatcgactgccagtacctcacctccaacccggacctgcgtttgtcttttacctttggcgccaacgccaccatctccgtgcccgtttgggaactcgtcctcgacctgctaggcgagagccaatccgagctccccttcaagatgcccttcaagaacgcctgcatctttggcatccagagcaccgccggcttccaagaggacaacttcgatgaggactgggccctcctcggtgagacctttttgcggtctgcctatgttgtgtacgacctcacccaccaccagatcggcatcgcgcaggcgaacttgaacagcacgacg

SEQ ID NO: 26784 - DNA, 2054 bp, Neurospora crassa
tccgtggtatcaacatcacagcaacttgccgttcgagcactaccggattcgcccagcggtggatatgcccctgccgttgtagactgtcccaagaccaagccgacgctccggaaggccgtggatttgtcgaacgaggagaagaactggttgtcgatccggaggaagaacaccatccagcccatgagggacctcctgaagagggccaacatcactgggttcgattccgagacatttatgaatgaggccgccaacaacatctcgcaactgcccaatgtcgccattgccatttcaggaggcggctatcgtgccctcatgaacggcgccggcttcgttgctgctgcggataaccgaattcaaaataccacgggcgcaggtggtattggaggcttgttgcagtccagcacatatttgtatgtaaagtggttcttcttatctcgttttcgagtgtcaactgcgccagttcagagttgggcggctgtggacgaccttgctggtgaacatgtcttggactccatgccccttcttcgtttcctcaaatcaagaagtcgaggaccgtgaccgtaaatcgctaacgcaactctagggccggactttctggtggtggctggcttgtcggcagtttgttctccaacaacttcagcagcattgagaccctgctgagcgagaacaaagtctgggactttgagaactccatctttaaagggcccaaggaggctggccttagtactgtcaaccgcattcagtactggtccgaagtggcaaaggaagttgccaagaagaaggatgctggcttcgagacaagtataacagactactggggccgagcattgagttaccaactgatcggagccgatatgggcggcccggcttacaccttctccagcattgcccagaccgacaacttccagaaggccgaaacgccgttccctattctggtagctgacggccgcgcgcctggagacaccatcatctccctcaatgctaccaactacgagttcaacccgttcgagacgggtagctgggacccgaccgtctatggctttgcgccgaccaagtacctcggcgccaacttcagcaacggcgtgatcccatcgggaggcaagtgcgttgagggtctcgaccaagccggcttcgtcatgggcaccagcagcacgctcttcaaccagttccttttggccaacatctccagctacgacggtgtgcccgacgtgctcatcgaggccgtgacttctgtcctcaaggaaatcggcgccaagagggacgacgtctcccaaatcatccctaatccgttcctggactggaacaaccggaccaaccccaacgccgacacgctcgagctcgacctggtcgacggcggcgaagatctgcagaatattccgctcaacccgctcacccaacccgtgcgcgccgtggacgtcatcttcgctgtcgactcgtccgccgacgtgacaaactggcccaatggcaccgccctgcgagccacctacgagcgcactttcggctctatttccaacgggacactcttcccctcgatccccgacgactggacgtttataaacctaggcctcaacaaccgcccctctttcttcggctgcgatgttaagaactttaccttgaacgccaaccaaaaggttccccccttaatcgtctatgtccccaacgcgccctataccgcgctgagcaacgtgtccaccttcgatccgtcatacaccatgtctcagcgcaacgacatcatcggcaacggatggaactcagccacgcagggaaacggcacgctggattcggagtggcccacttgcgtcgcctgcgcggttatcagcaggagcttagatcggttgggcaggcagacgccagccgcgtgcaagacttgctttgagaggtattgctggaatggcacagtgaactcaaaagatacaggggtttacatgcctgagttcaagattgcggatgcgcatgccctggactcgggtgctgttgctatcggaaagatggtgaatgtctggtcgtcggttgtggtgggagttgtggcggctactttgttgttgtaggggtag

SEQ ID NO: 26785 - DNA, 2673 bp, Neurospora crassa
atggagacaacacttcccctccccttcctcgtcggtgtcagtgttcctcccggactgaatgacatcaaggagggcctcagccgggaggaagtctcgtgtcttggctgcgtcttcttcgaggtcaagccccagacccttgagaaaatcctgcgattcctcaagcgtcacaatgtcgaatttgagccctacttcgatgtaacagccctcgagtctatcgatgatattatcactcttctggacgccggcgcccgcaaggtgtttgtcaagaccgagcagttggccgacctctccgcatatggctcccgcgttgcccccattgtcactggaagcagcgctgctttgctttcctccgccaccgagagcggccttttgctctccggcttcgatcagactgcctccgaggctgcacagtttctggaggaggccagagacaagaaaattacccccttcttcatcaagcccgttcctggggccgatctcgaacagttcatccaggtcgccgccaaggctaacgccatccccatcctgccatccactggcttgacaacaaagaaggacgaggccggcaagcttgccatctccaccatcctctcgagcgtctggaagtctgaccgtcccgatggtcttctccccaccgttgtcgttgatgagcacgacactgctctgggtctggtctacagcagtgccgagagtgtgaacgaggccctcaggacacagactggtgtctatcagagccggaagcgcggtctctggtacaagggtgctacttccggagacactcaggagctcgtccgcatctcgcttgactgcgataacgatgctctcaagtttgtcgtgaagcagaagggtcgtttctgccacctcgatcagtccggctgctttggtcagctcaaaggccttcccaagctcgagcagactttgatttcgaggaaacagtctgcccccgagggctcctacactgcccgtctcttctccgatgagaagctagtccgggccaagatcatggaggaggctgaggagctctgcaccgctcagaccccccaggaaatcgcctttgaggctgccgatctcttctactttgctcttaccagggccgttgctgccggcgttactcttgccgatatcgaaaggagccttgacgccaagagctggaaggtcaagcgcaggactggagatgctaagggtaagtgggctgagaaggagggcatcaagcctgcggcgtccgctctcgctgccacttcggcccctgtcaccaaggaggccgcccaggagaccacccctgagaagatcaccatgagacgtttcgacgcctccaaggtctctaccgaggagctcgatgctgctctcaagcgtcctgcgcaaaagtcgtccgatgccatctacaagatcattgtccccatcatcgaggacgtccgcaagaacggcgacaaggctgttctgtcgtacactcacaagttcgagaaggctacctctcttactagccccgtcctgaaggcgcccttccccaaggagcttatgcagctccctgaggagaccattgctgccatcgacgtgtccttcgagaacatccgcaagttccacgccgcccagaaggaggagaagcccctccaggtcgagaccatgcccggtgttgtctgcagccgtttctctcgtcccatcgaggccgtcggctgctacatccccggcggtaccgccgttctccccagcactgcccttatgctgggtgttcccgccatggtcgccggctgcaacaagattgtgttcgcctctcctccccgcgccgacggaaccatcactcccgagattgtctacgtcgctcacaaggttggcgccgagtccatcgtgcttgccggcggtgcccaggccgtagctgccatggcctacggcaccgagagcatcaccaaggtcgacaagattctcggccccggtaaccagttcgtcactgctgccaagatgttcgtcagcaacgacaccaacgctgccgttggtattgacatgcccgctggcccgtccgaggtgctggtcatcgctgacaaggacgccaaccccgcgttcgttgcctcggatctcctgtcccaggctgagcacggcgttgacagtcaggtcatcctgatcgctattgacctcgacgaggagcatcttcaggctattgaggacgaggttcaccgtcaggctacggagcttcctcgcgtccagattgtccgtggctccatcgcccactcgatcaccgtgcaggtcaagaccgtcgaggaggccatggagctcagcaacaagtacgctcctgagcacttgatcctccagatcaaggaggccgagaaggctgtcgatcttgtcatgaacgccggtagtgtcttcattggcgcctggactcctgagtccgttggcgattactctgctggtgttaaccactcgctgcgtaagttacatatcataaatagccccgcttcacagattcttctgctaacgtcaagacacatagctacctatggctttgccaagcagtactctggcgtcaatctcgcctcgttcgtcaagcacattaccagctccaacttgactgccgagggtctcaaaaacgtcggccaggctgtcatgcagttggctaaggttgaggagctcgaggctcacagaagggcggtcagcatccgtcttgagcacatgagcaagagcaac

SEQ ID NO: 26786 - DNA, 495 bp, Neurospora crassa
tccaccgctgcttctgctgctgccgccgcctcctcagcagcttccaacccccgcccccgcgacgcccgcacaatcgagctcctcctaaccgcgcaaggcgtaacggccttcgaacagcgcgtcccgcttttgctgctggacttcgcctaccgccacacctcggccgtgctctcagacgctttacacctctctgcggacccgtacacctcgcacgcgggcgcccggccctcggcctcttctggcgcggcccccgtcaatgtgggcgacgcgactattacaagtaacgcggtgcagctggcgattgccagccggctgaacttccaattccgtggcggaagcgggggcgggagcggtggtggtgtcagcaaggagtggatgatggagatggcgagggagaagaataaggtggcgttgcccaaggtcagtgtgaacgagtggggggtaaggttgccgagcgagaggtttgtgttgaatggggttagctggggtttgaag

SEQ ID NO: 26787 - DNA, 1806 bp, Neurospora crassa
caagacgcttcggaaccagatgaagagtacataccaacaagtttcgactgggcaagtcggccaatgaagaatccgatacctgaatcctcacttgtacagcttcccaaaggccctccccgtgagcttccgcgtattcaatatgccttcaccgcagacgaacttggcaaggcgcataacgagacccaatggtatcgaagggatgccgtcagaaaggccgctcaaaaatcatggaagtcttaccgagcgtttgcctggcgacatgacgagctcactccgcagtcgctgactggaaaggatagctttgcaggatggggtgctaccttggtggactctctcgacactctctggatcatggggttgagggaggaattcgatgaagctgtgcgcgcggtgggggccatcgactggaataagtcatcgtcttcgcactgcagcttgtttgaaacaaacatcagatatctcggcggcctaatctctgcctacgacttgagtaaccgggagatcctcttcaagaaagcggtagagctaggtgacatgctctttgcaggctttgacactcccaaccacctacctgccaactcttatgacttcaggaaggctaaggttggtgagctgagcgcctcatcacgccagtcccttgcggtcctcggttccatgtccatggaattcacccgcctctcccagttaaccggtgaccccaagtactactccatcgtggagcagctgaaaaagggtcttgaaaagacccaagagcaaaccaacctccccggtctctggccgaagtacatcgaccttatagaaggaacccgccccaggtccgacaccctcttcaccctcggcgcccaagccgattccgcctacgaatacctctccaagacctacctcctcctcggcggcctcgacccttcctacgaactgatgcacgtcaaagccatggacgcggccgttaagcacctcttgttccgccccatgctcccgtccggcgacgacgatacatacgaagctgggtctcctcctcccgatattctgttctccggcaacgccgtgtccacccaacgcgataaatccgatctccagccgcgcgttcaacatctcggctgttttgccggcggtatgtttgcgctgggcggtaagctctttgacaggcccgaccatgtgcaaatcggcgagcaattagcccggggctgtgcgtgggcgtatgaagccttttccactggcatcatgcctgaggtttccgagcttgtgccgtgcgacaaggtagtagagcatgaggccgaagaaaatgacgaccatctcgcccaatgcccctggaacgaagcaaaatggcgacaaaggaaaaagaaagccgccgccgctgctgctgccgcagctgcaatgaacacccgtttcgcctcagataccaccaactcccaaaccaccaccctcccaaaaccttttaccaaactcctcgacccccactacctcctccgccctgaagccatcgaatccctctttgtcctctaccgcataacggggaaaaaggaccttttggacatcgcctggcgcatgttccaatccatcaccaaggccacagaaaccaagtttgccttctccgccatcgaggatgtgcacattccaaatccgggacagccgaccaccaaaacagactcgatggagagtttctggatggcggagactttgaagtatttctatttgatttttagtcctgaggatggcgctgcggaagggtccggtggggaggaggagggggtgactttggatggatgggtgttcaataccgaggctcatccgtttagggtaccgagg

SEQ ID NO: 26788 - DNA, 1020 bp, Neurospora crassa
ggcagaggaaaatactccgaggtgttcgagggaatcaacgtggttaactaccaaaaatgcgtcatcaaggtgttgaagcccgtcaagaagaagaagatcaagagagagatcaaaattctccagaatctggcgggcggccccaacatcgtcgccctgctcgacgttgtgagagatagccagagcaagaccccctcgctcatcttcgaatacgtcaacaacaccgagttccgcaccctgtaccccaggttcaacgacttcgacgtccgctactacatcttcgagctcctcaaggccctcgacttctgtcacagcaagggcatcatgcaccgcgatgtgaagcctcataacgttatgatcgatcatgagaacagaaaggcaagttttcaaaatctcgggaatgaagcgcgcatcagcttcgagctaacacattctcttgcttgtcacagctgcgccttatcgactggggtctcgctgagttctaccaccccggcaccgagtataatgtccgggtcgcctctcgctacttcaagggtccggagctgcttgtcgattttcaggaatatgactacagcttggatatgtggagtttgggcgccatgttcgcatccatgatcttccgcaaggagccgtttttccatggtcagagcaactcggatcaattagtcaagattgctaaggtcctcggcacggacgagttgttcgactaccttgataagtacgagattgagctggacgctcagtacgatgacattctcggccgcttccagaggaaaccctggcacagcttcattaacgctgagaaccagcgtttcgtttccaacgaggctattgatttcttggacaagctgctgcgctacgatcataacgtacgtttttgcactcgaatttgtctcgctcaataccgctgtaacactagaaactgacatgatacttttccaggaacgtctgaccgcaaaggaggccatggctcacccttacttcgcccctgtccgcgacgaggccacacgtgcgcggtatctg

SEQ ID NO: 26789 - DNA, 1207 bp, Neurospora crassa
gtctctccagaagaacaaccgttcatcagcccaagacttatcctccggtgcatatagcagcaacaacagcaacaccaataacaacaatgtgggagcatctgaagaagacgacatggctaatgcccatctgtcggaccaaatggagcgcattctcaagctgttcgaggtcattagtgctcgatccgacatagaccacccaatatgtatcgagtgctccgacatgctggtggaggaaatgcaaaagaagcttgaatctgccaaccgggagaaggatgcatatgtcaactatctcaaggagctaaaagcctccgagccaacggacgaggagattcgagcacaagaggaggccacccgcaaagcgaagcaggcagaaaaggagttgctggaagaactcaaggccctcgagcaggaacaggcggccctggagagggagaagcttgagctagaggcggaaatacgcgaggtggacatcaaggaagaagagttctggcgagcacgaaatggcttcaacaccaccctgatcgatttccagaacgagcgggacagcatcaacagcaagttcgaccatgactcccggcagctggagaagctccagcgcagtaatgtctttaacgatacattctgcatcagccacgacggcacctttgccaccatcaacggcctccgtctcggtcgcatgcacaacgtccccgtcgactggcccgaaatcaacgcggcatggggccacgccctcttgctactcgtcaccgtggccgagaaactcaacttccgcttcgaaggctatgaaccgcaacccatgggctcaacgtcgcgcatcgtccgcatcgaacctgcctcaacgtccatggcatcgtccttctaccctagccgacccgtggatgccaacgccccgccgccgcccgccaagcggaccgtcctcgagctttactccagcggtgattttccactcggctttacttttattcatcgcaagttcgacacggccatggtggctttcctcgagttggtgcgccagctgggcgttcacgtgcaggaacagacgcggagggaaggtaatccacttagcctcccttatcagatccagggtgacaagatatcggacgtctccatcaaattgggcgttcagcaggacgatagctgggctaaggcttgcaagttgacgttgacttgctgcaagttcttgctcgcgcatgcaagcaatgtgagt

SEQ ID NO: 26790 - DNA, 852 bp, Neurospora crassa
gagatcaagaaggccttcgtcggcggcgaccagggatggctcagcctcaagctcgaggaggttgagctggtcaaccacaacaccaagcgcctgcgcttcagactccctgaggacgacatggtgtctggcctccatgttgccagcgccatcctcaccaagttcaagcctatcgatgctgagaaggctgtcctcaggccttacactcccatcagcgacgagagtaagtattttcgtattgactcattggtttcccacgatagtacgttgactaacgtccgagcaacaggtgcccagggctacattgacctcctggtcaagaagtacgagggtggtcccatgagcacctacctccatgacatggctcccggccagcgcctcgacatcaagggccctcttcccaagtacccctgggaggctaacaagcacaagcacatcgccctcgttgctggcggcaccggtatcactcccatgtaccagctcatccgcgccatcttcaacaaccccgatgacaagaccaaggttactctcgtcttcggcaacgttagcgaggaggacgttctcctcaagcacgagctcgccaccatcgagaaccactacccccagcgcttccgcgctttctacgtcctcgacaaccctcccaaggagtgggccggtaacaagggctacatcaacaaggacctcctcaagaccgtccttcctgagcccaagaacgaggatatcaagatcttcgtctgcggcccacccggcatgatgaactccatctccggcaacaagaagagccccagggaccagggcgagctgaccggtatcctcaaggagctcggctactctcccgatcaggtatacaagttc

SEQ ID NO: 26791 - DNA, 1580 bp, Neurospora crassa
ggtcagaatttgatcctcaacatggccgaccatggcttcaccgtctgcgccttcaaccgtaccgtttccaaggtcgaccacttccttgccaacgaggccaagggcaagtcgatcgttggtgccaagtccaccgaggagttcgtctccaagctcaagtccccccgccgcatcatgctcctcgtccaggccggcaagcccgtcgatgactggatcgagactcttctccccctcctcgagaagggcgacatcatcattgatggcggtaactctcacttccccgacagcaaccgcaggacaaagtaccttgcctccaagggcctccacttcgttggttccggtgtctctggtggtgaggagggtgcccgctacggcccttcgctgatgcccggtggtgacgaggctgcctggccccacatcaaggacatcttccagtccattgctgccaagagcgatggcgaggcctgctgcgagtgggtcggtgacgagggcgctggccactacgtcaagatggtccacaacggcattgagtacggtgacatgcagctcatctgcgaggtcagtagccccaatgcactctgccatacgtggtttttgaggcgaatgaggacaccgatctaactgatgacttggtacaggcctacgacattatgaagcgcggtctcggcctctcccacaaggagatgggcgatgtgtttgccaagtggaacaagggcgttctcgactcgttcctgattgagatcaccagggatatcatgtacttcaccgacgatgatggcactcctctcgtcgagaagattctcgacaaggctggccagaagggtaccggcaagtggactgctgtcaacgcccttgacctgggcatgcctgtcaccctcatcgccgaggctgtccttgctcgttgcctgtctggcatcaaggaggagcgtgtcaaggcctccaccaagctcgagtttgttggccgtgccaacaagttcgagggtgataaggagcagttcttggaggacctcgagcaggctctctatgcttccaagatcatctcttatgcccagggcttcatgctcatgcaggaggtatgtggatgcgcagaacagaaacagactatcaccgaggtgcgattgctaacgctattttgatcacaggctgctaaggagtacaactggaagctcaacaagccttccattgccctcatgtggcgcggtggttgcattatccgctccgtcttcctgaaggacatcaccgctgcttaccgcaagaaccccgacctcgagaaccttttgttcgacgacttcttcaacaaggccatccacaaggcccagcccggctggcgtgacgtcgttgccaaggctgctctccttggtcttcccactcccgctttctccactgctctgtcgtggttcgatggctatcgcaccaaggacctccccgcgaacctgctccaggctcagcgcgactacttcggcgcccacaccttcttggtcaagcccgagtacgccaacgagaagtaccccgagggcaagtacatccacgtcaactggactggccgcggcggcaacgtttccgcttccacctaccaggcgtaa

SEQ ID NO: 26792 - DNA, 1232 bp, Neurospora crassa
atgcccgccactactgcggaaacgctctccctggtgaaccgcagcgtctcggttgcgccgctggttctgctctcagttgtcgaccactacaaccgtacccaagccaacaagtccaagagcaagcgtgtcgtcggcgtgctattaggccagaatgatggaaagaatgttcgcgtgtccaacagtttcgcgggtgcgtagtctctgctgcggaagcttgcctggttgccccgcgcccaggtgaatattcggctaactctggtgatgcagttcccttcgaggaggacgacaaggacccctcagtctggttccttgaccacaactacgtcgagtccatgaacgacatgttcaagaaggtcaatgcgcgcgagaagctaataggctggtaccattccggccccaagctacgggcttccgatctcgacatcaacgagctgttcaagcgctacactcccaacccgcttctggttattgtcgatgtccagcccaaggagacgggcgttcctacagatgcctattttgccgttgacgagatcaaggatgtatgtcttttagaaacgccgtcgcgtttccacttgttcctactcagcctcgtccaagttacagctgctaactatacttgtgtgtgactaccacaggacggcaccactacatccaagacttttgtccacactccctccatcatcgaggccgaagaggccgaggaaatcggcgtcgagcacctccttcgcgacatccgtgacgtagccgtcggcacactatccactcgcatcaccaaccagatgcgctcgctgcaaggcctccaccaccgcctccgcgacatccaagcatatctccaaaaggtccttgacggccagctgcccgtaaaccacgccatcctcggcaacctccaggacgtcttcaacttgctccccaacctctcgacgcccaagtccggtccaggcgctactggaaccaacgccgacagcgagctcaaccacgccatgagcatcaagaccaacgaccagctcatggccatctacctcagcagtctgatccgcgccatcactgcgttccacgacctgatcgagaacaagatccagaacaggcagcagcaggaggagaacgacgccaagaagaaggagggagaaaacggcgagaaaaaggagggcgccgacaagaaggagggtagcccggcggcggcaaatggtgaaagcaaggagaaggagaacagtccgaaagagaagaagaaataa

SEQ ID NO: 26793 - DNA, 951 bp, Neurospora crassa
gtaaatgatgcctcgccaatgcgcctgcgtatggagaagttcgtcaaggagcaacagaaggaaattgtcagagcgctagaggaggccgacggcacaccattccgggtggatgagtggcagcgcaaggagggtggcggcggcatcacctgcgtcctccaggaaggcaaggtgtttgagaaggccggtgttggtgtgagcgtcgtctacggcactcttcccaagcccgccatcatcaagatgcgtgccaaccacaagaacctggcccaggaggatgacattcccgacagcctcgagttcttcgccgccggcctcagtctgatcgtccaccccaagaaccccatggccccgacagtccatctcaactaccgatacttcgagacggccaaccccgacggctcctcgggagcgtggtggttcggtggcggaagtgacctgacgcccagctacctctttgatgaggacgctatccagttccacaagtcgctgaaggaagtgtgcgatgcccacgacaaggagtactacccccgcttcaagaagtggtgcgacgagtacttctacaacaagcaccgcggcgagtgccgcggtatcggcggcattttcttcgacgacttggacgagaccgtctccgacaaggagaacaccttcgctttcgtgcaggacgcgctcaagtcgtttgcgcccacctacatttccatcatcaacaagcgcaaggatatgccttacacggaggaggagaagcggtggcagcagattcgcaggggcaagtatgtcgagttcaacctggtgcacgaccgcggcaccgcgtttggcttgaatacccctggggcgcgcgtggagagtatcctcatgagcttgccgttgacggctaggtgggagtacatgtatgagccggcgccgaaaagcagggaggcgaggctggttgaggtgctgaagaaccccaaggactgggta

SEQ ID NO: 26794 - DNA, 1079 bp, Neurospora crassa
atggtcgtcaaggtcggcatcaacggtttcggccgtatcggtcgcattgtcttccgcaatgccattgagcacgatgacatccacatcgtcgctgtcaacgaccccttcattgagcccaagtacgctgtaagttggcctcgctcacatagatcccttgtctcatatgacaactcagactctgaccatcatccctcttacaggcttacatgctccgctacgacaccacccacggcaacttcaagggcaccatcgaggttgacggtgctgacctcgtcgtcaacggcaagaaggtcaagttctacactgagcgcgaccccgctgccatcccctggtccgagaccggtgccgactacattgtcgagtccactggtgtcttcaccaccaccgagaaggcctccgcccacttgaagggtggtgccaagaaggtcatcatctctgccccctctgctgatgcccccatgtacgttatgggtgtcaacaacgagacctacgatggctccgccgacgtcatctccaacgcctcttgcaccaccaactgcttggctcccctcgccaaggtcatccacgacaacttcaccatcgtcgagggtctcatgaccaccgtccactcctacaccgccacccagaagaccgtcgatggtccttccgccaaggactggcgcggtggccgcactgctgctcagaacatcattcccagcagcactggtgccgccaaggccgtcggcaaggtcatccccgacctcaacggcaagctcactggtatggccatgcgtgtccccaccgccaacgtctccgttgtcgatcttactgcccgcatcgagaagggtgctacctacgatgagatcaaggaggtcatcaagaaggcctctgagggtcccctcgctggcatccttgcctacaccgaggatgaggttgtctcttccgacatgaacggcaaccccgcctcctccatcttcgatgccaaggctggtatctccctcaacaagaacttcgtcaagcttgtctcctggtacgacaacgagtggggctactctcgccgtgtcctcgacctcatctcctacatctccaaggtcgatgcc

SEQ ID NO: 26795 - DNA, 762 bp, Neurospora crassa
gtggtcctcatcggagactcgggcgtcggaaagtccaaccttctcagtcgattcacccgtaacgagttcaacctcgactccaagtccaccatcggcgtcgagtttgctaccagatccattcaggtcgactccaagacaatcaaggcacagatttgggatactgctggccaggaacgttatcgcgccatcacctctgcctactaccgcggtgctgtcggcgccctcctcgtctacgatatcagcaagggcgtgacgtttgagaacgtgaaccgatggctgaaggaactgcgcgaccatgccgaccagaacattgtcatcatgctcgtgggtaacaagagcgatttgcggcatctgagagccgtacccacggaggacgccaagaagtttgccggtacgttgcgcgtcacagccatgatgacatggtcgcttgggaaagccgtatcgccaggatgactgacagagagaactgcagaggaaaaccacctatcctttatcgagacttcggctctcgacgccacaaacgtcgagcttgcgttccaaaacattttgactggtaacgtttgcccaaagcctacagctgctgctctggcgcgagcctaccgctaacatgcgatcatttatctagaaatctacaagatcgtgtcgaccaagaacttcgacaacggccccagcgggtccaacgagggccaccaaaacctgtctggccagagcatctcgctcagtcagaccgcgaacgacccccaggcgaagtctggctgctgt

SEQ ID NO: 26796 - DNA, 1943 bp, Neurospora crassa
atgcatctcgtctcttcgctcctcgtcgtgggcgccgccttccaggccgtgctcggtctgccggatcctctgcatgaaaagaggcacagcgacatcatcaagcggtctgtcgactcgtatatccagaccgagactcccattgcgcagaagaaccttctgtgcaacatcggtgcttctggatgcagagcctccggtgctgcctctggtgttgtggttgcctccccttccaagtcgagccctgactgtaagtggaaattgcacagtgtgtctcatctctcatggcagcatagctcacagtgtcgatagactggtatacctggactcgtgatgccgcccttgtcaccaagcttattgtcgacgaattcaccaacgactacaacaccactcttcagaacaccattcaggcttatgctgctgcacaggccaagcttcagggcgttagcaacccgtccggttccctctccaacggggccggtcttggtgagcccaagttcatggtcgacctccagcagttcaccggtgcctggggccgcccccagagggatggccctccccttcgcgccattgccctcatcggctatggcaagtggctcgtcagcaacggttatgctgatacggccaagagcatcatctggcccattgtgaagaacgaccttgcctacactgcccagtactggaacaacactggcttcgatctctgggaggaggttaacagctcttctttcttcaccatcgccgcctcccaccgtgctctcgttgagggttctgcttttgccaagtccgtcggcagctcttgcagcgcttgcgatgccattgccccccaaattctgtgcttccagcagagcttctggtccaacagcggctacatcatctccaactttgtcaactaccgcagcggcaaggacatcaactccgtcttgacttccatccacaacttcgaccccgctgccggttgcgatgtcaacaccttccagccctgcagcgaccgggctcttgccaaccacaaggttgtcgttgactccatgcgcttctggggtgtcaactccggtcgcactgccggtaaggccgccgctgtcggtcgctacgctgaggatgtctactacaacggtaacccgtggtacctcgctactctcgccgccgccgagcagctctacgacgccgtctacgtctggaagaagcagggttctatcactgtcacctccacctccctcgccttcttcaaggacctcgttccctccgtcagcaccggcacctactccagctcttcctccacctacaccgccatcatcaacgccgtcaccacctatgccgacggcttcgtcgacatcgttgcccagtacactccctccgacggctccctggccgagcagttcgacaaggattcgggcgcccccctcagcgccacccacctgacctggtcgtacgcctccttcctttccgccgccgcccgccgcgccggcatcgtccctccctcgtggggcgccgcgtccgccaactctctgcccggttcctgctccgcctccaccgtcgccggttcatacgccaccgcgactgccacctcctttcccgccaacctcacgcccgccagcaccaccgtcacccctcccacgcagaccggctgcgccgccgaccacgaggttttggtaactttcaacgaaaaggtcaccaccagctatggtcagacggtcaaggtcgtcggcagcatcgctgcgctcggcaactgggcccccgccagcggcgtcaccctgtcggccaaacagtactcttccagcaacccgctctggtccaccactattgcgctgccccagggcacctcgttcaagtacaagtatgtcgtcgtcaactcggatgggtccgtcaagtgggagaacgatcctgaccgcagctatgctgttgggacggactgcgcctctactgcgactcttgatgatacgtggaggtaa

SEQ ID NO: 26797 - DNA, 939 bp, Neurospora crassa
atgacatcagataagcccgtagtcgcggcgacgacgacaaagaccaaaaagtccaagcaacaaacaatacactatcccttctggttcggaggaagcgccagcagcatggctgccactgtcacacatcctctcgatcttggtaagttttgcccattacctacctagaagcgaatatgtcacatctcccacgagctgcccaagaaacaccacggctaacatcaatgtgaaacagtcaaagtccgcctccagatgcgcaccggcgacgcccccaaaaccatgtccggcaccgtcctccacatcatccgccacaacggcatcaccggcctctacaacggtctctccgcctctctcctccgccaaatcacctactcgaccacgcgcttcggcatctacgaagagctcaaaacccgcttcaccaccaaagaccacccggcctccttccccgtgctgatcgccatggccaccgtctccggcgtagccggcggtttggtggggaacgtagcagacgtgctgaacgtgcggatgcagcacgacgccgctctgccccccgcgcaacgacgcaactacgcgcacgccatcgacggcctagcgcggatgacgcgcgaggaagggttccggagctggtttaggggtgtttggcccaatagtgcgagggcggccgccatgacggccagccagctggctagttacgatgtgttcaagcgcatcttgattagacatacgcccttggaggataacctggcgacgcactttagcgccagtttcctggcgggcgtggcggcggcgacggtgacgagcccgattgatgtggtcaagacgcgggtcatgagcgcgagcgggaagagtagtatcgggcaggtgttggggagcttgtatgcccaggaaggggtgaggtggatgtttaagggatgggtgccgagttttttgaggttggggccg

SEQ ID NO: 26798 - DNA, 1338 bp, Neurospora crassa
agcagctcgagaccggcgacgatcgaggtcaatggcaagacctacaccaccgacgaatggtacaacgtcccccagaccgtcctcgctctcaccggccgcaagcttcatctccagaaagaccaccccgttgccatcacccgccagatcatcgagtccaagttctccacggccacctacaagcgctacaatgagttcgaccctgtcgtcagcaccatcgagaactttgactcgctcggtttcccgcccgaccacgtcggccgcgcccgctccgacacctactacatcaacgagaccacgctcctgcgcacgcacacttcagcccacgaggccgagctcttccgcgccagcgcctcggacggctacctgatcagcgccgacgtctaccgccgcgacgaggtcgaccgcagccactaccccgtcttccaccagatggagggagcccgcgtgtgggaccgcaccaaagtgcccaatggcgacgtcgtggccgccatctacgccgacctggccaagctgcccacgcacgacgtcaaggtcgaggaccccaacccgccgcaccacccggagcgtaacccactgcagagcaagcatcatagccctgaggaggccgaggccatcgccgcccacctcaagcgctcgctcgagctcatggtcgtcgagatcttcacccgcgccaagcaggccgccgctcgtcaggatcccaactacgtcgacgagccgctgcgtgtccgctgggttgaggcctacttcccctttacgtcgccttcgtgggaattggaggtgtactaccagggtgactggcttgaggtgctgggctgcggtgtcagcaagcaggaactgttcatcaatgcggaccagccgcaacagctcggctgggcgttcggtattggtcttgagcgcatcgccatgctgttgttccagatccccgacatccgtcttttctggtccaaggatgagcgtttcctgagccagttcaccggcgtgcaggataatcttgacaagctgaagcgcttcgtccccttctccaagtatccggcttgctggaaggatgtgtccttctggctgcggtcaacgtctgcggcgggtggaaacactgccgtggccaacgtgcatgactttcatgaaaatgacctgatggaggtggtgcgtgaagtggccggtgatgtggttgaagacgtccagctgaaggaccagttcacccatcccaagacgggcaggaagagcatgtgctatagaatcaactacaggagcttggaaaagactctgacgaacgaggaggccaacgacttccatgagcgggtaaggcaaggattggtggagaagcttggtgttgagcttagg

SEQ ID NO: 26799 - DNA, 1344 bp, Neurospora crassa
gataggtttgaggtgctcaaggagattggcgatggaagttttggaagtgtggtgttggccagagtccggagtgcaggtgccaccgttgctcgccgcggtactgtcgtaagttacctggatgcttttgccatgacctcgggttcagtctaacacttgtgtgctcaacagattgccattaagacaatgaagaaaacattcgagtcggtaggaccgtgcatggaactcagggaagtagtcttcttgcggacgcttcctgcacatccccatctggtgccagcgctcgacatattcctggatcctttcaccaagaagcttcacattgccatggagtatatggaaggcaacctctatcaactgatgaaggccagggaccacaagtgtttggacaactcgagcgtgaagagcatcttgttccagattatgaagggtctcgaacacattcacgcgcatcactttttccacagagatatcaagcccgaaaacattctagtatcgacatcctcacatatggacgccacgaactcgttccgccgttattccgcgctgatgaaccctccaccgacgccgcccacgtatacggtaaagattgctgacttcggcctggcccgcgagacgcattcgaaactcccgtacaccacctacgtctcaacccgatggtatcgcgcccccgaggtcctcctcagggctggtgagtactcggcaccggttgatatctgggccatcggagccatggccgtcgaaatcgctacgctgaagccgttgttcccgggcggaaatgaggtcgatcaagtgtggagagtttgcgaaattatgggaagccccggtaactggtacaacaaggccggagcccgcgtcggcggcggagaatggagagaaggtacccggcttgctgggaagctaggtttttcgttccccaagatggcgccgcattccatggacaccatcctccaaaccccccagtggccggcttcgctcgcccactttgtgacgtggtgcttaatgtgggaccccaagaaccgaccgacgtcgacccaggccctcgcccacgactacttcaccgacgccgttgaccccttgaggcccaagtcctccgcttcccggatcctcggccgcaagcaatcggatatcagccgcggaaaggactcggccacgtccacgcctacgtcttcgaaaccatcgtggttcaggaaatccctgatcggtcgttctgagagcagcaccgaggtcgctactgtgtcgacgacgcaagaaaatgcaaaggtgaacattgctccccgtccatcacccgtgcaggttgcaccggaagttccctccccgaagcccaggccagctgttagcaagagg

SEQ ID NO: 26800 - DNA, 2089 bp, Neurospora crassa
atggcgtcgaacccaacgaacaccgcggcccctacgggtggccttaccgagaagaagcatgaccgccgttcaacatcgtccgaatccgtctcgggaaccgggtttgcggaacatgcagaccgcaccggcacttttaaccagaacgctcgactagaggcttcaaaaaagatagcgaatcctttggccggtctaagccctcagcgtctcgaggccatgggagaagaatatgcaatgatggccggtctcaccagcgaggaggacatcagggcctttcgactcggagccagaatcgccggcgatgagagcaactacgacctcatcccggagcttactgaacgggagaaagaggtgttggtgcgcgaaacaactcacaagtggtctaacccacccatgctttactgggttgttgtcagtatgtaatcccccgaatggtcaaaaggagtgcagcagtatgatgctaaccaccatacttcaagtttgctctctatgcgccgccgtccaaggaatggacgagacggtcgtcaacggcgcccagctcttctacaaggacaagtttggcattggtaccgatagccagagagacacctggcttctgggtctcgtcaactcagcgccctacctttgctgtgccttgatcggctgctggctcactgaaccgatgaacagaatctttggcagacgaggcaccatctttgtttcttgcatcatctcagccgtagcctgcttccaccaggcctttaccaacacgtggtggcacatgttcatcgcccgtttctacctcggccttggcatcggtcccaagtcagccaccacccccatcttcgccgccgaatgctcccctcccaagctccgcggtgcgctggtcatgcaatggcagatgtggaccgccttcggtatcatggtcggctacattgccgatctcgctttctacttcgttcccgatcacggcatcggcctgggtctgaactggcgtctgatgatgggctccgccatgatccccgccgtcatcgtcgtctgcctcgccttcctctgcccggagtcgccccgttggtatctcagcaagggccgacaccaagacgccttcggggcgctctgccgcctgcgtttcgaaaaggtccaagccgcccgcgacctcttctacacccacaccctcctcgaagccgagaagcaagccatgtcgggcgtcaagaagggtaaccgctttaaggagctcttcaccgtgcgtcgtaaccgcaacgcggtcattgcctcgtcgggactcatgttcatgcagcagttctgcggcgtcaacatcatcgcctactactcctcggcagtcttccgagacgccggcttcagcgacgtctcagcactggccgcctcgctcgggtttggcgtcgtcaactggctgtttgccatcccggccatgtacaccatcgacactttcggccggcgcaacctgctgctgaccaccttcctgctcatgtccctcttcctcttctttaccggcttcagcttttggatccccgaggactccaaagcccacatcggctgcatcgcgctaggcatttacttgttcggcatggtctactcccccggtgaagggccggtgccgtttacttactcggccgaagcctacccgctgtacatccggccaatcggcatgtccctcgccacggcgactacctggttcttcaatttcattctttccatcacctggcctaggatggtcacggccttcaagccgcagggcgcgtttggctggtatgcagggtggaatatcattgggtttctctttaccctgttcttggtccccgagaccaagggcaagacgctggaggagctcgatcacgtgtttgacgtgccgttgaagaagttggtcaggtatggggcagatcagagcttgtggttcttccataggggaaagaatggaaatggaatgaggccgacggcgcctagtgcggagatgtatcatggggatgcggagcggatgaacgaggtggttagcgggcagcagcttggggagggtgagagggagaagaggtggaacaaggaacaagagagggaaggggggattatgggacgaggggatgctgctgggaaggtgtag

SEQ ID NO: 26801 - DNA, 2160 bp, Neurospora crassa
atgtcgtccgtcctcatgagcaagactgtcacgcctttccttcgggaacacattcccagcatctacgcccccatcggcaagccggggaaccaagagacggccagagcagagaaccccaattccaagtactgctatagacaccaccccgactcaaagtgccgaagggctgccgacaaggccaagatggtcatgattcagagcgagctagacaagctcacatcagcggtgggtcttcatacaaaacataaacattgattgcttcttgtctccaaggtttggtggactgactggtaccttgcttgaaataataggatcagcaagctgtgacccacgtgtggtccctgttctcggccgcccctgcccgacatcgcgacctgatgcttcagggtatcctctcccagctctgcttcccccagctctccttcgtctcgagagaagtcaacgaagccctcaagatcgacttcatctccgccctccccgtcgagctcgcccaaaaggtcttatgctatctcgacaccgtcagcttgaccaaggccgcccaggtcagccagaggtggcgaaccctggccgactcggatgccgtctgggtccgcatgtgcgagcaacacgtcaacaggaagtgcacaaagtgtggatggggattgcccttgctggaacgcaagaagctgcgcaactacaccagacaaagacagctggccaagggtgggccacaagggagggtcacagaactggccgactcccacgacagccaggatcgatccgtcaatcaacatggaaagcgcccggcagcagaggcggaggaagaggaccccatcaagaagcgccagtgtatggctgcagcagaagcctccaaggcggtaacgcaacccaagacccgaagctggaaggccgtctaccgggatcgctggcaggtcagctacaactggaaaaacagccgatacaagttgtcggttctcaagggtcatgagaatggtgtcacatgtctccagctcgatgataacatccttgcgactggatcgtacgacaccactatcaagatctgtatgtggtcttgcttctttaaacattggtgctcgctttaaactaacacattgctgacagggaacattgagactgaggagtgcattcggacccttgtcggccatacggctggcattcgtgcactacagtttgacgattcgaagctcatcagtggcagtcttgaccgtatgttgcgcaacccgccttcaatgatagcgtggcaatgttgctaactgattcgtagacaccatcaaggtctggaactggcataccggcgagtgcctctccacgttcgctgcccacaccgactcagtgattagcgttcacttcgatggccacctactcgccagtgggtcgagcgacaagacggtcaagattttcgacttcaactccaaggagacatactgcctcaagggccatagcgattgggtcaactcgacccatgttgacatcaagagccgaaccgtgttctccgcctcggatgacacgaccatcaagctgtgggatctggacacgcgccaggttatccggacctacgaaggacatgtcggccatgtgcaacaggtcctcatcctcccgcccgagtatgagcccgacgaggaggtgctcaacggtgcttcgcaagacaaccaagacgccatgtcagtatcatcgggcggaagcggaagcccctccatgtcgcatgcacaaatcgagcgcgccggcagccctggcagccatagctccagccacaacctgctaccgagcagcctgcctagtggtgacgaggacgtgcgccatctctatggatccgcctttgtagccgacgagtcacggccacttcccccgcgctatttcatgacaggcgggctcgacagcaccatgcgtctctgggacagcgcgaccggtcggtgtttgaggacgctgtttggccacctcgagggcgtttggtctttggcgggagatacgatccgtgtgatcagtggagccaacgacggcatggtcaagacgtgggagccgcgcagcggaaagtgcgatgcgacgtatacgggccactgcggacccgtgacttgtgtcgggctgagcgatagtctaatggccagtggcagtgaggatggaacgattcggttacattccttcaagccctgtcggcagtgaggt

SEQ ID NO: 26802 - DNA, 2674 bp, Neurospora crassa
aactcgttggccaagtgtcccggctacaaggctacgaacgtcaagacgaacgccaatggcttgacggcggagctcaagcttgccgggaaggcatgcaatacctacggcactgacctggataacctcgtccttgaggtgacatacgagacaggtgagttgactaaaacaattactgaatgaagaactaaacaggtgggaggcgctaacaaggataattcatgtgttagacaaccgcctgcacgtcaagatccaagatgccacgaacgatgtgtatcagatccctgaatctatcttccctcgcccgcaggcagctcagggtgcgaactccaagaagtccgccctgaagttcacctacaagaccagccctttctccttcgccgtcactcgcgccaagacgggtgaggttctcttcgatacttcagccgcttccctggttttcgagtcccagtacctgcgtcttcgtaccaagctgcccaacaacccaaacctctacggtcttggtgagcattcggactctttccgcctcaacaccaccaactacatccggactttctggtctcaggatgcctactccacccccaacggagcgaacctttacggcaatcacccggtctactacgagcaccgcaagagtggcagccacggtgtcttgttcctcaactccaatggtatggacgtcgtcattgacaaggacagccgctccggtcaatacctcgagtacaactcccttgggggtgtcgttgacttctacttcgttgctggccctagcccgatcgaggttgctaagcaatatgccgagatcaccaagctccctgccatgatgccatactggggtttcggcttacaccagtgccgttacggctaccaggatgccttcgaggttgctgaggtggtttataactacagcaaggccagcatcccgcttgaaactatgtggaccgatatcgactacatggaccgcagaagggtctttactctggatcctcagcgtttccccctctcgacgatgaggcagttgatcggccaccttcacgagaacgaccagaagtatattgttatggtcgaccctgccgtgtcggcggcagaggggcctgaaaaccctgctttgacgaaaggcattgaagaaaacgtcttcctcaagcgtaatgatagctccatctacaaaggtgtcgtgtggccaggtgtctcagtcttccccgactggttctcggccaacatatccaggtactgggacagccagttcactgaattcttctctgcgagctctggtatcaacattgatggtctctggattgacatgaacgagccctccaactttccttgcttcttcccttgcaatgaccccgagaaatccgccatcggctacccgcctgagcctcctgccgtaaggacacctccccgggagctccctggatggccttgcgtcttccagcccgagggaactgaatgcaaggagaagaaagacttgaccattgaggctcctgtcaagagtgacattcttattgccaagcgcgaggagactgtggaagctagcattactgctggcaagcagcttggtctccctggccgtgacctcctcttccccaagtattcaattcacaacaaggctgcttacatggattcatggaacgccgacaagggcggtctctccaacaagactgtgaacaccgataccatccaccagaatggcctggccgaatatgatgttcacaacctttacggcaccatgatgtcgatccagtcccgcggggctatgcttgcccgccgccctggcctccgccccttcatcatcacccgctccacttttgctggcgctggccactcggttggcaagtggctcggtgacaacattgctgactggcaacactaccgtgagagcatttacggaatgatggcgtttgcttccatctaccagatccccatggtgggcgctgatgtctgcggattcggcgggaacacaaccgagtcgctctgcgctcgttgggccatgctgggtgccttctcccccttctaccgtaatcataacgagtacctaccttccatcagccaggagttttaccgttgggagatcgtggctgaggccgcccgcaaggccatcgatatccgctatcgcctgctcgattacatctacactgcccaatacaagcagtccgttgatggtactcccatgattaacccaatgttctacctctatcccaatgacgcgaacacctttggcctccagcatcagtacttctacggtcccggtctccttgtagcccccgtcactgaggagaactcgaccagcgttgatgtctaccttcctaacgatattttttacgattggtacacccttgacgtcgttcatggcaaggggaggaccgtcactgtcaaggatcagagcttgactgacatcccgctctacctccgcggtggcgtcatcgttcctcttcgggccaagtctgccatgaccaccaccgaacttcgcaagcaggactttgagctcatcatcgcggtcggtaaggaccttactgccgagggtgagctttaccttgatgatggagtcagcttggagcaacagggtgtgacaaacatcaagtttaagtatgccttgggtgttctgactgtcaatggcgactttggattcaaaacggatgtgaagatcaccaacatcaccgtcgtcggcgccttgggg

SEQ ID NO: 26803 - DNA, 1144 bp, Neurospora crassa
ctccccgaaccgttcgccagcatccctcgggagccgctaacctttggaccttctccgatccagcctctcccccgcatctcccaagccctcggtggaaaggtcaacgtctttgctaaacgcgaggacctcaactccggtcttgcctttggaggcaacaagaccagaaagctagagtatatcccaccacccgcccgtcagtctgttgtgttgtccgtccaccagcagcttgactaacaagtccggcccctcggcccccagatacctcgtccccgacgccatctcccgaggctgcgacaccctcgtctccatcgggggcatccaatccaaccacacgcgccaagtcgccgccgccgcctccaagctcggcctgcacgccgctctcgtccaagaacactgggtccccgactggaccgatcccggctacgacaaagtcggcaacatccagctctcccggctgatgggggccgacgtccgtcttgaaccgctagccgggttcgggatcgagcacaagcagacgctggcgaaactcaaagatgatctggagaaggaggggagaaagccgtattatatcccggctggggcgtcggatcaccctcttggagggctggggttcgcgaggtgggcgtttgaggtggtggcgcaggaggaggagttggggattcatttcgacacggtggtggtctgtgcggtgacagggtcgacgatggcgggcatggtggccgggtttaagttggttgagatgttggaacgccactcggaaaggctgggcaaggtgaataagaggagggtgattgggattgatgcgtccgccaaggttgagcagacgagagcgcaggtgctgaggattgcgaaacagacagcggccaagattgggttgaaggaggaggatatcacggagtcggatatcgtgctggatgatcggtaccatgcgggggtttatggcgtgccggacgagaaaacgattgaggctatcaagtttggggcgcggacggaggcgttcattaccgatcccgtgtatgagggcaaaagtctggcgggcatgatggacatgattaagaatggggagattgaggcgggaagcaatgtgctgtatgcgcaccttggagggcaattggcactgaatgcgtactccgctttggggttg

SEQ ID NO: 26804 - DNA, 1467 bp, Neurospora crassa
atgctacgatcaaacgtcagtcgcatcgaccccaaaaggcgaaacgtcctcgaccaccgcaagaaacaattcgcagaagccgcctacaaggacaccgattatccccatcggctcaacttctactcgacccctccaacagccgacatcaccattgagcagtttgaacaatgggccatcgacaggttacgaagtatgtatcataccacgctcatatctcagtgatctacaatactgggcgtgcctctaaacgctaatcaacctctttcttatcataatccagtcctcgccgaactcgaagcatgctccttccgtaacaaaacccccgccgagacggcctcgcacatgaaacctttactcgacaagtacctcccgctcgacaccaacagctcctcctcctcccagctcttcgcccagcggcaaaaagaccactacagccacttcatccttcgtctcgcttttgcgtccacggaggacctccgacgccgcttcacccgcgtcgaaaccatgttatttcgcatgcgcctgaacgccgacgacggtcgcgagcgcgcggcttttataaactcgcttaatctcgactgggagactgtttcggacgaagagaagcgcgaactagctgccgagttggcagcgactgcctccttcggcggctacaaaaagggacaacagcagcagcagcaatacgaagaagaccaacaaacatggtgcaaagtctcgtggctgcgcgtccccgagctggtcgaacagcggcgcgtctttctccgacaaggctacgcctacgttcccgcgcgcgaacagcaagcgatggtcgtttcggaattctcgtcccggctggaacgacagctcgagttaaccgcccgggcccttccccgactagacgaagacgaccgcttgacgcccatcctggcacacttgtccaagaactttatcacgcccgacgcttcgtacgtaggtacttcatccgccatctcctcggcggatatctcagccagaaacatcgacacgctggtgaacaaccaccatttccccgcttgcatgtcccatttgcatcgcaccctgcggcgggacgcgcacttgaagcactacggtcgtctccagtacaccctctttctgaagggcatcggcctcaacctcgaagaatgcttgctattttggcgacagagtttcaacaaaatcaccgacgacacgttcaacaaggagtaccggtacaacgtgcgacacacgtacggcgacgtgggcggcgacagcaatcggcgcggcggcggttactcgccatattcgtgccaaaagattctcacagaacatcctcccggaccgggcgaggcgcacgggtgtccgtacagacactttaacatggagaatctgcagacgctgttgcagcaggggatgggggtgacggatcgcggggtgttgaatggggtcaaggaggataaggagaagcaaaagtttcatatggcttgcaatcgg

SEQ ID NO: 26805 - DNA, 1170 bp, Neurospora crassa
ccctctatcaaaagacgcccctcgcgcaagtctgtcacctttaccgacgagaagctagttgtcaaccccgacggttctgtcaccatggacgcctctcccgccgacgaaatcaaggagactgcccagtcccactctgctcgtacgccgcccctccacgccgctctcggggcctttactgatgccccccaagccaccgagccccaggatgctgctgctgctgccgcccccgccgccgatgatggcctcgacctttcgctcatgaagaagaagaagaagaaggtcaagaaggaggacgatgccgacgccgctgctgatgaggccgcccctgccgagggtgacggtgctatcgacctcaccatgaagaaaaagaagaagaagaaggtcgtcaaggaggatgatgagttcgccaagaagctggaggctctcaacattgagggcaaggagggcgaggaggccgccccccaggaggacgagcaggagggcgatatggaccagggcaccggcatttgggcccacgacgagaccaagcccatcagctacaacgctcttctgtcccgtttcttcgcccttctctcgcaaaagaaccccgaccacgcctctaccggtacacggtcgtacaagatcccgcccccgcagtgtctccgtgaaggcaacaagaagaccatcttcgccaacctgcccgagatttgcaagcgcatgaagagagccgacgagcacgttacttcttaccttttcgccgaattgggtaccagcggttccgtcgacggcagcaggcgtctggtcatcaagggtcgtttccagcagaagcagatcgagaacgttctgcgtacctacattatcggtatgtctatttgatcctgtcgtcgtttggacgttttgcgcccaagtagacaatgtcaccaccagcacccaacgttttgctctgactacaaatgctaacatgctcaacagagtacgttacctgcaagacgtgccgttcccccaacaccgagctctccaagggcgagaaccgtctttagtaagttggcctctgtttacgacgaccatagccccaaaatgctgacatgtcacagtttcattacctgcaactcttgcggttctaggcggtctgtccaggccattaagaccggtttctctgcccaggtcggcaagagaaagaagatgcagggt

SEQ ID NO: 26806 - DNA, 1356 bp, Neurospora crassa
caggcaccacaacaattcaagcaaaagtttaacctcggcgagcataccaaagaccctgtctacatcgactcggagcgcagattccaggagctcgaaaccgagaccaaacgccttcacgatgaaagcaaaaagtactttgaggccatcaatggcatgctgcaacaccaaatcgagttctcaaaggcaatgaccgaaatctacaagcccatcagcggccgcatgtccgatcccgattcgctcgttccccatggcaactatgagggtattgccgcctgcgaggagtacgaggccgttgtcaaggacctgcaggaaacactggcgccagagttggaaatgattgaggctagggttattcggccagcgaacgagctcctcgatgtgatcaaggtcattcgcaaaacggccgtgaagcgcgagcacaagaagctggactacgacagacaccgcgccaccctcaagaagctccaggacaagaaagaccggtcggcaaaggacgagaaggccatgtggaaggctgagaacgaagttgagcaggccacgcaagagtacaattacttcaacgatctgcttaaggacgagctacccaagctgtttgccctcgaacgccagttcattcagccgcttttccagtccttctactacatgcagctcaacatcttctacaccttgcacgagaagatgcagcactgcgacattggctacttcgacctgaccctggacattgaggaggccttttacgcgaagcgaggtgacgtccaggagcgggctgaggctctctccattgtcaagttcaagaccacgggtatgaagcgaccgcccaagtaccaacgtccaggcgctctcgaaggaaacaagccagcaggcctacttacagctggctcctccacgaccacttccaccggtccgcctgaggcggctccctcagtcacagccccacgcccctgggaacagcaacaacaagctcctgccgtcacagcaccgcgaccttgggaaacccaggcggaaacagtagaagcgcatgcgccgccaccgtattcggtgaagccgagcacgctacatgctacgccgcgcctcgctacgccgctccagtctgccagcccgaaaccctcgtcgttgtccatggcggcggctgcaaaggccaagcccccaccgccgaagcccaagcccaaggccctcatggcggcggcacccaaagtagagaccgtcacagcgctttacgactactcggcgcaggcggagggcgatctgagcttccgtgccggtgatgtgattgagatagtaacaaggactgcgaacgagaatgagtggtggattggaaagttgcatggaaagcagggtcaattcccaggtacgtac

SEQ ID NO: 26807 - DNA, 2866 bp, Neurospora crassa
gcgaagcccgtcgtaccggaaatctacccccaggtcatggcgattcctatagcgaagcgaccgctcttccccggtttctacaaggccattaccatcaaggaccccaatgtcgctgcggctattacagaaatgatcaagcgcggacagccatatgtgggagcgttcttgttcaaggacgagaacgccgacgacgatgtgattcggaaccgcgacgatgtctatgacgtcggtgtttttgcgcagatcaccagcgctttccccatgaacaaccagaacggcgagggtgctagtctcaccgcgattctttacccccaccggagaatcaagctgtcggagctcattcctcccggctcgcctgaggctgcctcgatcgatggtgcgaaggagggtgctgcccctgagccggtacctgagccgatccccaaggtgaccgacgagtctgagcaaaagggtgacgtggtggcgagctttgaggaaagcgccgtgacacctaggcccgaaccaagccagaagccctacgagccgacatcgttccttaaaaagtatccggtcagtcttgttaatgtagagaacttgacggaagaaccctacgaccccaagagccaggttatacgcgccgttacgaacgagatcgtaaacgtcttcaaggaggtcgctagcatgaacagtctcttccgggatcagatttccacctttagcatgagccaatcgaccggtaatgtcatggctgagccagccaagcttgcggattttgccgctgctgtcagcgccggtgagcctgctgagcttcaggaggttctttctagcctgaacgtggaagaaagaatgcacaaggctcttcttgtcctcaagaaggagcacgtcaacgcccagcttcagtccaagattaccaaggacgtagagcagaagatcaccaaacgccagcgtgaatactggctcatggagcagatgaagggtatcaggcgcgagcttggtatcgagtctgacggcaaggacaagctcgtcgaaaagttcaaagagctcgccgacaagctggccatgcctgaggccgtgcgcaaggtgtttgatgacgagctgaacaagctcgcccacctggagcctgccgcttccgagttcaatgtcacgcgcaactacttggactggctcaccaacattccttggggccagagcagtgccgagaactttgacattctgaatgctgtcaaggttctggatgaggatcactatggtctcaaggacgtcaaggatcgtattttggagttcattgccgttggaaagctacgcggcaccgtcgagggtaagattctctgcttcgtcggtcctccgggtgtcggcaagacttcgattggcaagtccattgctcgcgcacttggtcgccaatactaccgcttcagtgtgggaggtcttaccgacgttgccgaaatcaagggtcaccgccggacatacgtgggtgcccttcccggccgtgtcatccaggccctcaagaagtgcaagaccgagaaccccttgatcttgattgacgaaatcgacaagattggccgcggctaccagggagatccctcgtctgcacttctcgagctcttggaccccgagcaaaacggctctttcctggaccactatctagatgtccctgtagatctgtccaaggtgcttttcgtctgcactgctaacctgactgacaccatcccacggccccttctcgaccgtatggaggtcatccgactttccggatacgtcgcagatgagaagatggccattgccgaaaagtaccttgctcctcaggcccaggagatggctggtctcaagggcgttgacgtgcaactaacaaaggacgcgattgaggaactcaacaagtcctactgccgcgagtcgggtgtccgtaacctcaagaagaagatcgagcaggtataccgcaagtctgccctgaagatcgttcaggacctcggcgagcaggcccttcccgagtctgaagctcttaccgaggagggtaaggctgcccaggaggagacggaaaagaagaagagcgaggaggccgcgtccggtgagaccagcagcccgaaggccgccaccgaagcttctgagaaggagaccacggagaagcctcgggtagccatgaagattcctgaaggcgtccatgtcgttatcaacaaggacaacctcaaggattacgtgggacccccgatcttcacttctgacaggctctatgatgtgacaccccctggtgttaccatgggcctggcctggacctccatgggtggcgctgccatgtatgtcgagtctattctccagagcgcgctgacctccaagagcgcgccatcgctcgagattaccggcaatctcaagaccgtcatgaaggagtcctccgctatcgcctactcgtatgccaaggcggtcatggccaaggacttccccaagaaccgcttcttcgacaaggccaagattcacgtgcacgttcctgagggcgccgtgcaaaaggatggtccttcggccggtatcaccatgaccacctctttgctgtcgcttgcgctcgacactcctattgacccccagatcgccatgactggtgagcttaccctcactggcaaggtactccgcatcggtggattgagggagaagactgtggcggctaggcgagctggctgcaagatggttgtgttccctgaggacaacatgtctgactggcttgagcttcctgaggtaagactatacatcctagcccatcaacataaccctcatccagacaagttactaacgctttctctttcaccagaacgtcaaggaaggtatcgagggccggcccgtgcgttggtactctgaggtctttgacctgattttccccaagctcgaccgggagaaggccaacaag

SEQ ID NO: 26808 - DNA, 1241 bp, Neurospora crassa
gatcggtacgaccacaaatcaataattattcaccaaatactgacatagagtatagatggacacaatgatttgccaatcctgctgcgagccgctttcaagaaccacatcaatgacaagaactttaccaccggctgggaagacggcacgctccccggtcatgtcgaccttgcacgcctgagagctggtatgaacggaggggccttctggagcttgttctggccttgccctgccaacggctccgacttttctgatgaaaactatctgcccggtgggttcaacctttcacgcagccttactgcatagcacgtcaagagaaaaagagtctgacattatccctttccaaccacacagccgtccaggctaccctccaacagatcgacctagtcgaccgcctcaaagccgcctatcccaaggacctcgggccggcagtctccagcaaagccgcctacaaggcctggaagcaccacaaccagctcatctcgcccatgggcatcgagggcctgcaccagatcggcaactcggccgccacgctgcggcgctaccacgccctgggcgtccgctacgcgaccttggtccacaactgcggcaacaagtacgccgacgccgccctgcaggagaacccattccgcaaggccccgtcccactggggcggcgtcagcccggccggcgaagccctagtcaacgagatgaaccgcatcggcatgatcgtggatctggcccacaccagcgtcgacacgatgaaggatgttttgggtggctcgggcaaggactggaatggcagcagggcccctgtcatcttcagccactcgagcgcctacgcgctgtgcccccacccgcgcaacgtgccggatgacgtccttcgtctggtcaaggagcgcaactcgctggttatggtcaacttctcacccgactttatctcgtgcgtggcggcgccggacagggacgatgggctgccggatttttacccggccaatgcgactctggagcatgtggctgaccatatcattcatattggcgagctgattggatatgatcatgtcggtctgggtagtgactttgatgggattccagtcgtcccgaagggactggaagatgtctcgcgctacccggacttggtggccgagctgcttcgacggggtgttagtgatgaggatgtgagcaaggtcgtgggcggtaacatactccgcgtgtggagggatgttgagctcgtggcggctacgatgcaagctgctggtgagtcg

SEQ ID NO: 26809 - DNA, 2031 bp, Neurospora crassa
aagatcaccgacaaggtcgcggccttgccgcccgacagcaactacttctcgctcgagtttttccctccaaagaccgctatgggcttcgcaaacctacgcgaccgtctcgaacgtatggcaagaggacttaggccgcttttcgtcaacgtcacttggggcgccggaggttcaaccgcccaaaagtctctcgagcttgccgaaatctgccagcgcgagcttggcctcacaacatgtcttcatcttacctgcacaaacatgagccgtcgcctgctagacaagaccctcgaggacgcaaaggtccttggaatccgcaacatccttgcccttagaggcgatcccccgagggctgccgaataccacgatgagaacgaccccgagccgaccgatgacgaggaattctcttgggccgccgacctcgtccgctatatcaagaaaactcacggcgactacttctgcattggtgttgccgcttatcccgagggccatgcagaggaggcccatcctcgcgagcagagcttggagcatgatctcccttatctcgttgaaaaagtccaggccggtgccgatttcatcatgacacaactcttcttcgacattgacgcttacgagcatttcgagaatactctgcgagaccaccctagcggtgccttcaaggacgtcatcatcatccccggccttatgcccatccagagctaccagatgatcaagagaacgacgaaacttagccacgccaagatcccgccggccctcatggcccgccttgacgctgtaaagggagacgatgagaaggtcaagatggagggtgtcgcgattgtcagtgagatgattgagcgcatcaaggagatcaagagcaggacacctggcccgcgaggcttccacttctatactttgaacctggagaaggccgtcgcattcatcgccgaacgcacgaatctcataccccctggaacgcccgatgaggacgagtctgccatcctgccagacatccctcaactcaggattaacggatcttcggtcccaactcgatcgattcaggacctgtcgactagaaagggctcaattggctccgacccgcgggatcgggtgattgtcgccaaccagagaccctcgcatccagactacgaggcttcgccttcggaggccggtcttccggcagagcccgtcaacaccagagctaacacactggcgatctctgaaggcgagggtgtcttgggccgagaagcgacttgggacgatttccccaacggcagatggggtgacgccagatctccggcctacggtcaaattgacggctacggcgtcagcctgcacgtcaccgtcccccaggcgctccagctgtggggctcccccaagaccacggaggatatcaacaagatctttatccgtcatttgaagggcgagctttccgccatcccctggagtgaagagggtttcaacgacgagacggaagccatccgggacaatctgattgagctcaattccaggggctggtggtcgcttgcctcccagcccgccgtgaacggcctgcgatcggacgacggcacctttggctggggccccgagaacggcttcgtctttcaaaaggcctttgtcgagtttttcatcccctcggccgactggcgggtactcgaagcgaaactgaagcagccagacatgaaggacaccgtgtgctttttcgccaccaatgccgccggggactttgtcagcaccgacactattaactttcgtgcgagaatggccgccgaagcggagggaactgctgaggccgaccacaggccgcatgagcctagcaccaacgcggtaacctggggcgtgttccccggcaaggaaatcctgacgccgaccatcatcgaggaggtcagcttccgcgcgtggagtgaggaggcgtttggaatttggagcgagtgggccaagatctacggaaagggatccgacacccagaagttgttggaggacttgaaggaggatctttggctggttaatgtgattcatcatgattatcttgagaaggacggcctttggaagttgttg

SEQ ID NO: 26810 - DNA, 569 bp, Neurospora crassa
caccagctgcgcaacagctgggtcttctggtatcggccccccatctcgaaggctaacggcttcatcgagtacgagaagactctgcaccctatcgccacctgcgagacggctgagcagttcttcgctgtctaccagcacctcaagcgcccctcgggtctgccgctggtgtccgactatcatctgtttaagaaaggaattcggccaatatgggaggacgaagagaacaagaacggaggaaagtggattgtgcgcctgcggaagggtgttgccgatcgctactgggaggacattttgctggctctgatcggtgatcagtttggcgatgccagcgacgatgtttgcggcattgttctcagtgttcggaatggcgaggatattctcagcatctgggctcgggctaatggccagcgggtcctgaagattcggtatgttttcactcacttgcccggatagcccctttggagatctcgagctgactttggctaaacagtgaaacgatgcgccggaccctctcattcccctccgagaccaaggtggaatggaagagtcacgactcgagcattcagcag

SEQ ID NO: 26811 - DNA, 1302 bp, Neurospora crassa
gatctcgataccggcgacaactccgacaaagaccccaaccccattgccaccgagtccgacccagacgttcttcaccccgaagacaccaccaccatctcccccgcgcctgacggcggtccccgcgcctggctcgtcgccgccgccgccgccttcaccttcttctgcaccctcggctacaccaacgcctttggcgttttcgagcaatactacctcacctcccccttttcccccctccactcgtcttccgcccactccgccttgtcctcctccaagatagcctggattggctccctgcaaaccttcctcacctttttcaccggcttcttcgccggtcccctcttcgaccggtatggcgccgtcgccaccgtgcgccccggtgccctgatctttgtgtttgccatcatgatgactagcttgtgtaagcagtactggcagctgatgctcgcgcaaggggttctgggcggggttgctatggggttgttgatgtttcctgctatggcggcagtggcgcagtggtttgataagaagagggcggcggcgttgggtctggcggttagtgggagttcggtggggggcgtggtggttccgattgcgttgggcaggatgctgaatggtggttctgccggtggtgggcatctggggttcggttggtcggtcaggatcatcggcttcatgatgttgccccttctggttttcgcgagtctggcgatcaagccgcgactgccgccacggacgacggatttcattgtggtcaaggcgttgaagcaaaaagactttgtcatgttggtgtttgccattttctttctgtttctgggcatgttgacgccgctgtttttcatcccgacgtatgccgtctacagaggggtcgatgctacgctggctagttacttgctggccattgtcaatgcggcgtcgacttttggacgcatcatccccggcgttctggctgatcgggtaggaaagctgaatatgctggcggtgggtggagtggcgagcgggatcagcattctctgcttcaacaaggcggtctcgacggctgggttgatcgtgtactcgatcttctatgggttttcttctgggatgatcatttcgggggcatctgccgctttgacagtctgcccgagagacccgagagatcttggatcatatatcggtatgggaatggcattaggagcaattgctgtgctgattggacctccgatcaacggcaagcttattgatgtgtatggaggatatctcgagctgtccatcttcagcggcgtcatgtgtcttgtcggtgggctggttgtaattgcaaccaag

SEQ ID NO: 26812 - DNA, 831 bp, Neurospora crassa
ggcctgggcatcgccctcgtcgccgccaccaaggccagagtccccgtcacccttgtggatgcctctgaaacgtctctagacaagggccttgcattcgccgacaagctcctcagcaaggatgtggccaagcaacgcatcactcaggatgaggcggacgccgcccgcgcgctcctccagcccaccaccatcctcgaggacctggacagcgtcgattttgtgattgaagctgtgcctgagattcccaagctcaagttcgacatcttctccaagctggccgagatctgccctaagcacgccatcttagccaccaacacctcttccatctccatcacgcgcatcgccgcctcaaccaccaaggaccccaacgacacctccaacagctcgcgcgtcgtgtccacgcacttcatgaaccccgtgcccgttcagaagggagtcgagatcatcagcggtctgcagaccagtcaggagacgcttgacacggccgtcgagttttgcaagaagctgggcaagatcccttccatctccaaggacagcccgggattcttggctaaccgcatcttgatgccttacatcaatgaggccattatctgcctggagactggcgttggcgaccgtgactctatcgatgctattatgaagaacggcaccaacgtgcctatgggccccctccagctggctgactttatcggtctcgatacctgtttggctattatgaaagtattgtacgaggagacgagcgattccaagtataggccgagcgtgcacttgcgcaacatggtcgatgctggctggttgggcaagaagagtggcaagggcttctatgactaccaa

SEQ ID NO: 26813 - DNA, 2143 bp, Neurospora crassa
ttcgaacatgtcagattccgacaggaaagcgcagacgtcggaggagcagaataagcaaagcgaaggcaaggaagccggccaacagcagtccgacggccaacaaggaaagcaaagtggtgagcagcaaggccagcaagggcccaagaggcctggtgctcagggccaaggtggtcaagagcctccccagggctttgacggcggcctcatgaactatgttattggtaccgctgttctgttctggacctacaaggtgctgttccccggcaacgactctcgcgagatcacctggcaggaactgcgcaagaactttctggaaaagggcctggtcgagaagctcacggtcgtcaaggatcgtgttatcgtggatctcaacaaggaggctgtcaggcaaatgtatcccgactcgcccgccgcttctcccggcttccactactacttcaccattggctctatcgatgctttcgagaggaggttagacgaggcccaggctgagcttgggattccgccagctgagaggatccctgtcagctatgccaacgaattcagctggggcaacatcatccttgccttcggccctaccctggtgcttgtgggtttgcttgcctacatttccaggagaggtcctggcggcgctggcggccccggtggcatgttcggcatcggcaagagcaaggccaagatgtttaatcacgatactgcggtcaaggtcaagttctccgatgtcgcgggtatggatgaggccaaggtcgagattatggagtttgtccagttcctcaaggagcccgagcgcttccagaagctcggtgccaagatccctcgtggtgctatcctgtctggtccccccggtaccggtaagactctgcttgccaaggcgactgccggtgaatcgcaggttcccttcttcagtgtcagcggttccgaattcgtcgagatgtttgtcggtgtcggtgcgtcccgtgtccgtgatctctttgccacggcgcggaagaacgctccctgcatcatcttcatcgatgaaatcgatgccattggtcggtctcgttccgacggcggcttcaggggtggaggaaacgacgagcgcgaggctaccctcaaccagattcttacagagatggatggattcaatacaactgagcaggtagtcgtcctcgccggtaccaaccgacccgacatccttgacaaggctcttatgcgtcccggtcgcttcgatagacacatcaacattgataggcctacgatgaagggtcgtcaggacatcttcaaggtccatctggccaaaattgtgaccaaggaggatatcgagttcctcactggccgtctcgctgccttgactcctggcttcgctggtgctgacattgccaacgtcgtcaacgaggctgctcttgtcggtaagttttttcttgaccttgactgtcgtatccccgcttgatgtcatgtgctaacaacgtgcatagctgccagagcgaatgcggagacggtcgagatgatccacttcgagcaggctatcgagcgtgtcattggcggtctggagcgcaagtccctggttctcagccccgaggagaagaggacagttgcctaccacgaggccggccatgccatttgcggctggttcttccagtgggccgaccctcttctcaaagtctccatcattcctcgtggccagggcgcactcggctacgctcagtacctgccatctggtgacgcctacctcatgaacaccaagcagctgatggaccgcatggccatgactcttggtggccgcgtgtccgaggagcttcacttccccgtcgtgacaacgggtgccagcgacgacttcaagaaggtcactcgcatggcgcgcgctatggtgacggagtggggcatgtccgaaaaggtgggcatgctgcactttgacgacagcgcggagcggttccagaaaccgtttgccgagtcgacggcgcaggccatcgatagcgaggtgagacgcatcgtcgacgaggcctacaagcagtgcaaggacctcttgacggccaagaagaaggaggttggcatggtggccgaggagctcctcaggaaggaggttctgtcgcgtgacgacctcgtccgcctcctcggcccccgccagtggcccgacaaggaggagttctccaagtacttccacggc

SEQ ID NO: 26814 - DNA, 5910 bp, Neurospora crassa
ctgacttgttttcttcattttcttttgctgcaggaactggctaaaatttgcgaagacattcccgaaagaacagctgcagccacaaagctggaaaccctcttcctcgtgtcactttgctcggcggagattgaagtttgtcagatagtgacatcttgcatcggaagcttcctcgaagaatgcagaatcatcgatgctgccgcatgctcggcatcgaagccctctctggctcttttgcgaaacgcagatatcttcagcgagatctcgtcacggacttttaggtttaccggcctggttgctttccaaaagcgcaacaggggactgctacggcgcttgcagtatcccagcgccggtattctgaatgcgtgggagaccgtttttgagagatggcttcacttgtccaaggatgtatctctgacatcggccgagtccatgggtgaaagagttgtggctgagtggcgcaactattccgggttccttgcctccctgggcggaatatgcacggctgagcaagccgctactctggaggagccggcagtcagtgggttgcggtggattgacaggctgtcctccgacaaccacgaagaacctttcctcaaccgatacctaaggctcagtattcagctcctggcttgtactaacgttaggatccgggagacgatgagggagatcctcgcaaccgaagtatcgcctgcgctgtatcagcacttgttcagagccctcgaatcagaacttgacgtactattcactggggcccttgaggcgccctcgaggggccaagacaacgagattatgtttgccgaacaagcagcatcgctccttaggtcgttggtggaaagacttgacacgccaactgagcttggcgccgcatcttcgctccatctcaactcactcacgcacagcttcgccaagttcttggacggggtaccagactcgccgaacagtttgcgtgtcaaaattaaaatctgtcagctctgtgaggccattgtcaaaagaaaggaacacctcaatctccgtgacgatgtccgcatccgaaaccaacttcttgcctacgtctatagctgggttacgaggcctcattcacccaggattgatgcgggcgccttcggtcaaagccgccaagacgagatgattagggtgcagaaggatctcgacagggcatgtcttaaggcgctggctgaacttacatatcgcctacctttgcagctgaacgactctacgaacgatgccacaaccagcgagcgaaaaatgaaactgttcgagtcgtacttcagcaggtttttggaggttctggaccctcaatatgagcatatgttccggtccgagcatactggtagctcttcctccagagatggagagccgtcaatgtccgatctatcaatcaccatcatgtccaatctcttgagcgccaacatcgatgtgggactcaagtcagccctcaacgtcggataccacgaacacgccgagatccggaccgcatttgttagggtgctctataacatcttggttcagggggctgagttcaacaatctctcaagcacagcggtgaatgaaaaatacgatgagcttctgagccttctgacgaccgacactacactggctatggctatgggtgcggtttgccccagtcatgaggtggatgagctgacaatcgcgctgcttagcatctacgaatcaagaggccaaagttttgtgctccttgaggccctgatcaaacaggagattgaggagacggagaatgaatcagagttgctgcgtaggagctgtgtcgcgaccaaaatgctctcaatttatgcgaaatggaaaggcgcagggtacctcaaagctaccctgcaaaaggtactggaccggttgatgcaaacatcgaaagacctcaatctcgagctcgatccgaccagggtatcttcaccggaggaattgcaaaagaatgccttgcagctcgaaatcgtggccaatgtattcatcgatgacatttgcgcctcatcggccaggataccgccatcatttaggaaaatctgcagtatcgtaagtgccgcctgtctacgggttgctgccaagtactgagaactaatccgacgcgtgtaacagattgctgcagcggtgatgccccgattctctgaggctaagtacacagcagttggcgccttcatcttcctgcgcttcttctgcccggccattgttgctcctgaggttgagggcttggttgctacggcaccttccaaggagatgcgccgtggtctcctcctgatcgctaaagtcatccaaaacctggccaacaacgttctgtttggcgccaaggaacctttcatgttcccattgaacgacttcttgacaaagaatatctatcgggtaaccacctttctgagggagatctcggtcgagccggaaaccatggagcgtcccaacagcgacgagtcatttgactttggttcttgtgtgtctcttcacaggattttgtatgaccattgggaccaagttcggcaacggctcgcctcaattgaaaggcgagaccttgtgaggtcaccttgcgaacccacaagaggaaagccaaacctccttgaacccctgagaagcctcatcatgaatttgggaccaccgccgctggctgtgacctggaacaggccacacatctcagcaaacctaccacctgtttactctagattccaggattttatgctccgaaatgcgttccgcggtgtcgaatcttcgtcgactccaccccccgccgtttatgatgctggcgagtccagggacggcattcagatgatctgcatcatgctgcggtacatagacaccgaatctgccgacgttgatgcatacttgtattactatctcaagattgctagtcgactttgggatcggccatttggcattttcattgatgctacgttctacaacgtgcagtccgaaccagcggagagtctacttcgcaaaatcgaactgcttacaccaactgagctctcgaagcagctccagcgcgtatacatcttcaacatgaactccgcctgcaagaagggtttccgcaaggtgttcaagacttggattagaaacgagaacagcatctatagccccgccaacattgaataccatcttcttggaagttaccgagagtatgatgcccatttcgaccacaaaaaatttagcctgaacaaggacaccagggaattcatggacgagactctggatggtttcaacatcacacggctgtcgaagaccaagggcaaaattgacgtttccttgtcaatcagcaaaagcttcgtcagggtttcgaccaagaagaggcaagaaatatatccagcatcccggattagtgtggtaatcaacgatgcctttcgcctgagcgaggttgaggaggctccaacatccatacaaacggaggatgattcggcgtttggtcttagagcagataatggcaagattgtgatgtacttcacaagtcctgagaaggccaaaatcttgagtctccttcgcatgagaaaggcgcaatacgtcaaggacccaaagcagatgcaaccgcacgaaagattcatcaaaccacaggatgtacccggtactctgctgaacttggcgttgacgaacctggctagcccagaccccgttctcaggctatcttcatacaatttgctgggggcactgtgcaaatcattcaagttcaaggctgcttcgagacttgtcagcaccaaagacattgcagttccgagcgatgcttcgcagttcatcatccaaatcagccagaagctagccgaatcagaaccgcagcttactggggatttcttgaacgagtttttcgccagttggcccagcttctctgatgagcagaagccgttatgtctcgcctatatggctccctgggtacccgggttgcgcccgtctctgctcgctaatgaggtggacggggagaagggcatggaaaagattgcagccgtcttaaggaagctcattgacattgccctttcagacccagcggttcttttccagctgcagcaatccgtttggcccgctatccagcaggacgaaaaactgcttgagagtttccttgaagaggtcatcaaggccgcactcaacagaggatttggcattgcggagacagacacgttgacctcgatagcaggcggaattggcacggttaccctgcgtggaaggataatctccagactacgcaaggcactaaaccggtcttccttgcgcccgacaaagtatctacctgacaactcggtatggaacgaaatctgcgtcttgctacaattctgcctcgccttgtcgtttgacagtggcgagcaagctgagatgtttatgccggaaatattccacattgtcaccatgcttgccaatacgggcaatccagacgtcaggcaggtggtccaccgactactaatcaacaccatacatgcggcttgtacttcgtttgccttggacgaggtacggctgaataagctgaaggtgacgctggacacgttgtcggatccgcggagcgacctcttcacaaacaacgtcacgtttacgcgggatggggcatcgatatcaaccaaccaggacggaggtgctaccttgacagccaccgaaaacctggcaactcttctgttcgagacctgctctattgccgctccaactgttgacctcgcaaacaaatggcggtcgcgatggatgggcctcgtggcgagcacagctttccagaacaaccctgctatccagcctcgtgctttcactgtcatgggctgtctagcacgtgaggaggttgatgacgacctgctttaccaggtccttgtagcgctccgaaacagcatcggccgctttggtgatgacagtaacagtgacatgctggtcgccatcgtcacctcgctctccaagatgatgtccaagctgccatctgcgtcccgttacggtctgcagctcttctggcttgccatgtccctccttcgactggtgccccccaacttgttcaactgcactgcaatgttcttggagtcggtcttgaccaacatcagcacgacgggcgacctcaagggcgagaagatggttcattatcttctccagggaagggcccagctggaggaggccgcgctcctgctcgatgaggcatacggtattcacttcactgctgagaacttccactttgccgcgtgcgcatgcttggtcaggggattgacagacacagtcaccaagtcaacggcgctgagggtgctgtccacgtttttggagatgaccactttcactgtgacaactgtgaacgcagctgtggcaaatgctactccggatggaatcctgagcccgacggtgcagccgctgaagaccatgagggaactctgcgcatcaccatacatggccttgatcctagcaaggacgctcaacttggatgagcttagggatagtctctggtctgcgggtatcaacgtcaaccccaacagcaacggcctacctccgttctcgtccgtttctgcctctgttgctgccggtggtctgggcagtggacttggagccggcggtgaccctctcgtgggggacgtcgccagtgacgcagtaccttcgcctgcagccgcagccgccgacacgtcagcgattgacattcgccggggtgcgaacgacttggactacatcaaagacaaggacttgctcctcaacacggccattgagctcgtagactttcagtatcttgaggatgcagtgcagaaccgcacgctgatgtggctcaacgagatcgctgtcggcagaccgtcggttatcatgcatctctgtggacccatcatcagtattctcgacgacattgtgctgcactgccagaacccgtcgacgctggagagcgcgcacgagctgctgcagacgctgacgaacaaccccaagttctcgggggcaatggagcaagcggctatgttgaacgagatcttggatgagatgggttttggtgggctgtggagg

SEQ ID NO: 26815 - DNA, 894 bp, Neurospora crassa
atgtcgtcctcattaccttgggactacatcgcaaagctagtgtgcatcggcgactcaggctgcggtaaatcctcgctcaccatccggctctgcgagggccgcttcgtcacccaccacgacgtgaccatcggtgtcgaattcggctcacgcatcgtccccgtcggtcctcctcacagcaacctcgattcccaacaatcacaacaacaacaaccagcatcctccacaaccaccttcacctcagattccacaacaacaacaataccaaacactacaacctcctcctccgggggcctccccccacccccaatagccgccaagccctcctcctcttcttcttcagcatccgacccccctgtcccgcaaaaacacatgaaactctccctctgggacacggccggccaagaaacctacaaatccgtcacgcgctcctacttccgcggcgcctcgggcgccctcctcgtcttcgacctctcgcgcaaacagacatttgagcacgtaaccgactggctgaacgaccttcgcgccattgccgagccggacattgtggtgatcttggtcggcaacaaggccgatcttaccgaagcaaacgacgaaaacgagggagaaaacaacaagcgagaagtaacgaggaaagaagcggaagagtgggcaaggaggaatggagtgctcgagtacgtggagacgagcgccaagagcggggagaacgtcgagaaggcgtttatgagggtggccgagaggatataccagaatattcaggcgggaaagtacgatttgaatgatagacggtcgggggtaaaggggcctagtgctgggttaggtggaggcggcgcaggagggggaggaacgcatgtgaagttgacgggggataaggcgggcggttatggagggtgttgt

SEQ ID NO: 26816 - DNA, 1579 bp, Neurospora crassa
ctccaggctgtgtcgggatctcttcccgatagatcattgactgacatccatgccagccaggagcccgacccggcaactaaatcccgtgctgtgcctatttacgccacttctgtaagtcgacaatatctcgcctacgaggcatacgagctcaaggggggcaaatgttgaccagtcaagtcgtatgttttcaatgacagcgctcacggggcgcgactgttcgggctcaaggagtttggaaacatctactccagaatcatgaagtgagccaaagcaagaaaacttgaagtgaagtcgaaacaagtgttctaacgctggtaccagccctaccgttgatgtctttgagaagcgcatagctgcccttgagggagggctggcagcaatcgctactgcaagcggtcaagcagctcagttcatggctatttctggggtcgcctgcgctggtgacaacattgtttcgacctccaacctgtacggtggcacctacaaccagcttaaggtcatgctcccccgctacggtatccagaccaagtttgtcactggtgacaagcccgaagacctcgccgcagccattgatgacaagactaaagctgtctatctcgagagcattggcaatccccgctataacatccccggcttcgaggccatcaccaagcttgcccatgagaagggcgtccctgttatcgtgagtttaacagttgtctactctgtacaagctcaccggagaacatttgctaacttacgctcttcctaggtcgacaacaccttcggtgctggcggctactttgtccaaccgttacaatatggtgctgatatcgtcgtgcactcagcgaccaagtggatcggaggacacggcacaacggtcgcaggcgtaatagtggatagcggtaggttcgactggggcaagcacgccgaccggttcccccagatggttgagccgtccgagggttaccacgggctcaagttctgggagacttttgggcccatggcctacatcacccgcgtgcgtgtcgaaattttgcgggatctaggcgcgtgtctcaacccgtttgccgctcagcagctcctcctcggtctcgagacgctgtcgctccgctgtgaacggcacacccagaacgcactcgcgctggcccgctatctcgagaagagcccgtacgtgagctgggtgtcgtacccgggcctcgagagccacgggtcgcacgagaacgccaaaaagtacctcaagcgcggtttcggcggcgtgcttagtttcggcgtcaaaggcggcgcttcggctggcagccaggttgtcgatggcttcaagctcatctctaatctagccaatgtcggtgattgtaaaacactggctatccacccttggtccaccacgcacgaacagctgacggacgaggagaagatcagctcgggtgtcacggaggatctgattcgcatctcggttggcattgagcatattgatgatataattgccgactttgatcagtcctttgcaaatgcggcggcgacttcggccaaggaggagggtgagaagggcttggtggttggtcagggcaaggttgaagaggcggcgcctactgttatctaa

SEQ ID NO: 26817 - DNA, 2276 bp, Neurospora crassa
atggcgccctcacaagataccgcggcttatatcaagtcgattgcggaaccgccacctcctgggactccttacgccctgcctgttcctggaacacagcgaccgaaccgtacggcagtttatcgtcattggaagttcgtcaacagccctctcctcgagacgctcgacccggctcaccagacggttcacgatctctttgaagcctcagttgagaaggtgcccaacaagaagtgcctgggatggcgcccatggaacgctgccaccaagacctacgagcccaagtatgtttggatcacttacaaggaggttgctgagcggaggaagaactttggcgccggcattgtcgccatccacaagtccatcggcttcaccgaggagaagtatggcgttggtttgtgggcgcagaaccgtcccgagtggcagatcactggcaagtaccgacttggacacaatgcgccgtgcacgtgcatgatgcacgaggtatgctaacagcatcacagagcttgcgctcctctcccagtccctgttccccatctctctttacgagactcttggtcccgagaccaccgagtacatcatcaaccacagtggtcttactgccattgcatgctctgtgccccatatcccgaccctcctcaaggtcgcgccgcgttgcccaaccttgaagctcattatctccctggatcctctggatgctggtgagcctgctggccacactaagcgcgagctgctcaatgccgccgcttccaacgtgggcatcaagatcttctccatcgacgaggttgaggcgctgggtgtcaagtcgggcctctccatgaagcctcccaagcgtgaggatgttctgaccatcaactatacctcgggcaccactggcgacccgaagggtgtcctgatcacccatgctcagggtgtggccggtattactgctgcccgctcgatgcagagcatcctctcctccgatatccacatctcctaccttcccctggcgcacatttacggtcgcatggccgaccagaccgctttggccgagggcgctagcatcggttacttccatggcgacatcgccggcctggtcgaggacatgaagatcctgcgcccgaccggcctcatgtccgtcccgcgtctgtacaaccgcatcagcggcgctgtgcaggccgccaccatcgacgccgacggcttcaagggcaccctgtcccgctacgttgtggaggccaagaagcagagcatggccctgcccaccggcaaggccaccaacaagcacttcctgtatgaccgcatctggaccaagaaggttctcaagggcgtgggcctcgaccgcgcccgcaccatggtcagcggttccgcccagctcgaccctgaagtgcaccagttcctccgcgccgccttcggcaacgatttcatccaaggcttcggcatgaccgagtcgtacgccacgggcaccgcccaggttcccggcgacttctccaccggcaatattggccccccttgcccctgtgtcgagctctgcatcgagtccgtgccagactacgactacactgtcgacgacaagccgaacccccgcggcgagctgctgatgcgcggtcccatcatgtttaaggagtattacaagaacccggaagaaaccgccaaggtggttgaagcggacggctggttccacacgggcgacatcgtcgaggttgacagcatgggccggttcaagattatcgaccgcaagaagaacgtgctcaagctgtcgcagggcgagtacatctcgcccgagcgtatcgagaacgtatacatggccagcaccaacctgatcgccatggcatttgtgcacggcgatcccaaggagtccagcctggtggccatctttgggatcgaccccgtcaccttcgcgccctatgccagcaggatactcaagaagaatattgcccctgaaaaccttgaagagctgaagcagtccgccaacgacccccgtgtcaagacggctttcctcaaactgctggatggcattggcaagaaccacaagttcaacagctacgagaaggtcaagaatgtttatttggatattgagccgtttacgattgagaatgagcttttgacgccaacgtaagtcctgatcctggtcatcctactacaacaacaacaacatgcgtgacgatctcgggcaggatactaacatccacaaacacagtctcaaactcaagcgtccccaggccgccaggaagttcagggccgaaatcgaccgcatgtacgaggagatcaacgctgctgcccagaccaaggccaagctatagaga

SEQ ID NO: 26818 - DNA, 1267 bp, Neurospora crassa
atgatgtcccgggcaactactcgcaccatcaagtccgctgtcggacaaatccaggctcgctctgtgtccaacagcgccgccagcagtaccccccgccatcttctctccatcagccagcttagccctgccgagttctccaagcttgtcctcaatgcttctgcttacaagcaggccaccaaggccgccttcgctgctggccccggccaggtaccccgcactttggacggcaagctaaagggacggaccgtggccatgatgttcagcaagcgaagcaccaggacccgtgtctcgaccgaggccgctgtggccctcatgggcggccaccccatgttcctcggcaaggatgacatccaactgggtgtaagtgttaactaccgtctcggctccatcgtccctccccttgcctaaaggagacacatacatgcgcaacgaccagcacctcgatcgctaacgacactttccacaggtcaacgagtctctctatgacacttccaaggtcatctcctccatgacctcgtgcatggtagcccgcgtcggtcctcactccgacgtcgccgacctcgccagggactcatcggtacctgtcatcaacgccctgtccgatgacttccacccgctccaggccattgccgacttccagaccatccacgaggcttttgccaccaagcccgcccacgaggccagcctcggactcgagggcatgaaggtcgcctgggtcggcgactctaacaacgtacttttcgacatggctaccgcctgcgtcatgctgggcgtcgacattgccgtcgcctcgcccgccggctacggcattcccgaccgcatgaagcagatcatcctcagcgtcgccgagggcgttgccaagcccggcaagctgatcgagactacggtccccgaggaggctgtcaaggacgctgatatcttggttaccgatacctgggtgtccatgggtcaggaggccgagacccagaggcgtctcaaggcgtttgccggcttccagataaccaacgagctggctaagcgtggcggcgcgaagcccggctggaagttcatgcactgccttcctaggcaccctgaggaggttgatgacgaggttttctatggtcctcagtccttggtcttccccgaggccgaaaataggctctgggctgccgtctgtaagtgaagcgatcttattctgccccgcggatgaagcttgagctaatcacgtttgtgcttttacctagctgcccttgaggctttcgtcgtcaacaacggtaggatactttga

SEQ ID NO: 26819 - DNA, 1718 bp, Neurospora crassa
atggctcccgttatgcgcctgggctccgccgccctgaggtcctccatccacctcacttctcgccagactgccttcactgccgccagatgctactcttccaagactcaggtaaggcagtctcatgagccggggacacactgacatcatccgctgaccgcgcttctttggccgtactagactctcaaggagcgcttcgctgagctcctccccgagaacatcgagaagatcaaggccctccgcaagtaagctctacctctgcctcggcataagccgtcgatagcttctcgactcgtctatcgtgttgctgatctgtcctgccaacctcagggagcacggttccaaggtcgtcgacaaggtcactctcgaccaggtctatggcggtgcccgtggcatcaagtgccttgtctgggagggttccgtcctcgacgccgaggagggtatccgtttccgcggcaagaccatccccgagtgccaggaactgcttcccaaggctcccggcggcaaggagcccctgcccgagggtacgttcacacgcctgcgcgccttgccaggaccatgcaccgtgagatatcgtgtttaagcggtcttgtgtattgacttgatacgcaggtctcttctggcttctcctgaccggtgaggtcccctccgagcagcaggtccgcgacctttctgccgagtgggctgcccgctccgatgtccccaagttcattgaggagctcatcgaccgctgcccctctgacctccaccccatggctcagctctccctcgctgtcaccgctctcgagcacacctcttccttcgcccgtgcctacgccaagggtatcaacaagaaggagtactggggctacacctttgaggactccatggacctcattgccaagctccccaccattgctgcccgcatctaccagaacgtcttcaagggcggcaaggtcgctgctgtccagaaggacaaggactactccttcaacttcgccaaccagctcggcttcggcgacaacaaggacttcgttgagctcctccgtctctacctcaccatccacaccgatcacgagggtggcaacgtctctgcccacaccactcaccttgtcggctctgctctcagctctcccttcctctccgtcgctgccggtctgaacggtctcgccggtcccctccacggtcttgccaaccaggaggtccttaactggctcaccgagatgaagaaggtcatcggtgacgatctctccgatgaggccatcaccaagtacctctgggacacccttaacgccggtcgcgttgtccccggttacggccacgccgtcctccgcaagaccgacccccgctactctgcccagcgcaagttcgcccaggagcacctccccgaggaccccatgttccagctcgtcagccaggtctacaagatcgcccccaaggtcctcaccgagcacggcaagaccaagaacccctaccccaacgtcgatgcccactctggtgtccttctccagcactatggtcttactgaggccaactactacactgttctcttcggtgtttcccgcgccattggtgtccttcctcagctgattatcgaccgcgccgtcggtgcccccattgagaggtatgtcttgctgctatatgatatcgtgtcgatccagggctatggctaacacttcgactctaggcccaagtcttactccactgacaagtggatcgagatctgcaagaagctttaaatc

SEQ ID NO: 26820 - DNA, 943 bp, Neurospora crassa
atggcgattttactcccacgcaacgacgtcttgaacgtccatcccgctcctcagggccagcatctaagtgtgcacggttcggattggctttgggctgctactgccctctttgcatttaacacagtaagtctcatctaataggaccttcctgatcatgttcctgggctgacttatttttccaaaatagctcgtcctatttgctctcaaatttaaggccagtcgcggtgaacgcctctggcattacatctggattgtcaccaacctggtggctaccttcgcctactttgctatggcggctaacctcgcctgggatgtggtcagccaaaggaaccaggttcgtcaacatggccctacccgtcagatcttctgggccaagtatgttctatgggtcgtctctttccctgcggctatcctcgccatgggcattctctccggtgtctcttgggctaccatcgttttcaacatcttcctctcttggatctgggtcatcggttacctcgtcgccgcctatgttccttccaactacaagtggggtttatttgcctttgccgctcttgcccacatcttcctcgcttttgagaccctgttccgcgcccgcagctcggctaaccgtgttggtatcaaccgcgattacacgatgctctctggctggaccaacctcctgtggctcctctatcccattgcctggggtgtctctgacggcggcaatgtcattggtgtcaccaagagcatgatcttcttcggcattctcgacgtcctcttcatcaccactctcagctacgcctttgtcgtcctcagccgccgctgggactacagtcgcctcaatattgccttcactcagtacggccgcgtccccatcgccggtacttatcccgagaagcatgccaccaccgatccacactccggcgtgactgaccctcacactgctgctcctgccgtttaa

SEQ ID NO: 26821 - DNA, 3799 bp, Neurospora crassa
agtctcccacgtaaccaggtcccagagtgggcagccttttacatcaactacaaaggcctaaagaagctgatcaaggccgcccaaggagcagccaagaatggagagccggtagatttggccgagttcttcttcgccttggaccgaaaccttgaagatgttgactccttctacaacaagaagtatgccgaggcctaccggcggctgaaggtgctgcaggatcgctatggcaagactcccgagattgtctccaacctcgacgacgacgaggttgaggagctgatgggagcccttctcgagctgcgaagtcagttccggaagctgcaatggttcggcgaaatcaaccgtcgtggctttgtcaaaatcacaaagaagctggacaagaaggtccccaacacaaaaagcacccagcacaactacatttccacaaaggtcgatctgttgccgttcgccaaggataccgccatcagcctcctgttgaccgagatcaacaagtggctgtcaaagctgggagatgcgcagaacattgatgagaccaaatccgagagatcgacactctcgctgggtcgtgcttctgcaaaggcaatgcttaacatacccagtgcgcttttcgacaagttggaccaagccattcgtaaagacgaagtcgcggctttggagaaaggtctaaaggagggaaacctagcgagctccgagggctcatcaccattacaacagcccttgctgcttaacctactccagcggtccatttcctcccgttcgagagactgtatcgtgttcctcctcaagcaagtcaactcgctggacgagcccgacgacatcaacgaacgcaactgcatccacagacttgtcattcacatcggtcgcacaaaaacggcctcgctcctcagtagtgagccagaagctgaatcgtaccccttcccgcgcaccggggttcactacgcccagccctacctcaccccagccacttctcccttgtcggcaccgcgcgggacgaccttgaaggagtcaaaactcctcggccatgatgatgaagcaattcagctgctcaagtacctactagaaaatctgagaccagaccagagagtggctctggttgccaaggacggatttggccgtataccgctccactatgccgcgcagttcggtttcgtcgtcgtctgccagatcatcatgcgcaagatgcaggactggggacagttcaacgtcgagaatggcatcgacgcccccgaatggcaagacaaggatggaaacgcgccgctgcacttgagcgttataggcggccacccgcttaccaccaaagcgctgcttcaaggagagaactggaagggggttaatgaccaccaagccgaaatgaggcgtgccatctccaagtcgagtgcggtgctggctctcgcgaccaaggccaactccaaggacatcgtcgagctgctggtcaatgcaggagtggacatcaactggcaggacaacagcggcgagacagccttgcacgttgctgccagatttggccacgatgagtgcgccagggtgttgctcaagggtactgagcagcaaaaggccaacctggaattggctgagaagaactttgcgtggaccccgctgcacattgcggcggttgatgggcatctgggtgtcgctcagctgctcgtggatgctggtgcggatgtggacaagttggattcgtctggctggacggcaaaggagcatgcggcgctgagaggccatctcgatattgcacgactcctgtctgctcacagtcaagcccctgaggatgaggggggcagcagctccgacggcgacgatgaaaagtcatcgacgaccacaccgtaccccgagaccgacaacaatacgctgtctgcatccctgggagatagacggtccaacgcaacgtcgcgtcccgccgaacccgtcaagacctttggtcacaggtacctcaaggatgagagcctcgtgctggtcagtctgggttcaatggatatgcgcaagggaattgaggcaatcaagctggacaaggtgcctcttgccgaagcgcacactacacagttggatacggctctgtcggttgtcgtctccgcccaaggcgccaagggcgacccgactatgatcgacctgcctgttcacgagaacatctctaccgagcctatcctcttcaccaccagggacgccgccaaggtcagactctttttcgatatcgtgccgacatactcgggtaacgagaagaacaaggttggccgaggtgttgctctcctttcgagtgtccgtcccaccgtcggcaccaagaggatgaatttgcaaggcgacatctcggtgccgattatgggcagcaactttgaagtcatcggcacagtcaatttcaatttcctggtcatcactcctttctctcacccaaagatggaagtaacctctcagcagacgtactggaagaagctggactctaccatggttattggccaccgcggcctcggcaagaacgttgtcgccaacaagtccctccagctaggcgagaacacgatcccatccttcattgccgccgcaaacctcggcgctcaatacgtcgagttcgacgtgcaactcaccaaggaccacgtccccgtcatctaccacgacttcctcgtcagcgagacgggcttcgacgcacccgtgcacaccctcactctcgaacagttcctccacatcaacccagactcgtcccgctcgggcacccaccaccaccaccaccaccaccatcacggtcaccacggccaccacggccaacctggccaacaagcccagcataggcagctgaagaaattccgcagcaatagccccggcccacggcagcgctccatgtccatggacttccccggagatggtaaagacctgatggaagagcgcatgaaacacacgcgcgacttcaaggaaaagggctacaagggtaactcgcgcggcaatttcattcaagcacccttcgcaacgctcgaggatctgttccgcaagctgcccgagagcgtgggcttcaacgtcgagatgaagtacccgatgctgcacgagacggaggaacacgagatggacacgtacgcggttgagctcaactcgttctgcgacacggtcctccagaaggtgtacgacatggcggggcagcggcacataatcttttcgagcttcaacccggatatttgcttgtgtctgagcttcaagcaacccaacatcccgattttgtttttgacggatgcgggcacgtgtcctgtcggcgatgtcagggcaagcagtctgcaggaggccattcggttcgcgagcaggtggaatctgctgggtattgtgagcaacgccgagccgctgattaacagtccgcggttggtgagggtggtcaagcagagcgggttagtttgtgtcagttatgggtcgcagaataatgatccaagcttggtgcaggtaggttttttcatgatgcattcaaattccttttgtcattcgaaccaggctaaccaactttcttctttactcatagaaacaagtcaaggagggcattgacgccgtcattgtcgacagtgtcctggctatccgtaagggactgaccagggaccaaggcaacgtcaatggtagcggcggcagtaatgccaaagaacttcagcaaagggtgagggaggtggaggaggcaatcaacaaggaggagcgaatcgaggaagagggctcgtctgctgagggaagcagctatggggatagtaacggtaacggtaacggtaccgagattcggatgactaccaatgcaggaggagacccaaagacggaaatcaaggagacaatgagggctttgcggacatga

SEQ ID NO: 26822 - DNA, 1129 bp, Neurospora crassa
atgcctcagttcgagattccagaacagcaatgggcccaggtggtcgagaagaagggcggtcgtaagtccaacacccctttgtccttactagtggcacctgtgacccgtattctgactttccttttcagccgtcgtcttcaagcagatccccgttcagaagcccggccccgatgaggtccttatcaacgtcaagtactctggcgtctgccataccgatctccatgccatgaagggtgactggcccctcgctaccaagatgcctctggtcggcggccacgaaggcgccggtgtcgtcgtagccaagggtgagctcgttactgaggttgaggttggcgaccacgccggtatcaagtggctcaacggctcctgcctggcctgctcattctgcatgcaggccgacgagcctctgtgccctcacgccctcctgtccggctacactgtcgacggttccttccagcaatacgctatcgccaaggccgcccacgtcgccaagatccccaaggggtgcgacctcgagaccaccgcgcccgtcctctgcgccggtatcaccgtctacaagggtctcaaggagtccggtgttcgtcccggccagtgcgtcgccatcgtcggcgccggcggtggtctcggcagcatggccattcagtacgccaacgccatgggcctgcacgccatcgccattgacggtggcgaggagaagggcaagaactgccgcgagctgggcgcccaggcctacgtcgacttcactactaccaaagaccttgtcgcggacgtcaaggctgccacccccgacggcctcggtccccacgccgtcatccttctcgccgtgtccgagaagccgttccaccaagccgtcgattacgtccgttcccgcggaaccatcatctgcatcggtctccccgctggcgccaagttccaggcccccgttttcgacaccgtcatccgcatgatcaccatcaagggctcgtatgtcggtaacaggcaggatacccaggaggcccttgacttctttgcccgcggcttgatcaaggttcccatcaagacggtcggcctcagcaaattgcaggaagtctacgacttgatggaggagggcaagattgtcggcagatatgtcgtcgataccagcaaatag

SEQ ID NO: 26823 - DNA, 1055 bp, Neurospora crassa
atgaactctgccacctccaacttcgaggtcgatgccaccggcgtctcacccaagcaaatccacaacctcatcccatcgctcaagctctccgatggcaatgagatccccatggttcgtccctcttatcccttcatcccttcatccttccctctcctgcaaaaccacattctaacaaaatcacttacactaaaaaacagctcggctacggcctcggtacagccaactacaaatccggcgactccgccgacaccatctccgagcctattgtcaatgccaccttgaccgctctcaacgccggctacgcgcacctggacggcgccgaagtctacggcaacgaagtcgagctcggcagagccattgcgcaatccaagctgcctcgctcgtccctctacatcaccaccaagactattgtccgcgccggagacacagtcacccagtctttcaaccgctcgctcgagaagctcgggctcgattacgtcgacctgtacctcttgcactctcctttcttcgccaagaaccccgagcaactccaggcggcgtggcgggaaatggaaaagatcaaggatagcgggatggccaagtccattggtgtttccaatttcctgatctcgcatctgcagaccctgtttgacattcctggagggttgcagtacccgcccgtcgttaaccagattgaataccatccttaccttcagcatgtggttgagggcgaggatttggtcgcgttttgccgggagaagcacattgctattgcagcctattcgccgctgacggccatcaccaaggctcgcccgggccctgtcgaccccatttacacgcagctggccaagaagtacggtgtcagtgaggccgagattgccttcagatggtgtctggatcagggtattgtgacgctcacaacgagtagcaatgaggagaggctaaagggctacctgaagaagctgcccagcttcaagttgacacccaaggaggtcgaggatatcgcgtcagcgggaaaggagaagcattatagggtgtggtggactgaggaattcgctggggacgacaggcattaa

SEQ ID NO: 26824 - DNA, 2706 bp, Neurospora crassa
atgttgaggtcgacattgtcccgttcggcttggcggactggcaggcatcaggcggccaggaacgccagccgtgccttttcggccacagctcagagacccgcagaggtcgagctcacaattggtatgtctccatccagacctccaccacatgactagcatacaccgtgtatgatccccgtacccgtcggcgccgatactgactcgtgtctcccgcatctcacagatggaaagaaggtctctatcgagggtgagcactcacaatgcgctgcgtcgcaagtcctggctacggataatggggatgaggggggcccaaaaatacggacatggtcgtcgctaatactcgaggaaaccaccagctgggtcggccttgatccaggcttgcgaaaaggccggcgttaccattcccaggtatgcggaaaacggaccctgaatctcgggactgcccgtagaggttcttgctgactgttttgcagatactgttaccatgagtacgtcacatgtggctcgccccgctctcccaaattgatcgcagctccagtcactccagcaggcgtcagccctacgaagatcgactgacaaatgttgtaactttccaggaagctcatgattgcgggcaactgccgcatgtgcttggtcgaagtcgaaaaggtcccgaagcccgtcgcgtcgtgcgcatggcccgtccaacctggcatggtcgtcaagaccaactcgcccctgacgcacaaggcgcgcgagggtgtgatggaattcctgctcgcaaaccaccccttggactgccccatttgcgaccagggtggtgagtgcgatctccaggaccagtcgatgcgctacggcggcgaccgtggtcggttccacgaagtcggcgggaagcgagcggtggaggacaagaacatgggtcccctcatcaagacctccatgaacaggtgtattcagtgcacgagatgtgtgcgattcgcgaacgatattgccggcgccccggagctgggttcgaccggccgtggcaacgacctgcagattggtacctacttggagaagaacctcgactctgagctttctggtaacgtcatcgatctctgccctgtcggtgctctgacctcgaagccatatgctttccgtgcgcgcccttgggagctgaagaagacggaatcgattgacgttctggacggcctgggctccaacattcgcgtcgacactcgtggcttggaggttatgcgcattcttcctcgcctcaacgacgaggttaacgaggagtggatcaacgacaagactcgctttgcctgcgacggtctcaagacccagcgtcttaccatccccctagtccgaagagaaggaaagttcgagccggcgtcatgggaccaggctttgaccgaaattgcacacgcttaccaaacgctgaacccccagggcaatgagttcaaggctattgctggccagctcaccgaggttgagtcattggttgccatgaaggatcttgccaacaggctcgggtcggagaaccttgcgctggatatgccctcgggccacaaacctcttgctcatggtgttgatgtccgctccaactatatcttcaactccagcatcgtcggtatcgaatctgctgatgttatcttgctagttggtactaacccgagacacgaggccgctgtactcaatgctagaatccgtaagcaatggctgcgctctgatctcgagattggcgttgttggccagacctgggattctacttttgagtttgagcacctaggtaccgaccacgctgctcttcagaaggcgcttgagggtgactttggcaagaagctccagtcggccaagaaccccatgatcattgtgggctccggcgtcaccgaccacggcgacgctaatgccttctatgagaccgttggaaagttcgtcgacagcaacgcttctaacttccttactgaggagtggaacggctacaatgtcctgcagcgcgctgcctccagagtcggcgccttcgaggttggcttcactgttccttccgccgagattgcccagacaaagcccaagttcgtctggctcctcggcgccgatgagttcaatgaggccgacatccccaaggacgccttcatcgtctaccaaggccaccacggtgaccggggcgcccagatcgccgatatcgttctccctggcgctgcctacaccgagaaggctggcacctacgtcaacaccgagggccgtgtgcagatgacccgcgctgccaccggccttcccggtgccgcccgtacggactggaagattctccgcgctgtgagcgagtacctcggcgtccgcctcccctatgacgatgtcgctcaacttcgggatcgcatggtcgagattagccctgctctgtcatcttatgatatcattgagcctccctcgctgcagcagctcagcaaggtgcagctggtcgagcagaaccagggcgccaccgcaaccaacgagcccctcaagaaggttatcgagaacttctactttactgatgccatttccagaaggttcgttctcttttgttacgctgacgacatctccacttccatcagatcataacgcagtatccactaaccgtccacaactcacagctccccaaccatggcccgttgctcagccgccaagaagacgggtgatccccgaaccaacttcatggctcccggcatggaggaggatagacctatgggtcagatcgcctatggtgcatagata

SEQ ID NO: 26825 - DNA, 3465 bp, Neurospora crassa
atggcggctctcgacgatggctttgaggccctgctggagccgttctacaatggcaagaagctgaccgatcccatctcgaccacgcaggacaagttccatcttgtcccggccttcctcaaggtcaagggcctcgtcaagcaacacatcgactcgtacaactacttcgtcaacgaggaaatcaaggacatcgttagggccaaccgcgtcgtccgcagcgaccaggaccccaacttttggctcgagttcagagacatccgcgtcggcatgcccacccgcaccgaagatggcgaacaagtccagtctcgaaaccccgtcacccccatggagtgccgtctccgcgacctcacctatgccgcccccgtcgaggtcgacatcgcctacacccgcgacaagaacgttatcgtccgcaagaacatcccgctatgccgcattcccgtcatgctcaagagcgcaaagtgctacctcaacggcgccaccaatgcccagatggaggtcttcaacgagtgccctctcgatcctggtggctacttcgttattggcggaaccgaaaaggtcatcttgattcaggaacagcttagcaagaaccgtatcattgtcgaggccgacgagaagaccggcggagtcatggcctcggttaccagttccacacacgagagaaagtcaaagacttacgtcgtactcaagaaggaccggattgtcctgcagcacaacaccctctccgagcccattcccatcgtcatcgttctcaaggccttcggtggtctttccgacaacgacatcatcgagctggtttgcggtggcgatgcgcgctaccaggacgatttcctcatcaacttcgatgaagccggaagagctggtgtctacacacaacaacaagcgttggaatacgttggtgctagagtcaagatgggcggtaacagacccaaattcggtgccgctcctcgaagaaaccatgctgaagaaggtctcgacgcacttgcgaacttagttatcgcgcacgttactgttgagggtctcgacttctatcccaaggccgtctacattgccatgatggttcgccgcgtgctgatggcagctcagaatcccaagctcgtcgatgacagagatttcgtcggcaacaagagattggaattggctggacagttgatctcccttctatttgaagacttgttcaaaaagttcatttcagacgtcaagtacaacattgacaactttttcaagaaacccaaccgtacctctacgtatgatccccatggtgcgatcatggctaacggccattatatctctcacggtcttaaccgcgccattcagagcggcaactggacggtcaagcgtttcaacatgaacagagccggtatcacccacgtgctcagccgactcagttatatcgctgcgctgggtatgatgacgcgtatcagctcacagttcgaaaaaacaagaaaggtttccggtccaagagccctacagccctcacagtggggtatgctctgcacctctgatacacctgaaggtgaagcctgtggtctggtaaagaatttggcactcatgacacacattaccacgaatgtgccggaggaaccagttaagaagatgatttttgctgctgatgagagcgtgggaccgatccgagaatacaccggaacagagatgcacagcaaaggctcgtatatcatccatttgaacggtacaccatttgctgtgaccagggagccaaagcggtttgccgccaggttcagaactttgcgtcgccggggctgggtctctccttttgtgagcatccacatcaacgagcacttctcggcggttcatatcgctaccgatgaaggacgtatttgccgcccgtacatcatcgtcaagaacggcaaatccatgttgaaggcagagcacctgaagatgcttcaactcgggcaagcgacattcgacactttcctgaccagcggcgtggttgagtatctcgatgtcaacgaagagaacgatacccttgtggcgcttcaggaggatcagatcaccaacagcactacgcacatggaaattgagccgttcacgattctcggagcagtcgctggtctaattccctttccccatcacaaccagtctccccgtaatacttaccagtgcgccatgggtaaacaagccattggtgctattgcctacaatcagttcaacagaatcgatacccttctttatacccttgtttatccccaacgaccaatggtcattacgaagacgattcaacttatccactacgacaagctcccggcaggacagaacgccaccgtcgttgtcatgtcttactctggctacgatatcgaagatgcgcttgttctgaacaaggcttctctagatcgtggattcggccgctgccaagtgttccgcaagtataccgccgaattgcaaggctatacgaatgggcgccgcgacagggttggcggtatcatgaaggacgaagacgacaagcccattgttaagcacgccatcctcgacgccgatggcctggcccaggtgggctcaaaggttgaatccggacaaacgatgatcaagaaggagaccccgttggaccagatctctactggaatcgctggcgatcgtgggtcagacgattaccgtgacgcatcaaccaactaccgcatttccgaccccgccatcatcgacaaggtcatgatttcggtcaacgagcgcgagaacaagttgatcaaggtccaaacccgccagacccgtaggccggaacttggtgacaaattctcgtcccgtcacggtcagaagggtgtcgtcggtatcatcgtcaacgaagaggacatgcccttctccgacaagggcctccgccccgatatcatcatgaacccccacggtttcccctctcgaatgacagtcggcaagctcttcgagtgcctgaccggcaaagcctcggtcatcgctggcgagaaggactacggcttcggcgatgccttccgctcgcaccccgtcgagtccatgggccaggccctgatcgaccacggcttctcgtgggagggtaaagactacttcacctcgggcatcacgggtgagcccatggaggcctacatctacaacggccccatcttctaccagcgcctcaagcacatggtacaggacaagatgcactcgcgctcgcgcggccctcgcgccatcctcacgcgccagcccaccgaaggccgttcacgcgacggtggtctccgtctcggagagatggagcgcgattgcttgatcgcctacggcgcctcgcagttgttgctggagcgtctcatgatatcctcggatggcaccgaactcgacgtctgccaggagtgtggcctgttcggttacaagggctactgcaacgcttgcaagagcacgaggaacgttacccagatgacaatgccgtatgcttgcaagttgctggtgcaggagcttatcagtatgaatgtgggtgtgaagcttaagttggaggatgagttccctcacccgagg

SEQ ID NO: 26826 - DNA, 444 bp, Neurospora crassa
ttcatctttgatattcgcgctcgccgcggggactatcggctcgaattctacgacacttccagtccagaaagctggagacttcttcggcccgacctagtcatcctctgctatgatatcagccagaggctcagtttgatcaacctccaaagagtggtaagcgccggttctaaccagggtgaaccgcatccttcaacaaactgatatattgcgcagtggaacaaagaggtccggacagcgggcgtaaccggcgacaacaccccggtgcttatgctgggcctcaagcgggatctgcgatctgagaatgatcccaacggtaccatctacccgcaggaggcgtatcgcatggcgcaagagatgaggttagacaagtacatggaatgctctgcggtgactggcgagctgctggaagaggtgttcgacgatatatgtacaacggcgctgaaa

SEQ ID NO: 26827 - DNA, 1536 bp, Neurospora crassa
aacattgtcgtcctcggcggtaactcccaccccgaattggtggagagcatctgcggtattcttggcctgcccgcctgcagcaggatcctgaccaagttctcctctggcgaaagtcgttgcgaaatccaggattccgtgcgcggaaaggatgtgtacattatccagactggcttcggtggcaatggcagcaggctcaatgaccatttcatggacctctgcatcatgatctctgcctgcaagactggttctgctcgcagagtcaccgctgtccttcccttgttcccctactcgaggcaacccgacttgccctacaacaaggccggcgctcctttgtacaaggcgcccacccccaacggcgagaatggaaagaatcagtacactttcgacagtgtcccgcccacccccggtcccggcgtgcccaagacttctggccttaccaacagctccgacatcgccaaccagatgatcaagaacgccctgacgaatggtagctctaaggagcagtatactacccatgactacgagaatctctccatcgtcaacggtttccaggccaagcccggttacaagcagtgggttgcgcaggcgggtacccttgtggccaaccttttgacctgcgccggctgcgatcatggtacgtcattccaacaaatggcctctggcccgaacaatactggggcctacaaccagttgcgagagacgcgcgacatgagggatggcttgtgcacaggaaatagctgctaactcacgtccgtacagtcattaccatggatctccacgacccacaaggtacgtgtctcggttgatgtggaaaacacacaaacacacttgcgcgagtagttgcgcattctttgtcctttcgtcccatgacgctggccacggctggtagattaacttgttccctgtatagtccaaggattcttcgatatccctgtcgataacctctatggacaaccgctccttaaacgctacatccagcagcacattccgaactggagggatgccgtcattatcagccccgatgctggtggtgccaagcgcgcgactgccattgcggatagcttgggtatggagtttgcccttattcacaaggtaaatgccctcctacagatttcccccccaggattaccacttaaccaagaatcacaggagcgccgccctaccaagattaccgatcgccaaaatgccagtatgatgctcgtgggtaacgttactgaccgcgtctgcattctgctcgacgacattgccgacaccggcaacactattaccagagccgccaagctcctcaagaaggagggcgccaccacaatttacgccctgttgactcacggtgtcttcagcggcgacgctatcagccgcgtcaaggcctcggcgattgacaagctggttgttaccaactctgttccccaggacgagcacaagaagcagcttggatccaagctcgacgtcttggacatctctcccatctttgccgaggcgatgcggcgcgtccaccacggtgaatcgatcagcgtgctcttcaactacgagtaaaat

SEQ ID NO: 26828 - DNA, 1403 bp, Neurospora crassa
ccccgtccttccacagagaagtcaaggaaaccctcaatgcgagatccgagtacctggacgacgatgtcgacggctgttcccgccaacgcatcaaccagtatctgatcaaggacgagataggccatggctcttacggcgccgtacgtctggccaccgaccagttcggcaaggagtatgccatcaagcagttctccaaggctcagctcagaaggcgcgctcagtccaacatcctacgccatgcaccaagaggtccgcggaaccagtccatctctcgcttttcagagcagaggcttaaagaggccaaggatgccctctttctcattcgggaggagatcgccatcatgaagaagctgaaccatcccaacctggtccagctgtatgaggtgttggacgatcccgaggatgattcactctacatggttctggaaatgtgcaaaaagggcgtggtcatgaagatgggcattcatggttcggttgagcctttgcccgaggaacaatgccggttttggtttcgtgatctcattctgggcatagagtatcgtaagtcctctgtctagtatcttgtcaccataacgccttggcttacattcatgtcaatagtacactcgcaaggagtgatccaccgcgatatcaagccggacaacctgctccttaccgaagacgatgtcctcaagatcgtcgactttggagtctccgaaatcttccaaaagacagatgagatgaagaccgccaagcctgcaggctcaccagctttcttgccccctgagttgtgcgcaaagcatggtgatgtctcgggcagggcagccgatatctggtccatgggtgttaccctttattgtctgcgctacggcaagcttcccttcgcacatgataaccagctggaaatgtgggaagccatcaagaccgaggagcctcagtttccacctgacgagaaacccgagtttcttgacttgatgcataagatcctggagaaggacccggccaaaaggattaccatgcatgagctcagggtgagtgacctcgttaaccgaagcatcaggtacagttgactgacaaaatcacaggagcatccttgggtcaccaagaacggccaggatccgttgctgagcgaagaagagaattgctccgagccaatcgaagtacccaacgctctcgaagtcaaccatgccgttacccggagaatgagccatctgttctgtgtggtaagtgaaatcttgttacttacgtatcccttatctctaacaaagtccagatgagagcaatctcgaaatttaagagcctcctcaaccgcaacggagctacgtccaaattacagaccccaaccctccaagtccaacctggcaaaaacaagccaccaacagcggacatcaacttttccaacaccaactccaaggactctcaaa

SEQ ID NO: 26829 - DNA, 825 bp, Neurospora crassa
gacgacagtatgtggatgaagggttctcttatcggccagggttcatttggctccgtgtacctcgccctacatgccatcactggtgaactgctcgccgtgaagcaggtcgagacacctgcgcctggtgcagacagtaagaacgatgcccgcaagaagagcatgattgaagcgctcaagcgcgagatcaccctccttcgtgacctccaacatcccaatatcgtgcagtacctgggctgcagctcatccgcggaatatctcaacattttcctcgaatacgttcccggtggttccgtgcagaccatgctcaaccaatacggtgccctccctgaatcactcgttcgcagcttcgttcgccaaatcctccagggcctctcctacctccacaaccgtgacatcattcaccgcgacatcaagggcgccaacatccttgtcgacaacaaaggtaccatcaaaatctccgatttcggcatctccaagaaactcgaagccaccaacatcctcaacggcgccaacaacaacaagcaccgtccctcactgcaaggctccgtcttctggatggctcctgaggtagtcaaacaaaccagttacacccgcaaagccgacatctggtcactcggctgcctggtggtcgagatgatgacgggtacccacccgtttcccgattgcacccagttgcaggccatcttcaagattggcggctccaaggcctcgccgacgatcccggataacgctagcgaggaggctaagcagttccttgcgcagacattcgagattgatcataataagcggccgagcgcagatgagctgatgttgagcccgttcttg

SEQ ID NO: 26830 - DNA, 1814 bp, Neurospora crassa
atggactccgttcttcgccagtccaaggccgtgtgccccttcatgaagaaggccacggcttccagcctccgcgccatgactaccgccgcgcgccctgccgcttctccttgcggcggcgccatttccaagctgcaggtcctcgcccaccgctgccccgtcatgggcaaggctatggctgttcagtctgctcgcactggaggccgcgccagcgctgctcctgcttccttcgttcacaaggccaagctgcacaccggccgtccccgtgaagcgcaggctgtcgagggtgtcttcaccggccagaagggtgagttgcgcagttcctgtgttttgccgtgctacagtatgttgactttgctctactcttcgcagccggtcttcctccccatcctcccgtgaagcctacgaccgccaccgccgcgaacccgtcgccggctgcctgcactgtttcgggcaactttggcaccaagttcaactatgagaagttctacgagaacgagctggagaagaagcacaaggacaagtcgtaccgctacttcaacaacatcaaccgcctggccaaggacttcccccgtgcccacatggccaccaaggaggagaaggtcgcagtttggtgcgccaacgactacctcggcatgggccgcaacaagcacgtccttgaggccatgcacactaccctcgatgagtacggcgccggtgctggtggtacaagaaacatctcgggtcacaacaagcatgctgtcgaactcgaaaatagtctggctaagctccatgctacggatgctgcgctcgtcttcagctcgtgctacgtcgccaacgacgcgacgctggctaccctcggtagcaaactccccgactgtgtgattctctccgacagtcttaaccacgcctccatgatccagggtatccgtcactctggcgcgaaaaagattatcttcaagcacaacgatgtcgaggatctggagaagaagctggctgccctgccgctacatattcccaagatcatcgccttcgagtcagtgtacagcatgtgcggatccatcggtcccattgagaagttctgtgacctggcggagaagtacggtgccatcacctttaacgatgaagtccacgccgtcggcatgtacggcccacacggtgctggtgtcgctgagcacctcgactgggaggctcaccagcgcggcgagaccaagggaaccatcgccgatcgcattgatatctactcgggaaccctgggcaaggcctatggctgtgtcggtggctacattgccggcagcgccaagctggttgacaccatccgctcgctcgcccccggctttatcttcaccaccaccctcccgcccgccgtcatggccggtgcccgcgccgccatcgaataccagatgagctacgacggtgaccgccgcctccagcagctgcacacccgcgccgtcaaggaggccctcgcggaccgtgatatccccgtcatccccaaccccagccacatcatccccatcctcgtcggcaacgccgagctggccaagaaggcctcggacaagctcctcaacgaccaccagatctacgtccagagcatcaactaccccaccgtccccgtcggccaggagcgtctgcgcatcacccctaccccgggccacaccaagcagttccgtgaccacctcgtcgccgctctcgactccatctggactgagctcggcatcaagcgcaccagcgactgggccgccgagggcggcttcatcggcgttggcgaggccgaagccgagcccgtggctcccctctggacagacgagcagcttggcatcgccgatgccgtcgctgag

SEQ ID NO: 26831 - DNA, 1075 bp, Neurospora crassa
atggacgtggtcctcgaggtcaccgaccagttcatgttcgattacatgtacgcctggctactaccagcacgacctgctctctatgatttccccgacaagaccaatggcaccgcacaagctttctcgtcctgggtgtatgagcccgcgaccaagttcttctcgctcgagccttcgcaggcggcctaccagagtatctggacaagagacaacatctaccgtcaggctctatcgctctttttaatactatggtgcgcgcaaaccccttttttcatgttcgagttgggcgcaaacacgctaaccttggcttacacacaggctcttcggtctcgtaacctactacgtcttcgcctccctctcctacatcttcgtcttcgacaagaagactatggagcaccccaagttccttaagaaccaggtctggctcgagatcaagcagaccaacgccgccctgcccgtcatggcgttcttcacattccccttcctggttgccgaagtgcgcggttactcactcctctacgacaccacggccgagggtcctggtcgctggtacgacttcttccagttcccactcttcatcatgttcaccgattttggcatctactggatccaccgtggccttcaccacccgctcgtgtacaagcacctgcacaagcctcaccacaagtggatcatgccaactccctatgccagccacgccttccaccccatcgacggtttcgcccagagcatcccctaccacattttcccctttatctttccgctccagaagatggcgtacgtcggccttttcgtgtttatcaacttctggaccatcatgatccacgacggcgagtactatgccaataaccccgtgatcaacggtgccgcctgccactcggttcaccacttcgccttcaactacaactacggccagttcaccacgctgtgggaccgcctcggcggcagctacagggagcccgacggtgacatgttcgcgaaggagaagaagatgagcacaacgacgtggaagaagcaggtcaacgagatggagaagattgtcaaggaggtggagggtgaggatgatcggctttacgag

SEQ ID NO: 26832 - DNA, 1144 bp, Neurospora crassa
gtgccgcagcccctgtccctcctcctcaagctgtctcctctcgttgacgagctcgccctctacgatgtcgtcaacacccccggtgttgctgccgatctctctcacatctcctcccccgccgtaagtagtcagcaccggctttgcgctggttgtcgccaagggcatgaaaataccacggaccccgcagaaccttgctgacacttggcgcattagaaaaccaccggctaccttccccccaacgacggcgccaaggccgccttcaaggatgccgacatcattgtcatccccgccggtattcctcgtaagcaacaatacgcgccgctggttatggtgaagcagagactgactggctcctcacaggcaagcctggcatgacccgtgatgatctcttcaacatcaacgccggtatcgtcaagggcttgattgaggttgctgctgatgtggcccccaacgcattcatcctcgtcatctccaaccctgtcaactcgactgtccccatttccgccgaggtcctcaaggccaagggtgtcttcaacgcccagcgcctcttcggtgtcaccaccctcgatattgtccgtgccgagaccttcgttgctgagattgctggcaatagcaacccccaggagctcgttgtccccgtcatcggtgggcactccggcgagaccatcgttcctctcttcagcaaggtgtccccctcggtcaccatccctgacgacaagtacgatgctcttgtcaaccgcgtccagttcggtggtgatgaggtcgtcaaggccaaggagggtctcggctctgccaccctctccatggcttatgccggttatcgcttcgctgagaagctcctcaaggccgccaagggcgccaagggccttgtcgagcccacctacgtctatctccccggtattcccggtggtaaggagatcgcggagaagactggtgttgacttcttctccgtccccgtcgagctcggcgtaagtttcggtctttgcaaaatttacggtgtttctggctaacatatctgtagcccaatggtgctgagaaggctattgacatcctcggcgacatcaccgagaaggagaagactctcctcgaggctgccatcaagggcctcaagggcaacatccagaagggcgttgactttgcccac

SEQ ID NO: 26833 - DNA, 1929 bp, Neurospora crassa
tccaaggtcatcgttatacaccccggaagtcaaaacctcagaatcgggtttgcgagcgacgcgcttccgaaaaccatccctatggtcctcgcgacaaagtacccccagaccgagtcggagatgtacgaagcgctaccgaggaggcagttcgaagctaggacaaatgagcagcaatacggcgaagactggtccaagaagtaccaaaaaatgtgcaacgacctcaagaccgacatgcgcgcaaacaggcgcaaggttctccccaactcaaaagatctggttctcaacttcaaccgccgaacagaagcggaagtcatctctacccacaatgacccccttcaagtagactggaccgatgtcaagactctggaggacccggattcgaacgcttccgtgttcattggacaacaggcgttacgcattccggacgattccaaccccaaattcaagctatggtggccgatacagcacggctggatgaatgaagacgactatcccacaaaagcccatctattcaacgacatcgaaaccctacttgatcgcgccttacgctatgatttgggtctgaagcgaagtaccgaatggaagcagtatagctgcgtcttcgtcatcccagatttgtacgacaagaagtatgtggagcaaatattacacctgtgcgtggagtggttcgagttcagcaagatttccttcatacaagaaagtatggcggcttcattcggtgccggctacacacaggcctgtgttgtcgacgtcggcgcacaaaagacgtccatcacctgtgttgaggatggactgtgcatcgaggactctcgcatcaacctgaaatttggcggttacgatgttaccgaaactttcatcaagatgatgctttacgacaacttcccctaccaggaaatcaatctacgccgaagatacgacttcttgttagccgaagagttgaagatcaagtactgcacgctatcacaagccaacatatccgtccagaactccgatttccacgtgcgcgcccctaaccagcccactcgcaaataccagttcaaattctacgatgaggttatcctggcccctatgggattctatgacccttccatcttcgacaacagcaccaagctcagaggcaggaggaagctcatcgagaggtcgtataacgcctacgatgtagaagtcccagatgaccctacatcagctgcccagttcgccgtcctatcccatatcgctcccagccttaatgcacacacccttgcgggagcgttgaatgatcttgctacgcctggcaaggagaagccgctgtcattcaatttcttggcgcgcggcgacaccgcggctggaacccctggcacatcaaaggcgccatcgcctgctcctggagagggcaccggcactcccgttccaccgccgttcgtcttcggagcaggcggcggtagtcccgcccccagtggacggaatggcactaccccagtccccacgagtggggccgctgcggcccccaatggcactggcgccggcagcaacacattagctgtccccggcatgccagccgaggccattcagcgcactccgaagtcaatggccgcagagcgtgacgctgtgctgccagtagttcctcttgacatcgccatcatgaccagcattcagaacgccgccaagggtgatgagaagaaggtcagggagctgatgggaagcatcatggttattggtggtggtgccaagatcccgcactttgcgccctatcttgaggagaagctcaaggcacgtcgtccggacctgtcagagcggatcttggtgagcaggagcgcgagggagatggacgaacaagtcgttgtttggaagggagcgagcgtctttgcgaagctgtcgaccaacgattcgtggattacgaactatgagtacaaaatgctggggtccagggtcatctaccacaaggcgctg

SEQ ID NO: 26834 - DNA, 1226 bp, Neurospora crassa
caaccacagcaagcaacactgcagccgccgcataatcaccatcagcagtctcaagctcagcagcagcagcagcagcagcagcagcaacaaccccaacagcagcagcagcaacaacagcaacagcaacagcaactgcagcctcagcctagtcagcccagggccaccaagggcaagtattcgctcgccgacttcgagatattgagaaccctcggcactggtagcttcggcagagtccacctggtccagtctcggcataactcgcgcttctatgccgtcaaggtgctgaagaaggcccaagtggtcaagatgaagcaggtcgagcacaccaatgacgaaagaagaatgctagcggaggtcaaacaccccttcctgatcacgctatggggaacatttcaggatgccaagaatctttacatggtgatggatttcgtagagggcggcgagctcttctcgttgctgaggaagtccggagtaagttagatgggtttgttcgcccatggagtatgtgcggctgacacggattctacagcgctttcctaaccccgttgccaagttctacgctgcagaagtcaccttggccctggagtacctgcactcgcgggatatcatttacagagatctgaagcccgagaacctgcttcttgaccgccacggccacctcaaaattacggatttcgggttcgccaagcgggttccagataagacgtggacactgtgtggtactccagactacttggcaccagaggttgtttccaacaagggttacaacaagtcggtagattggtaagtacattcattcggcagcctctccaacgggccaccaattgcttacatgagtaccgcgcaggtggtccctgggtattttgatttacgaaatgctttgcggttacacgcccttctgggacggcagctcccccatgaagatctacgaaaacattctcaagggcaaggtcagataccctcagtgggtcaaccccgacgcgcaggacttgttggagcggttgatcacggcagacctgagcaagcgccttggaaacctgtacggcggaccgcaagacgtcaagtcacacccttggtttgccgaggtgacttgggaccgactggcaaggaaagatatcgacgcgccgtatactccgccagtcaaggccggagcaggagacgcgagccagttcgacaggtatcctgaggagactgagcggtatggacaaggagggccagatgagtaa

SEQ ID NO: 26835 - DNA, 1874 bp, Neurospora crassa
tttcagtatatcacttcttcagccgccaactcgattgcgcctccgcgttcccaggacctcagttacccgctctcaagctacttcatcagttccagccacaacacttatctgacaggtaatcagctctccagcgactcgagcgtcgatgcctataggaacgttttgttgcgcgggtgccgctgcatcgaggtggacgtctgggatggctcggactccgagtcggaggatgacgatggtgacgccgagtctgtgacttcgagcagttccagctccagcgatgatgcctatggcagtggtgaggagggaatagcgagcaagttgaagaggaaagcgaagagaaagctgcctagctttcttggtggaaggaagaagtccaaggacaagaaagttccggagcccaccacaacaacgccgccgccgccgccgcctgcagcagcaacaaccactgaggccgccccagtaggactatcagccgaaacgaaccccttggagaggtgcaagagcggcggctctgcctctttattccaaactctcagtaggaagagcaccaaagagccgcgagtcctgcacgggtacacgctaactaaagacatcaccttccgagacgtgtgcgaggctatcaaggactacggttttgccacaaccgacttgcctctgatcgtcagtctcgaggtgcactgcagcgctgagcagcaggaaatgatggttgacattatgaggcagatctggggagacttgcttcttcctgagccggaggaggatgccaaatatcttcccactcctgaagagctgcgcggcaaaattctcgtgaaggtcaagtacgctccacccaacaatgaagggggctcgacgggctcgacgacccccgaggagctggacaacaccgccgccgcggcttctggaagactatcagaagaagcgggccaaccgaagcagcgggcgaagaaaccgtcgaaggttatctggagtttgagcaagatgggcatctacacgcgcggtgtgtcgttcaaaagtctgatgcagcccgaggccaacatgccgacgcacatcttttcgctgtcggagagtggcgtgatggatgttcacaaggagagtcgtagcgcgctcttcgagcataacaagcactatctgatgcgggcgtacccgtctggtatgcgtatcttgtcatcaaacctggatccggctgtgttttggagaaaggggatccagattgtggcgctgaattggcagaattgggatgagggcatgatgctgaatgagggcatgtttgctgggacgggcggttatgtgctcaaacctgctggtacgtccacttagtccactcctctttaggcaagacaaaaacgctaacaagacccgacctaggctaccgctgcgccaaactcaccgactctaatccgtccccctccccctcacccttggcctccgacacccaagccgacgccgtccagcactacaccatggatcttaccatcaatgttctcgctgctcaatcgctcccccttccccccggagacgacaacatcgactctttccgcccttacctgaaagtcgaactacacgtggaagagcctggagagcggcacggtaccgacgagctgccgcaggacggcaaagaaaaagggggcgagtacaaggccaagaccaaatctataaagggaggatgcgatccggattgggaggggaagttcggtgcccagacagaactgaaatttgagaatatccctggtgtagtcccggagctctcgtttgtgaggttcttggtgctggatgatgagattggaagggattcgttggcggcgtgggcgtgcgtgaggctggatcggttgagggaagggtatcggtttgtgcatcttttggatgcgaaggggatg

SEQ ID NO: 26836 - DNA, 2361 bp, Neurospora crassa
agaccacgaaaccactccaaaaccttcccattctctgacctctttcgaaccctcttcaaccctctcattgactgcaaaccctcaacctctgggggtacggtgcgcggccccaaaccaggacgaggcggccacttctccaaggtctcctaccatgaacagcgccggcacatcatcgagcgcttcatgtcgcgctggcggtccgaagttggcaacgacttttacccggccatgcgcctcatcctccccgacaaggaccgcgaccgcggcgtgtatgggttgaaggagaacaccatcggcaagctgctggtcaaagtcatgaagattgatcggaactcggaggatgggtataacctcatgcactggaagctgccggggggccagagtggggtgagccggtctgtaggggactttgcgggccgctgtttggaagtggtcagcaagcgcgcgatgcgtgctcagccgggggacttgacgattgcggatgtcaatgtcctgttggatcgcttggcggcggcaagcggggaggccgagcagttaccgatctttgaggagttttatcggcagatgaatgcggaggagatgatgtggttggtgaggatcatattgaaggatatgagggtgggcgccacggaaaggacgtttctgaacctgtggcatccggatgccgaggcgctgttcagcgtttcgtcgagcttgcggagagtgtgttgggagctgtttgatccagagtttcggctggaacagcaggagacggggattaagctgatgcagtgctttcagccgcagctggcgcagtttcagatgacgacgacgtgggagaagttggtgaaaaatttgggggtgacggaggagaatccggagttctggatcgaggagaagttggatggcgagaggatgcagatgcatatgatagaggatgataccgtgcccggaggatttcggtttgccttttggtcgagaaaggcgaaggattatacttatctctatggtgagagcttgggagatgagcagtccgctctgacacggcatctgcacaaggcctttgacgacggcgtgcgaaatttgattctcgacggagagatgattacttgggatatcgatatcgacaaaatggtaccctttggaacgctcaagacggccgcgttggagcaacaaaagaacccatccaaggctggtcctcgcccgctctaccgtgtctttgacatcctgctgctaaacgacaagccccttaccgaatacaccctcaacgaccggcggagagctctcgagcgtgccgtcgtcggtgtccaccgccgcttggaaattcttcccttcgagcgagccacctccccagacgctattgagccactcttgcgacgagtcgtggccgaagcatcggagggtcttgttctcaagaacccgcgctctcgctattcactcaacagccgtaacaacgactggatcaaggttaaaccggagtacatgtccgactttggcgaatcactcgactgcgttgtggtgggcgggtactttggctccggccggcgcggcggcacgctctcctccttcctctgcggtgtgcgcgtatcccagaacttcatcaaaagcggcaacgccagcgccgagaagtgcctctccttcgtcaaagtaggcggcggcttcaaagcggaggactacgccgaaatccggcaccacaccgaaggcaaatggcaggactgggacccttccagcccaccaacggagtacatcgagctcggcggcggggaaaagttacagtacgagaagccggacgtgtggatccgacccagcgactcggtcgtcatctcggtcaaggccgccagcatcacacaatcggaccagttcgccatgggttggacgctgcggtttccgcgcttccgcaaactgcggctggatcgcgcgtgggactcggcgctggacatggacgagtttgaagtgttacgatccaaaatcaaggaccaggaacaggaaaggaagaagatggagatggagaaccgcaagcggaaaccggcgaccaagcgagcgaggaaggacctagttattgcggggatgtctgatccttcgtcttcttctgctgctacacccgtcatcgctccgaaagagacaagagaagcgagcaaacggttgtttgaaggcttggatttttgcgtcctttcggattctctgaaaccaaacaaaatgactaaaccggctttggagaaactcatcaaagatcacggtggtcgtattcaccagcaggttatggaccactccggtcaggggaagatcatcatccccatagcagataagaacgtgatcaaagtggctagtctgagaaaggcgaacccggagatggatatcatccggcctaaatggatttttgac

SEQ ID NO: 26837 - DNA, 1810 bp, Neurospora crassa
atgctgaatcgcttccggccagcgcggctagtagcccaatcctccagatgcttgcccttgacgagggcgcgggcaggtcccttgcccgttaacaatgccaggactttggctacgagagccgctgctgtcaacaccaaggtatgctccaagtctgaagagccccaaaaatatggtcatcatgatgcagttccttaagtactgactatgactccaggaaccgaccgaacgcgacaacatcaccactctctccaatggtgtccgtgtcgcttccgaggaccttcccgatgccttctccggtgtaggtgtctacatcgacgcggggtcccgatatgagaacgactatgtccggggtgccagtcacatcatggaccggctagccttcaagtctacaagtacgaggactgcggacgaaatgctcgaaactgttgagaagctcggtggtaacattcagtgcgcttcttcgcgcgagtctatgatgtaccaggcggccaccttcaacaaggctattcccaccgctgttgagctcatggccgagaccatccgcgatcccaagcttacggacgaggagctggagggacagatcatgacggcgcaatatgaggtcaacgagatctggtccaaggccgaactgattctgcccgagttggtgcacatggctgccttcaaggacaacactcttggcaacccgttgctttgtcccaaggagaggttggattacatcaaccgggatgtcatccaaacataccgcgacgctttctacaggcccgagcgccttgttgttgcctttgctggtgtgcctcatgagagggccgtcaagctcgcagagaagtactttggtgatatgaaggcctccgatgctcccggtctctcgaggacaggttccgaaacctccgtcgactcgctagtgtccgagtccagcgaggcctcgagtgaatcttcatcatcctcctcggactcttccgagtcgagtggcgggctgctctccaagcttttctctcccaaggccaagaaagccacccccaaccccttcctcacccgggtacctattagcaccgaagacttgactcggcctgctcactacacaggcggtttcctcaccctcccatcacagcccccaccgctcaaccccaaccttcccacatttactcacatacagctcgccttcgagggcctcgccatctcggacgacgacatctacgccctcgccaccctgcagaccctcctcggcggcggcggctccttctctgccggcggtcccggcaagggcatgtactcgcgtctctacactaacgttctcaaccagcacggctgggttgagtcctgcgtggccttcaaccactcatacacggactcgggtctcttcggcatcgccgcctcgtgctacccgggtcgcaccctgcccatgctccaggtcatgtgccgcgagctgcacgccctcaccaccgaccatggctactcggccctgggcgagctcgaggtttcgcgcgccaagaaccagctccgcagcagcctcctgatgaacctcgagagccgcatggtcgagctcgaggatctgggccgccaagttcaggttcacggtcgcaagatcccggtccgcgagatgacgcgccgtatcaacgagctgacggtcaaggacctccgaagggtcgctaagcgcgtggttggtggcatggcgaataacgccggccagggaagcggtgcgccgacggtggtgctgcaggaggcgacggtgcaaggactcaagactacggagctggggtgggatcagatccaggatacaattgctcagtggaagctcggtagacggtaa

SEQ ID NO: 26838 - DNA, 1386 bp, Neurospora crassa
aagtggtaccacatcaaatggttcgctgacagcgacacccctcgcgagcggcgcctcatcatgaagctcgacctgctcatcgtcccttacgccttccttgcctactggatcaagtacattgaccaggcaaatctcagtgcgttattccttcctgccttctttcaatctcttctccagcccatcaaggacagcgaagtccagctaacaccaaggtatttccccctcacagacaacgcctacgtggccggcctcaaagaagacctcggtttccacggcaatgagctcgtccagctgcaaacgctctacaccgtcggcgctgtcgtcggccagatccccttcatgttcctcttcacctacttgcccatgcactggaccattcccttcctcgacattgcttggggctttttcactttggcccaataccgcgccaactcctttggtcagatggccgcctaccggttcttaatcggctggttcgaagccgcgttctacgcggctatccattacatctttggaagctggtatcgcggggatgagattagcaggaggggaggcgtgttctatactgggttgacgctagggacgttgactgcgggattgatccagtctggggcgtcatcgaggttggagggtgtaaacggactggcggggtggcggtggatgtacatcatttgcgcgctcgtcaccattcccgtgggaattttggggtacttcattttgcccggcacgccagagaacccgaacaagtggtttttaaaggacgaggacgtgcagattgcgaaagagagattggcgagggtggggcattcggtcgtacatccaaagttcaaactcggcacgctcaagagcctggcgaacaactggaagttttgggcgttgctgatgctggacatcttcttctggaacgggagcttgaactactcggctggaggctacttgttatggctgaagagcctgggacggtacagccagtccaaggtcaacgagctgggtaccatcagtcccgcaattggcatcttttatgtcttgttgatctgcttcatctcggacttggtggtcggcccggcgtgggcgattacgattgctcatgtctggaacatcatcggcctcgtcattctggtcatctggaacgtgcccgagtcggcgctgtggttcgccttcatgacaacgtactcttccgtggccatgtcggcggtgttgtacggatggattaatgccattatggggaagtcatcggcagaaaggtcgtttgcaatagtgttgctgaacacggttgcgcagagcacgaccgcctggacgcagcttttgacgtttccgaccaaggaggcaccccagttcaagaaggggtactcgttcgtcttggcgaatgccgtttgcttgatcatt

SEQ ID NO: 26839 - DNA, 1191 bp, Neurospora crassa
ccccttgtaacctccggccgctggatccgcgatgcctcgggtaccaacctgacctacgccggcgtcaactggcctggggcagccgatgtcatgatccccgagggtctgcagtaccagtccatcgccaccattgtgtccaagatcaagagccttggcatgaacgccatccgtctgaccttcgccattcaaatggttgacgaaatttactccaacggagggaaggatatcaccctgcaaaaggccttcacccaggccctcgggtcgacaaacggccccaagctgctcgaccaagtcttagccaagaacccccagttcacggcgagtactacccggctgcaggtgtttgacgccgtagcggccgaatgcgcaaagcagcacatctttgtccatttggataaccatatctccaagggcatgtggtgctgctcgactggcgacggaaacagctggtggggagacacgtacttttccgcagctaactggacaagaggtcttgcttatatggctaaccatgtatgtctcccttaaatcctccctttaccctgtcatcctgcttcccattgttgacaccatcgcgactcccaggggaaacaatggacatccctcatgtccatcggcctccgcaatgaaccgcgcgagcctacctctggggcagccaaatccacatacaactggcaaacatggtacacatacatgaagcaaggcgccgaagctgtgcactcctcgaatcccgaccttctcatcttcttgtccggcctgtccttcgatactttcctgacgcctgtcgtccggggcaccgctttgaccccgggaaccggcaagttcagcttcaacgactttcccggctacgccgacaaactcgtcctcgagctgcacaactacgaaaccagtgccaacaactgcaacaatctgcaaaataacttgtacaacaatggatttgaggcgttgacgagttctacggtaaaccagttccccgtcatgttaaccgagtttgggttccagatggatgcgagtacgtggaaggggacgtacgctagctgtctggcaagctatttgcccgcacagaaggctggctggtttatctgggtgctggcggggtcgtattacatccggtctggcacgcaggattacgacgagggatgggggctgctgacccatgattggagtacgtggaggagtccgagttatgtc

SEQ ID NO: 26840 - DNA, 1593 bp, Neurospora crassa
cccggcccgcgccagtttcccattgttggacgcatccacgacctgccacgcttctcgctttggctcaagtttaaggagtgggcagacgagtttggccccatctatacgacttcggtcccggacgccacctttgtcatcatatcagatgaaaagattgccgaggagctcttggtaaaacggggacacatctattccggacggccgcagatccggagcttgattggccataaagagggagtggtttacagtgctttgatggatcgtcatggtgagttcttgttttttttttttttccactgacttgaggcaatgtttgctaatgagagcatacctagacacctggaaatctcaacgcaaatgggctcacgccgccatggccgctgcctacaagcaccacttctacgggcacgttgagtcggagatgcgccgcttcctggtcgtgctgcttttcgatccggatcgcttccttgaccatacgcgcgagtactgtggtcgtgtcatgagccgcctagcctgggacgacgccacgcagggccgcctgaacggggagagcgccgacaagactctacattgcatgtccgtctcaggacccatcaccaacaccatgacgccattgtggtctttgccggccagcattaacccatggtacaagtacgaagtcaagagagaggccgagttgaggcaatggtggttgggcctgtttaggaaggctaaagagagaatgaggaagggtgaactaccaagcgatacgtgggcgtataggtatttcgagcagatggtgcaggatacggcgccatcgatgcctgccaccgccagagcccccggtccagatgtcaagaacgccgagaggtccccttccacagcggctcaggaagaggcatacgagaagaaagacgcactcgaccaacccgaaaaagacgagacctttgcctcgtgcatgataggcttcctcaacctcgtcggcgtcgtcaccatctcgggcccactcaagttcttccagatggccatggctctgcacccggagtggcaacacaaggcgcaagcagagattgacgaggtgtgcggtgaccggatgccgaccatgaaagactttgataagcttcccattctccgagcctgcctgaaggagacggtcagatggaggagcggagtcccacttggcgtaccacatcaggcggagagggatgatgagtttaggggcgtcaagatcaagaagggcacgatcgttcttgcttgtgaatggtatgtctttcttggttccttcttcccgtattttcgagcatcactaacactaacacttcggcacacaggaccctcaaccgcaatccccagaaatacccagacccagaaacgtataacccagcccgctaccttgacccttcctatccaactttccaggcccccctcacgcgctaccccaacttccgcgagggatcctccatgcactcgttcggctggggcaggcgcacctgtctcgggcagaacattgtcgatgacgagatgtttgtttttggcgcggcgcttctgtgggcatttgaggttaccccaaagacatgtccagtcacaggcaaggaggtgccgattgacacgcac

SEQ ID NO: 26841 - DNA, 1674 bp, Neurospora crassa
ggcatcgagttgacgtcggggtttgattcccagatgatcaacgccctgcagattttggagtcttggatccagtgtaagtggaacaagtcttctttcttatctttactccagtcctcaatcgttctttgcttttgctgcctgccagcccgggcggtacatggatgtagtgccgtcctggttccagttgctaaccacagtattgcagactttgacaacccgcagggtgctctcaaaggcatcatcagcgcagcatactctcttggtgccatcttgtctcttcccctggtacccatcatcaacgacaggttcggtcgaagatggtccatcgctctcggttccatcgtcatgattgtgggcgccatcattcagggtttctcccagcatggtaagcacctctctgtccttattaccatgaaaacgccaacactgaccgccatcatcaacagtcggcatgtacatcgtcgcccgtatgattctcggcttcggcatccccacttgcatcgtctccggctcctccctgatcggcgaacttgcctacccgaaagagcgtcccgtcttgacctcgctcttcaacgtgtcctatttcgtcgggcaaatcgttgctgccgccattgtctttggcaccaatagcatcgcaagcaattggggctggagaatcccctcgcttctccagatttgtccttcactgcttcaacttgcctttgtcttgtacgtcttgagtcatgggtcttgttggccaaagaacggaattcgctgacttgagaaaatgcagtttcatccccgagagtccccgctggctaatcaccaaagaccgctctcaagaagcccacgacattctgaaaaagtaccacggagaaatggagcgcggtgaggaatttgtcgccgccgagttcgcccagatgcaagccgtcattcgtctcgaatacgaaaccgtctccaagagctcgtggatggatctcctccggaccccgggcatgcgcaagcgtcttctcatctcgtccatgctcggtctcttcacccagtggtccggaaacaccctgatctcctacttcctcggcgacctcctcaagatgattggcttcaccgactcgacctttatccaaaagatcaacgtctccatcgcctgctggagtttgttctgcggtgtgactgtctcgctccttgtcacccgtatcagacgtcgtatcatgtacatggcctgcaccatcagcttgctgctgtgctatatcgcatggactgtctccatggagcgcgccatgacaggcaaggcgaatggcacacccaataacggggccaacatcgccaccctcttcttcatctacatgtattcgccgtgctataacatgggttataacgccctgacctacagtaagttgaacatcatgttccgttcagaggttgatatcactaactcaaagggcagcctacatggtggaagtctggccctatgccgagcgctcccgtggtatcgccgtcttccagctctttggtcgtttggccggcttcttcaccacctttgtcaaccccatcggtctcaagaatgttggctggaagtacctcatctcgtactgctgctggctcgcattcgaggtctgctttgtttacttcatgttccctgaaaccatgggtcggacgctcgaagagcttaccttcatgttcgagggcgaggacctt

SEQ ID NO: 26842 - DNA, 1551 bp, Neurospora crassa
gaaaaagatgtggtgttgtgtatctcgtcaggacacttcctcttgccctgcctgttctattcgaccatcgcggcgggcgccatcttctcggcatcaagtccggcatccacggctaccgagctcgctgggcagatcaagcagatcggggcaaagctcgtcctgtgtaacgaagacaccaaggaagttgctgcagccgcggcaaagctggccaacattcctggctcccgagtccttgttctggggtcgcagccgcacctcgaactcaccaaccttgaacagtcaagacccattcccatctccaccaaaaccttggagtggcaacgtatcacggacacgaaagcccttgaaaacagcattatctgcattctcttttcgagcgggaccactggcttgcctaaaatgtgcaggctctcgcacaccaacatggtaagccaggcatgtcttgtgctggatccggctcgagagtatgagaaggcaaggggacgggatatgtcggcggactaccggaccattgcccacttgccggcggcccacattgcgggagtgcagggctactttgtcaacagcttctatgtgggcggcaccttgtactggatgccgcgcttcaaccttgtcaagttcctcgagtacagcaagaaataccagatcacgacgctcgtctcggtaccccccatatacctggccattgccaaaagccctctggtgaccgatcagtttgactcggtggagtgggctgtggcgggggcagctcccatgggaaaggagctccaactggcagcgcggaagaatctgggaaaaggcaaggcacatctgacgcagacatggggtttgagcgagacgacgggcgccatgacaaccatgccgcgagggatcgacgacgaaacagggagtgtgtcgatgctggtgatgaatggccgggcgcgcattgttgatgatgatggcaaggacgtggaaccagggcaagcgggcgagctttgggtcaagggaccgaacgtgaccaaggggtattatatgaacgatgcagccaacaaggaggcctttgtggatgggtggttctgcactggggatatcgggctctttaaagacggcaagttttatatcgtcgatcgaaagaaggtaagagatgatggtggtttcctgctgtgacttgtaggtggtcaacggacaacatggatgactaacaaggagtcgcaggaactcatcaagtacaaggggctccaggtggcaccggccgagctggaggccttgttggtcagccatgccaagattgcggatgcggcagtgattggtgtggacggtgaagagactgaagttcctcggtgagtgtcccgtcaaaagagtcagtcgaacatgatgccggatatcagaagctaatgtagcgagtggaatagggcgtatgtcgtggctggcgatgcgactctcaaggccgaggagattgtagattgggttgccagcaaagtggccaaccacaagaagcttcggggaggagtggtgtttattgatgccattcccaagagtccgagtggaaagattttgcgcaaggaattgcgg

SEQ ID NO: 26843 - DNA, 1765 bp, Neurospora crassa
ccgtccattcgattcccccgagatccttcccacagcgtcgcgaccacacggcagccctcccctggccgagccagtactactacaaccgtcaccaagcagccggcgcaaggtcaccttcaagccgagcagcttcgactggacaaaggtcgagcaacacttccccgtcgagctcaagcacaagctcccgaccggcgcccccaagccgcagaagcccgtccagcacgacttctcccactacgtccacgaccccgttacgcgaaaccgacaaaaggccgttcgcgccgtcttcgagcgcagctggaacagctacaaggagcacgcatggcttcgtgacgagctcgcccctgtgagcggcgtgggcaagaccacgtttggcggttggggggctacgctagttgatgcgctcgacacgctatggatcatggagctgtgggaggacttctacctcgccgccaacgctgccgcccagctggactggcaaaacaccaccgaaaccgccgccaacatgtttgagaccaccatccgccacctcggcggcctcctcagcgcctatgatctgagcggcgagcaggccctgctggacaaggcgacggagctgggaaacatgctttacatgggcttcgacaccccgaaccgcatgcccggcttctggctcaactttgaggatgcaaagcgcggggtgcaagtggccggcacaaacgatccctcggcttctccctgctccttgtcgctcgagttcactcgcctcacccagctgacgggcgatcaacgctactttgacgccatcacccgcatcaccgagtttctcgagcgcacccaaaacgagtccaagatacccggcatgtggcccaagctgatcaacttccgcgaagagcgcgttgacggcgagagcggcttcactctcggcgcgctcgccgactctctgtatgagtatctgcccaagatgcatgccctcctgggcggactatcgccgcaatacgagaaaatgcaccgggccgccatggatgtcgttacgaagtacatgctcttccggcccatgctacctgctgaggaagcctcgaaacacgacatcttgttcgtgggcgatgcctttgccaaacccgaccggatcgaccgggtagccgagggccagcacttgacctgctttaccggcggcatgtttggcctcggcggcaaactgttcgacatcaacgagcacgttgagattggcgagcgcctggcccgcggttgtggatgggcatatgatgctttcccaactggcgtcatgcccgagatcttcaacatggtaccctgtggtggctcctgggatgctccctgcccgtggaacgaggagaggtggaaggcagagggcagcaagaatcttaagaagggatttgccagtgcgcgagacacccggtatatcttgcggcccgaggccattgaaagtatcttcctcttgtaccgcatgacgggtaaggaagacctgagagacctggcatggcagatgtttgaaagcattgtgaatgccacagagaccgagctggcttactcggctatttctgatgtcacggtcaagggtccgacgaccaagaccgactcgatggaggtaagcggactgttcccagcgaaggatccttagtaacatcaactaacgtgcttcctcctacagagcttctggctggccgagactctcaagtacttttacttgatcttctctccacccagcattattagcctcgacgaatacgtgttcaacaccgaagcacacccgtttcttcgaccgaag

SEQ ID NO: 26844 - DNA, 1697 bp, Neurospora crassa
ctggctagagagctaaagggccggcatctgcagatgattgccattggagggtccatcgggacgggtttgttcgttgcctctggcaagacattgagcgacggcggaccggcgagtgtgttgattgcctatctcatcattggcgtcatgctgttttgcacgatacaggccttgggcgagctggctgtcattttccccgtagccggatccttctcggccttctcgacgagattcttggatccaagttggggatttgctatggggtggaagtaagtcgagccacctttcgagttcgttgtgtaaaggagaagaagaaaatactgacagacacttttttccttgcagctacgctctgcaatggatcggggtactaccacttgaagtattagccggcgccatgacaataggatactggaataaagaaatcaacaaagccatattcgtcaccattttcctggtcatcatcttcgtcatcaatctttttggcgcaaaaggatacggcgaggcagagttcatctttgccatcatcaaagttaccgcggtggtaggattcatgtgagttttcatcccctttttcaccagaacacacccgttccactccctccaccccagacacccacatcaacctaacacccatcccctcaaaaagccttttaggtatcgtcatcaacataggcggcacccctaccgaaggctacatcggcggcaaatactgggaggaccccggtgccttccacaacggcttcaaaggtctctgctccgtcttcgtcaccgccgccttcgccttcgccggcactgaactcgttggcctggcagccgccgagaccgccaacccgcgcaaatcgctccccaccgccatcaagcaggttttctggcgtatttcgctcttctatatcgttagtatgacgctcgtcggtctgctcgtcccctacaacgagcctcgtctcctcaacgcccaaaacattgccgacgcttccgcctcgccttttgtcatcgccatcgaatccgccggcgctacggtcctcccctccgtcatgaacggcgttattctcatctcggtcatctccgtcggtaactccgccgtctacggctcctcgcgcactttggctgccctggccgaactaggccaagcccccgccatcctcgcctacgtcgaccgccgcggccgtcccatcgtcgccatcctcgtcaccatggccgtcggcctgctcgcgtacctgggcgacgtcccctcgcagaaaaacatatttgactggctcctggccatctcaggcctgtcctccatcttgacctgggcatccacctgtctcgcgcacatccgtctgcgcaaagcgtgggcgtacaaccaccgctcggtgcaagacattgcctttaaagcacagggcggcgtgattggttcgtggatcgggtttgttcttaatgttctggtgttggtgacacagatatgggtgtcgatcgacccgctccaccagggcgacacaccgttgacgaccaaagagcgggtgcgcagtttctttgtgagctgcttggcgattccggtggtgttgatttgtacgattgtgcataagtggtactataagacgaagtgggtaaggatcgaggatatggatgtggacacgggaaggcgagattttggacggttgggcattatcaaggcccaggagaaggaggagaggatggggtggccgaggtggaagcgg

SEQ ID NO: 26845 - DNA, 1274 bp, Neurospora crassa
cagaatggctgggtcaccagcttggccacctctttggagaagtacgaaaccaccgaatgaaccgcataatactcgcgcgaagatcatgaacttacaaatgctctcgcaattagccccaacatgctcctttctggtagcagagacaagtccctcatcatctggaacctcacccgcgatgagacctcgtacggctaccccaagcgccgtctccacggccactctcacatcgtctccgactgtgtacgttaaatactcgacattggaggattgtgtggatattttggaatcgcgggcagtttgactgattggcgcggcaggtgatctcttccgacggtgcctacgccctctctgcctcgtgggacaagaccctccgtctctgggagctttccaccggcaccaccacccgccgtttcgtcggccacaccaacgacgttctctccgtctctttctccgccgacaaccgccagatcgtctccggttcccgcgatcgctccatcaagctgtggaacaccctcggtgactgcaagttcaccatcaccgagaagggccacaccgagtgggtttcctgcgtccgcttcagccccaacccccagaaccccgtcattgtctcctccggctgggacaagctcgtcaaggtatgttgtataacctgctttactccccccccaaaaaaaacccgacaccatgatgcatgcatatttttctcaaaatagtatttgctacttcagagccctcgggccatgagaccaacatcacacgcactgattttctcggaaatcacaaactccttgtcagaaactgcatgagatttcgagaggatttgcgactaacagtctcaactcaatcaggtttgggagctctcgtcctgcaagctccagactgaccacatcggtcacaccggctacatcaacgccgtcaccatctcccccgatggctccctctgcgcctccggtggcaaggacggtaccaccatgctctgggacctcaacgagagcaagcacctctactctctcaacgccaacgacgagatccacgcccttgtcttctcccccaaccgctactggctctgcgctgccacctccagcagcatcatcatcttcgacctcgagaagaagagcaaggtcgacgagctcaagcccgagttccagaacatcggcaagaagtcccgcgagcccgagtgcgtctccctcgcctggtccgccgatggccagaccctcttcgccggttacaccgacaacatcatccgtgcctggggtgtcatgtcccgcgcttaa

SEQ ID NO: 26846 - DNA, 2422 bp, Neurospora crassa
aggttccagcaaatgctggcgtctcgcatgcagcttcccatgtggcagttccggcaacaggttgtcgacactgtcaagagagaacaggtggtgatcatttgcggagagactggttgcggaaagagtacacaggtgccctctttcttgctggaggatcagctcatgaagggcagaaactgcaagatttactgcacggaacctcgtcgtatctcggccctctctttggccaagagagtcagcgaggaaattggtgagggtagaggtgacctgggtacacctcggtctctggtgggttattcgatccgtctcgaggcaaacacttcgagggaaactcgccttgtctacgctaccacgggtatcgtcatgcgtatgttggagggctctaatgacctcaacgagatcacccatttggttctcgatgaagtgcatgaacgttccatcgacagtgacttcctcttgatcgttctcaagaagttgctcgctcggagaaaggatctcaaggtggttctcatgtcagccacggtggatgccgagcgattctccaaatacctcggcggagcgccagttctgagcgttcccggccgaaccttccccgtcaaggtggcctacttggaagacgccgtcgagttgactggctataccctcgaccagcgaaatcccgtcgcatcgaagcttactgagcttgatgacgaggcggatgccgaggttgatacgtcttccaaacctgagttgatccagtcgctcaggaactactctgccagaactcgcaatacgctggcgcaaatggacgagtatcagatcgactttgacctgatagtccagctgatttctacgattgccactcatccggattatgtcgatttcagcaaagccattttggtcttcttgcctggtattgccgagatccggacactcaacgacatgctgctcggcgacaaagcctttgctgatcactggctggtgtacccgttgcattctaccattgctaccgaggaccaggaagccgccttccttgttcctcctcccggtctgagaaagattgtcttggctaccaacattgccgaaacgggtattaccattcccgatgtcacctgtgtcattgatactggcaagcatcgtgagatgagattcgacgaacggagacaactgtcccgacttattgataccttcatttcgcgtgccaacgccaagcagcgtcgtggtcgtgccggtcgtgtccaggagggtctttgcttccacatgttcaccaagcaccgccatgacaacatcatgagcgaccagcaaactcccgaaatgctgcgtctttccctgcaggatctcgctattcgggtcaagatttgcaagattggtggtattgaagagacactgggcgaggcgctcgatccaccttcggcaaagaacattcgccgtgccattgatgcccttgtcgatgttcgtgctcttacagcctcatcggaggagctcacgccgctcggtattcagctggcccgcttaccgctcgacgtgttcctgggcaagctcatccttctcggcgccatcttcaagtgtcttgacatggccattaccgtggccgctattctttcgtccaagtcccccttcgttgcgccgtttggacagcgtcaacaagccaacaccgtccggatgggattccgcaagggtgactctgaccttctgaccgtttacaacgcataccagtcttggaagcgtgtgtgtcagtcgtcgactagcggtggcgccgagttccagtactgccggaagaacttcctctcgccccagacgctggcgaacattgaggatctcaagggccaacttctcgtgtcggttgccgactctggcttcctgcagcttacgactgaagagagacaggtgcttaacaggctccggtttggtggaaagcgtcggtaccaagccttctatgaggtgcctcagcgggtcaatatcaacagcgacaatgagctgattgctcagtcggtaatcgcctggagtttttaccccaagctcctggtgagggatgtgcccggcagcaagggcctgcgcaacgtgggtaacaaccagaacattagcttgcatcctagcagtgtgaacaagggccataacgagctgcggtggttgagttactataatattatgcaaaccaaagggtacgttgcatcatcctcttctctcttgaccttccttcttttcagatgctaacttgatggataacagaagcgtctataatgctcatgagaccaccgccgtggatccatttgcggtcgctctcctctgcggtgacgtccgcgccgacatgtactcgggcgtgctcgtgctcgacggcaaccgcgcccgctttgccgtgtccgactggaagaccatgctggtggtcaagatgctaaggacccgactcaaggaggtgatggcgcgcagcttcaagaaccccggc

SEQ ID NO: 26847 - DNA, 1175 bp, Neurospora crassa
gaaaagagacctgcgtccgatgaccccagcgggggccagctcgtcaagagacccaacctgggctcgagtcgcgccctcacgaggaccagcgcgactggcagcagcggtgaccttatccagacagcgccccgtacgagcagcctccaggctccggtgatggagctgtccggccactcgggcgagatctttgcggccaagttcgaccctactggcaaccttatagcttctggttccatggaccgtaccatcagtacgtcccaactcacatcagctgccggcattgacaattggggaccagttactaacaattgtctactacagtgctctggagaacctatggcgactgcgaaaactacggtgtcctcaacggccacaagggtgccattctcgacctccaatggtcgcgcgactccgagatcctcttttccgcctccgccgacatgcaccttgccagctgggaccttacatcaggcacaaggatacggcgctatgtcggacacgaagaaatcgtcaactcacttgacatctcgagacgcggcgaggatctgctcatcagcggtagcgacgacgggacgattggcatctgggatccgcgaaccaagaacgccgccgactacatcgagaccgatttccccataaccgccgtggccatgtcggaggccggtaacgagatctactcgggtggaattgacaatgacatcaaagtctgggatgtgaggaagaaggccgtcgtgtactcgatgattggacaccaggatactgtcaccacattgcgggtgtcgccagattcacaacagctgctctcgtacgccatggattcgacagcgaggacatgggatatcaggccgtttgctcctgcggataggcacattcgcacctttgatggcgcgccgctgggtatggagcaaaacctcatcaagggaagctgggacaaagatggcaagaagattgcggtgggcgcgggtgatggcaccgtggtcatctggggtagtgacactggcaagcttttgtacaagcttccgggccacaagggaacggtcaacgtagccgagttctctcccggcactgaccctcttagtaagttgattgcgttttggctgtcatctgcagtagcttaccatgttgtagttctctctgcgtcgtccgataggaccatgctgctcggcgagctgaag

SEQ ID NO: 26848 - DNA, 1926 bp, Neurospora crassa
gaggcagcaaccgtgcctgatctccttgagaccattgtctcgatagtcaaggaggtcacccgtttccaccgtgtgatggtctatcagtttgaccgggattataacggcaccgtcgtcgctgagctcatggatccgaaagcaagcaatgatgtctacaggggattgcactttcccgcaagtgacataccgccgcaagcccggaagctgtacatgatcaacaaggttcgcgtattgtttgatagaagccaaaggacctcgagactcattggcagagacgtcagtgatatggacgtcccactcgatctaactcatgcttacttgcgcgcaatgtcacctgtgcatctcaagtatctatccaatatgggggtaagatcatccatgtccatgtctctcgagtctgacggcaagctttgggggctcatcgtctgccactcgtatggaccggctgcaactcgagtgcctttctcgatccgagagctatcattctttgttggattggcggcatctacgtgcctccaaaagctgctcaactccgaaaggctgcaggcgcatcgaattatcgaaacactaagagggagaggcaggcctgacgagtgtattacttcttcgtcccacgagctacttaacctcttcgattgcgattgtggctttctggtcatcgagggagaggcaaggactattggacggctatcttcctatatcgaagccataacgcttctcaaatatcttttcttcaggggatcgcgcacgatactgttttcacacaacatcggagatgactttaaagatctccatttcccctccgggttcaaagccatcgcaggcgttctctacatacctttgtccagcaccacagatgactgtgtggtattttaccgcaagaaccagatccgagaagtacattgggcagggaggccttcgttggcgggtaagataggcagattggagcctcgaaacagcttcaagaaatggacagaggtagtggacggcacgagcaaggcctggtcaatagaacacagtacgatttcacttcttcaaccgagcatctgccaatactgctaacactagttcccagccaatttggcagcaatggctcagctgctctacggcagcttcatacaggtttggagggagaaggagacagccatcaacgatacccgacttaagcgactactcttgcacgatgcatcacatcaaggtaggaaccaggcattcatgtgttccatgtcgaccagctgacgcgttgtcgttctagtaagaaatcctttaaatgccgtcataaactgtcttgagatagccctggagaagcacctggatgatggcacaaagcaggtcctgacaacgtcatacactgcatcaaaatctctgatttatgtcattgatgatcttctgagcttgaccggtagcataacaggatccgttccattgctggacgaaccattccatcttccaaattgcttggaagaggtgctgtgtcccctaaggcggcttggtcaggagaagggtattcaacttatcatgatcccatctacagggccgacgcagtatgttcggggggatccaacaagtctacaacgaagtctatccattctggtcgccaacgctatccagcatactacaagcggccaagtcgttgtgaaatggtatgagacagctatgaacccagaaaataccgtgatacacatctccatcacggacacggggcccggtttctcggagcgtgagctggatgacatgtttcaggagtttgagcaggttcccgatgaagatttcgacgaggcaacttcaaaaccgcatgctgtcagggataacgtgcttcgcgttggcgtcggattggcattcgtagctcgtttcgtgaagcagcggaatggacaactgaaagtgaaatcaactaagggacgcggatcgaccttcaccctcgagatt

SEQ ID NO: 26849 - DNA, 2497 bp, Neurospora crassa
cgaaaatcacaaaccgccgacgacatgaagctttggtcagcacgaccgcttgcggtcctcgcatcgctcgcgacgttggtcgccccctctttagctcgcgatagggaactacattcaaactcgctcgccgcctgccaggaaaactcgggcttcacggccagtctcttcgacgtcatcttcttccccgacaatggaacagtcaacatcaacatgcttgccacctcgtccattcagggctacgtggttttcgacatccgtatcttggcttacggctaccaaatcatgcacgaggttcttgacccgtgcaatatcggcgttggcctgggcggtttgtgtcccatgaatgccggcaaaatgggcaatcctttcagactggagcttggcccggaggtcaaggatagaattccaggaattgcctacacattccccgacttggatgccacagttaaggtctatgtcaacatgacggacggagaattggctggagaaaccgttgcctgcattgaggccaatgtctccaacggcatgactggtaggtttaggggttgcccccattatatgcaggaaaagtgctgactcggccttgtcttctagtcgatcttgttggtgtcaaatgggccacctgggctgttgtcttcttgggcatcttgtcctctgccctgctttctggtctcggatacgctaacgctgcctcccatgtggcttccaacacgctgtcgctctatggctacttccaggcccaggccatgatcggtctctgtggtgtccatcttcctcctgctgtgcgagcttggacccaggatttcgtatggagtatgggtattatcagagtccagttcatccaggatatcctcacatggtatcagcgggctactggtggtaccgcgtccaccgtgctcaactcgctcgagaccgtgtccgtccaggtcgagaaggtgaagcgtgcgctaccggccgaatacgtcgatcccgctatcaacctcttcaagcgggcgaccgccatgttgcctcgtgccgcagctcatgttggcagcagaattgccaagcgagccaacgtccagacttctttcggcagttacattgtctatggtatccagcgagttgcgtttcgcggcaagatcgagtcaaccaacttgttcatgaccagtttgactttcttctacatttttgtggtatttactgccatcctggtcattttgttcaagattggactagagctctttgccaagttgggttgggttaaaggcgacgccttctccgagttccgcgcgggttggattactgttctcaagggtgagttactttgattattcaggttgatttccgtctagtactgacaattccgttaggtatcctttacagagttggacttgtggggttccctcaggttacggttatgtgcatgtgggagtttacccaaaatgactctcctgcggaaatggccctcgccgtcttcttcttttttggtctcttggctacccttctttgggcggcctggagggtcattcggattgcccgccgctccatctcccttcacaggaatcccgcctacatcctgttctcggaccctcaggccttgaacaagtggggtttcctgtatgtgccgttccgcgcttcaggttactacttcattgtgcctatcctcttctacattgtcatcaagggcatgttcattgcctttgctcaggccaatggcacccttcaggctatcgcgcttctgatcattgaagctgcggcgctcattaccgcttccgtcatgcgcccttggatggacaagagcaccaacacgttcaatattgccatttgcgccatgaacttcctcaacgccatcctccttttcctcttgacggacgttttcgacttcccgcccttggttatcggtgtggtgggcgtggttctctggattgccaacgccatcgtttgcttgatcctccttctcatgctgatcattaccaccacgatgacgctgctccacaacaacccggacacccgctaccagtccatgaacgacgaccgcacctccttcatgaagtcgaatccgcagctgcacactcagtcggaactcgaggctctgggtgtcacggcgcgtggtgagagcaagctttacaccaagtctcccttgagctttgaggatgacgattcggccctttcgagcccaagcaacccgctgaaccgtccagagacggccgattccaacgctggtaaccctcatttccactccaacaggcattctgggcgttggagtaacgacccgtccctcatgagggatgagccgtttgtgcgacataggccgagcggaagcattcagacaccgagtccaatgacggattcggcctcgagtctgccaggagggcaagcatcgactcactcgatggtttcagaaaagaaaccacacaacacagcgaggtacgtttgatggggaaatgggttatgtgctatgttcagttagctaacttacgacagtccttggcaacgcggtgccggatatgaaccaacc

SEQ ID NO: 26850 - DNA, 1726 bp, Neurospora crassa
gagcccgtagccgacaagaaggaaaagaaggaaaagaaggacaagaaggagaaaaaggataagaaggagaagaaggccaagaagtctgacgagtccacgaccgaggagtcaaccagcgcttccaaggccaccaccaacggcaccaccactcccgccgcctctaccaacggcgcctacacctacaagcaggccgatgccctcagcgctctccccgagtccgagatcgagaccttccttaaggagaaggagattgtcatcaaggatccttcctccagcaacctccgccccatcatgaacttctcccagctccctcagtccaacctcatctccaagaaccccttcgcagcctacacgaacccgacccccatccagtccgcttcctggcccttctcgctctccggccgcgatgtcattggtatcgccgagaccggttccggcaagaccatggccttctccctgccctgcgtcgagtcgctggcctcgcgccccaagcccaagttcaacagccgcgaccgcaccgcccacccccgcgccgtcatcgtctcgcccacccgcgaactcgccatgcagacccacgccgccctttccggcctcgcctccctggtcggtctgtcggccgtgtgcatctttggtggctccgacaagaacgagcagcgcaacctcctctacaagaacaacggtgtcgacatcatcaccgccacccccggccgtctcaaggatttcttgtccgagggctccatctcgctggccaacgtcagcttcgccgtgctcgacgaggccgaccgcatgctcgaccgcggtttctccgaggacatcaagctcatcctgagcggctgcccgcccaaggagcagcgccagacgctcatgttcacggccacttggcccctggacatccagaagctcgccgagagctacatgatcaaccccgcccaggtcaccatcggccacaggacacgtgccggtggcgatggtgagggtaacggaaacatcgagctgcaggccaacagccgtatcgagcagaaggttgaggttgtcgacccccgcggcaaggagttcaggttgtacgagctccttaaggaggctcagaagggcagccagaaggacgacaggatattggttttctgcctgtacaagaaggaggccgttcgcgttgagcagttcctttctcgcaagggcatcaaggtggctagcattcacggtgacttgaggcaggatcagcgcacgcgcagtttggaggcgttcaagtctggtactaccaccgtcttggtcgctactgatgttgctgcccgtggtctggatatccccgaggtcaagctcgtcatcaacgttactgtgagttcaaccgcacacatcttacttatcgtcaatggccaagtgctaacagattcccagttccccttgaccatcgaggactacgtccaccgtatcggtcgtactggccgtgccggtaagctgggcaaggccattactctctttaccgagcacgacaaggcccactccggatcgtgagtttctattctttctttctgcctctaatatttccccatgctaaccacaagttttcttttccagcctcgtcaacattctcagagccgcaaagcagcccgtgcccgaggagctcctcaagttcggcaccaccgttaagaagaaggcccacgacgcttatggctctttctacaaggacattgacccgaacaagaaggcgaccaagatcacgttcgattaa

SEQ ID NO: 26851 - DNA, 663 bp, Neurospora crassa
ttccaacgaggcgtctacccggccgaagacttcaccaccgtcaagaagtatggcctgaacatgctcgtctccgccgacgaccaagtccgcgcatacatcaagaggatcatgtcccagctccacaagtggatggtgggcagcaagatctccaagctggtcattgtcattaccgacaaggacacgggcgagcacgttgagaggtggcagtttgacgtcagtaatttcctcgtccccctcttataaaccgactccaagctaatccgtggtctataggtccaaatattctccaaagccgcccaatccaagaccaaatcccaacccgcttccgctaccaccgacgacaaccaaaatcaatctcctaacgaaaacgcagccgcctccaccgccgcctcaactcccacacctccactcgacaagaccgaagccgagatccaagccgagatcgccgccatcttccgccagatcaccgcctccgtcaccttcctgccccagctcagtggcgactgcaccttcaacgtgctggtctacgccgacgccgacagcgacgtgccagtcgagtggggcgacagcgacgccaaggagattgtcaacggcgagcgcgtacagctaagggggtttagcacgacaaaccatcgggtcgacacgttggttagttatcgcctg

SEQ ID NO: 26852 - DNA, 648 bp, Neurospora crassa
gtctacggccacaccggccccaacccgcccaaggtgatcatggtccttgccgagctcggcattccctatgacctggacaacatccaaatctcccaggccaagagccccgagttcgtcaagaacgtcaaccccaacggccgcctgcccgccatccaggaccccaacacggacctcaccctctgggagtccggtgcgatcctcgagtacctgaccgagaagtacgacaaggagctcaagctcagcttcacccccggcaccaacgacttctacctcgcccgccagtggctctacttccagaccacgggccagggcccctactacggccaggtcgcgtggttcaagagataccacccggagccggtgcccagcgccgttgagagatatgtcaaggagctgaaccgcgtgtcgagcgtgatggaggaccacttgcagacgcagaaggagaagtacggcaccgaggagccgtggtttgtgggcaacaagttcagctacgtcgacattgcgtttgcgccgtggcagcacattgtcggcgtgatgctgaccaaggaggagtatgatgaggacaagtacccattgatccacgcctggttggagaggttgagggcgagaaagcccatcaaggacgctttggataacatgattcctgct

SEQ ID NO: 26853 - DNA, 2486 bp, Neurospora crassa
acagacctcgcgaagccgtcgcctaccgacaatgtctaccgcgaggattgtacccaatgcttcgattccattgtccgtactctatcctggcctttcctctcttcttctagccccatctaccatgtccagcctagcaactaaccgcctcgctgtaaataggacgacccagctggtctggatgtctgcttaaagtgctttaacggaggctgcgctggcgaccggaatcacgcaaagctccatgccacctcgcgaaaccacccgctcgtcctcaacattcgccgaacccgcaagatcatcgagcgcaatgagccgcctctcaagatgtccaagctcgccatcgcggccgagaccgaaagcgatcgctacgatacaacacttacagtcaagtgcttggactgcggaatcgacaacttgaacaaggaagatgccaccatcgcccccgtcatcgaggccgtcatgaaggccaacacgttctcacgcaaggaggaggtcaaggcctgggaacaagagctcactacctgtgagcacatcttgacaatgcagcaaggagagcctcgcaagattgagtctcaggatctgggccattgctccaagtgcgacttgaacgaaaacctttggctgtgtttggaatgcggaaaccttggttgtggccgcgcccaattcggtggtgtcagcggaaactctcacggtttggctcacgcgaccgagaccaaacacggcgtcgctgtcaagcttggttccatcacccccgagggaacggccgacgtatactgctacaactgcgacgaagagcgcatcgatgacaacctgggcgcccacctggccaactggggcattatccttgccgagcgcgaaaagacggaaaagagcttgacggaaatgcagatcgagcagaacctgaaatgggagttttccatgaccactgaggacggcaaagagttgacacccgtttttggccctggcctgactggcctcaagaacctcggaaacagctgctaccttgccagtatcctacagtgtctctacgacttgccctctttccaacaacggtactatagcgacaagcttggtcctctccccagcgtatcagatcctgccgaggacctcgaaacacagcttcgcaagcttggtgatggtcttctttccggccggtactccaagtcagacgccgatgtctttgcttctgagcacactcccaacgtcccttaccagaagggtctccagccttccatgttcaagcacctcatgggtcgtggccacgaggagttctcgaccatgcggcagcaagacgcctttgagctcttgcagcatctgatcaagctcatcactcgatccaagcatccagtagagcttggtgatcccacccagcccatgcgcttcgtcatggagcagcgtctgcaatgcctcaactgcaagaaggtccgctacagtagcaatgagcaggacagcgtcttcattgacgtgcccatggagaagcttccacccgaggaggagggtcaagaaccgaagtacaagcctgtcacgctcaagcagtgtcttgacagcctgactgcctccgaggtcgttgagctgacctgtgcgggctgcggaagcaaggatgggtttaccaagcgtcaagccttcaagaccttccccgatgtcctcgttgtcaatgcccgaaagatggctgttgtcaactgggtccccgtcaagattgatgttcccgtcattgttgatgacgagcccttgaaccttgacgaatacctttccaagggtcagcagcctgacgaagaagccctgcccgaggatgagtcggccaagagcagcgctcctgcatttgtgcctaacgcggaggcgcttgccatgctcgaggccatgggatttccacgagtccgtggtgagaaggcgctgcatgccacaggcaactcggatgccaacgctgccatggagtggctgtttgctcacatggatgaccccgatattgatgtgcctttggacctcagtgccagcagcggtggtgcggcttcaggaggcgctggcgcggctgacccggagaagttggccatgcttgagtcgatgggattgtctggaccgagggctgtaaaagcactgaatgagaccggtggtgatgtggaaagagccatcgagtggctattcagccatcctgatgatgatggtgcggacgctgttgaagaggaggcaccggctggcaatgaggggccaaagaaggaggcgggcagtagtgagttgccagccaagttccagttgcagtcgattgtgtgccacaagggaacgagtattcacgctgggtaagtttccatccacgtattcagtcaccgaatcacacgctgaccatgacaaccagacactatgttgctttcattcgtaagaagcttagcgaggacgagacctcctgggtccttttcaacgatgagaaggtggtcaaggtggtggatgttgaggagatgaagaagactgcttatgtctacttcttcaagcgggtgtaa

SEQ ID NO: 26854 - DNA, 2244 bp, Neurospora crassa
accaacatgtccgagtgccccgtccgcaagtccaacgtcggcggtggtggcaccaggaaccacgactggtggcccgcccagcttaggctcaacatcctccgccaacatacccccgtctccaaccccctcgacaaagacttcgactatgccgctgccttcaagagcctcgactacgaaggcctcaagaaggacctcactaaactcatgaccgactcgcaagactggtggcctgctgatttcggccactatggcggtctcttcatccgcatggcatggcacagcgccggcacctaccgtgtcacggatggccgtggaggcggtggtgagggtcagcagcgttttgctcctctcaacagctggcccgacaacgtctctctcgacaaggcccgtcgtctcctgtggcccatcaagcaaaagtacggcaacaagatctcgtggtccgacctgctccttctaaccggtaacgttgcgctcgagtccatgggcttcaagacctttggctttgccggtggccgtcccgacacctgggaggctgacgagtctgtatactggggtgctgagaccacatggttgggtaacgaggaccgttactccgagggtcaggaaggccacgaaggacatggtgtcgtccaaggtgacgagtccaagaaacagcacacggacatccacaaccgtgatctgcaaagcccccttgcctcctcccatatgggccttatctacgtcaaccccgaaggtcctgacggtattcccgaccccgttgcctcagccaaggatattcgtgtcacctttggccgcatggctatgaacgacgaggagactgtcgctctgattgcgggtggtcactcctttggcaagactcatggtgccggtcccactcaccacgtcggcaaggagcccgaggctgcccccatcgagcaccaaggtctcggctgggcaaacagctttggccagggcaagggtcccgacaccatcaccagtggtcttgaagtcacttggacgccaactcctaccaagtggggcatgggctacctggaatacctctacaagtttgactgggagccgacaaagagccctgctggtgccaaccagtgggtggccaagaacgccgagcccaccatcccagatgcctacgaccccaacaagaagaagctcccgaccatgttgacgaccgatattgccctacgcatggatcccgcctatgacaagatctgccgcgattaccttgcgaacccagacaagtttgccgatgcttttgcccgcgcatggttcaagcttcttcatcgtgacatgggcccgcgtactcgctggatcggtcccgaggtcccctctgagatcctgccttgggaagactacattcctcccgtagactaccagatcattgacgataacgatatcgcggccttgaagaaggagattctggccaccggtgtcgctccaaagaagctgatcttcgttgcctggtcctcggcttcctctttccgtggctctgacaagcgcggaggtgccaatggtgcccgtatccgtctcgctcctcaaaacgagtggaaggtcaacgacccttccacgctccgcgaggtccttgctgcgctcgagtctgtgcagcaaaagttcaacgacagttcgagcggcaagaaggtctccttggctgatcttatcgtccttggtggtgtcgccgccctcgagcaggcttctggcttggtggtccctttcaccccaggccgcaacgatgccactcaggagcacaccgatgtgcactctttcactcacctcgagcctcacgccgacggcttccgcagctacggcaagggtaccaagcgcgtacgcaccgagcagtttcttattgaccgtgcctcgctgctcactctctcggcgcctgagcttactgccctcatcggcggtctccgtgtgctagaggccaactatgatggctcatcctacggtgtgttgaccaagacacccggcaagcttaccaatgactactttgtcaacctgttggacaccaacacggcatggaaggcggcggataatgagggcgaggtcttcattggctatgaccgcaagacacacgataaaaagtggactgcgacaagggccgatctcatctttggagcgcatgctgagcttcgcgcgcttgcggaggtgtatgccgcggtggatggcgaggagaagttcaagcgcgactttgtggcggcttggcacaaggtcatgaaccttgatcggttcgatctcaagcaggagggacgg

SEQ ID NO: 26855 - DNA, 2133 bp, Neurospora crassa
cccctcctaaccatccgcttctggatcctctccaccctctgggtcatcgtcggctgctccgtctcttccgtctactacttcaagccctactccgttcgtctctcgggttacgtcgtgcaactactctcgtgggggatgggcgcactcatggcgcgttacttcccacagaagcaatatactctcacgttacctattcttcgtaaagaaatttcattcaacctcaacccgggcccgtggaaccccaaagaacacgccctcgtcatcgtcgcctactggggcagcacgtacaccgcctacggcctcggcccgctctctgccatggagctctactaccacaagcgcatgagcgggccgtgggccgtcttgtttctcatgaccacgcagctgatggggtacggctttgcgggcgtataccgggacgtcttggtgcgtccgccgggcatgtactaccctggcgtgctacccaacgtgacgctgttcaatgccatgcatcgacacccgtccgtgaccaagaagtcgctggggttttttggggtagtggcggcagcggcgtttgtgtaccagtggttgccggggtttgtgatgcctttgttggcttcgttgccggtggtttgttggatgggattgggaacgaagacggcttttgtgttggggagcggaacgtatgggtttggactgctggacttttcgctggattggaattatgcttcgtttttgaccccgctttatacgccgttgtgggcgacggtgaatcggtttgtgggagccgccgtggtgatttgggtggtgtatcccttggcctacttcttgaatgtcaatggggctcagcagtttgcgccgatgagctcggggacgtgggatgccgaggggaatcggtacaatatctcgcgcatcttgacgccgacgtatgagctgaaccggactgcactggaggagtattctccgccgtattggtctttcagttacgcgatgcacttcttctggggattcgctgcgtcgacggccgtgttgacgtatgctgtcatgtttcatgggcgtcaatcttgggaggcccttcgaagctcgctgcaaaccatcagcaatccctttgcaaagaaggatcacaagcaaaagaagaagaactctcagcaacaccgggccgagtttgacgacccctacctcaagcttaccgcccacctcccccgtgtgccgcactggtggtatctcgccctcctcttttcctgcttggtgattgccattgcccaggtctcgggcggcggcatgcagctcccctggtggggtcttctcctcatcacggccatctccgccctcttcacgttccccagtggcattctctttggcttcaccaatgtgcaaatcggcatggactacctctcggagctgcttgccgggttcctgttccccggcaagcccatcgccgtgctcacgtgcactgtgtacggccggcagatcctcgagcagtgcctcaacctggtcagcgacatcaagttcggcttctacatgaagatccccgagcgcgagctgtttgtggcgcaggtgtatgggacgttgctgggcccgtttgtcaactgggcttgtatgcggctgatcatcgacacgcaggggccgaagctgacgggcgaggtggtgtcggggacgacgtggaacgctttgaagaccaagaacttcttttcgctgtcagttatttggggcgtgctgggtccgcaggtgttctttggggacgagtcgccgtatcgatgggtgtactgggggtttgtcgtgggaccgctggcggtgacgctgctgtggcttgtacaacacagactggcgaggcccaagtgggggaaggtcgcgagcgtggttaatccggtggtgatgctgaacggggcaacgctgtttcccatctatccgacgacgaacctggcgacatcggcgctggtggcggtggtgtttatgggatacgtgtacagataccacccggtgtggttccgcaagtacaattatctgctcggggctgggttagactgtggcgcgcaactggtgcagatggccatgatcttggtggtggacttgcctaatgtgaccatgccgcactggtgggggaatgatgccgtcgccgtggacaagtgttatcccatttgactctgtgagttg

SEQ ID NO: 26856 - DNA, 1332 bp, Neurospora crassa
aacaaagtcatgcttcctcccatccccgtcttggccgactatggaatctctccaacccatggcttcctccccgatgtcctgccgttgacgagactgccggatccctactataacaagtgggaggccattgccgccaacctgcaggctctcatcctcagcaagcgacttcgcggagtcgttgatcgtctccctgtgctcgacaccatcggtctggaacacgacgcagaatggcgcagagcctactcgctgctgtccttcatggcccacggctacatctggagcggtgatagccccagtgaccgtctgccgccttccatcgcagtccctctgctcaagatctcggaacatcttgaggtgccgcccgtcgctacctatgcagccgtctgtctttggaacttcaagcctcttttcatggacgaggacatcgacaacctcgagaacctcgccaccctcagcacctttaccggcgccattgacgagtcatggttctacctggtctcggtcgccatggaggcccgtggtgcacccatcatcccgctcatgctgactgccattgccgcagctcgcgtgggtgatggcgctaccgtcactcgctgtctgcacacgtttgccgaacgtcttgacgatctcactactctgttgcagcgcatgcacgagagttgcgatcccaagattttctatgaccgcattcgcccttttcttgccggttccaagaacatggccgatgctggattaccccatggcgtcatttatgaggacgggtccggaaaggaggagtaccgtcagtactctggaggcagcaatgcccagagtagtttgatccaattcttcgatatcgtcttgggtatcgaacaccgccccacgggcgaaaagcgtggccggccccaggagcaaggcgaggttcatgccccggcacccaagcacaactttttgttggagatgcgcaagtacatgcccggtccccatgcccgcttcctcgaccatgtgcagtccgtggccaacatccgggagtttgtcgagaagcatcgcggctaccgctcgctgggtatcgcctacgacgcctgcttggccatgctgcgtgctcttcgcgacaagcacattgccattgtgactcgctacattgtcctacccagcaaggaagtgcgcactcgcagccgcagccgcagtcccgaggctgtccgccgcaagatcaacctggcgaccgcgtcgcgccagcaacctcctggaattgccttggacaccaggggtgatggaaagaaggacaacctcaagggcaccggtggaacggcgctcatttcgttcctgaagcaggcccgcgacgagacgggagag

SEQ ID NO: 26857 - DNA, 831 bp, Neurospora crassa
ttctacggcgtcgccgtcggtcgcacgcccggtgtctacacagactggtccattgcccagcaggaggtggtgggctggaagaaccccaaatacaaaaagttcgaaacccgcgccgaggccgaggaattcgtgcgccaatggagtggcaagccgtcctcccaagccgtcaaggtaccacaagtggacgagacagatgacctgcaagtcattgctctggaagggccagcgaagagctctaggaaagctaggaaaaccggggccacgcaatcagctcatcaggctcaggaagcccttgatgatgctagcaagcccgtcatcatctacacggacggcagcgccagaggcaatggcaaggttggcgccatggcgggggtgggtgtctatttctgcggtggtttcagggagtaagtctgcagtctgacgcgaaagaatagcatgtgtgactcgttttcctaacacatctccaccacaaacagaaacatctctgaaagactccaaggccccgtccaaacgaaccaacgcgccgagttgaccgccgtcctacgagcactggaagccattccggacacgcaaaattgcgagctccgcaccgacagtcaatacacaatcaactgcgtgacgtcgtggtacaaaaagtggatgaagaacgagtggaggaacaccaagggggaggaggtctccaaccaggatctgattgtggccatccgcaagaagatcgacacgcgcgataggaaggccgccgagaccaagttcgtctgggttaaggggcacgggacggacgaaggcaacatcgctgcggatatgctggcggtcaaaggcgcgacaatgatg

SEQ ID NO: 26858 - DNA, 1476 bp, Neurospora crassa
ccgctcgaggtactgcctggcgagtactacacgccatgggaagacctcatcagacggttatcggagtcgctcgatgctggaacgtttcgagcagaggttgatcgcttgccggttttgcaaacggatcgattgatgagggaggaagagtggaggagggcgtatgtggtgctgtgtttctttgcgcatgggtatatttggggtgggaggagaccgtctgaggtgagttctttgtgcatggtggcatagagccgaagatgaagatgaagatgaagacgatgagaatgtactgataacgacaaaaaaaaacagatccttcccgcgccaatttctgtcccactcctttctgtgtccaaacacctcgacttgcctcccatagcgacgtatgcatcgctcaacctatggaactttcgatgtgtacctcccccatcttcttcacttcctccttctcctccagcgacacccgcttcctcttcttccccttctccatctctcaccacctgcaaaaccgccgccgccaaaacacccaaggtattcgacccaacagacctatcccgcttacaaaccctgcacaccttcaccggcacaccttcggagtcctgcttctacctcgtctccgtagcaatggaagcccaaggggcatacatcatccccatcatgctacgcgcgctacaagccatcggtctacgcgccgaagcatggaaggagtcgacaaccaaggcgttgcgggagttggtacgctgcgtgcaagctgtgggggagctgttggagcggatgtatgaggggtgtgagagtatggtgttttatcatcggattagaccttatttggcggggagtaaggggatgaatagtacctctatggggctggggaggggggtgttttatgatttggggcctttgagtcctgctggttctgagagaaagacaggggagaaaggggaagaaggggtagagggagaagaggtgcaaggacaaaagagaaaaggaaaatggatggcatacagaggcgggtcgaacggacaatcgtcgcttatccagttttgggatctggtgttgggggtggaacatgttagtgctggacactcttctcctcatggacaggcttcgcacccttcccaatcagacaccatgaaggagaaagaaaaacccttccatgaggaagtaagggagtacatgccacttaaacaccgacaattcctcaccctggtatcaaagatgggattgggaaaaggaggaatcagaaaagcagtcatggagatggtggaagccgcagagcacgaggggagggagttggacgataaggaaaaagaattgcagggtgcgttcaccgatgcgacgagggcgttggccgggttcaggaataagcatttgcagattgtcgcgaggtatatcgtcattccttcgaggcaggcggtgccggaggggagtaagaggccgggggcatctctgggggatggaaaagtgggtggaggcaaagat

SEQ ID NO: 26859 - DNA, 870 bp, Neurospora crassa
gctaccgaactcctcgccggcgccgccgccctcctcgcttccggcgtatccgccgaggcctacctcggcttcaactcgggtaacacgctccccagccgcgaagccaagttcaagaaggactgggtgcaagagttcaccacggcccagaacctcaagaactcccctggcgtcttcaacgccgtccgtctctacaccaacatccaggcctactcgcaaacctcggagcccattgaggcctttgaggccgccatcgagaccaacaccaagatcctgctgggtgtctgggcctcgggcaccaacaccatcgagcccgagatcaaggctctccagaacggtattgccaagtacggcaagaagctgacggacctcatcatcggcgcctccatcggttccgaggacctgtaccgtgtctccgtcacgggcatccagaacaagtcgggtgtcggcgcgggccccgccgagctcgtcaagttcatcgccgactggaagaaggccttccagggcaccgccattgccaacgtgcccatcggccacgtcgacacgtgggacgcctggaccaacggtaccaacaagcccgtcatcgacgcggtcgactgggtcggtgtcgacgagtacccctactacgagaacggcaagggcaacaacattgagaactctggatacctcttcgaccgcgcctacgatgctattgagggcgccgtcggcggcaagcccatctgggttaccgagacgggctggccctacgtcggccagacgtgggaccaggccgcggctaccatcaagaaccagcagtactactggcaggaggttggctgccgcaagctgttcggcaaggtccccactttctggtacaacctccgtgactcgaac

SEQ ID NO: 26860 - DNA, 981 bp, Neurospora crassa
tttttcgttcccttcccctccccattactaaccccggtggcagtcgaaatcggcacccccccacaaacagtctacacccaactcgacacgggctccttcgaactgtgggtaaacccggactgcaccaccgtctcgccctccgactcttccttctgcgaccacattggcttctacaacgcctctctctcttccacgtccaaatccctcggcaccagcaaaaccctccgttacggcatcggcgccgccaacatctcgtacgtgaccgacaccatctccctttccggctcctccacttctttgaaagatatccaattcggcgtcgccacctcctccaaagatgccttttcgggaatcctagggatcggctacggccagggtctagcgaccaaataccccaatttcattgaccagctgtacgcccaaaagatcaccaaggtcaaagcatacactttagcgctaggatccaagactgctcaacaggggagtattgtctttggcggtgtggacacatccaagttcgccggaccgctggggagactaccgattattccagccgaagactcgccggatggcgtcccgcggttttgggtgcagatgaacgggatcagcctcacgccgccttcgggacagagcatgggcgtttacgaggggagcaaaatcccggcgtttttggatagtgggagtaccatgacgatcttgccgcccgcgttggcgaacaagattgccgaggactttgggagcccggagatggatgcgaatgggttttatcgagtcgggtgtgggtatgtggagatgaatgggacgatggattttgagtttgtgggtgcgggacaaaaggtgacggttagggtgccgtacaaggaaatgatcagggaggtgggacagggggagagcaagatgtgctttttggggatcatgggcagtgagagttttacgttgttgggggatacgtttttgaggagtgcttatggtgagttcaac

SEQ ID NO: 26861 - DNA, 1639 bp, Neurospora crassa
ttgtctggggtgctgacacagagacatgcaccagccgtcgccgatgccgtcagaacgtcgctgggaccgcggggtatggacaagatgatcatgactggaaagggggagaccatcatcaccaacgacggcagcacaatgttgaagagcatgtcggtcatgcaccccacagccaagatgctcgtccagctgtcgcacgcccaagatgtcgaggccggtgatggcacaacctcggtcgtcgtcctttgcggtagcttgctcggtgccgccgacaggctactaggcaagggcatccacccctcagtcatctccgaagctttccaaagagccgccgccgctgccgtagacgtcctccacgacatgtcgcaacccatctccctcacagataccgcctcgctcctccaggccgccaacacttcgctctcctccaagatcgtgtcacaatactccaacctcctcggccccatggccgtcaacgcagtcaccaagacgatagatctcaagaccgccgagaatgtcgacctcaagaacatccgcataatcaagaaggtcggcggtacgatcgaggacagcgagctggttgatggtctcgtccttacacagcccgtcatcaagagcgctggtggtcccgtcaggatggagaaggccaggatcggtcttattcagttccagctcagccctcccaagcctgatgtgcgtatacctttctggcgaccataacctacccaccttgcctgctggccctaaatcgcccaaacactacccttttcgtgcttttactaacaactcactcttacagatggaaaacaccatctccgtaaacgactaccgccagatggacaagatcgtcaaggaagagcgcacctacctcctcaacatggtcaagaagatcaagaaagccaagtgcaacgtcctcttcatccagaaatccatcctccgcgacgccgtcaacgacctgtccctgcacttcctgcagcgcctcggcatcctcgccgtcaaggacatcgagcgcgacgaagttgagttcatttgcaaatcgaccggctgcaagcccatcgccgacatcgactccttcaccgaggacaagctcggcagcgccgacctggtcgaggaagtcaactcctccggttcccgcatggtcaaggtgacgggcaccaagtccgctggcaagaccgtgtccgtcgtcgtccgcggcgccaacagcctcatcctcgacgaggccgagcgctccctgcacgacgccctctgcgtcatccgctgcctggtcaagaagaaggcgctcattgccggtggcggtgccgccgagatcgagatcgcgtcgcagttggccaagcagtcgcgcgccctgagcggcaccgaggccatctgctggaaggcgttcgcggacgccatggaggtgatcccgacgacgctggcggagaacgctggcctgaacagcatcaaggtggtgacggacctgcgccacaggcacgagaacggcgagaagaacgccggtgtcagcatcaagagcggtggtgtcaacccgaatatcgccaaggagaatgttctgcagccattgttggtcagcacaagcgcgatcgagctggcggcggagacggtgaagatgattctcagaattgacgatattgctcttagcaggtag

SEQ ID NO: 26862 - DNA, 1361 bp, Neurospora crassa
ccaagagagcccgcccaccactaccaccgcaacggacaagtcgtctaacccccgtcaagggatattcaggtcctcaagacatacggcgccgcgccctacggtgctgccatcaagaagctagaacagcaaataaaggagaagcagcagagcgtggatgagaagattggcgtcaaggtatgctagtcttgcggtggctaccctacaaaccgcgaagcgcatctagctgaccagtgatactttttggtctacaggaatcagataccggccttgcgccccctcacctttgggatgtggcagccgaccgtcagcgtatgtcagaagagcaaccgcttcaggtagcgcggtgcaccaagatcatccctgacgagaaggacgaatcgaagagcaagtacgtcatcaacgtcaagcagatcgccaagtttgttgtccagctgggcgagcgagtcagcccgacagatatcgaggaaggaatgcgcgtcggcgtcgacagaaacaagtatcagattctccttccgctacctcccaagatcgatgcgagcgttaccatgatgacggtcgaggaaaagcctgacgtcacatacggcgatgtcggtggttgcaaggaacaggtcgagaagctacgcgaggtcgtggagatgcccctcttgtcgccagagcggttcgtcaacctcggtatcgatccccccaagggcgccctgctatacggacctcccggcaccggtaagacgctttgcgcccgtgccgttgccaacaggacagacgccacctttatccgtgtcattggttccgagctggttcaaaagtacgtcggtgagggtgcccgcatggtccgcgagcttttcgagatggcccgtactaagaaggcttgcatcatcttctttgacgaaattgatgctattggtggagcccggttcgatgacggcgcgggtggtgataatgaagttcagcgtactatgttggagctcattacgcagctggatggtttcgatgcccgtggcaacattaaggttatgttcgctactaaccgtccttccacgctggatcccgccctgatgcgtcccggacgtatcgaccgcaaaattgagttctctctccccgatctcgagggtcgtgccaacattctgcgcattcatgccaagagcatgtcagtcgagcgcgatatccgatgggagctcatttctcgcctgtgcccgaacgcgacgggtgctgagttgcgtagtgtttgcacggaggcgggcatgttcgccatccgtgcgcgcaggaaggtggcgtcggagaaggactttttgagtgcggtggacaaggtcatcaagggcaacctcaagttcaactctactgcggcctatgcccagtacaactaa

SEQ ID NO: 26863 - DNA, 2138 bp, Neurospora crassa
ccaaagcgtcatgctttggtcactcgttttcccgtccattcaagccatttccgtggctgcactgcggtgtcacgacgccaagctcatcagtttcgcaacatgtctcactcccagaacccccaagatgaacaagcccaaaaagggtcaaaattctcccacctccccctaagcacaagtggcccgttagagtgcgctctgaaaggcaccgtgctgctcaaccacccttacttcaacaagggatccgccttcacaaaggaagagcgtcgcgactttgctctccatggtttgctaccgccacagatccagtccctggaacagcaggtccaaagggcatatgagcagtattgcagtcaacccaatgatctggccaagaatacgtttatgacttcgatgaaggagcagaacgaggtgctattttatagggtaagattgcttttttgttctgtaccgtgaagtattgctataggtttagggtgtgcgttgttctgacttgagcggttgttcagcttctgcatgatcatcttgacgagatgtttagtgtagtctacacacccacagagggagaagccattcagaactactccaggttattcaggagacccgaaggagtgttcctgaacatcaatgatatggactccgtaaagcgtgatttggcgcagtggggaaagcctgaagacattgactatatcgtggtaaccggtaagacgcaaccttttgacataaaacgatttcatgggtgaggaagatggctgacaaagtgtagacggcgaggagattctgggcatcggtgatcaaggatgtggtggcatccttatctccatcgccaagttggtactgatgaccatttgcggtggcattcatccaaaccgtgtgctcccggtggtcttggactgcggcaccaacaacgaagagctcttgaaggacgatctttaccttggcctccgacagaagcgtgcccgcggtgacaagtacgacgactttgttgagaccttcatcaaggctgcgcgtgaactctaccctagagcgtacattcactttgaagattttggcctggacaacggtatgttgcaaaacgtttactcgcctgcatggttactgacataatcgctagcacgtcgacttctggagagatatcggccccagatgccctgtttcaatgacgatgttcaaggaacgggatgtgtgactttggctgccatcatggcaggtttacacatttcaaagcaaaagttaagcgacgtccggatggtggtcttcggtgctggtacggcaggtgttggtatcgcggaccacgttcgcgatgccattgccgcagatgcagacatcagtcccgaggaggctggcaagcaaatctggtatggcgacgcattccaggcctaggacaggtctcttcacgtaacaacacactgacactacgcaggctcatcgataaacccgggctactcaccaccaagtcagagtcactgtcagacgctcagaagaagtatgccaagtcgcacgacgactgggccaacgagaagaccgacctcctagctgtgatcaaggaggtcaagccgcatattctagtcggcacatccacaaaaccgaagtcgttcacggaagaggtcgtccgtgagatggcaaagcatgttgagcgtcccatcatcctacccttgtcaaatccaaccaagctccacgaggccgtgcctgaggacctcctcaactggacagacggcaaggctctcgtcgccacaggcagtccgttcgacccagtcaaaggcccctggggtaaggatggcaaggagattgagatcgatgtggctgagtgcaacaacagcgtcgtgttcccgggtatcggtcttggctctgtgctgtcgcgggccaaccgtgtaactgacaagatgttgatggcggcatcgaagggcgtggctgagatgggcccagcgctgagagacgatacggcgccgctgcttcccggtgtcgatgtcgtgcgcgatgtgagtgtacgcgtggctcggagagtcatcttggcagccatggaggagggtgtagtcgaggagaaagatgtgccaaccaacgaggaggaccttgatgaatggatcagggagcagatgtgggatccggtgtataggccgctgaagtatgttgagggcaacaag

SEQ ID NO: 26864 - DNA, 2160 bp, Neurospora crassa
ctgttgcatccttgctgaacagaaacagtatctgaaccgagtgaatttatagaagcttcgtgaatcgaatatccgattcgcatcaaaaagaacagccagagaacttccagggcggtattattgctgatccgatgggtctgggaaaaacgctaacaatgattgctctgacggcgagtgatttgatgtgggtatcgcttgctcgccgagggaacaacgaattcgcgtcggtcggccagacactggtcattgttccaccaccacgtatgtttaccaaaataggggcagttgtgattgggagtgctaatcaaccacccaatagtgttaggtacatgggaagagcagttgacagagtaagtttactccttatcatgacgacatcaggcaatcccagctcactcatacacgcccaataggcacgttgaacccggagctttctcatggtgccgacatcacggaaacgacaggcttatcacaacgaacgacgctcatcaacccaccattatccttacaacatatcataccgtttcagccgagtggaggaatgcgggtgaatctgctcgttctggcatcttctccaggcgttggcgaagaatcatcttggacgaaggtatgtttagtgagccatgttgtttgtggaaggttagcttgaacaagaattcactgactaagatattatgcctcaagctcatatcatccgaaaccacaattctcaaatggcacatgctatttgttcactcgatggggattctcgttgggctgtcacgggaacgcccatccagaacaagctctctgatctagcgactttgctaaagttcttgaggatttatccatacagcgacaagaggtgctttgacgctgatttcacgaatctttggaagaacgggcaagccaatgaggcactaaagcgcctgaagcgcttagcgggttgcttgattttgaggcgacctagcaccaccatccagctcccggaaaggcgcgatcttctgtgcccggtggaattttacccggctgagcgagagctgtatcaagacatccgcaccagaaccattgagcgcctcgatgagttcttgtacgcaaacaatgctgacaccgtacgactgccctcgtatgtcaatgttctccagcagattgaggggatgcgaatggtatgcaatcttggattatactaccgctcacgccacgacttcacagcccaagatccatccgccgataccacgtggaataatgcgatggcccaacgagcactcgaccttcagctggaaatgaaccccgtgcgttgtaaggattgcaaagcgtcacttgatgtggccttcagtcttctaggcgatactccagaggtacagggattgcaacaggcgctcttgtcgcaatgtatgaagtttgtgtgtccggaatgtgttttcagacgtggaggcgcaccgcccgtttgcgatcacactccagtatgcccgttcgccccagtgtccatcagtgccatcactgccaaggaagcgccggagcctgccgctatcgaattcgaaggaagagacttgatgtcaccgcatgagatgccctcaaagatcaagtcgctgattttgcagctcaaaaacctagcctgcgacaccaaaaggtataccagtaagccgctgattctaagaagatgagactaaccgcaccattagtgtcgtattctcaacctggaggaccactctcgatgttatcgaagccggactcaagacggaagatataccatgtctccgcttcgacggcaaaattcctcaaaaagagcgaccaaatgtcatcaacaggttccgacatgatccaacctgcagggtcctgctgctgacactttcttgcggagccgttgggtaagatcacaacaccgaatgtgctctctcaatgagctggtcttattgctaactccccaacccatcaaccagacttacactaactgtcgcctcgtatgccttcctcatggaaccacactggtaagtacccaatccttaattgacccttaccatttgataggtacaaaaaaccctgagctgaccatgagatatcaggaatccaactcttgaagatcaagccttggcgcgaattcacagaatgggtcaaacacgggaagtcaccactgctcggttcttcatcagggactcgttcgaggaggtgagtcttttgcat

SEQ ID NO: 26865 - DNA, 937 bp, Neurospora crassa
gcaagcggtattggcaaggcatgcgcgttggcctttgcccggtatggcgttcgaggcatcgtcatagcagatctcacgctcgaagctgcttctgcggtggcagcagagtgtaagtctcaggctactcaccctcacttcctggctgaagcagttgccatcgacgtaaccaaagaagagtccgtctatcaagcaattgcatacgcacatcaggtcctcggtcggatcgactacgcagtgaacagcgctggtgtaagctctaccatgaccccctaatcaccagcacacattgattgacattccctgtttggtacaggtcggagtccaattggccaatgaaatcgccgaagccagcgtctccgagtttgaaaagatgttcaaggtcaacgtaactggcaccttcatcgtcacccgcgctctctccgccctcatgaagacccaagaccccgttcccgttgacgaagccgttcccgcgcggggtgtctcacggggtagcattgtcaacgtggggtcagcttcggggtttgttgctaccccaggcatggttcaatacacagccgccaagcatgcagtcgttggaatcaccaagaatgctggtaagttaggttgttgggttacacaaagtaccgtgcctgctttagcgatagggtagcagaaagggtccgttccggcgtttactgacggttctcttccaatagcacttgataacgccaaacatggtatccgggtcaatagtgtgtgtccatcctgggtcgatacacccatgatccgcaaggccatggatgacatccctgaactcggagagatgatccagaaagccgttccgctcggaaggattgcgctagccgaggaagttgccgatgcggtcatgttcctctctagtccgaaagcgagttatgctacggggtgcaacatgatcttggatgggggtacaacgctt

SEQ ID NO: 26866 - DNA, 915 bp, Neurospora crassa
ctaggcttctgcaccaagaaccctcccacccccaaagagcaagccttcaaggccatgcgcgctgcccttgaatccggcgccaacttctggaacgccggtgaattttacggctcgcctgactggaacacgcaaaagcttctggctgcctacttcaagcagtaccccgaagacgctgaaaaggttgtcctctcggtcaagggcgccttcctcttcccgcagatgatccccgactgctcgcctgcgggactcaagcgctccatcgacgcctgtctcgccgacctggatggcacccacaagatcgacatctttgagcccgcccgcattgaccccaaggtgccgctcgaggagacgctcaagtacctcgaggacgagtacgtcagcaagggcatcattggcggcattggtctctccgaggtttcggccgcgacgatccgcaaggcagtcaagatcaccaagatcgctgcggtggaggttgagatctccctttgggcgacgcacacgctggagaacggcgttgctgaggcttgcgccgagtttggcatcccattgattgcttactcgcccatcggccagggcatgctcacgggtcagatcaagacgcttgacgatctggccgcggacgacttccgcaggcattacccccgcttctaccccgagaacttccacttgaacattcaattggttagcgagctgaacgagttggccaagaagaagggatacacgcccgcgcagttggccatcaactgggtcaagtcactgagcaagaagcccggttacccgacggttatcccgatccctggtgcgactaccgcggagagggtcaaggagaataacgtggatatcgacttgactagcgaggacttgaagaagattgatgagacgttgaaaaagtttgagattgccggaaggagatac

SEQ ID NO: 26867 - DNA, 1416 bp, Neurospora crassa
accatcaacaacgcatcatcattaccagcaacaggcgggtctcagtccagtgagatgcccaagacaccgggaccttcgccattggcagtactgccactaacaaacgtcctccgatcatggatgaccaccaccgtttcctcctcgcccttcctcctaccgccttcactagctgtcatgtccgtcctagcccataccacaaacccagttcttaaccccgaccgaaaccctctcctccgcgcattcctcaagaagaccttctacgcccaattctgcgccggtgagaatccggccgaggtccgccaaaccatcgactccctcaagcaaatcggtttcagtggtgtcatcctcggctacgcccgtgaggtggtccttactgattcggagaccaaagatctcgcctcctgcgcggccgagggtggcgccgctgcggaggagtgcattcgcacggaaatcaacccttgggccgaaggaaccatggagaccgtccgccttgcctctcccggcgacttcgtagctctcaaattcaccggcgccggccgccaggccctttatagtctttccaaacagctcccaccctccgaggctctaggttctgccatcgacggaatctgcaacctcgccgccgagcggggcgtccgcctcctcttcgacgccgaacaaaatgctctccagcctggtatcgacgactggacgctcgactacatgcgccgctacaacaaaagcaacgccgtagtctacggcacttaccaagcctacctcaaatccacacctgccactctctctaagcacctcgccatcgccgcgtccgaagggttcaccctcggcgtgaaactcgttcgcggcgcttacttgggcgctgatcccagatatctcatctgcgacaccaaggccgacacggatggccagtacgatgggattgccgaagccttgctccgcaagacctggtctggccccttgcaacctcctgtcccccagtctggatctgctgaaaaggagacgaccaacttccccgacgtgggcgtcgttctagccacgcacaaccgcgaatcggtactcaagggcaaggcccttctcgacagcggcgtggccaagctgggctatgaacaggtggcgttcgcccagctgcagggaatggcggacgaggttagttgtgagcttgttgctgggccgcacgagactcccaaggaaatggagatggcggcggagaaggaaagtgagaagggcagtgagaagggaagtgaaatggtcaataagccgcaggtgtacaagtacctggtgtggggatcgacgggggagtgcatgaagtatttgttgcggagggcttatgagaatcgggatgcggtgcagaggacgaggagtggacgggaggcgatgggaagggaggttaggaggagagtgaaggggctatttggggtt

SEQ ID NO: 26868 - DNA, 1053 bp, Neurospora crassa
cgctttctgccaacaggtctcatccccggtgatggcatcggcaaggaagtcattcccgccggccggcgcatcctcgaggctctcccggcctctctgggcttgaagttcgagttcatcgacctcaaggccggctgggaaacctttgagcagaccggcaacgccctgcccgaagagacagtctcgatcctcaagtccgagtgcgatggcgcccttttcggagccgtcagctcgcccaccaaggccgtcaagggctactcctctcccatcgtcgccctgcgcaagaagctcgacctgtacgccaacgtgcgtcccgtcaagtcggtccggggccccggcgtcaagcccatcgacatggtgattgtgcgcgagaacacggaggacctgtacgtcaaggaggagaagacgtacgacacgcccgagggcaaggtggccgaggccatcaagcgcatctcgcagcgcgcctcgtcgcgcatcgccaccatcgccggtgagatcgccctgcgccgccaaaagatccgcgagggcggttccccttccatccacaagggccctctcgtgaccgttacccacaagtccaacgtcttgtcccagaccgacggcctcttccgctccaccgcccgtgaggccctcgccgccggccgcttcacttctgtcgccgttgaggagcagattgtcgactcgatggtgtacaagctcttccgccagcccgaggcctacgacgtcattgtcgcgcccaacctgtacggtgacattctctctgacggcgctgccgccctcgtcggctcgctcggtctcgttccctcggccaacgtcggcgagggttttgccatcggtgagccctgccacggctccgcgcccgacattcagggccagaacattgccaaccccatcgctacgctccgctctgctgcgctcatgctcgagttcctcaacgaggaggaggccgcggccaagatttacgctgctgttgatgctaaccttgaggagggcaagctgcttagccccgatcttggcggtaaggctaagaccgaggaggttgtgcaggatatcctc

SEQ ID NO: 26869 - DNA, 1213 bp, Neurospora crassa
cgcgccggcccgacgcatcaggcaattcttcaaaatgagcaggcccgaggaggatactttgcgacatgcgcgatggggacgcctgggcagaaagtgacattgcagttggatacaggcagcagcgacgtatgggtaccggactcgactgcatcaatttgcaataagggcgcgtgtgatctgggaagttgtatgtgacctgccgctcccttatacctgagacggcgttgatgccaactaacaaacgtattagtcgatccaagcaaatcggaaacatacacggtggtagggcagggtgaatttgacatttcatatgtggacggcagttcgtccaagggggactattttaccgatgttttcaatattggcggaacaacggtcaccaacttgacgatgggcttgggagctcagacggatattgcgtatggcctggtgggtatcgggtatgctatcaatgaggccattgtgggaaatagccattccctgagctcccaataccccaacctgcccgttgccatggtcgatgatgggttgatcaacacaatcgcgtacagtctctggttgaacgatcttggtatgtatagcgcatgttctcgttgacacggacgcaaagctgacaatgtggcatcgcatagacgcgggtgaaggcagtattcttttcggcggcatcgacacaaagaagtataaaggcgacctgacgcgaatccgaatctaccctagtagtaacggctactacttctccttcatcgtcgccttgacatcgttacaagcaattagtcctagcggtaacgacacgcttacctctcaggagttccccattccggtagtgctcgactcgggtacgaccctgtcttatctgccgcaagacatcgtggatcagatctggcaggaagtcggtgcagaatactctgataggcttgagttggctgtcattccctgctcgaagaagtctagtaacggctacttttcctttgggtttgccggccctgacggccctcgcatcactgtgcggatggacgagctggtcctcgatctcactagtggagaccctccgaagtacacgagcggaccaaacaaaggccaggatgtatgcgagtttggcattcagaattctacctctgcgccatacctccttggcgacaccttcctgcggtcggcatatgtggtctacgatctggtcaacaatgaaatcggcttggcggagacggacttcaac

SEQ ID NO: 26870 - DNA, 1911 bp, Neurospora crassa
aagaaactcaagaagattcctggccaggaatccaagcgctatcccggcattcacttttcgacccaggccaggcttttttccaagatcaacgtctcttctttacgcgacctgatcctgtacatctttgccgatggccctgcgccgcaatgggtgtctgtcaagcatcgccccgagttcagaaagatcgtggccatcatggtaccgggtcttgacgaggccatgttcaagaacggtcttgacttctccgcctacaccggtcccactcttgatcaagcgatctccggtggcggcgcccctgatcctgatgagtactatccacgcgagctcaagaaggagctgttgcccgaagtcctgcagcccttcgccgacatgttcccgcatttgtggcctgtaaaagctccaggtgacgacaagtatggcaagttgcactcgccaatgcctgcaatgcttaccgcgcccctgcccaagagcaagggaacgggaatccagcccgtatctgagccccacggctggaaaaatcagcgaacacgcattaccgagtttttggccaccaacgaggagctgatggagcatggcttccccgttcatccagctatgctgaacccaggggagaaaaaagacaagttcaaggaccccgaaggctgggtacacacgagggtcgagaatcttgaggatggaaaggtccccgaaggcgaagtgcaacagggcagtgtcaccgcaggccgggaagtctatgccctcgattgcgagatgtgtatgacgggggaagccgagtattcacttaccagaatcagcttggtctcttgggacggcagtgttgttcttgacgagcttgtcaagccggacaagcctatcattgactatgtgacccggttttcaggtatcaccaaagagatgatcgatcctatcaacacgacattgaaagatatccaggcacgcttgctcgacattcttggtcctcgctcgattctcctcggacactcgcttgactctgatcttaaggccctcaagctcgctcaccccttcattgtcgacacctcgcttctcttcccgcaccctcgcggacttcccctcaaacaatcgttgaagtacctcgcacaaaagttcctcaaccgcgaagttcaaaagggtggtggaaccaacgccggacacgacagtatcgaagacgccaaaacgtgtctcgaccttgtcaagaggaagtgcgagaagggcaaggcatggggtgccggagagagccagggcgagaacctcttcaagcgcctcgctcgcgctggtacggcatatcgctcgaccgctgggccggaggccacgggcggtgctcctgtcggcaagagcagcgcagctgttgactggggtgacgtaagcagaagcgccggtaacgccgccaccgtcacaatttcctgcaaatccgacgccgaggttgaagccggcatcctccgcgcggtcaagggtgatcccgacggcctcgaagttcccggcggcggtgtcgactttgtgtgggcacgcatgcgtgagctcgaggccctccgaggatggtggaaccgcaacaagctcgtccccgaggacgctggcggcccgccggctctcactgatggtgataaaaaggaggaagaggaagagcaggaggatgccgcatcaccccttgagacctgcctgaagacactcggcgagcggttgaagcgcatctacgacaatctcccgccctgcacggctttcatcgtctacaccggcactggtgacccgcgcgagatgagccggctgcaggccatgcaggcccagttcaagaaggagtacaacacgcctggctctaagtgggaccagcttagtgtgcaatggacggacagggaggatcaggctctgcgtcgggctctgaaggtggcgagaagcggcattggcttcattggagttaaa

SEQ ID NO: 26871 - DNA, 2207 bp, Neurospora crassa
atgccttccacattcaccgatcccgccggagtcgcgcgtgacgagccgttgtataccgtcgtccacaatgacaagaagcgggtcgcctacttctacgactccgacattggcaactatgcctacgtgaccggccatcctatgaagccccatcgtatccgtcttgcccacagtctggtcatgaactacaacgtgtacaagtttctcgaggtctacgtaagtttgctgtgttgggggtactggccttggtcaacgacaaactgaccctctctgtgttagcgtgcaaaaccagccgttactgccgaaatgacacagtttcacaccgacgagtacattgagtttttacaaaaggttacccccgacaacatggacggcttcatgcgcgagcagggcaagtacaatgttggcgatgactgtcccgttttcgacggcctgtttgagttctgcggcatcagtgccggcggaagtatggagggtgccgctcgcttgaatagggacaagtgcgacatcgccatcaactgggccggtggtttgcatcacgccaagaagagcgaggctagcggtttctgctatgtcaatggtatgtggccttcacaatttcctggaacccgtacgacgccacccatgcttacctactacaccgaacagatatcgtcctggctatcctagagctcctgcgtttcaagaagcgcgttctttacattgacatcgatgtgcaccacggcgatggtgtcgaagaagccttttacacgacggatcgcgtcatgaccgtatccttccacaagtacggcgagtacttccccggtaccggcgagttgcgcgacattggtatcggttccggcaagaactatgccgtcaacttccccctccgcgatgggattgacgacaccacctacagctccatcttccagcccgtcattagcgctgtcatgcaatacttccaacctgaggctgttgtcctccaatgcggtggtgacagtttgtccggtgatcgtcttggctgctttaacttgagcatgcgtggccatgccaactgcgttaattacgtgcggagctttggactacccactctggttctcggcggaggtggctacaccatgcgcaacgtcgcaaggacttgggcctacgaaaccggccgtttggttggtgttgagatgaacccagtccttccttacaacgagtactacgacgtaagtggattagttccattatggcttgccgccttgctaacaaactcttagtattacggtcccgactacgagcttgatgtgcgttcttccaatatggagaacgccaacagcccagagtacctggagaagatcaagatatcagtgatagaaaacctgaagaagaccgccccagttccctctgtccagatgcaggacgttccgcgtcagggcttcggtatgtcagacgatcaggaagacgagcttgacgacatggatgaggacgagaacaaggatgtccggcggacacagcgtcaatgggagaaggagagagctaggcaagacgagtttgaagaaagtgatgacgaggacatggctcaagccaatggtgtgttcaagccgaacggaccgcagcgccggtccattctcgacttcaagaaccccaaggccgtggaggacatggatcttgatattggagaaccagctccgccctcgattgccgccaccgccgccgcggccgccgctaagccagcggagcctactgctgtcgacaacgatgagaccatgatcgataacgacgaagcccaaccggccgccgctgaacctgaagccgaagcccccgcaacgacagccgcgcagcctgcagtaagctctgcggccaaagttgacgaagatggcgatgtggatatgggcgaggccgatgagaagcctgcagaacctgaggcggagatcaagaccgaggaaatcgagactgcccctgctccggagccggaggcagagcgcaggccaagtcccgccgccgccactgcggagcctgctaccgaggcagcagcagcagcagcagcctctcccaaggccgcctcgccggtaccagacgccaacactgagaagccagtggcagaagagccaagcaaggttgccgaggaggcatccgacaaggcaccggcagcaacaacagatgacaaggaaaaggaggccgataagcctcaagaataggacgcaaccccccgaacaaacactcagtacgtctgatagctcggacta

SEQ ID NO: 26872 - DNA, 946 bp, Neurospora crassa
ctgggttctggtcaggacaacaccaacctcatcgacaactcggaaaccgtctacatttcctccctagccctcctcaagatgttgcgccacggtcgcgctggtgtgcccatggaagtcatgggcctgatgctgggcgagtttgtcgatgactttaccgttcgcgtcgtcgatgtgtttgccatgccccaaagcggtactggtgtcagtgtagaggctgtcgaccccgtcttccagatgaacatgatggacatgctcaggcaaacgggaaggtgagaggatactcagctcaacttgacctttcaccacccactaatgtatttcccttcgcaggcccgaggccgtcgttggctggtaccactcgcatcccggttttggctgctggctttcgtcggttgatatcaacacccaacaaagtttcgaacaactcaactcccgtgcggtcgccgtggttattgaccccattcagtccgtcaagggcaaggttgtgattgatgctttccgtctcatcaacccccagtcgctcatgctgggtcaggagccccgccagacgacatccaacttgggacatctcaacaagccttccatccaggccctcatccacggcctgaacaggcactactactcgatcggcatcaactaccgcaagaccgccttggaggagaacatgttgatgaatctgcacaagcacgtttggaccgaggccctcgaaatggaggacttccgctgcgagggatcgaggacgaaggagagactcgaccgcctggttagccttgctgacggctacgagaagagagtcaaggaggagacagagttgaccaaggaccaactcaagacacgctatgttggcaaggtggatcccaagaagcacttggaggatgtcggacagcaactgatcgaagacaacattgttgccgttacaaggcagatgatcgacaaggaggcgacc

SEQ ID NO: 26873 - DNA, 1753 bp, Neurospora crassa
ggcctctcaggccgaccgctctctctagctgtctcgactgtagccaccacgggcttccttctcttcggctatgaccaagggtgagtgctcagtcaacaccatgagtcgccctcgatgaagccgaatgttaacacactccaaacagtgtcatgagcggcatcattaccgcccccgctttcaacaacttcttcacaccaaccaaagacaactcgaccatgcagggtctcatcactgccatctacgaaattggatgcttgattggtgccatgttcgtcctctggaccggcgatttgttgggtagacgcaggaacatcatggtgggcgccttcattatggctctcggtgtcattattcaggttacctgtcaggctggatccaacccttttgctcagctgttcgtcggcagagtcgtcatgggtattggcaacggcatgaacacttcgaccattcccacttatcaaggtgcgttccggctttgccaaccactgaccgacaaaaaattctaacagattctgtagccgaatgctcaaagacatcgaaccgcggtcttttgatctgcattgaaggcggtgtcattgcctttggtactttgattgcttattggatcgactatggtgcatcttacggtcccgatgacctcgtttggcgcttccccatcgctttccagcttctcttcgccatcttcatctgcgtccccatgttttaccttcccgagtcgcccagatggctcctcagccatggccggacccaagaagctgacaaggtcattgctgccctccgtggctacgagatcgatggtcccgagaccatccaagagcgcaacctcattgttgactccctgcgtgcctctggaggtttcggccaaaagagcactcccttcaaggccctcttcactggcggcaagacccagcatttccgtcgtctcttgctcggttccagctcccagttcatgcagcaagttggtggttgcaacgccgtcatctactacttccccattctgttccaggattctattggcgagtcccacaacatgtccatgttgctgggcggtatcaacatgatcgtctactccatcttcgctaccgtttcctggttcgccattgagcgtgtcggtcgtcgtcgtctgttcttgatcggcaccgttggccagatgctctccatggtcatcgtcttcgcctgcttgatccccgacgaccctatgaaggcccgcggtgccgcggtcggtctcttcacttacattgcctttttcggtgccacttggcttcccctcccctggctctaccccgccgaggttaaccccatccgcacacgtggaaaggctaacgccgtctccacctgctccaactggatgttcaacttcctcatcgtcatggtcacccccatcatggtcgacaagattggctggggaacttacctcttcttcgcggtcatgaacggctgcttccttcccatcatttacttcttctaccccgagactgcgaaccgctcgctcgaggagatcgacatcatcttcgccaagggcttcgtcgagaacatgtcgtacgtcactgccgccaaggagctgcctcacctcactgccgaggagatcgagtcctatgccaacaagtatggcctcgtcgaccgcgattccaacggcgagggcggcaaccgccatgacgaggagaagacgcgcgaccgccccgaccagagtgacagcgactcccccgctcacgtcgagattgatgttgtcgacgagcacggtgtcgagtccggc

SEQ ID NO: 26874 - DNA, 3208 bp, Neurospora crassa
aatgagtctgtcttccggcgcaacactctacctccacggacataccacattcccacggaaaattccctcttgctcaacggccaatgggactttcactacgcctcgagtcctctagctgctccagacccgaccgcagaaaatggccacaactcggctgacaagcacaacgcaaaataccagtggactaccattcaagttcctggccattggcagcttcaaggccacggtatcccacactacaccaacgtccaatacccatttcccgtctgtccgccctttgtgccttcggagaatcccactggtacctatcgacgctccttcttcgtaccggacacgtgtgagactgaccagctccgcttgcgattcgacggcgttgacagtgcctaccacatttggatcaacggtgttctcatcgggtacgctcaaggttccaggaacccttccgaatttgacgtaaccgaatatgtcgaccgagccggccccaacgagctcgttgttcgggtctaccaatggtcagacggctcatacattgaagaccaggatcagtggtggctttcgggcatcttccgcgacgtacacctcttggccttcccccaaacgcgcatcgagcactggttcttacggacagatctcgacgtcgaatacaaaaatggaatactcattgccgagatcgatgtcaaaacaaactctcgctcggtgatagaagtagaagttctggatcacaaccaagatattgtcggctgtgcagaagactggggttttggcagcagaaaggtgatgctcaggattcccatcaacaatgttgaccaatggacagcggaaagcccgaatctctacacagtccggatagagcatgtggtcgacgagacacttttccatgtggttaaacagagggtcgggtttcgcaaggttgagctgaaggacggactgatctgtgtcaacgggaagcccatcagattccgcggcgtcaatcgacatgaccatcacccttcctttggacgtgctgtaccgctggacttcatcagaaaggatctcctgcttatgaagagacacaacatcaacgcgctgcgatgcagccattacccatcgcacccaaagcttctggaccttgctgacgagctcggtctttgggtcatagacgaggcagatcttgaatgtcacggattctacgatgccattgcacggcccttgaatatacctgaagaggtggattacgaagagcgaaagaagcttactttcggtcatgccgccaagtttacaagtgacaatccgtcctggaaagcagcgtatctggatcgtatggcgcagctcatacacagggacaagaatcacgcctctgtcattatctggtccttgggcaacgaggctttctatggccaaaaccacaaagccatgtacgagcttgcgaaagatatcgaccctacaaggctagtccactacgaaggagaccctcatgctgagtctgcagacatgttctcatacatgtatccatccgttgagcgattagtcagcctcgccaagactgaaggcgttaggtctgatggcacctttgagaagcctatagtgctttgcgaatacgcgcacgcaatgggaaacggacctggctggctcgaggattacgaagaggcattccgcgcctaccctcgccttcaaggaggcttcatatgggagtgggctaaccacggtttatggaaagaagaccctgatggaaagtcctattatgcttacggaggtgatttcggcgatgttcctaatgacgggacgtttgtcatggacggtcttttgtacagcactcatcaaccgacgcctgggctactcgagcttcagaaagtgtatcagcctataaaagccgagttgattgactatagtgatgtggcctgtaagctgaggatcacgaactcttacgactttgtctcagtcaatcatttaaccgcgacttggaaagttgaatcttttatgaacaccactaggtaaagtcctgtcaacttccccttgactaacttgacgccgaggcactaacaaatttgcattccctagtaccatcttgcatagcgctggcgtcatggaactgccacatatactcccacgatcatcaaagaacatcgagctgagtctaaggcgaccattgccgttacatccacctatgtggttgagcgtctcattccgcctgaaaagctcgacagcatgggcggaagagggacacgaagttgcttgggctcaatttgaactcgggtctgatgatggattttcccatggttccactttcttctatttaccaagcctgaccaatcttccactccgatccgaatcatctggcactctaaccaccattactggacataacttcaccatcaacttcgacaatgcaaaaggctatatgaccagttggacaactggtggtacccccctcctcgaacccaacccgcgaactggcgcggccattatcccctctttctggcgtccacccaccgacaatgataatcccatttccctcccgtactggaagcgcttcggtgtccatgccatgactagccagctccgattcttcgacgttactgccactgctaagatggtcgtaatcacaacgagaacgcttcattccccgccaattctctcctgggggtaccttgtccatacagtctacgaaatcactaaaattggcgacattcacatatcggtaaccctgaaacctcagtcttctgactacgtcaacacccttccagcccacgtccctcgtgtgggtcttgatctccgtctctcacgccgtctcgatgccgtgaagtggttcggcctaggaccgggagaatcctatcctgataagcgcactgcccagcgcctcggaatttggtcggtggaccacgtcgctgatcttcagaccccttatgaggtaccacaggagaacggcaaccgcatgggtaccaggtgggtagccatccatgagcctcaggggaccgggctacgagctatagcaggggacgacggtgagtggtctgataagtgcgagaggaacttcagcttcgtagcgacgagacacagcgcaaaggcgttagaagaggcaaaacatccatgcgatctcgtggaagaggatgctacgttgttgaggcttgacgcaaaggttgcgggtgtgggcactgcagcttgcgggccgggtgtgagggaggatttgctcgtcaaggttgaggagatgaagttctcgtttgtgttgaag

SEQ ID NO: 26875 - DNA, 1747 bp, Neurospora crassa
acttccacttgctctctcagcataactccttaccagccagtcaacatggctcacagcataaacgaaaaggaggccatgggtgcccatgacgatgccttcccagaatccgatattactgtccagttggcccatgatgtcgacaacacaaagtactcgccctggtccaagagcatgttccgcctctaccttgtcctcgcgtgtgcctacctctgcggatgtctcaatgggtacgatggaagtctgatgggaggcttaaacggtatgaaagcctaccagaactacttccatatgtatgtgttcatcggccaagacacccataagtgatacatcagctaacctcttgggttcttccaggtccactgcaggctcgggaaccggccttgttttcgccatgtataacattggcagtgttgctgccgttttcttcaccgcccctgtcaacgactggttcgggcgtcgctggggcatgttcacaggtgctcttgtcattatcattggcacgtgtgtccaagccacgacacataccaaatcccagttcctaggcggtcgcttcgtcctcggtttcggcgtcagcttctgttgcgtatcagccccttgctatgtcagcgagatggctcaccccaagtggcgcggcaccctgacaggcttgtataatacgacctggtacattggctctattatcgcttcgtgggtcgtctatggttgctcctatatcgagaacaacaaggacgcgtggcggattcccatctggtgccaaatgatcacctccggaatcgtgtgcttgggagtcttttggttgcccgagagtcccaggtggctcgtggctcaagacaggtacgaagaagctgccaaaatcctggccacctaccacggcgaaggccggctcgaccaccctctagtacagctgcaactcaaggagatggccaaccagatctcgtcagaggcatccgacaagaagtggtacgattaccacgagctttggaacactcactccgcccgtcgccgccttatctgcgtcctcggcatggcctgctttggccaagtcagcggcaatagcttgtcctcctattacatggtcaacatgctcaaatcagccggtattaccgatgagcacaaggtattggcgctgaacggtatcaacccggccttgtcgctcatcggcgccgtaatgggagcacgcatgaccgatgtcgttggccgccgtcctcttctgctctacacaatcgtcttctcttccacctgcttcgccattatgacgggtaccagtaaactcgcaatgccgggccatgttggtaaccttgacgacgctgatactcaagctctcaccccatcccaacgtgctgccgctaacacgaccattgcctttatctttatatttggcattgtcttttctttcggatggacggccttgcagtccatgtatattgcggagacactccctacagctacccgcgcaaaaggcactgctgtcggaaatttcgtatctgctgcttcgtctgtcgttcttcaatattcctctgggcctgctttcgagaagatcgggtactacttttatctcgtttttgtgttttgggacctcattgaaggtgtcctgatcttcttctatttccctgaaaccaaggatcgcaccctcgaagaactcgaggaagtgttctcggctcctaacccggtcaagaaaagcctggagaagaggagtgcgcagacagtattgaacaccatgggagcgccggatgacgagaaagttaca

SEQ ID NO: 26876 - DNA, 1628 bp, Neurospora crassa
agcaaggagtccatccacctctatttcgccatcttcgtcgccttttgttgtgcatgcgccaacggttacgatggttcactcatgaccggaatcatcgctatggacaagttccagaaccaattccacactggtgacactggtcctaaagtctctgtcatcttttctctctataccgtgtaagtgattagggatttagcaaatcactcctttttggtttggggcttttctaacacctcgagtcttccagtggtgccatggttggagctcccttcgctgctatcctctctgatcgttttggccgtaagaagggcatgttcatcggtggtatctttatcattgtcggctccattattgttgctagctcctccaagctcgctcagtttgtcgttggccgcttcgttcttggcctcggtatcgccatcatgaccgttgctgccccggcctactccatcgaaatcgcccctcctcactggcgcggccgctgcactggcttctacaactgcggttggttcggaggttcgattcctgccgcctgcatcacctatggctgctacttcattaagagcaactggtcatggcgtatccccttgatccttcaggctttcacgtgccttatcgtcatgtcctccgtcttcttcctcccagaatcccctcgcttcctatttgccaacggccgcgacgctgaggctgttgcctttcttgtcaagtatcacggcaacggcgatcccaattccaagctggtgttgctcgagactgaggagatgagggacggtatcaggaccgacggtgtcgacaaggtctggtgggattaccgcccgctcttcatgacccacagcggccgctggcgcatggcccaggtgctcatgatctccatctttggccagttctccggcaacggtctcggttacttcaataccgtcatcttcaagaacattggtgtcaccagcacctcccaacagctcgcctacaacatcctcaactccgtcatctccgctatcggtgccttgaccgccgtctccatgactgatcgtatgccccgccgcgcggtgctcattatcggtaccttcatgtgcgccgctgctcttgccaccaactcgggtctttcggctactctcgacaagcagactcaaagaggcacgcaaatcaacctgaaccagggtatgaacgagcaggatgccaaggacaacgcctacctccacgtcgacagcaactacgccaagggtgccctggccgcttacttcctcttcaacgtcatcttctccttcacctacactcccctccagggtgttattcccaccgaggctctcgagaccaccatccgtggcaagggtcttgccctttccggcttcattgtcaacgccatgggcttcatcaaccagttcgctggccccatcgctctccacaacattggctacaagtacatctttgtctttgtcggctgggatcttatcgagaccgtcgcttggtacttctttgggtatgttttgggtcttcttctctgtcgacatcgcgtaaacagcacacagatcgctaactcgttccactacagtgtcgaatcccaaggccgtaccctcgagcagctcgaatgggtctacgaccagcccaaccccgtcaaggcctccctaaaa

SEQ ID NO: 26877 - DNA, 1741 bp, Neurospora crassa
atggcgacagtactaccacccccgtcgaagcgccaaaagagagaggagattgagcgcaccacaacacagctcgatgtcgccccgatactggcgcctgagctcggctccttcaaggccaacttcgtcgacagcgatggcaaccagatgaccgatgtcatcgaaatcaactttgccgatgccaccgaaaagaacatctccgtcttgctcaacaccctgctcgagagggaccgcgaagagttcaccccataccgattccgcatccatattcccggcaaggatatcattgtcgaccagtacccttccgacctcctcggccttctcaagcagcatggtgtcgagaaccccttcgagtatgcaagacccggacacaggaagcccagcacgtaactgcttcgctaacctccgcatagaaccacaattactcttagtgccgagccccaggctgttttcagggtacaagcagtttcgcgccttgcccatcgcattcccggtcacggccaacccatcctcgcagcccagttctcgcctatttcatccggacgccttgctaccggcagcggcgacaacacagctcgtatttgggatacaaatacaggtaccccgaagcacacattgaaagggcacaccggctgggtcctcggcgtcagctggagacccgatggagagcaactagcgacctgcagcatggatggcacagtgaggatatgggatcccgaggccggcaagcccgttggtcagcctttcaagggccacgccaaatgggtgttgatgacggcgtggcagccgtaccacttgtggagagacggcacccctaggattgccagtgctagcaaggatggtacctgtaggatttgggttgtcaacacaggccgtaccgagcacgtcctgagcggtcacaggagctccgtcgcctgcgtgcgatggggtggaaccgacctcatctacacgggttcgcacgataaggttgtccgggtattcgacgccgtcaagggcaccttggtacacagcttgacatctcacgcccactggatcaaccatattggtttgtccagcgaccacgccctgaggaccgcctactttgaccacaccaaggacgtcccttccaccgaggagggcaggagggagaaggccaaggagcgtttcgagagagcggccaagatcaatggcaaggttgctgagcgcatcgtatctgccagtgacgactttaccatgtacctgtgggaccccaccaacaacggtaccaagcccgttgctagacttttgggacaccagaacaaggtgaaccaggtccaattctctcccgatggcactttgatcgcctcggttggttgggataacagcgtgaagctctggaatgccagggatggcaagttcctcaagagcttgaggggtcatgttgcacccgtgagttccttacccacattcatctcttaccacgaggggaaagttctaacgcgttgatacttcaggtctaccaatgctcctggtccgccgatagcaggcttctgattacggctagcaaagatactaccctcaaggcatggaatgtgcgcactggcactctcgccatggaccttcccggacacgaagacgaggtatgtgaaccaaatcacggcgacatcggtgttcccactgctggaaaattctaactcgcttccaggtatacgctgtggactggtcgccggatggcaagatggtaggatcaggcggaaaggataaggccgtgaggacatggagaaac

SEQ ID NO: 26878 - DNA, 2394 bp, Neurospora crassa
cgaagctctccgacatggggcggccggccggaccagccgatgtcccgtgcgaactctcccccgcctccttccctgatcaacagcagccgtgctctgaaccagaaggcgagagaaatgggtcgccaaggcatcacgcagccacggagcctcgtgagaagtgaaagccatgatcgagtgttcgcacacgccgactggaagatcgttagcgccgatcagggtaacggtggcttgcgcaacgccgccgaggcagctgccagggacggcaagcttggagagtacacatggattggcaccttgggcatgcccacggacgccctccggggtacccagcagctccaggacatcgatgacagacttgccactgagcacgacatgctggctgttttctgttcggacaaagacttcgacggtcattattcccacttctgcaagcagatcttgtggcccgttttccactaccagattccggacaacccaaagagcaaggcctacgaggatcactcatggaagtactacgtaaacgtcaaccaggcgtttgccgacaagattgttaagaactggaaaaaaggagacacggtctggatccacgattaccacctcctcttggtccctggaatgattaggaagaagattcccgaagccaagattgggttctttctgcacgttgccttcccttcttcggaggtctttagatgtctagctgttcgcaaggagttgcttgaaggcatgctcggcgccaacctcattggattccagatccgtgagtacgccagacatttcctccagacttgcagccgcattctgagcgttgaggccaccccggatggtcttcagctcgaggaccgttttgtcgacgtcatcaacctcccgatcggtattgaccctgttagcctcagccgtcaccgtggtgagagtgaagtcaagcgctggctggacatcatgcgtgagcgctatgcaggcaagaagctcatcgtagcccgtgacaagcttgaccacgtccgcggcgtgcgccagaagctcctctcttacgagatgttcttgaacatgaaccctgagtggagggacaaagtcgttctgattcaggttgccctttcaacaagcgaaaagagcgagttggacgctaccgtttctgacattgtgacccgcgtcaactcttcgtgggccaacttggcatatcaacctgtggtctacctcaagcaggacatcgactacgcccagtaccttgcgttattgagcattgctgatgctctcatgatcaccagtcaacgtgaaggcatgaacctcacatcccatgaataccttttctgccaggatggcaagttcagcgagaagaagcacggctcattgatcctttctgagttcacgggtacttcctcgttgttcaacggaaatgagttgtcggtgaacccttgggactacagggcttgtgcagatgccatcaagaaggctctcgagatggaaggcgaggagaaggagcgccgctggaagaacctatacgaggccgtcaacgttcacaccggctcgcattggttctcagagtttatgctccgcctagataaggtctacgaggagcaacatagccgcgatcagaccgcagtacctcgcctctccatgacgacgttgttgcaacaatacgagcgcactaatcgccgccttttcatcattgactttgagggaacccttgtcagctggggccccgttaatcaaatcattccggttagccctcaacgcaccctggatgttctcaacgatcttctgctcgatgagcgcaacactatctatgttatgtctggtagacgtccagaggagctggaccgtatcttccgccgcgttaccaacctcggcttgatcgccgaaagcggatgctatctcaaggactgcggaagcaacacctggaccgaaatggccgatgccaacaagatccgctcttggaagagttcactccgggacatcatgacctactacttggagcgtacgccgggagcggcgattgaggagcgtcgctgctccttggtgttccactacaagtctgcggatgattacgagacggccgctacacaagcttccgacttggccagccacatcaatgacgcatgcgaggaccaacgcgttcacgctattccaatggacggttgcgtgcttgttgagcccatagattggaccaagagcaccgcggcccagacgatctttgatgatttgcagcaacggatggggccagatgagaagcacaaatccccggttgacttcctcatggtggttggcgacggtcgtgacgacgagaaggtcttcaagtgggccaaccagttgggcactgatggaacagtacaggaggtggtgactgttagccttggcaatagaaacactgaggctaaggcgacggtaacccagggcgtt

SEQ ID NO: 26879 - DNA, 3273 bp, Neurospora crassa
cccagtgtacagaatgtacacccatctccccttggtaccacaagctcgtcttcctatcatcgatataggggagaagaacagggaaatggccgcggcgcaagtattcccaaagccaagtactcgagcagagctcctctaagggacctgaaggagtgttccggtacgactcccagctcgagagagatgagttcacctgtgatttctcagtcaagctggcggagcagtacatccaaatcattttctcaacgagacacctctgagactacattacgcctaccacgcaccttattgtacgatcgcattagcaagactcaagcaatgagcaccagatcaaccctgcccacacctgtcctgagtgactccgattcagactcagacgctgaagagtcaagcctcgagaaaagacaccgcctagttggctcctctctaatcataactccacagaaagaatcagctccaaccgtcagttctgaagaaaaagatcacgccatctgtgctatatcagagagtcgctctgcggaggttgttggcattgccgtcatcaatatcactacgggacaagtggatttagccagaattctgaacgatgacaagtacttgtatcagcgtctgggagacacattgtggaagatgtcgtcaaagccggaaaagttcctcgtcgtcaacagcgtcacgacgaatagcagcaagtctttactcatttcttgtctggagcaagacttcccagaagtccccatagtgctttggggaagggaacattggagtgaagcagaagggctcaggatgattgagcgttttgcacttcgggatcatgtgattgctctcaattcagaccttgagaacaacttctacactccttgtgccttttctgctgtaagttatcggcgtcatcgtggagataagactgttggctaactatatcaaggtaatgaagtatgtacagaacgagctgaacattcattttgccagcaacgcgttacgaatcagatatattcagccactcaacaccatgggtatcgaccgcaccaccgttgcctcgttagagctgcttcaaaatacacgacgagccactgcaaagaattcgacgcttttcggtatactcaacagtactaaaaccccccaaggacaccgcttgctacgcacaaccctcttacagccgagtacaaacaaggaagaggttatagaacggtatgaatcagttgaggagttgtctactaacgaagacctttttcgtgagttgcgcaaagcactcgaagagcttgttcgaatcgactttgagcgcgtcatcgtatgggtaagttgcttttagcactctcagtccctctagcatgctaattcttccaaagatcagccaggaacaacccaacccacggcagcctctggaagaaggcgttccaggatgtacaaatcaaggcctactcctaccaacccacgcggagcttaccaaagcggaacaggagttgaactccatactcatgctgaagaagtatcttagtggcattgacgcattgcatggtacacttgaagcagctgggtgcaaaagccgtctattgagatggatcagggataggtttgcaccagagcacactgagcccgttcaaagggccatggaagagatgatagaggatgatgctgcctacagtaaaaagccaatagagttgaggaacaatcggatgtgggctgtcagagtaagtcatttctgcttggttttcctttacggggctaacagctattcggcaggctgtgcgtaattccgttcttggaaaagcacggaggttattcacagctcttacgaatgacctcaatgagtattttgatgtgctagacaaccagttcaatggtaggtcaatctccctgcatcaagattattatcactgacgcagctcagaggttttgggaactcgtgcaaacttgcacatggacagcaaccggcggtattggctcaggtttgattactcagatgtcgaacgtgaaatacaacctcaatccgacgttcaaaaggggaattccggcgaagtcagccactggaagcaggtctccatcgccggtctcgaaatgattaacggcactagggataaaaggcatttcaaatgccagaccactgagcttctccagagaagcagggctattcagctccaggcagacattgcaacgatgcagagcgatagattggtcatcgagctcaaaaggagacttcaagagcattcgagtctcatgttcgatatcagcgatgctattgcattgctcgacatgcttagctcatttacacaggctgccactactcaagactacgttcgacccatgatcaccgacagcatggttataaaacaggcgagacatccgattgttgaggcgcgaaccgaccaatatgttgccaacgacgtgtattctggtgatcaatccggacgtttccaggtgatcaccggcggtaacatgagcggcaagagcacgttcatccgatcggttgccctgattcaaatcatggcacagatgggatccttcgtccctgcgcaatttgcgtccatttccatctgtgacagagtatttgctagagtctccacggacgatgcgcctgagaataacctgggaacatttggtgtggagatgagggagacaaatgccatcttgaggtatcctttccttccctacaacatgtcggagtaattgatctaatgggatgtctagacaagccacagcacaaagcatgatcatcatggacgagcttggccggggaacttctccaaaagacggtcaggctctcgccattgctatcgtcgagaagttaatcaagatgaaaccacgtgtcttttttgcaacgcacttcactcgtattcgtaggttcaaagggtgtctctcttctttgattcactgctaatcccagtcgtaccagctcaacttttgaacaaaatttatccgagagatgtcttgaacgttcacttccaaggccaaagccaagcagtaggccaaatcacacagatcacactgccacatactctcgccggaggtcccgtgcagaacgaggactacggcatcgaactagcgcgctgcgttcttcctggatccatagtgaacactgctgaggaggttttgaaagccttgcgtgagggccagaagccacaacagagtggagaaaagggaagggaggctagacaaaggaagctcacgctagctttgcctgttgttatgaaacaagccctcgactcgaccatggacgatgccgcattgggttcgtacctgcggaggttgcagaccgagttcacgcttaggtggttt

SEQ ID NO: 26880 - DNA, 1014 bp, Neurospora crassa
ctcaacctgctcgagaaactgcaatacgcccaactcgacaatgttaaattgcctcagatagtggtcgtcggcgaccagtcggctggcaaaagctcggtcctcgaagctctcactggaatcccgttcccccgcgaagctggcgcttgtacgaggtttgctaccgaaatcagattgcgcagatcccccgagtccagcatcaccgtctccatcattcccgacagaaatcgcccttctagcgagcaagaacaattgctagagtttggtcgtctaatcaacagtagctccccattcgatcttacagtaatgggagccgcagaactcattgctccaaagggtgttccaggacggtttgctgcacgggacattctggtggtggagaagaaaggaccagatatgccactgttgacccttgtggatttacctggtttagtacggaatcccaacaaggaccagtcccttgaagacatccatatcatcgaagcgctttccgatcgctacatgcggagtccccgtaccatcattcttgccgtcgttggcgggaactccgattacgtccaggcccccatactgaccaaggctcgacatttcgaccctaacggtacccgcactatcggcgttctcaccaagcctgatcttaccgactccattggtcttgaggacaagttcgtcgagctcgtcaagaacaatgaccggcgtaaccattttcgtttgggctggtacgtccttttgaaccctggcccgcgaacggaaggagaaacctggccttctgcggagcaacgccggtcgactgaacgggatttcttctccaaaggcaaatggagctcgcttccggcgtccatgtgcggagccagcgctctgaagcaaaggctaagtctccagcttcagcagcacattgggagacatgtcaacgcgttacgcagacagattcagaaggccttggatgattgtgatgccgaactcaagtcgcttggcactgccaaaagcacacccgaagaaatgcgcttagagctcatt

SEQ ID NO: 26881 - DNA, 1201 bp, Neurospora crassa
cccctacagcgccttgctcgggccgttgcccagcccaccccccgcctcgcccgcggcttcgccagcgtccaggacactcctgcgcagaccctccagtccgacatcttcaagcccaccaagtacggcggcaagtacaccgtcaccctcatccccggtgacggtatcggtgccgaggttgccgagtccgtcaagaccgtcttcaaggccgacaatgtccccattacctgggagcagatcgaggtttcgggtgtccaggacaacgccagccgcaccgaggaggctttccagcaggccgttgcctctctgaggaggaacaagctcggtctcaagggtatcctccacacccccatcagccgctccggccaccagagcttcaacgtcgccatgcgccaggagctcgacatctacgcctccatctcgctcgtcaagaacctccccggcctccaaacccgccacaaggacgtcgatctctgcatcatccgtgagaacaccgagggtgagtactccggtctcgagcaccagtctgtcgatggcgtcgtcgagtccctcaagatcatcacccgcgccaagtccgagcgcatcaccaagttcgccttccagttcgcccttgccaaccagcgcaagaaggttacctgcattcacaaggccaacatcatgaagcttgccgatggtctcttccgcggcaccttcaaccgcctcgccaaggacttccctcagctcgagtgcaacgacatgatcgtcgataacgcctccatgcagtgcgtcagcaagccccagcagttcgacgttatggtcatgcccaacctttacggtggcattctctccaacatcgccgctgcccttgtcggtggccccggtgtcgtccccggctgcaacatgggccgtgacgtcgccgtctttgagcccggctgccgtcacgtcggtcttgatattcagggcaaggaccaggccaaccctaccgctctccttctcagcggtaccatgctcctccgccacctcggtcttgatgaccacgccaaccgcatctccaacgccgtctacgacgtcattgctcaggggtaagttctcctaccactgcgcctttactaaaaacacgtgctaaccccctcacagcaaggtccgcacccgcgatatgggcggcgaggcctccacccacgagttcactcgcgccatcctcgactccatggagaagtctctctaa

SEQ ID NO: 26882 - DNA, 969 bp, Neurospora crassa
gcatactaatctctctactcaaaacccagtgtcgacaaacggagtggccaggcagtagctatcaaggttatcgacattgaaagcgccgaggacgaagtagaagacattatccaggagatcgccatcctttccgagctacagtcgccctacgttaccaaatactatggttcttacgccaaaggcgccgagctatggatcgtcatggagttttgctcggggggcagctgtgccgatttgatgaagcccggtctgattggggaagactacatcgccatcatcgttcgtgaactgctgctgggactggactatttacaccaagacaagaagctacaccgcgatgtcaaaggtaagggacagcaactggcaaatgcacatgtcccgttaaacagcttgtgctaaccgctagtagctgccaacatcctccttgctgccaatggccaggtcaagctagctgattttggtgtttccggtcagctatccgcgaccatgaccaagaaaaacacatttgtcggcaccccattctggatggcccccgaggtaatcaagcaaagcggctacgatcacaaggctgacatctggtcgttgggtatcacggcccttgagctcgccaaaggagagccaccctatgccgatatccatcccatgaaggtgctctttctgattcccaagaacccgcccccacgcctggaaggcaacttcagcaagggattcaaggacttcatcgagttgtgcttgcagcgtgaccccaaggaaaggccaacggcaagagaacttctcaagcatcccttcattcggcgggcaaagaagacgagctatctgacggagctcattgagcgttacaaccggtgggcagctacgcacaagcaagatgacgaagagtaccatgagcccgaggagaacaactatgttgagcaacggaagcatatcaatgaggacatgtgggactttggcacagtgcggctggttagt

SEQ ID NO: 26883 - DNA, 1155 bp, Neurospora crassa
atggctacaccgattccagttcagatcctggatggagggatgggaaccactctggaagacatgcacgacatcaccttctcgtttgaaactccgctttggtcatcacatctccttgtttccggcgaggaggacaagctgtcggattgccacgaggcattcaagcaggcaggagccaacatcatctccaccgcgacgtaccaaatatccatcaatggatttgctgccaccaaggcgccgagaagcggaaccgtcgacgaggagagggagggcatcgagaaggaagagattcctcgcttcctgagccgtgcggttgtccttgccgcaaatgcagcggggacggagggcaaggttgccttgtcgctgggtccttatggcgccaccatgattccatcgaccgaatacagcggcaggtacgatcctgaacaccaacatgtgcaggccctgggaaaatggcacaaggaacgtctggatctgttcaaggacgtcgatcccaaccaagtcaactacattgcctttgaaacggttcccaggcttgacgagatcgttgccatcagaaatctgctctcggccgacaacatcccaacatccctccgtggacgccccgtatggatttcctctccttacccaaacgatgatggaaagcttcccgacggcagcacggtagaggaggtcgtcaaagccgttctcacgcatagggaaggcctggagactccatggggtattggcatcaactgcacaaaggtggaaaagctcgactccttggtcaaacgatacgaagatgcgatccagacctgcatcaagaacggagagcagatggcctggccaagcttggtcctctatccagacgggacaaaaggggaggtctacaacacggccaccaagacttgggagttgtctccaggacacaaagagacagaggtacgctgtgatctaccattgtttacaggtcctttggttcacacaccaacactcacttctttcaaacaggccccctgggaaacagtgctagccagtgttgtcgaagccgcacgtcaaagaggaaactggaagtccatcgttgtgggaggttgctgcaaggcgtcccccgaacacattcgaaggctacgaaggaccctacaagattacggccacatgtcaacctctccagcggcgtag

SEQ ID NO: 26884 - DNA, 1239 bp, Neurospora crassa
atgaaggctacgattcttgccagcaccttcgccgctggtgccctcgcccagagcggtgcctggggccaatgcggcggtaacggttggtccggcgctaccagctgcatctccggatacgcctgcaactacgtgaacgattggtatagccagtgccagcctggtactgccgctcctaccaccactgccgccgccaccaccctcgtcacctcgaccaagaccgcccctcctgctagcaccaccactgccaccgcctccggcaagttcaagtggttcggtgtcaacgaggccggcggtgagtttggtgatggtatcttccccggaagatggggcactgagttcacattccctgacaccaacaccatccaggtatgtcacctccccttgttgtcaagatatgtatgtggttctggatactaacctcgcttggcactatagactctccgcagccagggttacaacatcttccgtgttggcttcgccatggagcgccttgtccccaacaccctgacgtcgtctttcgataacggctatctcaccaacctcacccaggttgtcaactctgttaccaactctggtgcctatattgttctcgatccccacaactatggccgttactatggcaaaatcatcaccgataccgatgccttcaagactttctggcaaaatgttgctgccaagtttgcttccaactccaaggtcatcttcgataccaacaacgagtacaacaccatggaccagacccttgtcctcaacctcaaccaggccgccattgacggtattcgtgcggccggcgccacttcgcagtacattttcgtcgagggtaaccaatggactggcgcctggtcatggaatgtgaccaacaccaatttggctgcccttaccgatcccgagaacaagatcgtctacgagatgcaccagtacctcgactccgatagctccggtaccagcactgcctgcgtttcctccgagatcggtgttcagcgcattgttggtgccactgcctggctccgcgccaatggcaaaaagggtgtcctcggcgagttcgctggtggtgccaactcagtctgcaaggctgccgttactggccttcttgagcacctcaaggctaacactgacgtctgggagggtgccctttggtgggctgccggtccctggtggggtgactacatgtatagctttgagcctccttcgggcactggctatacctactacaacagccttctcaagacctatacccct

SEQ ID NO: 26885 - DNA, 1194 bp, Neurospora crassa
actgtcaacaacttcatcaagaaacacaaggttaccgtcatcggttccggtaactggggcaccacagtggccaagctcgttgccgagaactgcgcagagcaccccgatacgttcgagaaggatgttcagatgtgggtttacgaggagaacgtcactctccccaaggactccaagcactttgatgcctcgatcggcgagcaaccgcagaagctcacccacatccttaacacatatcatgagaacgtcaaatacctccccggcatcccgttgccccacaaccttgtcgccaacccttcgctggtagacgccgtcaaggactcgagcatccttatcttcaaccttccccatgagttcattggcaacatctgcagacagatcaaggaccacattgcgccctatgctcgcggcatcagctgcatcaagggtgtctccgtcaccgacgacaagatcgagcttatttgcaactacgtcagcgacgctctcaacatctactgcggtgcccttagcggtgccaacattgccagcgagattgccaacgagcagtggtgcgagaccaccattgcctacaacacccccttggttgacaggcgcgacgagaacggcaggccggtcggcaacggcgagtctaacgaccacaccaagcaactcacgccgctgccgctcgactaccctcctctggatcacgatgagtggtcgctgctcttcagccgcccctacttcactgtttccatggtgtcagacattgtcggtgtctcgctggctggtgcgctcaagaacattgtcgccattgcttgcggctatgtcgagggacacggctggaacatgactgctaagacggccgtcatgcgccgcggcatgcaggagattattcgtttcgccaacgagttcttccccggccagatcgaacccaggaccttctgggaggaaagtgccggctggggtgacatgatcgtgagctgcacttccgcccgcaactggaggtgctccaagttggccgtggagcgcaacctgcccattgaggaggttgagaagacggagcttaacggacagaagctgcagggtatctccactacccgcgaggtcagcagcttcctccgtgccaagggcgccgaggagcgttaccccgtcttcatggctgttgaacgcatcatcgaccaggagattaaggtggaggagattcccaagcttttcaag

SEQ ID NO: 26886 - DNA, 1532 bp, Neurospora crassa
atcggaacgggtctcttcgtcggttcgggtggtatcttggccaccgtcggcccagcgccgctatggctggcctacctatccatgatgcttcttgtctggatcgtcatgaactgtatcggcgaaatgtgcacataccttcctctcagaggaatcacactgccctactttaccgaacgtttcgtcgatgctagcctggggtttgccgctggctggaattattggtgagtttcttttgggagcaagggaacgaaatgctcagtccaactgacgccatggctcctaggtatgcgtacgccatcctcgtcgccgccgaagcgtccgcaggcgccatcctcctcaactactgggaaacaccagtgcctacctgggcctggatcaccatcatccttgttgttaatctggtcttgaacatcatcgcggtcgaggtctttggtgaggccgagttctggtttgccagcatcaagttcatcaccatcatggggctcatcattgttggcctcgtcatcatgctgggaggcgggccaaaccacaagcggttagggttccactattggaacgatccgggagcgttcaaggagtacctcgcacctggtgccactggcaggtttgctgcgtattggacggcattcgtccgcgccggattcagcttcatcacctcccccgaactcatcggtctcgctgctggtgagactgtcgcaccgagacgcaacatccccaaggccgcccgccgtttcttgggtcgtctggctgtcttttatggtatcagctccttgatcgtaggctgcattgttccctcggataacaagaacctgctttccggcacctcggacgccagcgccagtccttgggttataggtattcagctcgccggtatcggcggcctgaaccatgttatcaacgctgccatcttgacctctgcttggtccgccggtaacgcgttcttgtactcaggatcccgtatcctgtattctctggcccaaaacggccaagcacccgctattttcacgagaactaccaggcgtggtgttccatataccgccgtcttgatgacctgggcattttctctgcttgcgtacctgaacgtatccaacaacggcgctcaggtgtttacctggttctccaacctttccaccatctccgggtacattggctggatcgttctgctcatcacttacctgcgattccgtcaggcgctcaaggtccagggactgttggcgacactgcccttcaaaactccgggccagccatatgcggcatggtttgccctggtcatgatcagcatcttgacactcacaaacggattccaggtgtttgtcaagtggaattacaaggatttccttgcagcgtacattaccttgcctgctttccttgttctatacttcggccataagatctggcacaggacgccgttccacaagcccgccgttgagatcgatgtattgacaggcaagaaggagatggacgatatgtgcgcgaatgacgtggacccggttccgaggaattggttggagaagatctggttttggatcgca

SEQ ID NO: 26887 - DNA, 924 bp, Neurospora crassa
cagtccatcaaggtcgccatcgtaggtgccggctccgttggtgtcaccaccgcgtacgccctcctcctcagccatctcgctgccgagatcgtcctcatcgacatcgacaagaaccgcgccctcggcgaggttatggacctttcacacgccgcccacttcgcgcacgccaaggtcagcgtgggcgagtacgaaaactgcgctggtgccacggccgtcatcatcaccgccggcgtcaaccagaagcccggacagacgcgcatggatctggtcaagaccaactacggtctgtttgagcaaatcgtaccgcagattgccaagcacgcgcccaacacgatcctgatcgtggccaccaacccctgcgacgtgctgaccaaggccgcgtacgagctcagcggattccccgtccagcgcgtcatcggctcaggcaccgccatggacaccacccgcttccgccacgagctcggcaagcactacggcgtcaacccgcgcaacgtgcacgccgtcattgtgggcgagcacggcgacagccagctgcccgtgtggtcgctcgccagcatcgccggcatgcgtctggaggactactgcaagcagaagggcatcgcttacgatgaggacgctatggatgcgctaagcaaacgcacacgcgaggcggcttatgagattatccagaggaagggaaagacgaactacggtgtggcaagcgtactggtgagcatcttggagcctatcattaccaatgccgatcagctggttaccgtgtcgagagtgggtgactatgccggcgtggagggtgtggcgttgagcatgccgtgcaagttgaacagcaagggagcgcatcaggacgtggaactgttgctgaatgagaaggagaaggaggcgttgaggaggagtgctacgagtatcaaggagtgctttgatactgtt

SEQ ID NO: 26888 - DNA, 1368 bp, Neurospora crassa
cactccgcgtccaaggaggacgtcgtttccgccgttgagctcgcccacgacacctacaaatccggcgtctggtctcgtgctccccgtcatgtccgcgcggaggtcctcgaacgagccgccagcctcttcgaaacccaccttgccgccctcattgacatcgaagtcacgcaaactggtcgagcaatccgcgagatgaacgcccaagtcccctcccttgtgaaatggttccggtactacgccgccttgctccgtaccgaagaacgctccgtacttcctaccgtcggcaaactacacaacttcctcgatcgtcgaccgctgggtgtagtcgtccaaattactcccttcaatcatcccctcctgattgctgtcaagaagcttgctccagccttggcggcaggtaactcggtgctactgaagccgagcgagttgacacccatcacatcactgatgctgggaaagatcatgaaagaggcgggtctgccggacggagtcctgagcgtactgcccgggtacggtgctactactgggaaggcacttgttgaacatccgcttgtaaagaaggtggatgttacgggcggaacagcagcgggacgggccatcggtgagatcgtagggagaaatctggccaagtatacggccgaattgggtgggaaagcgccactagtggttttccaggatgccgacttggacgcagctgtcaacggcatcgcttttggagcttttattgcgagtgggcagacgtgcgtggccgctacgaggatcatcgttcacgaatcgatctacagtgaagtgcttcagaaattgacaaccagagctacttccatcgaacggcggatgggctcaccaaaaaatcccgagtgtatgatgggtccactgatctcggagcggcagctgaagaatgtggaggagctagtggatgaggcgtgcctatatcacgagcgaatcgtacaagcaggcgggaacagactggaggggcgaagtgaactcgacgatacagacttctccaagggctactacttcccacctaccatacttgcatacaataagccaaaagataggagcatactcaacgcaaggatctggcgcgaggaggcatttggcccggttgttgtggtggtcggatttagtactgaagaggaagccattgagctcgccaatgacagtgagtttggacttggagcagcgatatggacgcgcgatctggcgcaagctttccgtgtgtctgagcagatcgacgcaggtattgtctgggtcaacactcaccatcgcaacgatcccagcagtccttggggaggagccaaaagctcaagtggtgtaggaagcgaaaacgggatcgatgcgtaccatgcatatactaagaccaagagc

SEQ ID NO: 26889 - DNA, 3420 bp, Neurospora crassa
ataaacaaaaaggtcacccctccgctccagaaattgtccaagatcacctcgtccaacccaattcacaccattgttctcgtcgctctgctcgccagctcctcctatatcggcctccttcaaaacagcctcttcaatgtcaccagaagcgtcagaaaggccgaatgggagtcgctccaggcgggcagtaggatgcttcgcgccggtgccaatacggagtggaactggcaaaatcacgaccccgaagctcccgttcctgcgaatgccaaccacctcgctcttctcaccctcgtcttccccgataccgccgagtccggtcccgttgtcgcgcagacgaacaccgttcccatccccagcaacctctcgatcacgcctctgccgtcgactgccatctcctttacctactcccaagacagcgcgctcgccttctctctcccgtacagccaagctcccgagttcttggcaaacgcccaggagatcccgaatgccgtgtcgtcgcaggagaccattgagaccgagcgcggccacgagaagaagatgtggatcatgaaggctgcccgtgtccagactcgcagcagcatcgtgaagtgggtacagaacgcctgggtcgaatttaccgatctcctccgaaacgccgagactcttgatatcatcatcatggctctgggctacatctcgatgcaccttaccttcgtttcgctgttcctctcgatgcgccgcatgggatccaacttctggcttgctaccagcgtcatcttctcgtccatcttcgcgttcctctttggtctccttgttaccaccaagctcggagttcccatgaacatggttttgctttcggagggtctgcccttcttggtcgttaccattggttttgagaagaacattgtcctgacccgcgctgttttgtcgcatgccattgaccaccgccgcccgaccgaaaagtctggcaagccttccaagcaggccgattcggcccacagcatccagtccgctattcagcttgcgatcaaggagaagggctttgacattgtcaaggactacgctattgaggccggcattctggtcttgggcgctgcttctggcgtccagggcggcctgcagcagttctgcttccttgccgcgtggatcctcttcttcgactgcatcctgctcttctccttctacactgccatcctctgcatcaagctcgaaattaaccgcatcaagcgccacgttcagatgcgcaaggctttggaggaggatggcgtcagccggcgcgttgctgagaaagttgcccaaagcaacgactggccccgcgctgatggcaaggaccagcctggaaccaccatcttcggtcgtcagctcaagagcactcacatccccaagttcaaggtcatgatggtgaccggctttgttctgatcaacgtcctcaacctctgcaccattcccttccgcagcgccaactccatctccagcatctcttcgtgggctcgtggtcttggcggtgtcgtgacgcctcctccggttgaccctttcaaggttgcgtccaacgggttggatatcattctcgaggccgcccgcgccgatggcagggagactatcgtgaccgtccttactcctattcgttacgagcttgagtatccttctatccactatgatcttcctcagaagtcggccgaagttgagggtggcgattacgccaaccttggtggctatggaggccgcatggtcggcagcattcttaagagcctggaagaccctattctgtccaagtggatcgtggtcgccctcgctctcagtgttgcgctcaacggctatctcttcaacgctgcccgctggggcatcaaggaccccaacgttccggatcaccccatcaaccccaaggagctggacgaggcacaaaagtttaacgataccgcatctgccacccttcccctgggagagtacatgaagcccaccgctccctcgagccccgttgctcctcttaccccgtccagcactgatgacgaaaatgatgctcaggccaaggagaaccgcgctgttacccttgcagcccaacgcgctactactatccgttcccagggggagctcgataagatgctcgccgagaagcgtactcacgagctcaacgatgaggaaatcgtccacctctcgctcaagggcaagatccccggttatgctctcgagaagacgctcaaggatttcactcgtgctgtcaaggttcgccgctcgatcatctctcgcaccaaggccaccaccgagttgaccaacattctcgaccgctccaagcttccttaccagaactacaactgggcccaggtccatggtgcttgctgcgagaacgtcatcggctatatgcctctccctgttggtgttgccggtccccttgttatcgatggacagagctttttcgtccctatggctaccactgagggcgttttggttgcttccaccagcagaggctgcaaggccatcaactctggcggtggtgctgttactgttctgactgctgatggtatgactcgtggcccttgcgttcagttcgagactcttgaaagagctggtgctgccaagctttggctcgattccgagaagggacagtctatcatgaagaaggctttcaattcgacatctcgcttcgctcgtctggagaccatgaagactgccatggcgggtaccaacctttacatccgcttcaagactactactggtgatgcgatgggtatgaacatgatttccaagggtgtcgagcatgcccttagcgtcatgtacaacgagggttttgaggatatgaacattgtctccctcagtggcaactactgcacggataagaaggctgctgcgatcaactggatcgacggacgcggcaagagcgttgtcgccgaggccatcattcctgccgatgtcgtcaagaatgtgctcaagaccgacgtcgatacccttgtggagcttaacgtcaacaaaaatctgattggttccgctatggctggctccatgggtggcttcaatgcccatgcggccaacattgtcgcggctatcttccttgctactggccaagatcccgcccaggtggttgaaagtgccaactgcatcacccttatgagaaagtgagtatccattcccctagataagttggagatgcatgactaacatatccatagcctgcgtggaaacctccagatctccgtctcgatgccttccattgaagtcggcacccttggcggtggcaccatcctcgagccccagtcggccatgctcgacatgctcggtgtccgcggccctcaccctaccaaccctggtgagaacgccagacgtctggctcgcattgtcgccgcagccgtcctggccggcgagttgtctctgtgcagtgctcttgccgccggccacttggttaaggcgcacatggctcacaaccgttccgcccctcccacccgcaccagcacg

SEQ ID NO: 26890 - DNA, 1732 bp, Neurospora crassa
cgcaccgtcatcggtatcacctttggcaactccaacagctccatcgcctgcactgtcgacgataaggctgaggttatcgccaacgaggatggcggtacgtgccataccctttcttttccccatgcggccgctcctaacaaactctcgtcgtacagaccgccagatccccaccatcctgtcctacgttgacggcgacgagtactacggccagcaggccaagaacttcctcgtcaggaaccccaagaacaccgtcgcctacttcaaggacttcctcggcaaggactttgcggccgtcgaccctactcacaaccacgcctctgcccaccctgaggatgccgatggcaccgttgcctttactgtccaggagaaggaggagggcgaggcttccaagctctctgtctccgaggtctctacccgctaccttcgccgcctgatcgaagccgcctccgagtaccttggcaagaaggtcacctccgccgtcatgaccgtccccaccaacttctccgacaagcagaaggaggccctcctcgctgccgccgccgccgccaacctcgaggttctccagctcatcaacgagcccgttgccgctgctctcgcctacgatgcccgcgccgagaccgaggtccaggacaagattgttgttgttgctgaccttggtggcacccgctccgatgttgccgttgtcgccagccgcagcggcatgtacaccatcctcgccaccgtccacgactacgacttccacggcactgccctcgacaaggttctcattgaccacttctccaaggagtttatcaagaagcaccaggtcgacccccgcgagaacgcccgctccctcgccaagctcaaggctgaagccgagtccactaagaaggccctcagcttgagcaccaacgccagcttcagcgtcgagtccctcgccaacggcatcgacttcaccagctccatcaaccgcctccgctacgagaccattgcccgctctgtcttcgagggcttcacccgtctcgtcgattccgccgtcaagaaggctggtctcgatgctctcgacattgacgaggtcatcctgtctggcggtacctcccacactccccgcatcgccgccaacctcggctacctcttcccccagactaccaagatcctcgccccctccaccacccccgccgccatcaacccctccgagcttaacgcccgcggtgccgctcttcaggccagcttgatccaggagtacgaggccgaggacatcgaccagtccacccacgccgccgtcaccaccgttcctcacgtcactaacgctattggtgtcatctccctcaacgaggccggtgaggaggtcttcgtccccgtcatcgcccccgagaccgccgtccccgccaggaggacaatccacgttgccgcccccaaggatggcggcgatgttctcgtcaagattgccgagggcaacacccacatcaaggtcaccaagcccgaacccaaggttaaggacgagtccaaggccgccaaggtcgaggatgctgatgaggagggtgacgactctgacttctccgatgacgaggaggaggaagaggaggagaagcgcgagaaggtatggaagatcggctctacccttgccgaggccgccgtccgcggtgtcaagaagggcggcaaggtcgaggtcaccatcctcgtcgatgctaacctctcggtcaccgtaacgacgagggaggttggtgccaagactggtgtccgtggtactttg

SEQ ID NO: 26891 - DNA, 990 bp, Neurospora crassa
gatctccgcgtcggtaacaagtaccggatcggtcgcaagatcggctctggttctttcggtgacatttacctcggcaccaacatcatctccggtgaagagattgccatcaagctggagagcgtgaaggccaaacaccctcaactagagtacgaggcccgcgtttacaagtctctcgccggtggcgttggtatcccctttgtccgctggttcggcactgagtgtgactacaacgccatggtcctcgaccttcttggccccagcttggaggatctgttcaacttctgcaaccgcaagttctctctgaagactgtcttgctgcttgctgatcagctcatctcccgcatcgagtacatccatgccaagtcgttcatccaccgcgacatcaagcctgacaacttccttatggggattggcaagcgtggcaaccaggtcaacgtgatcgattttggtcttgccaagaagtacagagatcccaagactcacttccacattccttacagagagaataagaaccttactggcactgcccgttatgcctccatcaacacgcatctcggcgtcgagcagtctcgccgtgacgacatggagtcccttggctacgtcatgctttacttttgccgcggctccctcccgtggcagggccttaaggctgccaccaagaagcagaagtacgaccgcatcatggagaagaagatgaccactcctaccgaggttctttgccgcggcttccccaacgagtttgccatctacctcaactacactcgttccctccgcttcgatgacaagcctgattacagctatctccgcaagatcttccgtgacttgttcgtccgcgaaggtttccagtatgactacgtctttgactggaccgtctacaagtaccagaagaacgcccaggctatccagcaggctgctggcaactccagccagccccagcctgcggactccaaggaggcggcccaggctgctgctcgtaaggaccctcagcag

SEQ ID NO: 26892 - DNA, 1028 bp, Neurospora crassa
ggcacctttgctcgtgtggtactcgtccgaccagccaatggcaccgaaattgaccgccaaaaggtttacgcattaaagattttgagaaagacggaaggttagtttcgcttgggctgctttcaaaccagaaaaatgccgggcgtcaggatcactaataggtggttacagtgatcagactaaaacagattgaccatgtgcgccacgagcggcagatcctccaggatgtaaccggccacccgttcatcaccagtctgcaagcctccttttccgaccacgacttcctctacctgctgctcgactacattcccggcggagagctgtttacatacctgcgcaaataccgacggttcgacgaggagatggcacgcttctacgcggctgagattgtgctcgtgctcgagtacctccacgaagagcagggtgggatagcttaccgagatatgaagcccgaaaatctgctgttggatgcggatgggcacatcaagctggtcgactttggttttgccaagcggctggggtacaatgacgttgaacgcccggtcgagacctacaccctttgtggcactccagagtatctggcgcccgaggttattcagaataaaggccacacgacagcggtggactggtgggcgttggggatcctgatatacgaattcctgacgggctatcccccgttttaccacaacaatcccctcgagatttacagacagtgagttattcccaatttgagctgctgctccagacgcaagtccaccgtcactaagacccaagtcagaatcgtagaaaagccggttttattcccctcgtcaacagaaatcagcgaagaagccaaggacatcatccggtccttctgcaccgtcgatcggaccatgcgactcggcaacatgagcggcggcgcggcaagagtgaaggcgcacccatggttcaagggcgtcgactgggaggctgtggagcaaagacggcacaagggccccatcattcctcacctaagtcaccccggcgacgcttcgtgcttcgacgtctacccg

SEQ ID NO: 26893 - DNA, 1766 bp, Neurospora crassa
caaccagatcctcccgattcagtcaccattggtgagtttatgaagaatgaagtctacggccgtcgccccatcgacaagagcaagaacccttggacatgcggtcttaccggcaagacatataccgtgaagcaggcctttgagaggacagagctccttgcaaaggccctccacaagttgatgggatgggagcccaacgccgacttgccctgggataaggtcatctgcgtcttttcttacaacaccatcgactacatttccgtccttcactcggtccatcgcttgtctggcatcgcaactcctgccaacgtcgcatataacgctagtgaactcgagcaccaacttcgctcttctggcgcaaagtgcctgttcacatgtctgcccgtcctggagaccgccctccaggccgccaaggccgtgggcatccctgaagacaggatcttcctgatggagctgcctcaccattcaaaaaagcttccctacaagaccgtcgacgacctcgttgagctcggccgctccgtacccgacctcgagccgctccaatggaccaagggtcaaggcgcgcgccaagtcgcattcctctgcttctcgagcggcacctctggtcttcccaaggccgtcatggtttcccacaggaacgtgattgccaacacgatgcaaatcagcttattcgaagattacggtcgcaagaagaagggtgtcaaaacacaagttgagctcggattgctacccttcagccatatctacggccttgtcgtggtcgctcactgtgccccatggcgcggcgacgaggtcatcgttctacccaagtttgagtttaacgagttccttcaggccattgaaagattcaagatcaactacctcccgctggtaccccccatcattgttcgtatgttgagcagcagggatactgtcaagaaattcgacttgagcagtgtccgccatgtctttacgggtgccgcccctctcggaaaggagacacaggacgagttgcgcaagctactccccaaatggaaggttggccaaggttatggcttgacggaaacggcaactgtcgttagcgcaacaagtgagcatgatattgtgcagggcacatcaggctctctggtccctggagccaaggtcaagctcgtcgaccaggatggaagggaggttacagagtacggaaagcctggtgaacttctcgtccagtcgccgtccgttactcttggatatctcaacaacgagcgtgccaccagcgaaacttatgtctttgacgaagatggaaggtggatgcgaacgggagatgaggtcatcgtgaccaagtcgccggcgggatacgaacatatcactgtcgttgaccgactgaaggagctgatcaaggtcaaggtacgtacagtaacttccaccgtactcccaaattgtggggcccaagtactgacatatgatgctttcagggacaccaagttgcgcccgccgagttagaagcccatctcctctctcaccccgccgtagatgactgcgctgtcattgctgtgcacgacgatcgcgacggagaagtgccaaaggcctttgttgtgacacccgcttccatgtcttcccgccctgacgcggagatcgcggctgagattatcaaacatgtgcaggagcacaaggcccactacaagtggctcaaaggaggtgtcgagttcattgatgcgattcccaagagcccaagtggaaagatcctgaggcgcttgttgagggataaggatagggaggctagacgggctcaaggtgctaaactctga

SEQ ID NO: 26894 - DNA, 3730 bp, Neurospora crassa
gcggtggtgacggctacggacaacgagatgccgccttctccaacatcttcggcgccgccccgccccccggccgatcgcataccatgacttcctccgtcccaccccctatgatgcacctcaacgagggccgaacccataccatgtcgtccacgtcgggagcctccatgcagagaccgccgcaacagcgccccccaccgcccggcggacccggaggaggaggcagtggatcaggggaaagaggaggctatggtgacccccgggcgcgccttgacacgaatggatacggccagagccagcgctccgtctccgccggacagcaagttccctctgctcagtacctacaacaacaacaagcggcgcgacgaccccctcctggcgcctacccccctcaacatgctccgaggggcgactctgtgagggccgattctcttaggggccctgcgccccagggtttctacaacaatgcctcgcgatctcctgcccaggcttattacaaccagccggggggcagaccggcgccggccttgaactccgacccctaccgatcacagtcgcttgcgagcgttccccggccacagatgtatcagggttcgaccccgcaacagtcgccagccaacgctttccgccaggctcaatacactgggagctcggctcggacaaccgcacaggggcgcattgtgcccgagaggcatatggaagaccgtgccatgtccatgaccggctacccctcatacgaccgcgatgcccaccaaactcctagcggaagagtcatacccaacaggagggcaccaggatccagcccagaccatggccctgccccttcgcaatacccagctcccggaagccagtcgggaagaacggtcagcatcacgtccacgacaaccgtcgacccgaatgggcgaaccatgtccatggcgtccactatcgctccttcgatagcgccgacggaacggaacgaagatgggaccttggtacatcgctactcgggcggcgcatcgtccatgacgggcgaccggcccgttaccgtcaaaatcaggatgcctctggtatacccggctcttctgtcccgcgtggccgaaacgttccggcgcaagattgttgtaggagataggaccaagaacgaactgacctacaagaacgctttcagcggtgccgaagccgtcgatgtgctgtcatacattatcaggacgacggatcgaaacttggccctgttgctgggtagagctttggacgcccaaaagttcttccacgatgttacctacgaacaccgcctgagagattcaacctacgaaatgtaccaattcagggaaacactgaccgatgacgagaagccagcggtcaatggtgtttttgtcctgctatccgaatgttactctccaacatgcacacccgatcagctctgctactctatcgcatgccctcgccgtctcgagcaaatggccaagctgaacctgaagggaggaattggcctcaagcaagaaggaaaagccgcggtcaacgatgacgatgttgaccagaccgacgagcaaaagttgtggattaacagcgtaccaaaggagattgcggacagtatcggcgacagagagaagaagaggcaagaggttattagtgagatctgctacacagaaagggactttgtcaaggatctcgagtatctgcgagatttctggatctaccctctcaagggcaagatcaacggccattctccgattcctctacaacggcgggagcgcgttgtacggacaatcttcaccaacattatcgatcctccaagcattcacggcgtcagttcaaagttcgccaagagtctcactgaacggcaacaaaagacgccagtcgttcaaaatattggagatatctttttggaatttgtccctcaattcgaaccattcatcctttacggtgcgaagcagctggaaggcaaattcgaattcgagaacgaacggtccatcaacaaggactttgcaagatttgtggacgaggttgaacgccgcagagagtcgagaaagctggagctgaacggttacctcaccaagccaaccacacgtctggcgagatatcctctacttctagaaaacgttctcaagtatacggaagaaggtaatccggacaaggaggatcttcccaaggtcctgactatgatcagagatctcttgagcagggttaacgcggagtcgggcaaggctgaaaaccgcttcaacctgcgccgtctgcacgagcagctcaagttccgccccaacgacaagatggacctcaagcttacggacgagggtcgtgagcttgtatacaaggctcagttcaagaagtcgccaacagaaaatgctgatctcacggctttcctgttcgatcacgcagttctccttgtgaagattaaacaggttggcaagactgaagaaatcaaggcataccgcagacctattcccttggagctactttctatcaaggaaatggaggaaatcattccttcaggggctgtcaaaaggtcttcatcaagcttgctgcctgctctacgcacgaccaccgacgccaagaagggtgatggatggccgatcacgttccgacatctcggaaagaacggctacgaactaacggtgtacgcgtcgaatcaggcaggacgacagaaatggctcgagtttatcgatgctgctcagcagcagctcagggcccgtgcggatttcttgaacactacgataatatcgtatggttactttgccggtcccaacaaggtcaactgcgccacgccgttcggtaagcactttaggacggcccagtcaagtatcagagctcttgtgctaacaaaaatacagatggtggaaggaagatcatctatggtacggaccagggtatctttgtctccgatcgtaagaccaaggagataccaccgaagcgtgttatcgatgtgcaaaacgtcacccaagtcgacgtgttggaagagtattcactgctgttggtgctttccaacaagtctttatactcgtaccaactggatgcgctcaaccccaacgagccgatttcatctaagcgtggcaagaagatccaaagtcactgcaacttcttcaagatcggcatctgcctcggccgacatcttgtgtgcgccgtcaagagctccgcgctgtcaactacgatcaaggtgtacgagccgaatgatgccatgtcgggcgccaagaagcaaaggggtctcagcaagatgttcaacgccggacaggacgaactccggccattcaaggagttctatatcccaacggaatcctcatcggtacacttcctcaagtccaagctttgcgttgcatgcgcccgcggcttcgaggttgtcagtctcgagaccctcgagacgcagtcccttctcgatcaggccgacacatcgctcgattttgtccagaggaaggaaggcgtcaagcccatccatatcgagcgcctcaacggcgagttcctcctcaactacagcgagttctcgttcttcgttaaccgcaacggatggcgggctcgtcccgaatggcgtctggattgggagggaacaccacaagcctttgcgctcagctatccttggatattggcgtttgagcccaactttattgagctcaggaacattgataacctggcggtacatattgtgccgcacaagaacatcaggatgctacacagcagtacacatgaagtgagccttaacctaaatgtcatatatgatggacacctcgaagctaacacaactgccagattctgttcgcatatg

SEQ ID NO: 26895 - DNA, 854 bp, Neurospora crassa
atggccgaaatcatggccgattcggaacttgcccccaagttcgcgccgttcattggcatggtacgtcaacagcagtcgcgaaaccacccatccccggtggccaacaaggtgcagctaggataggaagggacatcaccacgcaaccgtcactcgacaagaacaatgtcaaggcccactaacaatgttctctcttaccaggccggcatcgcagccgccatgatctttggcagtacgcttctcccaaatcccaacttgacgccttaccaacatcacaaacgctgaccatgtcgtttccaattgtacaggcgcgggcgctgcatatggcacagccaagtctggcatcggtatcgccggcgtgggtaccttccggccggacctcatcatgaaggttagttccccgctagcaacatggctatagtactcatatgcagagactaacatgctctcctacgaccgatagtgcttgattcccgtcgtcatgtccggtattattgccgtttacgccctcgttgtagctgtcctgattgcacaagatctcgggccgccaggatccggccaacattacagcttgttcaagtacgtttcatgaccgacgacgtctctgggtttacagactcaggttatggatgtcacatattttgtgaagggcacaactgacggtcggttctcaccacagtggcttcatgcatcttgcatgcggtctttcagtcggcctcaccggtctcgccgcgggctattgcattggtatcgtaggcgacaagggcgtccgttcgttcatgctacagtcgaggatctttgtcggcatggttctgatcctcattttcggcgaagtccttggtctttatgggtaagat

SEQ ID NO: 26896 - DNA, 4087 bp, Neurospora crassa
agacgaaatcaagaagttgacggcgggacacaacgaaaagatcaggaaccttgaacaccgtatcaatgacttgaaggctgaactcaagcaagatagggcagaattcgataaaaagaaagctctcctcgagggtgaggttgcaactctccaggggaaggtcgatgacaagtcctccaagctgagctccaaggaggccgaattcaatgagctcaaaaagctgaacgaagcccagattgccgagttgagaaaagatgtcgccgacaagtccaattccttgcaggacaagcttgaagagctcagtgacctcaaaggacagcaaaaaactaggatcgaagacttcaacgtacaaatcaacgaaaagatggcccagttgttgaaagcccagaatgagctcaaggcgtcacaggcaagcctcaacaccaccactacagagtacgacgccaagatcgcccaactagagaaaagcctcaaggaaaagaaggatgagctgaagagaaaagagggcgccgcaaccagctcgacggaacaaaacacggtccagctcaacaagctcaatgacgatgtcaaggataagcagaagaagttggatgagcaacaggctgaactcaacaatctcaagacaaagcatcaggcagaaaccacagatctcaaccagaccatcaaagacacaaaggccaaactgaaacagaaggagactgagctcatcgatctgaaaaagaagcacaaggaccggcttgatacactggaaaagactatcgctgagaaacagaccacgttggctcaaaaggaaaccgaactggaaaatctgaaggctcagaaccgaacgaacatgatgaatacaaaccgggaaattggcgataagaccgccgaacttttgaagaaagaaggcgagctcagggacctcaggcagaagtacgacgatgcccaaaaattggccgatggaagtaaggagaaggacctcgcaattgcacaatacaaacaaatcattgcgacgaagacgagcgaactagaaaaagcgaagaaggacgtcgcagctcttactaaggacgttaacgatcagaaagcccggatcaaggaccttgagagcagtgtttccagcaagagagccgacctaaagaagaaggaaactgaaatttccgatctcaaacgacagtacgaagagaatatcaaaaggctcaacaatgacctcagtagccagaaggccacgttgacagccaaagaaaatgagattgctgctctaaaatccggaaacgcatcccgtctcagtcgcgacatccaagagaaggcaagtgagctggcgcagaagaaccaactggttgcgaatctcaaggtacagctcgatggcctgcagaagaagcaaaacgacctacttcaaaaaggaagcgatgccgccaagcttcaagccgacgtcgactcgctcaacaagaagatcagcgagaagagacagaaagtcactgagcttgagggcaaggtcaacaagcttgatagcgagctcgcggaagagaaagcgagagtgtccaggcgcgacagggagattactgacctgaagaaggacgtgtccgacgagaaggccagaaccaccaagcgcgacagggagattactgacctaaagaaggacgtgtccgacgagaaggcgagagtgtccaggcgcgacagggaggttactgacctgaagaaggacgtgtccgacgagaaggccagaaccaccaagcacgataacgagatcggtgggcttcagagtaagctggatgccaagcaagcctcgaaagagatgcttgagcaagatatcaaggatctcaaggcgaagcaggagaaggaggttgccagtctgaccagtcagattcttgccaagagtaaggagattgtgggttacgagcgcgatctcagttccctcaaagcggactaccagaaagagaccaccaagctgaagaatgagatcagccagaaggagaaggaactggccgagatccagaaaaccaacaagaagcttaatgccgatatcaaggagaaggaagccacgctgacggcctcccaggcgaaggtcaaggatctcaaccgggaagtccaacagaagaaagatcagatcaaagacttcgaggctcaaaacgctaagctccagattgacattgagaacaagaaagccgagatcgaaaggatcaaagaggagaggaggacgcttaacactgaggcggacaagagcatcgcgaggattgaaggtctcgaacgcaagatcaaagagctcaccggcagctccgcagagaaagaagcccaaatgaagcaatatcaggccgacctcgctgcaaaggcggagaccgaagcccgcatcaagcagcttgagcgtgatctcgccaccaaatcgaattcgctggcggagttcgagaagaagtacaagcgggccaacatggatgccaacaactaccgcagctcgttggcgcacacccaaggcgaggttgccaagctggaagaggaaattaaaacgaccaagggcgatgtgcagtactgggaggatcagatgatcatgaatcaagaggagactcagaagatccaggaccaagtcgacaggttgaaaatggatgtcaaggacaagaacaagatcctggaggatcacgagaaggaaatccagacgcttaaggatactgccacgcggctttctcaggatctcatacacaagaagtccgagttggagggatctaactctgagcttcagcgtgtcaagaaccaagtcgctcaacttacgcaggacaataaggaccagcgggttgtggtcgacacgaaagatggcgaaattaggaagttgcagagggaggttgatgatctgaacacccatgtgatggacaagggagaccagttgatgaaaagaggcgaagacatcaagaagctccgggatgaaatcaagaacttcaaaaaggacatcagtgaccacgagactactctagaagagacgatggctgaaatcgaaaagctgtcggctgacaacaagcagctcaccgctgaaatcagtagctacaaagacaaactaaagcaatctcaaaccgaggctgatgctctcaacaatgacatcaaagacatgaaatccaccaaagagaagcttggccaggatgctaaagccaaagagaccgtcctggctgagaaaatgaaggagatccaaggcctcaaggacagcatcaataggttgaaccaggacatcagcaccaagaacgccaccctggatgacaagagggagataattgatcagctcaaggacgatatcaaaacagccaacagcaccatcgacacgttgaggaaggatgtcaaggataaggatgccatcctcgctcacaagacgaaggacgtcgttgctagagatgctgaacttgccaaactcaaggcagagattgcttccaaaaacgctgccctcgccaaaaagacggaagaagccaaggcgttcgaaaagaacgtccagacacttaccgaccaagccaaggggttgaatcaggacgtcgccaccaaaactacccagctcgcgcaagaccgagccacgatttctaaactcaacaaggacatctttgatctcaagactgatgtgacaaagctaaaacaagagctcagcaccaaggacgccaatctgacacagaaggcgggcgagattggttctcgagatgctggccttgccaaactgcgggaagagctccgtgccaaagaggctgccctggcaaagaagaccgaggaagccagcagtcttgagaagaacgtcaagaaactgaccgacgaagctacggggttgaaaaaagatgtcaccagcagagatactcaactcgcccaggacaaggacgcgatctccaagcttgaaaaggatattgcgaagctgaaccaagagctcagtaccaaggacgctagtctgacgcaaaaaacgggtgaagttggctcgaagaacgctgagcttgctaagctacgggaggagattcgtgtcaaagaaactgccttagcaaagaagaccgaagaactcaaagggttgaatcaaagtgtcgacgcaaaagacactcaacttgcccaggataagatcaagattgagaggcttgagaaggaggtcaagggtctcacagccgac

SEQ ID NO: 26897 - DNA, 3045 bp, Neurospora crassa
aacccttttacattcagccccttcacaagtcaagagggacatagggcggataatgaagccgctatcgaggagtacgaccggttgcgggacgacaatgaagggaaaacggaccccaccagaccactgaaatacaaaccatacgacgagggaacgctgcgcgatacacgattcatggtcgcccagttatctcagtacaaggaccacgccatagcagtgctagataacaaggtcgataggcacagtatgttgaggacgtacatcgaaaaagcaggagagcctgcgatccgcaaggctttcaataccctgctggagtattacgaccaggcaagcaaaacaaagatgcggctactccgggaattccgtgccctgcagatcaaggtggatgatgacaagctggccaaggaagaggtggaaacatatctcgcccaggccgaaaagaggctgcatgatcaagagaaatcagagtttgatacgtatcaacaattgatggatgagaagaagaagagatcgatggacgagcatgagctgcagaaactccgagatttcaagcaagacgcggacaggcaacgccttgcagcggtagccttggccacacacgcgtccgaggccaagatcaaaggcctggaggagagagtcgacgaactccaattcatagatcaacaaagggaggccgacatcgagcattggcggcaagtgcaaaccgatctcaaaaagaaggaggattctctatctcgcttgcaggaagaagctactcgcaaaaccgagcaggccgaccagatgtcggaatccttaaaccgaacgctgaacgatatcatggataccgcggcagcgcttggcgttcctatcaaaggcggcgccgaccctcatgacataggcgcaacaatccttgaagtcttcgataacatattgaacctgtacgaagacaccgagcaacgacttgttcaaaccgaagaagccaaggacaaggcagaagcagcggccaaggaatccgccacacgatcccgcagtgaaacaatccagaagctcacgtctgaaaacaacaagcttaaagaacagagagatgagcaaaaaagaaaggccgacgcgttttaccagaaactcaagaaaaagggatggcttgagccgaccgaggatccatcggcgtcacttgccctcgaccagaagtcgttgaaagaccaacaagatcgctgggagtctgaaaagaatgccctgaaccagaaaatcactaatctcaacaaatcgatcgaagaagccaatgtggcgctcaaggacatgaagcttatgcaggtggagagggattctctggtcgatctacaacaacgtcaggaaggggatatcaaaagcttgaaccaacaggttctggacctcaagcaaaaattggcgagcaaggccagcgccggcgccgatctgaaggatattcagtctttgcgattggagaacaagtctttggaagaccagcgacaacgtgtgcaagccgaaaaggaggtcttgcagcagcagctttctcagacgaaggcaaggctggaaaaggtggagacgaccctcaagaacacggcgtcgcaaaagatggatttggagactcaaagaaatgagtggtccaaggcaaagaaagtcctggaggaagagatcagcaggctcaagaaggaggttgacttggccaggaagaattccgctgcgccaacaatcgtcgagatcaaaccggaacccaacattgccgaaagcatcactcgcgtcgaacaactcatgaaggagcaaaaacctcaactaccgctgaccgcacgcgacttcgtccaaggactggttgccaagttgaaggacgcgcagggacacaaggacttggatgccagtgaggatgtcattcgtgaatgcatcggccttctcaatcgtgtcttgaaggagcctgtctttgatgagaaggacaaggagatgcttcagactttgcaaaatgagttgaatgaggctctgaggaagggcaaggaggaccgcgaacaaagcgcgcagttgcagagcatcattgacaaatacgaaggcgaaaaggaaagccttgagaaggaggtcaaggttcataaagacgagatcaagaagttgaagcaggagatcactgagaagaaaacctcactggcaaacaagcagcaagagagagatatgctcaaggaaagctacgaagagcaaatcaaaaatctcaatgcggaccacaaaaaggctgctgcggagctgaaagtcaaacaccaaaacgagctgacgcagctcagaaaggacggcgacttgaaagaaaccaacctcctgcagaagttagacacactcaggcagcagaatgaaagtgagaggaacaggcttcaagccgattacgccgctgagaaggcgaagctcacgaaggatattgaagctcagaagaaattggtggcgcagaaggagaaagatcttgcggagctcaagtccaagaaagagaaggagatcaaggagctcacacagaagaaagacgttgagatcgctaccctcaagtccaccaagcaagtcgacatggagcagcttaaaaaccgccacctccaagagactgagatccttcgcaaacagcaccaatctcgagtgggagagttggaaagtgaaatcgcaacgatcaaagagaagtataagaaggacctggatgaactctcccgcaacaataccagccaggacgctatcaagctaaagcagcacgaaaacgaactcgccaacttcaaagcgaagtatgaacaggaaaagaagcagctcgcggtccagcacaaaactgagatggaaagccttacagatcggtaccacgaaaaagagaagcttgcaacccaataccaggaacgtgttcaggccctgtcggcggagctcgcagacaagaagactgcgctagcagagtacaaagagcagctatcggcaagtaaagctcagcttgacaagctcaaagcggatcacggggtcaaggttgacgagttgcaagcaaaactcaaatcggaagtcgccaaggtcacagctgattatgagggcaatctttcggagctcaggaccaaacatcaa

SEQ ID NO: 26898 - DNA, 2784 bp, Neurospora crassa
gagcccttttcgtttgcgagctccgaccagctcaactatcccgtctcgattcgcatcatgagtcttgagggagaagagacgcccattccgttcagcacgctccttgagaggccagacctgcgacatgtgggctctaaccaaaggtacacccgcctgtttcttgttgtccgggaagatggctactgaatcacctctcatagtcctcactcggacctctatgtcaccgttcaggtctgggccggatccaagcctctgactgttcccgtccaaacaccctacaagtggttccggaatgagcgcaaatggtccgagtggctaaccctgcccatcgactactctactctccccgaaaatgcccgtctggccatcaccctttgggacctctctccaaccggaggcgaaggcgcccatggtcatgccattccctttggtggcaccacactgcccttgttcgacaaagacaaccaactgtacaagggccgtcaacagtgttttgtataccgacacaaacaagcagatggcaatgatgatactggaactcctgctttcatacccagaaggtccggtgtgggctccagcaagaagggaactccctcgtccattgttgacaacgatgccgaagagtacgaccgcttgatggaccttctcaagaaacacgagatgggagagataccccgtgtcgactggctcgaccaactggccttcagggtaatcgaaaagcgcggatatggttcggccaaatcctccctcaggctcaaggctattcagcgtcaacaggaagctctcgccagtgccaaccccgatgcgtccaaaccaatcccagtgccgtccgattttctgttgactgtcgagctgcccagatttgactttcccgttgtctttgcagatcacgagtatccacctccacccatctcgtcgctgcaacatctatcgtcctcacagtcgggtctcatggtgaagccgacaccagacattcagcttggaccgggaatcagccgcatagatgccgacgatgaaacctccgcaggccgcttaatccgagtttacgatccggaggtaggcgcgagggacaatccagccgagagcaagcaccgaagactagtccgcagtcagcatcgcaacggtattctggataaagacctgaaaccaaacgctaaagtcagagatgaactcaaccagatcatgtcctacccacccacccacagcctgtcgcctgaagagaaggacctcatctggaaattccgataccacttaactagatacaaaaaggctctcaccaagtttgtcaagtcagtcaactggctcgacgcgtcagaagcaaggtcggctgtggtggttctcgaaaagtggactgatattgatgtggacgatgcgctggagttgctgggcccgaccttcagcaactcggccgtaagagcctttgcagtgaaacgtttacgcaaggcagacgataatgagctgctgctgtatcttttgcagctggttcaggcgctcaagtacgagcacatattgccacagtcacgtcaagacgtatcccaggatagctccctggccagtttcttgataacgagggccgtgtcaagtctgacgctcggcaactatttctactggtatgtcatggtcgaaatcgacgacaggagctccgagcaaggacaagatgccagggaaatctacaccaaggttgcatacgatttcatggccgagcttgacaagcagccggggggccaggagaagagaagaacatacaaacgacaggccgagtggatccgtatcctttctcaagtctcaggagaagtcaaggaggccaacgagtctatcgccagaagaaccgaccgggtcaagcacttcttggccgattccaagaacgagctggtcaccctcgacccgccgctcccactcccactggacccttcagtcatgatcacgggcgcgatcccggaggagaccatcgtcttcaaatcctctctccatcccatcaaggtggccttcaaaaccacttctgggaccaagtaccccctcattttcaaaacaggcgacgacctccgccaagaccagctcgtcatccaaatcatcatgctcatggacgaccttctacaaaaggagaacctcgacctcaagctctcgccctacaagattctcgctaccagcaccagcgccggcctctcgcagtttgtcccgtccatgtccttccagggcatcctcaacaaatacggcaacaacgccgcgctcgcctacctcaagcaaaacagccccgacagcaacggcccgctgggcctgcgcaaggaaacgctcgacacctttgtcaggtcgtgcgccggctactgcgtcatcacgtacattctgggcgtcggcgaccgccacttggacaacctcctcttggcccctgacgggcacttcttccatgccgatttcgggtacatcctcggccgcgacccgaagccgtttgcccccgtgatgaagttgtcgaaagagatggtggactgcatgggcggggtcaactcggagcactatcgccagttcaagcagtactgcttcttggcgtatagtgccctccggaaaaacagcaatttgattttgaatctctttagtctgatggtggatgccaacattccggatatcaagctggagccggacaaggcagtgttcaaggtcagggacaggtttcacttggagctgagcgaggaggaggcgattaggaatttggagaagattatggaggatagtttgaatgcgctggtgccggtcatgattgatcggttgcatggagtcatgcaggctttccgg

SEQ ID NO: 26899 - DNA, 3661 bp, Neurospora crassa
atggcaggagaaagaccaagccagcagcaacgcgtaccatcgatatcttcatttccggaaaccctcccgtcccccaaccccaatgtcgaacgagaccctttggcgcccacccccgagcccgcacatccatccggcatacctcagcggaagaggagtttgattcgaccggagcgcaacaggattggcaaagaccaccccaactatcactacagaaaacatgcggccaacatgaacaccctaccgtcctcaaccggacacgacccgatatacgaggatctggagggagcaacggacgatgtatcgggaactggctcgaggaacgacgacgatgtttccgaggagtcgcccccaagaagaaagcactcgacgaaaatgcaggtcatcgaaactgaaaagtccggtgatgaaagacgacgtcggcggaaatcggataccacaaaacatggtaaaattgtcaaggcctccaagggaaagcgcgaaaagtccggaggactccctaccccgagcttttggaacatttactgcggattcgtcaccttctggtgccctggctttgtcctcaagtgcttcggcatgcccgagatggctcaacagagggcgtggagagagaagatgggtctgatcagcattattctgctcatcatgggctttgttggcttcatcactttcggcttcacccaggtggtctgcggtaaacctccgctccgtttgcgcatcaatgaggtcgggtcaggatacatgatcttccacggatctgcatatgacctcaccaaatctcaccatcctccggccgagggtatcccgcgccgtccggacggtttgggtgcaaacgtgatctatgacttgcctcagcattacggtggacaggacggcagtttcttgttccagaacgtcaacggcaagtgcaagggtctcatcaccaagcaagagaactccgatgtgccaagcgataagagcggcaatctggcgtggtacttcccttgtaacacgttcaaccaagatggttcatccaagcccaataccacgataccttattacctgggctatgcctgtcacacgaccgctaacgccagggactctttctatctcggcctcaagagctccgccgatgtctactttacgtgggatgacatcaagaacagctctcgaaaccttgttgtgtactctggccatgttctcgaccttgatctgcttcactggttcaacgacactcaagtcacgtatcccgcccgcttcaaggagctgagggataagaatactgctggaaaccaggctattcgtggacgcgatattacccatgctttccagtcgagcaaagacaagcagattgccgaatgctttgaggagatcatcaaggtcggttcggtggataccgagacagttggctgcattgcgtcaaaggtcgttctctatgtgtccctcgtccttatcctcgcggtcgtcctcgccagattcgtcttggctctaatcttccaatggttcatcagcaagacgtatgcggctgctaagacctcccaaacgtctgaccagcgaaagcgaaaccgtcagattgaagactggactgaagacatttacagagctcccccaaggctaccaggggaggtcggtagcagtgtcgctggaagctccgatcgtcaaagcaagcgcagcagtgctttcttgcccacacactctcgtttctccaccgtctacggcaatgagcgcggcaataggaagcctggacttcctacaaccatggccagccagaatgccgctggtcaactactccatcctggaaccatatacggccaaggaaatgagagtcggtcaagcttcctcaaatctgatgcttacggatcaagcagcagtccagcagacggcccaggtcctgccggatttattcatgaagctgtcgttcctcagccgccttccgactggatgccgtttggtttccccctcgctcacaccatctgccttgtcacagcctactccgagggtgagatgggcgttcgtaccactctggactcgattgcaatgacggactaccccaacagccacaaggttatcctcgttatttgcgatggtattatcaagggccacggagaggaacactcaacccccgatatcattctcggcatgatgaaagaccacacgattcaccccgatgacgttgagccattctcttatgttgcggttgcaactggttctaagcgccacaacatggccaaggtctacaccggcttctacgattatggcactaactctgccattcctctggagaagcagcagcgtgttcctatgatgatggttgtgaagtgcggcactcctgctgaagcctccaagtcgaagcctggaaaccgtggcaagcgtgacagtcagatcatccttatgtcttttctccagaaggttatgttcgacgagcgtatgacggagctagaatacgagatgttcaatggcttgtggaagatcacgggcatttctcctgacttctatgagatcgtgctcatggttgacgctgataccaaggtcttccccgacagtctcacgcatatgatctcggccatggtcaaggatcctgaaattatgggtctttgtggcgagaccaagatcgccaacaagcgagcaagctgggtttccgccatccaggtattcgagtatttcgtctctcatcatcttgccaaggctttcgagtccgtctttggcggtgtcacctgtcttcccggatgtttctgcatgtaccgcatcaaggcacccaagggtgcccagaactactgggtccctatcttggccaacccggacgttgtcgaacactactccgagaacgttgtcgatacgctgcacaagaagaacctcttgctccttggtgaggatcgttatctcagtacgctcatgttgcgcacgttccccaagcgtaaacaagtatttgtgcctcaggccgtttgcaagacgactgtccccgatgaattcatggtgttgctttcgcagcgccgcagatggatcaactcgaccattcacaatctgatggagctcgttcttgtgcgcgatctttgcggtaccttctgtttcagtatgcagttcattgtcggtatcgagctgattggtacccttgtgttgcctgccgccattgcctttactttctatgttggtgagtagccaccaaccccagttttctcttcctttcttgtttgaccaactgaaaactaatgtccgatacctagtcatcatctcaatcatcaactccccgccacaaatcattcctcttgttctccttggtctcatcctcggtctcccagccatcctcgtcgtcgtcacagctcacagctggtcctacatcatctggatgtttatctacttgctctccctgcccgtgtggaactttgttctgcctacctacgctttctggaagtttgacgatttctcatggggcgacacgcgcaagacggccggcgagaaatcaagcaagggtggccacggagaagccgagggagagtttgatagcagcatgattaccatgaagcgctgggccgagtttgagcgcgacaggcgcgtccgcagcacgtactgggccggctcgagggacaatgtcatatccggggtagggggtagtaatgggtggggaagcagccagccgagaggccatgagcaggggagacactttgatgactacttttcggacgcttag

SEQ ID NO: 26900 - DNA, 1150 bp, Neurospora crassa
aatgcttctctcctcagcgcccagaaaacgttggagatgtacaggcagaatgtcaagaaaaccacggacttctctactcagtattcctttgccgtttttctgatcaacacagcaaaggagcagggcctgaactttgacgaactcaggaattctaaaaatcttaaacctgggcgatcttcagaaactctatccgcagaagccaaccaatcttcgccatacgaactagtgcgggaagcgcgggccatcctacagaaattgtccaacaacggcttcccttttgcacagtattatctcgctgacggctatgcctccggtttgttcaacaagggaaaggaggactacaactcggcgttccctctgttcgtgttagctgccaagcatggccacgcagagtccgcttatcgcactgctttatgctacgagtttggctggggctgtcgcaaagaccctgccaaggccgtgcagttcttgcgaacagcagcctccaagcggcaccctggcgccatgacaaggctgggaaaggcctgtctgtcgggtgatttgggcgagaagagatacagggagggtgtcaagtggctgaagctcgccaccgagtccgctgatgcgatttataatgccgctccatatcagcttggatgcctgtacgagacaggctatggtgacgacatcttcaaggacgagagttatgcggctgagctgttcacccaagccgccgatctgggccatcccgaagccaattataggatgggcgatgcctacgagcacgggaagctcaactgcccaagagaccctgctcttagcgtccacttctacacgggcgctgcggagcgtggccatcctgctgccatgatgggtctctgcgcttggtacctggttggagcagatcccatcctagaaaaggacgaagaggaggcatatgaatgggccaagaggtccgcagagcttggtaagtaaacttcaaccacactgaacatgatgtcgcgggaagaataaatctaatccggacttgacagggtatgtaaaagcacaatatgctgttggctacttcacggaaatgggcataggatgccgaagggatattttggaagccaacctctggtacgtcaaggcggccgaggcaggcgatgagcgcgccaagcagcggttggca

SEQ ID NO: 26901 - DNA, 1032 bp, Neurospora crassa
cttcctgcagagggccgcctgttgcaagcctgcttgaacctcctcgagggtgccgacatccagtttagacgcgagaaccgcctcgacattgcgctcgtcaagaatcttcctatcgccctcgtcttccttcccgccgccgatatccccaccttcgtcggcgagggccgtgtcgacctcggcatcactggctatgaccaagttcaggagcacgatgccggcgtccgcaccgttgcccgcgcccgccgtcaaagcggcgagtggagcgcccaggatggcgagaaggccaagccccagggttgcgataccgtcatggagctgggcttcggcgcctgcaagctccaggtccaggttcccgttaagggcgagtacgctactggcaaggacttgatcggcaagaacattggcaccagctttgttcaccttgcgcaagaatactttgcccgtctcgagctggagcaggagggccttgtggatgcggacgcctcccagctcgccggccgtaagctcaagactcagatcattgagctcagcggcagtgtcgaggctgcctgcgctctcggcgtcgccgacggtatcgtcgatcttgttggtgagtaatctagccagcattgcccgcggctctccccaaccctgacgcagtaactaacatatttcgccccgacagagtccggagagaccatgaaggccgccggcctcatggccatcgacaccgtcgttgagtcctccgccatcctcatcaagtccaaggcccccagcaacccggagatggtcgatctgattgcggcacgtattggcggcgttattaccgcccagaaatacgtgctctgccagtacaacgtcgagcgcacccgtctggccgacgccactaagatcactcccggcaagcgcgcccccaccatcacctcactcgagaccgagggctgggttgccgtcagcgccatggtagagaagaagcgtatcgccactgttatggacgacctgaccaccgtcggtgccaccgatattattgtgctcgatattcacaacacccgt

SEQ ID NO: 26902 - DNA, 2370 bp, Neurospora crassa
ttctccagtaaagacttcattgtacgcgactttgtcgattccctcgccgacactgcctttccggcgaaccgccgctccaaccccacgagtgcgagcaccccctttgaccccaagcccctcatccggaccttcgagaatgcgctgtcacagttgggcactctgagcgaggagttgcaagagaaggaatcagagctcttatcacaggttcggcgagcagagattcaacatgaccagactctcgatacccttggtcggaagctagaccagtcaatggcccagttcgaggccctcgacttgaccctgaataactccagcacaaatagcggctccatgaacggacacggccggcctgatggtggaggaaacattgccgttcagattggagagaagctggaggagctggataggaaacggaggaaggcgcaggacgctaacttcctgattcagtgctggacagaggtttccgagacaggccaactcacctcgctcgaggagattcagagacagggcggtgccgagaacaaggttcgctgcgccgtcattgctcgccagcttatgcgcatcagtcagagactagaccctttttcgtgggtaacaggtggcctccgtgccaatggcatcgccaacggcgctacgcggaagcacaacactagggaggctctcgaaaagttctgcgagcatcttgagcaagaccttctgaagcagtttaacaacagttaccgccggcaaaatttcgacgacatgatggagtgcgcaaaggtcctctacgatttccacggcggtgccagcgtcatcgccgccttcgtgaaccagcaccagttctttatcgaccgagaccagctcatcaccgacgaggttacgacagatggcgagatgtgggagcaactggctgatcccgattccgacccaccaggtgtcgagcccagtctgcaatctcttgttgacgaggtcaagatcgtgatgcaggaggaatcttttatcattaagcgtgccttcccatattacgaaacagtcctcatcaagtttatacagcgtgttttccagcagtctattcaacaacggctagagatgctactggacaaggccacgacaatttcatcgctcgcctatttacgctccttgcatgcgtcgagatcctacattggtgccctggtggaagacctcaaaacccacggtcttacagagcacccggaaccatgctctgcacaaatatcacagactcttgatcagcaactagaggaattattcgtcccctatctacttcaaaactcatacatcgacagggaaaggaagagtctggaggaactgtacaattcgttgctcttcaagttcaccttgtatcactcacgcagaaagaaggctccctcgggcttcatggccgctattgcccaacagggcactcagcttttggcaaccgctaaagatgcctatatggagcgactcgattcgtcagaccttacgcccactcagaagcgcatgatgttgaaggttgccggtctgcaagacaatagcagcaacaagaacgagatcgaagtgtcggaggaacacggccgcctgagcgtacagaacgccaagcgcatgattgtctggttggccgaaagcgtgcgcagaacgctcgagatgggttcgggaagcgaaacccccaaagacatcaacatcttgctcaaccttctccttaccagcatgggccaagtctacgttgagactgccctcgatgccgccttggacactgccacgtcgcaggagaacatcaagacagaacctgacctctcgtaccttcctcacatcaaaccggctgtcaccatcacgaacctcatgtcgcggttcatcacaactgtgctgatccggcttgccgagtccaacacagccctgcgccgcagcatggaggcccaagccaagcaagccatcgaggccacggagcggaagaccaacgccgtcctcaagagtaccatggatgtagcggtcaactgggtcgctaagatcctggcgggccagaagaagacggactaccggccccgcgacaacgaccttgaaggcttcgttgacctgcagacgcccacctgtcaggctatctgcacgttcttggcctccaaggtggcggcgcaggccgcgctggctatcgacggccacaaccttgagctattcagctccgaactcgctctggccgtccactcgctcttgtttgagcacttcaagaagttctcagtcaacgccaccggtggcttgatggtgactaaggatatcgccaagtacgtgacgacaatgaaggagtggccgttgaccaaggaggtgcaggcgattgtcgagctccttaccgaggtcggatacctcttcatcattggacccgaggcccttcgcgaacgttccaag

SEQ ID NO: 26903 - DNA, 735 bp, Neurospora crassa
atgacaataggctaacttgtttacccacaacagccctcctcctggctccgcgccgcaaccgacgaccgcgccaacccttcgtgccccatcaagatcgcccacggcacgaccacactcgccttccggttccagggcggtatcattgtggcgacggactctcgcgcaaccgccggcaactggatcgcctcgcaaacagtcaagaaggtgatcgagatcaacagcgacttgttgggcaccatggcgggcggcgccgccgactgccagtactggctggcgtggctgggcatgcagtgccgacttcacgaattgcggcacaagcgccgcatcagcgtcgcggcggcctccaagatcctggccaacctggtgtaccagtacaagggcatgggcctgtccatgggcaccatgtgcgccggcgtcaccaaggaggaaggacctgcgctttactacatcgattcggacggcacccggctggcgggtaacctgttctgcgttgggtctggtcagacttttgcctatggcgtcctggatgccgagtatagatacgacctgacggtggaggaggcgctcgaactgggcagcaggagcattttggccgctacacatcgtgatgcttactctggtggcttcatcaacttgtaccacgtcaaggagtcgggatgggagaagcacggcttcaacgacacaaaccccatcttctggaggaccaagctggagaagggcgagtttagcaacgtc

SEQ ID NO: 26904 - DNA, 693 bp, Neurospora crassa
ttcatccccctcgaagccaaccccgaactcatgaccagcctcctccataagctcggtctctcgacctccctccaggttcacgacgtctactctctcaccgacccagacatgctcgccttcatcccgcgccctgccttggccctgctgatggtcttccccgtctcggccgcctacgaatcggctcgcctcgctgaggactctctcctcgaagactactcaggcaagggtcccctagagcctgttctctggtttcgccagacaatccgcaacgcctgcggtctgatgggtctgcttcatgcggccatcaacgggccggcccgccagcttgtggaagagggctcgactttggacaaaatcatcaaggatgcgacaccgctggatcccgttgcgagggcaagagtgctggaaacgaactctgagctggctaatgcccacaagagcgcggcgacccagggcgataccgaagcaccggccgctacagacgaggtcgatctgcactatgtctgcttcgtcaagaccgaggatggaggcttgtgggagctagacggacgcagaaagggaccgctgaagaggggtgaacttggcaaggacgatgatgtcctgagccaagcggcgttgacgcttggaccgctcaagttcctagagagagggggcggcgatttgaggttcagctgtgtggcacttgccagcagc

SEQ ID NO: 26905 - DNA, 1256 bp, Neurospora crassa
ttcaatctcgagacctgcgccaggccaaacatcctcgccttggaaccctatcgctgcgcgcgcgagtgagctcacccccaaaacttctctgtctatgacctctcatgaagtacatcgactaacacacgtatttcagtgactacaaggacgatggcaccaacatcctcctagacgccaatgagaacgcctatgggcctcccgttccccagaacctggctaccggctccggctccagtggtcccgagcttgacctcctcggcctgcaccgctaccccgaccctcaccagcgggacctcaagcagctcctctgctcgctgcgcacgacccacgcgcacacctccaagcttctgacgcccgagaacctctgcgtaggcgtcggctctgacgaggccatcgacgctctcttgcggtgcttctgcgttcccggccgcgaccgcatcctcgtctgcccgcccacctacggcatgtactccgtttccgctcaggtgaacgacgtcggactcgtcaaagtcccgctgctccccgctccctccttcgccatcgacgtcccgcgcgtcctcgagacgctgtcgaccgaacccaacatcaagatcatctacctctgctcgccgggtaaccccacgggatcccttctcgccaaggaagacatccaaaaggttctcgaacacccgacctggaacggcgtcgtggtcgtcgacgaggcctacattgactttgcgcctgagtcggcctcgctggccgagtgggtcaacgagtggcccaacctggtcgtcatgcagactttgtccaaggcgttcggcctggccggcatccgtctgggagcggcctttacaagtccccctatcgccaggctgctgaacagcctcaaggctccctacaacatttcttcgccgaccagcgcgctggccagctacgcgctgggaccggacggactaaaggtgatgcgtgcgaacaaggagaggctgattaagcagcgggagaggctggtggcggagctgccgcagattccgggcgtgggcaagttggcgggcggtgagagcagcaactttttgttgtacgagatgctggacaaggagggaaagccgagcaacgagacggcgctgaaggtgtatcagaagttggccgagacgaagggagtggtggtccggttcagaggcaaggagcacgggtgcgaggggtgcttgaggattacggtgggtacggaagaggaggttacgaggtgcctgggagcgttgagggaggcgttgaaggaggtt

SEQ ID NO: 26906 - DNA, 1662 bp, Neurospora crassa
ctagtctttggctatgatacgggttggatcaacggcgtgctaggcatgccttactttatcaccctttacacgggttactcgtacgactacgacaggaaacagcccatcggtatcgaccccgtcaactttggcttaccctcgtcaaccaaatctctcatgacctcgattctctcctgcggcaccttcttcggcgccctcatcgccggtgacattgccgacttcatcggccgtcggctgaccatcatcatcggctgtctcatcttctgcgtcggctgcgttctccagattgcctcgactaatcagacggttctcttcgtgtttggtcgactcattgcgggcttgggcgttggcttcatctcaaccgtcattatattgtacatgtccgagatcgcccccagaaaggttcgtggcgcgctggtgtcggcgtaccagttctgcatcaccgtgggaattctgctcgccaactgcgttgtgtattccacgcaggatagaaacgatacgggctcgtataggattccgattggtgtgcagtttttgtgggcattgattttgggaaccgggttgttcattttgcgtaagttgcgcggtgctttggaagttttgtctggaagctcgatatactgacactctttccccttcttttttttttccaattagccgagtcaccacgttaccatgttatgaagggtcagcttcaatcagccgccaaatctctggcttatgttcgtggacagccgattgagtccgagtacatcaaggacgagctggctgagattgtggcgaaccatgagtatgagatgcaggtcgttccgcaaacgtcgtatatcggatcgtgggtcgcttgtttccacggctcgctgcgcaagggtaacagcaatattcgtcgtatcattctgggttgtggattgcaaatgtggcagcaactcactggtaagttttctttcggtttctctataaaccattctctctggcctccagggatcatgggggatgaataatttctagatgtcatgttgacacaaactaacccttcgtttcttcccaggaatcaacttcatcttctatttcggcaccaccttcttccaacaactcggcaccatctccaaccccttcttcatctccctcatcaccaccctcgtcaacgtgctctccacccccatctctttcgtcgccgtcgagtacctcggccgccgcttcctgctcatctacggtgccatgggcatgataatcatgcaatacatcgtcgccatagtcggcgtcacggccgggcgcatcgacgccaacgaccccgccgccgtccgcggcatgatcgcctgcatctgcatcaacattttcttcttcgccaccacatggggccccacagggtgggttgtcatcggcgagtgtttccctttaccgatccgctcgcgcggcgtgggcatttctacggcctgtaactggttctggaactgcatcatcgccgtcgtggctccctacatggtcggtaactcaaagggttcagcaaacctgggtcccaggatcttcttcatctggggaagcctgtgtatcttttccatgctgtttgcgtatttcttggtccccgaaatgaagggactcacgctggagcagatcgataagatgatggaggaggtcagtccgaggaagagtaagaagtggatgccc

SEQ ID NO: 26907 - DNA, 2541 bp, Neurospora crassa
gagggtcgttttgaagccgaggtaccgctcgaaggagagtctttgctggaccatatcgatgagttgaacgagttcgatgaaactgaggaggacccggccgacaactctccctacgcacaagtacgggcttcagttgcgcccactgacaatacgacactttccatcaacactccacgaatgtggaccttggccgtgctattttctattatcggatcttccaccaacttgttcttctcgttgagataccccagtgttgccatcacgcctgtcatcgcactcctatcaacccatccccttggtctcatgtgggacttcttcctcaaacgagcggacgaccccccagaagagtatgttgatggatgtcggacagatagtgccaatatcccggttgaccacccgaccgatgagcaaccacgtgtttttgttccctgggaaaaaagaagcaagctcgaccagctgcgactatggctcgctcagggtcgctggaacgagaaggaacatagttgcgtctatgtcagcagcaatgtctccttcggctttgcctttgcgacggatgttatcgttgagcaaacccagttttacaagcaggatgccccgatactctaccagattctcctcaccctctctactcaaattatgggctacaccttcgccgggctcacacggggattccttgtccggccaagcggcatgatatggcccggtacgctcatgtcggccgccatgtttactaccattcacaagcaggagaaccacgtggcgaatgggtggaagatgactagatggaagttcttcatggtcgtgttcctcgctggctttctcttctactttgtacccggccttttgttccccgcattgagctatttcaacgtcatcacctggtttgctcccaagaatgttgttgttgccaatctctttggtgtcgtgtctggcttgggattatttcccatgacatttgactgggcccagattgcctatatcggatcgcctcttctaacaccattttgggcagccatgaacgtggttggcggtcttgtcgtggtcatgtggattattgcccctatcgcatactacagcaactggctttactcctcatatatgccgatattatcagcagccgttttcgacaacacaggccaggtatatgatgtcagcaggatccttacggaggattttgttttcgatcgcgaagcctattcgaagtatagcagagtcttcctccccatcacctatgtcctcggctatgccgttcaatttgccggcctggcctctctacttacacataccatatgttggcacggcagagacatttgggctcagtggaagcaaaccctgggcgagatgcatggtgccgagcccaagggctcgtatgagccggttgcagtgtcgaccgaggggctcagtcggacttggagtcggttgagctcaagatcaagctttactaggtctaattcgagcacggagaatattatgaatagggaagacgtacataaccggctgatgaggaggtacaaggatgcacccatgtcgtggtatctcatcacttgcatattaatgctggctatcggtatctttgtcgttgaatagtaggtcgggattccccgcgcacatggtacatatcgatctaaccctgtccatagctacccagttcacctgccttggtacggcttgctcctcgctctcggaatctgcagcatcctcttcatccctatcggcatcatcatggcagtcaccaaccagcacagcagcatttacctgatctgccagctcgttgctggcgccgtctttcccggccgacccgtcgcgaacatggtctttgtgacttacggatacatctcctcggcgcagggcatcaagttcgctgccgatctcaaactaggccactacatgaagataccaccccggatcctcttctcagttcagatggtagcgaccatcgtctcctcgctcacgcagatcggcgtcctcaactggatgttcaagaacgtccccggcctttgcactccagaggccctcaacgggttcacgtgccccattgcccgtgtgcacttcaatgggtcaattctatggggcgtcgttggccctagcgagttcttcggccccggggcaacctaccgaccgctcgtttgggcgttcgcagtcggagccgtcctacccattccgctgtggctgtacgcacgcaagaggaaggatagtattgtgcggaaactcaaccttcccgttctctttgggtcgttgggctggatcccgccagcaacaggcttgaacttttccgtgtgggctctcgtttgctacgtgttcaactacgtgataaagaaccgggcgcgagcgtggtgggccaagtacacaatgacgctcagcgccgcgctggattcgggcctggcgtttggtattgtggtggtgtttttcgggttcatctatcccggggtggtcaaagggtttagttggtgggggacggaagtgtataaacaaggatgtgattggcaggcttgtgcgtatcaggcggtgccggaggggggaaggtttgggcctgatgtttgg

SEQ ID NO: 26908 - DNA, 1449 bp, Neurospora crassa
tgcgacagcccagagcttggttaccaatgtaactcagagacaacccacacatggggtcaatactcgcccttcttctccgtcccgtcggaaatctccccctccgttcccgagggttgccgcctcacctttgcccaagttctttctcgccacggcgctcgcttcccaactcccggaaaagccgccgccatctccgccgttctcaccaagatcaaaacctccgccacctggtacgcccccgacttcgagttcatcaaagactacaactatgtcctcggcgtcgaccacctcactgcctttggcgagcaagagatggtcaactcgggcatcaaattctaccaacgctacgcttccctcatccgggactacactgacccagaatccctcccctttatccgtgcctcggggcaggagcgcgtcattgcctcagctgagaacttcaccactgggttctactctgccctccttgccgacaagaacccacccccttcctccctcccgcttccccgccaggagatggtcatcatctccgaatcgcccacggccaacaacaccatgcaccacggtctctgccgcgcctttgaggactccaccaccggcgatgcggcccaggcgacctttatagctgccaacttcccgcccatcaccgcgcggttgaatgcgcagggtttcaaaggcgtcactctttccgacacggacgtgctctcgctcatggatctctgcccctttgacaccgtcgcttacccgccctcctcctctctcaccacctcgtcctctccctcggggggaagcaagctctcccccttttgctccctttttaccgctcaagactttaccgtgtacgactacctccagtccctcggcaagttctacggctacggcccgggtaattctctggctgccacgcagggggtggggtacgtgaacgagcttttggctcgcctcacggtttccccggtggtggataacacgaccaccaattccacgctggacgggaacgaggacacgtttccgctgagtaggaacaggacggtgtttgcggatttcagtcatgataatgatatgatggggatcttgactgctttgagaatctttgagggggtggatgcggagaagatgatggataatacgaccataccgagagagtacggggagactggcgatgatccggcaaatttgaaagagagggagggcttgttcaaggttggttgggtggtgccatttgcggcgagggtgtattttgaaaagatgatttgtgatggggatgggagtggagagatggttcagagcgaggaggaacaggacaaggagttggtgaggatcttggttaacgatagagtggttaaactaaatggatgtgaggccgatgagttggggaggtgtaagttggataaatttgtagagagtatggagtttgctaggaggggtggagattgggacaagtgttttgct

SEQ ID NO: 26909 - DNA, 1246 bp, Neurospora crassa
aaaatcgaagcgcaggaaatcgagacgtactggaacatcttctcggcgcgaacaaatggcggcaagttcctgacgggcgagcaggcggcgccggtgctgaagaacagtggcctgcgcgatgaccagctggagcgtgtttgggatctggccgatgtggacaatgacggaaaccttgatttcgaggaattttgtgttgcgatgagggtcatctttgaccttttgaacggggttcgtctacctccttctgtcctgaagctgcgagcgagcgagcgagcaagcaagcaagcatgggagcagtaatagcagcagtatcagagaactaacagggggagacggtaacaggaatacgctgatgtcccgacaactctcccagactggcttgtccccgaatctaaagcccaccttgtgcaagcgaaccgcgcgctaaccggcaaggcgccgaaattcgagcaagtcgaagatgaagacgatacccccggcttgaaggatgggtttgactggtacatgagcccggcggataagtccaagtacgagcaaatctatcaagagaaccgagatatgcgcggcgaggtttcctgtatgtttacatcccttcctttcccttcccttccggtccctaacctcatactaatctacctacctacccgcagtcgccgccctccaagacctctacgactccctctccgttcccgacaccgacatccgctcggcctggaacctggtcaacccgtcggcctcctcgaccatcaacaaagatgcctgcctcgccttcctgcacatcctcaactaccgccacgaaggtttccgcatcccgcgcaccgttcccgcttctctgcgggcctcgttcgagcgcaacaagatcacatacaacgtcaacgacccgtcgcagtcgcgctgggcccaaaaggccgacgatgagacctctaccggccgcaaggccaagttcggcgatcagtacctgacgcgcctaggccgttcctcgttcaagacggccggcaccgacttctcgtccgagcagacggacgatcagtgggaggaagtcaggctgaagaagcagctggcggagctggacgagaagatggccaaggttgaggaggcggcgaaccgtcgtaggggcgggaaaagggatacaaagccggcactggtcaagagggagctggaacagctgttggattataagcgcaaggaattgagggacttggaggagggtaaggggaaggcggcggctggtgggagcctgaagagc

SEQ ID NO: 26910 - DNA, 4964 bp, Neurospora crassa
agcgaggatgaggacggatcctttggtagcgacaaggacgacggcatgctcgacaacacccctcccaatgccaaaaagcagaagaaggcgccggtcaagaaagccgccggcaagcctctggccgaaatcgagaacgatagtatgcagatcgatagtgtcgctcccgccaaaaagacgggcgctgcaaagacggccaccgaaatgtaccaaaaacttactcagctcgaacatatcctcaagcgtcccgacacctacattggctccgtcgagcgctccgagcaaaagatgtgggttttcaacaaggctaccggtctcatggaaaaccgccaaatctccttcgttcccggtctctacaagattttcgacgagattctcgtcaacgccgccgataacagccagagagatagctccatgaccttcctcaaagtgacaataaatcgcgagtctggcgaaatctcggtcgagaataacggcaagggcattcccgtagagattcacggcaccgaaaaatgctacgtccccgagctcatcttcggtcatctcctggctggttccaacttcgatgacaacgaaaagaagacggtcggcggtcgcaacggttacggtgccaagctcacaaacatcttcagccgagaattcacgcttgagtgccaggattccgtcaacggcaagagatacaagcagacatggaccgacaacatgagcaagatgtcaccacccaaaatcacctccaacaaggctgctgattttgtacgcatcactttccgccccgacttcagcaagttcggcatggctgacgggatcgacgatgacctggaagccttgctctaccgacgtgtttacgacatggcaggtactgttagtggtgtcaaggtttggcttaatggtgaacacctcaagttgaacttcaagacatactgcgggctgtacgccaaggccattgccaaggagcgtgacgaggtagctgacggcgaagatgtcactcctgccacagtcatctttgagcagcaaaggtccgagggtaaactatgggaagtgggctttacggtttcggatggctcattccagcaagtctcgttcgtcaacaatattgccaccacctctggcggctcccacgtcaattacattgccgatcagatcatcgaagtcctcatgaaggagctgcaaaagaagaagggcaagggacacggtctcaagacggcaaacgtcaagaaccagttcttcatcttcatcaactgcctgattgacaacccagccttcagctcgcagacaaaggagcagttgacgaccaagcccgccaaattcggcagcaagtgccagcttggtgacctgttcctcaagaaagtgcgacaatcggaggccattgacaacttgttgagctttgccgacaagaagcgagacaaggatttggctaagaacgatggcagcaagcgaaagcgtatcagcaacgacaagctgatcgaggccaattatgctggtggaagatattcgcaagagtgtacccttattctcaccgaaggtgattccgccagaggtcttgctgtcgctggtcgtgctatcttggatcctaaccgtatcggtgtctttcccttgcgtggtaagatgctgaacgtccgtgacgccagcgctgatcaaatcttgaagaacaaggaagtcgaaaacatcaagaagttccttggcctcaaacacggaaaggtctacaccgatacgaaggatttgcgatacggccatctgatgatcatggctgatcaggatcttgacggtagtcatatcaagggtcttctcatcaactttttcgagtgccagtttccatcactcctgcgcattcctaatttcttccaggagttcatcacgcccgttgtcaaggtgtggcaaggtcctaacccgaagaagcctcaaaggctacagggtttcttcactctgcctcagtacgaggagtggaaggaagcacacaggaacgaattgcgcagatggaagtacaagtatctcaagggtttgggtagttcgacaacagacgacgcccagctctacttcaccaacttgaacaagcatctcaaagagttcgatgtcatgactagagaggaatccgagatgttcgagttggccttctccaagaagaaggccgacgctcgtaaagagtggcttgccaagtgcgagccgggcacctacctcgaccattcgaccgagaagatctcctacactgatttcgttaatcgcgaactcattctcttcagtatggcagacaacattcgatcgatcccgtccatggtggatggtctgaagcccggtcaacgcaaggttctgttcggctgtttcaagcaaaacctcattcacgatcaaaaggttgtcgagttggccggttatgtgtccaaggaggcagcctaccaccacggtgaacagtctctgcagcaaacgattattggtctggcgcagaactttgtcggttcaaacaacatcaactgtctcgagcctagcggtaacttcggttcgcgtctttccggtggttccgatgctgccagcgctcgttacatccacacgagactgtctcccttggcgcgaaagatctttcaccctctcgatgagcccaatcttgaattccagttcgacgatggcaaactgattgagcccaaggtctatgctcccattattcccatggttttggttaacggtgcagatggtatcggtaccggttggagcacttccattcccaactaccaccctcttgacattgtcgagaacttgaagcgtcgcatgggcagggactcatctggtgacggggaggagaagcccttcgaacccatgactccgtggttccgtggttggaagggcactcctgagccagacggacccaacagattcaagttcaacggtatcgtggaggtcaaccctcagaaccccaatgaggttgatgttacggagttgcccattcgcatgtggaccgatgatttcaagtccaagctggaagagattatccgtggtgataagagtccttcatggatcaaggactacaaagagtacaacgaccaccaaactgtccacttcatcatcgcccttgaggagaagcacatgtcctcggctcttcgggacggtctcattgaaaagttcaagcttaccaagacagtggccacaacaaatctagtggccttcgacacccgtggtaaaatccacaagtatgagaacccgcaagaaatcatggaggaatactaccactaccgactcaacctgtacggtgagcgcaagaagcactggctcaaggtttaccatgcagactaccgcaagctgcagaatcaataccgatttatttcggaaatcattgagaacaagctcgtcgtttccaaaaagaagaagtcggtccttgtccaggaacttcgtgaacgcaagtacgaggccttccctccgaaatcagatggaaggaatgtgaagtctcctgatgaggagctcggtgctgcggacaacgaggacgaggaggatgccgttggcggagcccgcgattatgactatctcctttcggtttgtgatatcgagcctactgattatgttgccggaaagactaacatgatgatagatgcccatttggtcgttgacctttgagcgcctcgacaagctcaagcagcagattgctgcaaagaaggctgagcacgatgaactcgatgcactcagcgaaaaggatctgtggtgcagagatctcgatgctttcaccgctgagtgggaagagcagttgaggctggaagatgaagtccggaaagagatcaggcagaagggacgccgtgtctcgtacaagggcggtgctgtctccagactcaagaagtccagaggtgccaaggatgacgaggacttcgacccgggtgccaagaaggccaaagccaaggcagctcccaaggctgagacaatcaagacacagcagcgttttctagagaagttctctgggatggcgaaacccaagcctaagtcgaccgctttcaccgacggagctgatgacctctcagacgatgacttcgacttgttgaacaagaaggccccggctgcagccaaaaagaaggatgaggatgcggagcccgttactaccatcgccagtgtgcgcgccaagcgtgccaccgtagcgaagcctaagacttatgcgctcagtgatgaagattcggacgatgagttcttggacatcgcaaaggttaccacaacttctgagaaaacgaccacgtcggcttcagcttcggtttcagcggcagaacaatctgagcaacctgtagcaaagcccgcgaggcgtgctgcaggagccaagaagcctatcgttgatgaggattctgaatccgatttggatgacttcattgacgacgagtccgaggaagaggtgattcctaagcccaccaccaagcgagccaccgctgccaagaagccggccctcgaagatgaagactccgatgtcgagttccaggacgctcctgaagagcctatcccgcccacccccaagccggaggccaagaaggctacggccaagaagccaattgtagttgaagactctgacgaagacatgatgctcagcgaagcagagaagcctgcgcacgcagctaagccccccactaagcgcgctgctgctgtcaagaaatcacctgttctcgaagatgatgacttcgagagcgacgctgatgacaagattttgagcgaggcagaaaaacctgcgccggctaaggccaccgccaagcgtgcggctgctgccaagaagtcacctgttcttgaggacgatgatcttgagagcgacggtgatgacaagatggtaagcgaggctgagaaacccgctccggccaatcccaggaagcgcgcggcggccgctaaggccaagtccttcttcatagacgaagaagactccgaaagcgaagcttctgatgacgacgacatgcttcttgacgtcggctccctagtcaagggtataggagcccctgccgcgacgagcgagggcccgaggctcagcc

SEQ ID NO: 26911 - DNA, 3504 bp, Neurospora crassa
gacgacttggagagcctcgagcttctgtcgctcgtgtccaaggtcacgtccgagttgcagaaccacttgggcgtcagcgaaaagacgctcgccgagttcatcatcgcccaacgagtagaatgcgggtcattcgacgagttcaagcagaagttggccaccatcggcgccgacttcccgcccagcttggttgagagtatcgacagacttgtcctgaccttgcacccaaagttcaagggccaaaaccatggacagacccgcgccgatgaaaacgagaagcatggtcaatctgccgaggaaaagacaaaggtgttcaagggtctgtccatcccggacaaggaagtggatgtcatcgacgacaccctggccttactcgaaagcctcgagcctaagagagcggagaaagaacgaccaaggaaacgaagccgcacccccgaacgagacgactatgcagacgactacgggaagaggaagcgcaaggagcgataccggtcaaggtcgaggtcaaggtccaggtcaatttcgccaccaagaggccgacggaagggccgatatgatgatgaatacgatggtgatttccgacggccaccaccgcgcgaggtggacgactcccctattttatacaaggtttacgaaggccacgtcacgggaatcaaggactttggtgcctttgtcaacctgcatggcgttaagggcaaggttgacggcttagtacatgtatccgctttcggtcagcgtgtcaatcacccttcggatctcttatccaagggtcaggaagtcaaagtcaaagtcattaagctcgagggaggtagagtaggtttgtcgatgaaggacgtagaccaagagacgggcatggacctcgcaccgcaattgcggataggttcgggcgccaatatggaggcattgggcgggagaggaggatacgatacaaagaatgttgtcaccaacggctttggtgacaagggagcattccaagcgacagcaaatgccaggcaacacaagaagaggatgacgtctcctgaaagatgggagattcgtcaaatgattgcggcaggcattgcaaaggcatccgattacccagaacttgaagaggactaccaggcaacactcaaaggcgagggacagatggagcttgaggaggatgttgatatcgaggttcgagacgaggaacctcccttcctggctggacagaccaaacagtcactcgagctgtcacccatccgcgttgttaaagctcccgacgggtcccttaaccgcgccgccatggcaggcaccaatcttgccaaagaacgaaaggaactgcggcagcaggagactgaagccaaaaaagcagaggagaaaaaggttgacttgtcctcccaatggcaagatcctatggccaacccggagaccagaaagtttgctagtgatttgcgcaaaaacgctcaagcagcaccagcggctcccgatgctgttcctgagtggaagagggccgttgcacccaaagaagtgtcgctaggcaggcgcaccaacatgagcatcaaggagcaacgagaatctctccccgtctttgcctttagagaacaactaatcacggctgtgagggagaaccaggtccttattgttgtcggcgagacgggatccggaaaaacgacacagcttactcaatacctggctgaagccggctttactaacaatgggatgattggatgtacgcagcctcgccgtgtcgccgccgtgtctgttgcgaaacgtgtttctgaagaagtcggctgccagcttggccaagaagttggttataccatcagattcgaggacgtcaccagcccagcaaccaagatcaagtatatgaccgacggtatgcttcagagagagatcctgatcgaccccgaccttaagagatactcggtcattatgcttgatgaggcccacgaacgtaccatcgccaccgacgtgctctttgcccttttgaaaaagacaatgaagagaagggaggacctcaaggttatcgtcactagtgctaccttggatgccgacaagttcagcgagtacttcaaccaatgccccatctttaccatccctggtcgtacattccctgtcgagattctctactcccgtgagccagagtcagactacttggatgccgctctcaccaccgtcatgcaaatccatctcagcgagccaatgggcgacatccttttgttcttgacaggacaggaagaaattgacacggcttgcgaaattctatacgaacggatgaaagccttgggccctaacgttcctgagcttctcatcttgcccgtttactctgcccttcctagcgagatgcagagtaggattttcgacccagcgccgccagggagtcgaaaggttgttatcgcgaccaacattgccgagacatccatcacgatcgaccatatctactacgttgttgatccagggttcgtcaagcagaacgcatacgaccccaaacttggcatggactcgttggttgtcactcctatttcgcaggctcaagccaaccagagagccggtcgagctggtagaacaggaccaggaaagtgcttccgcctgtatacagaagccgcataccagtctgaaatgttacctaccacaatccccgaaatccagcgccagaatctgtctaacaccatcctcatgctgaaggccatgggcatcaacgaccttctccggttcgactttatggacccacctcccgtcaatactatgcttacagccctggaagagctctacgccctcgctgcgctggacgacgaaggtcttttgacacgccttggaagaaagatggctgattttccaatggagccagcccttgctaaagttcttattgcctctgtggaaaagggctgttcagacgagatggtgactattgtcgccatgctcaacctccccaatgtcttttatcgccccaaggagaagcaagctcaggcggaccagaagaaggccaaattccacgatcctcatggagatcatttgaccctcctcaacgtctacaactcgtggaaaaacaacgggtatgcgaacccttggtgtttcgagaacttcattcaggcacgttctatgcggcgcgccaaagatgtgcgtgaccagattgtcaagatcatggatcgccacaggcatcccgtcatcagctgtggccgcgataccaacaaggtccggcaagctctttgcgccggtttcttccgcaacgcggctcgcaaggaccctcaagagggttacaagacgctgatcgaaggcacgccggtgtatctgcatcccagctcggcgctcttcggcaagcaagctgagtgggtcgtttatcacaccttggtcttgaccacccgtgagtacatgcactacacaaccagcatcgagccgaagtggctggtcgaggccgcaccaaccttcttcaaaatggcgccgaccgacaagctatcgaagcggaagaaggccgaacggatcgaaccgctgtacaacaagtacgccggcgctgatgactggcgtcttagtgcgcagaggagaggcgga

SEQ ID NO: 26912 - DNA, 1140 bp, Neurospora crassa
gacctcgactccctctgctcctcaatcctcctcgcctacttctgcacctaccgcaccacccctccgaccctccacatcccgctctccaacctcccgcaagccgacctcgccctgcgacctgagcttgccgccgtgttgaagcccgccggtctacacaccaatgaccttatcaccctcgatgggctgcccaaggacgacaatgtcacccccgaaaacactcaatggctactagtagaccacaacagcctcacaggcccgcttgccgcgcgcggttttgggggtccagaaaggataatagggtgcatagaccaccatgatgacgaaggcgttgttcccccgaccgtaaagccgaggatgattgagaagagcgggagttgcatgagtctggtggtggaatattgcaagcctgtctgggaggagctaagccgacttgaaagtgccgaagcgggggctacggacagccgggaagagtgggagtcgcagttggcccatctggcgctggcaccgatactgattgacacgacaaatttgacgagcaaggacaagacgacagagtgggatacgggggctgtggagtttttggaaggtcgtttgacacaaaaatcgcaacagacgagtgccaccagtggagggcaagaagggtatgacaggacagcctacttcaaccacatcacctccctcaaagaagaaatcgccgggctaagctaccgcgacattctgcgcaaggactacaaacggtgggaagacggcggactagcggtgggcatctcgacggtggtcaggggactcgagtacctcttgacggaaatcggagaccaaaaagagttcaccgaggcgttgcgggcctgggcgaaagagcaggagctggacattgcggcggtcatgacggtgtcaaatccggatgggaagttcaccagagagctgctcgtctgggcgttcaacgagcgggcggtcaaagttgtgaagcggtttgtggagaagcatggggaagaggggttgcagtttcagacgtggggcggtggaaagttggattcggatgatggaaaaggcgagtgggtcaggtgttggacgcagggacgggtggataagagcaggaagcaggtggcgcctatgttgagggatgcgatgaaggaggcggct

SEQ ID NO: 26913 - DNA, 915 bp, Neurospora crassa
ctcgtcccctgctccgacgccctcggcattatcaccgccgtaggccccctcggccccggcgcctctgagtccgcctggaaagtaggcgaccgcgtcctctccaccttctgccaatcccacctcaccggccaaatcaccgccaaggacctggcctcggcgctcggaaagcctctcgacggcgtgttgcagacctaccgcgtatttccctccaccggcctcgtccgggttcccgagtacctgaccgacgaggaggcgagttgcctgccgattgccgccgtgacagcttggatggccattttcggaatggagccctttggcacctgggccaccaaggcatctgatgatgggaagaagccgttgcagggcaaaacggtgctgctggagggaacgggcggcgtggctattgcaggactgcagattgccaaagcggccggggcgcggaccatcatcacgagttcgagcgacgagaagctgcgcagggccaaggaggagttgggcgccgatcatgtgattaactacaagacgacgcccgactgggagaagaaggtgatggagattacgggagagaacgacggggcggatatcattctcgagacgggcggggcgggaacgctgtataaggcactggattgcattgcgtttggcgggctgatctcttgcattgggtatacggccggtaaggaagacagtggggaggggagcaggatgaatgtgaacgtgttggcgctgaggaggactgtgacgctcaagggaattattaatggtcccagggaccgatttgaggagatgtgcgagttctatcagaggcatgagattaggccggtggtggataaggtgtttgagtttgaggaggggaaggaggcgatcaagtacttgaggagtggcagtcattttggtaaggtggttgttaaggtc

SEQ ID NO: 26914 - DNA, 3972 bp, Neurospora crassa
gtcctcgagcttatatttcaagaaaaagaactgccaccttcaaaacacggccgacatattccattacgaccccatcatgacaaacccctgatcgacgaacggcgagggagcgcatatatcccaaacacgattcggacatcccgctacaccatctacgatttcatcccgaagcagttattcttccagttctcgcgcctggccaacttctacttcctctgcgtcggtgttcctcaaaccattccgggcgtcagtaccaccggaaacttcacaaccatcattcccctattgttctttgtatttctcactattgtcaaggagggatacgatgactggaaacgccatcggctcgacaaggtggaaaatgcaagaagcgcgaccgtcctccggcccactggccacgtcgacagccgacaggactggcggactgggtttggattacgaagaacaaaggataaggacacagtggcggttcaagaggttatacccgactcggaatatcaatggcatgccacgcaatggaaggatttgaaagtcggcgatgtcatcaagctctcccgcgacgaggatgttcccgcagatatcgtgctgctgtacgccgacggcgaaaattccatggcctacatcgagacgatggctctagacggagagacgaatctgaagaataagcaagtatccaaggcactgcagcgttgcaacaccatacaaggcattgccaattgccaggccgagttcgtggtggaggatcccaatccggatctctatcggtttgacggaagagtaaccgtggacggtgaaacgttgcctttgactttaaatgaagtggtgtacagaggctgcacgctacgcaacacaacatgcgcgatcggtatggtcatcaatacgggagaagagtgcaaactccgacgaaacgccgaccgacaccccaaggcaaagaagccggccatggagaaaattgccaacaggattgtcatcagccttgttgttgtggtcatctccctttccatcggttgttccatgggctatttgctctggaaaaatgcttatgagcataaggcatggtacttgaggcacctgggagttgactttgaggatattattatcggatttttcatccagttcaacaatatcattcctttggcgctatatgttagcttggagattgtcagaatcgggcagatgtggtggctcaactccgatctggagatgtacgacaaagtatccgacacgccagccaagtgcaacaccaacactattctcgaaaatttagggcagatcggttacgtcttttcggacaagacagggactttgactgagaatgtcatgaagttccgaaagatgagcatcgccggaacgacatggttgcatgagatggatattgtgaaggagcaggaagcacaagggctcacccaaacggaaacgaagggcaaagggctcaacgttatgttggaaccgacctttgaaaacgacaacgcattgacaaagacaacaaccgctgtgtcagtccgttcaccgaacccgcgccggtcatcttcacaatggcggtcgactggtcggcctgaccatgtccagccagaggtcacgactgaggatctacttgagtacataaggctgcgcccaaaggctccgttttcgaggagggcagttcagtatcttcttgctatggccctctgccacacctgcttgccagaaattagagacggggagattgagttccaggccgcttcacccgatgagcttgctcttgtcaaggccgctcaagagcttgggtttctcgtggtccaacggtcctcccagtccgtcacgctccgtatatcgcggggtgatggcactgagttggagcgcacctaccaaatcctcgacgtgatagagttcagcagcaagcgaaagcgcatgtccattatcgtgcgatgtcccgatgaaaggatatggctgataaccaagggcgccgactccgtcattctgccacggctaaggatggcacaactggcaatacaaaaggctaacgaagtccgcaagagcttggaggttgagcatgaaatgcaacgcaggagtgaggctcgagaaccacgtaacagttttggcgggcggcccagccttacaatccgccgcagcatccaccttgccagacagaatagcgttgctggacctagcaagcgcccaatcaccaatcgtagtaagtcgtttgaggtgggtagaatgtccctgtctgcaccagaaaatcgcctcaggccccaggttaccgttcgcacagcatcctatgatgtgccttatgaggacgctgcagcggcgtcagtgtcagacaagtttgcattccttgacgatccttccgtgtgcgatgagggtgctatcttcactcgatgcttcaagcacattgatgatttcgcaaccgagggccttcgaacacttctgttcgcccaacggttcttgtccgagtctgagtacaacacatggaagaagctttaccgcgacgcagagacgagtcttgtcgatcgtcaagagcgcatcgaaacggcaggtgaattgatcgaacagaccctggacctcatcggtgccacggcaatcgaagacaaacttcagaaaggtgtccccgagacaatcgagcgtctccgccgagctaacatcaaaatatggatgctcactggcgacaagcgcgaaacggccatcaacatcgcccactcggctcggctttgtcgtcctacttctgacatatatatcctcgacgccaccaaaggaaacttggaaggtcaaattatggacattgtcgacgagctaaacatccgggccgaaaccatgcctactgcgattcccaatcacaccgtagtagtaatcgacggccacacgcttgcggcgctggatcagccggaaacgcacgggaatgccaaagaactcttttacagcctcatcccgacgattgactcggtcatctgctgtcgtgcctcccccgcccagaaagccttgctcgtcaccgccatccgtaaccactcccatcaaccgagcaccaccaagaagaagggcttcctcgcctatctgatcacacctagacgaacaccaccactcactctcgccatcggcgatggtgccaatgatctggcgatgctctcagctgcccacgtcggcgtaggcatctcgggccgggaaggtctgcaagccgcgcgagttgctgattacgccgtgtcacagttccgcttcctcgcccgcctcctgttggtacacggaagatggaattacgcccgcacctccaagttcattgttgccacgttttggaaggagatgttcttctatttgcccaccgagctgtaccagcgctacacaggatatacaggcaccagtctttacgaatcgtggagtttgacggtgctgaacacgcttttcaccagtttgtgcgtgatcgtccccggagtgtgggagcaggacctgagcgcagaaacgctgatggccgtgccagaactgtatgtctggggccagagggacggcgggttgaatctgcggaagtatctgggatggatggtggcggctgttgcacaaggtgtggtggtctggtgggtgtgttggggtctctacggtgggattgcggtgaaggacaatggtctgtttgctgtgggcaatttggtctttaccgtcgccattgtctggaccaacttgaaattgctgtacgtgtttgttccctcactcattctcactctttttcttttttctctttcttttaggcacgacactaacctgtcaaccaacaacagcatcattgacacccaccacaagaccggcataatccttggcgcattcggcattacctttgcaggctggtggatctggcagatcttcctcgccagcgcctacgccccgggtgtctggccttacgcagtccgcggtgggttcttttcctcgttcggccctgatccagcctggtgggttgctctttttgcggccgtcggcctgctcaccgctgttgaactcggctataaatccaccaag

SEQ ID NO: 26915 - DNA, 3309 bp, Neurospora crassa
atgcggacagtatccgttgttgcagccgccctattagcggcctcgtatgtggccggcgagcatgtggggcccaccaagcccaagtactacttccctaaacatgtcaaacgccagtatgccaacgccacgataacatccaacgatgcccctatttccaccatcgatacgtcgtccgacgccttatcgcagacgaccaagagggagacgaccagcaacgaccagagcgaaagcttgtcggacatcccctttgtcaagtcgacttcttcgcgcttcctcacctcgagcgaaccgcagtccgaatccgagtcagacacgtctcgggtcacgacggtggtgattgcgagcaccgtttacgtttcaccttcccagcccacaacagccgacttgtcgaccgctggcacagccgctccctctgcccccgctgtcgacaccgactttgttagttccaccgatagcactgcgggctcctctgactcaactagccagggtaccactggtctctccagctctgctactgacaacagctcaaccgacctacttgggtttcctacgggaatcagctctggctctacaaccgagagcagcttatctgactcaactaccgggggcacctcttctggcgctacttcgtcacctgaatctactccgggaaccagtcttggttctactacggacagtagtactagctcacctgttactgccaccgacagggtcgactcttcggcttcggcttcggcgtcggcttcagcttcaacttcggctagcgataacaccatcttgcccagctccggcgccaatgttaccagctcttttgcctcgaccaccgacgctgttagctcgtccagctctgtcacaaagaccgctagctcatccagccctaccaccgatagcgccagctcttcggcttctgttactggcagcgtcacctcacctggctctattgctaacaccaccagctcggccatctctgctagctcgtccagctctgttgtagatatccttagcttcttgaaccctggtttcggtggtgctagctcttcggcttctgctaccgatagcactactgtgcttggctctgtcgccaataccaccagcgcggccatctctgctaccgatgtcgctagttcttcggcttctgctaccgatagcactactgcgcttggctctgttgccaacaccaccagcgcagccatctctgctaccgatgtcgctcgctcctcggcttctgctaccgatgttgctagctcgtcggccgcgtcgactgatgcatctggctccttgacttcggccagcgctttacctaccgtctcgtcaggagtcatttctaacacgactagtcccgactcgtctagctctttgcaggtccttactcctcctaccaccaccgttgagcctatttccacggccaatgctaccaccgtcgagacagcaagcaccgtgacagccaccgatgggagcgcttccacgggttggcttccgcctatcatcgtccttccttcgatccggacgagctcgacttctgcggccgatgtagcaaattctaccgcgcctgccctcgtttctgggactggccgtgcaaccaactctaccatcggaactgccacagcctccgagatcatcgcgacagaggatcctctgatcaccagctcgagcagctccggaattctcctggcccctacaggcgtcgtcaatgaaaccaccagtgcgtccaccaacctaattgaatctttggctagcaatgtcgcatccttggtaggcagcatacttattcctacgggcaatggaacagcaaccgaacccacggctcccgttactacgtcggatagtgtcacgattccctcagcgaccgaaccttatgctagcggctctggatcgggcgttatcacgccttccgcctcgctgaccaccagccagcctaagcctcccatgatgtcttcgggtatcgtctctatcccgattggaaactcaactgtttcctcaaccaaagctgttgaatcgggcccaacaacaaccggaatcccggggtcctcagtgcctgttattcctggaaactcttcgatccctgtcacatccatgtctgacacaacggtcgttctgccccctgtcactttgattaacagcaccacagtagcggccaattcctcaaccattattccagtcatcgtaacgagcgcttcagctgagagttcggtacctgtttcctccttggaacctgttaccaccactcaggttctgattcccccgcctgtgccgaccacgacgatcaactatccaccggttacgcaatatactcctacagccaccgtgtctaacatgccgcctggctacaatagcccaaccacgattctggtggaccagcctcctcctgcgcagacccacaccgtgtccttcgtgcaacaaactacagcgactgcccttcccactgacctccccaaggcgattgcccctgatgacacgactgctcccaagccggaagacaacgtttttatccagatcggtttcaactatggattcaattacccatttgtggccaagaacaacaacgctgcggcgcagatcttccgccttctccctgaggcgctggcgtttgcttcgtccattgagtcccacagagtaagagtcacgaagctgatgcccatgaacacggtgaacactctgggctactggaccactcttgctgttgtatcatacccgcaggcgtatgttgagagccttcgactggatgttaaaatcgccagttctccgctctataacaacccgaccccgctggtttacaacttgacaatgcagatcaatcctgccatcgacattatccttggctcgaccctcattggcgatggctccggtggcgacagtggaagtaacccgtccaacgccggtaacaacggcaatgcggacccatttacaaacaacaacaacggcaaccagacttctcagcagcggggaaccacggcgggcattgtaggtggtgctgttgccgttgctgctgcgtatggcgcggccatgttcgtggttgccaggagatacaagaggaagaagcaggcgcacagacgggcgagctccctcggcggaagcccgtcggacatgcagcagatgggcgggggcagcccggctctcatgggcggggcactccttagtagggactttaccggctatggaggagtggctggcggcgcggcggcggccggcgccgttgcgcctggtggacgggacagccatggcagcggaaggagcgggatgggtctctcttctcggaccgcctacatctcggcccccgttgccgcggaaaattccctcgggtggaactaa

SEQ ID NO: 26916 - DNA, 1432 bp, Neurospora crassa
ctttccctcctcgccctctccgccgcttgtgtcgccgtcctcgccaacaccttccagggtgatggctacccactcatcgcctcgctcgcgcttggcgggctggcattcagcgcgaccttctccatgatccgatggctgggaccaaccttcatgagggccggcctgaaaggcgtggatatgagcaaacaccataaaaaggagctgccagaatgcatgggcgcgatcgcagccatggtgtacttgctggctgttattgtctttattccgtttccgttctacaaggatattgtggcggccacgagcggaggtggaaaccgcgatgtggtgatgcatgttgagcatgtacaggaagggaggtttctacatcggtttccgcatggaaaggtatgtcgacaatccgttgccctctcctttagagacgggaacacacaaagacagaacagatgctaacactttgcgacaccaacagctcgcctcctacctctctgccgtcatggccctccaatccatctccctcctcggcatcggcgacgacctcttcgacatccgctggcgccacaaattcttcatccccgccttcgcctccatccctctcttggtcgtctactttgtcgactttggcgtcacctctgtcgtaatcccgacccccttacagccttacctaggcgagctcttcaacctcggcgccttatactacgtctacatggcctcggttgccattttcagtcccaacagcatcaacatcctggcaggaatcaacggcatcgaagtcacccaatccatcgtcatcgccctgttgctcgctttcaacgattgcctctaccttttgacgccgtatccgcacccggctacggactcccacttgttctcgctttatttcctcgtcccctttttgggtgtgtcttttgctctgctctggcataactggtaccccgcccgcgtcttcgttggcgacacgtactgctatttcgcgggcatggttttcgtggtggtcagcatcttgggacacttcagcaagacgttgattttacttttgattccgcagatcttcaactttgtttattccgtgccgcaactctttggtcttgtaccctgcccacgtcaccgtctaccgcggtttaacgcgcgcacgggactgttggagccgagcgtgacgccctggacgccagagaggcagcccaagccgccggtggcgtgggcgctgaagacgcttgataaggtgaaactgttgagggtgacgctggatgaggaggggaggttcgtggagacgagtaactttacgatcttgaacttgtggctggtctggagaggcccgttgcgggaggaccggttggcaatggagatcacggggatgcaggtagtggtgggactgtttgggttgtttgtgaggcatcggttggcgttgattctgtttaagcaggacaatttgggg

SEQ ID NO: 26917 - DNA, 2674 bp, Neurospora crassa
atgtatctccctcgacagcttatatcaaaactctacctccacttgcaaaatacccgccatccactatcgccgcccgtcctcatcttggtcgctctcgaaaccgatgcgctatgtgcctgccgtatcctaacccaacttctcaaacatgactatattccgcacaagatccagccagtcgctggctactccgacctcgaacgtgccggcactgagctcgtcagccccatgatggagacccgtggtggtgctggaggagtcgtcgtatgcttgggagtgggtggtatggttgacctcggcacagttttgggacttgagcccgagggcgaagaaaatacctttgggggtgtagaggtgtgggtgatcgactcccatcgcccgtggaacttgggcaacgttttcggcggctttcccctcgaaccagagacgcaagaggccaggacattctctgcgcgaacccccattggtgtcaatggcggccggatagagcgagcatacaaaccaggcaaaggcggcatcattgtcatggatgacggcgacattgaagatgagctctccaaggaacgagatgcgtatctggcgctagtggatatgcccgaaatcgaagatgatggccgagacttgggcgacagtgatgaagacgaaagcgagaacgaggaagacacgggcgatacatcggttgttgcaggcagaaagaggaaatcatggtcggacttcgacgaggacgatgatgaagacgaccgacccagacagcgacgaagaagcaattcggtgagtacattccgatttcttcatagtaatacatctctcatgccagatacagtcgagtccaattccagattcgcctcgacgaccgcaacaccgtggtctcatatctctacgcgacgatgccctattttccagtgacgcgctggaagctccgcctgctgcacaaccacccagaggcccttcagccaacaccctccgacggagattgctacgactacgacgagaaaacgagggagttttgcgcgagtactaccgactgggtacatcatattcggagcccatctcgtccatgatgtactcccttgcgtcagaactgggtcgtgaagacaacgacctgctatggttagcgatcgttggggtcacgtcgatggagctgtacggccgctcatctgccggtattgcggtagcagctcgcaggtcagacgcccgcatttccggttggctcggcatgcgtggtgcgagaatacggcagcttctgcgagacgaggtcagacgtctcaacccaccagagataggaaacggccgggtgctccccgagacgacaggaattatcccaacaaccgctcgaagtccggaggataccagtatcaggttgtcgccggagcccaagttcctgcttattaggcactggagtttatacgacagcatgcttcactcaccctacctcttctctcggctaaagacgtggagcgaggctggcatgaagcgattacacaagcttctcgccaagatgggtgtcagtctggtgcagtgcaagcagagttatgcccacatggacatgatgttgaagcgcgaacttcgcaccaaactactaaaatacgcgtctctctacaacctcgacgaacttgtcccgaccatagacacggacgggaaagatcgtggaggtgccaaagatggatggggctttgtacgcagttggggttggagggcaaccctgagtgcgcaagatgtcggtgtcgtagtcggagccctgttggaagtggggaagaacaccactagtgctgatgaccttcctgctggcccatctcaggatcttctcgacgtagacaacaaccagagccaaagtgaggagtggatccccaggttctgggaggcgtatgatgcgctggaggacatcgaggcccttaaggctggccttcccacggcgcagtatctacacaaggccatcttcaccactggcacgacaattttgaagaagaaacaaatatctcatctgcgcgcatttcgcatgtgcgtggtcaaggactcaccagatgcgacactcttcaaccaccccggcgctttgaccaagctagcgctctggatcggtgaagcactcgcggaacaggaaaaagaagccactggcgggaggctcgcccatggcggtcgtggcacacctctcgtagtggctagtctagatgacaagcgcggagtgtatgttgtcgtcggtactggtggcggcggtgggccagacacaaagtttctcgatcgtgaatcggccaagaagcgagccgaagaaaaagaggccaaagctaaagccaaggagatgcagagaaggatcaaggaaaagatcaaggccgagaagaaggaggccaagagaaaggaaaaagaagagaaaaagaaagccaagtccgacgccggcggcgatgaggacgaggaggaggacaacgaggaagatagtgacgacgactcggatctctctgatacggactcggacgacgatgatgagtcggacgaagacgaggacgagctcgatcaggaacttgaaaggggctacggcctcaacaaattcggaacagcgttccaagacgtggtggcggagactaatgccagagtgcgcatcgacagctttgagcactgcgtcgtggaggtcaagaaggaggatcttagtggcttcttggaaagtctcagcatgaaagtcgtcattggg

SEQ ID NO: 26918 - DNA, 575 bp, Neurospora crassa
ggcttcctcaaggattgcccctccggcatgctcaccaaggccgagttccagaagatctacgcacagttcttcccctttggcgacccatcgtcattcgccgactacgtatttaacgtattcgacacggacaagtctggcaccatcgacttcaaggagtttatctgcgccttgagcgtcacgagccgcggcaagatggaggacaagctcgactgggccttccaattgtacgacattgacggcgatggcaagatcacctacgacgagatgctcaagatcgttgaggctatctacaagatggtgggtttaccctttctttcttatctctctacgccctttcccgtgtcgtcgcaatcttgtacgttaacattctgatccctcaaaacaggtcggctcaatggtcaagctccccgaagacgaagatactcccgagaagcgcgtcagcaagatcttccgcatgatggacaaggacgaaaacggcagcctcgacatgaaggaattcaaggagggcagccagcgcgacgagacaatcgtatccgccctctccttgtacgatggcctcgtctaaccaagtttct

SEQ ID NO: 26919 - DNA, 2213 bp, Neurospora crassa
ctggtcgctaagcccccctatactctcgatgtcccgggccagacgcccgtcgagggcgagactcctgttcgtcgcattcccctcgccatcgacggtctgcatgccatacccccaaacaggcgatggggcgagaatgaggccatcggcgaggaaatcgataccgtctacaaactcgtcaagtgggctgccctcgcacatggcgagtcccagtgcatgggctcccgcaagctcgtaaacacccatgttgagactaagaaggtcaagaagatggtggatggtgaggagcgcgaggtggacaagaactggacctacttcgagctcggccactacgagttcattaccttcaaggactacgagcagcttacgctcgacgttggcgctggtctgcgcgccatcggtctcaacaagggcgaccgtgtccacatctttgccgcgacaagccagaactggctcgccatgtctcatggttccgcgacccagtccatgcccattgtaactgcctacgacacactcggcgccgaaggtctcaagtactccatggtcgctaccaatgccaaggccatcttcctcgacccccatcttctccctaccctcaacggcgttcttgagcatgccaagggcatcacacacgtcatctggaacaaccagaacaaggtcaaggaggcccacattgaggccctcaggaacgagcgcggtgttactgtcttgagcttcgacgagcttgtccagctcggcaagcagaaccccgtcgcgcccgtcgcgcccgcccctgaggatctctgctgcatcatgtacacctccggttctaccggtacccccaagggtgtccccctgaagcacagcaacgtcgtcgctgccggtaagtggccgcaaactcttattgtcttgttcctgaactgctactaacgtccttgtcacagtcgctggtgtctgccccgtagtccagcccttcgttggccccggtgaccgcctcctgacctaccttcccctcgctcacattctcgaatttgttttcgagaacgcctccctctactggggttcaaccatgggttatggtaaccccaagaccctctccgacacctccgtccgcaactgcctcggcgatatccgcgagtttcaacccagcgttttggttggtgtgcccgccgtctgggaaaccgtcaaaaagggcattctcgccaaggtcaacgctggcagccctctcctccgcaaccttttctggggcgcacttgctctcaaggagaagcttatgggccttggtcttcctggaagcggtcttttggacgccattgtgttcaagaagatcaaggatgccactggcggtcgcatgaagctttgcttgaacggtggtggccctgtcgccaaggatacccaaaagttcatctccatggccatctgccccatgattatcggctatggtcttaccgagacgaccgctatgggtaccctccagaaccccaacgagtggactgctgagtcaattggcgccatgcccgcctcgatcgaggccaagctcgtcgatttcgccgacgccggttacttcgccactaacaagcccaacccccagggtgaaatctggctccgtggcccctctgtgctctccgaatactatgagaaccccgaggagaccgctgccgctgtgaccgcggacggctggttcaagaccggcgacattggcgagtgggaccagaacggccatctcaagatcattgaccgcaagaagaacctcgtcaagactctcaacggcgagtacattgctcttgagaagcttgagtccatctaccgctccgccgccgtcgtcgccaatatttgcgtctatgccgaccaggatcgttccaagcccatcgccatcatcgttcccgcggaacccgcccttaagaagctcgcctcctcgagtggtgtgaagggtgacagcttggaggagctcgtacacaacaagaagctccaggctgccgttctcaaggagctccagaacgccggtcgtgccggcggcctttctggcattgagattatcgagggtgtcgttatgtcggatgaggagtggaccccccagaacgtgagttttccactgtctacatctatttgtttacctaacccatcgctaaccaaatcaatcacagggtcttgtaacggccgcccagaagctcaaccgcaagggcatcctcaacaagtacaagaaggaggttgatgaggcttatggccccaagcagtag

SEQ ID NO: 26920 - DNA, 2526 bp, Neurospora crassa
cgtaccctttacgacaaggtcttccaggcccatatcgtcgacgagaagcttgacggtaccattctcctctacattgaccgccacttggtccacgaagtcacctctcctgtaagaagtttgaacccacatgctggagagctccggtttcgcagtccagtgcccagtactgacccctaatcaatagcaagcttttgagggcctcgaaaacgccggacgccaagttcgcaggccagactgcacccttgctaccaccgatcacgtaagttcaatgtcactgccattgtttttttattttcacatggctgcgcatgcagcgttttcgcgcccatgataccttgccccttcgcaatcgctgtgtgggactgcaagctgaccgcggacccgctgtagaatgtccccaccacctccaggaaagcgctgaaggatatcgccagcttcatcaaggaggatgattcgaggacgcagtgcgtcaccctcgaggagaacgtcaagaagttcggcatcacatactttggcctcagcgacaagaggcaaggtatcgtccacgtcatcggccccgagcagggcttcacccttcccggcaccacggtcgtctgcggcgactcccatacttctacccatggcgctttcggcgctctcgctttcggtatcggcacctccgaggtcgagcacgtcctcgccacccagtgcctcatcaccaagcgcagcaagaacatgagggttcaggtcgacggtgagcttgcgcccggtgtgagttccaaggatgtcatcctccacgttattggtcagatcggtactgccggcggtactggtgccgtcatcgagttctgcggctccgtcatccgcagcctcagcatggaggcccgcatgtccatctgcaacatgtcgatcgaggccggcgccagagccggtatggtggctcccgatgagatcacctttgagtacctcaagggcaggccccttgccccccgctacggatccgaggagtggaacaaggccgtcacctactggaagtctctcgcctccgaccccgatgccaagtacgatatcgatgtcttcatcgacggcaaggatatcatccccactgttacctggggtacctcccccgaggacgttgtccccatcaccggtgttgttcccgaccccgagaccttcgctaccgagggcaagaaggctgctggccgtcgcatgatcgagtacatgggcctcgttcccggcacccccatggaggacattgaggtcgacaaggtcttcatcggctcctgcaccaactcccgtatcgaggatctccgcgctgccgcccaggtcgtcaagggcaagaagatcgccgccaacatcaagcgcgccctcatcgtccccggctccggtctcgtaaaggaccaagctgaggccgagggccttgacaagatcttccaggaggccggtttcgagtggcgcgaggctggttgctccatgtgccttggtatgaaccccgacatcctctcccccaaggagcgttgcgcctccaccagcaaccgcaatttcgagggtcgccagggtgcccagggccgcactcatttgatgtcccccgtcatggccgccgccgccgccatcgtcggcaagctcgccgacgtgcgcaagctcaccgactacaagtccagcccgcatgttgaggccgctgtcattcctgaaactacctccaccgccaaggcccacactgacgagcgtatcgaggaggacgatgtcgagaaggacaagctcgccgaccagccccaggactcctctccccaagtcaacacctcggtctccaagtcctctgctggcctccccaagttcaccaacctcaagggcatcgctgcgcccatggagaaggccaacatcgacacggacgccatcatccccaagcagttcctcaagaccatcaagcgcaccggtctcggctccgccctcttctacgagatgcgttacaaccctgacggcagcgagaaccccaactttgtcctcaaccgcgagccgtaccgctccgccaagatcatcgtctgcacaggcgccaactttggctgcggctcctcgcgcgagcacgccccttgggcactcaacgacttcggcgtcaagtccgtcatcgccccttccttcgccgacatcttctttaacaactccttcaagaacggcatgctgcccatcgcgatcaaggaccaagccgctctcgagcgcgtgcacgccgaggccgcggccggccgcgagatcgagatcgacttgcccaaccagctaatcaaggatgctgacggtaacaccctctgcgagttcgaggtcgaggagttcaggaagcactgtctcgttaacgggctggacgatatcggtctgacaatgcagatggaggataagattgccgagtacgaggcgaagatgagccagcagacgccctggttggatggacgcgcgtatctcaagaggaagggacagggtggcaagttggtggctaaggcggtcccagtaccgaagactaaccgcggggaggagaagaaggagccgctcgagtggtaaaag

SEQ ID NO: 26921 - DNA, 595 bp, Neurospora crassa
atggcaacttcccaagcagacgctagggaccgtcagttcctggctgtaattggagacgaggtgagtgtgattttgcaactaggtctacatctgtcaaggagctaacaattatctaggactccgtcacgggactcctccttgcaggcattggcgtaggttcccgtatggtcctcggatgatatgcggtagcggagttctaatacgcactcgaatcgtagcacgttacggctcccccagattcgcaaaagaactttcttgtggtggacaacaagacggataacgctgctatcgaggcggcctttgaccgcttcacaaccgagaggaaggacattggcattgttttgattaaccaacatgtaagtgcgggtcttggttcaaagggggggcttgtggggagatatttcttattgacaattctggataaaatgggcaactgacgtggaagacacagatcgctgataggatacgacaccgagtcgacactcataccgcggccttccctaccgttctcgagatcccgagcaaagaccacccttacgaccctgagaaggacagtgttctccgcagagtccgtcgtctgtttggtgaataaacg

SEQ ID NO: 26922 - DNA, 921 bp, Neurospora crassa
gtcctgatcatgggcgcaggccacatcggccgtcgggtagcgctagtatgggcctcggcgctccgcccggtgacggtgtacgacatctccaaaaacgcgcttcgctcctcgaccgagtacatcaccgacaacctagccaagtactgtctcgaacacgggacccatcccggccccgtccacttcaccagcgacctccgcgaagcaaccacagctggcaaacgccacggtctgaagttggacttcagcgcggcgcacgacactgaacccaaatcgacacgcaaaaagggaccgtggatggtaatcgaatgtctccccgaaaacctctccctcaagatcgctgccctcgccgagatcgagcgccttctcccggagaactgcatcatcgcgtccaacagcagcagcctgatgacttccgaaatggcgccgcacctgcaacaccccggtcgtctcatcaacacgcactactacatcccgccgcgcaacgtcatggtggaggtcatgtcctcctcgcacacgtacgaggggattttcccgttcctaacacgggaaatgaagaacatgggcttgacgcccatggtggtgccgcccggcgtgcagtcgcaagggttcattttcaaccgcatctgggcggcatgcaagcgcgagacgctggcggtgctgcaggaaggggtcggacagccggccgagattgacgcattgtttcgcgactttttccatgccgagaagggaccctgtgagcgcatggatgaggttgggctggatgtggtggccaatgttgaggagcattatatcgagcaacggccggaacttgcaaggtctggcgagaagccgctggagtggttaaagaagacgtatgttgggcgtggtgatctgggtgagaagagcggcgacgggctgtatacgtgggaggagcgggaggcg

SEQ ID NO: 26923 - DNA, 1278 bp, Neurospora crassa
tccaactcaacatggaagctcaccatagacgacactccctctggtcggaagcaaaccatcaaaggcttcggcgccgccgtcaccgactccaccgtgtccgtcttcaacgccctcccctccgcccaacgcaccgccctgctcaacaccctcatgaccaccgccggcgccaatttcgccatgatgcgacacaccattgcctcctccgacctctctgccaacccagcctattcgtacgatgactccaacggccaaaccgatctatccctttccaacttcaacctcggcggccgcggcaacgccatggcctcgctactcgccgagatgagacgtctccaacccggcctcaccatcctcggctctccctggagtccaccaggttggatgaagctcaaccgcgcgattcaaggcaccacggtaaacaacaacctcgaccacgcctacgcctcccagttcgcccagtacttcgtcaaatacctccaagcataccaagccaagggcgccacaatcgacgccatcaccatccaaaacgaaccgctcaactcgcgcgcgcagatgccgaccatgtacatctacgcggacgaggccggtgatctcattcagaacaacatcggtccagctctgcgcaacgccgggctggataccaaaatctgggcatacgaccacaacaccgaccaaccctcctacccgtccactgtcctttctcgggcgggcgggtacgttcccgcggtggcatggcattgctacgccagctcgctggactggtctgtcttgaccacctttcacaacgcccacccgggcgtggagcagtacatgactgagtgctggacgtcagcaaagcagccgacgccgtggaactgggctgcaagcttcaccatgggaccgctgcagaactgggcgagcggggtgacggcgtgggtcctggggacggataccaatgatgggccgcacttgacgggcagtgatgcgtgtgataagtgcacggggctggtgacggtagatgcggcggcggggacgtataatttaaggggagattattacatgatggcgcagttttcgaagtttatgaagaagggcgccgtggtgatgagtggaacgggaagttggacgtatggggatgggagcggactggagagcgtggcggcgacgaatgcggatgatgggagtagggtggtggtgattgagaataagtttgggaacgagatttatgtgacggttgaggcgaagagtggggaggtttggagcgggttagtttatagaaactcggtggtgacttgggtt

SEQ ID NO: 26924 - DNA, 1782 bp, Neurospora crassa
atgtcaaagcgtcaccttttcccatccttggacgggctcgtccccaaggctcttcgcggcatcgttgcttcgaacccccgactcaacctggacgaagccaacaaagtcgtatacgactccgaagcacctcggtccaatgtcagcattgtcagtggcggaggatctggacatgagcctgcctgggccggctatgttggaaccaacttacttgcggcagccgtaatgggtgacgtctttgcctcaccaagcaccaagcaaattctagccgcggtcgaatcagtaccttccgacaagggcactctcctggtaattacgaactacacgggcgactgtcttcattttggactcgcggccgagaagacgaaggcaaagggcaatccgtgtaagatgctcatctgcggcgacgatgtctccatcgggaagaagggcggctccctagtcggaagacgtgggttggccgggcaaattggagtgctcaaggttcttggtgcggcagctgctcagggggcgactctcgatgagctttacgatttcggttctgcatttgccaactcgattgtcagcatttctgctactctcgaccattgccacgtcccggggaggactgagcacggagcactagccgaggacgagctggaactgggaactggaccacacaacgagccaggttactggaagctgtcaccagcaccttcagccgagggactcgtccagcagattctcaagtactgcctggacgagacagaccccgaaagaagctacgtcaagttcaaccccggtgatgagacggtccttttgatcagcaatttcggcggcatctcgaatcttgagttgggcgggctcgtagacgagattctgcaacaactgctcaaggactggaatatggagccggttcgagtgtactcgggatgcctggagacatcactcaacgctcctgcattttcagtatccgttatcaacatcaccgctgctgcagccaacagcacctacaccgttgaccagatcaagggcttctttgacactcgaacggacaccgcctgggaagccgttgctggataccagagttatccgcgacgacgtaagcggtctgagcaggtcgttccacccccgaaagaaatcaggagaacagtcgatgactccactgacctgaagattgacccatcgctgctcgagagcatgatcgagagcgcctgcaacgcagtgtcagccgcagagccggatctcacaaagtgggacaccgtcatgggcgacggcgattgcggcctgaccctgcagacgggagccaacgcgctagtagatgctctgaagaccaagaaggttgcctccaatggctcggtgatcgaggtcctgaacgagctggaagatatcgtcgagggtaagatgggagggacattgggtggcattctgggtatcttcttcgtggcgctgcggacggcgcttcaggagaacatcggactcgcaaaggaagtgggagttcctgctctatggggaaaagctttgtcaactgccatcagtcatttgcgtcagtacaccccggccaaagttggtgatcgtacagtgatggacacgctgattcccttcgccatggctatggaagaagggagaagctttgaacagagcgtcgctgcagctgtgaagggatccgaagggaccaagaagttgaagccaaaactgggcagggctacttacgttggtgttggtgcggataacaacaaggagctgccgcccgatccaggtgcgtggggagccatggtcggactccagggcctcttgtcggctttc

SEQ ID NO: 26925 - DNA, 1512 bp, Neurospora crassa
atgtcgacccttgaggaactcgacgacctcgatcgccgtgagcgcgaggacaagaagaaggatcaggacaaggataagaacaacaagaaagagggagatggcgatgccgagatgaaggatgccgagcccgaggccgatgacatcctagatgaggagatcctgagtttgagcacagaggacatcctgatgcggaagcgcctcctcgagaacgatgccagaatcatgaagagcgaataccagcggttatcacatgagagggctaccatgaaggacaagatcaaggagaaccaagaaaagattgccaacaaccggtaaacattccccctacactcccctaaggtttgccttcagtagccgcgaaacctcccctactaacgctggcctcatcagacaacttccgtatctcgtaggaaatgtcgttgaacttttggaccttgacccgaccgccgagtcctccgaagagggcgccaacatcgacttggatgccacgcgcgtgggtaaatcggcagtcatcaagacatcgaccagacagaccatctttctccctctcatcggcttggtcgaccccgagaagttgaagcccggcgatctcatcggtgttaacaaggattcgtaccttattctggatacgttgcccgccgagtacgacagcagagtcaaggctatggaggtcgacgagaagcctcaggagaagtacacagatgtcggtggtctcgacaaacagattgacgaacttgtcgaggctattgtgtggcctatgaaggaagccgaacggtttaagaagatcggtatcaaggcgcccaagggtatgtcttcaccaagatggagcagaaactcgctgctgtggtattgctgctaacttcaggaataggagctttgatgtacggacctcccggaacaggcaagactttacttgccagagcttgcgccgctcagacagatgccacattcctcaagcttgctggcccccagctagtgcagatgtttatcggagacggtgccaagctcgtaagggactgcttcgccctagcaaaagagaaggccccgtcaattatcttcatcgacgagttggatgccgtcggtaccaagcgtttcgacagcgagaagtccggcgatcgtgaagtccagcgaaccatgttggagctcctcaaccagctcgacggtttcgcttctgacgaccgtatcaaggttctcgccgcgacgaaccgtatcgacgtcctcgaccccgctttgcttcgttccggtcgtcttgaccgcaagatcgagttccctcttccgaacgaggaggcacgcgcacagattctcaagattcattccaggaagatgaaggtcaaccccggcgttaactggggcgagttggcgcgcagcacggatgagtttggcggtgccatgctgaaggctgtgtgtgtcgaggctggcatgattgccctccgtatgggcaagaatcagattggacacgaacactacgttgacgctatttctgaggtgcaggccaagaagaaggaagtgagt

SEQ ID NO: 26926 - DNA, 1175 bp, Neurospora crassa
gtcgcccacctcgacacctttgaactcccagagaaaatcacgggctctgctagcgaccgcgcacttggcaaggccatcattgacacttggcgctacgagggaatcatccaaatcgctcagagtgatctgcagaagaagctatggaacgacgccaaggccgccagcaagcgcttcttccggaagcccgcggccgagaaggcggcttgtgttgactcgcagagttatgccggatatattgcatccggcgaggaggtgacggacggcatcgctgactactcggagatcttcaccatcaccaaggatctcgacctggaggagccgcgcgtccgggcaaagtggccctgccacggtccttgcccctggcctgatgtggaaatgaaggagcccatgatgcgatacgtcgacaatttagggctcgagggcgagaagatcctccagttggccgagtttggtttgggtgttgctcccggtacactcacacagtacacgcgtgatggttggcatcatacaagggtccttcggtaagtcgtcaaacatgatggcttctactcctgtcatgccgccccatccctccactacgggagaggagcgggccgtttgcttatcgtttcacacgagaagttcatacgctaacgctttgttttcacgtcagtttcccaccccgcaacgctaccaatggaaagggcaaggaaggccgaggcatcggctcgcacacggactatggccttctcgtcatcgccgcccaggacgacgttggtggtctcttcatccgccgccctcgggacgacgagaagtttgcaaactggcagaaatccgccgccggccataaggaggacgcagacggatggttctacatcccgcccgtcgaaggggtgcacacagtcatccttggcgatatgatgcagtacctgacgaacaactacctgaccgcgacgccgcacaaggtgggactcaacacccgcgagcgtttcgttatggcttacttccatgagccttctttccaagctgtcatcaagcctatcaacgagggttgcggaggcatgcggaccgcctctgagcaggccgaggagggcgtccattacggtacccacttcaccaacatgttcatgcgcaactatccagatcgcatcaccaccaagaggctgttggcggagaaccgctatgcgaagctgtcg

SEQ ID NO: 26927 - DNA, 1558 bp, Neurospora crassa
atgtcctacccaggctaccctccagcgtcgccttatggccgtaagtggaaaagaaaacagcacctacatagttttgtcttcacgactaatcctagaccatgcagagccaccaccacaaggaggcggatattatcaacagcctcctcctcagcagcatcatcagcaacctccatatggtggacctccgcctcatgctcactacaacacctaccagcaaccacaacaaggatatggacaaccaccgcccgggccgccgccggggcagtacggcgcaccccctccacagccctatggtgctccggctcattccccaccacccgggacgtatggtgctgctcctcccccgagcccctcgtattacccgctcgggcctccaccggccggttacggcgcaccaccgcctcacggttacggacagcctcccggtccgccccctcagcaatcctatggggccgtaccgcccacacccacagcgtacacgccccagccctacgccgtgcagtacccgccgacacccccttcgcccggatatggccctgcgatgaatatcccatggaaccccgacccggacgcggataggctaagaaaagccatgaagggatggggcacggatgaaaaggagctgatccgggttctggccgacaaggaccctttccagatcaatatgctccgcgatgcgtttcaacggcgccaccgccgcgatcttatcgccgacatcaagagcgagacgagcagctggtttgaggaagggctcgtcatgcttgcccggggtcctcttctcaatgacgtgcacatgctgttcaatgccatggatggggcaggcaccaacgaagacatcctaaacgatatcctcctccgccggtccaacgccgacctgaaggccatcaaagccgaatttagtcgagtttgccatcggccactggaggaaatggtgcgcggcgaactgagcatgaagacggaacggcactttatgattgtgctcggtgccacacgtgcagaagattcggctccagtggtgaaggcggacattgaccgcgatgtcgatgatctctacaacgcgacggagggcaagattggcacagacgagatgcgcgtatgcagcattctgagcttgaggaatgacaaccagatccgtgccatttcctacgaatacaggcaaaagtacgccagggatctcgatactgtcatccaaaaggtgagttgactctagcgaaccactgctacaacaaccaaaagccatttagggaacaacagctaacaaccccggcaggagttttcgggacacatgaaagacgcccttctcatccagctacgccacggtactgacaagtacatgctgcaggcccggctcctcgaggatgccatggcaggaatggggacaaaagaccgtctcctcaccagccgtctggtgcgggctcactgggatcgcaacaacatgcgaaacgtgaggaacgcgtacgagcagcgttacaagaagaagctggccaagagagtgcagggggagaccagcggtgattatcagaggcttttgatggcgatttgtggagaacctatttga

SEQ ID NO: 26928 - DNA, 1863 bp, Neurospora crassa
ctcaaaaccaactgtggcgggctgatcgccgacgtgatgggaatgggcaagacccttagtacccttgtcaccatcctacatacattgcaatctgccgttgactttgccgactttacgtttcgtcaagctgaccacaaaacacctacaagagccaccttggttgtagtaccctcacggcgtaggttctaccccaatcgaagtcctgcggttttaagctatagctgattgcgtcttatgaagagctgatcgacaactggcaatccgagattgaacggtaagagtcaaatcattcgcaccgcacttctcgactggcaagctgatgtaaaaccacctctacttctagtcacatgtctggagctctgcacgtcacaatattccatggggaacaaaagcctcggggatacgagactctcatggacacagatctggttctcacgacatactctacactcgcatccgattacaagagaagcggtttgcttcacagaatggagtggtatagggtagttctcgatgaaggtaggtaacattcaacctttttctgtttatccaaaattgcggatttgctgaaatatttcaacattgacatatttgacagcacacgaaatgcttctacacactacttccgagccgctgcaactctcaatactaccagacggtggtgcttgacaggtacacccattcaaaacaagctagaggatctctcatctcttgcggatttccttcggttaccgccttatttggcgaaaaatgctttccgaaagcacgttctggagcccctctccgggggaggcaggtgcaactctgaaccattgcgagcctacctccgttcgtactgtctccgccgaacggataaatgtctcgatgtacccccatcaacgtccaagatcatttatctggctctctctgatcaagaacagtggacttacgatgctattttgagcaggacaaaatggcttttggacgacatcgtcagtggcaaagatacaggtaccctcaagctgtacaatgtactattcactgctatcctgaagatgcgcatgatgtgcaatcatggtactttgaaccctctatgggcctctgcggattaccttacgccacagcacggggaggttgacacgtcgtgtgaacgatgctcatccttagagaatgacgtggactttggggatattcagttctgcccaaactgtcgtcgccctcttcaacctggtagtcatttcgtgaatgcaggagagagtcctgacccaactggcttgttgggcgacgccatcgcagacacaatcgatatcaatagctcgttgcagacagacctgttctcaacgaagcttaaagccgtgagaaagcaagtacttgaagctggaacgggcaccaagcagtaagtattgccatagctcatggaaatttgccggacattggcaacagaactgacgagaacgacccagcctcatattttctcagtggatacccactctatacgggcttgtccacatattcagagacgcaggtgtcgctgcactccttgtgcatggcaaaacaagcatctccgagcgaacgagacttatcaggactttccagggagatcctcaagcgttcatcctaatcatgtctgtgggtacaggggcagtcgggtaagtcacaaaccatgtcttccaggtatcatacattctggatcgctctgctaacgtttgccaaagactgaatctcacagcggcaagtcacgtacatgtcgttgagccgcactggaatccttcagtcgaggctcaggctattgctagggcagttcgcatgggccagacgaaaaatgtccttgtgacaaggtacattatgaaaagaaccgtggaagacgtaagcgacgcatgcgac

SEQ ID NO: 26929 - DNA, 774 bp, Neurospora crassa
cctcacaatccaacacgagaggcaaagctcctgggcctcttaagcaagccatgcatccctttgctcgacacctttcgagactacgagcagcgtctggtcttagtctttccatacatgccgctgactcttgagagcctccgggagcgggcgcctctcaaagacagccaaatccgcatcattttcaaggatgtctttactgctttggcctctttacatagccagggaatcattcaccgcgatgtcaagccttcggctattctccttgaatcccccacagggccagcctacctttccgactttggagcgtcctggcatccgaccctgtcagcagccacggagcccgcagacaacaagatcttggatattggtaccggcccctaccgagcccccgaagtcttgttcgggaatcactcgtatgggcctcctgtcgacatgtggggggcaggcgtgatgcttgccgagtgctgcagaagaggggcgaacaagcacctattcgagtcacgagctgtgcatgaggacgggaatcaactgggtctcattcttagcatattcaagaccattgggtcacctacgagggagagctggcccgaggccgtgagctttaggacgcctccctttgacatctaccgcgagttcgaacgtcgctcatgggacaaaattcttccggatgtaactgaggattggagggaactgataagtggccttgtgaagtatgatagcggaagagctacggcggaacaggtatgtgacctatctccggtgtcaaaccgactc

SEQ ID NO: 26930 - DNA, 2030 bp, Neurospora crassa
gcaaggagaacattgccccgccagatgcagcagagtacgaagcccagaggcggcgcatcgaagagctaaaggccgaggttggcactctcacctaccagatcagcaactacgaacaggaaaaggagttgggacgattgcagatggaaaacgaaatgcgcgatatccgtcgacaagctgagcaggattttaaagcaaaacaagccgccgatgccgaaaagtccaaggcgctgcgacatgctgagtcgctgcaagccgagttggacgccctacgagccgaaaaggaaacccaaaaacgagaactcaatgcgaagacaagggaaacacaggaagaggcaagactacttcgagaacaagtcgaggagttgaaggctgctaaggaggaagcagcacggctagcggagcgggaaatcaccgaattaaaggcgaaggtaactgtgttggaaaggaccgcgcaagagacagaggaggagaacagaacactaaaggataccctcgaaaaagtcaatgcccaactggcagagcgagacgacacaataggcaaactcgatgccgaggttcttcgactcaaagctcacacaggcgatgccgagacagtgtccgtgatccgcagggaactttcggaccaagtgaatcacattcggatgctcgagtctaagaaccgtgagcaaataacagagctcaaacacttgcgacaggtttacaaggccgtggaggtagtcgaggaagagaaacggactctacagaggaagttggaagcagcacaaactctggagaccgagctggccgaggaacgaaggcaacgcctcaggctagaggatgaaaggagatcatggaccgcatacttggagtcgaattcagagggtcccgtcgagttcgactcaccggaagccgtagcaagggcattggtggaggagcgtttccgctccgcctcgctgaccgagcggttgggtgctctccagccggagattgccgaccgtgataacatcatcaagtcactggaggatgaaaaggccagacttctcgagcagattgagaaacttcgggcaagcagcggtccttctgctaacgacaaggcccgcgcccgtctagaccggcaacgcgccctcgccgtcaaggaggtggagtacctacgcgcccaactcaagacctttgacatggaagacgtcaccatgcaacccgagcagctagacgagcaaaaagccaagcggatccaagagcttgaggacctcgtcgacaagtacaaagaagaggttaacaccctccacgccgacttgacctccctcgaatccgccagcaccagccccgtccaacccgtactggccggcaccaaacggccccgcgatgaccacgacggcgccgagtccgaacaactcggccaactcgcccgcaagaaccgcaagctccaatccgagttctccgacctgcaaaccgcccaccgcatcctccaaaaggagcacgaagtaaccacctcccagctcgccgccgccaaggaacaactcaaaacccgcatcctctcgctgcgcgacaacccaacctcggaatacgaaaagatcaagaccgacacccttaaagccctcaagctcgagaacgccgagctgctcgcccacctcgagcgccaaccgactctcttcgcgaccgtccccgccacccaaatcgccgcgctcaaacgcgaaatatccgccgcgcaagccgagacggcctcggcccagaaacgcgccgaccgcctaaaacaagtgtgggcagccaagtctgccgagttcaaagaggccgtgttcagcaccctggggtggaccgtgacgttcatccccggaggcaagatgcgggtggaaagtgtttattacccttccaagacggaggagcacgagaacagcatcgttttcgatggcgagaagggcacgatgaaggtgggcggaggaccgaggagcgagtttgccaacaggatcgcggataatatccggttttgggtcagggagaagggagaggtgccgtgctttctggcggccttgacgttggagttttatgaggaaatg

SEQ ID NO: 26931 - DNA, 1667 bp, Neurospora crassa
gacgacggcggcgacttccgcgccatcgaccctcactcgggcgtcaagcgcggcctcaagactcgacacttatccatgatggccctggccggcatcatcggccccggtcttcttgtcggatccggcggtgctctacattccggcggccctgcgtcgctgcttattggttttggagtcattggcctcattgccttttccatcatgcagagtctgggcgagctgacgacgctgtaccccagcggaggcgcgttcacggatctcggggacaggtttattgataaggcgtttggtgtggcggtcgggtggaattatcttatcagtcagtttctgttgtcgttatgcgagttgacgtttcttttgctgactttgtgtggtttagtttgggtttgtgtcctggcgaatgagtataatgtgatttcgagcgtcatggtggattggagcgataaagtcccgctttgggggtactttttgatattttgggtcagttttatatctctgtcaagcaggcatatagtgaaagaccgagtttagggtggttgctaacatggcagacagttcgcatttttgggcttccaactcctcggtgtcgagacattcggtgaagccgagttctggctggcgcttatcaagcttatgggactggtggcctacttcatctttagcattgtgttagtttgcgaccctccaacatgtctatgtctacggacttgtactgaccccaaaatagttacgtctccggaggcgtcaaaggcgccgacgccatcggcttcaagtactggcgtgaccccggccccttcgccgatggcttccgtggcgtcgcctccgtcttcgtcttttgctccaccttctacgctggcgtcgaatctgtcgccgtagccgccaccgagaccaaaaacccgggtgtcgccgtcccgcactccatccgccaagtcttcatccgcatcgtcgtcgtctacatgggctgcgccttcttcttcggtttgacctgcccgtcgaacgcccccgatctctccggcggtgccagccatgccctcaagtcgcccatgaccatcgctcttcacaacgccggctgggcaaacggcacccacctgatcaacgccttcatcttcgtcacctgcttgagcgccgtcaacagctccatttacatcggcagccgcaccctcttgtacatggcgcaggacggaaaggcaccccggttcctcggctggacggatcgtcgtggcgttcctgtttacgccatcatcttcaccaatgcgtgcggagccctctcgatgatgaacgtcagcacgggcgcaagcaaggcgtatgggtacattatcaacctaagtggtgtctcgacctttttggtctggggcgccatcagtctgattcacatccgcttccgcgccgcttggaaggcgcagggacacagcccggaggaactgccgtacaagtccttgtggtacccatggaatgcctactttggcctgatttccaatgtctttttggcttttgtgcagggctggtcgacgttggctccgtttgacgcgggcaatttcgtggatgcttacatcctgttgccgttgtttcctgtgatttactttgtgtacaagttcacgttcaagacgcggctatggcggccgcatgaggttgatcttcaggcgggcaggcgtcgggatcttgatgag

SEQ ID NO: 26932 - DNA, 2250 bp, Neurospora crassa
tactaggaccccaaatccaccgaactcaacaagttctcggaccttcccctttgcgaacctaccgcctctggactacgcgcatcccatttcgaggtcctaaccgatgtccaacgcgccgccatccctctcgcgctcaaagggcaagatatcctcggcgctgctaggacaggtagcggcaagaccctcgccttccttgttcccgtcctcgagaagctataccgtgcacgatggactgagtacgacggtctcggtgccctcattatcagcccgacccgtgaattggccgtccaaatatttgaagttctcaggaagattggtcgcaaccacagcttttcggcaggcttggtcattggtggaaagagcttgaaggaggaggcggagcgtcttgggcgcatgaatatcctcgtctgcacacctggccgtatgctgcagcatctcgaccaaacggccggcttcgatgtcgacaacctccagatgctcgtgcttgatgaggccgaccgcatcatggacatgggtttccaacaggccgttgacgctcttgttgagcatcttcccaagagcaggcagaccctgctgtttagcgccacacaaagcaagcgtgtctcggaccttgcccggttgagcttgaaggaccccgaatacgtctctgttcacgaagccgcagcatcggcgacccccgtcggcctccaacagcattacatcgtcacacctctccctgagaagctcgacacgctatggggcttcctacgaacgaacctcaagagcaagattattgtgtttatgtcctccggcaagcaggtcagattcgtctacgaaagttttaagcggatgcagcccggtattccactactacatttgcatggtcgccaaaaacaaatagcacgtctcgagatcacgaaccggttcacgtccgcgaaatactcctgcctcttcgccaccgatgtcgtggccagaggtgtcgatttccccgccgttgactgggtcatccaggtcgattgccctgaagatgccgacacctacatccatcgcgtcggcagaacggcgcgttacgagagcaagggccgcgccgtcttgttcctcgaccccagcgaagaagagggtttccttaagcgtctcgagcacaagaaggtgaccgtccagaaagtgaacgtcaaagaaaacaagaagaagagcatcaagaacgaactacagtcacagtgtttccagtcacccgatctcaaatacctcggacagaaggctttcgtctcgtacgtccgttcgatttacctgcaaaaggataaggaggtgttcaagttcgacaaactcgacctcgacggttttgcttccagcctgggtctcccaggtactccacagatcagataccagaagggcgaggacgtcaagaagctcaagaatgcctcgcgcgccgccatgtccagcgggtccgacaccgaaggctcggacggcgagatccgcaagaagaagaaggaggtcaggacaaagtacgacaagatggccgagcgtcaaaaccaggacgtcttgtcgacgcattaccgcaagcttctcggagaagatcaggcagaagacaacgaggaagacgacttcctctcggtcaagcgcgtgctggacgacgatgccgccctcgacgacgccgccggcaatgccaagtccggcaccaaccccgacggcacggccaaggtggtcaagctgggcaagaacgccgagttggtcatcgactcgcaccgtcgcgagaagctgctcaagtccaagaagaagctgctcaagtacatggagaagggccagaagcttgtgtttgacgacgaaggaaacgcccacccgctctaccagctgcaagacgaggaggacttccagaaggagggcgacgccaaggagctcaggcagaagttcgtcgagagcgaagccaccaaggtcaaggagcaggatgtcgaagacaagctgctggccaagcagcggaggaaggagaagagggagcgcgccaaggcaagggagaggggagaggaggtcgagagggagaagggtcccctgcagccggcgctgctggacgcgcacagcgatgtggaggaggatcctttggctttgctcagaagtttgcctgttgctggcaagggcggtgacagcggtgacgagagcgaggacgatagggaaccgcctaagaagaaggctaagaagtggttccagaaggatgactcggatacggagtatagcgatgacggcaggccgaggaggaagaaggctaagatggagggcggc

SEQ ID NO: 26933 - DNA, 1506 bp, Neurospora crassa
gacgtccctccagatggtgggtacggatgggtgattgtggcggcagtgtttctcatcaacgtcaacacctggggcatcaacagcgcctggggaatcttcatggagcagtatatccgcgagaacacctttccggaagccagccatttcgagtacgccctcgtcggaggtttgtccgtctcgctggccctgatcttgggaccgattattagtgctatccagaaaacgttgggcaccaggtatacgatggtgctggggtcgttgatgatttttggtggtcttttctctgcgtcggcggccagtcgggtatggcatcttttcatgagcgtggggctttgtatgggatttgggtttgggctgctttatatcccggtgagttgccgttcctctacggatattttgaaaaaaaaaaaaaaaaaaaaaaaaaaaaaaaaaaaaaaaaaaaaaaaaactgggtgagtggcttacaatgaacacacaaacaggcaatgggactcctccccccatggttctcacgccaccgaagcctggctctcggccttgcaacggcgggagcaggcggtggcatcgcatggaacctcatcactggcaaactcctttccgtttcgggactgaaatggacctggcggattcttgcccttgtctccattgcttttaacattctttgcgcctttctctgccgcgagcggcctattagctcttccacggggtcgttgaaacgccgatccttcaacatccgtgattttggccggacccaggtccttcttattcttctgtggggtttcataaccgaattcggctacgtctccctctggtactctctcccgagctatgcaaccagtatcggtctcactccatcccaaggatccgtggtaaatgccatgttgagtttgggagtaggcgttgggcgcccgcttgttgggtaagtgagctctctaactaacactgtctcgctatctattgctcctcaacgtcaatttccggcagtctgctaattctcctattacttcactagcgccctcagcgaccgcttcggccgcatcaacctcgccctcttctgctgctcttcatgcgccatcctctgcctaaccctctggattctcgcccgctcgtacgccggcttgatcatctttgccttggccgcaggcgctggaggtggttgtttctggtctacagtgaatcctatcctggcggaaaccgtcagtctcgccgaaagtagtgccatttttggcactatctgcttcgccttggtaattcctaccacctttggcgaagccattgcgctgcagctggtcaagggtggagacggcataaacaagttcattccgagccagatctttgtcggttgtacgttcctagggggtaccgctttactcatgctccttcgaagctggcagatttgcgaaattgagaggaaaagtgagggcatggggagtggtcaacatgagcagggccataagaggtctggagaagaaagccgaacggaggaggatttggagcaaggggtta

SEQ ID NO: 26934 - DNA, 1672 bp, Neurospora crassa
gtcatcgccacacaagctatcgcaaatgtcgtcaagagctccttcggccccagcggtctcgacaagatgatggtcgatgacattggtgtaagttgcttctcccccgcccctatcgccgaaagctgagtgaaccccgccatgcctaacactgtttgcgcaggatgttacggttacaaacgatggcgctactatcctcagcttgctcgacgtcgagcaccccgccggcaagatcctcgtcgaccttgcgcaccaacaagataaggaggttggcgatggcacaacatcagtcgtcctgattgcggccgagctgctcaagagaggaaacgacttgatgaagaaccggatacaccccacaaccatcatcaccggctaccgtctggccctcagggaggcggtcaagtacatgaaagagcacatcagcatcaaggtcgagaacctcggtcgcgagtccctcctcagcatcgccaagacctccatgtccagcaagatcatcggcgccgattccgacttcttcgccaacatggttgttgacgccatccaggccgtcaagaccaccaacaacaagaacgagaccaagtaccccgtcaaggcggtcaacattctcaaggcccacggcaagggcgttaccgagtcgatgctcatcaagggctatgccctcaactgcactgtcgcctcccaggctatgaccacccgtgtgacagacgccaagattgcttgcttggatatcaaccttcagaaggagaggatgaagcttggtgttcagattacagtcgatgatccccagcagctcgaggccatccgcgcgcgtgagtccggcatgatcattgagcgcgtcgagatgattcttaaggcgggcgcaaacgtcattctgacgacaaagggtattgatgacatggttctcaagcttttcgttgaaaagggcgccatggctgtgcgccgctgcaagaaggaggatcttcgtcgcatcgcccgtgccaccggcgccaccctcctcagcactctttccgatctcaatggcgacgagaagttcgagccctcttacctgggtcacgccgaggaggttgtgcaggagcgcatttccgacgacgagtgcatcttgatcaagggtaccaaggttcactcttcggcttccatcattctccgtggccccaacgacttcaccctcgacgagatggagcgctcggttcacgacagcttgtgcgccgtcaagcgtaccttggagagcggcagcattgtgcccggtggtggcgcggtcgagacggctctgcacatctacctggaggagtacgccggtactgtcggttccagggagcagctcgccatcggtgagtttgcccaatcgctactcgttattcccaagaccttggccgtcaacgccgccaaggacgcctccgagcttgtcgcccaactacgatcgaggcacgctctgtcgcagcgcatccaagagggtgaggcgaacgaggacgagaagattgttgcccgcaagaaggcctacaagaactacggtcttgacctgatgaagggcaaggttgtggacgagatcaaggccggcgttatggagcccagcatgagcaagatcacgcaactgaagagtgcggtagaagcatgcatcagcatcatgcgtatcgataccctcatcaaactcgaccctgaacagagggccgaggatgat

SEQ ID NO: 26935 - DNA, 1357 bp, Neurospora crassa
cttgacgacatctcgcatcgtcgctacaacccgctcaacggctcttggctgcttgtatcgcctcacagaacaaagaggccatggcagtgagtcctcgatagccacaccggaaataaagaaatacagcgggttagtttgaattgacgagttgcaatcagaggacagcaagaggctccagccctcaacaagcttcctgagtatgatccccaggtgcgtaatccccgtcccttcatgactttatattactctcactcactctaactgcaacccagtgctacctttgccccggcaacaagcgcgcccaaggcgactccaacccgcactacaaaaacacattcgccttcgtcaacgactacagcgccgtcaaagaggaacagcaagagtaccaccctcggaaggacgccgctggtgacggcgacgatgacattgcctctctcctcctgcaagcgcagcccgccaccggccggtgctacgtgctcaccttctccgccaagcacgacaccactttggcggacatgagcgcgaccgagatcgtacccgtgatcgagacctggacgcgcatctacgccagccacctgtctgcctcgcatccgctcagggacgccgccgcgcgttcactcagcgagattccacctaacccggacggcgaagtcgagcccgcgaaaaagcagcagctgcggtacatgcagatctttgagaacaagggcgcggccatgggctgctcgaacccgcatccgcactgccagatctggacgacgagcacgctgcccgaggagccgggcaaggagctggcgcagatgaccaagtaccaccgtgagcacaaggggaggcatctgctggaggactacgtcaaggtggagatggccaagggcgagcgtgtggtttggcagaacgacgggttcttggtcgtctgcccttggtgggctgtctggccgtttgaggtgctcgtcattgcgaagagacatgtgcgcgcgctggtggagcttacgagcgaggagaggctgcagtttgccgaggcggtgcaggaggttacgagaagatatgataacttgttcgagacaaactttccgtatagtaagttctactaccctctgcaactgcccgaaggagagagaaagggagaaaggagctaacggtatgagaaggctcgggtattcatcaggcgccgttggattgcacagaggaagaggctgagacgagctggttccatatgcatttctaccctccacttcttcggtctgctaccgtgcgcaagttcttggtcggatacgagttaatggctgagccgcagagggatatcactccggagcaagcggctgcgcgactcagagactgcggtggtgagctctatcgcaag

SEQ ID NO: 26936 - DNA, 846 bp, Neurospora crassa
aagtatggcaagaagggcacctgggctgttatcactggtgcctccgatggtctcggaaaggagttcgcccagcagctcgcctccaagggcttcaacctcgttctcgtctctcgcactcagtccaagctggacgtccttgctagggagctcgagctcagatgggatggtttcaaggccaagactttcgccatggacttctccaaggacgacgattccgactacgagcgtctcgccgagctcatcaagggcctcgacattggtatcttgatcaacaacgttggccagtcccacagcatccccgttcctttcctccagaccgaccgcgacgagctccagaacattgtcaccatcaactgcctcggcacactcaagaccaccaaggttgtcgctcccatcctcgcccagcgcaagaagggtcttatccttaccatgggctctttcgccggtgttatgcccaccccctaccttgccacctacagcggcagcaaggcgttcctccagcactggagcagcgctctctctgccgagctcaaggaccagggcgtcgatgtccaccttgttgtcagctacctcgttaccactgccatgagcaagatccgccgcaccagcctcctcatccccaaccccaagcagttcgtccgcgctgctctcggcaaggttggcctcaacagctccgagccctttcctaacacctacaccccctggtggagccatgctgtgttcaagtgggttgttgagaacactgtcggtgcctacagctactttaccctcaggctgaacaagaacatgcacatcgacatccgcaaccgcgctctccgcaaggccgctcgtgaagccaagaagcag

SEQ ID NO: 26937 - DNA, 1743 bp, Neurospora crassa
cagcagcaacttccccatcaccgacgtgaaggagcagaagaccaagaggatggacacgccgccgccgccgctgctgacctcgtaaccaccaccgaatcccgctcactcacccgcggcctcgcccagcgccacctctccatgctcggcatcgccggctccatcggcaccggtctgttcctggggctcggcggtgccgtcgcgcgcggcggtcctctcggtgcgctgctgggctactttgtcatcggcctgattgtgtgcgcggtgcagttcgccttgggggaagtcgcgtccctgttgccggtaacgggcagcttcgtgcgccacgccgagttcctggtcgacccggcctgggggttcgcgattggctggaatctggtgtatggcaatgtcttgtccatcccgagcgagatcacggcgatttgtgtcttgtttgagtactggacggagggccgcgtcagcccggccgtgtttattgtcttttttgtggtggtgacggtcggggtggggatggcgctcgtgcgggtgtttggggaggtggagtttgtttttgcaatgctcaaggtggtgttggtggtgtttttgatcttgctggggctggtgattgatttgggggggatcccgggaacggagaggatcgggtttcggtattggaagagtccggggccgtttgtggagtatattgccacgggagattgggggaggtttttggggttttggagcgtcatgacgggggcggtgttctcgtttgcgggcgtggagagtctggcgatggcggcggcggagacgaggaacccccggaaggcgataccgagggcttgcaagcgcgtgtttgcgagggtggtgctgttttatatgctggcggtgctggtggttggtatgttggtggcgagcgatgatccgaggctcgatggtagcggtgatagcgtcgcgcagagcccgttcgtgatcgcggcttcggcggcgggcatcaaggcgattccatcggtggtcaacgccatcgtgattacttccgcgtggtctgcgtctaaccagagcttgttggcgggcacgagggtcttgtatggactggcgctgaagggacaagctcccaagatcttcttgcggactacgtcgtggggaacgccgtacatgtgtgtactcctgtttggagttttcatgtctctgagcttcatgagtctctcggagcgcgctatcaacgtgttctggtggttggtacggctgacctcggcgggagtattggtgtcttggtcatccatcttggtgaatcatatccgcttgagaaaggcaatggacaggcagggcattgcatataccaggctgccgtggtccagctggtggactggtaagttgttgtcgtcaaagctagattccagatctgagactgatcactttcccggttatagtctacagctcgccggtagccctgttcatgtgcatcgtcattctcctaacaggaggcttcagcgtttttaccaagggtaactgggatgccgctacatttgtctcctcatacttgtaagttcaccaacatcaatcagactatagtcgcaaggatactaacgaatgactagggacattccgatcgtcctcatcgcctacctggcttggaagttttacaagaagaccaagatcgtgtccctggatgacgtcccccttgatattgcattcgagcaagccgaagacgccattttcgaggaccccgaagaagggaagactaaagggtgggcacgggttgtgagttgg

SEQ ID NO: 26938 - DNA, 942 bp, Neurospora crassa
ctcctcacctccatcgccgccacctccactgccctccgcgccgcccaagacgtctccctcgccggttcctctaactcctttggcgacgaccaactcaacgtcgacgtgctcgccgaagaagccatccggctctgtctcgcccaatgtccttccgtcgtcaccgcctccagcgaagaggaccccattgagaaaccggtgcagcacaccggtcttccctttcaggtcgtcgaggccgagcaggatcgcacccacggcgaggtctacacggtcgcgtttgacccgcttgatgggtcctctattattgcgccgaactggactgtcggaacgattttctcgctgtgggatggcacgtcagcgctgggcgctagtccgagggacaagcagatcggggcggtgttgggtgtttatggaccgagaaccacagcggttgttgcgttgagattcccaggggaggagaagggcgtttgttttgaggtggggttgtcggattcaagcgaggcagggaaagggcaagaatgggatctcatccgcccctctgtctcttacgcgccgccgcctttcaaaacgcggtatttcgccccggcgaacttgcgctcgaccaacacgcacgcggcttatgccaagctggtggcgcattacatggcggagaactacacgctgagatactgcggcggactcgtaccggatgtagtgcacgcgctggttaaagggcatggagtgtatctgagcccagtgacggagacgagcaaggctaagttgaggagtctgtatgagctgttcccgctggcgctggtggtggagtgctgcggtggacgggcggtagatccggtgagcggggagaatatcttgggggataagggagtggaggggtgtgatgagcgtggtggtattgtgtgcggaacagcggaggaggttgaatatgctaaggaggtgctgtgcggt

SEQ ID NO: 26939 - DNA, 942 bp, Neurospora crassa; identical to SEQ ID NO: 26938

SEQ ID NO: 26940 - DNA, 1322 bp, Neurospora crassa
ggaatcgtcgacgccctctgcgaagcttgcgaacgactcggatacaagaacccgactcccattcaagaacagtcgattcccctcgcccttcaaaaccgcgatatcattggtattgccgagactggttccggaaaaacagcagcctttgccctccccatcctacaagcgctcctcgacaagccggcccctctgttcgccctcgtccttgcgcccacaagagaacttgcagcccagatcgcccaagccttcgaagcgctcggtagcttgatctcgctaagatgcgctctgattttgggtggtatggacatggtaacacaggcaattgctctcggcaagaagccccacgttattgttgcgactcccggtagactactcgaccacctggagaagaccaagggcttcagtctgcgttccatgcagtacctggtcatggacgaagccgaccgtctgctcgacatggatttcggcccaattctcgaaaagattctcaagttccttccccgcgagcgccggacgttcctcttctccgccaccatgtccagcaaggtcgagtctttgcagcgcgcctcgttgcgggaccccctcaaggtcagcgtatcctccaacaagtacgcgaccgtctcgacgctcaagtccaactacgtcttcatcccgcacatgcacaaggacacctacctggtctacctctgcaacgagttcgccggccagaccatcatcatcttcaccagaaccgtgctagaaacccagcgcattgcgatcctgctccgcaccctcggtatgggtgccatccctctacacggtggcctctcgcagtctgctcgtctcggtgccctgaacaagttccgcgccggttcccgtgagatccttgtggctaccgatgttgctgcccgtggtctcgatattcctaacgtcgactgcgtcatcaaccatgatcttcctcaggactccaaaacctatgtccatcgtgtcggtcgtactgctcgtgcgggcaagtctggtcatgctatcagcattgtcacacaatagtaagtttcacaccctgttccgccttatctcatcgagaacggtgagcctaaccatgatgtagtgatctcgaaatttggctccgaatcgaagctgctctcggccacaagcttgatgagtatcctttggagaaggacgaggttatggtgttcaagccccgcgtcgaggaggcgcaacgccatgccaggaacgagatgaagtcgttgatggagaatcagggcaagcacggtggcttgctgaagaggaagcgcggaaacggccagggtggcggccgtgatcatatggatgctgaggagggt

SEQ ID NO: 26941 - DNA, 957 bp, Neurospora crassa
cttacaactgtcaacagcagcaagactcacaagctcaacacgggcgacgagatccccgccgttggcctcggaacctggcagtccaagcctggtcaggtcgagaaggccgtcgaggccgccctacgtgccggctatactcacatcgacaccgcgtatgcctacggcaacgagaaggaggttggccaaggcatcaaggcctccggcgtcccacgcgagaagatctggctcaccaccaagctggacaacgactggcacaagcatgtcgccgaggctatcgatacgtcgctcaagaacctggacaccccctacgttgacctctacctgatgcactggcccgccagtcttgtcaaggggaacaccaaggaggtgtacaacgactgggactttgtggacacctggcgcgagatgcagaagctggttgacaccggcaaggtcaagaacattggtgtcagcaactttggcgtcaagaacctggagaagcttttgagcgccgagagcaccaaggtaagcaagattgtgctcctcctcctcttcaagttttgttgtgaattgatgaggacctcacacatataattacagattgttcccgccgttaaccagatcgaacttcatcctggtaacccgtccccccaccttgtcgagtatctgcgctcgaagggcattcatgcttcggcctattcgcccctcggtagcagcgactcgccgctttacaagcttaacagcctcaccaagctcgccgagtccaagggcaagactgtgcagcaggttctccttagatggggtgtccagaagggctggagtgtgctgcctaagagcgtcactgaggagcgtatcaaggccaacattgatctcgagggctggagcttgaccgatgaggagattgctcagattgatgaggttcacaaggagaacagcttcaaggtctgcggcgatgactggttgcctgtcaagatcttc

SEQ ID NO: 26942 - DNA, 456 bp, Neurospora crassa
ccctatttttcttccccctccgtccaggaattcgcagactgcaccaccgccccaccccctggcatttccatcaccctcccctctgacgccgacctacacacctggcacgtcaccgtcacggcgccgcccaactccgtctacgcccccggtcgcttcggcctcatcctcaagcttcccaccgattaccccttcaagcctccgaccatcaacttcacgacgcgcatctaccaccccaacatcaccaacgactcgctggggaacatctgcctgggcctgctgaaatccgagaactggaagcccgcgagcaagatcatcagcgtgttggaggctgtgcgcaacattctcgtcgaaccgatgcccgacgacgcgctcgagcagcgcattgcggatgagtatcggagggatcggcccgagtttgagaagaatgcgagggcgtatgtggagaggtatgcaaag

SEQ ID NO: 26943 - DNA, 885 bp, Neurospora crassa
cccaagtgcgccaacccgaaatgtccaaagcccaatgtcgtcgacggaacctgccagacttgtggtatggtcgctgatgacagcaacattgtctcggaaatcacattcggtgaatcttcttctggtgctgccgttgttcacggtactcatgtcgcctttgatcaaggcgggattcgcggcgttggtggtcttgcattccgccgtgtcgctggcggtggtgcttctgaagcccgtgaacgaagtcttcgcgaggtcaaggctcttatgcaacagtactcctaccagctcagaatcggacaaagtatcagcgatattgctttccgctactacaaagcctgctcccacgccaacttcgtccagggtcgccgtaagcaaaatgtggccgccatctgcttgtacgccgcttgcagagcggaaaataaccacaagattatgctcatagacttggctgatctcctccataccgacgttttcgctcttggtcgtggctacaaggacttcctcaaccggtttcctgaatttctcacaggccctcggcccatcgtgatcgaggatctcatttaccgttttgcttccaaactggagtttctgcacgacaccaacaaagtagccttatccgctgtccgtattgcgaagcgcatgcaacacgacaacatcacgcatggtcgtaggcctgctggtatctgcggtgcggctctcatcatggccgccagagctcacaactatcgccgtacggtcagagaagttgtctacatcgtcaaggtcacaatggccaccattcaggagcgaatggacgagtttgccagcgtacccgctgcccagatgactgtacaagacttcgacaacgaggacctcttgaaagcggctccagagcacgatcccccc

SEQ ID NO: 26944 - DNA, 1543 bp, Neurospora crassa
attaacaaagccattcaggacattggaatggggaggtacaactggcaactatttgtcttatgcggttttggctggtttgccgacaagtatgaggccccttttcaaaatccgctgaatcaatccgttgttaactccagtttcacacagtttgtggatgcaaggcatctctctcaccctcccatcactatcagccgagttcgacatatcagagaagaccgttcgctacaccacgtcttttctattcgccggtctctgtgttggcagcttcatctgggggatcgggtccgatgtcctaggtcgacgcctcgccttcaacgcaactctgtttatcaccgccatcttcggcatcgcctctgcttttgcaacaagctgggctggtgtttgttttctctacgcagctcttggctttggcgttggcggcaatttgcccgttgatggggccctctttctcgaattcttgcctgacgcctccagctccctgctgacacttctctctgtctggtggcccatcggccaactttgctcatcactgctggcctggtatttcatcggccacttgcccgccgagcaaggatggcgacattttgtgttcagcatcggcatcatcaccttgatcatgttcctcgtccgcttcttcattttccacctatacgagtctcccaagttcctcctctcaagcggccgacaagccgaggcagtggccgtcgtccacggaatcgccttccgcaacggtcgtaagacgtggctaactgaggagattctcgatgctgttgtcgatggactatcatccctatccccagctactcctcgacgccgccagcatgtgacccgacaacgactatcaaccgccaacatcatcaagcagcgcttcgcctctttctcaagcaatcgtctccgcccactcttcagcagtcgcaaactcggtctgactaccgtcctgatttggttctgctgggcgaccattggcatgggataccccttattcaacgcctttctcccacaatatctatcccacggcggcaacaacggcgggcaacaaccagcaccggaaacaagcactagcatagacagtccagaaaccatctcagccgaaacctaccgcaactacgccataacctccatcgcaggagttccgggtagcctgctcgccgcctacgctgtggacatgaaatcgcccttcttcggtcgtcgtggaaccctcgctctctcaacgctcgtctccgctatcttcctgtatctgttcatcaagttcggtaccacatcggctgccctcctcacgttctcgtgtattgaggcgttcgcgcagaacatcatgtatggcgtcctgtacgctttcacgcccgagatctttccggcaccggtccggggggcgggcacgggcgtggcgagttttttgaacagagtgacgggcttagtagcaccaattttggcggcgacggtgccgggcgatggtaggaccacgccggtgtatctgtcggcggcgctgattctggcggcgtttgtgggaatggtgttgattcctattgagacgaggggtaggcag

SEQ ID NO: 26945 - DNA, 1060 bp, Neurospora crassa
gtagaaaagtacagaccagttttccttgacgatgtggtcggcaacacagaaacgatcgagcgcctcaagattatcgcaaaggagggcaacatgccccattttattatttcaggcatgcctggtatcggcaagacgacgagtgttttgtgtctggcaaggcaattactaggtgatgcgtacaaggaggcggtactggagttgaatgccagtgacgagcgaggttagaaaaggacaagagcatccagctctgtggctatgagctacgccaaacaacacaaaaacccccccatactgacataccaacccaaaaaaacaaacaggcattgaagtagtccgccagcgcattaaaggcttcgcccagaagaaagtcaccctccccccaggtcggcacaagatcgtaatcctcgacgaagccgacagcatgacctcgggcgcccaacaagcgcttcgccgcacaatggaaatctactccaacaccacgcgctttgccttcgcctgcaaccaatccaacaagatcatcgaacctctgcaatcccgctgcgcaatcctgcgcttcgccaagctcaccgacgcgcaagtcgtcaaacgcctgctgcaaatcatcgaagccgaaaaagtcgagtacagcgacgacggcctggccgcgctggtcttcagcgccgagggagacatgcggcaggcgattaataacctgcaatctacacacgccggcttcggcttcgtgagcggggataatgtctttaaagttgtggatagcccgcacccgatcaaggtgcaggcgatgctcaaggcctgctacgagggtaatgttgatgcggctctggacgggctgcgggagctgtgggacctggggtattccagtcatgatattatcagcaccatgttcaaggtcacaaagacgattccgacgctgagcgagcacgctaagctcgagtttatcaaggagattgggtttacgcatatgaagattttggagggcgtccagacactgttgcagttgagcgggtgcgtggcgaggttatgtaagttgaacatggatccgaagaagtttgcggtaccg

SEQ ID NO: 26946 - DNA, 1342 bp, Neurospora crassa
ggctccatccccgcggccaagaagaagtatgtccctacttctggcacctatcccttgggcttctcggcttccggcatcaacgtaggcgtcaagcccaagaacaccaccaagcccgatgtttgccttgtcgcttcggaccgtccctgcgccgccgccgccgtcttcaccaagaacaagttccaggccgcccccgttactttcagtcgtagcttgttacagaagaagggcaaccagggtattcaaggtgtcgttgtcaactcgggatgcgccaacgccgtcactggtaagggaggcttggaggatgccggcaagatggcccaggccgccgatgagtgctttggccagagcgagagcactctcgttatgagcactggtgttatcggtcagcgtctgcccatcgaaaagatcaccagcaatatcccccgggctcacaaggccatgggctctacccacgatcactggctcacggctgccaaggctatctgcaccaccgacactttccccaagctcatctcccggtccttcaagcttccctcctctccttcagtcgagtaccgcatcgccggcatgaccaagggagctggtatgattcatcccaacatggctaccctccttggtatcatcgccaccgatgctcccgtttcctccaccgtactacccgccgttctcaagcacgccgtcgaccgttcgttcaacagcatcacgatcgatggcgacacttccaccaacgacaccgttgccctgcttgccaatggtgctgctggcggaaaggaagtcgttgccaacactcccgactacgatgccttccagactgtcctgaccgatttctctaccgaccttgccaagctgatcgtccgtgatggcgagggtgccaccaagtttgttactatccgcgttgtcgaagctgctagcgaggaggccgctaggaaaattgccagcaccattgcccgttctcccctggtgaagactgctctctacggcaaggatgccaactggtaagttgcggaaaattatcccatgcgtttcggcagctactgacgttgtcattaggggccgtatcctctgcgctactggttactcccttgtttctgagcccggccttcccgtcaacgatgtttctgaggttgtccctgaaaagaccaatgtttctttcatccccactgacggcactgctgagctgaagttgctcgtcaacggcgaacccgagcaggttgatgaggctcgtgctgctgagatcctcgagcttgaggaccttgagatccttgtcagactcggaactggtgacaagcaggctacctactggacttgcgactacagccacgagtacatgtaagttgatccg

SEQ ID NO: 26947 - DNA, 773 bp, Neurospora crassa
atgagcaccgaacagcccgcgccccgctgggccgcctttgcacgcgacaccaacgagaccaagatccagatcgcactcaaccttgatggcggcgcattccctcccgagaccgacgcccgcttgaacgtcagtatcgccgacggccatgccactcaggctagcaaatcgcaaactatcagcgtcaataccggcattggtttccttgaccacatgctccatgcgcttgccaagcatgccggctggagtcttgcgcttgcttgcaagggcgaccttcacagttagtagacacacttggcttgggcgcagaagtcctcgtggaacaacatccagaactctgaattgactttgtccctctcatagtcgacgaccaccataccgccgaagacgtctgcatcgctcttggttacgcctttgccaaggctctcggcacacccaccggcctcgcgcgcttcggatccgcatactgccctctcgacgaggccctcagccgtgccgtcgtcgatctgtcgaaccgtccctttgccgttgtcgacctcggtcttaagcgcgagaagattggcgatctcagcaccgagatgatcccccactgtatccatagctttgccggggctgcccgcattaccgtgcacgtcgactgcctccgcggcgacaacgaccaccacagagctgagagcgcattcaaggcgcttgcggttgccacgaggcaggctactagccgggtggcgggtcgcgagggtgaagttcctagcaccaagggaacgctcagcgtataa

SEQ ID NO: 26948 - DNA, 3851 bp, Neurospora crassa
gactttaagtcctacaagggccaccacaccctcctgttcggcgactcctacttcacctccatcatcggtcctaatggctcgggaaagtcaaattcgtaagttgcaccgggttgcggtcgctagggactgctttcatattgacgggcgcgcgccttgctaggatggatgccatctccttcgtcttgggcatcaaatcgtcacacctccgatcgacccatctccgagacctggtctatcgtggccgtgttatgaaaacctcgaaaatccaagaagatggcaccgctgcccccgctactaacggcgtcaatgggcacgaagacggcgaagacgaagacccttcccaacggtcatcgaggaacgaccccaagacggcttgggtcatggccgtctacgaagacgatgctggcgacgagcaacggtggaagcgaaccattacaaacagtggatccagcgagtaccgcatcaacgatagagtggttaccgcccagcaatacaacgatgcgcttgaggctgaaaatatcctgatcaaggcgcgtaacttcctggttttccagggagacgttgaggccattgcctcgcagtcgcctcaagatcttacacgcttgatcgaacagatatccggaagtcttgaatacaaggccgattatgagaagttgcaggccgaggtcgagcaggctgctgagaaccagaatttccagctgcaccggagaagaggcatcaactcggaaatcaagcagtatcaggaacaaaagaaagaggccgaaaacttccaacggaaaaccgaagaacgagatgaggccgtcattacccatatcctgtggaagctatatcactttcagaaggtcatggacgagtctagcgcgcaaatccaggagcaccaggaaaaccttaaagagttccgtcggaatgttgaagcctttgaaaacaaactggatgctgctcgtaaagagcaggctacggtaggacgtgaggtgggcaaggttgagaggaacatcaaggccaaggaaaaggacattgaagacaaggaaaacagtcttgtgccaatcgacgaaaagattgcgcaaagcacccaagatatgggtgtgctacggaagcgcattgtcgaagtgaaaaaagaccgcgacagccaagcatctagcatctccaaattgcaaaaggacctcgccaccgtggagaaagcgcagcagcagttcgaaaagcaatgggccgaaacactcaagaagcaaggcaaggagcttagtgatgaggaccgcaaggaatatactagtcttcaagccgaagctatgaagaaaactgccgacaaccgggccaagctggccaacctcacgcgccagctcaagagtgacgaggtcaccgtcaacagcctgaaagggaaaatcgacaactttgaggccgctatcgaaaagctgcagacggaggttcagtcgatcaaggatagaaaagacgccagcgaggacgcggtacaacaactccgaagcgatatcgccgccaagaagaaagagtataacaaactccagtctgagcgcgtaaggataaaccagaccagaaccgcccaggaggagaagctgcgggaaatccttcgcaagctggaggatgcggagtctggccggcgtcagaatgagaaggagacaagattgaggaacatgatcagcgacctcaggcgcatctacccaggtgtccgaggccgggttggagatctttgcaaacccaaacagaaaaaatttgacgaggcggtcatcacagcccttggacgtgacttcgatgcagttgtggtggacaccgagaaggttgggatggactgcgtgcagtatctcaaggagcagcgatttcctcccttgacgtttattccgctcgacaacatcaaggtcaacagctcagtttcggcagttaagggcatttccggagcacgactgaccattgatacaattgactttgatccttccctcgagcgtgccatcagctacgcttgtggtggatctgtcgtctgcgacaatctccatatcgcaaaggacattgtatacggtagaaagatccaggtcaaggctgtcacgctggaaggtttcgtaattcacaaggctggtaccatgacgggtggccgtttgcctaatgagaagggcggcaagcgtcggtttgaggaacatgacatccaaaatctgcaacggatggcacagtcattaaaagacgaggtggcagctttggcgcactctgggcgacgaaccgccaaggaggatgctttgttggtcgaatttacggcgcttgaacaacgcctcaagattcaggaaggtgaactggccgcctttgagaagaacctcaagagcaaacagaaagagctcgatcatcaggagcggcagctggacgactacgagcccaagtatgaggaaaagcacggcgagctggagcggacgcgggcaacggtacagaagttcgaaaaagccatctcagacgtcgaggataagatctttaaagatttctgcaagagactgggctacgagaacgtccgtgcctacgaagcccagcagggcactttggaacaagaagctgcccagaagcggcaagactttgatatccaaaaacaacgcatccagagcaacatcacatgggaaatgtcacagcacacggcgaccagcgacaggatagcctcactagaacggaccctacaacggcatgaacgagatctcgatacatatcgacaagagaaagcatcgatcgaagaggaactggcggaagaccgggaggcgctcgaggagcttgagcagagtctagaagagctcaaggtctcccacgcagaaaagaccaagaaggtccaggaggccaagcaagacctacagaggaggagcagagacatagaagtcaggttgaaggagatcagcaatctggaggctacagttcagcagagtagtgctcaaaagcttgccctgctcaggagatgcaagcttgagcagatccaaattcctcttcaacaaggctctcttgacgacattccaaacgaggacatgttactccagaaggaccaggatgccatggatgttgatggcgaggatgaagaccaggaagccgagcttctcgaagctgccatggacgactacggtgtcgaaatcaattacgacaacctcgatgacgcactacttcaagacccgaacgacgaagtcgaagagaagctgcaagaaaagatctcggccctcaccgccgagatcgagaagctcaaccccaacatgcgcgccatcgagcgtctcgagtcggtcaagtcgcgccttgagtccacagaaaaggactttgaggactcgcgcgccgccctcaaggcggcacgggatgccttcaaccaggtcaaggacaagcggttcgagctcttcaacaaggcctttacgcacattcaggagcagatcacgcacgtgtacaaggacctcacacgctcagacgcctatccgctcggtgggcaggcgtacctggatatcgaggaggacacggacaccccctacctgtcgggcatcaagtaccacgccatgccgccgctcaagcggttccgcgacatggagcacctgtcgggcggtgagaaaaccatggcggcgctggcgctgctgtttgcgatccacagttaccagccgtcgccctttttcgtgctggacgaggtggacgcggcgctggataatgccaatgtggagaagatcaagaagtacatccgcgagcatgcgggtcctggaatgcaatttatcgtcatcagtctcaaggctgggttgtttcaggatagcgagagcttggtgggcgtttatcgcgatcaggacgtgaatagctccaagactttgacgttggacgtgagtttctccccccccttcttgttgttgctaaccatttga

SEQ ID NO: 26949 - DNA, 596 bp, Neurospora crassa
cccttcttcggtgccatgggctgcacagcagccatcgtcttcacctgccttggtgcctcgtacggtactgccaagtctggtgttggtatcgctgccatgggtgtcctccgccctgacctcatcgtcaagagtatgtcgaatttcccaagagtcaagctgagttctggcgtggtatcgtacatcaatatgctgacttggcttctccctcagacattgttcccgtcattatggctggtatcatcggtatctacggtctcgtcgtctccgtattgatttccgatgctctcacacaggaccactacgctctctacactggcttcatccaactcggtgctggtctcgccgtcggtcttgctggtcttgctgctggtttcgcgattggtattgtcggtgatgctggtgtccgtggaactgctcaacaacccagactcttcgtcggcatgattcttattctcattttcgccgaagtcttgggtaagtcctctgtgatattggcctcccatccccattgacgactaacccgttgtctaggtctttacggtttgatcgttgctctcttgatgaactccaaggctacgctcaacacctcatgctag

SEQ ID NO: 26950 - DNA, 1410 bp, Neurospora crassa
cccggcatggaccccaagatcgacacctccggccacttcgaatttggcggttcgttgggcaccggcgccatgatgatcttctttcccatcctcatgtggtacatgtggattggcgcgacccaatacaacggcggcatccccagccgcgagcccggccagagctgggccgactttgccgcccacctttgcgaccttgtctacaccaaggctttccctcacgccaaagcgtggctgtggtactggacctttctcatcttcgagggcgccttctactgcctcatgcccggcgtcaccgcctacggcaagcctctcccccacgagggcggcaagatgctcaagtaccactgctcggcctacgtctccttctacgtcaccttcgccatcgcgggcgtcctacacttcaccggcatcttccccctgtaccagatcatcgacgagttcggcccgctgctctcggtcgccatcatctcgggcttcctcgtcagcatcgtcgcctacgtctcggcctttgtccgcggcgccacgcaccgcatgacgggccaccacgtctacgacttcttcatgggcgccgagctgaacccgcgcatgtttggcgttctcgacttcaagatgttcttcgaagtgcgcctgccgtggtacatcttgctcctgctttctctgggcgccgctgcccgccagtgggaccggtacggctacgtctcgggcgaagtcggtttcctggtgatggcgcactacctgtacgccaacgcttgctccaagggtgaggagctcatcgtgacgacctgggatatgtactacgagaagtggggttttatgttgatcttctggaacctggctggcgtcccgctttcgtactgccactgcaccatcttcctggccagccaccacccggacgagtaccggtggaaccgttttgcactcgtcggcctctacgtctcttatctgttcgtctactgggtttgggatacgtgcaacagccagaagaaccggttccgcgcccaggagcgcggcaagctgctctaccgcaagaccttcccccagctgccctggcagacggtcaagaacccgcagaagattgagaccgagacgggcgacagcatcttggtcgacggttggtacggcctcgcccgcaaggtgcattatacctgcgacgcctactttgctatctgctggggcttgattaccggcttcagcagccccttcccttggttctaccccgtcttcttctgctgcatgattgctcatcgcgcgtggcgtgacattactcgctgccgcgagaagtatggtgatgcttggaaggagtatgagaggagggtgccttatcttttcattccggtaagttttttttttttttcttttttttctcttttttttttctttttttttcccttccgtcactcttgttgggga

SEQ ID NO: 26951 - DNA, 1236 bp, Neurospora crassa
atgatcgatctcggactggcccgcatcgggcgtcttcttcagcacacgccgcagacctggaaggccatccacgttgccggcaccaacggcaagggctcaatatgcgcctatctctcggctatgctcagtgccagcggtgtctcgtgtgcgaggttcacctcaccccatctcatcgaccgctgggactgcatcactatcaatgagaagcccgtctccgagacgatattccgtcaagtcgagggcttggtcaagcaacgggatcaggacgagaagatcggggccaccgagttcgagctccttgctgcgaccgcctttgagatctttcaccgtctgaaagttgagtatggcgtaatcgaggttggtctcggcgggaagctggacgctaccaacatcttgaagcacaagtccgttaccgtcatcgcaaaaattggtcttgatcaccagtccttcctaggaaacacggttgaggagatcgcgctgcaaaaagcaggcattatccgctccggcgttccctgtgtcgtcgatgacagcaacgagtcttcggtcctgaaagtgattcaagaccatgcgaaggaggtcggcggcgtagagctgcactatccctcatcagattccgccctgttgcagattctcaccaaagaaggctatgagccgcatcaagttcagaatctggcgtgcgcgttgttggcctttcgcttagcgtgtccggatgttgaccactcgatgagtcgtctcctccccatcgttaagcagctgcaatggcccggtcgtctgcaaaaaattgatctctttcccatcatcaggcagcatcaagaggctctgctggacggagcccacaatagccagtcggccgaagttttggctgggtatgtcaacaagcactaccgctcgcggagtcaatcaattacttgggttctggccgcttccaagggcaaagatgtggacagtattatgtcccacatcatacagccgagcgatcatgtcacggctgtgcagtttgggcaagtggatggaatgccgtgggttaaagccgaggacccggccaacttgatcaaccaggcaacccgttatggcgttgagactcaaaatacgcacaactcgggagatgatgtacgagctgccctcgaatgggcatccaaggctgcaggagataagccgattgttgttgctggaagtttgtacctggtctccagtgtcctgcgtctcatgcgtgaggcggaatcttaccaaaaggcg

SEQ ID NO: 26952 - DNA, 1791 bp, Neurospora crassa
agagtcgcttcttccctgtcacgaccgtcatcatctattcccgtcgtcgagcaccctgtcgtcccgtctgctatcgcgttacgtccctgcagagggaggatagagagatagagaaagagtcaacggctcgtaccgtatatcaagagagacatcgttgccaactcaatttttgcacatctagatggccaccccgaatcgaagcatgaacctcccctgaagccatccgagtcgacgaccaatgccgaaccagccaaaccactcgcgcctccgccccgtcccgctgcgcaacaacagtccacgaacagcccttccgactacttctcgcagaaccccatcagcggctccctgagcctggagccgaacccatttgagcaatccttcggtggtgcccccgaaacgcccggcggtactaaactcccgcccgtcgccgccctagcgtccccatcatccatcttgcctcctggctcaacacctttcccctggggcggtagcaactcgttgcgatccggcccattgagtccggcaatgctgtcgggcccaacgacctctgattattttggcgaccacattcgcggaggtttcccaacgccaaacgaatcgtcgctcagaacaggattgacgcctggtggtagcgggtctatgttccctgccccgagtcctaactcgactctctttgcacaacttgccggccctgctgccacgcctggaaccatcgactttcaccgaaccgccatcagtgccgctgccgccaaggcccaagctcaggcccaggcccaacaacaagcagcacatcagcatcaacaacaatcgcaaccgccatcgattacgtcacaacccgcctccgatctccccaatggcattccgcctctgaagcctgagacgaagccaccgactggaccctttgacccgcatgataacgacgcggcaaatggtcttttcatgttagcacagggacgaaacgcatctcagccaccaagccaatcatttaacgtggtgtcggcacctccgccacctccatcaagtcacccgcacactgtgccggctcctcctgtgcaaccagttaacacgtcaccacaaatgaatgggaacgtatccattgcaggaagctcagcacgtggtgtcagtgaagttagcatcgggtcagacgacagtgaacttgccaggcctaatacccgtggcaaagggaagcgtaactccacaagcgcagcgacgacgggttcccgtcgcaaggctgaagaaactccggccaagactccagccaataaaaagaccaagacaaacggatctgtttcttcactcaacggtatggactactcaggctcggaagacgagtcgaagccaggcaaggatgacggaacgggctcaaagtccaagatgacggaagaagaaaagcgcaagaacttcctggagcggaacaggtatgtgaaactcgttatgttagccattggaaaacacttgatactaacagtttgcagggttgccgctctgaaatgtcggcagcgtaagaaacagtggctcgctaacctccagcaaaaggtggagatgttcagttcagagaatgacgcccttactgcaacaataacacagcttcgggaagaagtggtcaatctcaagacacttttactcgcacacaaggactgtccagtgacgcaacagcaaggtctccatggtgcgttcatgcagcaagccatcgagccatttagtcaccagatgaacccctacggtatgggagctggcatacctaatcagcccgtcggcatgccgccgaatgttgctcctcgccgattctca

SEQ ID NO: 26953 - DNA, 769 bp, Neurospora crassa
gttttactaggcatcacgggcaaggactttaccatcattgcggcgtccaaggccgctatgcggggagcgaccatcctgaaggcatccgacgacaagacaaggtcgctgaacaagcacacactgatggcattctccggtgaagctggcgacacaggtacggcagcgatatcgtgatgatggcgcttttgaaccaaaccaagttaaccaactgtttgttcccatcgacagtgcagttcgccgagtacacccaagccaacgcccagctctactccatgcgcaacgggaccgacctttccccttctgcccttgccaactttgtccgcggcgagcttgcgacgagcttgcgctcccgcaaaccctacaacgtaaacctccttctcggaggtgtcgaccctatcacccacaagcccagcctctactggctcgactaccttgcgtcgttggcgaaggtcccctatgccgcccacggctacgcacagtatgtgatctcgaccgatatctctgtaccgtctttgatgcgtaggagtcatgtacagaatcactgaccggttctttcctcatcagatactactgcctctcgattctcgacaagcaccaccacccagacatcaccctccaccagggtatcaagcttctcaacctgtgcaccgacgagctcaagaggaggttacccatagacttcaagggcatgacggtcaaggcggtaacgaaggacggcatcatcgatatcgagttcgacgacgacaaggtggttaagatggcttgattt

SEQ ID NO: 26954 - DNA, 1681 bp, Neurospora crassa
tttgagggccagcagggcgctggctggggcggccctcgtcctcagggcggcttcaaccccaacgcgtaccgcggcaacgctggcgctggcgccggtgccggtgccggtggtggtggcggcagcttcagcaaccgtggctctggcgatggtcagtggcgcgatggcaagcacattcctggccctgccaacccccgcgtcgagcgtgagctcttcggtacccccgacgacccgtccaagcagcacactggtatcaacttcgagaagtacgatgacattcccgttgaggcttccggtgacaacgtgcccgagcccgttcttaccttcagcaaccctcctctggacaaccacctcatttccaacattcagctcgcccgctacaatgtccccactccggttcagaagtactccatccccatcgtcatgggtggccgtgatctgatggcttgcgcccagactggttccggcaagactggtggtttcctcttccccattctttctcagtctttccacactggtccgtctccgattcccgccagcgctgctggtgcctatggtcgtcagcgcaaggcttaccccaccgccttgatccttgctcccacccgtgagttggtctctcagatctacgacgaggctcgcaagttcgcctaccgttcgtgggtccgtccttgcgtcgtctacggtggtgccgatatcggctcccagcttcgccagatcgagcgcggctgcgatcttcttgttgctactcctggtcgtcttgtcgatctcatcgagcgtggccgtatctccctctgcaacatcaagtacctcgtccttgatgaggctgatcgcatgcttgacatgggtttcgagcctcaaattcgccgtatcgttgagggtgaggacatgcccaaggtcaatgaccgccagactctcatgttctcggccactttcccccgcgacatccagatcctcgcccgcgatttcctcaaggactacatcttcctgtccgttggtcgtgttggttccacctctgagaacatcacccagaaggtcgagtacgttgaggatattgacaagcgttccgtccttctcgacattctccacacccacgccggaggtctcacccttattttcgttgagaccaagcgcatggccgattcgctgtccgacttcttgatcaaccagaacttccccgctacttccattcacggtgaccgcactcagcgtgagcgtgagcgcgctttggagatgttccgcaacggtcgctgccctattctggttgccactgctgtcgctgctcgtggcttggatattcccaacgtcacccacgtcatcaactacgatctccctaccgacattgatgactacgttcaccgtatcggtcgtaccggtcgtgccggaaacactggtattgccaccgctttcttcaaccgtggcaaccgtggtgtcagtccgcgagcttcttgaactcctcaaggaggctaaccaggaggttcctgccttccttgagaccattgcccgcgagtcctcgttcggcggtggtcgtggcggtcgtggtggtggtcgtggcggcggtcgcggtcgcactcaaactgccgattaccgcaagttcggcggttccggtggtggcggcttcggcggtggcttcggcggtgctcccgctagcggcggctacggcggcggcggctatggtggtggtggt

SEQ ID NO: 26955 - DNA, 2030 bp, Neurospora crassa
atggcttcttcgcaacctaacatggaaaagttcctgcgcgaatggcgccaggatgccctcaacaaagctcaatacgagtcagctatattcataggggacaagctcctagctatgacaagtaagcacttgtattcaccctcaccccggtagcggctttgatgtctaactgttgggttaccccagacgacgacaacgatgccttctttctagcccaagtccactttgccgccggaaattatactcgagcacaggcactgcttgtcaaacaagacctcctcacctcgagtccatcctgccgatacctcgcagcgcactgcctaatcaaacaaaacaactttgtcgaggcccttgcaatactaggcgaacacaccccgacacatctatttgcgactaatgcgaaacggaagactactcgaggcttgcgcggcaccacagcaagagccagttcaaaaacaccatcgcgccaccatgaccaaggcgacgatataccagaggaagacataccaagcaggcgctacgaagcctccatgtgctatcttcgagggctctgttacgccaagcagaatgccttcgaccgagccaaggaagcctacaaagatgctctgcgaatcgatgtccagtgtttcgaggccttcagtcaactggtcaagaactcgctgatgtcgcccgatgaggaggacgagtttatgcagtcgctcgccttcgactcgattcgcgctccaggcgatgacccagacatggaggacgaaccagccgactacgtgcatatgctgtaccaaacacagctctccaaataccgcaacccacaagccttcaacacagccatcgagtcgctctcgacacactacggtctcgagaacaatgccgatattctgcttgccaaggccgacctgctctatacgcaatgccgctttaaggatgcgcttgcgatcaccgagtcgatcctgatggacgacaaatacaatttcgccgtctacccgattcatcttgcctgcctgtacgagctccgaaaaacgaacgtactcttcctgatcgcccacgaactagccgacacccaccccgacgaaccctgcacctggctcgccgtcggaatctattacttcaccacgggcaagatcgccgacgcgcgccgctacttcagcaaggccagcatgatggacgccaactttggtccggcctggataggctttgcgcacaccttcgccgctgaaggcgagcacgaccaggctgtgacggcttactcgaccgccgcccgcttattcacaggcacccacctgccgcaggtctttttgggcatgcagaaccacgccatgaacaacatgacggccgccgaggagttcctcaagacggcctactcgctgtgcaagacagacccgctgttgctcaacgagatgggcatcgtgctctaccaccaggaccgcctgaaggaggccgtcaagatgttcgaccaggcccttgccattgccgaggagaccgatagcgatcctcacgcttggctgggtgcccgcacgaacctggggcatgcgctgaggcggctgaggaaacatgatgaggcgttggaggaatttgaccaggtccttcgcgatggcgggaaagatgcccagatattttgcgccaagggattgatatacctggatcaagggagaccagatgaggcggtacgggtgttgcatgaggcgttggcgatacacccgcaggaccccatcgctacggagttgctgaataaggcgcttgaggaatcggcagaagcaggggggatagggctgctagggactgcagatgcggatctgggcggagaagcgggggatgaggcgatcacggccagctttgagcagttgctggggggtgcggcgaggatgagattggctagggagagggggaggcgggccgttgcggagacgccaggacaaggtggtgtgaaggataaagggaagggcgttgctaggggtggaaggaggggagcggcggggggcactagattgtttaggggagatcaagaagaggtggatagcatggagctgagcgattga

SEQ ID NO: 26956 - DNA, 1395 bp, Neurospora crassa
atggcgattgctcgcccagtacgagccctggccctggcggctgcgctcgtctggtgtttcttcatatggcagcttctgtcgccatcgggaaccgccatgaccaaagacaaatacttgtcctttgagcgggatcccaacctggaccgtaagtggatgtggcgcttttgttttgtccgcagtcgcattgctgttcgatgctaatctgctcttgcgcgtcgcacagctacgggagaacccgaagggaagctcatacgcgcttccgaagactatgcgccgggcgcaaagaactcggccagaatcaatgccactctgctggcgctggtgcgaaacgaggagctggaaggcatgctgcaggcgatgcgcgacctcgagcggacatggaaccacaagttcaactacccctggacctttttcaacgacgtgcccttttccgatgagttcaagaagagaacgcgcgcggtaacgaaggccgaggtcagatacggtacgtaaggcggtgtagccacccacacggtatgatacgtggagcagacgggctgattttactgtgacggttacagaacttatccccaaggagcactgggaaatgccatcatggattaaccaggacctgtaccacgagtcggtcaagatcctcgaagaaaagaagattcagtatgccgacaaaatttcgtaccaccagatgtgccggtggaacagcggcatgttctacaagcacccggccctggccaacacgcagtactactggcgcgtcgagcccaacgttcacttcttttgcgatgtcgactatgacgttttccgctacatgcacgataacaacaagacgtacggcttcaccatcaacctgtacgacgccccggcgtccatcactactctgtggcccgaaaccgaaaagttcttggccgagcaccccgaatatgtgcacgagaacagcgccatgaattggctgacggacaagacccgccgtcccgaccacacaaaggatgccaacggttattcgacatgccacttttggagcaactttgagattggcgatatgaacttctggcgcagcaaggcgtacgaggattatttcaaccacttggaccgtgccggtggctttttctacgagcgttggggtgacgcacctgttcacagtattgccctgggtctcttcgaagactctagcaagattcattggtgagtgtcgacagaaagtttgcctcaaccacttatgctgaccatcccttttttaggttccgcgatattggctatcagcacattcccttcttcaactgtcccaactcccccaagtgcaagggctgcgttaccggccgtttcaccgatggcgaggcctggctcaacagggaagactgcagacccaactggttcaagtacgtcggcatgggctaagct

SEQ ID NO: 26957 - DNA, 813 bp, Neurospora crassa
ctacagggcaaagttgtcctcattaccggcggcgccaaaggcatcggccgcatgatcgccgaaggtttcgtccgcaacggcgccaaagtgtacatatcctctcgcgacgccgccgcctgcgagaccgccgccttggagctcaacgctctggcctccaagacctcctcaggcggttccgccgtcgcccttcccgccgacctctcttccgcggaggaatgcacccgtgtcgcccaagaactctccaagcgcgagcaaaagctgcacgtgctgatcaacaactcgggcgccacctggggcgctgcttacgacgagtacccggataacgcgtggacgaagctgctgactctgaacctgcatcgagtttttacgctgacgcaggctttgactccccttttggagaaagcggcaaagaagacgtcgtcgtcgtcgtcggaaggaagaagcgacgacggagtggtgattgacccggcgcgcgtcatccacattggcagcatcgacggcatccgagtcccgctgcttcccacgtacgcttacagcgccagcaaggcgggactacatcacttgagcagacacatggcggtggaactggggccgagggggatcacgagcaatacgctggcgtgtgggccgtttccgagtaagatgatggcggcgacgctgagggactttggggaggacatcaaggccgcgaatcccctggggaggattggaacgccggaggacgcggcgggcgcatgtctgtttttggcgagtagggcgggggcgtttgtgaatggggcgacggtgacgctagatggaggggtggcactggtg

SEQ ID NO: 26958 - DNA, 583 bp, Neurospora crassa
ctgtctagcctgtccaacctcttttggacaaagaaggagatccgcattctgatattgggcctcgataatgccggaaagacaacactactatacaggctcaaggtaggcccacctgttgaaaagctgacgaacggaagcgcgcacagttcggagagctgacaacatgttgtagattggcgaggtagtaaccacgataccaacaatcggtttcaacgtcgaatcagtcacatacaagaatctcaacttcaatgtgtgggatctgggtggtcagactagcatccgcccgtactggaggtgctactatgcgaacacggcggcggtaatattcgttgttgactcgaccgatatggagcgattgcaaaccgcggcggatgagttggccgctatgttgaatgaggaagagctgaaggacgctgcccttttggtgtttgccaacaagcaagatcagccaggtgcaaagggggcggcagatatctctcaggctctccgcctgggcgagctaagggacaggaactggagcatcatggcctgcagtgcagtggaagggacaggcatcacagagggcatggattggttggtggta

SEQ ID NO: 26959 - DNA, 572 bp, Neurospora crassa
actgcagccgactaactggcgtcaaacacagatcgtgttgttgccgagcgatcccttctcatcaagaacctgattgaggatttgggcgacgaggctgttatgaacgaggctattcccctaccaaacgtcaacgagcctgtcctccgaaaggttgtcgagtggtgcgagcaccaccgcaaggacccgccccagactaccgaggacgagaacgacagccgtaagaagagcacggagatcgacgaatgggaccagaagttcatgcaggttgaccaggagatgctcttcgagatcattctcgtaggtttctccctcgttctacccgccgatgctacttgatatgcaaacatcactcgggttctgcagggtcagatcatgctaacatattcctcatccaggctgccaactacatggacatcaagcccctccttgatgttggatgcaagaccgttgccaacatgatcaagggcaagtcccctgaggagattcgaaagacgttcaatatcacaaatgatttcactccagaggaggaggagcagattcgccgcgagaacgaatgggcggaagaccgttag

SEQ ID NO: 26960 - DNA, 2753 bp, Neurospora crassa
cgcgagcttctccccaccaacgtcattcccaaacactatcacatcaccctcgagcccgacttccagaagctcacctttgatggtaccgtcgtcatcgacctcgatgtcgaggaggactccaagtccatctccctccacactctagagattgacattcacaatgccaagatcacctctggtggtcagactgttaggtcagcgagctcacctccccgccccccgtagtattgtttacttgttgtacttactttgcccctgcattgattctacggctacgaccaagctaactttaagccaatagctcgtcgcccaaggtctcttacaacgagactacccaggtctctaccttcgactttgacaatgccgtcaacaagggcgccaaggcgcagctcgagatccagttcactggccagctcaacgacaagatggctggtttctacaggtcgacctacatcaaccctgatggcacacaaggtctcttggccgtcagtcaaatggagcctaccgatgctcgccgcgcattcccttgtttcgacgagccttccctgaaagccgagttcaccgtcaccctcattgccgataagaagttgacctgcctcagcaacatggatgttgcttccgagtctgaggttaaggatggcaagaaggccgttaccttcaacaaatcgcccctcatgtctacctacctcgtcgcctttgtcgtcggtgagctcaactacattgagaccaacgacttccgcgtccccgttcgcgtctacgctcctcccggacagaatatcgagcacggtcgcttctcgctcgaccttgctgccaagaccctcgctttctacgagaaggtcttcggcatcgagttccctctccccaagatggaccagattgccattcccgacttcgctcagggtgccatggagaactggggtcttgtcacatacagggttgtcgatctcctcttggacgaaaaggtcagcggtgctgctaccaaggagcgtgtcgccgaggttgtccagcacgagcttgctcatcagtggttcggtaacctggttacaatggactggtgggatggtctctggctcaacgagggcttcgctacctgggcttcttggtactcttgcaacatcttttaccctgagtggaaggtctgggaaacttatgttacggacaacctccagcgggctctcgctcttgactccctcaggagctctcaccccatcgaggttcctgtcaagcgtgccgatgagatcaaccagatcttcgatgccatctcctactccaagggctcttgtgttctgcgcatgatctctacctacctcggcgaggatgtcttcttggagggtgttagacgttacctcaagaagcatgcctacggtaacacgcagactggtgatctctgggctgctcttggcgatgctagcggaaagagcgtcgaggaggttatggatgtgtggaccaagcacgtggggtacccagtcgttactgttaccgagaaggacgagaagaccatccacgtcaagcagaaccgtttcctccgtactggtgacgtcaagcctgaggaggacaaggtcatcttccctgttttcctcggcctccgctccaaggatggcattgatgagagccttacccttgacaagcgtgaggatagtttcgaggttcccagcactgagttcttcaagctcaacgcgaaccacaccggtctctatcgtacctcttacactcctgagcgccttgagaagctcggtgaggcggccaggcagggtctcctcagtgtcgaggacagagctggtatgattgccgatgccggtgcccttgcttcttcgggctaccagaagacctctggtgttctgacccttctcaagcgattcgactctgagaaggagttcattgtctggagcgagatcatctctcgcgttgctgctgttcaggctgcttggatctttgaggacaaggctgttcgcgatggccttgaggctttccagcgtgagcttgttagccctagggctcacgagatgggctgggagttctctgagagcgatggtcacattgagcagcaattcaaggccatgctatttggcaatgccggcctctgcggtgatgagaagattatcgctgctgccaaggagatgtttaagaagttcattgctggcgacaagtcggccatccaccccaatattcgtggcagcgtcttcagcatagccttgaagtacggtggcacggaggaggtaagtttggtatatccagtgaacacataaaaacccggtgctaatcagtctctaatttttcccctttagtatgatgctgttctcaacttctaccgtacctctaccaacagcgatgagcgcaacaccgctctccgctgcctcggccgtgccaggagccccgagctcatcaaacggacccttgaccttctgttcagcggtgagatcaaggaccaggatgtgtacatgcccactgctggcctccgtagccaccctgagggcatcgaggctctcttcaactggatgactgagaactgggatgagctcgtcaagaggttccctcctcagttgtcgatgctcggaacccttgttactatcttcacttccagcttcaccaagagagagcagttggccaaggttgagaagttcttcgagggcaagaacaccaacggcttcgaaatgtccttggcccagagcttggatgctatccgctccaaggttgcgtgggttgagcgtgacggcgaggatgttgccaagtgggtgaaggacaacaagtacagt

SEQ ID NO: 26961 - DNA, 1050 bp, Neurospora crassa
cgagccaatatcttgaaagaggtgcaaatcatgcgccagcttgaccatcccaacatcatcaagcttgtcgacttcgccgagtctcgccaatactactacatcattcttgaactggcgcctggcggcgagctgttccaccagattgtgcgtctgacgtactttagtgaggatctctccaggcacgttatcacacaggtagcaaaggctctggagtatctgcacgaggagaagggtgtagtccatcggtaagttgacccacatcatcgtgccagtagttagtgaatctctgctcactccttgaacagtgacatcaagcctgaaaacatcctcttcagccccattccatttatcccctcgaagcacccgaaacccaagcagccaggtgatgaggacaaagttgacgagggcgagttcatcaaaggcgtaggttctggtgggattggtcagatcaagatagccgatttcggcttgtccaagatcgtctgggacaaacaaaccatgactccctgcggcactgtcgggtatacagcacccgagatcgtcaaggatgagcggtactccaaggcagtcgatatgtgggcgctgggttgcgttctctacactcttctttgcggcttcccacctttctacgatgagagcattgaggtcttgacggagaaggttgccaagggccagtataccttcctttcgccatggtgggacgatatcagcaaatccgcccaggatcttatctcgcatcttctgtgcgtcgatcccgagaagcgctacacgatcacagagttcctcgcgcatccttggattgccggctcgggtcctacgccaagagacgagcggaagaacccggatggtgtgctgcgggccttcgatgcatccaagattgtggatggagacagacgttatgacttccgttctccaggtgctgtcaatctgcgcgaagtgtttgatgttggctatgccgtccatcgccaagaggaagaaggcaagagacgtcataaccttggagccaaggcgggcgtgtctcgtctggtaggcctcgacgagaactctgac

SEQ ID NO: 26962 - DNA, 1594 bp, Neurospora crassa
gaggaggatcaggaggattactgcaagggaggttaccatccggtcaccattggcgaaaagttcaaggacggcaaatacaccgtagtgcgcaagctcggatggggccatttctcgacagtctggctatcaagagacaacaccaccggaaaacacgtagccctcaaggtggtacgctccgccgcccattacaccgaaaccgccattgacgagatcaagcttctcaacaaaatcgtccaagcgaatcccaaccatcccggtcgccgacatgttgtcagccttctcgactcattcgaacacaagggccccaatggcacccacgtgtgcatggttttcgaggttttgggagagaacctcctaggtctcatcaagaggtggaatcacaggggtattccgatggctcttgtcaaacaaattacaaaacaggtccttctcggtctcgactacctgcaccgtgaatgtggcatcatccacacagatctcaagcccgaaaacgtcctgattgaaattggcgacgttgagcaaactgtgaagagggtcgtgaaggatgagcccaacgacaaagagaacactcggaatagtcgcaggagacggaggaccctaatcactggcagccagccgttgccttcgcctctcaatgccagcttcaatcagggatcgatgttcccctccccagcaccccagtcgcttggccagatgttggcggaaggtcagtagaaatgatttgcagaaagtgctatccacgaatctctgactgacattgaacaggggccaaatcgcaagaaggatctccgttccacaacaagaacggggaggacgaccaaagtcggcgtgagaagagcgccgatctcctgagcaaggaggtttcgggaatttcgctagataagacggctacaccccccgcgacttcgggagacaagcgcaacctagacgatatgcagtttgacattatcagtgtcaagattgcagatctcggaaacgcatgctgggtcaaccaccacttcacaaacgacattcagacgcgacagtatcggtcgcccgaggtcattctgggtgccaagtggggtgcaagcacggatgtctggagtatggctgccatggtacgtaaatttgacctgaataaagatgtagcgcagatgctaacacaagaccacaggtgttcgagcttatcaccggcgattatcttttcgatccgcagtccggaactaagtatggcaaggacgacgaccacatcgcgcagattatcgagcttctgggtgccttcccgaagtccctttgtctatccggcaaatggtcgcaagagatcttcaaccgaaaaggcgagctacgtaacatccaccgcttgaggcattgggcgctgccggatgtactacgtgagaaatatcacttcaaggcagaggaggctcagcgcattgcagacttcctcatgcccatgttggagctgatacccgagagacgagccaatgcaggcggtatggccggacacagctggctcgaggacactcctggtatgaagggcatcaagatcgacaaggtagaggtcggaagtcgtggtgagggtatagagggctgggcaagtgaggttaggaagcgataa

SEQ ID NO: 26963 - DNA, 1421 bp, Neurospora crassa
gagtacgcctttgaaatggctgcctcctccatccgctttggccctggcgtcacgcaagaagtcggcatggacattgccaacctcaaccccaccggcaccgtcgccgttatcaccgactcaaccgtcgagaagctcgacgccatgcgccaagtccgcgagtctctcgaccgggaaggcatcaagtacaagatctttaataaagtcaaagtcgaaccaaaggactactccgtcaaggaagccatctattgggcccgtaccacgggcgactactccgtctacctggccgtcggcggcggctccgtcatcgacaccgccaagcttatgaacctatactcggtctacaaggacgccgacttcatggactttgtcaatgcccccttaggtaaggggcgtccagtggaccggaaactccacccgcttatcgccgtcccaactacggcgggcacaggcagtgagaccaccggcacggccatttttgacttggtagccaagaaatccaagacgggtatcgcccaccgcaacctcaagccctacctgggaatatgtgacccactgaacacgcggacgatgccgagtgccgtgaaggctagttcggggttggatgtactttgtcatgcgctggaaagttacacggctattccattcaacgagcggacgccgagaccaacgaacccgattctcagaccggcgtatcagggcgctaatcccattagtgatattttctcactaaacgcgctgaggcagacggtcaagtatctacctaggagcgtaaaggacccggaggatgttgaggcacagaccgagatgttgctggcggcaacgctggcaggtgtgggatttggtaatgctggtgtgcatttgtgtcacggtgcgtcactgtctttttcgtcctcctcttcttcttctttgtctctcttatcctcttgagtcatcatgcttcttgtgtaaccattcccttgactcatcatcactatcgctaacacttttcgcaaggcatgtcctaccccatctcctcccaaaacattgcctcctacaaacacgccggctacgacgtaccacaccccatcatcccacacggtgtctccgtggccgtgacggcgcccgcggtcttcaagtttacagctgcttcaaatccggacagacatcttgctgccgccgaagcctttggggtggatatctccaacgtcaagcgcgagagcgctggcgaggttttggcagaagccatcgccaagttcctggctgacttgggagatcaacccgctggactgaaggctttgggcttcggaagggaacatgtcgagcagctggtcgagggaacgattccccaggcaagagtgttgatgttggccccaggactggcgaaggagttgcaggcagagagggagcagttgggacggttgtttgaggatgcgttggaacat

SEQ ID NO: 26964 - DNA, 3078 bp, Neurospora crassa
tcctccatctccgggccgacctatgtcaacagccagctgcttgtccagcagactgcctacaagctctccgacaagatcttctcgtactctcccgagactttcgacctcgatgtcgccgtgaaggaatgggctgaggccaacgagaagaacgtccacggcgagactaccaccgttgtccctctccagaccagggccggtgccggtgcttttgcccttggttacatcttttccaaggacttcgacttggccaagcgccatgtcccccagaccctcctggccccctcgttgagccttcgtcacctccgctcttccctcgaccagctcgcccttctctacggcgtctccagcccctttgtcgcccatgttgccgctgccgactacagcgccgagaagggtcttggtgccgactacgctaccgctctccagatcgccgaggaccttggtctcgctctcgtctccagctcctctgcctacgaggtccagcacatgtctctgctcgccactctcctggcgtctgtcctccccaccctccacatctacgacggtatccgcaccgcccgcgagtccctgcgggtcgtcgatgccctcggcgaggctcacattgccgatatctacgccaagatctccaaggaggctgctgccctgaacaagaggctggataccgctggcaaggttgttgagcttctcaaggccttcaacaacgagctcggcacttcctacgctcctttcgagtaccacggtcacgaggcccccgagactgtccttgtcgttttcggcagcgccgaggcccagctcgccaagcaggtcgcttccgctttggccgccgagggcaagaaggtcggcaccatcgttgtccgtgtctaccgtcccttcgtcgaggaggccttccttgaggttctccccgcctctgttcgccagattgctgttcttggccaggtcgccgatgctgctgccgtcgaggatgccaacgtgcagtctgccctctactctgatgtcctcactgccgtctccttcaccgacaagctgtctcaggcccccgaggttgttgatgtccgttatgcggttaccgatgcccacacccccagctccatcgcctccatcttcaacaagctcaccagcaagggcgaggccgagcccgtcgcttttagcctgaccgctgtcgaggaggcccagcagtacgttttctgggatgttgacaactcctctgccgctgcttctgcttcggccgttggcaagctcctcgagaccgagcagtccaacaacgtctatgttcaccagacctacgacaaccttgtccagggtggtgttgtccgcaccgacattcgcgtgtcccaaaagtccatcgaggccccttaccctgttgagagcgctgacgtcgtcttcgttggtgaggagaagcttctcaaggagattgccatcgtcaagggtgtcaaggccggcggcaagctcattgttcgtcttcccaacttcaaggaggacgagcttgagaagcgcatccctgctgctgctcaaaaggagattcaggagaagggcatcgagctctacgtcctcgactcctcttcttctcctgctcttgaaaaggaggccggcctccttgttgacgttgccttcctccgcgttgctcgtgctgatatcacaaagttcgactcgctctccgctgaccagaccgctctgaccgaggccgtcaacgcccttgatcagtccgttcgcaaggttgaggtgcccgccaagtgggccgaggtcgagaacactgttgctcctcttgttgacagcgtcaagcccaacagcttcgtcgccttccagaaggaggaggaagaggagacctccagcctcgagaactggcagtctgccgccaagggcttcgctttcaaggaggcctacggcacccagaaccagctccgccctgaccttaccgtcaagacctacaccatcaaggtcaaggagaaccgccgtctcacccccaccgactatgaccgcaacatcttccacattgagtttgatctcggtgactctggtctcacttacaacattggcgaggctcttggtatccacgccgacaacgaccctgagcaagtcctccagttcatccaggcttatggcctcaacgcggatgaccttgtccaggttccttcccgcgaggatcccgccgtgctggagacgcggactgtctaccagtccctcgtccaaaacgtcgacattcttggcaagcctcccaagcgcttcttcgaggccctcgcccagttcgccaccgacgaggaggagaagaagaagctcgagcgtcttggcagcaaggagggcgccgacgagttcaagcgtcttactgaggaggatactgtcacttatgttgatgtgcttgacatgttcaagtcggcccaccccgacttcaacgacctcgtccgcatcgtcgaccccaccaagcgcagagagtactctatcgcctctgcccaggctgtcacccccaactcggtcactctcatgatcgtcgttgtcaactgggtcgataccaagggccgcacccgctacggccatgccacccgctacctctcgggccttgctcccggcagcaccatcaccgcctcggtcaagccttcggtcatgaagctccccgtcaaggacacggcccctctcatcatggctggtctcggtaccggtctcgctcccttccgcgcgttcgtccagtaccgcgccatgcagaaggcccagggcaaggagatcggctccatcctcctctacctcggttcccgtcaccagcgcgaggagtacctctacggcgaggagtgggaggcttacctcgacgccggcgtcatcaccctgctcggtgccgccttctcgcgtgaccagcccgagaagatctacatccaggatcgcatgcgccagaccgtcaccgacattgtcaaggcctacatcaaggaggagggctccttctacctctgcggtcccacctggcctgtgcctgatgtcactgccgtgcttgaggaggccattgcggctgaggctcaggagagcagccgcaaggtcgacccccgcaaggagattgagaggctcaaggaggatggccgctatgtccttgaggtgtac

SEQ ID NO: 26965 - DNA, 3159 bp, Neurospora crassa
aagaacatggcatcaacctcaacaaaccagtctttctcaaccgacaccgtggtggatcttggaggaaaagtcccatcctctcaaccaccaccattgtacagagtgacagtagccatcggcggcatgacctgcgcagcctgcgtcaacaccattaccaacgaactgaacaagaaagactggatcgcccacgtctccgtcaacctgatcaacaacagcgctgccatcgacattcatgacgaaagcagggcgaccgagctggtcgaggccatcgaggacctaggctatgatgtgaaactcgacaaggtcattgccctcgccgacccgtcaaagccaccacccaagccaaaagccggcggcgaaattttatcagatgcatggcgggcgaccgtgtccattggcgggatgacatgtgcgtcctgtgccaactccatcaccaacgagatgaagaagcgggactggatccaagacatcacggtcaaccttctcaccaacagcgcgactgtcgagtttgcggggagagaaaacgccaacaagctggtgggagagattgaggatctcgggttcgaagcgacgctcaacgaggagaccttggtcaacgtcgccatccatgaaggggggccgaacccggaggaggaacagcagcaaagaagagaagtcgagattcgcatccagggcatgtactgcgaacactgcccctcacgagtctcggccagtctggcaggcttccgtaggcagctggacgtgatcagccaaccaagtcataagagaccgatcgtcaagatagtgtatgtccctgacgctcccgagttcaccatccggcacatcctcaaagcgattgaggcgagtgacccggctttcaaagcatccatctaccaccctccttccctcgaggaacagtccaaggccatccagcgccatcaccaaatgcaaatcctctggcgtgtcctcttttctttagtcgtcgctatcccaaccttcatcatcggcatcgtctacatgaacctgataaaggcctcctccggcaacaagtctcgcgagttcctgatgaaaccatggacgtccggcatctcgcgcgggcagatcgccctattcatcctggccacacccgtctacttttttgccgccgacatcttccataagcgcgcctacaaggagatcaggacgctgtggcgacgatccagtcgcgtccctctgctccagcgcttctaccgcttcggcagcatgaacacgcttatgtccctgggcacaaccattgcctatgtctcgtctgtttgccagatgattgcggcgggagcgcagaaagtgcacatggttgataatgccaacttttactttgactcggtcgtgtttctcactttcttcttgctcttaggccgattgcttgagtcgtacagcaagtcgcgcacgggagacgcggtggagatgctggggaagctgcgcccgacgacggccattctggtggaaggatacggtactgcgaaagagcgggatgaagtagtacaggcggactcgttggactacggcgacgtcgtgcgcatccctcatggcgcttccccaccggcagacggcatagttgttcgcggcgaaggcagtttggacgagtcgagtctgactggcgagtccaggccggtcaagaagatcgtcggcgatgaggtgtatacgggcaccgtcaacaaggacgcaccgctcttggtccgcgtcactggcgttgctggcaagtcgatgctggacgaggtcgtcaaggcggtccgcgaaggccaaaccaagcgggctcccattgagcaagtggcggatatcttgacggcctatttcgttcccgtggtcactgccattgcggttgccacttggatcatctggcttgctgttggatatagtggtcatgtgtcaaacgacttgcttggagacaccaagggcggttgggttgtctttgcgttgcagttcgccatttccgtctttgtggtggcttgtccctgcggcctggcgctagctgccccaacggccatctttgttggtggtggaatcgcggcaaaacatggaatcttggccaagggaggtggtgaagcgtttgagaaggccagtagggttgactgcgtcgttttcgacaagacgggcactttgacgatgggaggagagcctaagatcacggaatccgaagttttccatgatgcagcagcagatggtgaagctggtaccgtatttgcggcactgaaggcggtcgaagagaacagtagtcatccgatagcgaaagccattgtcgctttctgtgcggcaaagacgtccgccaaggcccaagtcgaggacttgcaggagattgctggcaaggggatgaaggccaggtgtataggtgtggactcacaaaatgactttgatctcattgtcggtaacgaatccctgatggaggacttttgcgttaccgtgtcgaatgagactgtccagacgctgcagaagtggaaaagagaagccaagtccgttgctttggttgccatacggcgacaccagagcaatgatcccaacagatggctccttgctgttaccctagcaatttccgatcccattcgccccgaagcaccactcattgtcgacgcgctccagtcccggggcacgcgcgtgtggatgctgtccggtgataaccccgttacggcagccgcggtcgcacaccaactcggcattcccgctgaccaggtcatcgccggagtgcttcctaccggaaaggccgataagattgggtatttgcaaggaacagaaaaggcgcgcgtcggcaagggcagcgaatccagtacccgccgtgcgttggtggccatggttggcgatggtatcaatgacagtccagcgctggcaacagctgatatcggcattgccatcggatccggagcagacattgccattagcagcgcggactttgtgctcatcaacagcgacctgcgcggggtggtgacgctcctcgatctctcgtccgcggtcttccagaggatcaagttcaactttgggtgggcggtgatatacaactgcatcggggttcctgtggcggcaggcgccttctatcccattgtcagccatgggcaccatgtcacattgaatccggcgtgggctagtctagccatggcgttgagcagtattagcgtagtgttgagctcattggctttacggagcagagtgcct

SEQ ID NO: 26966 - DNA, 5895 bp, Neurospora crassa
ctcgagacttcgaatcgcgaaaccctggccattgtcgactccaagacccaggccaacgccacccttgccgaggagctccaaacccagcacaagaagatcctcaagttgaaccaggaggttacgtcgctcaatcaggctgtacagaccgcgcagacggccgccaattccgcaaagtaccgtgaggaggccttgaaacaggaactggagcacgcgaaacgcaccaatgactggctggacaacgagctcaagaccaagaatgccgaggcgatcaagttccgcaaagagaagggtgctcgcatcgccgagctgcaacgcctaaacgaggacgcgaactcgaccattgaatcactcactagaagtgagcaggttctccgcaagcgactccaggaggcacaggacaaggccgaggagaccttgacaaaggtccagcaactccaggaagccgctgcccgtaccgaagagggtttcaagcaggagctcgagtccgccaagcgtcttgttgagctcaaggatcagcagtcggagactcaccgtaaccgcttgaaggaggtcgagttgaggctggagcagatcaaggatgatcacgccaacgagatcagacgcatcagacgcgagctcgaacaagaaaaggaggatcacgcacagacggagcagcgcgctcaggagctgcagaatgaagtcgaccgcatcaaggcatccagcgatcttcgcggtagatctcccggcactggacctcaaacccccaagggtgatggctcctttgccgctactcgcgcgggatctcccttcggtaccccgctctccatccgcggtagagccggccagcgtgctaccgatgctcttgaggagctttacaacgtcaagggccagcttgctggtgagaagaggcgctgcaagaagctacaggaagaacttgacgatgctgtcgcgatgctggaagcgaagatgcctgaaatcgacgagcttaatgccgagtcggaacgtctcaagaatgaaacgattcaaatgtcacaactcctcgagcagtcttacgaggagcgcgaccttgccgtcaagacccagaggaaggccgaggcagctgcagctacggctcaagctgaggtcaagattcttcgcgggcagctacgcgatttgagcactcaagtccatgtcctctgcttcaacattcatgcgcaggagaagggtctcgataagttgaccgaagaagaagctgccaagttcgaaaggctcaagaggggcgaagttagcgaaaatgcccttgacgacatgtcggatactcaccagtacatcaccgagaaattcgttgctttcacaaacatctacgaactgcaggagaagaaccaggagctcctacgtgtggttcgcgaccttgccgacaagatggagaacgaggaggcaatggccgaaaaacagcaagcagcccaggatcatgaagaggtccagcaacttcgtcttgttgtcacgacacttcaagatgaggtcaagtcgatcacggtccgcatgaagagctacatgacggagagagacatgttccgtcgcatgctccaacagcgagccaaccctgccgaaattcgcgctgccctgggcgaggatgtaagccaacgagaagttctcactagtatcgagcaaaactccaccgaagatgcagacctcgccgcggcctatagggagctacaggctcagtacgactcttaccgaaacgaccaaacgactgaacggaagtctctcaaggagcagatcgacaaactgtcttcggagaagggctcgcttcaggctgagattgccaaggtctccagccagcttacgctcgctacggaacgctacagcatgctggaatccaacttcaaggcagcccagagtgagaatcagcagctacagaagagaaatcaggccttgtccgagtctggtgttaagcaagatttgcgggtacagcagattgctgaggatctggttgaggctcgtggcttggctgagagtcttcgcagcgagaatgccaacctcaaggcggagaagaacttgtggaagacgatccaagagcgtttgagccaagataacgagagtcttgcacaagagaaggcaaggctgaacactctgttgaccaaccagcaatcccttctcaacgagcgcgaacttagcgagtccgaggcaaaacgcagacaacaaacccagatcgacgctcttgaggcagaactctccactaccaagcgcaagctttctgaggagatggaggagagcaagaagattcagctcaggaaagagttcgacgcccagcaataccagaaacgcattgatgagctcacgacgatgatcagccaggtcaaggaggagaatgtggccgccaagactactcgtgatcatcttcaggcacgtgttagtgaactcgaggtcgagcttcgtaacgcccaagaacgtgccgaccgtctccgtcccctgccaacagccagggcgcagcctgctgagcagggatctgccgaggatgattctcaggctcgtattgaggagctcgagaatgaggtccaggatctcaagaacaacatcgacttgctcaacgcgcagcttgagaatgccaagcaacaatgtgataacttcaagcagctcagtcgcgaaatggaggaagaactcacgagtgcgaacgagacccaagagcaataccgacaacagatggatgcggatctcgcagccaaggagagcaggatcaacgaactgcagcagcgcgttgaaggacttacagtcgaactgggcaactccaacagcgagcttaacatgctccgcgattcccaggccgatgtcgctcgcaagtttgaagacaaggagcgcatgctcaacagtgaaattgctcgcttgaaggacgaggaggaaagatacaaggaaaccttcaagttccatcagcaagacttgcgagctcaagctgaaattgccaccaaggcccaacaggattacgaacaagaacttgtcaaacacgcagaagcggctaaatcgcttcagcagcttcgcgaagagcataaccagctcaagacttattcagctcagtggagggctgaggctgagtcggccaaactttctctgacacagagtgaacaatcttgggaggagcggagacagcagctcgagcaagagatcgctgaaatcaaggcaaggagggacgacctaaccgcgcagaacaagcttctacatcaacagctcgatggcgttacctctcagattagcgctttgaagcagagccgttccgcaatggatgaaagcgccgaaggcacacagatttcggccaatgacactgctattgaaggtcttcgggaactcaacaactacctgcgtcgcgagaaggagatccttgaggtacaatttgatctcaaggtacaagaagcgaataggcttcagcagcagcttgagtattctcaatcacagctcgatgaagcacgtcttaagcttgatcaggagcgtcgctctcaagctgatagcgcccgaaactcacttacccacaaggagttgatggataagctgaacgagctcaacctgattcgtgagagcaatgtcactctcaggaacgagaacctgcgaatccaggcgcagcttgcgatgaagaaccgaaagattgaagacctcgagaacagaatccagcccttggaagcccggatttctgagctcgagctcgacaaatctttcaaggaggccgaggtcaagcaactgcaggaagcccgcgatggcctacaaaagagaattgagtctatcctcagcaagtatggccaggctgaccctcaagaagtcgagcagctcaaggcctcggtcgagagcctgcaagctgagcgtgaagctttcaagcagacagaagccgcgcttgaagagaagctcaaggaagctgagacgaacctagagactgagcggaccaactggaagaatatgcgggcccgacttgcagaggacttcaagacccgtttcggtaacgtcaagactcagcgcaacgagcttgctgctgagaagcaagcgcttcagaccaccctggatgctgctaatgaacggttgtcagccgttgagaaggatctggagtcggcaagacaagatctggccaacttgcaagcgcaaaacacgcagcttcaggaacagcacgcgcaggctgcagcggcagctgcagcggcatctgcagaacagactgttccggccgccgttcctgcagccgctcctgcagaacaggaccctcaacttttgcagcagctggatgcgcttagacaagaattggaatcagtcaaatcacagaaggccgcccttgagaccgaactcgaaagcctcaaggccgaactagcgacggcgatcgctgaacgcgacgaagcgcgcgccgaggtcgcacgcctacagtcttctacgcacggtactgacaccgagatgcaagatgttgaggccccggctcagcctgcttctgccccagcacctgctcaagaaggcaccggcctctcagatgaggaacggaaggcgttggaggagagaattgcggctgcggaggcgaaggctgccgagttcgaggccaaggctaaggacttggaagagcgtgctgatgccattgtcaagcagcgttctgagaagatgaagactgcgctgaacaagaggctggcggaatcgaaggaggccatggagaagcagacgcaggacgagagacagaagttgcaggctgaatacgatctcaagctccagcaagagctcgcgatcctgaaggccgagcagcagagcggcgtgtctcaaaatggcgtgccagcgacaccggcgaagcctcccactgcccaaactgcacagaccccaggtgccggtactcctgggctcccggatctcgccaaccttaccgaccagcagactcgcgagctcattagctccaaccaggtcattatggggattatcaagagtaatgtcaagaagaatatcgccgcagagtccaagaaggtccgcgaagaattagaggtggtcgtcaaggcggagtatgagcaaaagatcgcctcagcgaaagagcaagcggctgctcttaccgagaagaaatctgccctccggcttaacatgctcgatcgacagctcaagaccgagaaggccaagacggctgtcgttgagaccgcagcaaaggaaacgccgcagaaacccgttgtcgaagtatgggaagttgcaaaggttgctaagccggctgccccgcctccggcaccaccggcggccacactaccggcccccctgagtaggtcccaacgtgcccgcaaatccatgaccaagcatactaatgatggctcagacgccgctgctgtagtagttaaacctgctcctggagaggagatcaagcctcagattcccccgactcctaccaacaaggcggcgcccgctccggccaggcaaggctctatcgtaggtggacaggtcgttggtaatcccttcggtcagcctggagcgaatcaatccccggtaacttcgcagccacctgccaatcctttcggtgccgcgccccagcagcaacagaacgcgcaaccacagcaaccaccagccacaaacccctttggtgctccacaagcgcaacagcctggtcaacaacagcctggccaacaacagcaacaagggggccagttccctggtgctcagcagcaacagaaccagaaccaacagggtaaccgtaccggcctcccagttactgctagaggaggcgcgaacaacgctcgtggtggacgtggcgcatacggggcccaaggccgcggcggtcaggggccacgcggtcgcggtggctttggcggacgcggcggagccaacgccgctcaaggcggtggcggtatgaatccccatgccggcgagttccaacccggtcaacaagccgctggcaacaagcggcctagaggtgacggggagggaggaaaccaaggagggcccaagagagctcgc

SEQ ID NO: 26967 - DNA, 1479 bp, Neurospora crassa
cagactatctccggcgagcacggcctcgatgcctccggtgtgtacgtaacctcgtgcccaataaccatatctggtgatggcctcgaaagctcaccgcccactacaggtacaatggcacctctgagctccagctcgagcgcatgaacgtctacttcaacgaggtgagcaacaaccggtctcgacgatctccccctcctcgagaattcgctcgctaactagcttcgcgcttgacaggcttccggcaacaagtatgtccctcgtgccgtcctcgtcgatctcgagcccggtaccatggacgccgttcgcgccggtcccttcggccagctcttccgccccgataacttcgtcttcggccagtccggtgctggcaacaactgggccaagggtcactacactgagggtgctgagcttgttgaccaggttctcgatgtcgtccgtcgcgaggctgagggctgcgactgcctccagggcttccagatcacccactccctcggtggtggtaccggtgccggtatgggtaccctccttatctccaagattcgtgaggagttccccgaccgcatgatggctaccttctccgtcgtgccctcccccaaggtctccgataccgttgtcgagccctacaacgccaccctctccgtccatcagctcgttgagaactccgacgagaccttctgcattgacaacgaggcgctttacgacatttgcatgaggaccctcaagctctccaacccctcttacggcgatcttaaccacctcgtctccgccgtcatgtccggtgtcaccgtctccctccgtttccccggccagctgaactccgatctccgcaagctcgccgtcaacatggttcccttcccccgtctccacttcttcatggtcggcttcgctccccttaccagccgcggcgcccaccacttccgtgccgtctccgtgcccgagttgacccagcagatgttcgaccccaagaacatgatggctgcttctgacttccgcaacggtcgttacctcacctgctctgccatcttgtaagttgctgatcatggaatgctgcttttgaccactaatactgacgaatcaaacagccgtggcaaggtctccatgaaggaggttgaggaccagatgcgcaacgttcagaacaagaactcttcctacttcgtcgagtggatccccaacaacgtccagactgccctctgctctatccctccccgcggtctcaagatgtcctccaccttcgtcggtaactccaccgccatccaggagctcttcaagcgtatcggcgagcagttcactgccatgttcaggcgcaaggctttcttgcattggtacactggtgagggtatggacgagatggagttcactgaggctgagtccaacatgaacgatctcgtctccgagtaccagcagtaccaggatgctggtgttgacgaggaggaggaggagtacgaggaggaggccccccttgagggcgaggagtaaatc

SEQ ID NO: 26968 - DNA, 1944 bp, Neurospora crassa
cagcaaaagcagcaaaagcaacagccaaagaaggagcagccaaataaggcagcgaataagaagaacgccgaggacaagaagaaggcccgcaagaacgagaaaactactgtcgagccgaaggaccccgaactagaaaccgatcttttcaccaaactggaggagcttcctgagcctgaagaggaggaaattgatatgtccgaatgggtgccactcgatttgtcacctcgtatgatctcgtccatcgccaaactcaggttctccaagcccaccgtgattcagtccaaggctattcccgagatcatggctggtcacgacgttatcggaaaagcatccaccggttcgggaaagacgttggcattcggaattcccgtcatcgaaagctggttgagcgctgctgagacgaggaagcagaacaaggaagagagaaagggcgctacagcgctgattttgtcacccaccagagaacttgcccagcagatcagagaccatcttcaagcgctttgcaaaggtcttcctacagcaccttacatttgctcggttcttggtggcatggccgtacagaagcaaaaacgacagctccaggtcgccgatatcgtcattgcgaccccgggcagaatgtgggaggttatgagctcagataactctgtgctcgcttctctgaggaacatctccttcctcgtgttggatgaggcagatagacttcttaaggacggtcacttcaaggaggccgaggagattttcaaggctcttgacaggccaccggtggaagagaacaatgaggatcagaagatgggcggtactgatgaggagggacaggaagaggaagaagaggacagcgaggaggaggaggaggaggaggaagagcacgtcaacaagaggcagactctcattttctccgccacgttcaacaagaacttgcagcaaaagttggccggaaaatccaagttcaaggcgacgagcacccaggacatggagtatcttctccagaagctgaacttccgcgaaacccccaagtttgtcgacgccaatcccgtccaccaaatggccgagaacctcaaggagggtctcattatgtgcggcgacatggagaaggatctctacctctatgccactctcatgctccagcccacacggcgcgcgcttgtattcaccaactcggtcaactctgtccgtcgcctaacccccctcctcgagaacctcaatcttccagccttccctctccactcgggcatgatccagcaagcccgtctgcgctctatcgaccgcttcaaggccaacgaaggcgcaaagaaaaagaacggttctgcagctatcctggtcgctaccgatgttgctgcccgtggtctcgatatccccgacgtcgacctcgtcatccactaccacgtcccgcgcgccgccgaggactacgtgcaccgctccggccgtaccgcccgtgcctccaactcgggcacgagcatcctgctctgcgggcccaaagaagccgtgccgacgcagcgcctcgttgccaaggtgcacgcccaggccgaggtcaaggccggcaactcgggcaacaacaccaagaagctcgtttcgagcggacttcgcaccatcgatatcgaccggcgcatcgtcgccaagttgcgggagcgcgtcgacttggccaagaagatcgcggatgcggtgcaggccaagaccatgggtggaaaagaggacgattggatgaagaaggcggcagaggacttgggcgtcgactatgactcggaagagcttgagaaggcgggcaagtggggtggcaagggtagctccaagaagcagaagcagaaggaggcacagcagatgagcaagggcgagttggcgtcgctgagggctgcgttgagagacctcttgagcaagaggatcaacacgggcgtcagcgagaggtacctcactggactggatgttagtgagctgctgaagggcgagcag

SEQ ID NO: 26969 - DNA, 1182 bp, Neurospora crassa
gacgagcccttttacacgtcatgtcaagaacccgccattgaccaaccgcgcgagaaggcagcgatggtgatgctggtccgcaaccaggagctgatgaaggcgctcaagacggtgcagagcattgagaaacacttcaatcagtggtttcactaccccatcgtcttcctgaacgatgagccgttcagcaaggagttcatcagcgccatgaacgcgactgtgagtggggaagcgaggttcgagctcgtgccgaagaaggaatggctgtttcccgagtggatggatgtggcggatgcgaaggcatctatcaaagcacagggggaggcggggatcctgtatgctgggttggaaacttatcaccacatgtgtcggttttactctgggtgagtctagccacggttctccgttgcttcctccacccacgtttcttctaacctccccattctgttccccttcacagcaaattctacaccctcgaagcactcaaagactacgcctggtactggcggatcgagccagacgtcgagttctactgttccattacctacgacccttttgtcgaaatggccaagcacgacaaagtgtacggtttcaccatcgctctgccagaggagccgcggacgtgcccaagcctcttccgcaagatggccgactacaaggagttgaacaacattccgaccacggagctgtggaaggccacgatagctgcttcatgggtgccttggccactccgccccttcatgggttggtttcggcaccgcgaccgctctggcgatgggtggagtttgtgtcattactggtccaactttgaaattgccaacctggacttttttcggggaaaggactatcagcggttgtttgagtatcttgataagactgggggattttactacgagcgggtacgttgtttcttattttcaccaggacaatcttcagaccagggtactgacacctttacgtcgttttcagtggggtgacgcagccgtccattctcttgctttgcacatgcttcttccttcccacaaagttcaccactttgaagactttggttaccgccacgactggtattaccaatgtccagccaatgcaccaaatggtcaactgttcgagtcgaagctacttcctgatggtccatatagcccagaacgtgaaggcggtattggatgccggtgcgagtgtgacggg

SEQ ID NO: 26970 - DNA, 4134 bp, Neurospora crassa
ttcaccctcctgtacctgcctggttacattgtcagctccatcatcatgtgggcggcagtcttcaggaccagcagcgttggtatcctcattatctaccatattctcgctggtctatcgttggcttccttctctattttgggcgcggctttcttcaaaaaagcacagctcagtggtatctccatcgtcattctttacattctgctcggtgtcattgcccagatcatcacggcacccaagactgccacggttgtcgtcctcagtttgctgttcatgccgtgcaattacacctacttcatcgcttaccttgcacgctttgaggccaaggatatggcaaccaacctcggcaagagtgctcctgatagcccctcgcaagtggccggtatcgtgttttggatcttcctgattgttcagatctttgcttatcccattctcggtgctataatcgagagatacctccacggaaccacttcttccacccgcaacatcgcctacggcgagaattcggagctaggacccgacaatgccgtccagctggatggcttcaccaagatttacaagccgggtccttttcgcaacatgttttccttcctgtccaaaccgagagagcccgttattgctgtcaatggcttgaccctcactgcccgtcgtggtcagattctcgttttgcttggcgccaacggtagcggaaagagtaccacgctcgacattatcgctggcatcaacaagctttccagcggcagcatcaccgttgacggcaccggcggtctcggaattgctcctcagaagaacgttctttgggacgagctcacggtcgaggaacatcttcgcatcttcaaccggctcaagtctcccaaccagcttgccaccaaagaggacatcttggaacttatcagcggcgttgatctcgcccaaaaggttgacgcaagatctggtactctctctggcggccagaagcgcaagctccagctcggtatgatgttgacaggtggctccgccgtctgctgcattgatgaagtctccagcggtatcgatccactttctcgtcgcaagatctgggacatcctccttgccgagcgtgggcatcgcaccatgattcttactactcatttcctggacgaggctgaccttcttgctgaccatatcgccatcatgtccaagggcacgctccgcgccgagggctcttctgtcgaactcaagaaccgcatgggtggatacagaatccatctgaacaacgccaagtacatctccaactcgcccaacgtctctggtgtccagaagaaggtttcccccgaggagattacctacatcgcctctacctcggccgcggcagctcaagttatcaaggagcttgcggttgctggcatctcggattatcgcttctctggtcctactatcgaggatgtgttcttgtcacttgctgaagaggttcgggcggaagatggcgcgagactcgaccagttccaaagcaccgccgctgtcctaggcgcgcaacggagtacggaaaaacagtcttcgactgagatggttaacaatgcccccgttgacgacacaaccaagcccagtcttaacctcctgtctggtcagcgtatcggatatttcaagcagggggtagttctcttccgcaagaggatgaccatcctcaagcgcaactggttcccgaccctcgctgcatttgccattcccatcatcgctgctggtttagtcactctgttcgtcatgggcaaggatcctgttggctgcagccctgcagatcagtcttctcgtcgtgttgcaactaacctcttcgcctccgattttgacctcttcatgatagctggtccctcggacaagttttcggctaataacctcgcccgtctttttgctcccatctacatggctacccaggacaacgctaccagcagcggcaactccccgggtattggcatgaaccccctggacctgttcaagaacatcacgctggttgacactgtggatgagttcaactcggctgtggtgcagtatcgcaagaacatcactcccgccgctgtctggcttggggaggacaactctgtcccgaccatgacctacaggtccgacagcgtggagatgttcaccgcttggttcggccagtggatcaccgacatgatgctgtccaacaccacgattgcttctcagtttgtcaactttgacattcccttcgctcccgacacgggcaagtctctccagatgcttgtctacatgagtctggcgctttgtgcctaccctggtttcttcgctctgtaccccaacgttgagcgccgttcgtttgtgcgtggcttgcaatactcgaacggtgtgcgtcccttgcctctctggctcgcctacaccaccttcgacttcctcatagtcctcgtcgcgagcgccatcatgacggctctgctcgccggcctggccagtgtctggcaccacgtcggatatctgttcatcatcttcgtcctctacggtctcgcctcgatattgctggcctatgttatctcgctctggagcaacaaccagctttcggcctacgcattcaccgccggtggccaggtagtcatgttcctcatctacctgatcgcctacatgtgcaccatcacctacggccccgtcgacagggtggatgatatgctcgtcgtggtgcactttgtcgtagccatcttcgcccccatcggctcgctcacccgcgccctcttcatcgcgctaaaccttttctcaacagcctgcgacggcgacaagctcgcctcgtatccgggtggcatcctccagtatggcggtccgatcctgtatctgattcttcagtccatcatcctcttcatcctcctcgtctgggtcgacgccggcaacccctgctcaaccctcaagcagctcttcaagcgcaagccgcgctccgccccgcccaccgtcgcccaagaagcagacggaatctctgacgaagaagtcgcccacgagctcgtccgcgtcaagtccaccgccactggcagcggggtcgccggcaccaacaacacggacggtctacaggtcgtcaacctaaccaagacctttgggcgcaacacagccgtggacaacgtaacctttggcatccctcacgggcaagtctttgccctcttaggccccaacggcgccggcaaatccacgaccatttccatcatacgcggcgacgtcaagcccgactataattcaggcggcgacgtcttcgtcgaacaatcctccgtcgcccgctctctcgccgccgcccgctctcacctcggcgtctgcccccaattcgacgcagtcgacaccatgaccgttctcgagcatctgcgcttctacgcgcgcgtgcgcggcatccccgcttccggcatagagtacaacgtcgaacaagtcatccgcgccgtcggcctgacccaattccgcgaccgcatggcgcgtgcgctatcgggaggtaacaagcgcaagctgtctctcggtatcgctctgatgggtaaccccacggtggtgttgcttgacgaaccctcctccggcttggacgcggccgccaagcgcatcatgtggcgcaccctcgccgaaaccgtgcccggccgctcgatcctgctcaccacccacagcatggaggaagccgacgcgttggcgggcagagccggcatcctcgccaagcgcatgctagccatgggatcggttgactcgttgcgcaagcgcttcggcgatacattgcacgtccacctcgtctgccgtggcgcgccccgcacgtcggacgcccggattgcgcaaatccacgcctgggttgaatctacctttggctctgccgccgcgatggaggggaagacatatcacgggcagatgcggttttccgtacccgccgctgttgtcctttccctcaccactggcatcattaaccagcgggcagataagggcatggcagcggaagaaatcagggagacggaaacccagcaaagcacgacgagcgcgataggcaagttggtagtgttacttgaagagcagagggaggaattgggcgtggagcatttcagtgttagtccgacgacgttggatcaggtcttcttggaggtcgtggggaggcataatgttagagaggaagggtatgcggctccggaggaggggaagaaaagggggttgaagaggtggtttaagaggagttag

SEQ ID NO: 26971 - DNA, 2070 bp, Neurospora crassa
gatggtgatactatctcggccgaggagcttgagcgctacatgagagttggcgctagggacgtgtcgattctcgtcgttgacatcagaagtcgtgacgagtacgatgagggccatgtcatgtcacaggcaacaatatgtgtcgaaaatgaagtgctgatgaggccagatatttctgccagcgatatagcagagagcatggtattggcaccgcaagccgaacagcagcgttttgagagacggcatgattttgacctgattgttttctacgaccagcggtccaaacgccttgtatcgagtccccagacaccagaggaacgagcggtcctaactttttacaatgcccttacagcgtatgactacgccggcggatcaagttcacaacagcgactgaagttgcttaaaggtggaatagaggcgtggaccgacctagttgggaccggagctttgcagacatcttccacgagtgccgctgcgagatcacagccaaggccacctttgacccacaacctcacaagtcgtctacgcagaaacgtaacgcggccaatacaagatctcgcggaggtacaaaaatgggaagaaaacgtcgatattgttactccggtgagaactacggaagactttttgcggagatacccttccgtttcaacgatacaggagtccatgacttcacctatcaaccctgctgccgctcggccagcgagcccattacctcgacatatcgtacacgaacagaacctttactcttcgctaccatctcctccaactcgcccggctccgactgtcccacgtaggagttatagcggcctagcagaaaccgacaccagcaccacggcaacgtcaacaagatcgtcacttaaatcgggaattgagaaagtccgcaagtttaggactggtcttgtcaaccctggtgtattctgcttcgccaacagctctctgcaagccatgttcgccacgcctggatttgctcgcgagttgtacacgggtgtttggaaggatgtgtacaaagtcccactgaaagcggatgagaaaaacgaaaatcctcaattactcaccaagtatttagctggcctattccactggcttgatgagggaacgctgagatcgttggaagcgaagcatctcatggtacgtgatgatttggatattatgtggccgtcgcggacgattcacagactaacaccgcataggcttatatacactttattcactccaagaacgcggatggcaggaagaaaccagaaacggaaatctttggcgggccggcgcagcaagatgcccaggagttctactcatttatcattgacaacatccatgacgaaaccaacgttcaccgagaccgcaagccgcccaaagaagaaaagccgtatacacccaagaacgggacagtgatccagaatgccattgattattggcgtgactattcaaacgccagtgcttctatcattgacaagtacttccggggcctagaagtcttcatctcccgctgccagaacgccgaatgccggcaagaaatccgcatgttccagccctgcgacgtctggatcctcaacatcgccgccgagacaggaggcgaaggcaatggctacggagtcacggatcttgaccgtcttcttgccagccaccaagcaaccgaacacttcccggacctgaagtgcgaaacatgcaaccaacccggcaggacaagacgggccaagtttgctcgcctccctgaccgtcttgccttttgtctcaaccggttcaactcgtcctttgggcagtcccgaaattcgttctcctccatcctttctggcggtggttccaacaagatccacaccaaagttcggttcccgatccgtgacctcgatctgaccaagtactgcgccgaaccggatccggacatggcaactacggacgatgcgcactacgccggccgcatgaagtatgattgctacgccgtcacggtacatgtgggacagggaatcaatggcgggcattactatacgtacgtgcaggatgagcagtccaaggacccgacggattggttcaagtgtaatgatgatttggtggagagggtgaagattggaagtggtg

SEQ ID NO: 26972 - DNA, 1434 bp, Neurospora crassa
ctcgacgccattcccgccgtctgcagcaccgcccgtgccacctttgcctcccacaagaccaagaacctgcaatggcgtctcgtccagctgcgcaagctctactgggctctcgacgacttcaaggcctcgctcatggccgcgctgcagcaggacctgcgcaagggcggatatgagtcggacttcaccgaggtcgactgggtcaagaacgactgcctgcacatgatcaacaacctcgagacgtttgccaagacggagaagctcaaggatctgcccgtcacctactcgatgatgaacttccgcgtcaaaaaggaacctttgggaaccgtcctcatcatcggcccttacaacttccccatccagctggtgctggccccgctcgtgggcgccattggcgccggctgcacggccgtcatcaagccctccgagctgacccccgcgtgcgccatggccatgaaggaaatgatcgagagccggctggaccgcgacgccttcgccgtcgtcaacggcggtgtccccgagaccaacgcgctcatggaggagaagtgggacaagatcatgttcaccggcagtgcccaggtcggctccatcattgcccgcaaggccgccgagacgctgacgcccgtgtgcctcgagctgggcggcaggaacccggcctttgtgaccaagaaggccaacctggcgctcgcggcccgccgcctgatgtggggcaaggtcctgaacgccggacaggtgtgcatgagccataactacgtgctcgttgacaaggatgtggccgacactttcatcgagttcctcaagattgcgtacaaggacatgttccccaacggagcaaaggccagcccggatctgtcacgcattgtcaacgcgaggcacttcaacagaatcaagaagatgttggacgagaccaagggcaagatcgtcatgggcggcgagatggacgagagcgagctgtacattgagccgacggcggtgttggtggatagtctcgatgatccgatgatgcaggaagagagcttcggtcccatctttagcatttaccctgtggacaccctcgaccaggcgctcagcattgccaataacgtgcaccggacgccgttggcgttgatggcgtttggtgacaagtcggagactaacaggagtatgcttctttttttctttgattcttcccccttttatgtcaattcagtctgttatactaacaagctaccccaatcacttacagttctcgacgaaatgacctctggcggcgcctgcatcaacgactcctacttccacggcgccgtgcacacggtccccttcggtggcgtcggcgactccggctggggcgcctatcgcggcaaagccagcttcgacaacttcacccacttccgcaccgtgtccgagaccccaacctggatggaccggttcctgcgcgtgcgctacatgccgtacgac

SEQ ID NO: 26973 - DNA, 1107 bp, Neurospora crassa
acagccatgagatatacaggccaaggcgtccaaagagtcggcatgctcacgccctggctagaagcctttccctcgacaacttccgaaatcatcgacgaaattgactcgatagtgggccacaagctctcggacgtgatacaaaatgggcccggcaaggacctcaacctgtcgcccaacgcacaaccagccatcatggctacctcgatattgatcatccgcattctcgaaaagcatttcaactttagagtccaagacaatgcccactttactctcggtcactctcttggcgaattcgctgcgcttgtcgcaggcggctatatccattttgaagatagtttgcgaatggtgcaaaagcgagcggaagccatgtccaatgccacgcggcaggccgaggagatgtatggcggagagtacggcatggtggcactcgtcagtagcaaggccgagcacctgccacccttgattgccgcaatccacgagttcgtcggctacgacagcgccggctcgaaagtggagagcgccgacgaatggtgcccaatcgaccaagtgctcattgcgaacgtcaacagcaagacgcaaatcgtgctcagcggaagcattgagcgcatcaagacactggtggaacacgtgcggcagttcctgggacacgacccacgcgcggtcaggctcaagagcgacagtccgtttcacagtcccatcatgaagccggccgtcggggtgctgcagcagatgatggcgggaaacagcatggtcaaggggagggaaaaggaggacattatcacgtttcccggcaaggttacgtgcattagcaacgtgacggccaggccgtttgaaagtagggagcagctcaaggaccttttggctcggcaggcggtcgagacggtacagtggtgggacagcatcaagtatctggatcagtccatgaaggtcaggagatgggtcggtatcgggccggggtacgtgggccggaacctggtgggcaaggaggtgggcatgcgcgggaaggacgtcatcaagggcgccggtgtctgggcaatcacggatccgaaggagattgaggaggtgctcagagggttggaggagacagacttttatgaggacgacgag

SEQ ID NO: 26974 - DNA, 1525 bp, Neurospora crassa
tcgacgtcctccaacgtcgtcggtgtacactatcgagtgggaaagaaaatcggagagggttcatttggtgtcattttcgagggtaccaacctcctcaacaaccagcaggttgccatcaaattcgtatgttctatttcttggaccttggctcgtcgcgccttccccatacgcgacgtgggatgaactggattgacaagtaatgtgattataggagccgcgcaagagcgatgctccccagcttcgcgatgagtacaggacatacaagatccttgtgggatgccgtgagtataggcctttcctgagtcgtcatggttccttgctaacctcgtatctacagctgggatccccaatgtctactactttggccaagaaggtcttcacaacatcttggttattgatctcctcggtccctctttagaagatctctttgaccactgcaatcgccggttcagtctcaagacggtcgttatggttgccaagcaaatggtaggtcggccggtcgtcttccccgtgtcccctgaaacgaggtaatctaacctttatgtagctgtcccgtgtccaaactattcacgagaagaacttgatctaccgcgatatcaagcccgacaacttcttgattggaaggcagggaaccaagaccgccaatgtcattcacgtagttgatttcggtatggccaagcagtaccgtgaccccaagaccaagcagcacattccctaccgcgaaaggaaatcgctttcgggaactgcccgttacatgtctatcaacacccatcttggccgcgaacaatcccgacgagatgatctcgaggccttgggccacgttttcatgtacttcctccgcggtggcttgccgtggcaaggcctcaaggctgctactaacaagcaaaagtacgagaagattggcgaaaagaagcagaccactgccatcaaagatctctgcgaaggattccctgaacaatttgcccaataccttacttacgtccgcaaccttggcttcgaggatcaacccgattacgactacctccgcgaacttttctctcaggcgctcaaggatgccggtggcgttgaggacggcgaatatgactggatgaaggttaacaagtccgacaagaagggggactgggatcggcctggggctttgcacaacccaaacgcgagacctgggccctcagctatggaaatccacaactcgagggggcccacgacccatcacgcaagcgacccccgagctcaattgacggccgctcgtttaaacgccccgcagccctcgcctccagctcagccggggcagcgggcgaaagagcaaccaaacgccaacgcgcagaataaccgggcttacaagtcccaacccacgcccacccagtcggcgggaaatggggcgcaaccatacaacatgcagcagcctccgcaacggacaatgacccacactgccacatcgaacacgaacccaccaccttctaaccagccacaacaacagcaaggcggcatcaagggcatttggaaggccctgtgctgcagctgaaaa

SEQ ID NO: 26975 - DNA, 1680 bp, Neurospora crassa
ctccgcgaaggtcccggcagcgcccctgctgctccgtcaactcccgcttctgtcatcgcccagcggacgggaggcgctactcctagccacgcatcgaagccctccgtcggtggcagcggcaagatcttcgtccaaggctcaaacgctaacatcacccacaccatcaacgaagatgaacgtaccgaattcacgcgccacatcaacgctgtccttgcgggcgaccgcgacatcggcagccgcctgcctttcccgaccgacaccttcgagatgttcgacgagtgcaaggatggtttggttttggccaagctcatcaacgacagcgttcccgataccatcgatgagcgtgtactgaacatgcccggcaagaagaccaagaccctcaacgcgttccagatgacagaaaacaacaacattgttatcgagtcggcaaagggtattggctgctccgtcgtcaacattggtagctcggatatcattgaggtcagggagcatcttatcctgggtctaatttggcaaatcatccgtaggggcttgctgagcaagatcgatatcaagctccaccccgagctctaccgccttctcgaggaggacgagaccctcgagcagttcctcagactccctcctgagcagattctcctgcgctggttcaactaccatctcaaggccgccaactggcccaggagggtagccaacttctcctctgacgtcaaggatgccgagaactacaccgtcctcctcgctcagatcggttccgactacggctgcacgagggcgcctctgcaaacgcgcgaccttcatcagcgggctgaggaggttcttcagaacgccgacaagctcggttgccgcaagttcctctctccctcttccctcgtggccggtaaccccaagctcaacctcgctttcgttgccaacctcttcaacacacaccccgcgcttgaccccatcactgaagaggagaagcttgaggtcgaggactttgacgctgaaggcgagcgtgaggcccgtgtgtttaccctgtggctcaacagcttggacgtcaaccccgcagttcagtccttcttcgacgacctccgcgatggtaccgtccttctacaagcatatgacaaggttatcaagggttccgtcaactggcgccacgtcaacaaggctcccgcgcatggcggtgagatgctgcgtttcaaggccgtcgagaacaccaattacgcgatcgagttgggcaagcagaacgggttttccctggttggtatccagggtgccgatatcacggatggtcagcgcaccttgaccctgggtctcgtctggcagctgatgcgcaaggacattacccttaccctgcacggtctagcccaacgcctcggcaagcgcgagattacggatgcggaaatggtcagatgggccaacgagatgagccgcaagggcggccgcaactcgagcatccgctcgttcaaggaccctgtcattggctcgggtattttcttgttggatgtgcttaacggcatgcagagcaactatgtcgattatgacttggttactcccggcaagactgatgaagatgcttacctcaatgccaaactcagtatcagcattgccagaaagatgggtgccactatttggctggtgccagaggatatctgccaggtgcgcagccgcttggtcacgacctttatcggtaagttgctc

SEQ ID NO: 26976 - DNA, 1707 bp, Neurospora crassa
cagcagcagcaacaacaacaccggaatcaaccggccatgctgccaaacgatcaaaaagaagaggcaaattctccgacttggtcttcacccgcaacttctccacctttgaccggcaaaacgccctggcagcgtcgtcgccctttcacggcttcttcaccctcttctggctcggcatctccctcttcgttatcaagatcggcgccgagaactggcggcagcacggcaacccgctggggcggaacgagatttttcgaatcatgttccatcgggacttggtggtcttgctcatcgccgacggtgtaatgtgcctatccaccggcgtttcctgggtcctgcagcgtcatcttgtccgtcgaggcgtggtcgattgggatgaggaagggtgggtgttgcagaatatctggcagtgtttgttcgtggctggtgtggtgggtttcccactgtggagggactggccgtggacacataccgttttcttcgtcatgcacggcatggtgatgctgatgaagatgcattcgtacgcgttctataacgggtatctggcgtcggtgtggaagaagcggcagctgttgctgggaaaactgaaggaacttgagcatgtagaggttgttaccaagcatgacccgaacaggagctggacggagccgttcccgctgctgccgagagacctatcgaccgagcatctatcgagagtgccgtcggcgcaggagtataaggagaggagaaagatgtcgatcgcggcgcagcaaggggctgatggccaggaaggagagaacgacgtggccaagatcgttgcggcaattgactcgcacgagccgttgaatgaggagcaggtccatgtttttgaaagggcgctcaagtgggaggtggacgccatgacggatgagctcaggggcaaggcgacggacgacaagagggtgtatccgaataacctgacgctggcgaaccattacgagttcatcgtgctgccgacactggtgtacgagctcgagtatccgcggtccgagtccatcaactggtactatgccgccgagaagatggtggcctgtttcggagtcatcttcgtcatgatcatgatctcgcaagccttcatataccccgtggtcatggagacggtcaggatgaaggagatggggatgccgttgagcgagcggttccagtatttcccttggatgctggccgacttgattttccccttcatgatggagtatctgctgtcgtggtatctcatctgggagacgatcctgaactttgtagccgagctgaccaagttcgccgaccggaacttctatggtgcctggtggaacagcgtgtcgtgggatcagttcgcgagagactggaaccgaccggtgcataactttctgctcagacatgtgtaccacagctccatctcggccatgaaggtgaacaagcacacggccacactgatcacctttttcttgtcggcatgtgttcatgagctcgtcatgtggtgcatcttcaagaagctgagaggctatttgctgttccttcaaatgttccagttgccggtaagttcagatatcccctaacctacgcgttggctgacatgatgctgacgtttttggacagcttgtgagcttgagcaggacaaagtggatgcggaataggaagacattggggaatgttttcttctggctgggtatttttacaggcccgagtatcctgtgcagcttgtatctgattctg

SEQ ID NO: 26977 - DNA, 1026 bp, Neurospora crassa
ctcagcgccgccgaccagttccgatccgcagtttctcagcctaccgtggctgccttttgcgccggcggtgtcgccggtgccgtctcccgaacagtagtctcacctctggagcgcctaaaaatcctctaccaggtccaaagcagcggtcgcgaagcgtacaagcttagtgtgggcaaggcgttggccaagatgtggagggaggagggctggaggggcttcatggccggtaacggcaccaattgtatccgtatcgtgccatactcggcggtacagttcggaagctacaatttctacaagagaaacatctttgagaggcatccgggcgactccctcacgcccttgtcgaggctgacttgtggtggcctcgccggcatcacctcagtgaccttcacctaccctctcgacatcgttcgcacgaggttgtcgatccagaccgcgtcgttcgccgagcttggcgagaggccacgcaaaatgcccggcatgtgggaaactttggtcaagatgtacaggaccgagggcggatttccggctctctacagaggcatagttcccactgtcgctggtgttgctccttacgtaagtcaaacttggcatgtgtcaaggtaatccgtatgtgttgaccgtggtcaataggtcggtctcaatttcatggtttacgagcatgtccgccaatacctaaccttggacggcgagcaaaaccctagtgccgtcaggaagctgctcgctggtgcgatttccggtgcggtggcccagacctgcacctatcccttgtgagtccaatcttcccccatcttctatgcgcatgactaatcagggggggaacaaaaaagcgatgttttgcgccgtcgtttccaaataaacaccatgtctggtatgggctaccagtacaagggcatattcgatgccgtgcgcgtcatcgtcaccgaagaaggaatccgcggcttgtacaagggaatagtacccaacttgctcaaggtcgcgcctagcatggcgtcgagctggctcagttacgaggtctgccgtgat

SEQ ID NO: 26978 - DNA, 4434 bp, Neurospora crassa
atcaaggagcagctggccgaccagctccctaagcgcttcagagccctgcagttcggagtccagtcacaccaagatatagtaaatcagggtgtcctcgaagtctccgacaacctcctttacgatgtcgaaaacggccgccgcactttcccccacggccccctcgatccccgtctcggtacttcgagcaagacgggcacctgcgagacttgcaacctccctctccagtcctgcgccggtcacttcggtcacgtccgcctcccacttcccgtcttccacatcggctatctcaagtacattcaggccacgctccaaaacatttgcaagacctgctcaaaggtcctgctcgaggaggaacccaaggccaagttcctcaaggctctccgtgcccctggtatcgataacctcaagcgatcggccatcctcaagaagatcaacgatgaatgccgcaagcaaaagacgtgcccctactgcggcgacacccagggtgttattcgcaagttgagcgtcatgaagcttacccacgacaagttctcgcacttcaacaagtcgactgcccagaaaaaggttccgcccgttgccaaggccgccttcgattcctccttcatccaggcaaaaacattcactccggacctcgagaagcactccaagaaagctatggacgacatggatcctctcaaggtcctaaaattgttcaagaagattaccgccgaggactgcgagttgctcggattgaacccttccgagggcagaccagagatgttcttgtggcaatatcttcccgctcccccaatctgtattcgtccgtcggtccagcaagaagccgccagtaacgaggatgacattactagtaaactctccgaaatcattctctacgccggccatttgcgcgaatccctcctcaaaggtgctgccctcaacaccatcatggaacagtgggagttcatccagctccaggttggtatgtacgtcaacagtgatgttcccggtctctaccagcccggctttggcaagcccatccgcggcttctgccagcgtctgaagggtaagcagggtcgtttccgtggtaatctgtcgggtaagcgtgtcgacttctccggccgcacagtcatttcgcctgatcccaacttgggaatcgaccaggttgccgtgcccgagcgcgtggccaagaacctgacctatcccgagcgggtgaaccgcaacaacattgaaaagttgcgaaaatgcgtcatgaatggacccaaagtatggcccggtgctcagggcgtcatcaaaagggacggcggcatgaagttcaaccttaactttggagatgagtccatccgggaggaacgcgcgcgggaactcaagtttggtgacgttgttgaaagacatctggaagacggcgacattgtactcttcaaccgtcagccctcgctacacaagttgtctatcatgagtcatcgtgcaaaggttagaccctggaggacgttccgtctcaacgaatgcgtgtgcactccctataacgccgatttcgatggagacgaaatgaaccttcatcttccgcaaacagaagaggctcgcgccgaagccatcaacctcatgggtgtccaaaacaacttgatcacccccaagaacggtgaacctattatcgccgccacgcaggatttcattactgcggcatacctcctgagtagcaaagatttgttcctcgaccgcaagacctttacctacatctgcacgcagatgctgttgggcgaaacccatctcgaccttcccccgcctaccatcatcaaacccgtcgagttgtggacgggcaagcagattttcaacgttttgatgcgtcccaacaagcaatcaccggtcctcgtcaacctcgaggccaagaacaaggtctacaaggcgaagccaggcgagcttccggatatggacattgatgattgctacttggtcgtccgcaactccgaggtcatgtgcggaagaatggacaagtccaccgttggtggtggcaagaagaactcggtcttttatgttatccttcgtgattggggtccggagcacgctgctcaggccatgaaccgtctggccaagttgtgtgctcgcacactaaccctccgcgggttttcgattggtgttggcgatgtctatccatccaaggatttgacggagcacaaggctaagctggttcaggatgcgtatgcactctgcgacgacctcatcgcacagttcaagtctggaaggcttgaaaaggctcccggttgtaacatggaggagacgcttgagaacaagatctctggtattctcagtaaagtccgttcgcaggccggtgactactgtgtcggccatttgagtcgcaacaactctcccttgatcatggccaaatccggttccaagggttccgacatcaacgtcgctcagatggttgcccttgtcggacagcagattattggtggcaagcgtgttgcggatggattccaggatcgtaccctcttccacttccacaagaacgctcgccagccccccagcaagggtttcgtgcgcaacagtttctacactggtctggtgcccactgagttccttttccacgccatctctggcagagaaggtttggtcgataccgccgtcaagacagccgagacaggttacatgtctcgtcgtctcatgaagtcgttggaagatctctcaactcagtacgacgataccgtgcggacatcggaaggaaatattgtgcagttccagtacggtgccgacagactggatccagcagacatggagggtaacgccaagcctgttgatttcgagagatcatggaatcatgccgaaagcttgacaatgaaccacaatgacaggtcgctgcttccggcagaaatctcggccatgtgcaaggagattctggacgaaaggcggaaatggtacgtgcgcaagcaccttgtcacgggcgagttgctgcactacgaggacaagacgattgcggaaagtgacgatcacgatgtgttcattgccatcgatgagcatgagggtgccagagtctatctcaacaccattcaggctgagatggacaagcgcgcactcaagctggcaaaagcacgcaaactcgctggcttggatccttgtctgccccaggacaacgcggacctgctgaaggaatttgctgcatgggagaagaagcaaaacggcggcgatatcaagatgttggatccggaagaagaagaaatccagcaagcccacgttgatcgtgtcgccaaggtttcggaggctaccctgagaaagttcatgaacctctgtctttccaagttcgataaggcaaaggtggagcctggccacgccgtcggcgccgttggtgcgcaatctatcggtgaacccggtacgcagatgacactcaagactttccatttcgccggtgtcgctggtatgagtatcactcagggtgttccccgtatcaaggaaatcattggcgcctcgaaactcatcagcacgccagtcatcagctgcgagctcgagaacaaccgagacatcaaggccgcgcgcatcgtcaagggcaagattgaaaagacttatatctcggatgtcatcacttatgttgaggatgtctggcttccggatgttgccaagattgtcctcaagatcgatatgcaggctctttcggacatgcagctcggtatcggtcttcgcgagatcatggtggccatcgtcaaagctaagaagctcaagctaaaggtggagatggacgatctcaagatcggtcccgataatactattgaggtcatcgtgagcaacgactggaaggatctgaccgcacaaaagaaggcggcgcgagttcgcgccgcagcgattgagaagggccaattgcttctcaccacctcggacgagaccgccgccgacttccaactgcgcgtcaacttcctcaagcgcatgctccctgctgtgcccatctccggctaccccgaggctttccgtgccatcatccaatccagcgagtccaatgagcacaaggtcctcgttgaaggttacggcctgcgcgcctgcatgaccacggagggcgtcatcggcaccaagtgtatctccaactccatcatggagtgccgcgacgttttgggcatcgaagccgcccgcaccaccatcgccaaggaaatcggcagcgtcatgggcgacatgggcatcgatccccgtcacatggatttgctggccgacgtcatgacttacaagggcgagattctcggtatcacgcgccatggtctcgccaagatgcgcgacagcgttctgcagcttgcctcattcgagcgcacgcccgatcacttgttcgatgcggccgcgggcatgaagaccgaccgcattctcggtgtgtcggagtgtatcatcatgggccagaccatgaagatcggtacgggagcattccaggtcgtcagacggttgggtatccgggatcatcaggttagacccaaaaagtccatgttcgag

SEQ ID NO: 26979 - DNA, 2426 bp, Neurospora crassa
atggagcaccgaacgcgaagctgggccttgggcctcagcatcctgggcttctttgccctcctcttctctgctggctttgtccagcaggcccacgccaatgacactgaggctatgggcactgttatcggtattgtaggttgcccgcatttccctcctcccccttcccatccctcgtgttgggcaaagcattctaacaacgcttctttgacaggatctcggaaccacctactcgtaagttacccgtgcacgaattcgctgcccgacacgattataagcacgatcaccttgcggggcatgcggcgtttgctatcaacctctaccaccaatctacgtcccggtttcgacaaacgatacacattgtcttttggggacaaggaaactaacaacctcgtagttgcgttggtgtgatgcagaagggcaaggtcgagattctcgtcaacgaccaaggaaaccgtattaccccgtcttatgtcgccttcaccgatgaggagagacttgttggtgacgccgccaagaaccaggctgcggccaacccccacagaaccatcttcgacatcaagcgtctcatcggtcgcaagttctcggacaaggatgtccagaatgacatcaagcacttcccctacaagtaagttcaggtcactcttgacaaaccacttcttcctagccgccactgactctagtacccagggttgtctccaaggatgacaagcctgttgtcaaggttgaggttaagggcgaagagaagaccttcacccccgaggagatctccgccatgattctcggcaaggtacgtcgcatcgtttttgctctggaacagtaatcagagactgacccccacaacagatgaaggaaactgctgagggctaccttggcaagaaggttactcacgccgttgttaccgttcccgcctacttcaacgacaaccagcgccaggccaccaaggacgccggtatgattgccggtctcaacgtcctccgcattgtcaacgagcctaccgccgcggctatcgcctacggtcttgataagactggtgaggagcgtcagatcatcgtctacgacttgggtggtggcactttcgatgtctcccttctttccattgagcagggtgttttcgaggttttgtctaccgctggtgacacccatcttggtggagaggatttcgatcagcgcatcatcaaccacttcgccaagctcttcaacaagaagcacggtgtcgacgttaccaaggatgccaaggccatgggcaagctcaagcgtgaggccgagaaggctaagcgtaccctttccagccagatgtccactcgtatcgaaatcgaggccttctacgatggcaaggatttctccgagactctgactcgcgccaaattcgaggagctcaacaacgacctcttcaagaagaccctcaagcctgttgagcaggtcctcaaggatgccaaggtctccaagtccgagattgacgatatcgtccttgtcggtggttccacccgtattcccaaggtccaggctcttatcgaggagtttttcaacggcaagaaggcttccaagggtatcaaccctgacgaggccgtcgctttcggtgctgccgtccaggctggtgttcttagcggtgaggagggtactgaggacatcgtccttatggatgtcaacccccttactctcggtattgagaccactggtggtgttatgaccaagcttatcccccgcaacacccctatccctacccgcaagagccagatcttctctactgccgccgataaccagcccgttgtccttatccaggtctacgagggtgagcgttccatgaccaaggacaacaacctccttggcaagttcgagcttaccggcattccccccgctccccgtggcgttccccagatcgaggtctccttcgagctcgatgccaacggtatcctcaaggtctctgcccacgacaagggcactggcaaggccgagtccattaccatcaccaacgataagggccgtcttacccaggaggagatcgaccgcatggtcgctgaggccgagaagtatgccgaggaggacaaggccacccgtgagcgcattgaagctcgcaacggtctcgagaactacgctttctccctgaagaaccaggtcaacgatgaggatggtcttggtggcaagattgacgaggaggacaaggagaccatccttgacgccgttaaggaggcccaagactggcttgaggagaatggtaagctttattccgatcccctttgacacatgaagacgaaatgctaacacgcttttttcttttcccagccgccactgcttccgccgaggatttcgatgagcagaaggagaagctctccaatgtcgcctaccccatcaccagcaagctttacagccaaggtggcgctggtgatgacgagcctgctggccatgacgagctttaaatgaagataatc

SEQ ID NO: 26980 - DNA, 1625 bp, Neurospora crassa
caaggaaagaagaagaggcaatacggaaacgaagccgtcaagaaccacattctcgccgccagaaccgtcgcaaacattgttaagacttccctgggacctcgtggcctcgacaagatcctcatctcgcccgacggcgatatcacagtgaccaacgatggcgcgaccattctacaacaaatggagatcacaaatcacgttgccaagctgctagtcgagctctccaagtcccaggatgacgagattggtgatggcaccacaggtgttgttgtgcttgctggcgcgctgctcgagcaggcggcagagcttattgacaagggcatccaccccatcagaatcgccgacggttatgaccaagcttgcgacattgctgtggccgagcttgacagaatttccgatgttatcgagttcagcaaggaggaaaccgcaaacctggtcaaggtcgcgaggacaagtttgggcagcaagatcgtctccaaggcccacgaccagttcgccaacattgccgtcgatgcggtcctctccgtcgccgatctggagcgcaaggatgtcgatttcgagctcatcaaggtggacggcaaggttggaggtgctctcgaagacactatcctcgtcaagggtgtcattatcgacaaggacttctcgcatccccagatgccttccgaggttagggacgccaagattgccattctcacatgcgccttcgagcctcccaagcccaagactaagcacagactcgacatcaccagcgttgaggagttcaagaagctgcagacgtacgagcgcgagaagtttatcgagatgattcagcaaataaagaacactggtgccaatctggccatctgccagtggggtttcgacgacgaggcgaaccacttgctccttcagaacaaccttcctgctgtccgatgggtcggtggtcccgagattgagctgattgcgattgccacaaacggtcgcattgttcctcgcttcgaggatctcaagcccgagaagctcggtagggctggtgttgttcgcgagatgacattcggtacgacaagggagaagatgcttgtgatcgaggagtgcgccaacaccagggccgtgactgtctttgtcaggggtagcaacaagatggtaagcgatggagttctgttgcatcagtaaggtcttgactgacttttttcacccagatcattgatgaggctaagcgttctcttcacgacgctctttgcgtcgtgcgcaaccttgttcgtgacaaccgtgttgtctacggtggtggttcggccgagattgcctgcagcttggccgttgaggacgctgctgtcaagtcccctggcttggagcagtacgccatgcgtgccttcgccgacgctctcgacactatccccatgaccctggccgagaacagcggtcttaaccccatcgctaccctggccgaggtcaagagccaacaggtcaaggatcctgctggtcgcggccgtcttggtgttgactgcatgggccgtggctcgaacaacatgaaggaggctttcgtcattgaccccctcatcggcaagaagcagcagctcatgcttgcgacgcagctctgcagaatgattctcaagatcaacaatgtcattgtgtctgggtcgggcgaggaagat

SEQ ID NO: 26981 - DNA, 1854 bp, Neurospora crassa
gttcgaatctgcgtttgcggcgatgaggggacgggcaagtccagcttgattgcctctctagtcaagggcgtcttcgtcgccaacaagatacaggccgtcctgcctcaagttaccattcccccgacgaccggaacacccgaaaatgttaccaccaccatcgttgatacatccgcccgcccacaagaccgaaccaccttgcgcaaggagattcgaaagtccaacgttatcctcctggtctactccgatcattacagctacgaacgcgtcgctctattctggatgccctacttccggtcattgggggtcaatgttccggttgtactatgcgccaacaagtcggaccttgttagtgatggaaatgctgcgcaggtggccgaggaagagatgcttcctgtaatggctgaattcagggagatcgattcgtgcattaggacgagcgcaaaggagcagaagaacgtaattgaggtcttctatctatgtcagaaggccgttacccatccaattgcccccttgttcgactacaaggaaggccagctaaagcccgcctgcgtcgatgcgttgaggaggatattcttcctgtccgacaaggaccaggatgggtacctgaacgatcaagaaatgcaggatttccaacaaaagtcttttgacaagccgctttcacaagaagacctcgacaacatcaagctgacagtcagcaagtcagtgccaagctctagcactgacaagggtttggatctccgagggtttctgcaactgaacaagctatatgcagaaaaggggcggcacgagacgatctggatcattcttcggaaatatcactacacagacagtttgagtttggaggacagtttcctacacccacgattcgacgttcccgattatgcgtccgcagaactcagtccagcgggataccggttcttcatggatcttttcttgacttttgacaaggacaacgatggaggcctcaacgaccgggaacttgctgccttgttcgcgcccactccaggactcccacactcttgggctgagacttcgttcccctccaccaccgtccggaacgaggctgggcacatcactctccaagggtggctcgcccagtggagcatgactaccttcctagaacctaagacaaccctcgagtatctagcatacctaggattcgagacaccaaacgcccgcgagacgacaacagccgccctcaaaatcacaaaacctcggaagcgaagacgtcggcccgggcgcgtcgaccgcaacgtagtcctctgctacattctcggctcctccggcgccggcaaatcctccctcttagacgtgttcctcaaccggcccttcgacacgctctaccaccccaccatcaagcccagacaggccgtcaacagcgtcgagctccagggcggcaagcagtgctatctgatcctcgaagaactcggcgagctggagccggccatcctcgagaaccaagccaaactggacgcctgcgacctcatctgctacgcctacgactcgtccgagcccgactctttctcgcacattgtcgagctccgcaagcgatacccgcagctcgacgagctacccgccgtctacacggccctcaaggctgaccgcgacaagaccacgcagcgcagcgagctgcagccagacgcgtacacagccgcgctcaacatgagcgcgcccttgcacgtaagtgtcacctggaatagcattagcgaactgtttgtcgcgctggcggaggcggcgacgaaccccagcacggcgtttcccaggagcgaggaaccgccggcggatagggccagtctgtacatggcactgggagcgacggcgtgcgcggcgctagcggcgtttatgatttggagg

SEQ ID NO: 26982 - DNA, 3794 bp, Neurospora crassa
cagaaatggcgtcaagtcaagagcacattgcggctgttgcgacagaagagggacgaccaatacgactatttcaaatctgccgagctcatggccgaacttaccgcagttacaccggctgtcttgatgtttgccagcatgatccagcgcgacgaacatggaaacaaaagaatccccgtccttcttgaacagctaagactccgaatcaaggacagtgcacctcttcccggcaaggatagcgagagacatgtgctctttaccattgagcttgagtacggaagcggtcccagccagatgaagtggacggtcaaacgtcacataaaggagatcatgaacctccacttcaaatacaagatcaacccccctaaagacaagctgttgatacatcggccagagggcggtgttcggcccaaacagccaaatttccccatctcggctttcccttatttgcgcgcagtaagaggcttggaggacgacgaggaacaagaatcacttgacccccctcgtatagtcgaagatcccgccggcgaggccacggccggggaaacagctgttgagggcactgatgttgatgaaaatggcaggccgcaggtacggaaaaagaagtctcgcatgggtgcttttggtgggcgccgcaagaactcggccataggctcaaagggtgatctgaatcaaatagctcttgacgccgccgccaagaagaaaaagtatatcgaacagcagcagagaatcctggaaaagtatctgcaagagatggttcgttggctcatgttccgggcagacagtaaccgactttgtcgatttttggagctttctgctcttggagttcgccttgctgccgagggaagttatcacggcaaggaatgttacctccacatccagtcctccaaagggctcgatttccggcgggtcctgacaccgggcaaggttattgcgaggcacagcaagaagtggttccttgttcgtcagagttatatcgtctgtgtcgaatcgccggaaaacatgaacatctacgacgtttatcttgttgaccccaaattcaacattgtttctaagaaggacaagaacaagcacctcacagcaaacggcaatgaaaatgaggaagacctcgaaaatttcgacccgaccacggccaagaagtccaagtcctccaaccaccatacactcaagatcgtgtcatccgagaggaagatcaagctcttctcctccagccagcatctgatacagcagttcgaggaatccattttggagatgctcaaaactacaccatggcatcagcggaatcgctttggaagctatgcgcctgttcgaactggcgtgttcgcccaatggctggtcgacggtcgggactacatgtggaacgtctcaagagccatcagtatggccaaggacgttatctacattcacgactggtggctgagcccagaattgtacatgaggcggcccgcttgtatcagtcaaaaatggcgtctggatcgtctactccagagaaaggcacaggaaggtgtcaagatttttgtcattgtctatcgaaatgtcgaagccgcagttcccattgactcggagtacaccaagttttccctgctgaacctccatcctaacattttcgttcaaagatcacctaaccagttcaagaagaaccagttcttcttcgctcaccatgaaaagctggtcatagtcgaccacgatattgcatttgtgggcggtatcgatctgtgtttcggccgatgggacacgccccagcatccagtgaccgatgacaaacccactggattcgagcctgattcgtacaatttacccaaggatgcagagcattgtcaaatgttcccgggaaaggattactcgaatcctcgtgtccaggactttgtcaggctccatgagccatatgaggagatgtatgaccggtccaaggttcccagaatgccgtggcatgatatcgccatgcaggttgttggccagccagccagagatcttacccgccacttcgttcagagatggaattatgtgagacgtggccgtaagccaacacggcctacaccattcttgctgccacctcctgactgcagcagagaggaactcgaggccgcaggcctcaatggaacttgcgaggtacaaatgctccgttcagcatccacgtggtcgatcggtatcgatgagaccgaacacagcatccagtcagcatatgtcaagatgatcgaagagtctgatcactttgtgtacatggagaaccagttcttcgtgaccagcacagaaacattgaacgtgaaaatcgtcaatcatatcggcgatgctctggttgagcgcgctatccgtgcgcacgaaaagggcgaggactggcgcgcagtcattattattcccctgatgccaggtttccaaaacgaggtcaatgaccaggacggaaccagtgttcgcttgattctccaatgtcagtatcggagtatctgccgcggagaacactccatctttggccgtcttagggctgccggcatcaacccggaggactacatccagttctttagtctgcgtcaatggggtaaactcaagaacaactctctgacgaccgaacaactctatatccacgccaagtgtatcattgtcgatgaccgtattgccttgatcggatcagccaacatcaatgagcggtctatgcttggcaatcgtgattcggaatgcgcggccgttgttcgtgacactgacatgatctggtctaccatgggtgggaagccttaccaggttggtcgttttgctcacaccctgcgtctccgactgatgagggaacacttgggcttggatgtcgatgagatccaagaggaagaacgtcaagcagagcttgacgaggctgaggcaagagctaagatggaacaacgcacggaacaccacatggagcacccgaacttggaacatcgcgacttcactgacgactcggaagattccatggtcccagaaagctcgtccaggagacggaggtcatctcatatgtcgtctcatattctacctagcacgccgccgccgccgcaactccctcgtcatagagcgcatagtttcaatcatgacgttgaaatgcaggaactcccaaggccagactctaagggcaaatccgttgccggcagagaagaccaggagcatgtgcatgccggtgaaaggcacaggagggatgtggaaggattgggtcctgatcattggaagcttgctcaaatgcaaggtattgatgagggcagagactctgtcgtggtgaatggccgtgaagtgctggttcacgacatctctgcggagggcaagggtacgctggacagcccgcatgagtctcatgagcttcgcacccggcctcatgatgctgcgtctctttctgaaagcatcggcaatgagcacatgccgccaatgccaccgttcaacagacggactacggagcagcttggtcttcccagagccaatcagttgcctgtcctgcctgttgttgacgatactgatattggtggaccgcctgttcagattacagcaaacgggacactgtctcacagccagatcgccatgaacattgagctggccaacattgacaaagactgcatgcgtgatcctcttaatccaagtttctatgaggatgtttggtctcgtgttgctgagaacaacaccaagatctaccgccgcgtcttccatgtcatgcccgattctgcagtaacgaactgggccgagtacaaggagttcaaggctaacgagcgggagttcaagaagcagtttgaaggtggcaaggcaagcgaggaagtcaatgagaagaacggagtgaccgctgagcatgcgca

SEQ ID NO: 26983 - DNA, 1371 bp, Neurospora crassa
tctcaagtcggaagccagttctggcagcagctttgtctggagcatggcatcagccaggacggaaccatcgaggactttgcgaccgaaggcggcgaccgtaaagatgtcttcttttaccagagcgacgatacgcgatacattccccggtccatcctgatcgatctcgaacccagagtcatcaataccatccagaccggaccataccggaacatatacaacccagaaaacttctacgtgggcaagagcggacttggtgcgggtaacaactggggtgatggttaccaaacaggcgagcaggtacatgaggagatcatggagatgattgagcgcgaagccgacggcagcgactccctcgagggcttcatgatgttacactccatcgccggcggcacaggatcaggcctgggttctttcctactcgagcgactgaacgaccgcttccccaagaagatcatccagacatattcggtatttcccgacacgaccagcgccggcgatgttgtcgtgcacccctacaacagtttacttgccatgaggaggttaacgcaaaacgccgactcggtagtggtgcttgacaacggcgccttgtcacacattgccgccgacagactacacgtacaagagccatccttccaacagacgaatcagctcgtatcgaccgtcatgtccgccagcacaaccacccttcgataccccggctacatgcacaacgacctggtcagcattctcgcgtccttgattccgactcctcgatgccacttcttgatgacgtcgtacacgcccttcactggcgaccaggtagagcaggcaaagacggtgcgcaaaacgacggttctcgacgtcatgagacgattgctgcagcccaagaatcgcatggtgtctactgtacccggcaagaagagctgctacatttccatcctgaacgtcatccagggcgacgtggacccaaccgatgtgcacaagagtctgctccgtattagggaacgtcgtcttgctacattcattccttggggtcccgctagcatccaggtggcactgaccaagaggagtccctacgtgactatggcacatcgtgtcagtggtttgatgttggcaaaccatactagtattgctacggtatgtcaactgctgctgtgttggctagatagatgatcaaactgacatttcttcacacagctcttcaagcgtatcgttaggcagtacgatggcatgcggaagcgcaacgcctttatggaagcctacaaaaagacggcgccgttttctgaaaacctcaacgagtttgacgaagccagggaggtcgtcatggaccttattgccgattacgaggctgccgaagacgccaattatctcaaccccgagcttggcgaaaac

SEQ ID NO: 26984 - DNA, 1809 bp, Neurospora crassa
ccgccagcaataccatcgccagccaaagtacattcgagcttaccaagacacatccttgaaaccccgcagtccggcaaatccatcttcgttcgcaccatcgacgagccatccaagtccctccagtatactggccatacaaccactaccaccgttgcccgcttctcgccatcaggcttctgggttgcttctggtgatgtctcgggcaaggtgcgcgtctgggacgctgtcggtgctgagaacaccaagggcgaatactctatcatttccggccgcattaacgatattgcctgggacggcgactcgcagcgtgtgattgccgttggtgatggccgcgagcgatttggccatgctttcaccgctgacagcggcaacagtgttggtgaggtcacgggccacagcaaggttgtcaatgccgtcagcataaggcagcagcggccattgcgtgcagctacggtgtcggacgatgggtccatgtgtttcctccacggcgcacccttcaagttcgccgataaggcgtcggagcacaagggattcgttaccggcacggcattcagcccagacggtgcaacattggtcacggtcggtgccgacaggaagatccagctgtacgatggaaagacgggcgcaccaaccaagacgatcggcgagggtgtccacacgggcggtatctatggcatcagctgggcttccgactcgaagcatttcgtcacctccagcgccgaccaaactgttcgcgtatgggatgccgagtcgggcaagaacaccgaaacctggcgattcgggcctgagggcagcgtcagcatcccggaccagcaagttggcgtagtctggccgcatggccgtaccgacgggctgattatcagcctcaatctcaatggggacctcagctacctggttccgggcaatcccaaaccgatccgcgttgttcaaggccacaataagaacatcaccgcccttggcgccagccccgacggtcaggctcttctgacgggtagctttgagggccgcgtcctgagctgggacctcgcggcgggcacgggaaccgttgtcgacggccagtcgcactccaaccaagtgacccagttcgccctctccccctcaggcggcaccgtctacagcgtcggctgggacgacactctgcgctccgtcgacgtgtctgccaacaccttcaccggcttatccaccaagctttccgcccagcccaagggcatcgccaccaccagcgacggcaagttcgtcgtcgtggccgcccacaccggcatccaagtctaccagggccccgacttcatctccgagctcccgaccaccttcacctccactgccatcgccgcctcccccacggacggctctgtgattgccgtaggcggcgacggcaacacagtccgcatccactcactctccagctctgacggcactctctcctcccagcccgtcgccgttcttaccaactcctccgcccaaatctccaccctgtcattctctcgcgacggcaagttcctggcggccggcaactcgacgggcaagatcgtcgtttaccgcaccagcggctctggctcgtgggaagtggaaaccgaccggtggtcggcccacacggcgcgcgtgctaagcatcgcgtggaacgaggccggcacgcacgccgtcagcggcggcctagacacgaatgtttgtgtttggagcttggcgaagccagggagcaggacgagcgcgccaaacgcgcacaaggacggcgtgaacggggtggcgtggatggaggaaggtacagtggttagcacgggtgtggatggggcggttaaggtctggaaggtttcg

SEQ ID NO: 26985 - DNA, 1083 bp, Neurospora crassa
ggcgccggtggagtaggaaagtgcttcctctcccagctcgagtcgctggccgctcgccgccagaaccagaagctggtgctcacctacattgccaccagcaagaaggccgtctacagcgactcatactcgcccatcgccctcgacagcgtcgtctcgaccctctcctcctcgtcgcaggctccccttgccctcccgaagctcgtcgactacctcgccgcctcgggcaccaagacggtcctcgtcgacaacaccagctcccaggacatcgccgatgcctaccccagcttccttcgccgcggcatcagcatcgtgacgcctaacaagaaggccttctcgggctcgtacaagttgtggcaggacatcttcgccgccaaggaggagggtggttctttgctgtaccatgaggcctcgtgcggtgccggcctgcccgtcatctccaccatcaaggacctggttgagacgggcgacgaggtgaccaagatcgagggcgtcttcagcggcaccatgtccttcctgttcaattcgttcgctccgacatcgggctcgggcggcggcaagtggtccgccgaggtggccaaggccaaggagctgggctacacggagcccgacccgcgcgatgacctcaacggtctcgatgttgcgcgcaagctgaccatcctcgctcgctacgctggcctcgaggtcgagtcgcccacgtccttccccgtgcagagcctgatccccaagcagctcgagtcggtcgccagcggcgacgagttcctcgcccgcctgcccgagttcgatgccgagatggaggaggtcaaggccgaggcgcagaaggagggcaaggttgtccgcttcgtcggcagcatcgacgtggccagcaagcaggtcaaggtcgggctggagaagtttgacctctctcaccccatcgcggccctcaagggcagtgacaacatcattagcttctacactaagcggtatggaagcaaccccctcatcatccagggtgccggcgctggaggtgacgtaaccgccatgggcgtcaccagcgatctcctcaaggtgcttgctcagctataaaccggcgcttgtccccaaagc

SEQ ID NO: 26986 - DNA, 2318 bp, Neurospora crassa
atggcgaacacagggcccggaaacgtgcctttgcacttcatccagaaacctccctttaccgtcgaggaccccaatgcccaaccgatcccaggcgagaccattccccgccgacatcccaaggctaagaatggcctcgcgactcgccctgcccccggagtcaacaccactctagacctcctcactagaaccgtggagctgtacggtgatgagcgcgccataggaagccgcaagctgatcaagcttcacaaggacatcaaaaaggtccccaaggtcgttgacggcgagaccgtcatggtggacaaggaatggcaatgctttgagcttactccgtattcgtacatcacctatggagaatatttcaccatcgtgaagcagataggcgctggtcttcgcaagctcggcttggaacccaaggacaaattgcacatctttgctactacgaggtacgctcccactttttacccacgcctttttgcatctgcactttgctaatgctgtctttatgcacaccacagcccccaatggctcggcatgtcgcatgccgcctcgtcccagtctctcaccattgttaccgcatacgacaccctcggtgagagcggcgtccaacactcccttgtccagagcaaggcgagcgccatgttcaccgaccctcaccttctcaagacagctacgaacccgctcaaggaggctacatccgtcaaggtcgtcatctacaacaaccacactacgcagcccgtgtcccaagacaagattgatgccttcaaggccgagcacccggaccttaccgtgctctctttcgaagagcttcgtgctctcggcgaagagaaccccgtcccactcacaccccccaatccggacgatacctactgcattatgtacacctccggcagcaccggtccaccgaagggcgttcccgtcagtcacgctggctttgtcgccgccgtagccggtctctacgccgtcatggaggaatccgtcacccaccgcgaccgagttctcgcctacctgccgcttgcccacatcttcgaactcgtcctcgagaacctcggcgtcttcgttggcgggacccttgggtactcaaatgcccgtaccctttccgacaccagcatgcgcaactgcccgggcgacatgcgcgccttcaagcccaccatcatggtcggcgttccgcaggtttgggagaccgtcaagaagggcatcgagggcaaggtcaacagcgccggcgccctcaccaaggccctgttctggggcgcctacaacatcaagtccttccttgtctccaataacctacccggaaagaccatctttgatgatctcgtctttggccaggtgcgcaccatgacgggtggcgagctgcgcttcattgtcaacggcgccagtggtatcgccgcctccacgcagcatttcatgtccatggtggttgcgcccatgctaaacggatatgggtaagtgattttctgtctgtcttgaatcagtattatttcactttgttaaaaacgcgctgctcaccatgtcaaaaacagcctaaccgagacctgcggcaacggcgccctcggctcccccatgcaatggacctccaacgccatcggcgccatgcccgccgccgtggaaatgaaactcgtctccctccccgaactcaactatcacaccgacacggttccgccccagggagaaatcctcttccgtggcgcctgcgtcataaaagagtactacgaaaaccccgaagaaaccgccaaggccatcacccccgacgggtggttcaaatccggcgacattggcgagatcgacgccaacggccatttgcgggtaatcgaccgcgtcaagaacctcgtcaagctccagggcggcgagtacattgccctggagaaactcgaggctgtgtatagaggagccgtgtttgtgcataacattatggtgcatggtgacaatagtgccccgaggccgatcgcggtggtggtacctaatgagaaagcgttggcagagaaagcagaggagttgggactaggcgcggaagcgccgggtgagatgcacaggaataggaagttgagggatgcggtgctgaaggagttgcagagtgtgggaaggagggctgggttaagtggaatggagacggtggcgggggtggtgttggttgatgatgagtggacgccggcgaatgtgagtccctttctttcttggtccctgttgaaagaatttgtggcgaaggtgatgctaacagattttcatgatagggttttgttactgctacgcaaaagattaataggagagcggtgaaggaaaggtactcgaaggagatttcggattgtcttgatgggaaataa

SEQ ID NO: 26987 - DNA, 1451 bp, Neurospora crassa
tatgtggagcaatccgagctcgaaaagttcgatggcgttagcacgggcaagtacaccatcggtcttggccagaccaagatggctttctgcgacgatcgtgagggtgagtttttcccttccctcctattctgatccacttccacgcgcctgttcaggggctgacttgccatgtgcccttccagacatctactctcttgccttgactgccgtctctcgcctcctcaagaactacgagatcgacaccaacacaatcggccgcctcgaggtcggtaccgaaactcttctcgacaagtccaagtccgtcaagtctgtcctgatgcagcttttcggcgagaacaccaacatcgagggtgttgacaccatcaacgcctgctacggtggtaccaacgccttcttcaactccgtcaactggatcgagtcttccgcttgggacggccgtgacgcaattgtcgtcgccggtgatatcgccctctacgccaagggtaatgcccgccctaccggtggtgctggctgtgtcgccatgcttgttggccctaacgcccctattgccgtcgagcccggtctccgcggcagctacatggcccacgcctacgatttctacaagcccgacttgaccagcgagtacccctacgtcgatggccactactccgtcaactgctacaccgaggctcttgacggcgcataccgcgcctacaaccagcgcgagaagctcctcaccaatggtgttaacggccactctgaggatagcaccaagacccccttggaccgcttcgactaccttgccttccacgcccctacctgcaagctcgttcagaagtcgtatgctcgcctcctctaccacgactacctcgccaaccccgagagccccgtcttcgccgacgttcctcccgaggttcgcgacatggactacaagaagtccctgaccgacaaggtcgttgagaagaccttcatgactctcaccaagaagcgcttccaggaacgcgtcaaccccgccatccaggtccctaccctctgcggcaacatgtactgcggtagcgtctggggcggtctcgcctccatcattggccacgtcgacagcgcccaacttgagggcaagaggataggtctcttctcttacggctccggtctcgctgcctctttctgctctttccgcgttactggcagcaccgagaagcttgccaagactcttaacctccccgccagacttgcggctcgccgggccgttccccctgagtcttacgatgctgtgagtattcccgactgactcaaccaattcaataatactagtcaagatgctaacgattgtacagatgtgcgaccttcgcaagcaggcccatctccagaagaactacacccccaagggtgaggtctctactctcgagcccggcacttactacctcgaaaacgttgatgacatgttcaagaggacatactccatcaaggcttaaacg

SEQ ID NO: 26988 - DNA, 1221 bp, Neurospora crassa
atgagaggctcaactatccggcccaaggcgcaatgccttcgttcgctttccaagggcctgactaaacgtccttcggccggtctacgatctgtccccgttgctgctactctggcgccgtctctcccgtcgcaacgagcgtactcgacacacccgcctcatgcgaagctcaatcttcctaccgactattcgacaactccattgcttgcgcagacatcccaatcggcgctcaacaaccctgagctgtctcccgaagtccgcaatggcccaacaaagcgcatgaacatgttccaagctgtcaacgatgccctatctgtcgccctcgcccaagacgaatcggtcttgatattcggcgaggacgtcgcatttggtggtgtcttccgctgtacgggaaagcttgccgacacatatggcgccgaccgcgtcttcaacactccgttgtgcgagcagggtattatgggctttgccattggcgttgctgccgagggaatgcgccctgttgccgagatccagtttgccgactacgtatacccggctttcgaccagctggtgaacgaggctgccaagttcagatacagggatggttcttgcgggcggagtgccggggggttaacggtacgcatgccctgcggaggtgttggtcatggtggtctctaccacacacagtcgccggagagcttgttcacacatattccaggattgcgagtgatcatgcccagatcacccatccaggccaagggcttgctgttatccgccattcgcagcaatgacccatgtgtcttcatggaacccaagatcctctaccgtgctgccgttgagcaggtgcccaccgggtcctatacgctgccattatccaaggctgaagtgctgaaggaaggaaaggatgtgaccatcatctcatacggtcaacccctatacaaatgcatggatgcgttgcaaaaggccgagaaggactttggtgtctcagtggaattgattgacctccgaacggtctatccatgggacaaggagaccgtgttccagagtgtcaggaagacggggcgctgcatcgtggttcatgaatctatggtcaatgccggcattggtgccgaggtggccgctgccatccaagaggactcggaaacctttgttagactcgaagctcccgtggctcgagttgctggatggagcattcacacgcctctcatgttcgaggcacttaacattccggatgttgcgagtgag

SEQ ID NO: 26989 - DNA, 520 bp, Neurospora crassa
ctttcagcctacgtcaaggagcactttcctaacgccgcctatggcgcgtacccgatagagaatgacaccaaagtcgcggttgtcattgtcgcgaacaagtacagcccgaacaacttctggtatgtcgctttagaacggagtcgatcgccttgtcgcatattacccgccttttgcgttaacacgaggtaacaggaacggacgttggcgctcgctatacatctacgacccatccaacaactccattgagggctccatcaaggtcgacgtgcactactatgaggacggaaacgtgcgtttgttgactaacaagacagtcaccgcgaccgtgtcgtcgggcaccggcagcggcattgccaaggagatctcggtgaacgagaagaagtaccaggaggaattgaacaagagcttcacaagcctcagcgagggcgctttcaagggcttgagaagacagctgccggtgacgagacagaaaatcgagtgggacaaggtcgccagctatcgcctgggacaggatatcggt

SEQ ID NO: 26990 - DNA, 2914 bp, Neurospora crassa
aaaagactcacaaagaagcaacgcccgccatccgcaaatcaccgcactagctcctctttcaatgtcgaatcgctccgtattgacgcccaatctctagacagcaaacggagcgcctccagcctgcgccagggccccaactgcaaccaaagcccatctctggccaggaccgtatccgtcccagtctccgtcccttcaaacgcgcccgcccacaccaaagccagcgacctctctctgccacgctcccacaccactcgctctcaatccgcaaatcgcccttacaatccgacgcagacaataccaaccaaccgctttatcctctcgccggcctcatcgtcgcaaccccaaactcaatcgccgccttatcccagcgctgttgccagcaccaccgttactagctccaggaacaaggacacatccaagcagtacgacccactagactcctgcattggatccttcgatcaaaacaaattatccacggatgaactgattggcgctccattcgacggcaacgccattctcagtcgaatcgaggcaacaaaattatcagccgcgcccgcgcccacgtccacgaccacgattgcgcactccaacaacatttctcctcgtcgtgtcgctcctcctcctcctcctcccccgcctgctctatcgcgctcaaacacggactccaaggctgcgagatcttcaaaaccgtcaaagtcgcccaaatccaccatatcaaacaagaccatgggcgcatcttcattccgccactcggcgagtttctcgtcggctgaacaacttccgccaagcgaaaagccgtccaagtcagagagcagctcttcgagtaacaagagacactccggtgatggtaaagagtccagggtgcccggtatgctaaggaagaagtcgggcttctccggcttcatgaacagcttagttgggtctccgaaaaagccattgatttcggcgccagagaaccccgttcacgtcacacacgtcggatatgatagcaatactggccagttcacggtatgttgccatgccatgtcaactagtctgaatgttatggatggactaatacgttgatagggtttgccaaaagagtggcagcgtttgataagcgagagtggaatcactgagaaggacagaagagaacacccacaaatactggtcgatgtcctcacattttacaaggagacaaccgagaagccacaggaagatcaacagctagagaagttccacgatgcacgagcgacagattttcgcagcccgcccgtgaccggcaccgctccgctcgtactgcaaacaggcgttggctacgctcatggtcccatgtcgccaatgattagtccacccgctagtcctaggtttcctcaagttggtcatgagggcagctttgagaacccccgtgcgccgccgccggttcccaagggccctggccctcttccagcaaaggatatcaacttgatccccagcagaccggcaccgaagccaccagcaatatccacacgaccgctggtgccgccagcctcattgccagccaaggattcaggaattggcatgccaccgcccggtgatgaggctccgatgccgtacctccctcccaaggataatgtccagcatatgtaccaggaggagcacaggaacaggtccagatcgaattcccggacaaacggcgctgccccgttctctcccgtgcaggcgtccccactgcatccgatcgccacggcgaaccagactgcggcttatcagcagcaattgttgcaacaccagcaagaacaggccatggcccaagcccaggcagcaatgagcggtcaactgagccgagctgcaagcaagagacaacaaccaactccgcccacctcacaacaccaacacccccggcagccagacatcaatggggctcctcgtatgccacagactcagggggcggctccccaagctagcgcgagaccccgtcacagaccgcggcaaagtaacgcgattgatgtcgtggcttccctaaagaggatatgctccgacggggatccgagagagatttatcgtgggtttaccaaaattggtcagggtgcctctggtggtgtgtatactggccatgaaaggggaagcaacaggctggtggctatcaagcagatgaaccttgagcaacagccaaagaaggatctcatcatcaatgagattttggttatgaaggagagctcacaccccaatattgtcaactttattgacagttacctatgtgctggggaattgtgggtagtcatggaatacatggagggtggtagcttgacggatgttgtcacgttcaacatcatgactgaagggcagatcgcgtcagtttgccgagaaaccctcagaggccttcaacatctgcactccaagggcgtcatacacagagatatcaagtcagacaacattctccttagcatggaaggcaatatcaagctcagtaagttttccccttcgggctttttgggcagtctccgaaagttcaaactttttgagcattttcctgttcattttcccaccatcttcaacccccaacgcccatctggtgctgtgacccgattctaacccttgttcttccaccatagccgattttggattctgtgctacaatcaacgaagctcaaagtaagcgtacgacaatggtcggcacgccttattggatggcgcccgaggttgtgacacgtaaagagtacggccgcaaggtggatatctggtcattgggcatcatggccatcgagatgattgaaggagagcctccctacctgaccgagtcgcctcttcgagcgctttggctcattgcgaccaacggcacgccgcacatcaaggatgagcagtcactctcaccagttttccgcgacttcctctactttgccctcaaggtggacccggagaagagggccagcgctcatgatctactaagggtaagt

SEQ ID NO: 26991 - DNA, 735 bp, Neurospora crassa
atcatcagcggtgcccgtggtctcggtaactacatggctcgcgcttgcgctgaggctggtgccaaggccattgttattttcgatgccaaccaggacctcggcgacgagtctgctgctgagcttcaccaaaagactggtcttcccgtctcattcttcaaggtagatgttcgtgatggcagcgccatcaacgctgccgtccagaacgttgttgacctctatggcgctcccgacgttctggttaactcggccggcatcgccgactcgaacattcctgccgagaagtacgatgctgccatgttccgtcgtctcattgacatcaacctcaacggctctttcctgatgtcccaggccgtcggccgcgccatgatggccgctggcaaacccggctccattatccttgttgcctcgatgtccggcaccatcgtcaactaccctcaggagcagtcgtgctacaacgcctctaaggctggtgtcattcagctcggcaagtctcttgctgccgagtgggccaagtacaacatccgtgttaactgcatttcccccggttacatggataccgccctgaataaggtccctgcccttgacgcccaaaagaagatctggaagtcgctgactccccaggagcgtttgggcgccgttgacgatctcaacggcctctgcgtcttccttgcgtctgacgcttccagcttcatgaccggctccaatgtcatcattgacggtggttacaccctttac

SEQ ID NO: 26992 - DNA, 933 bp, Neurospora crassa
aagcttacccatcccgtgggatacaagacgaaccctcctcccgtgggtaggccagtcagagtatatgcggatggtgtcttcgatctgttccatctcgggtacgttcctcttctttttccctagtggtgggcaatttgtcatatgaagacaggggaaaggccaatgcccccggagctgggtaattgacgcagatttggcatccaatgtggcaggggataacgaaagaggccctttgtagctcttgtaacggcatttgctaaccacaaggacaacagacacatgcgccagcttgagcaagcaaagaaggccttccccgaagtctacctccttgtgggcgtgacgggcgatgaggatacacacaagcgcaagggtttgaccgttttgtcaggcaaggagcgtgccgagaccgtccggcattgcaagtgggtggatgaagttatcgaggactgcccctggattgtcacacccgagttcctcgaggaacacaaaattgactatgtggcccatgacgacatcccctacggcgctgatgagggcgacgatatctatgcgcctatcaaggcggctggcaagttcctggtcacgcaacggacagagggtgtgagcaccactggcatcatcaccaagtgagttatccctcacctatcgtcccacgcattgcataccagtttctgtactgacagctatttctttcactgcaggatcgtccgcgattatgaaaagtatattgctcgtcaattcaagcgcggcgcgtcgcgtcaagagctcaacgtcagctggctaaagaagaatgagcttgacctgaagaggcacatccaggatctgcgtgacaatatccgcagcaactgggctacgaccggacaggagctcagcaaggagctgcgccagttttggccgtctagtcgaccccaaagcccaagcccttcgggattc

SEQ ID NO: 26993 - DNA, 2868 bp, Neurospora crassa
gaagatgattcgctccgaaggttccgctacctccttggtctgaccgatcttttccgtcacttcatcgagacaaacccaaaccccaaggtccgcgaaatcatggccgaaattgatcgccaaaatgccgaggatgcgaagtcaaagaagggcgctggtcgccaaggcggtgctactagtgacaggcgtcgtcggaccgaagctgaggaggacgccgagttgcttaaggacgagaaggtaggaggatccgccgaaactgtgttccgcgaatcgcctgcctttattcagggcaccatgagggactaccagattgctggcctcaactggctaatctccctccacgaaaacggtatctcgggcatcctggccgatgaaatgggtctcgggaagacactacaaaccatctccttcttgggttatctgcggcatatcatggatactcccggtcctcatttggtcattgttcccaaatcgactctggataactggaagcgcgagtttgccaaatggacacccgaggtgaacgtgctggtgctgcagggtgccaaggaggaacgtcagcagctcatccaagaccgccttgtggacgaaaacttcgacgtttgcatcaccagttacgagatgattctcagagaaaaggctcacctgaagaagtttgcctgggagtacatcatcattgacgaggcccatcgtatcaagaatgaagagtcttcgttggcccaggtgatcagagtgttcaactcaagaaatcgtctcttgattacaggcactcccctgcagaacaacctacacgagctctgggctctgctcaactttctgctaccagatgttttcggagattccgaggcgtttgaccaatggttctctggccaagatagggatcaagacacagttgtacagcagttgcaccgtgtgctacgacctttcttgctgcgccgtgtcaagagcgatgttgagaagagccttttgcccaagaaggaggtcaatgtctacatcggcatgtcggaaatgcaggtaaaatggtaccagaagatccttgaaaaggatatcgatgccgttaatggagctggtggaaagcgcgagtccaagacacggctcttgaacattgttatgcagcttcgtaagtgctgcaatcatccttacctctttgagggagccgagcccggtcctccttataccacagatgagcatctcgtttataatgcgggaaagatgcttgtacttgataagctgcttaaacgactgcagaagcagggcagtcgcgtcctcatattctcgcagatgagccgcctgttggacattctcgaggattactgtgttttccgccaatacaagtactgccgtattgatggcggcactgcccacgaagatcgtattgcggctattgatgagtacaacaaacccgactcggacaagtttgtcttcttgttgacaacaagagccggtggtctcggcattaaccttacctctgccgacattgttatcctctacgacagcgactggaacccgcaggccgatttgcaggccatggaccgcgctcatcgtatcggacagacaaagcaagtggtggtttatcgtttcgtcacggataacgccatcgaagaaaaggttttggaacgtgcagcccaaaaactgcgcctcgatcagctggtcatccagcagggccgtgctcagattgccgcaaaggctgctgctaacaaagatgagctgctgtctatgattcagcatggtgccgagaaggtcttccagagtaagggcggtttcggggccttacccgagaatggcgccgagttgggtgatgacgatatcgatgctatcctcgcggccggtgagaaccgaaccaaggagttgaatgccaagtacgaaaagctcggtctcgacgacttgcaaaagttcacctcagaatcagcgtacgagtggaacggagaggatttcgcggctcgcaagaaggacattggcatcaactggatcaacccggcgaagcgtgaacgcaaggagcagatctactctattgataagtactataagcaggccctgcagaccggcggaaggacggccgacacaaagcccaaggccccgcgtgctcccaagcaggtacctgtgcacgactatcagttctatcctcttcgactccgcgaattgcaagacagggagacggcatactaccgcaaggagatcggctacaaagttcccctccctgacggcgatgacgagaccgtggaagagcgcgaggccgagagagctctggatcagcaagagattgataacgccacacccttgacagaagaggagcaagctgagaagcaaaagctcgcagaacaaggctttggtgactggaacaggcgagacttccagcagttcattaacggctctggtcgctatggccgcaacgactatgaaggaattgcgcaggaagttgacagcaagactcctgcagagatcaaggcctatgccaaggtattttggcaacggtataccgagatcgcggactataacaaatacctcaaggtcattgaggatggtgaggaacgtatgcgcaagattgaacaccagcgcaagatgttgcgcaagaagatgagccagtaccgtgtgccattgcagcaactgaagatcaactacactgtctcgacgactaacaagaaggtctatacggaggaggaggacagattccttctggtgatgctggacaagtatggcgtcgattccgagggcatctacgagaagatccgggatgagatccgcgagagccctctttttcgcttcgattggttcttccttagccgtactcccattgagatcagccgtcgctgcaacactctgctgacgacgatcgtcaaagagtttgaggacgagcctagcaacaccaccaag

SEQ ID NO: 26994 - DNA, 1266 bp, Neurospora crassa
tcgatcaagaggaatggtgccgtgggcctaatcaatccggcaaacgattgcttcatcaactcagttctgcaggctctcgctggccttggggacctccgtttatacctcatccgggagactcatcgtcgatgcctggacggtggctgggtgtatgcgcagaccatcccgagcgatgtttggggcagtggtggcgaaggcgaaggcgacgagacaagcaaatggcaagtccgtggtggtgttcccgagtggaaagccgaaggacttcagatgggtatcgtcaccaagggcttaaaggatatccttgacgccctgaacgagagaccaatctacaaaaagacgatctcggcctcgccgtttgtcaggacactggagattgcctttggtcagcggatcagcagacagcaacaggacgcccaggagttccttcaggtcgtggccgagaggctctgcgacgagtatcatgctggccagagagcgcgaagctacgctatgcgtggagccgagcaaccaactactaagatatctctcaatagcaagacatcagacagtgaagctctggatcggcctctacctctaagggccagtgagcaggtcagtggcgctgaccaaccggcggcaacggccgcgagcgcggttccgaacggcgccgatgaagaaagagcagaagaagggttcccgtttgaaggaagctttgaatctcagattgaatgccttacttgtggtttcagacccaggcccactcagtcaaccttctgcaccctaacactgaacgtgccacatatcccaacaacaactctgagcgcatgcttcgacggcatgttcaaaaccgagtacatcgaggatttcaaatgtgaaaagtgccggttgttacatgccaaggccgttctcgaagcagatattcagcggtcaacgtcagagtcctcgagggagaaagctcgcacggctctagccagtctcgagctagctatcgaaacggatcctgagaaggcaccaaagggtgtcgagttgccggatcctcgctatgctcccaagcggaagatagctcgacacatccgtatgacaggatttcccaggatcttggccatccatctgtcgcggtcgatatacgacatgagcaacttctcccagaaaaatcttgcgaaggttacatttccggaactattgcccctgggtggccttctgcagcagagaaaatacaagcttcttggcgttgtgacgcacaagggtaatcaccatagcgggcactatgaatcctttagacgacaa

SEQ ID NO: 26995 - DNA, 1351 bp, Neurospora crassa
acaacagaaacaagtactactacaaccgaacaacaaacgacaccaacatcaccaaccatgggaggcggtccagacaccaccggctaccgcaccgtagcctactttgtcaactgggccatctacggccgcaagcaccggccgcaagacttgcccgccgagaagctgacgcacattctctacgccttcgccaacgtgcgcccggattcgggcgaggtctacctgacggaccagtgggcggacacggacatccactgggaaggagacagctggaacgacagcggcacgaacctgtacgggtgcctgaagcagctgaacctgctcaagcggcgcaaccgcaacctcaaaggtgctgctgtcgattggcgggtggacatacagcagcaacttcaaggagccggcgagtaaagaagaggggaggaggaggtttgctgaaagtgctgttgaacttgtacgttttggaagtctctagatcttcatcttccttacatatcttttcctagtccatgttcgggactaaaagctaacactgccaaccaaataggtcaaaaacctcggcttcgacggcctcgatatcgactgggaatacccgcaaaacgcccaagaagcctccgactttgtctctctgctctcagcctgccgctccgccctcgacgcctacgcctccaccgtccctgggaacccccactttgagatgagtgtcgcctgcccggccggcccgcagaactacgagaagatggacttgccaggaatggaccggtacctcgacttctggaacctaatggcgtacgactacgctggctcgtgggaccaggtggcgggccaccaggccaatctattccattgcaacagcaacccggctgccacgcccttcagtacccagcgcgccgtcgagtactacttgtcgacaggcgtggcggccgacaagatcgtcttgggcatgccgctgtacgggcgcgcgtttcagggcaccgagggattggggcagccgtatagtggtgttggcgaggggacgtgggagaatggcgtgcatgattacaagaagctgccgttggagggagccgaggaacgcgtcgattacgaatctggtgctacgtattgctatcatccgggaaccaagacgctggtcagctatgatacgcctggcatggcgaggatgaaggccgagtatatccgggagagaggccttggtggtgccatgtggtgggaaagcagtgctgataaggaaggccctgatagcttgattggtaccgtcgtcgagggtttgggcggcctcccggcgttgcgttgggacggcaactgcatcgactacccgaacaccaagtatgacaacttgcgggctgggtttccgggg

SEQ ID NO: 26996 - DNA, 1655 bp, Neurospora crassa
gcgtacatgatgtgcgtctttgccgctttcggcggtatattcttcggctacgactcaggttacatttctggtgtcatgggcatgaagtactttatcgaaaccatcaacggacccggcgccaccttcctgccatccaaggaaaagtcgctcatcacctccattctctctgccggtaccttctttggcgccctcatgggcggtgatctcgctgactgggttggccgtcgtcctaccatcatcttcggctgcctcgtcttcatcgtcggtgttgttctccagactgcctcccagagcttgggtctcatcgttgccggccgtctcgtcgctggtttcggtgtcggtttcgtctcggccattatcatcctgtacatgtctgagatcgcgccccgcaaggtccgcggtgccatggtgtccggctaccagttctgcatctgcctgggtctgctcctggcctcgtgcgttgactacggcacccagaaccgcaccgacagcggctcttatagaatcccgattggtctccagatggcctgggccctcattcttgctactggtatctttttccttcctgaatcccctcgcttcttcgtcaagaaaggcaagctcgacaaggccgccggcgtgctctcccgcctgcgcgaccagccgctcgattccgactacgtcagggacgaacttgccgagatcgttgccaaccacgaattcgaaatgaccgtcgtcccctacggcaactacttccagcagtgggccaactgcttccgcggctccatctggcagggcggttcttacctccgccgcaccattctgggcacttcgatgcagatgatgcagcagtggacgggaatcaactttatcttttactttggcaccaccttcttccagcagctcggcaccattgacaaccccttcctgatgtctctggtcactactcttgtcaacgtctgctccacccccatctccttttacaccatggagaagctcggccgtcgtaccctcctcatctggggcgctctcggcatgctgatctgcgagttcatcgtcgccatcgttggcacctgcaggccggatgataccatggccatcaaggccatgctcgcctttatctgcatctacatcttcttctttgctaccacctggggtcctgcttcctgggtcgtcatcggcgaagttttccctcttcccattcgtgccaagggtgttgccctttccaccgcctccaactggctctgtaagtctttttttttcttctgtcctgctaccttttgaaagtctctctcaaaaatagtttgactaacctttttccctcttgtttagggaactgcatcatcgccgtcatcaccccctacatggtcgatgaggataagggcaacctgggccccaaggtgttctacatctggggtggcctctgcacctgctgcttcatctacgcctacctgcttgtgcccgagaccaagggcctcacgctcgagcaggtcgaccaaatgctttccgagtctaccccccgcacctcgaccaagtggaagcctcacaccacttatgctgctgagatgggcatgaccgagaagactgttgctggccacgctgagaaccgcagcgatagcgagtaaagaaaaaataaaagaacaatacaaaaccagaagaaagaaagaaaaatggat

SEQ ID NO: 26997 - DNA, 1409 bp, Neurospora crassa
cacagagccctcatcgcatacctcactgccgccaacctgcccaacaccgccgccgcccttcgagaagagctgaacctaagcgaagaggtttttgatccagctacggcaaagaagtatgaaggcctactagaaaagaaatggactagtgtagtccgactgcagaaaaaggtgcgcatcctgtccgctgtccgaccgccaaataaccttttctccctctttcccccttaccagccgcttaccccccttgccacgtacagattatggatctcgagtcgcgaaatcatatcctacagtcagagctcgacaatgcgacgcctacatcgcgacagaacaaagaccctgtcgcctggctaccccgagcacctcctcgacacacgcttcaatcacaccgagaccccataacctgtgtagcattccaccctgttttctcgtctctagcttccggatcagaggatcagaccatcaagatctgggattgggagctaggcgagctagagaggacgatcaagggccacacaaaagctgtcctcgacgtcgactatggcggcccccgcgggaacacgttgctcgcttcgtgcagctcagatctaactatcaagctatgggaccccctagactcgtataaaaacattcggactctacccggccacgatcacagcgtcagcgccgtgcggttcatccctggttctggtaacctcctggttagcgcaagtcgcgacaagacactaaggatatgggacgtgagcacagggtactgcgtcaagacattgcgcggccatgccgagtgggtgcgcgacgtatgcccatctcttgacgggaaatatatactctccaccagcgacgattacacaagcaggctatgggatgtgacgataacaaaccccgagcccaaggtgaccttgatcggccacgagcatgtcgtgctatgttgtgccattgcacctccggccgcatatcagaatcttgccgccatggccggtatcaagaagccccctgcgacaagctctgccgagtttatggccacgggctctcgagacaagtcgatccggttatgggatgcgcgcgggacatgcatcaaaaccttggtcggtcacgataactgggtgcgagggttggtgttccatcctggagggaaatacctcttatctgtatccgacgacaagacccttcggtgctgggatctgacacaagaaggaaaatgcgtcaagacgatcggggatgcgcatggccacttcgtccagtgtatcaaatgggccccgtcggttatcaaggatgcgtcggtgaacggtgacaatggggaaccaaacgggacgccaaagaagggtggagcggctgccacccccgaggctcagatccgttgcgtaattgcgacaggaagcgttgatttgaacgtcagaatctttgccaac

SEQ ID NO: 26998 - DNA, 1273 bp, Neurospora crassa
gactttcccgaaggtggcctgcagggctggctggtagtgtttgggtccttttgtgccatgatatcggtgtttggactcatcaactctgcggccgtctttgaatcatatttttcgacacatcagcttgtcaaccacagcgcatccgagatcggttggatcttttcgctctacctctttatcgtcttttttgtgggcatccaagttggccccattttcgatcggcatggagcgcgcctcctggtggccgtgggtagtctgctggttgtcctcagcttgatgttgttgagtctcagcaagagtaagtccttacaacacttccgcccctagttgtggatggcatatggtgctaacgacagacacagcttattatcaaatcatgctgacataccctgtgctcggtggcttgggcggtgcccttcttaactgccctgcgtacgggtcgatcacacacttcttccacgtgcgccgtggactggcaaccggtgttgctaccatttccggcggcattggcggtatcatgttccccatcatgttgcggtataccctcccctcgattgggttcccctggagttgccgcattcttggcttcattatgctcggcctcgccgtgcccgccaacctctttatcaagactcgtctgaagcccaagatcagccaagacaaacccaagatgtcgtcacttttgcccgacttttccggattccgagaccttcgctatgccttttcggcgatcggcatcttcttcatggagtgggggctgttcatgcccctgacgtacattgtctcgtacgcagcggcgcatggtcaggatgcaaccgagagctaccttctcctatcgtacctcaacgccgggtctgtgttgggccgtgtgctccccggtctctttgctgatcgcattggacggttcaacgtggtcatcatcaccatctcgctgtgtgtgattctcgtgttggccatgtggcttccggcagccatgtccaagtcggtgctgatcggatacgctgtgctctttggatttgcgagcggaagcaacctcggccttgtacccgtatgtcttggacagttgtgcgacgctcgccaattcggtcgatactactcgacggccatgatggtggccagtttcggcacgctcagcagtgtacccatcggcggcgccctgttggagatgggctctgctgagacgggctggcgagccgtcatcatcttctcgggcctttcgtacttcgtcgccctggcgtgttatacgtccgcccgcgttctcgctgtcggcttc

SEQ ID NO: 26999 - DNA, 1143 bp, Neurospora crassa
gaccagccgttcgcgacaggatgtctggacccgtcggttaccgccgcgcagccgcgcgagaacgccacttttgtcatgctggcgcggaatagcgaaattgaaggtgcaaaagcaacagtggcgaatatcgaacggcagttcaaccggtggtttcactacccgattatgttcctgaacgacgctccgtggtcagaggaattcaaggatgtactaagcagggctgtgagcaatgggactgaggtcaggttcgaggtcatcgagaagggaaagtgggggtttcctgaggaaatgaatgagaaggaaaagacaaaggccagattgcagatgaagaagcagggtgagcgaggtgtgggctatggtgacatggagagttatcatcacatgtgtcggttttactctgggtacgtctcccgatgtgtttggtgtgataggtccacatgctaaccctgatgttttcgcaaaaacagcgagttctacaatctcgaagccctgaggccctacaagtggtactggcgcctcgagccaagtgtacgctacagctgtgccctcacatacgacccttttgcggaaatggctcgtcacgacaaggtctacggctggacgatagcgctctgggaggttggcgacacctgcccgtccctattcaagaccaccgacgactaccgaatcgaaaagggtattccccggacgcccacctggaacgccttgttacaagtgatgtggttccccgcgcccgtccgttggtttctcggcttgtttcgggtacgggagcacgacaactccggcaacaagtggaacatgtgccactactggagcaactttgagattgccaatctggacttcttccgcggccgcgagtaccaggattacttccgctacctggacagcaaaggcggcttctactcggagcgctggggcgatgcgccggtgcacacgctcgccgtgcacatgcttctcccgcccgagaagattcatcacttttcggatattggctacgagcatgacacgctgtggcagtgtccgggaaatgcaccgatggaccagcaactcctcggtaacaaggcgctgcgtgacatgggcaggatgacactgccgtcggagggagggacaggatgcaggtgcaaatgccaggagaataagagg

SEQ ID NO: 27000 - DNA, 1404 bp, Neurospora crassa
gaagactggaaaaagggacttaacctacctgccagggacacaagacaacagaccgaggatgttacaaacacgaggggtctggattgggaagacttcatacacgacagggatctcttgatgggcattttcgaggctggcttcgagaaaccgtccccgattcaggaagaagcgatccccgttgccctcaccggccgagacatcctcgcacgcgcaaagaacggcaccggcaagaccgccgctttcgtcattcccgccctcaacaagatcaaccctaaggtctccaagatccaatgccttattctcgttcccacccgtgagcttgccatgcagacatcccaagtctgcaagacgctcggcaagcatctcggcatcaacgtcatggtgacaaccggcggaactggcctgcgggacgacattgtgcgtctgcaggaccccgtacacatcgtcgtcggaacaccaggtcgtatcctcgatctagctggcaagcaggtggccgatctcagcgagtgcccaatgttcattatggacgaggctgataagctcctgtcgcaagagtttacccccgtcattgagcagctcctgcagttccaccccaaggatcgtcaggtcatgctgttctccgccactttccctctttcggtcaaggatttctcggacaagaacatgactagcccgtacgagatcaacctcatggacgagcttacgctccgcggtatcactcaatactatgcctttgttgaggagaagcaaaaggttcactgcctcaacactctgttttccaagctgcagatcaaccagtccatcattttctgcaactctaccaaccgcgtcgaactgcttgccaaaaagatcactgagcttggatactcgtgcttctacagtcatgccaaaatggctcagcaggcgagaaaccgtgtcttccacgacttccgcaacggtgtttgccgcaacctggtctgctcggatctcctcacccgcggtattgacattcaggcagtgaacgttgtcatcaacttcgatttccccaagaacgccgagacgtacctccaccgtattggtcgttctggtcgttatggtcaccttggtcttgctattaacttgatcaattgggatgacagattcaacctttacaacattgagcgcgatcttggtacagagatccagcccattcctcagaccattgacaagagcctctacgtgtacgagaaccctgaatcgattccccggcccatctcgaccttcaagcctattgcccagcagccgcaacagcaattgcagcaatcgcaaaggcctcaacagtctcaacagcaacagcatttctcaacacagacacagccgtcaaaccagctcccgcctcaacagggcaaccaacaacttggcttcaatcctcaagctcaacagcct

SEQ ID NO: 27001 - DNA, 1295 bp, Neurospora crassa
ggaatccggccggtaatcaaggtggtggacgatagatgcctgtaggttcgctgttctcttcccttgaggcaggactgatgaggtatccaaaaccagagatgctaacaagtccgccgatgccaagtgttttcgatcctccagaagataacccaattcagaaattctctcgatcagtcgtgccagcgatgggcaagaaagtcaaggaccaagtctttgcctttgaccgaatattcgacgagaacgcctcccaggtggaagtctacgaaggcacaaccaagggcctcctggatagtgtccttgacggctacaacgcgactgtcttcgcttatggcgccaccggctgcggcaaaacccacaccattaccggaacgccacaatctccgggcatcatcttcctcaccatgcaggagctcttcgaaaagatcaacgagcgcagcggcgagaaacacaccgaggtcacactctcctaccttgaaatctacaacgagacgattcgggacctgctcgtgcctcctggcagcgccacgaacaagcaagggttgatgttgcgcgaggactcgaatcaaggagtgagcgtcgccggtctgacgagccacaagcccaaggatgtgcaggaggtcatggacatgatagtacaaggcaacgagtaccgcaccgtatcccccaccgccgccaacgcggtctcgtcacgctcacatgccgtcctgcaaatcaacgtggcgcaaaaagaccggaacgctgccgtcaatgaaccccacaccatggccacgctatccatcattgacttggctggaagcgagcgcgccagtgcaaccaagaaccgcggcgaacggctgcttgagggcgccaacatcaacaagtccctcctcgcgctgggcagctgcatcaatgcgctctgcgacccgcgcaagagcaaccatgtcccttaccgaaacagcaagctgacgaggctgctcaagttcagtctaggcggaaactgcaagacggtcatgattgtatgcgtgagcccgtcgagcgagcactttgacgaaacgcaaaacacgttgcggtacgcgaaccgggccaagaacatccagacaaaggtcacgcgcaatgtgttcaacgtgaatcgccacgtcaaggactttttggtcaagattgatgagcagatggccctcatcaacgagctcaaggcccagcagcgcgatgccgaaaaggtcttcttcgcaaagtttctcaagcagagcgaaaagcgcgatgccgtagtgcgagagggcctggccaggctgcacgccgcctacgagcatgctgagaag

SEQ ID NO: 27002 - DNA, 1665 bp, Neurospora crassa
aacttccgggtcttttctattgcatgcttcgcatgtatcggtggtgtgctctatgggtacaaccaagggatgttttcgggtgtcctcgccatgccagcctttcagaaacgtgagtcgctatctttaaacccacatgttgccgaaactgttgttaaccttacgggtgaacctcaaacagacatgggcgaatacgatccgatagacgagaacgcgagtcagacaaagaagggctggctaaccgcaattcttgagctcggtgcttggcttggtacgcttctgtctgggttcatggcagaggttctctcgagaaagtacggtgtgctagtggcgtgcttggttttcatgctgggtgtggtcatccaagccacgtctatctctggaggacatgagaccattcttgccggacggtttatcacgtaggtcgtggctgattactcttgaatcgtctatcagcccctactaacacgacattgctcaacaggggtatgggtgtcggatccttagccatgatcattcccatttacaactcggaagttgcaccacctgaggtccgtggagctcttgttgctctccagcagttggctatctgcttcggtatcatggtcagcttctggattgactagtaagtcttctttgttttcgactttggtcacaccaaggggtcgctgatatcaaatattacgcagcggaaccaactatatcggcggcaccaagctcgagacccaatccgacgccgcctggcttgtacccgtctgcctgcaactcgcccctgctctcattctgtttttcggcatgatgttcatgcccttctccccacgctggctcatccaccatggccgcgaggcggaagctcgaaagatcctctccacccttcgcggtctaccgcaagaccacgagcttgtcgagctcgagttcctcgaaataaaggctcagtctctctttgaaaaacgcagcattgccgagttgtttcccgaattgcgcgagcagactgcctggaatacctttaagctccagtttgtcgccatagagaagcttttccggacaaaggcaatgttccgacgcgttatcgtggcaaccgtaaccatgttcttccagcagtggtccggcatcaacgcgattctctactacgccccgcaaatcttcaagcagcttggactgagcggcaacacaacctcactcctggctacgggtgtagtaggcatcgtcatgttcatcgcaacggttcctgccgtgctgtggatcgaccgtgttggtcgcaagcccgtgcttactatcggtgccctcgggatggctacctgccatatcatcatcgctgtcattgttgccaagaacgtggaccaatgggagactcataaggctgctggatgggctgctgtagccatggtctggctattcgtcattcactttggatattcatggggtccatgtgcctggatcattgttgctgagatctggccgctgagtacgagaccatatggtgtctctctaggagcttcgagcaactggatgaacaactttatcgtcggtcaggtcacgccggatatgttaaaagcgatcccgtacggaacgtatatcatcttcgggttgttgacttatatgggcgccgcctttatctggttctttgtgccggagacgaagagattaaccttggaagagatggtaagt

SEQ ID NO: 27003 - DNA, 1407 bp, Neurospora crassa
tcaggcgagggccagggctcgcagggtcttttagaaaccatccagtccatcctctcttactccgtcaacacgtgggaccaaggcttcatggacaagctgtacgcctccaccaacgccgtcggtgtcgtcactgagctgctcctctccgttctcaacaccaacctgcacgtctaccaggtatctcccgccctcagcgtgatcgagaagtacacagccaagcagttcgccgcgctgttcggcttcaccggcccccgcgccggaggcgtcacctgccagggcggcagcgcttctaatctgacctccatcgtcattgcccgcaacacgcttttcccactctccaagctccacggtaacgggcacgagcagtgcggcgccccgggcccgctgattcttctcaccagtgctcacgggcactactcgattgagaaagccgccatgacgtgcggtttcgggtcctcggcggtctggaccgtccccgtcgatgagcaagggcgcatgcaacccgccgctttgcgcgagatggtcctcaaagccaagagcgagggaaaacaccccttttacgtcaacgcgacggctggcacgacggtcttgggctcgtacgacccgtttgacgagatcgcggacgtgtgcgacgagtttggcatgtggttgcacattgatgggagctggggtggcccagccgtctttagcaagaaacacaagcacaagatgcaagggtcgcatagggcgaggtcactgacggtgaatccgcacaagatgctcaatgcccccgtgacgtgttcgttccttttgaccaatgatgtcaaggttttccatagggcgaatacgttgccggctggctatctgttccatgggccggcggcggcggaggaggaggaggatgccgacggggaagagaatgcgccgcaaagccagaccaccccttcggaggaaggagtgactaccacaaacggatgtggaaacgggaacacccaagacgaggtctgggatctagccgacctgacgctccagtgcggtcgcagaggcgacgcgctcaagctggctttgtcgtggatctactacggcgcagccgggttcgagcgccagattgacggcgccttcgacatggccgcctacttggccaatctgattgccgagcgcaacgactttgtgctggtgtcgtcgaacccgccgccttgtttgcaggtgtgcttttactatgcccccggcggcaagttggcggacgagcctcaagagaacaccagaaggacgagaatcatggtggagaagttgattgcgagagggttcatggtggattatgccccgggcgataagggaagcctctttagggtggtggtcaattgccagacgttgaggggaacggtggaggggctcgttaagggtttggaagctattggaaaggagatt

SEQ ID NO: 27004 - DNA, 965 bp, Neurospora crassa
atgggcatcaacggtcttctccccctgctaaaatccattcaccgccctgccgaactcaggaagtacgcgggcgaaactctgggcatcgatggctatggatggcttcatcgaggtgctatcgcttgcgccattgacttggctcaaggcaagccaacccgcaagtaggttccaaccgaggctaccatggactgtctgaccccaaggctaattgtaacaccgtaaaaaaaaaaagatatgttgactatgcgatgcaccgcgtcaaaatgttcaagcattttggggtgacgccctatgttgtcttcgacggcgactaccttccaagcaaggccaagacggaactggatcgcgagagcagacgagaggcgagccggaagacgggcctagaactcctcaaggctggcaaaccatcacaagcccacatcgaactccaaaaggccatcgacatcacaccagaaatggcccgccatctgatcgacgagctgaaaaaggccaatgttccatatgtcgtcgcgccgtacgaagcagatgcacagttgatctacctcgagcgtcggggcatcatcagcggcattgtctcggaggattctgatttgctggtttttggagccaagcgcctattgaccaagatggatcagtacggacaatgtatcgaaatcaaccgcagccagttttgtgccgtccgtgagatctccttgacgggatggtcggatgccgagttccgccagatggccatcttcagcggctgtgactacctcgacagccttcccagcatgggtctcaggacagcataccgcatgattcgaaagctcaagacgcctgagcgcattgtcaagaagcttcagttcgacggcaaaatccgagtccccgccgactatctggcacggttcaagcaggctgaactgactttcatctaccaacgcgtgttttgcccagagaagcaagcggtggtgtgcttgacagaaccc

SEQ ID NO: 27005 - DNA, 1872 bp, Neurospora crassa
atggccgctactgcgcttgaccatctcagcctcggcggcaagattcagtggctcgctcagcttaacactgagttccagcccgctcgcgagttccgtcgcacttccatcatctgcaccattggtcccaagaccaactcggtcgaggccatcaacaagctccgcgatgctggtctcaacgtcgttcgcatgaacttctcccacggaagctacgagtatcaccgtacgtattctcccctctgacatttggtggtgcctttgaaaacccaccgatggtgcaaggtccgccaagctgctgcgcgcttagctttccaggaccattagcgcctcgctttgccaaaatcctcctgcacagcttacccgctaacactgagccacctgcagagtccgtcattgacaatgctcgccaggctgagaaggttcatcccggccgccctattgccattgcccttgacaccaagggccctgagatccgtaccggcaacaccaagaacgatgaggatattcccatctccgccggtaccatccttaacatcaccactgatgaaaagtacaaggatgagtgcactatcgagcacatgtaagtttgaatcgatctgcttctgggtatgcgccagtggggccgatcattgctgacatcgttgcaggtacgtcgactatgtcaacatcaccaaggtcattgctcctggccgtatcatctacgtcgacgatggtgtcctcgctttcgaggtcctcgagattgtcgatgacaagaccatcaaggttaaggcccgcaacaacggctacatctcctcccgcaagggtgtcaaccttcccaacaccgatgtcgatctccctgctctttccgagaaggataaggccgatctcaggttcggtgtcaagaacaaggtcgacatggtctttgcttgtgagttcaccctaggaagaccttggatacgtggaacaagttgctgacagatgataatagcttttatccgtcgcggccaggacatcaaggacattcgtgaggtccttggcgaggatggcaagcagatccagatcattgccaagatcgagaacaggcagggtctcaacaactttgctgagattctcgccgagaccgatggtgtcatggttgcccgtggtgacttgggtattgagatccccgccgccgaggtgttcgctgcccagaagaagatcatcgccatgtgcaacattgccggcaagcccgtcatctgcgctacccagatgctcgagtccatgatcaagaaccccagacccaccagagccgagatcagcgatgtcggtaacgctgttaccgatggtgctgactgcgtcatgctttctggtgagaccgccaagggtgcttaccccaccgaggccgtccgtgagatgagcgaggccgttcttaaggccgagaacaccatcccctacgtcagccacttcgaggagctttgcagcttggccaagcgccccgtctccattgtcgagtcctgcgccatggcctctgtccgcgcctcccttgaccttaacgccgctgccattcttgttctctccacctccggcgagtccgctcgtctcatctccaagtaccgccctgtgtgccccatcatcatgatcaccaggaacgactctgcttcgaggtacgcccacctttaccgtggcgtctaccccttccttttccccgagtccaagcccgactttagcaaggtcaactggcaggaggatgttgatcgtcgcatcaagtggggtctcagccacggtattggcctcaaggtcctcaacgagggcgaaaccgttgtcgttgttcagggctggaagggtggtatgggtaacaccaacaccttccgtatcgttaaggccgatgtcaaccacctcggtcttggccagccttaa

SEQ ID NO: 27006 - DNA, 1948 bp, Neurospora crassa
tcgctgtaccaaatatgtttgtcgctcaaacaacgcctcgcccaggttcccggcttcgagggctatctagaacaactgcagcgcgagcaggagaatggccatgatggccccgtcgaggccctctggaagctccttcgcaccggtctgcccctgctcaccatctacaatgcgctccaacccgagaaaccgctacacgtcgatcagaggccgaacgagacggaagcgcgacggtccaaacgcgccattatggaattcgtcaaggcctgcttgagcgacctcgaccctcccgttaccgaatgctttatcgtcgccgaccttacaggggaggataccaccggctttgtcaaggtgagcgaatcttatggcgccccctttttacctgcacacttgatggaacagtatatgctgacgagagcacatgttcggaaaaccaggtgacttctgttatcaactatgtgctcgatcttgccgaaaaacggggcctcttgctccaaaccctgccataccccgaagatgatatcacgcagccgggttctaagatgacccatcgcgattacattgttcgagaactggtagacacggagcgcaaatacgtacaggatctcgagaacctccacgacctgaagaggacgctggaacacaggagcgttatccctggcgaattcatccacgacatattccttaatatcaacgccatcttggatcatcaacgaaagttcctcatcagggtagaaacaacaaattcgatgccgcaggctaggcaggaatggggaagcttgttcgtcacagctgaagagaactttggcatttaccaaccctttatcgcgaaccaaagaaaggcggcccaggttgcgacgcaagtgtttgacaagatccaagaggctggccatccggtcgcgtgtgattttaatacccttgatggtttcctcctcaagcctatgcagagactggtcaagtacccgcttttgctcaaggtatggatactgcgtccttttgatggtactaatgcgcatactaattggcttgttctcaaaggatttgctgaagaagagcgaggacgagcacaccaaggaggatttagctgccggcatcgctgctgctgaacgggtcttgatgaaagccaattcggccgttgataagaacatcctcgaagaggccttgcaggaccttatacaccgagtagacgactggaagagccataaggtggacaactttggaagtctgctcctacacggagtatacactgttataacgggcaagagtgaacaagagaaggacgtacgtatctcccccctggcgcatgcgttcctccttttgctggtataagacgagctgataatggaccgctaaccttcctcagcagtatgagatctatctttttgagaatatcttgctctgttgcaaggaactcactacgactaaagccaaggacaagaaggacaagactcgatcatccgtaccaaagttgcggaacaagttcgccaaactacaacttaagggccgcatcttcatgaccaatgtcaccgatgtagtagccatttccaagcctggtaagcgacacagttggaattctcggcggaacacaacagttgctgactgtgcaggttcgtataccgtacaaatatggtggaagggcgatccgggcgtggagaatttcatgatcaaattccagaccgaagagatgatgaagaagtgggccgccggtctggaagaacagcgaaagcagaacacgcaagcggccccagttgctcctgatcaagctccgccaaactttgcctggctcgcctcgcaaggcaacggactggagaatccctacaaggacgaagaagaggacgaggacatctataatgctgctgccccgaccgttgccatgccaggcacaatgccgcggaatggatcgagcacaagtctacggcagcggtccgccaccagcgacagtctagcaggt

SEQ ID NO: 27007 - DNA, 1827 bp, Neurospora crassa
tctctccttcacggcccaacagatcctcctctggtcgacctcacactgggagagctgctcaacctccaatgtctgcaccacggcacgcaagaagctctcgtcattccatggactggcgcaagatggacatacaacgagctcaaccaccaaagtcagctcatggcacgcgctttgttgggactgggaattcgcgtaggcgatagggtgggcatcatggctggaaactgcgagcagtatgcttctcttttctttgctgccacgaggataggcgccatcctcgtcattctcaacaacacgtatacccctaccgaagctcagtatgctttggagttctcaggtatgctcctccgcgcaccagccatgcccggtaccggccctagtcaagctcaccctttccagactgcaaggttctcttcactaccaagaagatcggtcgcctcgatcaagggcccctgctcgccgagctcaagatgaagtccaaggctcccaaagtagtaattatcaggggagatagcgagggttaccagacgtatgatcagttactttctcaagggttcaaggtcagcgtagaacgtctgcatcacatggagaggaaggtcctccctcacttggtctgcaatctccagttcaccagtggcacgactggcctgcccaaggccgccatgctcacgcatcagtatgtccatcatttcctgcactcatcacgcctgttgctccccagctgacatggtaccagcaacattgttaacaacgcgcgcttcatcggtgaccgtatgaagctgggccccgacgacgttctgtgctgcccccctcctcttttccactgcttcggtcttgtccttggcctcatgtccgtcatgacccacggcggcaagattgtctacccagccgaggtttttgacgcccccgctaccctcaaagccatcgtcaacgaacgctgcaccgccgtccatggtgtccccgctatgtttgacagcatcctcgccctccccgaagccaagaatctcaaggctgccgatttgcggctaaggacaggcatcatcgccggtgcccccgtgccacgctacctgatggaattgctcgtttcgaagctcggcatgaccgagttcacgtcaagttacggactgactgaagcgtccccgacctgcttcaacgcgcacaccgatgacccgatcgacgtaaggttgactaccgtcggcactctgatgccccatgcccacgccaagattgtggacagagatggccagattgtacctatcggcaccaaaggagagctttgcattggtggctaccagctgcaagcgggatattggaacaactcggagaagacgaacgaggtgatgatgagggatgagtccggcatgttgtggttgcacaccggcgatgaggccgtcttcaatgagcagggatactgctctattactggacgctttaaggatatcatcatcagaggtatgtttggaaacgactttctgttcaacccaacacgtctcctcccatgctaatctcgacgggcacacaggtggcgaaaacatctaccccctcgagatcgaggagcgtctcgtagctcacccggccgtctccatggccgttgttgtgggccttaaggaccagcactacggcgaagtcgtcggtgccttcctcggactcgagaagggccatcagccaatgagcacagaggaggtgcgcgagtggtgcaggcggaagctgggtaagcacaaggctcccacgcacgtcttctatctcggcttggatggcgtgcctagcacggttccactcacgggaagcggaaaggtgcgcaagttcgagatggcgcagctgggtaat

SEQ ID NO: 27008 - DNA, 1068 bp, Neurospora crassa
tacaggaaggtatggcatgagcccgtccacaggcgcgacccttccaaggagaccgagacggagaaggcatgcttccgccatctcgaactgacctcgcggtcattctccgccgtcatccaggagctcaaccccgagctcctgatgcccatctgcctcttctacttggtacttcgtggccttgatacgatcgaggatgacatgactatcgatcttgccaagaaggagcccttactgcgcgagttcgccgatttgatggagattgatggctggacctttaccgagaatggccctaacgagaaggatcgtgaactcctggttcactttgacgatgtcattgcagagttgaagaaggtcaagaagccttactacgacatcattcgcgaaattacggtcaagatgggtaacggtatggccgactatgccttgaacgccgagcacaacaccaacggtgttaacaccattgaggaatacgagctctactgccattacgtggccggtctcgtgggcgagggtctcacccgcctgttcgtcgagagtaatctcgccaacccagcgctcctcgagcgtatggagctgacggagagcatgggtcagttccttcaaaagaccaacattatccgtgacattcacgaggattacgtcgacaagcgacgattctggcccaagacaatttggagcaagtatgtcaacacatgggacgacatgttcaaaccggagaaccgggaaaaggcgctccagtgcagttccgagatggtcctcaatgcgctcaagcacaccgaagattgtttgttctacatggccggtatgcgcgaccagagtgtgttcaacttcgtcgctatcccccaggctatggctatcgcaacattagaactcgtcttccgcaacccagccatttttgagagaaacgtcaagattaccaagggtgacgcctgccagctcatgatggagtcgacacagaatcttcgcgtagtgtgcgaggtgttccgcagatacgcgaggaggatacacaagaagaacgatccaagagatcccaattacctggcaatcagcgtccaatgcggaaaggta

SEQ ID NO: 27009 - DNA, 1771 bp, Neurospora crassa
ttcgaagaccgggcatacacgtatgcgcaggcttatgatacagtcctgcgctatgccaactggctcaaggaccggcgcggcgtcaagaggggcgatctcgttggcttggactttcaaaataccgatactttcatcttcctcgtcctcgctacatgggccattggagcgtcgccggcgctgctgaattacaaccttaccggtaacccgcttattcactgcgtgaacaagtcaacggcgcggttggtcctggtcgatcccgttgttgcgggcaatgtcagtgaagatgtcaggtcggctttggggggcgtcatcttcgaagtcgtgacgccagcgctggaacaagagatgttggcgatggatagcgtccgtcctgcggatgagctgagaagcggattcaaggacaaagacatggcgatgcttatctacactagcggtacgactggcttgcccaaagctgccattatctcatgggccaaggctgccactgttgccaatttcacctttcgatggctcggcaccaatgtgaacgacgtgtattatacggtaagtctccttgcaagatttgttacatcacttcaactcatacttttctcaggccatgcctctttaccacagcacagccatgctattgggctttgctcatactttggcagcaggtgccacttttgccatgagccgtaagttctcgacttccggattttggaatgacgtccgaaaacacaatgccacgattatccagtacgttggagagacgtgccggtacctcctatcggcacctcccattattgatccagttactggtgaagaccttgaccgcaaacatagagtacgcgctgcctttggaaacggactgcgaccagatgtatggaaccgattcaaggagcgttttggaatcgagacgattgccgaattctatggcgcgaccgaaggcacttttgcgacatggaacaagagccgaaacgacttcagcatgggtgcagtggggcgaagcggtagtctctacaacgttatctttacaagagaggttgccattgtcgaggtggaccatgaaaccgagcttcctcgccgagatcccaaaaccgggttttgtacccgagcgccccgcggagagccaggcgagctgctcttcaggttaccgcctggcgatatcaactctcgcttccagggctactatggcgatgaggaatcaacatcgaaaaaggtgatgagggatgtgtttagcaagggcgatgcctggttccgtaccggtgatgtgctgcgctgggataacgagaaccgagtttacttcagcgaccgtatcggcgacactttccggtggaagagtgagaacgtctcgactgctgaggttgcccaggtggttggcttgcatcccgcggttctcgagtgcaatgtctacggcgtccaggtgcccagccacgagggtcgcgcgggctgcgccgccgtggttttgaagccgtcgtgcttggtgcagacaagcggcgaggcggctagagcacctaggccaaccgacgacaccgttaagagtctagctgagcatgtcaagagggggctccccaagtacgccttgcctctgttcctgcgcgtagtgccggagggaggcctccaggcgacaggtacgaacaagcagcagaagcacaacctacggagcgagggcgtagatccggccaggacgggtgaggatgaagtgttctggctaaggaacggtacgtacgtcaagttcggtgtagcggattggaaggagcttaatgcaggtaatgtgaagctttgagat

SEQ ID NO: 27010 - DNA, 780 bp, Neurospora crassa
caaagctcgttttgcgcggatgaacgactgacccgtgattcccaatgcagcctccgcctgggcaccattgcccccaacttccaggctgacaccaccacgggtcccattgacttccacgagttcattggcgacaactgggtcatcctcttctcccaccccgaggactacacccccgtctgtaccaccgagctcggcgagatggcccgcctcgagcccgagttcaagaagcgcggcgtcaagctgatcggtctctccgccaacaccctcggcagccacgagggctggatcaacgacatcaaggatgtcaccggctcccaggtccaattccccatcattgccgacaaggagcgcaaggttgcctacctctacgacatgtaagtatacccaccacatctcacagatagggaggggggttttggggaaagtgggcatcgagttgctgacactctgttctacaggctcgactaccaggacaccaccaacgtcgacgagaagggcatcgccttcaccatccgctccgtcttcgtcatcgaccccaagaagaccatccgcaccatcctcgcgtaccccgcctcgaccggccgcaactccgccgagatcctccgcatcgtcgactccctccagaccggcgacaagcacaaggtcaccacccccattaattgggtccctggtgatgacgttattgtccacccttccatcaagggagaggaggccacccgtctcttccccaacctcaaggctgtcaagccctacctccgcttcactccccttcccaaggac

SEQ ID NO: 27011 - DNA, 1485 bp, Neurospora crassa
atgactctccttgcgctcaaggaagataggccaacgccaaaggccgtttacaactggcgcgtctacacatgcgcggcgattgccagttttgcctcgtgcatgattggctatgactctgccttcattggcactacccttgcgctgccgtccttcaccaaggaattcgatttcgcctcttacacacctggtgctcttgccttgctccagtccaacatcgtatccgtttaccaagctggtgccttttttggatgtctattcgcttatgcgactagttacttcttgggtcgacgcaaatccctaatcgccttctccgtcgtcttcatcattggcgccgccatcatgctcgctgctgatggtcaggggcgaggcattgatccgattatcgcaggcagagtgctggctggaatcggcgtcggaggtgcctccaacatggtacccatttacatctcagagcttgccccacccgccgttcgcggtcgtcttgtcggcatttacgagctcggctggcagattggtggtctggtcgggttctggatcaactacggcgtcaacactacaatggccccaacgaggtcgcagtggctaattcccttcgcggttcagctcatccccgccggcctcttgttcttgggcagcttctggattcccgagtcgccacggtggctttatgccaatggcaagagagaagaggcaatgaaggtcttgtgctggattcgcaatctcgagcccaccgacagatatatcgtgcaagaggtttcattcattgacgctgacctggaaaggtatacccgacaggtcggcaatgggttctggaaaccgtttttgtccctcaagcagcgcaaggtccagtggcgcttttttcttggtggcatgctctttttctggcagaatgggagtggtatcaatgccatcaactattactcccccaccgtattccggagcatcggcattactggtaccgacaccggcttcttgacaacaggcatcttcggcgtcgtcaagatggtgctcaccattatctggcttctgtggcttgttgatcttgttggccgccgccgcatactcttcatcggtgcggctggcggatcgctctgcatgtggttcattggagcctacatcaagattgctgatccggggtcgaacaaggcggaagacgcaaagctgacctctggcggcatcgcagccatcttcttcttctacctctggactgccttctacaccccttcatggaacggtacaccttgggtcatcaactcagagatgtttgaccaaaacacacggtccctgggtcaggcatcagccgcggccaataactggttctggaactttatcatttctcgtttcacgccgcaaatgttcatcaagatggagtacggcgtgtacttcttctttgcgtcgctcatgctgctgtcgattgtgttcatctacttctttttacccgagaccaaatcgatccctctcgaggccatggatcgcttatttgaa

SEQ ID NO: 27012 - DNA, 963 bp, Neurospora crassa
atgtcgacagcaaccaccacaacatcagcgacgacgacgatgtcggtcgtccagccccgacagcaagagctccttcacctcaccagcacacccgacatcaccccctacaccagacatggctatctcttcggccagaaactcgcggcctccatgtcccctctcctccactccatcgtttactcccacctctctctcaactgggcccaacttcgtcttgactccccctctataccactcttcctccagctggcccagcacccagacttctacggcgcctcagtgaccatgcctcacaaagtggccatcatcccgcaccttgaccacctgactcccgaatgtcgcgacgtcggcgcctgcaataccctatttctcaaaaccgacccagccaccggccgtcgcctgtactgcggcgccaacaccgacgtgattggcgtgcgcgagagcttcgttcaaaatgtctctgaccccgcccgggtatacgagagccggccggcactggtaattggcggcggcggcgcggcgcgatcagccgtgtacgcgctgcacaagtggctcggcgcgacggacatctacctcgtgaaccgggacaagagcgaggtggacgcggtgattgccgaatgcacggagcgcgggtacggcgatcgcctggtgcatgtggcgagcgtggagcaggctgaaggcctggaggggccgggggcgatagtcgcttgcattccggatttcccgcctaagacggagaaggagatgttggtgaggaggattgtcgagacgttcttgatgaaggaggagaagggtgctatgctggagatgtgctataaccctagcccgtttaccgagttgggagcgttggcggagcacgaggggtggcaggttatcttgggcacggaggctttgatctggcaggggattgagcaggtatgtatccgtcctgagcttacattgtactgtggaggacaactcaac

SEQ ID NO: 27013 - DNA, 519 bp, Neurospora crassa
atggcgtccccccgtcacattctcctcatcaatggccccaatctcaacctcctcggcacccgggagccccaaatctacggctcaacaaccctccatgacattgagcaagcctcccagactctggcgtcctcgctaggtcttcgtcttacaaccttccagtccaaccatgaaggagccatcatcgaccgtatccatcaagcagcgggattcgtcccgtctccaccgtcaccgtcgccgtcaagtgccgcaaccacgacggaggcaggattgggtcccggagacaaagtgtcggccatcatcattaaccccggcgcttatacgcacacgagtataggcatccgcgacgcgcttctggggacaggaattccgtttgtggaggttcatgtgtcgaatgtgcatgcgcgagaggcgttcagacatcatagttacttgagtgacaaggcggtggcagtcatttgcggtttggggccgtttgggtatagtgctgcgctggactttcttgggagacacatgaagttt

SEQ ID NO: 27014 - DNA, 801 bp, Neurospora crassa
cgtgtcattcctctatgcgcctcctggttccttccaaacgacccacaaaagcgcaccggcctcgacgttttcatcgaaaagagaatccccaaggcacgcttcttcgaccttgacaaggtcatcgataagcgcagcccttacccccacatgctacccagctccaaagactttgccgctgccatgagtgagctcggcatccgccgcgaagacactgtggtcatctacgacagccaagagctgggcatcttcagcgccccccgtgttggctggaccatgaaggtctttggccaccccaaggttcacattctcaacaacttcaagctatggatcgaggagggtctccctaccgaatccggaaacgtctggacgattgagtgcggtacatatcccattcccgagatgaatgaggacaaggtcgcaagcttcgaggaggtccgccaagttgccattgactccagtaaagagggctccaagagcgtgcagatcctggatgcgagatcgcccggtcgctggagtggcacggagccggagccgagagagggtctgtcctcgggccacatgcccggctccatcaacattcccttcagtgctgtcttggactccagcaccaaggccttcttgccagccgacaagttgaaggaggtcttcgccagggcgggcgttgatccatcaaagcccatcatctccagctgcggaaccggcgtcacggcctgcgtccttgaaacagcgctcaacgaggcgcagtttggatcgcctgagaagagcaaagtttatgatggaagctggacgtaagtgcttttg

SEQ ID NO: 27015 - DNA, 1832 bp, Neurospora crassa
atgactgcagttgctgattttcgcatttcacccaaagggacgtcattcactccagaagagcgtgtggccaagaacttgaccggacttattccgcacgtcatggaggactccgagaagcaggttgagcgtgcgctcaagatgatccgcacccgtcagaccgacattgacaggtacctctacttgtcgaccatcaagagccaaaacgtcgacctcttctaccgcctcctgatggatcatgccaaggagatgatgccattggtctacactcccaccattggcgacgtctgcctccagtactcaaccctctacactcgtccagaagcgctgtacatttcgatcaaacaaaggaagtcgatccgtacaattttgaggaattggccctatcctcagcccgagatttgtgtcgtcactgacggttcccgcattctcggtttgggagaccttggtgtcaatggtgttggcattccggtaagtggcaattactcaatttcatacgctggcaagacactaacgtgtaccagatcggtaagctagctttgtacacggctgctgctggtattcacccggacaagacgctccctatcgtcctcgactgcggtaccgccaacgagaccaacctgaaggaccctctctacttgggccttcgtcagaagcgtatcccggttgccgagcaacaggagttcatggacgagttcatggaggctgccgctgaagtcttcccggacatggttgtgcagtttgaggactttgaaagtgaaaaggctttcaactacctcgatcggtaccgcgatcagtacaagtgcttcaacgatgatatccagggaaccggagctgttgtcctcgccgggtaagttggaaaacccctccagccctgcagaagatgaagttgcttgaatgggaaatcccacgtttcaaaagtgacttgtgagcgtgagacaaattgctgacagtacgctgtacaatatagttacatcggtgccgtcaacctttcaaatgttcctatcgaggagcaacgtcttgtctttatgggagctggctccgccggtgttggcgttgccaagcagctggtcgagtactacaccaagcgtggcctctcggagcaacaagctaaggacaagttctggcttgttgataccaagggtcttgtgaccaaggatcgcggtgataagctggctgaacacaaaaagtactttgcccgtaccgacaacaacggccatcagttccgcaccctcgaggaggtcatcgagtacgtcaagccaagtgcgcttgtcggtcttactgccactcatggcgtctttaccgagtcggtcgtccgcgccctcaaggcttccgtcgacgccggaggacttggccgcaggcccatcctcttccccctcagcaatcctctcaccaaggctgaatgtacattcaaggaggccattgactggactgacggaaccgtgctctttgcttccggttctcccttctccagctacactacaaacggtgtaacatatcaccctaaccagggtaacaacgtctacgtcttccccggtattggtcttggtgctatcctcgccaaggctactagagtcaccgatgacatgatctacacctcggccgctgccctggccaactccctcaatgccgatgaggtcaagcaaggccttatctacccccgcattgaccgtgtccgtgaggctagcgtcattgttgcgcgtgaggtgatgaagtctgctcgccgtgaaggcgtcagcactctaccggaagagcagtggcttgagtgggaggagtggggtgacgttgatctcgagaggtacatcaagcagcacatctacgaccccaagttttga

SEQ ID NO: 27016 - DNA, 894 bp, Neurospora crassa
ctcggtgaaggtacctacgccaacgtctacctcggccactcccgtctcgactcctcaacacaagtcgccatcaaaaagatcaaagtccaaaaggaataccaagatggcatcgcgcccgacgccatccgcgaaatgaagtacctgcaaaagcttcggggccacgccaacatcatcatcttacattccgtcttttcatccaaggaccagaacctcaacctcgtccttgaataccttcccctcggcgacctcgagatgctcatccgcgacgttgaccacgtccgctacggcgccgccgacatcaaagcctggatgggcatgctgactcgcgccatctggtggtgtcacgacaattacgtgctgcaccgcgatatcaagcccaacaacttgctgatcgccgccgacggcgaagtcaaactggcggattttggtctagcacggagctttgccgaccccggcgtgcgaatgacggcgaacgtgatcaccagatggtaccgtcctcccgagctgctgttcggcgcccgccactattcgggtgccgtggacatttggtcggtgggtctggtgtttgccgagctcatcattcgtgccccttacctgcctggtaactcggaggttgaacagatcgccttgatctgcagggaaatcggcacgccgacggaggagaactggcctggtgttacgcagctgaaggagtatacggttcccagcgacgtggtgcccgtggcgggcaaggacaagtacatgggtcggtttggcgcagtcgggtccgatggcgtggatctgttgaccaagacgctggttttggatccaaggaggcgtatcacggcgagggagatgctggagcataggtggtggaaggcagatcccaagccgacgcctaagcatgacctgccg

SEQ ID NO: 27017 - DNA, 2853 bp, Neurospora crassa
atggcttggcaaccgagtggagagaacctgaagactttggcacaatgtctgaaggattccctgagcgccttcaacaaggccgcccagaagcaggctgaaatcgtgagttaatgcccctcggcaccatctagttacccagtctgatggagcattgccacaagacagagattctgacttgtctttataaaccagatgcttaaccaagcgaaagcttcgcccgatatcaacaactacttggccctgattttctcgagctcggaaccaccccaggagtttccagcgactgctgcagactggcatgttgtgcgctgtgccgccgctctgatgctgaagaacaacatcaagaacaactataacaagattccagaacagagcttggctcttgtcaagttggctgtccccttggggctccaggacaagaactcacagatccgcagtcatgcaggcactcttgcgactgagctgattaacaagggaggaatctacggctggcccgagtttctgcccgagttgctcaagatgttgaccaatgagtctggtcaggtaacgcccgaggcgcaggagggagctatggctgccatggcaaagatctgcgaagacaatgcgaagatgctagaaagggaacacaacggccaaagacctatcaactttctccttccaaagcttattcaggcaaccaggagcgcaattcccaaagttcgcgcccatgctctcacagccatcaatgtgttcacccctaggaagtcgcaggccatgctgaactcgatagatgaccttctacagcacctctttgctctggctgaagatccctcaatcgatgtccgaaaacaggtctgccgtgcttttgtgaacctggtggaaacccgtccggacaagcttctgccccatatcgaaggcctggccaagtacatcatcgctcaacaaaagggtgacgacgaggatcttgccactgaggctgccgagttctggctgactgttggagagcacgataacctgtggcgggccctggaaccgtacatcacagacatcatccccgtacttttggagtgcatggtctacagtcccgaggatattgctatacttggaggtgcttcggacgatgaggatgaagaagaccgggaggaggatatcaagccacagttcgccaagaagaagctgacccgtgctgctaacggaaacactgcggctgatatggcgaagaatggaaacgcgttcgagaaggttgcaagcatggaggaagacgacgatgatttggaagatggcgaaattgacgacagcgagtccgagggagatgagaatcccgatgagaagtggactctccgcaagtgctcagcggcggcacttgatgtatttgctcgcgactttggcggaccagtcttcacttctattctaccatatttgcagagcaacctcaagcacgcggattggtcttacagagaagcggctgttctcgcccttggtgctgttgctgagggctgcatggacgtggtcgttccccaccttccagaattggtgccctatcttgttagtctcctcgacgacgaggagccggtggttcgccagattacctgctggacccttggtcgatactctgcgtgggcggttagccttgtggatcaggcagaaaaggagagatacttcctgcctatgatggacggaattctcaagaagatgcttgacaagaacaagaacgttcaggaggctggtgcctctgccatggcaaacctagaagagaaggcaggcaaggcgctcgagccttactgcggacccatcatccagcaatacatccggtgcttcggcaagtacaaggataagaatatgtgggttctctacgactgcgttcagacgctggctgagcacatcggccccgtcctggctaggcctgagcttagtaaccagttgatgccagtcctactggataggtggcagaaggtgggtgatgagtcccgggagctttttcccttgctcgagtgcctttcctacgtcgctatggcccttggcgatgccttcaccccttacgccgagcctattttcggcaggtgtattcgaattattcatcaaaacctggagcaggccatgaaggccaagaccaacaccgatcttgatcaacctgatgaggatttcctggtcaccagcctcgatcttctcagtgccatcatccaggccctagacaacgacaaggcttccaagcttgttgccaacgtccagccaaccttttttgagctgatggctctgtgcatgggggatcaatccgatgccgttcagcaatcggcatacgctcttctcggcgattgtgccaagtacgtctttgaacaactcaagccattcctgcccaacatcatgccggtcgttatcaagcgcttggacatggacactattctggacgaggaggtcgacaacagcttcagcgtagtcaacaacgcctgctggagtgtcggcgagattgctcttcagtacaaggcaggcatggcgccattcgtgccccagctcattcaacgatgtgttgacatcctctccaaccccagggtacccggaggtgtcagcgaaaacgccgctattgccttgggtaggttaggacttgacaatgccgaacttgtggccccacatcttggcagtttcgctgaggagttcctcgacacaatggacgatgttgatccttctgaagagaaagccacagcgctgcgtggcttcactgagatggttactcgcaacccccaggctatggagagcgttctactgcattacttcagcacaattgccaactaccaggaacttagcctgcagaagcccgttttgcttgagttgcatgaagccttccagaacgtaagtttcaacccgagaattcccatgatc

SEQ ID NO: 27018 - DNA, 1732 bp, Neurospora crassa
atggcctctttccagctgggcccggtctccgctcgagtccgggtttccacgctttcttcgacagctttcgggcggtgtccgacttccacgcgcttcaccagactcgaaatcccgttctctgcgtcgacacgggcgcccccagcccaccaaatgtttggccgacgcttcttttccaaccacatgccaaagcggcccaggatgcagtggcaccccatacccattggcctgggcatcggccttctaggcgtcatgcagttctacaaagtctacacgagagaccgggacgaaaaacgccaggctgccgtcgaaggctccgagcctggccaagccggcaagcccaagaagcggcgccgcatccggccggacggcccttggtacgttgaccacgccggcttgctcaattttttgaggcgccacgagctaaccacccggtgtttaggcaggttcaggtcatgtcgactcttcctctcaaggccatgtcccgtctttggggcaagttcaacgaattgaccatcccctactatctcagagctcccggtttccgtctatatgcatacttctttggtgtcaagtgagtgagacccggactcctcccttcctctctctctctgtcttgtgctgacacgtgcgctccagtctcgatgaagtcgaagaacaagacctccacaagttccccaacctcgccgctttcttctaccgcactctcaagcccggtgtccgccccgtggatcccaaccacaatgccctggtttcgccgtccgatggtcgaatactccagtttgggcgaatagaaggaggcgatatcgaacaggtcaagggtatgacttatactatcgatgcgctcctcggccagaactctccaactcccagcatctccggtacgacgctcctcgacgaaagcaccaaggcgaaatcggtcaatggagactttgagggcgacgaggaattggtcaagaaggacgaagaatttgcccgcgtcaacggtatctcttacactctcccggatcttctctctggttccaagaagcatgacaagctgttcaagcccaaggatgagtctgtcaccccttccaagacttccgagactgaggtgagcgccgagcttgcgcttggtgagaagccctggtacgacgttctctcgggtggcgagcgccacactctctactatgctgtcatctatctggctcctggcgactatcatcggttccattcccccacggagtgggttgtcgagcgcagacgtcactttgccggcgagctcttcagcgtgtccccttacctacagcgcaccctccctggtctcttcaccctgaacgagcgtgtcgtcctcctcggcagatggcgttggggcttcttcggctacgtccctgtcggtgcgaccaatgtcggctctatcaagatcaacttcgatcgcgaacttcggaccaacagcttgacgaccgataccgctgctgatcgggctgcggagcttgcggcggccaagggcgagccttacctgggatatgctgaggccacctacgaagctgccagcccggtcctgaagggtcatgctttgcgcagaggtgaggagatgggtggcttccagcttggcagcaccatcgtccttgtctttgaggcgcccgttgccgagcacgacgagtccggcaaggtcaccaagggatggacctgggacgtcgagaaggggcggaagatcaagatgggacagaccttgggtcatgttgcgctctaattt

SEQ ID NO: 27019 - DNA, 820 bp, Neurospora crassa
caggttatcatcttgggcgacagcggtgtcggaaagaccagtttgatgaaccaatatgtatgccagcgtcgagcccgttgtcaccatgcattatgatacaaagaggacgtcatctgacccccgctcttttggcgcaaaacaggtcaacaagaagttcagtgctagctacaaggccactatcggagccgatttcttgacccgggaggttctggtggacgaccgccaagtaaccatgcaggtgcgtgcgccaaataccctactttgagctggttggacgacgtgctaatacgtaaggttctcgacgggcagctgtgggacacagccggacaagagaggttccagtcgctgggcgttgccttctaccgcggtgccgactgctgtgttctagtatacgatgtcaacaactccaagagcttcgatgcgctcgacagctggagagacgagttccttatccaagcatctccgcgagacccggataacttcccgttcgtcgtgctgggtaacaagatcgatatggaagagagcaagagggtggtatgttttctgttcgatgggccttgtcgtatgttggagatcatcatttactgaccttgtggcgcagatttcgaccaagagggccatgaccttttgtcaatccaagggcaacattccgtatttcgagaccagtgcaaaggaggctatcaacgtcgagcaggcctttgaggttatcgccagaaacgcgctcatgcaggaagagtcggaggagttcagcggagatttccaggatcccatcaacattcacatcgagaacgaccgggatggatgcgcgtgctaagggcga

SEQ ID NO: 27020 - DNA, 1821 bp, Neurospora crassa
atgaggcgcacgtcggtctccctgccgaccaagcacgtagctcacgatccccacgagaagcccgaccgctaccgccgtgaccagcacaatcaggaaccggcaagcgtcttcatcaggatgcagaacgcttggatgtcgcagtcgcaaaaggcgcgctacctaaagacgggcgcaatcgtctttgccgttctcttcctcttctacctcttttccccatcaggcgtcgagatctctggtgctgatggaggtaagcaagcatcttacgacgaaattggtttacacaagtccaaatacttacaacctgacctcaccaggcccttctcaaggcaaccagggccaagtaccctccgactcgtcctatggcaccgaccgatgcacaagatccttctccaaggagaagcccatcgtgcagtatgtttccatgatcgacgccggcagtactggttcccgtatccacgtctacaagttcaacaactgcggccccgcccccgagctggagggagaggttctattcaagatgactgccaagatcgagggccagagcagcggactgagcgcgtataaggacgatcctctggccgctgctaagagtctggaccccctgatgcaggctgccctcgaagtcattcccgataagctcaaggcctgcagtcccgtcgccgtcaaggctaccgccggtttgcgcctgattggtcccgagaagagccagaagatcctggatgcagtccgcgagcaccttgagaacgactaccccttccccgtggtctccaaggaggagcatggcgttgccatgatggacggtgccgacgagggtgtctacgcttggatcacggtcaactacctcctcggcaagattggcggtcccgaccacagccccaccgcagccgtcttcgatctcggcggcggttccacccagatcgtgttcgagcctacctttgagggccttgccagcggcggcatgccccagaagctggccgacggcgaccacaagtacgagctcaactttggcggccgcaagttcgacctgtaccagcactcgcatctgggttacggtctcatgtcggcccgcgacgccatcttcgccactctcgtcaacgacctcttcgagcttaacaagcaggacaagtcgtggatgcagaagcccgtcatcaacccttgcttctcgaccggcatgaccaagaccgtcaaggtgcccctcggcgacagccacccgctcggccccaaggttgagctcaacatgacgggcccctcgaccccggcccccgccctgtgccgcagcttggccgagcgcatccttaagaaggatgccgagtgcaagcttgccccgtgctccttcaacggcgtccaccagccgcagatcgccaagacgttcgcccgcgaggacattttcttgctgtcctatttcactgaccggacccagccgctcggcatgcccgagtcgttcaccctccgcgagatgcacgacctggccgcccaggtgtgcggcggcgagcagagctgggatgtattcaccagcgtgcctggtgcgctggaggagctcagcgataggcccgagcactgcatggatctcaactttatgcttgcgcttacgcacacgggttacgagatgccgattgatcgcgaggtcaggattgcgaagaagattaaggataacgagcttggctggtgccttggtgctaggtaagttaatgcatttttggtgctgttccttcctaggtcatagagatgctaacatggtattttttttttttttgctacagtttgccattgctttctcagtcttccggctggaagtgcaagatcaaggagatccactaaatt

SEQ ID NO: 27021 - DNA, 732 bp, Neurospora crassa
cagatcaccaccctcctctttgactgcgacaacaccctcgtcctctcggaggaggttgccttcgaaggctgcgccgacctgattaaccagatcgccgccaccaaaaacatcccgctcgaaaagcctttcacgggcgaatcgctcatcgttgagtttgttggccagaacttccggggcatgctgcgctcgctgcaggagcggtacggcttcccgctcaccgatgaggaaatggagatgtacgtgaagaaggaggaggacgtggtgattgccaagatccaggaaaagctctcgccctgccctaatgtcgacggcgtgctcgagcgactggcggctgagggcaaatacgagcttgcggtcgtgagcagctcggcgctgcgccgcgtcaaggccagcattgaaaaggttggccaggacaagtactttggcgaccgtgtgttcagcgcggccacgagtctgaacccgccgacgagcaagcccgatccggccatctacctacacgcgctcaaagagctgggaaagaaggcggaggagtgcctggcgatcgaggacagcaaaagcgggacgctaagcgccgcgagggctggcatcaaggtcattggttatgttggaccctacaaggccgaggaacgacttaagatggagaaggtcctggcgcaagcgggtgcttccatcatcatgagggactggaaccagtttgaggggtacctggcggcgatcgagaagggtgacttt

SEQ ID NO: 27022 - DNA, 1187 bp, Neurospora crassa
gcagggacgggtagtagtgacaactatgcctacctcgttgtcgacgacaagtccaaggacgccgtcatcatcgatcccgcgcatcctgaggagtgagtcctacaccagcgcgctccaagacccaaatatgcgtcttgcaacctttgaggtgggcaggtatgctgataggaagtaccggtttgacggacgtaaagggtcgctcccgtcttgaagaaggccatcgatgatggatccatcaagctcacagccattgtgaacacccaccagtgagttgccttcctgcgccgatctcagcataatacatagctaacactactttcagccattgggaccacgccggcggaaacaccaagcttgtaggctccctcttccgtttccctcctcactatcctcaaagcacatgttcactcacatgtatacagcgcactgctctcggcctccccaacctcgaaatcatcggcggtaaggactgcgagaaggtgaacaaggttccggcccacggccaaggtttcaacatcggcaatatcgccgtcaaggctctgcatacgccttgccacacacaggatagcatttgctggttcatgcaggatggggacgacaaggtcgtctttactggtgatacgcttttccacggaggtatgttttttttttgtccctggtctattgtagatgtcggttgggcttgggtctctgacatggccattataggctgcggtcgcttcttcgaaggaaatggagcggagatgcacaaggctttgaatgagacgcttgcttctttgccggatgagactcgtgttttcgtaagtccagagtcccctatcttaatctttggataacacagtagtatctgacatatccaatgaagcccggtcacgaatacaccaagtccaacgccaagttctgcatgtcggtattgcaaagcgaggccgtcaaggctctccaagcttttgcggagaagcatcgggagacgcagggcaagttcaccattggtgacgagaagaagcacaatgtattcatgaggcctcatgtgagttacagtctttcacggcgaacggccatgatggaaggttgcagctgaccttgtcgtttgataggaccctgagatccagaaggcaacgggcgagaccgatccggtggctattatgacgaagttgagggagatgaagaacaacttcaagtgagcgttg

SEQ ID NO: 27023 - DNA, 2182 bp, Neurospora crassa
atgccaaatccaagactccatccaattttttctgtccagccttgcagcgcaggggtctggagtgttctagctaccccacgttcccctatcttatcggaactttatagcggggccgacggttcctgtgagggtcacagtgctgaagcgccgctactatgtaaactatactagtatagagtagtaccggtcatgtacctggcttaattgaacccactggagctacgcgtctcgaaattgtcaagcgcgtcgtcgagtttcgtcccttgaagtcagtttccgagtcgggcagcacatgaataagtcaccaattgcttttgtcgttctcacatcttgagccattgtcagtatcaatcatacgatggtcaccttggacgaagttctcggtagcggtttgctacagaagccctcgtgagtagcagtggatcatccatcttccactggcgatcatcagctaacaacccaacttcacgaagaggcgatgcgcccgaggctctccagcgccagatcaccaactacaagccccttcataccttcaaactcgaaaaaacccgtccctatcaacaacaatatgccgatatttactttttgcgtcttacaaagatcaggcccgccgtcgaggcagccgccagcgccgcttgggagggaacagtgcttggtggtgagaaggtcaagagggtcgagcgtgtcctagacgttcgccagggagaactatgctgggtagctggaacagtatatatggacatgcctctaaagccctcaatcctcgaggatgtctccaaggatgtgagtttcagcctatcctttggtggacaccaggcagctgacaatgatgttatagcgctggatctccgctcccacctcggtcggccactactactccggcaacggcgaagactcggtaatgctcgaagacgactccggccgcatccgtcttgtcggcaacgctctgcaaaaccacttcatggtgaccggctgcatcgtcgcggtaatgggcaccgagaacgccaacggcgaattcgaagtcatcgacctcctcttcgccgaactaccaccacagcccgagcgctggtcgctctcaaaaggcaaaaaggaagcagactcctccgaagacgtcgaaatgatggacgcctctttctccaggcagtcccacaagccctcctctaaaaagattgccctcgtctccggcctcgagttctccaacgccgacacctcctacgccatggaactcaacctgcttctcgagtatctcctcggcgaagcgctcgatccctccgtccaacgcgacgagctctcacacatcacccgcctcatcatagcggggaactccatctccacgacggcggccgaacaggccaaacccgcggctgccttcgacaccaccaccgtaacaaacaagttccaaccacaaatcaaaaaatacggctacgacagcagctcctacaacccggttccctcccaactgttggacagctttctgagtgatctcctccccaccatgcccgtcaccctgctcccgggcgcgctcgaccccgccaacgcgagttacccgcaacagccgattcacccggccatgttcccgcagtcgaggacgtacatgccacccccaaaagcgggggcgggcaaggacagagatgtgccaggggaagaagagccggggtggttcgacaacgtgacgaatccatgggagggcgagatcgaggggtggcgggtgctgggcacaggcggacagaatctggatgatgttttcaagtatgtggagagtgaggatagactgggcatgatggaggccatgtgcaggtggaggtgtgtggcgccaacggcaccggatacgctttgtgagttttgcttttcccttttgcagcactccttttcctcccctttatccttggacttcgattcacatttccatccccccttccccgttcggaattagcaacgaactaacctatctgatcaaacagggtcctaccccttccaagaagacgagcccttcgtaatcaaagagtgtccccacctcttcttcgtcggctgccagccagagtttggaacgaaagtgatccacggaccggacgggcaagcagtgcggttgattgccgtgccctcgttctcggagactagagaggtggtgctcgtggacacggagacgctagatgtggaaagggtgaagattgtcgctgagtga

SEQ ID NO: 27024 - DNA, 2819 bp, Neurospora crassa
tgtcgccccctacgcgacttttgtcgtctatggtatcatgtcggcagtgaagaaagaccaaaacctactagcagcacaagctttcgcctctctctcgctcattaatctgttaacaacccctttgcttatgttctgtcaagctttcccagctgccatgcaggctgtggcgtgttttggccgtattgaggcatacctgactaaacaggagttgaagcaattggacctatcctcggttgaagataggggacggtcggcgggagcctcttttgagagtggcacagagctaagaagcgtcgtgggctcgagaccgttcgcccgtgaaacgacacctggggcactcgcctcgtttgcagctgcggacatctcctggtcagcaaatactatcgagccagtacttcaaggtgttaacttgactatcaagccggggtttacggcagttatcggtccagttggttcagggaagtccacgcttctggagagcttggtaggagagacgactttgcagcgcggatctgtcaccaccaacttctcccgtgtagcttattgcccacaagcagcctggctcatgaacgataccatccgacacaacatcaccggcagcagcgaggacttagagatcgaccagaaatggtacgatttgtgtattctatcgtgcggactccgtcgtgatctcgacggtatggtagcgggggaccaaacagccgtcggaacgaatggctcttcgttgagcggagggcagcggcaaagagtagccctcgccagagctgtatactctcgtgctccagttatcatcctcgacgatgttatgagcggcctggatccagcaactgctaaggatattaccacaagattgtttagcaggcaaggccatcttcgtaaggcgggtgtctcggttgtacttgcaactcataatagtaagtttcttccttacaccatcacatcaccgcgttattaactggtttccagagcgccttctcccctatatggatgagattatcgtactcgaaggcggcaaaatcggggatatcggctcatacagcgagatccaatcgcgaggtgacctcaagctcatggccatgaccgacgacgacgatgttatcgagtccggggaggagcagcagtctgcaacagacgaggtatcaagggacagcaaaagcccggccatgacacaaaagccctcagacacgacaaatcgacaaccaatcaagcctaatttcgaacgccgtcaaggaagctggtccgtttacgcctactacgctcgtagcgccggcgccctcagtctctccctctgggccttcttcaccgtcctcggtgccataacatccaactacatgaccatttggatctctaactggagctccgccagcaccccttcggcctccaaccccgatccgcatccaaatctaggttactaccttggtatctacacgctcctcgtcgttctcgcccaaattggtaccgtaggcgagtgcttcgttttcctcatcaacatcatcagtaacacggccctgtctcttcacacggaccttttgaattccgtgctctccgcaccgctttccttcttttcccagtcgtcgtcgttgtcgttgtcgtcgtcatcgtcgtcacccacagactcaaacggcgacgacaataacgacacaagctcagaagacagcggcaccataaccaaccgcttctcccaagacatggacctgatagacatgaccctccccatccaagccatcatgttcaccagcgccggttcctacgccctagtccagctaatcatcatctgcgtcctgggaaaatacctagccgccaccgtcccattacttgccgtcaccctatttctcgtacaaaagtactacctgcgctcgtcacgacagctgcgattgctagacattgaagccaaggcgcccgtgtacaagcacttcctcgaaacagtaacggcggggggtgtagctaccattcgcgcgtttgggtgggataagaggttccgtgacagactggcgaggatgatggatgaggcacagaaaccgttttatatgttggcctgtattcagcagtggttggcgctggtgttggatttggtggtgggcgggatggcggttgtgttggtgggtgtggcggttggggtggcgccggatccggagaaagcagggtcgtcgaagtcggctgtcagtgcaggggctttgggtgtgtcgttggtgttggtcatgacgtttaatgagctgattgtgcaggcgttgcaggcgtggacgaggttggaaacgtcgattggggcggtggcgagggtgagggactttgtaaggacgacgccgaaggaagaggatccggccgcagactgtgacaatggtggctgcgttggagatggattggcgggatggccttccaggggtgagatcaagatcgaaaagatctgtgccagttacgagtatgtgtcacccacccccttccccttcttctccttgtggtacccctgaataagtaaacaaaactaacaacctgcctcccgtgtatttagcaatacctcctctaacaccaataacaccaccactagcggacccccagccctcaaaaacctcacccttaccattccctctgggtccaaactagcagtcatcggcccctctggctccggaaagaccacattcctcctctcccttctacgcatgatcccgctctcctccggatgcataaccatcgactccctcaacatctccaccatccctcgctcgcgtcacatcttcaatgtgatcccgcaagaccccttcttcatccccaacaccagcctagccttcaacctcgaccccttcggccatctctcccacctgccc

SEQ ID NO: 27025 - DNA, 2004 bp, Neurospora crassa
atgtccaaccgacacttcatcaacgacccccaacacctcgtcctcacatccctgcaatccaccaccctcctcaaccccggcatcgccctcgacgcccacaacaaaatcgtctacctgcgtcccggctacggcaatgcctcctcctcctcctcctcctccaaccaaagacagaaagtctccctcatctccggcggcggctccggccacgaaccttccttctccagcatggtcggtcgcggtctcctctctgcctgtgtagcaggtaccatcttcgcttccccctccgccgaacaagtccgtacagcgatcatggggcgggttgaaaacaacgagccctcctcctctcctgaacatggacaacaacaacagagaggagaggacgcgggcggggtcctggtggtagtcatgaactacaccggtgacgtgctcaactttggcctagccgtagaaaaagccaaagccgcgggggtgaacgtggagatggtggttgtcggggatgatgtcggtgttggacgggctaaagctgggaaagtaggcagaagaggcattgcggggacggtgttggtccaaaagattgcgggagcgttggctgcgcagggacggagtctgaaggaggtgacaaaggtggccaatttggcggcggagaatatcgtcagtgtcggcgccagtctggagcatgtgcatgttccggggagaagggcggaggcggagggcgccgagttcaaggtgttgaaggagggcgaggtggagattggcatggggattcataatgagcaagggagcagtagggagaaggggattgggttgccggagttggtggggaagatgctgaagcagttgctggatcggaacgatgaggacagggcgtttgtgaacgtaaattcgaatgaggtggtgctgttggtgaacaacctcggtggtgtcagcccgttggagatgggcgggattgtcaccgaggtggtgacgcagttggcggaacaaccgtatgggatcaagcccgtgaggatcctgagcggcacgtatatgacgagcttgaatgggttgggatttagtatctcgctgttgaatgtggttaacacggacattggcggaccgggcatgattgacttgctggattacccatctgaggcaacgggttggacagcacccatctccaagctgacttgggaggagcagcgggaaaacaagagtacccgggagaatgaggtcaagtccgaggaggaggtgaggccttgtggtctaacgtatgagccccaggaggtgcagaagcagctggttgccgggctgaaggctgtcatcgccgccgaaccggatgtgaccaagtacgacaccatggtgggtgatggtgattgcggtatcggtctgaagcgcggcgctgagggtatgtccccctagcaacaacaaccccttttccccctgatagctaacagaatgccagcaatcttgtcgcatctcgactccaaccccctaacaggcgatgcagccattgacctcgccaagatcgtcaccgtggtcgagcaaaccatggacggtacctcgggtgctctctacggcatcttcctcaacgctctggtcgcctctctccacactgtcggtggaggggagtcggacaagaaagctgctgatgaaaatgcctgggccgcagccctcaaactgagctgtgaggccctgtccaagtacacgcccgctcgtcccggtgaccgcaccctggttgatgccctctatccctttgtcgatgcgctcgaaaagaccggtgatgtgaagaaggcggccgaggctgccaagcagggagctgagggcaccaagggtatgaaggccaagttgggccgcaccgtctacattggcgggtccggattcgagcaggtgccggatccgggcgcttggggattggccaagttcttccttggactggctggaattgaaaaggctgatgattccagtgctaagcaggccaagggatcggatgatggatgggaggaggttacaagagaggcggaattgccg

SEQ ID NO: 27026 - DNA, 3859 bp, Neurospora crassa
atggatcacgaacatcagagcaggaggcataaactgggcgtcgtctccggcgtctacatcccagtatgcctcaatattctcagtatcctcatgttcttgaggttcggctccatcttgggtcagattggtctacttggcatgcttggtatgtccttcccggagcttactgtgtaccactttggatgaaactggctaactatttctaggacttctcttcattgcctactcggttgattttgtcactactctgtctctatctgccattgcctccaatggcgaggtcaagggaggtggtgcctactatctcatctccaggtcccttggccccgagtttggagggtccatcggcatcctgttttatttggcgcaggtcttgaacaccgcactcaacgtcgtcggtctcatcgactgcctgaggctgaatctgggatctgtcatggctcagggatactggtggacctacctgttcgagacaggcgcgttgttggtatgcactctactgtgcctggctggcagcgccatgtttgcaaaggcgagcaatgccttgttagccatcatggtcatctccatcctgagcattcccgtctcggccattttcctgccatcattcaacgatccggtcagtggcatcgagttcacaggcgtcagtctcaccactttgcgatccaacctgtggccgcattttgcaggtgatgagttcaaaggagctggcacctttagggatctcttcggcatcctgttcccggcaacttcgggtatctttgctggcgcgtccatgtcgggtgatttgcgaaaccccagcaaggacatccctcgcggaactctctgggccatgttgtcaactctcatctcgtacgtcgtggtcatcatctcgctggcctcgagtacgacacacggcacgtttctgcgaaataccaacgttatccaggagacaaatgtttggcctccaatcatctttgccggagagtttgcaacatgctttttctcggctttgatgggagtgataggctctgccaaactcatgcaggccttggccagagacaaactggttcctggtatctccatctttggaaaaggcaccaagaagactgatgagcccttgctcgctatcttcttaacgtacatcgttgctcagtttgccatgttcgcgaacctgaatcagattgcaaccttcatctccatgggataccaaatgactttcttcgtcatgaacctcgcttgcttcctgctcaagattggctccgcccccaacttccgcccaggcttcaagttcttcagctggcagactgccttcgccggtagtgtgctttcagcggctgccatgttcttcatcgacgagacgtatgctaccactgccgtctcactgctcgttactctgttcctgctaattcactatctgagtccgcctaagcgctggggcgatgtatcacaaaacttgatctaccaccaagtccgaaaatacttgttgaggctgaaaccagagcacatcaaattctggcgaccgcagatcatcctactcatcaacaacccgagaaagcaaacccgcctcattcagttctgcaactcgatgaagaagggcggactgtacatcctcggccatgtcatcgtcaccgatgatttctccgcgggagttaccgaggcaaaactccaacaagcggcgtggtcaaagtacatatcggagttctcgaggatcaaggcttttgtccagctcaccatgtcaccaaccatcacttggggcgtgaggaacctgatcctctcggcaggcctgggtggtatgcggcccaacattgccgtcattggcttctacaacctggacgacctgcggcgttcccggccaacactgcgtatatcccaccaggcgccgacgtcacatactaagagtccgcagactactgaaactaaacaacccgtgaggcagcgaaagagaggcgatacttcggctaggttgatggaaggatttttgcccactgacgtgatcaggaccgaagagatgatgtcggttattgattatcttactattctagaggatctggctttgcgatatcgtctgaatgtggcggttggtaaagggtttgagaccctggagacaccgaggaaagatgggagtaacaccaagaagtacattgatctttggcctatccagatgtcggcggagctttccgcggacggcaggaatgttctgaccaccaactttgatacatgtgagtctctgtcaactggacatggttatcacttcaattgctgacatataacagacactctcatcttgcagctgggttatatcctcgatactgtccccgcttggaagaaggtttaccaagttcgtgttttggtattcgttgaatacgaaagcgaggttgaagaggaaagaggacgagtcaaggctctccttgaaaagctaaggatcgaagccgaggtgctggtcttctggctggcctctggtgatctcggtacatacgaggccatcatccacgggcgtttccgagatcaagaaacggagaaactggtcaatgattgtctagtgggccaagaatggtgggaagaacttcagaagattcggggaacccatgaagagacctcacagcccgacatgagttccgtactgaacatcgttgagtcgacttcgggacgaccggggttgtacaatccacacagcgagctccctgatccgcgcgataggaggcgcgccagctgggcgccactggctgattttcccaagaagcccacagtctcacagttggttcggctgggtgtcagcatgggaatacacactcagaaccttgcggcgaatgtgctggacagctcagacacagacgttgacggcgagagcgacagcgacagcagctcatctagcggtacattggatggagatttcaatgatgctgcaagtgtcgcaaataatggcggccttgaagcacttgaaccgtcgcgacttcctctattgggagccactagacgaatgagtcacggagacctcttcgatcgcttgaagaagccttggaaggataggagatcgcggaaggcaggaggaccatctgcacagcaatcttatggcgcagtgtctcaggataccgggccaagtcgcaataatggttcagaaggcaggtctagcaagagggacgattttctgagcgtgggcacggagcgatcatcccacacgacaacgccaacactgtcgcgacaaaactcatcaatcttaaaaagctctaccgccagaaagttcaccagctcactggtcccggaaacaaggataaccagtgatgacacaggaccacagattatgtttgcagaagatcaggctcgccccgggatatcacgtcggtccacaccggggaccactgcacttctttcaagcaaacaacccgccagaaatacaattggtgacggcaacggaggaggtcctagaacggtctgctttgttgagcctcgctacgatggggcttcatcgtccccagacaagtcaagagcaaactccccggcaaggactggaattggcagcggcagtggtgatgtcctgcttgacatacccgagctactctcttcatacagacttcagcaacagcagcaacaggacgatgatgccgctgaagctggctcgagctattctacccaagggcttccgctctcctttaacgacctcccaagccgggcgcagcatctgattttgaacgagctgatgcggcagaatagcgcggacacggcagtcctctttaccacgctcccggtacctgaggaaaacacttgtcaaagtgaggaggcaagtttgacgtacctgttcgatgttgaggtgctttgcaatgggttaccgcccatgttgctggttttgagtaacaatatgacggttactgtgagcctctga

SEQ ID NO: 27027 - DNA, 2167 bp, Neurospora crassa
ctctcgaggacgaaggacaaggattccaagtccaagaagaataaggatgcgaaggacggaacagcttcccccaactcacaaggctctcgcgaggccacccagtcgcccgttctcaccccttcatcgtctacgtcgacacttgtaaatgacagccgtaacaagccattgccgcctaacaatgcggcccatggcgaccacggcaattccatgctcggccctcaaggcggcaactcgaaccctggcgcagcggatagattcagcagtatcggggggcagcaacagggcgccaacggcggcagcacccctgtccgtcacggcacccttcctcctaccgttataatcagccccagcgcgccggtaagaagctccttggactgccgtacctggaccatggaaatactaacgattggttgtcgtagcatgtcccacctcccggcgccgcggaaacgatgccgcacgatctcgctcctccaaaagccggacaaaagtcgcttatgtttgaccgtttacaccagacccccaaagacgtcctggaagggctcaggacgccaaagaggcagaactcgtcgcggttcgacatctcagcccatcgcgagctcgagaagctcccgggcttccatgaggtggcccccaatcaccgccaggatctgttcatgaagaagatcgagcagtgcaacgtcatctttgacttcaatgatgcgagcgccgacatgaagtccaaggagatcaagcgattggcccttcacgagctgctggattatgtcgctaataaccggcaagtcatcactgagccaatgtatccgcgtgtggttgagatgtttgcaaagaacttattccgcccaattcctcctcccatgaacccgcagggtgaagctttcgatcccgaagaggatgaaccggtcctggaggttgcctggccgcatattcaagttgtctatgagttcttcctccggttcattgaaagtcaagatttcaacaccaatattgccaaggcgtatatcgatcatagcttcgttcttcagctactcgagctcttcgactccgaggaccccagagaacgggactttttaaagacgactctgcatcgtatctacggcaagttcctcaacctgaggtccttcatccgccgctctatcaacaacgtctttttccagttcacgtacgaaactgaaagattcaatggtattgccgaactgctcgaaattcttgggtcaatcatcaacggttttgcgctccctctcaaggaggagcacaagcttttccttaccagagtattgcttcctcttcacaaggtcaagagtctgagcatgtaccatccccaattggcgtactgcatcgtgcagttcctggagaaggatgcttccttgacagaagaggcatgtgacacaccccgtcttttgcgaccccaccataagctaacatttgtctcaggttgttctcggacttctccgttattggcccaaggtcaacagcaccaaggaggtcatgtttctcaacgaggttgaagacatcttcgaggtcatggacccggctgagttcgccaaggtccaagaacctctgttccatcagctcgccaaatcggttgccagcccgcacttccaggtcgccgagagagctttgtatttctggaacaacgagtacttctgcaatctcgtgagcgacaatgtcgagatcattctccccatcatgttcgctcctctctacgaaaactccaagggacattggaataggtacgtgtttgaacaacatcacatattttgaggtatcacgactaaccgaaaatagaaccatccacggcatggtatataacgctatgaagctatttatggaaatcaacccgcagctattcgatgattgctcccacgagtacacggaaaaccaaagcaacgcccctgcaagggaagctcatcgccagagcaaatgggctcgactcgaagaactcgcgaagcagaggaaagtagaaagtggaacatccaatggcaccagctctatcccagctcgcaccactgtccacccgctgcctcgcctagaagaagtagacggtacagaggataatcaaaagaggctggattctttgaagttgcaggatggtgatagaagggagcgacgacccgggatgcacgagaggcaaagctcagtaggttcatccagaagtcggtaatacgcc

SEQ ID NO: 27028 - DNA, 2647 bp, Neurospora crassa
atgaagaccgacttcaagttttctaatctactgggcacagtctactgccagggcaacctcttgttcagcccggacggtacccatctcttctcgcccgttggcaacagggtgacagtctttaaccttgtcgagtacgtctcaagattccctacacacctgcctggcgcatggcttgtaagctggctaacacggtcgcagtaacaaatcatatacccttcccttctcccaccgaaagaacattgcgcgtatcggtctcacgccccagggcaacctcctactctccatagacgaagatggccaagctattctcaccaacgtgccccggcgcgtagtactatatcacttctccttcaaggctccagtaacggctctctccttttcgccatcggggcgccacttcattgttggactcggcaggaaaatcgaggtttggcacgttccctcaacacccgacgccaacgccgacggcgagctcgagtttgcgcccttcgtcaagcaccatacccacgtccaacacttcgacgatgtccgtcacatcgagtggtcccacgactcgcgattcttcctcacatcttccaaggatctcacagcaaggatatggagtgttgatcaagaggaggggttcacacctacagttctgtccggtcacaggcagggtgtcgtgggcgcgtggttttccaaggatcaagagacgatttacacagtcagcaaggacggcgccgtattcgactggcaatacgttgcgaagcctggacaggacgaggatatggtggacgacgatgacctggcctggaggatagtcaacaagcactatttcatgcagaacagcgccaccgtacgatgcgccgctttccatcccgaatcgaacttgctggttgccggtttctcgaacggtatctttggcctctacgaaatgcccgacttcaacatgatccacactctcagcatctcccagaacgaaattgactttgtgacgatcaacaagagcggcgagtggctggcgtttggcgcatccaagcttggtcagcttttggtgtgggagtggcagtccgagtcttacattctcaagcagcagggccatttcgactcgatgaactccctcgtttactctccggacggtcagcggattgtcacagtcgccgatgatggaaagattaaggtgtgggatacggaatcgggattctgcattgttaccttcacagagcacacgagcggcatcactgcttgcgagttctccaagaagggcaatgtcctgtttacctcgagtttggacggttccatcagggcttgggacttgatcagatacagaaacttcaggacctttacagcaccagaaaggctatctttctcttgcatggcagttgatcctagtggcgaaatcgtggcggctggctccgttgactctttcgacattcatatttggtctgtccagactggccagctcctagatcgtctttcgggacacgagggccctgtgtcatccttggcctttgcgcctaacggcggtcttcttgtgagtggtagttgggaccgcactgcccgtatctggtccatcttcaaccgcacacaaacaagcgagcctctccagctcaactcggatgttctcgacattgcctttaggccagattctctccagattgccatctccactctcgacggcaacctgtcgttctggtcggtctcggaagctgagcagcaagctggtcttgatggacgcagggatgtctccggcggtcggaagatcggtgatcgcaggactgcggccaatgttgccggtaccaaggctttcaacaccatcagatacagcacagacggatcgtgccttttggccggcggaaacagcaagtatatttgcttgtactccgtcaccaccatggttctcctgaagaagtacaccgtgagcgtcaatctttcaattcaaggcactcaagagttcctcaacagcaagcttctcaccgaggctggaccccagggtctcctggacgagcaaggcgaggcctccgatttcgaggacaggatagacaggtcactcccaggctccaagcgcggcgacccctccgcacggaggaagaatcccgaagtgagagtaaacggcgttgccttctccccgaacggaagtgctttctgcgccgcctccacagaaggtcttttgatctacagcctggacaccaccatccagttcgatccctttgacctcaacatggagatcacccccacctctaccctggccgtgctcgagaaggagaaggactacctcaaggctctcgtcatggctttccgcttgaacgaggccggtctgatccagcgtgtcttccaggccatcccttacaccgacatccctctggtggtcgagcagtttcccaacgtgtacgttgccaggctgctgcggtacgttgccgcgcagaccgagcagagccctcacgttgagttctgtcttctttggatcaaggctctggtcgacaagcacggcgcgtggttgtctgccaaccgcggcaaggtcgatgttgagcttcgtgttgtcgcaagggctgtttccaagatgagggatgagatcaggaagttggccgatgaaaacgtctacatggttgactacctcctcggtcaggcgagcgctgctaaggagactaataccaccaagaccttggcg

SEQ ID NO: 27029 - DNA, 1357 bp, Neurospora crassa
atggcccctgccactaccgagagcgcctcaccgattggcattgccaatctgcccaaccagcgacacaagattgttgctaagagaggcgctgcttttactattatggtgcgcttcactgtccaaagcttgccgaacctcgcgcttgtaaaaccaatgctgacggcgtgggtggataggttgctggcgagtccggcctcggcaagaccaccttcatcaacacgctgttctccacgaccatcaagaactatgccgaccacaagaggcgccaccagaagcaggtcgacaagaccgtcgagatcgaaatcacaaaggctgagctcgaggagaagttcttcaagggtacgacagcacatcacgcagggggaccttggtgtcttgtaggagagctctgtctaaccagcttatagttcgcctgactgttatcgacacccccggctttggtgactacgtcaacaaccgcgactcgtggatgcccattatcgaattcctcgacgaccagcacgagtcctacatgctccaggagcaacaaccccgccgtcaggacaagattgatctccgtgtccacgcctgcttgtacttcatccgccccaccggccacacgcttaagcccctagatatcgaggtcatgaagagactctgctctcgcgtcaacctcattcccgttattgccaaggccgacactctcagccctgccgacctggcgaggttcaagtccagggtaggtttttccctttacttgaagataccacccatcatcgctaaccatgacttctagatccgtgccgtcatcgaagctcagggtatcaagatctaccagccacctattgaggaggatgacgaggctgccgcacaacacgcacgcagcttgatggccgctatgccctttgccgttatcggctccgagaaggatgttaagaccagcgatggacgtattgtcaagggccgtcaatactcgtggggtgtggccgaagtcgagaacgaggaacactgcgacttcaagaagctccgttcgattcttatccgcacccacatgttggaccttatccacacaacagaggagctgcactacgaggcttaccgcgcccagcaaatggagacccgcaagttcggcgaggctcgcccaaggaagctcgacaaccccaagttcaaggaggaggaggaggctctccgcaagcgcttcacagaacaggtcaagatcgaggagcagcgtttcaggcagtgggagcaaaagctcattgccgagcgcgaccgtctcaacaaggaccttgaacagacccacgcccagatcaagtccctcgagatggaactcgagtctctgcagggaaatgccgttcgcagccacggtcgccgctaagcg

SEQ ID NO: 27030 - DNA, 1492 bp, Neurospora crassa
atgcggatttcctgtccttgccttgacatcacatgcaccaggagcccacgcttacaatgtgatctcttcacttacagatgggtcgcaaaggaagctcgaccgatcagtttgcgccaattgatggtctttggccgttccctgaccgagtcgaggttgattagctctgccaattatgtgcgaacagagcttccgacgaggtaagctctaaactagactctccaacatcgagactaccagagttacagcatctgactatgtatgcgacaactcggacagaattgcccaccgcatccgcgacatgcaacggctcccctacgtagtagtaaccaacccacacatgaacgaagtctacgacctctactactcggctttcgacaccttccgcaaggtccccgaaatcaaaacgctcgaagacaacgacgccctatgcgccaccatccgctccaacctcaaagcgcacctgaccgtgatccccaagctagccatgggcatactggagtcagccggactcatggacgccaaagagctagacaagttcatgaacacaattctccgttctcgcatctcgcgccgcgtcatcgccgagcagcacttggctctaaccgacaccttccacgcgccttggttctcccccggcgccaagctttcggaatccgagttcatcggcgaagtctttttgaagtgcgtcgccaaggatgtcgtcgaaagatgcggccaagccatccgcgacattgcgcagcacgcatacgggcccgacgtggcgatccccgagatcaaaatcgacggacacctggaggccaatttcccttatatcctcagccatctcgagtacatcatcggcgagctactccgtaactcggtgcaggccgtagtggagaaacaccagcgttataaggagaaggtagcggcagcgggagggaagaccgacgagattggcccgccgcctgcgatcgaggtgacaatctgcgaaagccagcaacacgtcatcattcgcatctcggaccaaggtggcggcatccagcaggacgtcctgccgtacttgtggtcctttagcaaagggcctgcgagtcagcagctgctgacgaatctggaacaggtgcccaagatggccgcgacgatgcaggagctcaaggtcgagggaagtacctctagcgaagctgggacaacggtgggcaaattgcaacaacagcggcaggaacagcaacagcaacagcaacagcaacaaaaacaacagatcaaaggcattcacaacgggaacaacttccccggcgacccgggttactgcaattcgttggcgacgctgacaagccgcccgccgaacctacgcctgggcatggggttgcctttgagcagggtgtacgccgagtactgggctggtagcctggcgctgcacagtctggaagggtatggggtggatgcgttcttgcagatctcgaagctggggaacaagaatgagcagctgacgacgcgggcaacgatggatgccgtttag

SEQ ID NO: 27031 - DNA, 3946 bp, Neurospora crassa
atgggcaaccccgccaaccgcgctcttctgactccctcgccatccccgccatctgacgaccaggttgctaatctgcctgtccgcaccaaggatgaccaaaacccccaagccccctcgcccaacgccatgttggtcgatacacccgaggaacacgttgtcgaaccaaacggcgtcgataatgacgaggtcgcaatcatcaccccggaggctgacgagaaggaggctcctgtccttgccactgactgtgagttggacaacaacacaacctccatcctcctcgggggctccgcaactgacgctgttttagacaaaaccatgaaagagcacgtccttccagccctaatcgacgaacccccaatccttgaggaccaggtttacacgtgggagatcaagggttggcgcaacctaaacaagaaggagcatggtcccatcttccatgctggtggcttcccatggtcagtatttctcggtggtttcttcacgtctgctaaggaaactaatattgttcaaaaggcgaattcttcttttcccgtatggcaataatgttgaccagtgctcgatatacctggaacacggcttcgaagcggacgaaatgcccgaaaaatggagctgctgcgttcagtttgcgctcgtgctatggaatcctaacgacccttccgtctttcatcaccattccgcccatcaccgtttcaccaaggaagagagcgattggggttttacacggtttctggaactccggaggctgttcagtcagccttatgacggttcaagccgtcctctcggcgaaaatgaaagcgtcaacattagcgcctacgtcaggattgtcgaggatgaaacaggagttttgtggcacaacttcaacaactacgattcgaagcaggagacaggctacgtcggtctcaaaaaccagggcgccacttgctatctgaactcactcttacagtcgctctatttcaccaatgctttccgcaaggtaaagagatcaacatcttgttcctttttgctctgttttccgcccgcatgctgactggcttgcagattatctaccaaattcctaccgaacaagacgagagcatgatgaacagcgcctatactctacaacgactcttttatcagttgcaaacatcaaatactgccgtggctaccagtgagcttaccaagtcttttggatgggagacccgtcatatttttgagcagcaagacgtccaggagctctcgcggaaattgatggaacgcatggaggagaagatgaagggcacaccacacgagaaagcccttgcacagatgttcagcggcaagatcaaaaccttcatctcctgcatcaacgttccgtacgaatccagtcgagttgaagatttctgggacgtccaacttaacgttagcggcaataagaacctgctggagagtttccaggactacatccaggtggaaaaattggacggggaaaaccagtactatgctggcgacgagtacaaacttcaggatgccaacaagggcgtcattttccagagctttcccgatgttctgcatttgcagttgaaacgcttcgaatacgacattcagcgcgacacgatgatgaagatcaatgctcgctacgagtttcccgaggagttcgatgcagctcccttcctcgagaaagacgccgaccgatcggaaccttgggaatacgagcttcatggtgtgctggtacacagtggggacctgaacaccggccattattacgctttcctgaagcccaccaaggacggaaattggtacaagtacgacgatgacaaagtcaccaaggccaggaagcttgaggtcctggaagacaactttggcggtcctttccggttgccgaatggacaaattaggactttacctcaaaagaagacaccaatcatgcgacccaatagcgcttacatgctcgtgtatattcgcaagtcccgaatcgaccagatccttacccaggttaccgaagaggacacacctccacatctccgcaacagattcgcagaggagctggctgctcgtgaagcccgacgcaaggagagggaggaacaacacctctatataggggttaaggtcgtcaccgaagcgacgttccaggagcacggcggcaccgatctgacctatttcgacacgactcctgaccaagatcccggggcaccgatttactatcgtgttcttcgccaggataccatggagcagttggtcgctaaaattgcagcagacctcggacaagatcctaaacgggtccggttgtggataatggtgaatcgccagaacaagacagttcgcccggacgttcctatcatggatcttgcgcttacagtggaggaaacctactccaaggctactgctcaacgggatgagtctttacgtgtgtgggcagaagtggctgaggaggtcaacgcggacggtgaacccatctggccatcgcatcaggcacaagctaacggcgcgattgtaaaggataacatcttgttgttcctaaaatggtttgacgtggagagccaaaccttgaggggcgttgggcatgtctacgtgaggttggacaagaaggtcgaggatctggtccctgtgattctgaagaagatgggctggggcgaaaaagtccccagtggagagaagattcagctgtgggaggagatcaagccaacgatggtggaaccgctacgaggcaaggaaactcttaagaccgaggagttgcaagacggagacatcatctgcttccagcggacccatgtgcacaagtcaagacttggtcttggcgagagcaagccttctgaagacgctaaatcatcggacaagttgacggatgctagggagtattacgacttcttgtaccaccgcaaggtcgtaagattctgccctcacccccaaaaagctgatgttcagcagtacccacagttcgagcttgtcttgagttccaagatgagctatgacaaactttcggagaaggttggagagcacataggtgtcgagcctactcacattcggttctataccatcaatggggcaaatggcaatcccaggacggcagtcaagaagctatccaaccaaacggtagagaggattcttaccccgccgggatacgggcagatgaacctcaatcaactatcagacgcactttactacgaagttctcgacattagtcttgccgagctagacaccaagaagagcctcaaggtcacttggctcagcgagggcatcacaaaagaggtgagtagcttggtaacattggtggctgcttacgttactaacgctacagtaggaccaatacgatcttcttgtaacgaagagtggtgtggttgaggacctgatcgagacgttggtcaagaaggccaagattcctggcgaggaggaggccggccaaatccgggtatatgaagtcagcaacaacaagtggtacagagatctcgacagaaactatcctgttatctctattaacgagtacaccaccgttgtggctgaacggaaacccgaggaggagattggtgtcactgatcctaaccagtatataaccgtcttccacttccaaaacgaaccgagcagggctcacggcatgtcgttcagattcttgatcaaagaggtaatttcacattcatcgccttctgaacgctttaagatctaaccaaatggtcatcacagggcgagccattttcggagacgaagaagcggctcgaaaagagattgggaatcaagggcaagagcttcgagaagatcaagttcgctgtggttaggagggctcagttctcacgacccatctatctccaagacggtttgtggcacctaccgatatctgttttcccaatggcatgactaactcgtttgctgcatagacgacatcctgtacgagaaggccgaaaaagaggactaccttggcctggaccacgttgatcggtcaaggtcggcgcgaaatggcggtggtgacttgttcctcaagggataagtgtaatatgga

SEQ ID NO: 27032 - DNA, 1460 bp, Neurospora crassa
gatgttcaggcgcctgccatgttcaagcccagcgacgagcaatttttcgaggacgaaacccacaccaagcccgacatccagtttttgaagcaacatttttaccgcgagggccgtttgaccgaggagcaagcactatggatcatcagggagggtaccaagcttctgcgcgccgagcccaacctgctggagatggacgctcccattaccgtttgcggtgatgtccacggccaatactacgatttgatgaagctcttcgaggtcggtggtgacccggccgagaccaggtatctcttcctgggcgactacgttgatcgtggttacttcagtatcgagtgtgtcttgtatctctgggcgctcaagatccactaccccaagacactctggctgctgcgcggaaaccacgagtgccggcatttgaccgactacttcaccttcaagctcgagtgcaagcacaagtactcggaggccatctacgaggcatgcatggagtcgttctgttgtctgccgctggcggcagtcatgaacaagcagttcctctgcattcacggcggtttgagccctgagctccacactctcgacgacatcagaaacgttagtctaacagccacttgactgccacgttatggtatgggcatactaacccggtgacttttatgcagattgaccgtttccgcgagccccccacacaaggtctcatgtgcgacatcctgtgggccgatcccctagaggactttggccaagagaagacgactgacttcttcgtacacaaccatgtacgaggttgctcttatttcttctcctattctgctgcttgtcatttcttggagaagaacaaccttctctccatcattcgcgcgcacgaggctcaggatgcaggctaccgtatgtaccgtaagaccaggacaaccggattccccagtgtcatgaccattttctccgcgcccaactatctcgacgtttacaacaacaaggccgcggtgttgaagtacgaaaacaatgtcatgaacatccgtcagttcaactgcacgcctcatccctattggctcccaaactttatggacgttttcacctggtcgcttcccttcgtcggcgagaagattaccgatatgctcatcgccattctcagcacctgctcggaggaggaactcagggaggattccgcgacaacttcacccggttcagcctccccggccctcccgtctgcggctaatcaagatcctgactctattgagttcaagagacgggcgatcaagaacaagatccttgctatcggtcgtctgtcccgtgtcttccaggtcctcagagaggagtccgagcgggttacggaactcaagaccgtttctggaggccgtcttcccgccggtacccttatgttgggtgccgagggtattaagaacgccatcagcagttttgaggatgctagaaaggttgatttgcagaacgagaggcttccgccgagc

SEQ ID NO: 27033 - DNA, 3945 bp, Neurospora crassa
atgccttcttcagacacataccatctctccaagccgcccgattcccacgtcgtcgatgaatccgactccgacttggagatagacctcgaagaactcgacccccaggcaaccgaccccaataaccaccaccagtccttggggcaacaccgcagccgcaactcgtccgaacaacgccctcctcccccaacaacaagtatagcacttcgcaatcttcgcatggggagtctacgccgtggcgccaaacgcaatggatatggcgagctaggccgtagccgggacggaaacgacgacgacgacgccgacgctctgctccgccatgatcgccactcggttggcagtgccacccacgacgaggatgccggcctcctcagcgaacatggtggtggcggccgaatacgcaccagcagtggaagacgacggaggtctttcgccggtgacggtcttcgaaacatctcgatgaagctaccaggcttcatgtcgggcgaccagagcaaccataacgacgagcaggaacaggaggaagacgacccctcatcgtcacgattagttgcagttggctcatcccagtctacccgcttcccacccaacatcatatccaacgcaaagtacacagcatggagttttctgccagtcactttgtacaacgagttctccttcttcttcaacatgtacttcctcctggtcgccctctcccaggccatccccgcactacgaatcggctatctctccacctacgttgcacccttggcatttgtcttgttcatcaccctagcaaaggaggcttacgacgatatcgaacggagaagaagggacaacgaggcgaattccgaagagtacaccgttctgcagttcgacgatccaggcgctagtctaggcatcaaccggcctaggaggaagatgaaatcgtctcatacacgaacgggctctaaacgtcttggcattgagcaggaaaatgatcggctatcggatatccaagaggaggaagaacagactgaaggtcggggtcttcgcgaattgccggcatcctacctatccgaagtcagcaaaaagtcgcgggacctcaaggtcggtgacgtcttgaagcttaccaagggccatcgcgttccggcagatgttatcattctcaagtgcttggcacacgaatcagctgccaacaaggagaccgaagagcaagaagtacccgcgaaggaggagatgctgctcctggaccatgtcgatgatgacgatgttggagagggcagttccaagaatgcgaaaacgtccaaggagagcaacaataatggcgccgagggaagctctagcggcgagacttttattcggaccgaccaactggacggtgaaactgattggaagctgcggttggcgtccccgttatctcaaaaccttagcactgaggaactagttcgtctccgtgtcacggccggaaaacctgacaaaagggtcaatgagttcgtcggaacattggaacttcttccttcgcgacaagatgtcatgagcggtgccgcctacaaccctagggagggcgacgatgtcaaggcagcgcctctctcgatcgacaacacggcctgggcgaatacggtcatcgcatcgaatgcgacaaccctcgcagtgattgtttataccggacctcaaacccggtcagccctgtctacatcaccttcgcgatcaaagaccggccttctagagtatgagatcaactcactcaccaaaatcctttgcttcctgacgctcttcctgtctatcgttcttgttgcgctggaaggcttcagcacggccaagggaaacatctggtacgtgaagatcatgagattcttagtgttattctccaccatcgtccccattagtctccgtgtcaacctggatctcggcaagtctgtctactcatggtttatccaaagagatcctgggattcccggggctgtcgtgcgaaccagcacgattccggaggatctgggacggatagagtatctactgagtgacaagacgggcactctaacccaaaacgaaatggaaatgaaaaagatccacgtcggcactgtctcgtatgccaacgaagcaatggatgaggttgcaacctacgtgaagcaggggtttaatctgagctcatcggcctcttccgcaagcttggctttggcaaccccgtcttcaacatactcggccgccaatgttggtgccacgaggacacgccgagagattgggtcgcgtgtccgtgatgtcgtactagctcttgccctctgccacaacgttaccccaacttcggaagaagacgagaacggtcacaccgtcaactcataccaagccagctcgcctgacgagattgccattgtaaaatggaccgagtccgtaggcttgcgtctggctcaccgagatcgcaagaacatcgttctcgaatccgccgaaaccggccggccagtggtcaaggttcgtattctcgacattttccccttcacttcggagggcaagcgcatgggcatcattgtccagttctacgaaaagctccagcccgggaaccccagcctcggcagcagcgagatttggttctaccaaaagggtgcggacactgtcatgagctccatcgtcgctgccaacgactggctcgatgaggagacggccaacatggcgcgcgaaggtctccgcacgctcgtggtcggcaggaagcgtctgtctctgaaggaataccaggagttctcggccaagcaccacgaagcctcgctcgccatcagcggccgcgaagccaacatgcaggctgtcgtctcgcagtatctcgagcataacctggaactgcttggtgtgacgggcgtcgaagataagctgcaaaaggacgtcaaaccttctctagaacttcttcgaaacgccggcattaaaatctggatgcttacaggcgacaaggtcgaaaccgctcgctgcgtcgccgtgagctccaagcttgtagccaggggtcagtacatccacacgattgccaagctcaggaggaaggacggcgcgcaagataatctggacctgctccgaagcaagaccgattcctgtctgctcatcgatggagagtccctcgccatgtacctgacccacttccgacgcgagttcatctccgtagccgtgcttttgccgaccgtcgtggcctgccgttgctcgcctacccagaaagccgaggtcgccaagctaatcaaggagtacaccaagaagcgcgtctgctgtatcggggacggtggaaacgatgtttccatgatccaggctgctgacgtgggcgtgggtattgtgggtaaggaaggtcgccaggctagtttggcggccgacttttccatcgagcagtttcatcacttgaccaagcttttggtgtggcacggtcgtaatagctataagcgcagcgcaaagctggcgcagtttgtcattcatcgtggcttgattattgctgtctgtcagactatgtacagtattgctctcaagtttgagccggagggtctctacaaggtacgtttgacttggcgagtgatccctttcgttgcagtcgtagttactaacctaaacaaaacacaggactggctgatggtaggctacgcaacagtctacaccgcattccccgtcctctctctcgtcctcgacaaggacgtagacgaggaccttgctaacctgtaccccgagctctacaaggaattaacctcgggtagctctctttcctaccggacgtttttcgtttgggtcttcgtctccatctatcagggctgtctgatccagggcctgtctcaagtcctcaccggcatcgatggcccccgcatgttggccgtcagttacacggtgctggtgctcaacgagctgctcatggttgcgatcgagatcacgacgtggcattgggtcatggtggtctcgattgtgggaacctttctgatgtacattgtctcgataccgtttttgggggattattttgatttgaagtttgttttgactttg

SEQ ID NO: 27034 - DNA, 2796 bp, Neurospora crassa
acggcgaggacccggctcaccaaaaaagctgccgcctcccaaccaccttctcccttcttatcacctcagccgtcagttgactctttgccgttgcctgtccctacgcgggatgccaacaatgtcttgctcttgatgaaaaacctgtgcggaaggatgcgcggagaggcccagtacctgaaagacatgggaggcctatggtatggtggtatatgttatatagatgaggagaaggggagcttagtgagcgactcgggagagggtagctcttcttcttctgtgtcgcttttgataccggatcttcgtggatgtcgtgtacttccgctcagtcggatggagagaggcggccggccgtcgctggagatcaccagtccacatctcaatctcagcatcatcttgtgcccttcagcggtagaagagtatgatctgtggctggctgccctgctgtgttggcagcagctgcggccttccggcaccaagaacaccatgacaagatcagggagcagcgttgctctaccaccgctgaggagcgagatgcagcgtcgggcctcctcttccggcctacgggaggctaccgtcatcaaggtcggcagagtgatgctctgggacaaaggcctcgccacctccccacgggccattgtcaaacgtccctctgcgcgagacttgcaaataccgcacatggcctggaaacgtgtttcttgcatactgtcagacaacggcgaactcaaactcatgacagagcacgatgtctcgcttctggccatgatcgaattgtctcagctgtccaggtcagctatacagcagctggacaagacagtgctaaacgaaaactactgtataggtatcttccccatctactcccctacatccactcaattgtcaattttgcgcccagtatatatatcattggagtctaggctgcttttcgaggcttggttcgcccttctcagagcctttgcggtgcctgatctatacgggctcgattcaacaagccgaggacgtgtatacgaggtgaccaacctcagctcagtgcccaaaggagaagttttcagagtcgaaaaaacagtcaaggttagagtcaccgaggcaaggctacggagtcgaacatttgctcaagagggaaacctgatggagcgccaaaacaaaagtgttgcagacccagaccctgccgtcggtaattacttcgccgaggtcatactggatggcgaggttcgaggccggacatcaatcaaattcaacaccaagaaccccttttggcgagaggattgcgaatttacggatcttcctccctccttaccttacctatcggtggttctaaaacggatcgtgggcaataccgaaagcttcagtcaccagcttcaggccactcttggcttgcccaaaacaggccagctgagcgaggcgttgtgcggtgctgtcgacatccctttgcatcttctggagcgtggaaaagatcatgagcagtggctccaagtgtatgacgcacgacagcagtcgattggaacaatgcttctcaaggtgcaccatgaagaggtcgtcgtgttgcaatccagagaatatcagcctctctcggagctcctacaccgctttgggtcagggctgacgacacaaatagctgacgtgatgcctggaaacctacggaagctcgcagaaatattcgtcaatatattccaggtttctggaaaggcaacagagtggctggtgaccttggtagaggaagaaattgacgcgatagggagccaaacggccagcaagcaatcgcggttcaaccagcggctgatgtcaaatgactcgatcgcttccacggacaaaatgtggcagacggttcaggacatgagcaggacgctcccgggcgaggcgagcttgctgttcaggggaaactcattgttgacacaggcctttgaaatttacatgcgacgcttaggcaaagaatatctggaggagactctggcagcaaagatacgtgaaatcaacgagctcgaccttgattgcgaagttgacccgagtaggatgcagaacggcgatgatattcaacaacattgggcgaagctaatcgagctgaccagcgctgtctggcgctgtatcgcatcgtccgcgcatcgtttgccgtcggagatccgtcacgtactgaaatatatacgggctgttgcagaggatcgctatggccactttatccgcactgctactgcagtttatacttcggtgtccggatttctcttcctccgcttcctctgcccagctatccttaacccaaaacttttcggcctcttgcgcgaccaccccaaaccgcgtgcacaacgcactctgactctcatcgccaagaccatccaggctctagccaaccttaacatctccagcaagaaggagacatggatggagccaatgaccgagtttctccaaaaacagcgccagccattcaaggattttgctgacgccgtgtgcgccattccggccgaaagtaccagcaacagcgtgcctgctccctactcgacccccctaacgattctgggccgcttatcacctctagctcgcgagggtttcccttcgctcccatacctggtcgatcatgcgcgtaactttgcggctttagccaaactgtgggctaaagtccatcccgagtcagactgggactcttccaactgcgaaggcgacctacttcatttccatcgtctatgcaccacgctccaccaacgcgcaatgcattgcttctcgcagatggagactcgccgaagcgctggtgaaactaccagcaggccaccggatgagcggcttcgtctctctgatgcactggacaacttg

SEQ ID NO: 27035 - DNA, 1422 bp, Neurospora crassa
cgcacaatggcttccgaggctttccagaagatcaaggtcaagaaccccgtcgtcgagctcgatggcgatgagatgacccgcatcatctggcaggacatcaaggagaagttcatctaccccttccttgacatcgacctcaagtactatgacttgggtctcgagtaccgtgaccagaccaacgaccaggtcactattgatgccgccgaggccatcaagaagtactccgtcggtgttaagtgtgctaccatcactcccgatgagtctcgtgtagaggagttcaagctcaagcagagtaagttttgttttccatcttggagatttccacgcagaaagcgaagcgctgcacggcgcatattgacgcattggctaacatggtttgtgcgcgttagtgtggctgtcccccaacggcaccatccgcaatgctctcggtggcactgttttccgtgagcccatcgtcattccccgcgtccctcgcctggtgcccggctggaagaagcccatcattattggccgccacgcctttggtgaccagtaccgcgccaaggacctcgtcgctcccggccccggtaagctccagatggtttacacccctgagggtggtgagccccaggtcatcgacgtcttcgactacaagaacggcggcggtgttgcccagacccagtacaacactgatgagtccatcgagggcttcgcccacgcttccttcaagctcgctcttgacaagggtcttcccctctacatgagcaccaagaacaccatcctcaagaagtacgatggccgcttcaaggatatcttccaacagatctacgatacccagtacaaggaggctttcgaggccaagaagatctggtacgagcaccgtctcatcgacgacatggtcgcccagatgatcaagagctccggtggctacatcatggccctcaagagtaagtctccgaattcccgcaacaaccggttggagaagcaaactctaactgaaaatccctctccacagactatgatggtgatgtccagtccgatatcgttgctcagggcttcggctccctcggtctcatgacctccgtcctcatcacccccgatggtaagaccttcgagtccgaggctgcccacggtaccgtcactcgccactaccgcgagcaccagaagggtaaccagacctccaccaaccccatcgcctccatctttgcctggacccgtggtcttgtccagcgtggcaagctcgacaacactcccgagctcattgctttcgctgaggctctcgagaaggcctgcattgacaccgtcgatatcgatggcatcatgaccaaggatctcgcgcttgcctgcggcaagaccggccgtgaggattgggtcaccacctccgagtacatggctgccgtcgagcgccgcctcaagagcactctcaaggagaagctctaagcc

SEQ ID NO: 27036 - DNA, 1141 bp, Neurospora crassa
gattgggcttccaagcctacgtcggcttcacctttacaagtctctgtacaggagacactacatgattcgccagaactggaccagcgggaaggttaagcccagtcacgttgcctttgcggcgcaccctcgccatgtcataacctgcctgcagttcgacgaggacaaaatcatcaccggtagtgacgacacgctgattcatgtctacgacactaaaaccggtaagctgcgcacgaaactcgagggccatgaaggcggagtctgggctcttcaatacgttgggaacaccctggtttcgggcagtaccgatcggtctgtccgtgtctgggatatccaaaagggtatttgtactcaaacattctatgggcacacgtccaccgtccgttgtctgcaaatcctcatgccgacggagaccggggaagttaagaacggcgagccggtcatgatgcccgagaagcccttgatcattaccgggtctagggatagccagctgcgcgtttggcgccttccggagccgggttctcgccggtacattatgaacgggcctgccgctaatgaagaaaactgcccctattttgtccgtatcctttccggacacgcccactctgtccggtccatttcggctcacggggatactctggtttcgggcagctacgacagcaccgtgcgtgtgtggcgcatcagcacgggccagcagctccatgttctgtccggccacaatcaaaaggtttactcggtcgtcttggaccacaagcggaatcggtgcatttctggctcgatggatagcttcgtcaagatctgggatctcgacactggtgcatgcttgtacaccttggaagggcacagcttgctagttggacttctcgacttgcgtgacgagaagttggtctcggctgcggcggacagcacgctgcgcatctgggaccctgagaacggaaaatgtaagcacactctgatggcccacaccggagcgatcacgtgtttccaacatgatggccgcaaagtcatctctggaagcgagaaaaccgtcaaaatgtgggatgttcaaacgggcgaatgcatgcaggatcttttgacagaccttagtggggtctggcaagtaaagtttgacgaaaggcggtgcgttgcggcggtgcagcgtggc

SEQ ID NO: 27037 - DNA, 823 bp, Neurospora crassa
tcatagacaaccatcttctcccccgaaggtcgtctgtaccaggtcgaatatgctcttgaagccatttcccatgccggtaccgccatcggtatcctcgccaaggatggcatcgtcctagctgctgagcgcaaggtcacctccaagctcctcgagcaagacacatcggccgagaagctctacattctcaacgagtaggcgcatccctttcttgctctgcatcatacagtcgctaaccttattgctgccctccagcaacatgatctgcgccgtcgccggcatgacagccgatgccaacatcctcatcaactacgcccgacaagccgcccaacgctatcttttgacctacaacgaggacatcccctgcgaacagctagtgcgccgtctctgcgatctcaagcaaggctacacacaacacggtggtctccgtccctttggtgtttccttcatctacgccggctgggatccccagcgccagttccagctctacctcagcaacccctcgggtaactacggcggctggaaggcgaccagtgcgggcgccaacaatgcgagcgcccagagcctgctgaagcaggattacaaggaggactgcacgctcaaggaggcatgcgccatggccgtcaaggtgttgagcaagaccatggactcgaccaagctgagcccggagaagagtgagtcttggcgatattgtggtcatggatgaaatcatactaatgtttccacgacagtcgagtttgcgacggttggccagaccaaggacggcaagatctaccacaggctatggagcgcggacgagatcacggcgctattgaaggaacacgac

SEQ ID NO: 27038 - DNA, 3112 bp, Neurospora crassa
aaccatcaagtcattcatcgcaacacgctgcctccccggagccacttctttctctacccagacagcgagaaagcattgactcgtgatgtctccttggccaaggcccagcttctctctggcgaatggaagttcaacctctccaaatcgcctttggtaggtccagttggcttccaacactttgattccttcacggatccggactggaaacccatccatgtcccgggcatgtggcaacttcagggcttcggaaaaggcccgcattataccaacattaactaccctttccccgtgaacactccacgtgttcccattgatgagaacgagtgcggacgctacgtgacatatttccagcttgcccccgaagacaaggaccaccaactgcgccttcgcttcgaaggtgtcgactcggcttttacagtctggttgaatggcaagaatgtcggctactcccaaggctcgcggaatccatccgaatttgacatcaccccatatgtgaatcttaaaggagacaatattcttgccgttgaggtctaccaacgatgtgacggcacctacatcgaggatcaggaccaatggtggctgagtggcatctttcgcgatgtctggatacacaagtttccccagaagtctcacttcaaggatgtcaagattttgccaaccctagacaacgagtacaaggatgccaagctatccgtgactgttgaacttagcagcccagaagagttcactttccggctgttgaatatcagtggtggcgaagtcattcagggcacaatctctggagaacagtccaccgttatggagttcaacatcaaagaccccctaaagtggacggccgagacgccgaacctgtacacgttagtattgagcatgtcagattgtgctctgaccgagagagtaggtttccgccgcgttgaacttctcgatggcgtattctctgtcaacggaaatcccatcaagctgagaggcgtcaaccgccatgaacaccatcccgatttcggacgcgccgtcccatacgagtggctcaagagagatttgttgctcatgaaacagcacaacattaacgccattcggacttcccactacatcaacgaccctcggctatacgagttagcggacgagctcggcttgtggatcctggatgaagctgacctggaatgccatggaatctttgttgtcggtggtgatggtaacaagattctctctgacaaccccgagtggaaggaggcgtatcttgaccgcgcacgccagatggtcatgcgtgattacaaccgcccttccatcattatctggtcgcttggaaatgaatccggctacggcagtaaccacagagccatgtacgagtacatcaagagcgtcgacaccagtcgtcctatccactatgaaggtgactggaacgctcattcggccgatatcttcagcagaatgtacacatcggttgacgacatggagcgctacgccagggagccgtcgtgggacaaacctttcgtcatgtgcgaatttgcccatgccatgggcaacggaccaggtgctctgaaggagtatattgagcttttctacaaatggcctagactcatgggaggctttgtctgggagtgggcgaatcacgtatgtatctcgggggtttcagctcttccattctttgcatgtgactaacaaatgatcagggtctgacaaccaaaaacaaagaaggagaagagtacatggcctacggcggcgactttggagacgagcccaacgacggtaacttcgttttggacggcctttgcttctctaatcacactcccacccctggtctgttagagtacaagaaggccatcgagcctgtccagacactcaaccttgagaatggcaatcaggtgcgagtcgtcaacagatacgactttgtaactcttgaccacctcaagtgtctctattactactcagacgatgagcccgaatggattgagaaacgggaggttaagatccctaaaggtaggtagtgtcataaatcatcaccaacttccaagccgaaccactaacacaaagcacaggagtcaaaccacacgaacaagccctcatcaccatctccgacctactcgacgccgaagcgctccaagccgccggccgccacgactgctacctaacactcgaattctccctcgccgaagccaccaactgggcaggaaccaaccacatcctcgccacaggccagttccctctcacacccccgcacaaccccttcgccaacttccccgccgccaccaacgcccacttcaacctcctctcacccactctcctctccatcactgttcccggctccaactccaccacctacgaattcgacctctccatcggcgccctcacaagctggaaacgccccccctcttccgccaacatcctcaccacccccctcgccctctgcctctaccgcgcccaaaccgacaacgaccacggctgcgactttggtcgcaactggacctcttcgcgactaaacatggctaaacaccacgtcctctccacatcatgggcccccaccgcctctcctccgaccataaccatcaaaggccgcttcgcgccccctgtactgaactgggcactcgaaaccacaaccgtctactcctttctcgaaggcggcaaggtcaacgtcaaaatgcacggaaaacccgtaggtaactggctgccgcgtgcatgggcgcgcttggggttagaggttggattgaaggacgtacattctgcgtcgtggcagggtcgcgggccgggggagtcgtaccgcgacaagaaggagtcgcagcttgttgggtcttggacaagtaccattgatgaactatggaccgagtacgagttcccgcaggaggggggaaataggacggatgtgaggtcggtggagtttaggacggaggggtgggacatggtgctgggagcgaggtttgtcgagcccaatggagagaatacgagttttcaggcgagtaggtatacggtgatggatgtggaggcggcgagacacccgtttgagttgcataggaagaggagggaggatacgattgtgcatttggattggatgcatcatggtttgggcacggggagctgtgggccggagacgaggccggagtatacgctgtgggcgggtagg

SEQ ID NO: 27039 - DNA, 1061 bp, Neurospora crassa
ctcctcccgcttctctccctcctctccctctcctcctccgccctcgccgccacccgcatctcccctccttccaccgcctgtctccgcgtcggcgccggccaaccgtactcgaacatccaatccgccgtcaacgccctctccaccacggcttccgggtctcagtgcatcttcatttaccccggcacctactgggaacaggtcctgatcccggctcgctccgcccagctctccatctacggatacactgccaacagccaaggctatgcttccaacaccgtcaccatcatcgccaacaagtcccaggccgatggcctaagcaacgaccagacggctactgtgcgcgtcaagagcagcaacactcgcttgtataacctcaacattgagaatgcccacggccagggcagccaagccgtggcgctgagcgtggccgccaacggcgtgggcgtgtacggatgccagttgaagggattccaggatacgctgctggcggaggacggagcgcagctgtatgcccggacgttgattcagggagccacggacttcatctttggacagcgcgcaccggcgtggtttgagaagtgcgatatcaaggtcatggctgctaatcttgggtatatcaccggtatgttttcattccccccctttcactggtcttccactttcaatttggttcagtaactgactgttattcagccttgggtcgtgattcatccagcaacccagccaactacgtcttcaacagctgctccatcgccgccgctgccggtaacaatgtgccttcgggagcctactacctcggtcgtccttggcgccaattcgctcgcgtcaccttccagaagaccagcatgaccaacgtgatcaaccctgctggttggtcgatctggcagaacggcgatgcgaggaccagcaacgttgagtttggcgagtacgctaataccggtgcgggtgcgagcggagtcagggcgtggtttggtaagctgttgggttcccccgtcaagattgagtcggtgctggggagtcgttactctcgtcagggctactatgatgctagctatatgtaa

SEQ ID NO: 27040 - DNA, 1353 bp, Neurospora crassa
acgacgacgacgacaacagtctcagccgccgacctcgaattcggccagcccgtctacgaaacgcacccccacatcctgcaaccgggtgaactaacccccggcatcacggcccaagaatatcacgagcgacgttccaagctcgccttcgcacttcccgaaaacggcatcgccattctcgcctcctcggaactcaaataccgctccggcgccgtcttcttccccttccgacaggactccaactttctgtatctcaccggattctccgagcccgactcgctggccatcatccaaaagacgggtcccaaaccaggcgactacgtcttccacctcttctgccggcccaaagacccgcgcgccgagcaatggtccggcccctggtccgggctgcaagcagccgaggatgtcttcaacgccgattttacgggggacatcgccaaggttgagaccttgctgccacccatcctgcgcggcgccggcaaggtctacacagacatcacgccctccacccccgtcaccggccaactcgtcaccaccctcctctcgcacctgcacctccccccggctcccctagccgggctcgtccactctctgcgggccatcaaatcccccgccgagatctccaacatgcgccacgccggccgcgtctccgggcgcgccctcacctccgccatgcgccgctcttggtcgtccgaaaaggacttggaagcctacctcaactacgccttcacctcgcacggcctctcgggccccgcctacgtgcccgtcatcgccggcggcagtcggggcaacatgatccactacgtgcacaacaaccgcctgctcaaccaagacgacatggtcctcgtcgacgccggcggcgagtacggcacctacatcaccgacatcacgcgcacctggcccgtcaacggcaagttctcggccccgcagcgggacctgtacgaagccgtcctgaccgtccagcgcaaaatggtttctctctgtcgggagaacgccaccttgtcgctggaccagatccaccgcgccactgaagccggtctgcgcgagcaacttactttactcggcttcgatctttcatcagggggaggaggcaggatggatgtgctgttccctcaccatgtgggccattatgtggggttggatgtgcatgatacacccggttactcgaggagtttgacgctgaggcaggggcatgcggtgacgattgagccgggcgtctatgtgccgcaagacgatgaccggtttcccgagcatttccggggactggcggttcggattgaggatagtgtggtggtggacgtggagagccccttgatcttgacgacggaggcggttaaggaggtggtggacattgag

SEQ ID NO: 27041 - DNA, 840 bp, Neurospora crassa
ctgcttccagcctgccccaatgacaaggccgtcggcaaggaaatcatcaacatcgacttcaccaagggcgccgacagcttcttcaagaacatggtcggcactactctccagtacgacaacaagctcggcgccgtctacaccatcaagaaggagacggatgctcctaccgttgccagctctcgctacatcttcttcggtcaggtcgacgttaccgtgagggccgccttcggcaagggtgtcgtcaccagcttcgttcttcagtccgacgacctcgacgagattgattgggagtggatcggcagcgacaccactcaggttcagaccaactacttcagcaagggttgcaccgagacctacgaccgcggtggcttttctaccgtcgccaacccccagaacgagttccacacctacaccatcaagtggacccccacccagctcgactggatcatcgacggcgccgtcgtccgcaccctcaaggccgccgatgccaagggctgcgccggcttcccccagactcccatgcagatcaagctcggcacctgggttgccggtcgcaaggacgccgcccagggtaccattgagtgggccggcggtatcaccgacttcaacgagggtcccttcatgggctactaccagagcatcaagattcaggacttcatgggtggtgacggtaccaccggcgccaaggacgccaccgagtaccagtatggcgacaagagcggcacctggcagagcatcaaggtcctcaccggtacctctactaccgaggacgttggcaccaagtctggctcttctactgccaccactctgagcgccgtcccttccgcctcctccacctcc

SEQ ID NO: 27042 - DNA, 1686 bp, Neurospora crassa
ggagcctcgccatccttgtcacggctgctcaccctatcgacactcgccgctctcgctcccttgagtgaagcacaattcccgccatatcaagctgtcggcttgaagacagtcacctcaccttccaacccgaacatcaagatctcgtacaaagaacccaaggatgtctgtacgactgctttcagacggcagaagcagtacaccggctgggttaccgtccccggcgagtacccaacacacctcttcttctggtttgttggtgcccgcgagccaacctctgcgctgacaatgatgctcaacggcgggcccggctcgagttccatgtttggcctgttcgccgagaatggcccttgccaggtcgtcgagaagggcgccagccgcctggagacggccgccagagaatggggctgggatagagcctccaatatgctctttgtcgaccagcccaaccatgtcggtttctcatacgatactcccaccaacggttctctggacttgacgactgggatggtgtcgcctaccatgcaattgcctgataacctgcctcccagcctcttcctcaacggcacgttttcctcaaacaacatccaaaacacggccaacacgactcagaatgctgccatggccgtctaccacctgctccaggggttcctgagtactttccccgagtacgtcccggacaagcacagcccgttgggcgtaaacctctttacggaaagttatggcggccactacgggcctgtctttgccgacacctggcagaaggagaatgacaagctttcaaagcgcgcaatgcctctttccagacgacaggatgatgccaacaatatccaatcccgtccccccaaggctggcagtagtaaccgcgaaataaaactcacttcgcttggcatcatgaacggctgcatcgacgacctcgtccaaggctcccgctacgtcgagatggccatcaacaacacgtacggcatcaagctgatcgaccaagccacggccgacgccatcacctcgggcttcaacgcccctgacacgggctgcaaagacctgatcctcgcttgccgccaagcccaagccgctctcgacccgctggaccagggtaccgacgaaaccgtcaaccaggtctgcgcctacgcctcgctcacctgccagcagctcctcggctccgtgctcgccagtggcgctaatgcctacgacattgcgcacatgggtcccgatgcgtttcccgattaccactacctcgagtatctcaactcgcgccgcgtgcaagaggcgatcgggtccgtggtcaactacacggatatttcgcccgtagtctaccaagcctttttccaaaccggggatagggctcgcggcgggttgatcgccaagctagcttcgcttctgcagcgcggcgtgcgcatcggtctggtgtatggcgaccgcgattacatctgcaactggatgggcggcgaagccgtgtctctggctcttgccgacgccatggaggatttggatcccaagagcccgtatccgaccaagtttccgcaggctgggtacgagaatatccagaccaataacagggaggttggcggagtggtgaggcagtttggcaacctcagcttcagcaggatctatcagtcagggcacttcgtgcctgcttaccagcctgagacggcgtttcgggtgtttgagcgcattatcggcggtagatcg

SEQ ID NO: 27043 - DNA, 1543 bp, Neurospora crassa
gacctcatcacggccacctcccagctccaggaccaaactgttgagcactgtctacccttcctggccggcgaggatggacctctcgatctcaacgactatggcctccccaagctgaacagggagaagcatatcaagtttctcaagcagtcccttggcccgttaccaggtcgcttcgttgcagtggacgctagcaggccatggtacctctactggtgtctgtccggtctcaccatgatgggggaagatgtgtctagttacagggatagcgttatcgagaccgctcgcaccatgcagaatgagtctggaggattcggtggaggccatggacagacttcgcacctggctacgacgtatgcggtcatcctagctatcgccctggttggaggtgaggaagcatatgatgttatcgataagaaggctatgtggaaatggctgtgctctttgaagcagcctgatggtggctttcaggtatgcgtgggaggtgaggaggatatcaggtgcgttggtcccaggccacacttctcttaatcgaacatgttgactgacaccacacggataaccggaaaggggggcatatatcgcggctgtgatcattactctgctcgatctgcctctggacttgacgccagaatctcctgcatatgacggtcgctcaaacctgttgactggcttagcggaatatgtgcgtagttgtaagtgttaccctagttttacatccttgtatcgaaacagaagaggctatgaagaggcagtcagactaacatgagcccaggccaaaccttcgagggcgggatatctagtcaacccaacaacgaggcccatggcgcgtatgccttttgcgctctcgcctgtctcgccatcctggacaaccctcgccgtatcattccaaggtaagcaggcttgatcacggtccggagaaaacatgaagcaaacaagccagatctctcaccacctgtctcataaaatatccattccaacaacgataacaagcacactgcatttcatatgcgcatgaccccctctaagtaccttctcgtcagacatacagacagctaacaagttctctttcccacccaccagctacctagacgtcccacgcctcgtctcctggttgtcttaccggcagtacgcacccgaaggcgggttttcgggacgcaccaacaagctggttgacggctgttacagccactgggcgggtggatgtttcccccttattgaggcatgtctcagtccctccggccctggtgccgagaagaacaagacagccaccggtcttgcggctgcgccggagagtctctatagtcgagaaggtttgattcggtatatcctttgctgttgccaggaccagactaagaggggtggactgagggataagccatataagtgagtttttctccccccttttgttatgctttgctttgctttgcttcggattgaggtttcattgtattctgcgatcttacctcgctttacttttcattatttcaccttactttttacctcacctgttttactttacatcatctcatcttcttacctcacc

SEQ ID NO: 27044 - DNA, 1672 bp, Neurospora crassa
ttcgtcggctccgtcgaccaaggcaccacctcttcccgcttccttatcttcaacggcgagggcgaccctgttgccagccaccagattgagtttgagaacctctaccccaagtcaggatggcatgagcacgaccccatgactctgctcaactcggtcgaagagtgcattgaaggtgccatgcgtaagtttcaacgactaggcttctccaagaacgacatccgctccatcggcatcaccaaccagcgcgaaaccacgctcgtgtgggaccatgaaaccggcgagcctctctataatgccgtcgtctggtccgatacccgcaccaagtcccttgtccgcgacctcaaggacaaggacggcgccgatgccatcaaggacctttgcggtcttcccctctccacttatcccagcagcgtcaagcttctttggctcattgagaatgttgaggccgtcaagcaggcctacgaagaaggccgtcttgccttcggcactgtcgacacttggctcatctacaagctcaatggcggtgcccaggctgagagtcctgtccacgtaacagacagcaccaacgccagcagaaccatgttcatgaacattcgcactctgcagtatgacgacaagatgctaggattcttcggaattgaccgaaccaaggtgcatttgcccaagatcgtcccttcgtcggaccctgaatgtttcggtcgcattgccagtggtgcgctgtcgggtgtgccgatcgctggttgcttgggcgatcaatccagcgccctggttggccagtgcggcttcaaccccggccaagcaaagaacacctacggcactggctgcttcctgctctacaacgtcggcaccgagcccgtcatctcgcagtacggtcttctgtccactgtcgcctacgactttggccagggccgcgcgcccgtctacgccctcgaaggcagcattgctgtcgccggcgccggcgtcaccttcctccagaacaacctcaacttcattgagaacgctaagcaaatcaacgaccttgccgagtcggtgcccgacaacggaggtgttgtgtttgtcaccgccttcagcggcctgttcgccccttactggatcgatgatgcaaagggaactttgtgtaagtgatctccattacccactctttccacacgacttcttccgacccaccttggagcatcatccaaccgttacattcatcctaccccgttccacatgaaagatcggaagctaacctgtcatgtgcccaatagtcggaattactcaacacacccaaaagggacacattgctcgtgccactctcgaggctacttgcttccagaccaaggctatccttgatgccatggagaaagactcgggctgcaagctcaagctcctcgctgtcgatggtggtctctccaactccgacctgaccatgcagacccaggctgacatcagcggtattcccgttgatcgcccggccatgtgcgaaaccaccgctcttggcgctgccattgcggccggcctcgctaccggtgtctggagcgataccaccgagctccaggaagttaaccggaccggccggaaggtctttgagcctaagatttctcgcaagtgtgccgagaagaggttcaagaagtggaaccaggctgttcagatgagccgcggctggctgcaagacaatgacaacgaagac

SEQ ID NO: 27045 - DNA, 1098 bp, Neurospora crassa
taccgccagctgggcaagagcggtctccgtgtttccgtgcccatctttggttgcatgagcttcggtgatcgacggacgctggactgggccatcgaggaagatgaggctctcccgttactcaaggccgcctatgaccgtggcctgaacacatgggatacggctaatgtttactccaacggcacatccgagatcattgtcggaaaggccctcaagaaatacgcaattccgcgcgagaaggtagtcatcctaaccaagtgttggggtgctgtcggagagactcccgatctccgctcctttttttttccttcccagattgccgcctccaaggactacgtgaaccagcatggcctgtcgcgggccgccatcttgaacgccgtcgaggcctctcttcggcgcctggatacgccctacatcgatctgctacagattcatcgctttgatcccaacactcccatcgaagagaccatgaaggccttgcacgacttggtgcagtccggcagggtgcgctatatcggtgcaagcagcatgtgggctactcaatttgcccagatgcagttctgcgccgagaagaacgggtggaccaagtttatcagcatgcaaaatcagtacaacttgctctatcgtgaggaagagcgtgagatgatccgcttctgcaacgacactggtgttggcttgatcccgtgggctcctttgtgccgtggccacttggcccgcagacccgatcagtttggcaggaccaagaggagtcaaggagagaaggaggcccagcctgggtcgcatggcactgttgagcccgatctaaccattatcaaccgcgtggttgagattgcggataagcatgaatggccggtaagtttcatagccaagagaaacccatcgatatccgtaggtatcttttgaagaggcttaccttgctaaccgtatctgtagatctcccacgtagccttggcttggattgctaagcgcgtcatcagtccaatcattggttttagcagcgttgagcgtttggaagaagcaatcaccgctagaggcaaggttttaacggtggaggaggagaagtatttggaggagatgtataagcccaaggctatccacgga

SEQ ID NO: 27046 - DNA, 2228 bp, Neurospora crassa
tcctatcacaacgccgtcattgtccggaatgcttccttcatccgccttctccccaagctggccctcaagtttgcgcgcatccctgccttgttcggcaccatgatgattggaggcgtcgcatggattcagtatcaggccatccgtaagcgacctacggcccgagtctgctggtagttgggtaccccgctaacaaagacacagaggtgagcaattcggcccaagaagtcttcggcaacgtcagagataccgtcaccacaaccgcctccggcctatggggcagcgccgtcgatattgccgaacagaccaagcgaggttgggataatacgaaggaagaattcgagctgcctgaatggttagggaacctcttcaaatcagagggcggacctgaagggggtaacaacaatggttccggacctggaagacccgaacccccaaagaaagcaaggatgggcgccgccgttggcgcttcagcagctgcttatggttacgatgatgcagccgaagaggatgaccggacccccgaggaaatctccaaggacgatcagatgatgtatatgaccaagatgatgatcgagattcggaacctactccagaaagttggccagtcgagcacggtctctctgccctcgatcgttgttatcggatctcagtcgtcgggaaagagctcggttctcgaagccattgttggtcatgagttcttgcccaaaggcaacaacatgatcactcgccgaccgatcgagttaacgctggtgaacgaccccaaggttagcgccgattacggtgaattcccggaccttggtcttcataggatcaccgacttctctctgatacaaaagaaccttaccgagctcaaccagtccgttcccgaacgcgagtgtgtctccgacgacccgatccgtcttaccatccactcaccccgagttccggacctgtctttgatcgatctgcccggttacatccaggttgctggagagaaccaaccccgggagctcaagcgcaagatctcggagctttgcgataagtatatccgaggtcccaatatcattctcgccatttctgccgccgatgttgatctggccaactcgactgccttgcaggcaagccgtagggttgaccccaggggagaacggacgattggtgtcatcaccaagatggatttggttgatccggagaagggtgcagcaattttgagcgacaagcaatatcctctacgtctgggttatgttggtgtgatttccagggctcctcagcaaacagggctgttcaagcgggataccggtgctctcctgagacagatcagcaaaaatgagaaatcctacttcagcactcatcctgaatttggcccagactctggtgtcaacatcggcaccgtaacactacgcaagaagctcatgcatgtcttggaacagcaaatgtcatcgaagctgcaggatacaacagctgccattcagcgcgagctcgaagaaacgtcctaccagttcaaggtccagtataatgaggagcccatgactgcggaagcataccttgccgctagcttggacgacttcaagcacgcctttaagaggtttgcttccagctttggccgtccccaaatgcagcaattactaaaagaggctctcgaccagcgggtcctcgatcaattggccgccaagtactggaacaagcctatcgaggatctctcccctgctccgtttgagccggagaacatcgccgatcttccaaaggctgaccccgactcacagttctggcatatgcagctcgataccgcaacctcggcactgacccggctgggtgtcggtcgcttggctgctaccgtggtcgccaacgctatccaggccaacgtggacaagctcgtcaacaagtcgaccttcgccaagcacccctctgcgcgccaggtcatcaatgaagctgccgccaccgtcctcgccgatcgttcatacaccaccagcgatggtatcgagttttctctcaagccttacaagtatgaagtcgacatccagccacaggagtggtcgcaagggcgggatcacgttgccggtgtcctcaagatggaactggaccagtgccagagggccatgggcaacctggaaaattccgttggaggcaagaggaaactgaaggaggtcatgaactttgtcgacaaggctcgcaagggtgagattgtcgtcgagggagagaccaggaacggtgccggtggattcagtgctgctttgctccagaaaggtatg

SEQ ID NO: 27047 - DNA, 1959 bp, Neurospora crassa
atggctgaccgatacattcccgagcatcgtcgcacccagttcaaggccaagagtgctttcaagcccgatgagcttcgtcgccgtcgtgaggaacagcaggtcgaaattcgcaaggcgaagcgcgaggagaacttggccaagaggcgcggtattggtgctggcgactcgcggcctggagcttcccttggtgccgcccccgacagtgacgatgagaaccctcccaccgagtctcaggtatgcaaacctctatcttactccccttacatgatcggccacaattttgctactgcgtccgtccatcgcctctcccttctctcccccacgtgtaccccgccgatgatggtgatgcttgagccacaaacccccaggcagtgccgaacctgcattcaagctgcgcgcgcaaactcgaacattgtacaaacgaaaaccaccccacattccgtcacgtccccgatctttgttatagttgatctccacatgctaacccagttgtcatagttgagcgaggaccttcccaagatggtcgagggtgtcttctccagtgagatcgataagcaaattcaggcgaccactaagttcagaaagctgctcagcaaggagcgcaaccctcccattgaggaggttatcaagaccggcgtcgttggtcgcttcgtcgagttcctccgctccccccacaccctggtccagttcgaggccgcttgggcccttaccaacattgcttcgggctctgccactcaaacccaggttgtcatcgaagctggtgctgttcccatcttcgtcgagcttctcggaagccccgagcctgatgtgcgtgaacaggctgtttgggctctcggcaatattgctggcgatagccctcaatgccgtgattacgttctaagctgcggtgctctgcgtcctttgttgaccctccttggtgatagccgcaaacttagcatgctcaggaatgctacctggactcttagtaacttctgccgtggcaagactcctcagcccgactggaacacggttagttctctcgatcacgaacaatctagtatgtctactgatccatcatagatcgcccctgctttgccagttctcgccaagctcgtctactcgctcgacgacgaggttcttattgacgcttgctgggccatctcctacctctcggatggatccaacgacaaaatccaggcggttattgaggctggcattcccaggcgtcttgttgagctcctcatgcatgcttccacctctgtccagacgcccgcgcttcgatccgttggcaacattgtgacgggagacgatgttcagacccaggttatcattaactgcggtgcccttccctgcctcctgtcgcttctgagctccaacaaggatggcatccgcaaggaggcttgctggaccatcagcaacattactgctggaaactcggctcagatccaatctgtcattgacgccaacatcatccctcctttgatccaccttctctcccatgccgacctcaagactcgtaaggaggcctgctgggctatcagcaacgcgacttcgggtggtctccagaagcccgatcagatcagatacttggttgctcaaggctgcatcaagccgctctgcgaccttctggcttgccctgacaacaagattatccaggttgccctggatggtcttgagaatattctcaaggttggcgagctcgacaagaacgccgctggcgatggccctgactcgatcaaccgttatgccctatttatcgaggaatgcggaggaatggagaagattcacgactgccagacgaacgccaacgaggagatctacatgaaggcgtacaacatcattgaaaagtacttctccgacgaggacgaggccggtgatgaggccatgggcgctcagcagcagtttggattcggtgcttccggtggtgcccagcagggtggcttcaacttcggtgctaacggcaccgagtcgatggacatg

SEQ ID NO: 27048 - DNA, 1341 bp, Neurospora crassa
tcgcccaccatggctgacggcggaatcgatcgcaaggccgatgaaaagattcagttctccacctccaaggaggtaacggttcatccgactttcgagtcgatgtccttgaagggtaagtcttgtcgcatcgcatgtatttcatggttgctgtggcttagtgaattggattgaaactaactggttctcaaaacagagagtctccttcgcggcatctacgcctacggatatgagtccccctctgctgtccagtcccgcgccatcgttcagatctgcaagggtcgcgataccatcgcccaggcccagtccggtaccggtaaaacagccactttctcgatctctatgcttcaggtcatcgacaccgccgtgcgcgagacccaggccctcgtcctttccccgacccgcgaacttgcgacccagattcagagcgttgtgatggctttgggagattacatgaacgtccaatgccatgcttgcattggtggcaccaacgttggcgaggatattcgcaagctcgactatggtcaacacattgtctctggcactcctggtcgtgttgccgacatgattcgccgccgtcatctccgcaccagacacatcaagatgctggttctcgatgaagccgatgagctcctcaaccagggtttccgcgagcagatctacgatgtgtaccgctatcttccgcctgccacacaagtcgtcgtcgtctctgccaccctcccttatgatgtgctcgacatgaccaccaagttcatgaccgaccctgttcgtatcttggtcaagcgtgacgagttgaccctcgagggtttgaagcagtattttattgctgtggagaaggaggactggaagttcgacactctttgcgatctctacgacactctgactattacacaagccgttattttctgcaacacccgccggaaggtcgactggttgaccgataagatgcgcgaagccaacttcactgtcagcagcatgcacggcgatatgccccaaaaggagagagacagcattatgcaggatttcagacagggcaatagcagagtgctgatctcgaccgatgtgtgggcccgcggtatcgatgttcagcaggtcagcttggttatcaactatgatcttcccagcaaccgtgaaaactacattcatcgcatcggtcgttcaggtagattcggtcgcaagggtgtcgccatcaacttcgttactagcgaggatgtccgcatcttgcgtgatatcgagtgtaagttttgggcaatctaacctcggcgccttcgtttgctaacgggagatacagtgtactactcgacccagattgatgagatgcccatgaatgttgccgaccttatc

SEQ ID NO: 27049 - DNA, 762 bp, Neurospora crassa
atgatgtccggccccgagaccacacgcgcggtccgctgggccctcggtgccggctaccgcggcttcgacagcgcccaatggtactacaacgaacgcgaagccggccaagccatcctctccttcctgtcctcccccgaaaacaccgcgggcctcacccgcaaagacgttcatttcaccagcaagctgcgcgacaacagcaccaattacgacgctgttcgcgcttcgatctccaagtcagtgaaggcttctggacttggctacattgacctgttcctcctgcacagcccgcttggcggccgcgaagcccggttgaccagctggaaagcggtcgaagatgcggtactcgcgggcgaggtcaagatggcgggcgtctcgaactacggcgtcaagcatctcgacgaggtcatgtcagcaccttttaaaatcaagcctctcgtgaaccagattgaatgccatccattcaacacgcagccggagatcagggccgcgtgcgagaagtatggtattgtcatcgaggcgtacgcgccgctagcgagagggatgcgcatgaagcatcccgtcttgacagcggtggcaaagaagtacggggtcacgcccgcgcaggtgttggttaggtggtcggtgcagcatgggttcgtgacgctgccgaaaagtaccaagaaggagaggttggtagagaatgcggatgtgggtaggtttgagttggccgaggaggatatggagaaactggatgggttggatgagaagttggttactgattgg

SEQ ID NO: 27050 - DNA, 1503 bp, Neurospora crassa
atgcaggctatcgcaaggcaaacacggcccgcgggcaagctcgtccagcagctgtccaagagagcctacagctccaactcgtccccctatgcggcgaccatcaacaacctgaaaatcaacggcgacaccaaggttctcttccagggattcacgggcaagcagggaacgtgagttagagctacctcccctgcccgaaattccccgttccccgttttccccattgcgccctgcttgtcgtgactcgcgacgccgatgacacgactcgggcgcatctggggaatgctccacctccaccaactgcccatgatcacaagctttccaagaccaggacaccattggatgtgattaatgctgcgaatttgacttggctgacgatggctcattgtacagtttccacgcccagcaggccatcgaatatggtaaaccaccaccctcaaccacccaccactgccaccattcccctcgcttatctcccgcttatcggtaccgatcttgggtcgcaaactgtcgcaaacatggaattctgacgcatttcgccctctgttctaggcaccaatgttgttggcggcaccaaccccaagaaggctggccaaacacatcttgatcgccccgtcttctccaatgtgagcgaggctgtcaaggagaccggtgctactgccaccgccattttcgtcccgtaagcactctccgagataccagcctttgggggccttactaatagcaacatcgaaaatagcccccctctcgccgctgccggtatcgaggaggccctccaggccgagatccccctcgccgtgtgcattaccgaaggcattccccagcatggtcagtacaatggctcacaaggacggcgcgcaagcggatgaaagcgaattttggaaaccagtgatctaaccgggcgttgcagacatggttcgcatcacctctatgctcaagactcagtccaagacccgtctcgtcggtcccaactgccctggcatcatcgcccccggtcagtgcaagattggcatcatgcccggtttcatccacaagcgcggccgtatcggtatcgtcagcagatctggcaccctcacttacgaggccgtcaaccagaccacccaggccggcctcggtcagtctcttgtcgtcggtatcggcggtgaccccttcagcggtaccaacttcatcgactgtctcaaggtcttcctcgaggacggcgataccgacggtatcatcatgatcggtgagattggtggttccgccgaggaggaggctgccgacttcctcaaggagtacaacaccaagaacggtggcaagcccgtcgtctccttcatcgccggtatctccgctccccccggccgtcgcatgggtcacgccggtgccatcgtcgctggcggcaagggtggtgccgactccaagatcaaggccctcgaggccgccggtgttgttgtcgagcgctcgcccgccagcctcggcaaggctctccgtgatgagttcgtcagacgcgatttgctttaagaaaag

SEQ ID NO: 27051 - DNA, 942 bp, Neurospora crassa
atggcgactactcgtgagcgccgcgttgcgaaggaattgcaggatatatggaatgaccgcgagacctcgggcgtcatggccgaacctctcgactcgagcaatctgtcgcacctcaagggctccttcagcggccctccagactcgccctatgctgggggtacatacgaggtcgacattcagattccggataagtacccgttcaagccgccctcgatgtatcttattaccaagatctggcaccccaacgtcagcagtgtcactgtacgtttctctcgtttttgtccccttgttttatgatggatgttaggaagtaggtggagtttggagagctcaactaaccctccgacgtctttacagggcgccatctgcctcgacattctgggaacagcatggtccccggtcggcacgattaagacagcgctgcttgccgtacgaatgcttcttgaatcgccaaacccgaaggatccccaggacgcccaggtggccaagatgttgatggaaaaccccaagctgttcgcccgaacggcacacgactgggccgtcaagtatgccggcgcgcccagggtggacaagattcctctcaagtatgatgagaccgcaaaggaaggttcaaggaacgatgctagcaggtacgtggcatttctgaccatcccgatgcagtgaaccaccttgtgttaagcaaaagccatatggacaatgcattactggaaacccggaataaaagtcagaggcgactaaccttgagagcctgcttggcgaacccaacacagatatgctggatataacaaggacctggtggatcgttttgtcaacatgggattcgacgtagaaaaggtggtcgatgcttttaaatttgtgggtattgaccggaacggaggcgccgattacgaactcgaggaagcatacatgggcgatatcactgcgcggctcctcggcgagcag

SEQ ID NO: 27052 - DNA, 1404 bp, Neurospora crassa
ggacatcgctaaccaccatcgccaccaaaacagaaagataagcccaagtacgagccgccgccgaagcctaccacccgcatcggtcgcaagaagaagagacaaggcggtgccagcgctgccgccaagctcccctcagtgtatccgacaagccgatgcaaactccgactcctacgaatgcaacgaatccacgatcatctactgctcgaggaagaatatgtcgaaaatcaagaacgtctacgcaaggcgaagaccgccaaggacagcaatgctcctgcgtccgagctcgagtcttccgaccgtatggctgacgagcgctcccgtgtcgatgatatgcgtggcagccccatgggtgtcggtgttctcgaggagttgatcgacgacgaccacgccatcgtttccagcacatcggggcccgagtactacgttagcatcatgagctttgtcgacaaagaccttctggagcccggcgccagcgtcctgctacatcacaagagtgtcagcattgttggcgtgctcaccgacgacacggatccggccgtcagcgtcatgaagcttgacaaggcgcccacggagtcgtacgcggatattggtggcttggaacagcagatccaggaagttcgtgaatcagttgagcttccattgctgcatccggagctctacgaagaaatgggtatcaagccacccaagggtgtcattctttacggtgctcccggtaccggtaagaccctccttgccaaggctgtggcaaaccaaacttcggcaacgttcttgcgcatcgttggtagcgagcttatccaaaagtatcttggtgatggtcctcgactggtccgccagcttttccaggtatgtaaaagtgtttcaagctacactgtcaaatatatactctaacatgttcctcaggttgccgccgagaatgccccttccatcgtgttcatcgacgaaatcgatgccatcggtaccaagcgttacgactcgacatcgggcggcgaacgtgaaatccagagaaccatgttggagctgctgaaccagctggatggtttcgacgaccgtggagacgtcaaggtcatcatggccaccaacaagatcgagtcgcttgaccctgctttaatccgtcctggccgtatcgaccgcaagattctcttcgagaatcccgaccagaacaccaagcgcaagatcttcacgctccacaccagcaagatgtcacttaacgaggatgttgacctggaagagttcatcgcccagaaggacgatctctcaggtgccgacatcaaggccatctgctctgaggccggtctcatggccctccgtgagcgcagaatgcgggtgcagatggcagacttcagagctgctcgtgaaagagttctgcgcaccaagcaggaaggcgagcccgagggcttgtacttg

SEQ ID NO: 27053 - DNA, 1812 bp, Neurospora crassa
cccgtcgttgtcgccgaggatatgattggtgttgctatgtatgagttggtatggttctacaattgtccttggccactagtggggtgcctgagctgagactggaattaggttaaagtcggtcacgatcaactagttggtgaagtcattcgtatcaatggcgaccaagcaaccattcaagtatacgaagagacgggtaaggctgacaatctcaagtcactccatccttgcactagatggctaaccaatccctcgatagctggtgtcatggttggcgatcccgtactacggacaggcaagcctctctctgtcgaacttggccctggtctcctgaacaacatctacgatggtatccagcgccccctcgagaagattgccgaggcttccaacagcatttacattccccgcggtattgccacccctgcgctggaccgcaagaagaaatgggagttcacaccgaccatgaaggttggcgatcacatcgcgggtggtgacgtctggggtactgtttacgagaactcgtttatctctgtccacaagattctcctccctccccgggcccgtggtaccatcactaggatcgccgagaagggcgagtacaccgttgaggagaagatcctcgaggtcgagttcgatggcaagaagaccgaatatcccatgatgcagacctggcctgtccgtgtaccgcgccctgcggccgagaagcattctgccaaccagcctttccttgtcggccagcgtgtgctcgacgctctcttcccctcggttcagggcggtactgttgctattcccggtgctttcggctgcggcaagactgtcatttctcagtccgtctccaagttctccaacagtgacgttatcgtatacgtcggttgtggtgagcgcggtaacgagatggctgaagtcttgaaggatttccccgagctgtctatcgaggtcgacggccgcaaggagcccatcatgaagcgcacgaccctcatcgccaacacctctaacatgcccgtcgccgctcgtgaggcctccatctacacgggtatcacagttgccgagtacttcagagatcagggcatgaacgttgccatgatggctgactcttcgtctcgttgggctgaggcgctcagagaaatttcgggtcgtctaggagaaatgccggctgatcagggtttccccgcttaccttggtgccaagctcgcctccttctacgaacgcgccggcaaggtccaagctcttggtagcccgccgcgcgagggtagtgttagcatcgttggtgctgtctctccccccggtggtgatttctctgatcccgtcacttctgccaccctcggtatcgtgcaggtcttctggggtctcgacaagaagcttgcacagcgcaagcacttcccgtccatcaacacctccgtcagttacagcaagtacctcaccattctcgacaagtggtatgagagggagtaccccgacttcccccgcctccgcgaccgcatccgccagctcctttccgacagcgaagagctcgaccaggtcgtccagctggttggcaagtcggcgctctcggatcccgacaagatcacgctcgacatggcgacgctcatcaaggaggacttcctccagcaaaacggctactcagactacgaccagttctgtcctatttggaagacggagtggatgatgaagctcatgatgggattccacgacgaggcacaaaaggcaattgctcagggccagaactggaacaaggtgcgcgaggccacccaggatctgcaagcccagttgaagagtctcaagttcgaggtgcctagtgaaggacaagagaagatt

SEQ ID NO: 27054 - DNA, 3291 bp, Neurospora crassa
cctgctccctctgccggcgcctctggttcgacgttcggcaacttccaagatcccacccagggtcacgcccgagagaacagcaccggcggtcgtggtggtcggggtggatccggcggcggtcatcagagaagacattccttggccttggctgatgccaagaaggccgccgagatcgcccaacagaagcgcacgacgtctaccttccagttccctgctgctcctgcccctggctcctccgagaagtctgaggatgatgccaagaccaccccgagcaccactcctgctccggcggagggccagatagctcagggatcgtcgttccgtggcggtcgtggcggccatggcaggagccagagtatggctgttggtgccaatggccgtggtggccgcggaggccatttctctaccgactccgtgggccaaggcagcgacttttcccgccgcgctcctggtagcggccatgcccgcactggttcccgcaacttcgacggcaactggaggaaccagaaccagaaccagaaccagaaccaggctcaggaccagaccgctgcccttcctcagagccagggcttccagcccggtcaccgcagccgcggctcggtgagccagtccatctcttcgattggatccttccagtatcctggacagcctcagctggttcagttccccggtcagatgatgatgccccaggttttccctggccaacaactcaatccgatgcagctcaaccagcttcaggctcttcagcttgctcagatgaatggtcagccacttaccggtcttgccgccagccagcacgctcctcaaatggctgctcctggtcagcaaagccagcaacagcagcgcaagacgcttttcactccttaccttccccaagctactcttcctgccctcttgggtaacggccagcttgtttctggtattcttcgcgtgaacaagaagaacagaagcgatgcgtacgtctcgacgcaggatggcctgcttcccgccgatatcttcatctgcggcagcaaggatcgcaaccgtgctctcgaaggtgatctcgttgcggtcgagctgttggatgttggtgaagtgtgggcgcagaagcgcgagaaggaagaaaagaagaagcgcaaggatattaccgacactcgttctggctccattagtggaggccaaaatactggtgacgacaatggcaacgctgaggggggactccgccgccgtggcagcctcagacagcgtcctacccaaaagaagaacgacgacgtggaagttgaaggtcaaagtcttcttttggttgaggaagaggagatcaatgatgagcagcagcctctctttgctggtcacattgttgctgttattgagcgtgttcccggccaaatgttttctggtacccttggtctgctccgcccgagcagtcaggctacgaaggagaagcaggaagctgaacgcgctgcgagagacggtggcaatggccgccaacaagactcgcgctcccacgagaagcccaagattgtttggttcaagcccacggacaagcgtgttcctctgattgccattcctaccgagcaagcacccaaggacttcgtggagaagcaccaggactatgcggaccagatcttcgtggcttgtatcaagcgctggcccatcacttctctgcatccgtttggtaccctcgttgagaagctgggcaaaatgggtgatcttaaggttgagaccgatgccctccttcgtgacaacaacttcgcgtccgacgagtttgctgaggctgttttgcgcaacgtcagccagcaagactggtcgcttgaaagtgaggatcaagctgctcttgccgctcgccgtgacttccgtggcgagaatgtgttcactgttgaattagatagctctgtcgagcttggcaacggtgttcatttcaagcagttgcctgacggcaagatcgaaattggtattcacgttcccgatgtcgcccacttcgtcaagcccggctcactcgttgaccgtgaagctaagaagcgcggtactgcggtccatcttgtcaaccgcttctgtgcccttctcccccccaagctgtcgagcgagctttgcaccctcactcctgaacaggatcgcttgacttttagcgttgtgttccacgtcaacccccagactggcgcggtggccgaaggcgacacctggattggaaagggtatcgtcaagagcggcgggaaggtgtcgctcagcgagatcgatgaagccatttccggtagcagcggattctcccatccatctgtgaaggccctggacatccagattctcaacgctgtcgcccagaagttccgtgaagctcgcttgggcgccggtggcgaacccattgcgcctctccgtctcctccagcaacttgatgatgagaacatcccgcctaagcacaacattttcgagtctagccaggccactgaacttgtcgaagagcttatgcacaaggccaacacccatgttgcccaacgtctggcgcagggactcccggagaaagcccttctgcgcaggcagtctgctcctaactcccgccgcctacaaactatcattgaccgtatgactgctttgggctacgacattgacgctactagcagtggtaccctacagaatagcttgttcaagattgacgactctgacatcagaaagggtatggagaccctcctcgtcaagtctatgcagcgcgccaagtacttcattgcgggcaagactgccagtctgctttggcctcactatgccttgaacttacccctctacactcatttcacgtaccccaccaggcgctacgccgacatcattgttcatcgtcagcttgaggctgttctttctgatggaaagattgaatatactgaggatttggagaaccttgtcaagaccgtagagtcttgcaacaccaagaaggattcggctcaaaatgctcaggaacagagtgttcacatcgaatcttgccgcaccatggataagaagcggcaggaggttaatggcgacctgatcagcgagggtatcgtcatttgtgtgtacgagtctgccttcgacgtcctcattccggagtggggcttcgagaagcgtgtccactgcgatcagcttcctctaaagaaggccgagtttagaaaagagaagagagttcttgaactctactgggagaagggtgttcccagctccgcctacgttcctgaagatgagcgccccaaggccgccgcttctcagcgcatctcgaatgctctcgctgctgctcgccaggctgaggaggccgaacgcgctaagaaggatcgcgaggaggctgcccgcaagcagatc

SEQ ID NO: 27055 - DNA, 1492 bp, Neurospora crassa
atgtctaaccttccctctgagcccgagttcgagcaggcctacaagggtacgtctgagagaaaaaccaactgtttagccgcggacatagagctgacttgatttttcaccacagagttggcctacactctcgagaactcctccctcttccagaagcaccccgagtaccgcaccgccctcaccgttgcctccatccccgagcgtgtcattcagttccgtgttgtctgggaggacgacaacggcaacgtccaggtcaaccgcggttaccgtgtccagttcaactccgccctcggtccctacaagggtggtctccgtctccacccctccgtcaacctttccattctcaagttcctcggtttcgagcagatcttcaagaatgcccttactggccgtaagtgaccgaacggatatacaaaaccagaatatcagatttgctgactcggcgtctctagtgagcatgggtggtggcaagggtggtgccgacttcgaccccaagggcaagagcgacgctgagatccgtcgcttctgctgcgctttcatggccgagcttcacaagcacattggtgctgataccgatgttcccgctggtgatatcggtgttggtggccgtgagatcggttacatgttcggtgcctaccgcaaggccgcgaaccgtttcgagggtgtccttactggcaagggcctctcctggggtggttcgctcattcgccctgaggccactggttacggtcttgtttactacgtcggccacatgctcgagtactctggcgccggctcctacgctggcaagcgcgttgccctctccggttccggcaacgtcgcccagtacgccgccctcaagctcattgagctaggcgccaccgttgtctccctctccgactccaagggtgcccttgtcgccactggcgagtccggcatcaccgttgaggacatcaacgccgtcatggccatcaaggaggcccgtcagtcccttaccagcttccagcacgctggccacctcaagtggatcgagggtgcccgcccctggcttcacgtcggcaaggttgacatcgctcttccttgcgctacccagaacgaggtctccaaggaggaggctgagggtctccttgccgccggctgcaagttcgtcgctgagggttccaacatgggctgcactctcgaggccatcgaggtctttgagaacaaccgcaaggagaagaagggcgaggccgtctggtacgcccccggcaaggccgccaactgtggtggtgttgccgtttccggtctcgagatggctcagaacagccagcgcctcaactggactcaggctgaggttgacgagaagctcaaggacatcatgaagaacgccttcttcaacggtctcaacactgccaagacctacgtcgaggctgctgagggcgagcttccttcccttgttgccggctccaacattgctggtttcgtcaaggttgcccaggccatgcacgaccagggtgactggtggtccaagaactaa

SEQ ID NO: 27056 - DNA, 3294 bp, Neurospora crassa
gatgtccttccctcttcccgcttccgaactttcaagaatgacggcaagggcaggataccctctacccaacccaagagcgccttcgagagcgaggtgcttgagcgtatgagccaggatatttccgatctgaaacagaataactcggaaaaggatcaagcttgggaacgcccgccactaccagcgacctacaacccagctacagacagtctctgcttccagtccattgaggctgaagagggattcctccacggcggccaagcgaccattaagctgtttggtgttaccgagaatggaaactcggtcctcctccatgtcaaagacttcaaacactacctctacgttcaagcccctgtatcgtttggtcccgatgattgtcccaagtacagagcattcctcgaaacgcagctcgccatgcccacaccggccatccattcggtcaccctgacgatgcgcgagaacatgtacggcttccaaggcaacacacaaaacccttatatcaaggtcaccgtcaacgaccccaaatttcttcccagagttcgaagattgatcgaaacgaacaaagccaactggaagggcatgtggaagagcgatgggtctatcatgacctttgatgatatccagtatttgcttcggttcatggttgactgctcggtatgtcgcctcttcacactacccccaagattccctaagctaacaaacgccagattgctggtatgtcttgggtggaggctcccgcaggcagctatcagcttgtcaacgataaacattccaactgtcagatcgaagccgagatgagctaccgggacctaatagcacacaagcccgttggcgaatggtccaagatggcacctcttcgaattctctccttcgatatcgagtgcgctggccgcaagggcatctttcccgaaccgcaacacgactccgtcattcagatcgcaaacattgtcacaaagtacggagagaagaagccatttgtccgtaatgtgttctgtcttgacaccactagccccatcgtggctactcaaattctttcttttgacagggaagaggacatgctccgcgagtggcgcaacttcctggaacaggtcgatccggatatcatcatcggttacaacatcgccaacttcgatttcccctaccttctcgaccgagctaaacatctcaaagtcaaggatttcgacttttggtctcgtaccagggtgagatctgtcgcaaaggagacaaatttctctagcaagcagatgggcaaccgtgacaccaaggctacaaataccaacggacggcttcagctcgacatgcttcaactcgtacaacgcgactaccagttgaggagttacacccttaattctgtctgctcgcacttcttaggggagcaaaaagaagacgttcatcattccatgatcacagaattgttcgaaggcacaccagaatccaggcgacgtcttgcactttattgcttgaaggacgcctacttgccgcaaaggctgatggacaagctgtcatgtttagaaaactacacggaaatggcaagagtcacgggtgtgccgttcaacttcctcttggccagaggtcagcaagtcaagttcttgagtcagcttttccgcaaggctttggagcagaagctggtcattcccaacctacgtcccgagtcctcggaagagcagtacgaaggtgctactgtcattgagcctacaagaggctattacgatgtgccaattgcgactctcgattttgcttcactgtatcccagtatcatgcaggcgcacaacctttgctacacaacactcatcaagaagcgggacatcgagagatgggatttgaagaaggacgaggactacattgttactccgaacggagacatgtttgtgacgactaagcagaggaagggtcttttggcacagattctggaggagttgctctctgccagaaagcaagcgaagcgcgagttggccgtagagaaggacccattcaagaaggctgtgctgaacggtcgtcagttggctttgaaggtcagcgccaactccgtctacggtttgacgggagccacaaacggcaagcttccttgcttggagatcgccagtagtgtcaccagtttcggtcgtcaaatgatcgaaaggaccaaaaaggaggtggaggagcggtataccattgccaatggctactctcacgacgctcaggtcatctacggtgataccgattccgtcatggtcaagtttggaaccaaggatcttgctgaggccatgaagctcggccaagatgcctccgagtatgtctcgggcaagttcatcaagcccatcaagttggagttcgaaaaggtttatttcccgtacctcctcatcaacaagaagcgttatgcgggtctgtactggaccaagcctgagaagtacgataagatggacaccaagggtatcgagacggttcgtcgtgacaactgcttgctagttcagacagttatcgagaaggttcttaggatgatccttatcgaccaagacgtccctggagcccaagcgtaagagtttgccaaatttatcccttttgccattgccaacatcgcgctaacttactacccccagatatgtcaaagacaccatcgccgacctcctgcaaaacaagatcgacatgtctaagctagtcatcaccaaggccctgaccaaagagaactacgatgccaagcaagcccacgtcgagctcgcgcagcgcatgaagaagcgcgatgccggttctgccccggggctcggcgaccgcgtcgcctacgtcatggtaaaaggcgccacgggctccaagaactttgaacgctccgaggaccccatctacgtgctcgagcacaacgtgcccatcgacaccaagtactatctggacaaccagctagccaagcctttgggccgcatcttcgagcctatcctgggcgagaccaaagccaagtcgctgttgcacggcgaccacacccgcgtcgtctcagtcgccgccccgaccgtcgggggactcatgaagttcgccaagaagacgcagacctgcatgggctgcaagaagccgctgacgggcaaagaggagagccagggcgctgtctgtgcggatgatgctccgagagtgggtgagctgtacaaaaagacgctcgatagggtgtcggatctggaggtcagattcggcaggctctggacccagtgtcagaggtgtcaggggtcgatgcactgcgaggttatctgcagtagcaaggactgtccgattttctacatgcggatgaaggctaagaaggatctggaagatgcgaataaggagttgcagaggtttgatttc

SEQ ID NO: 27057 - DNA, 642 bp, Neurospora crassa
ccctcacttctttggcgcaaacaggacgattctgcgaccctcaacatcctcaagtggcgcttcggcctcatggtcatcaaccccgacagcgcctttaacggggggtacttcagggccgagatggtattttcggacgaatacccctaccagccgcccaagttccgcttcctgatccccatcacccaccccaatgtgtatccggacggccagctctgcatctcgatcctgcacacacccggcgaggacctcatgtctggcgagcaggctagcgagcgttggtcgccgctccagggcgccgagagtgtgctgaggtcggttctgttgctgctggacgaccctgaaatcaatagccccgccaacgtggacgcgggcgtcatgtaccgcgaccgccgagaggattacaacaagaaggcccgggaaacggtggagagatcaaagaaggatatcccgccaggattcgagatgccggtcagctttgaggaaaagccgcctccgaaggccgagaacgacgacgatttttgggccgagtcggatgaggagtttgactttggtggtagtgacaccggggatgacgacgagatggaggactttgaggacggggaggaagggagcgaggatgacgacgacgattccaactccaag

SEQ ID NO: 27058 - DNA, 1062 bp, Neurospora crassa
aagctcgctcgtctccgcgctcaactactcgagccagggccgggctcgggcggcggtccaggtgccggtttcgacgtcagcaaaagtggtgatgctcgtatagcactggtcggcttcccgtcagtcggtaaatccacgttcttatccaaggtcaccaagaccaagtccgaagtcgcctcatacgctttcacgaccctgacagccattcccggtgtgctcgaatatggcggtgccgaaatccagctgctcgatttgcccggtatcatcgagggtgcctccgagggcaagggtagaggaagacaggtcatttccgccgccaagacaagcgatctgattcttatggttttggacgccacaaaacgtgctgagcagagggccctcctcgaggccgagttggaggctgtaggcatcagactcaaccgggagccaccgtacgcccccttttcccttcccatgttacttttctaccgacgctaacgatataatccccctttgcctagaaacatctacctcaaacccaaaaaggccggcggcatgaagatcaccttccagacgccgcccaagaacgggctggacgagaaaatggtgatgaacatcctgcgcgactacaagatcctcaactgcgaagtcctggtgcgcgacgagaacgtgacagttgatgacttcatcgacgtgattatgaaggaccaccgcaagtacatcaagtgcctgtacgtctacaacaagatcgacagcgtgtccctggacttcctcgacaagcttgcgcgtgagccgtacacgtgcgtcatgagttgcgagctcgacctgggcatccaggacgtcatcgaccgctgctggaaggagctcaagttgatccgcatctacaccaagcgcaagggcaccgacccagactttagcgaggctctgatcgtcagaagtaatagcaccatcgaggacgtgtgcgaccgcatccacaggacgctcaaagagaccttcaagtacgcgctggtctggggcgccagcgctaggcatatcccccagagggtggggttgggtcatccggtggcggatgaggatgtcgtg

SEQ ID NO: 27059 - DNA, 1125 bp, Neurospora crassa
tatgaagcccaaatcggcgttggagacgcaagatgggaggcccacccccagatcctcgaggatctcaaggccaaggcaaagtccttgggcctgtggaacatgtttcttcccaagggtcattataaggaatcccctggcttcaccaaccttgagtatggcttgatggctgagtggttgggcaagtcccgcgttgcatccgaggccgtcaattgctctgctcccgacactggcaacatggaggttctggccaagtacggtaacgaggagcaaaaggccaaatggctgaagccgcttatggatggcaagatccgctctgccttcctgatgactgagccgcaggtggcttcttcggacgcccggaacatcgagatgaagatcaccaaggacggcgatcactacgttcttaacggccagaagtggtggtcaagcggcgccggtgaccctcgctgcaaggtctacattgtcatgggcaagagtgaccccaacaacaaggatccttacaggcaacagtccgtcattatcgttccatccgacaccaagggcatcaccatcgagcgcatgctttccgtttatggctatgacgatgctcctcacggtcacggccatatcacgttctacaatgttcgcgtgccagcagccaacctcgttcttggcgaggggcgaggctttgagatcatccagggtcgcctgggtcccggtcgcattcatcacgccatgcgcacgatcggtgccgccgagagggccttggagtggatgctcatgcgcatcaacgaccctaagaagacgccctttggaaagcagctgcgggaacacggcgtcatcctggaatgggtcgccaagtctcgcattgatatcgacgctgcgcgccttgtcgtgctcaacgccgccattaagatggacgagcaaggtcctaaagcggcgctcacggaaatcgcccaggccaaggtccttgttccacagacggctttgactgtcatcgaccgcgctgtccagagctttggtggtgcgggtgtcagccaggatactcccttggctaatatgtgggctcagatcagaactctaagactggctgatggtcctgatgaggtccatctgcaacaaatgggtcgcaacgagaacaaacgc

SEQ ID NO: 27060 - DNA, 1128 bp, Neurospora crassa
atggccaagacaacgacccttaaggaattcgagagcgtcttccccaagctggaggaggcgctcctcgagtatgccaaggcatacaagctgcccgagcagatgctcagctggtacaagcaggtgagagcagaccaacctacctacctgtctggtcgtgtagctttttcagagctttgatactgactcttttgtcttttttcgtcgcagtccctcgaggtcaacaccctcggcggcaagtgcaaccgcggcatgtccgtccccgactcggcctccatcctgctcggccgccccctgaccgaggaggaatacttccaggccgcgacgctcggctggatgactgagctcctccaggccttcttcctggtctccgacgacatcatggactcgtccatcacgcgccgcggcaagccgtgctggtaccgccaggagggcgtgggcatggttgccatcaacgacgccttcatgctcgagtcggccatctacacgctgctcaagaagtacttccgctcgcacccgcgttacgtcgacttcctcgagctcttccacgaggtgaccttccagacggagatgggccagctgtgcgacctgctcacggcgcccgaggacaaggtcgacctggacaacttctcgatggacaagtacaccttcatcgtcatctacaagacggcctactactcgttctacctgcccgtcgcgcttgccatgtacatgctcgacatcgccactccggagaacctcaagcaggccgaggacatcctgatcccgctgggcgagtacttccaggtgcaggacgactacctggacaactttggcctgccagagcacattggcaagatcggcaccgacatccaggataacaagtgctcgtggctggtcaacaaggcgctcagcattgtcacacccgagcaacgcaaaacgctcgaggagaactacggccgcaaggacaaggccaaggaagctgtcatcaagcagctgtacgacgatctcaagctcgaggaccactacaagcagtacgaggaagagcgcgtcggcgagatccgcaagatgattgatgccattgacgagagcaagggtctcaagaagcaggtctttgaggccttccttggtaagatctacaagcgcagcaag

SEQ ID NO: 27061 - DNA, 1851 bp, Neurospora crassa
aacccagaccccgtagaagctgagctggaggctaaggagctcagcaagtatctgctcgccaagtccttcttcgattgcaaggagttcgaccgttgcgcttccgtcttcttgccagattccctcctctccggcctactatccacgaaagccacggatgctacgacacccaaaggcaaggccaaggcaagctctgcgccgccgtacgagcaggctctcccctctctcagtcagaaaagcttgttcttggccctctatgccaaagtcatttccggagagaagaagaagaacgaggagtcggagatgatcatgggtccccaggacctgggcaccatcaagaatagccatctggttgttgtcagccgcttcctcgagaggtggtttgccgagcgcaaagccgaggactcggatttgccgccaagtcaaggcttcctcgagtatttgtacgtgtgtcccggtgtttatcgttctgtatatgcgtttggctgatgttgaaacagatacggcatggttatggttaaggagaagaacgaggacgccgcgttagattaccttctcaacagtgtccatctgtttccgtggaactggggcgcttggcttgagctcacaaatctcatctcaggggtcgaacagctcaacaagataacccctgtcctcccgcaaaacatcatgtcttttatcttctacgccaacacggcggttaatctgtatcaacaggggcaagatctagctgcctctgtcaacgatctcctgaagcttttcccgacgtcttccttcattctaacctgtagggcgcttttgaactaccactccaaggacctgtacacggccgaacaaaacttcagtaacttgcttgcgttacatccccatcgtctcgattcactggaccactactccaacatcttatatgtcctcaacatgcgcccaaaactagcatttctggcgcacctttgttccagcattgacaagttccgacccgaatcgtgcgtcgtcataggcaattactactcccttttatctctccacgaaaaggccgtacagtacttccgccgagctcttaccttggaccgctcttgtctctctgcctggacgcttatgggccacgaatacgtcgaactgaagaacacacacgcagccattgaatcatatcggcgtgctgttgatgtcaaccgtcgcgactaccgcgcctggtacggtcttggccagacatatgaggtgctcgagatgaattcctacgctttatactattacaaaaaggctgccgggctcaggccttgggacggcaagatgtggcaggccgtcgggtcatgcctgcaaaaaatgggcaaagacagggacggcataaaggcgctcaagagggcactactagcggatagctactatgactctactttgagcagctttgggagtgcgggacctgcagacaggatggcgcagatggatccagaagtgttgctacagattgctagcatgtatgaccgcctgggtgaggtcgaggaggctagggcatatatggagctttgtgtggcacaggaggatggaggagccacggacaatgcggatgcttcagctgtttgcacctcgaatcccggcgaatccttcgtcgttcatggtgattcgcctgggtcggacggggatgcagagggagggtacgaagggcgtggtggagctgggcagggagaagggactggagtgacagtagccacaagcaaggcacgtatgtggcttgccaggtatgcaatgagaacggaggactacgttacggctaaccggctggccacggagctgtgccaggatggagtcgaggtggaagaggccaaagcgctcattcgagaggttaggtcgaggatggaa

SEQ ID NO: 27062 - DNA, 2093 bp, Neurospora crassa
agagaccaactacgagaaaatgcccttctaaagaaatactactgcgatgtcaacattggcgacttgatcaaattcaatgaagaaattgcccatagactagtcaccgaacccgccgagattatccctctgttcgaggccgctctgaagcgctgcacacaccgaatcgtcttcccaaacgaacccaagatagacctgcccgaccaccaactgcttctacactccaacgccgaagatgtttctatccgtaacctcgactcccttacaatctcccggctggtccgggtacctggtatcgtcattggtgcctcggtaatgtcgtccaaggcgactgagctccacgtccagtgccgcaactgcggccacgtccaacacgttcacgtatccggcggcttcagtggcgctacccttcccaggacatgtggcagaatcagggcacctggggaccctggcgagaagtgcccaatggatccctactttgtacaacatgaaaagtccagattcgtcgatcagcaaattatcaagcttcaggaagctccagaccaagttcccgtcggtgaactgccccgccatgtcctgatttccgccgaccgctacctcacgaaccgcgtggtgcccggctcaaggtgtaccgtcatgggtattttttctatataccaaagtggaggcaacaagaagtccacaagcggcgccgtcgccattcgcacaccctatctccgcgcagtcggtatccagacagacattgaccaaacagccaagggtctggctgtcttttccgaggaggaagagcaggagttccttgagcttagccgtcgtccagatctctacaatgtcatggccgaatgcatcgcgccgtccatctatggaaataaggatatcaaaaaggctatcctctgtttactcatgggtggctccaagaagatccttccagatggcatgaggcttcgtggtgatatcaacgtcctcatgcttggtgatcccggtacggccaagtcacaactgctcaagttcgtcgaaaaagtcgctcctatcgccatctacacctccggcaagggttcctccgccgccggtttgacggcttccgtccagcgtgacgcttccacgcgcgagttctacctcgaaggcggtgccatggttctcgctgacggcggtgtcgtctgtatcgatgagttcgacaagatgcgcgatgaggacagagtggcaatacacgaagctatggagcaacaaaccatttccatcgccaaggccggcatcaccacgatcctcaatgctcgaacttcggtcttggccgccgctaaccccatctttggccgctacgacgacatgaagaccccgggcgagaacatcgactttcagaccaccatcttgtcgcgtttcgacatgatcttcatcgtcaaggatgagcacgagcgcggccgtgatgagcgcatcgccaagcacgttatgggtatccatatgggtggtcgtggtgtcgaggagcggattgaggcagagatcccggtcgagaagatgaggcggtacatcagctattgccgatcgtaagttgtttatgctcctatctaccaccttagacacataaaaactgacattgtcgctcctccagccgctgcgccccgcgcctctctccggaagccgccgagaagctctcctcgcacttcgtcgccatccgcaagcaagtgcacgcctcagagcttgaagccaacgcgcgctcctcgattcccatcacggtccgccagctcgaagccattgtgcgcatcaccgagtcgctcgccaagctgacgctctcgcccgtcgcgacggagaagcacgtggacgaggccatccggctattcctgtgctcgaccatggacgccgtcaaccaaggtggcagcacgggcagcaatcgggagttgaacgaggagacgtcccgcgtcgaggccgagctgaagcgccgcttgcccatcggctggagcaccagcttggcgaccctgcgcagggaaatggtggagggtaaagggtttagcgaggtggcgctgaatagggcgctgatgatgttgcagaggcgggataccattatgtttaggaaccagggcgcgcaggtttataggaatggcgcg

SEQ ID NO: 27063 - DNA, 1225 bp, Neurospora crassa
atgtcgagcacaggtttcaccagcccttttgggaacgcaaacccgtttggcagttcaggcagatctgagtctgggccaatgcataggctggttgaggaagacgagaatgatactattacttcgcctacaactccccatttcggcgtcaagaacaacgctgcgcccgctttctggaacggctttggtggcgatgctccgtcagacatgcccgtccggcgccaacctgatgacttccctgctcactacaacttgggtcgccggacctccgtttcggcagaatccctgaaaccagtcacggataactccgacaactggtcacctcctgttcatccaaagacagcagagcaacttgagcgtttgaagaaagccatcagcggcaactttcttttcaaccaccttgaggacgaccagagtgcccaagtattgggtgctttggtagagaagccggtgcctgccaaaggaatcaaggttagtacctgaagccactgcaactctctgttttgagaaacacggtttttctaacgctttttggcaggtgatcactcaaggcgatgccggtgattatttctatgtggtagagaagggaagattcgaggtttatgtcaacagcaccggcgctcttcaacccggcccagacggcatgggacagaaggttggcgagatagcggagggtggctcttttggcgagcttgccctcatgtacaacgcaccccgtgctgctactgttgtctctgctgagccccagtgcacactatgggcgcttgatcgtgtcaccttccgacgaattctcatggaatcgaccttttctcgtcgtcggatgtacgagagctttctcgaagaagtgcccatcctcaagaccctcacgccatatgagcggtccaagattgcggatgctctcgaaagccagaagtacccggctggccatgagatcattcttgagggtgaccccggccactccttcttcctgttagaggctggcgaggcggcagcgttcaagcgaggaaacgattctccagttaagaactacaagaagggtgatttcttcggtgagcttgcgctgctgaatgatgcccctcgcgcggccagcgtcatcagccaaactgaggtcaaggttgccaggcttggcaagaatgcttttcaaaggttgcttggtccgattgaaagcattttgcggaggactaggtacgtcgaagcggaagaggtggatcctttgcaggtgtcttga

SEQ ID NO: 27064 - DNA, 3380 bp, Neurospora crassa
atggcagacatcaaaatcgacagcaaggtcttccaggagcgcgtctcgcacttctacaatgcctggaaggccgacaagcgctccggagacgctctcttcggtggcgtctcttccatcgtcatcctgatgggcaaggtcgacgagaaccccgagtttcacaagaacaacgctatccatgtgagttttgccctctggagagcccgctcggcgtgcgctggctgtacgtctggcgggccattccagtcaaatgacagctgctgatagctctacgtaaagttctggctgctaggttacgagttcccgacgaccctcatgctgtttaccctcgacaccatctacattctcaccacccaaaagaaaggttcgcccggtattcccgacccaagaacgcggacaaactatctgacacgttaatagccaagtacctcgaccaagtgaagggcggcagataccccgttgaggtcctcgtgcgggggaaggacgccgccgagaacgagaagcttttcatcaaaattacggatgccatcaaggctgcgggcgtaagttacatcccatcctgggcgcacatcaacatctcggtgcggttctaacacattttcgctcgttatagaagaaggttggcgtccttaccaaggacacctccaagggcccctttatcgacgaatggaagaaggtctatgccgataactgcaaggatgtggaggaggttgacgttgcccaggctctgtctgctggcgccttctccgtcaaggatgagaccgagcttcgtgccatgcggacctcgtccaaggcttgcgtcgccctcctgaccccttacttcctcgacgaaatgtccaatatcctcgaccaagataagaagatcaagcacagcgcactagccgataaggtcttcaacaaactggaagacgataagttttggaagaccgtcgagctgcccaaccgacagaagctcccggctgacctcgatcccgagcagctggactggattctgggaccgatcgtccaaagtggtggcaaatttgacctgaagtggcaggctgattctgacaatgatatactccacccgggaattatcatcgcggctatgggtctcagatacaagtcctattgctcccaaatcgccagaactttcatggtcgatcccaacaagtcccaagaaagcaactacaagttcctacttgctgtccacaacctcattctcaaggagatccgggatggtgccattgtcaaggatgtttacaccaaggcctacaactttgtgcggtccaaaaagcccgatcttgagaagcactttcttaagaacgtcggctttggaatcggcctggagaacaaggacccgaccttgattctcaacaacaagaacacccgtacccttaaggatggcatgacactggttgtgaccaccggcttcagtgatatccagaaccccaacccccaagacaagaacagcaaggtctattccttgatcctttccgatacgatccgtgtcactagctccgagccggtggtgtttactggcgaggcgcctgtcgatgttgatgccacctcgttcttcttcaaagatgaggaagaagcacagcccacaccgaaaaaggagaagcgggactctagggtgggtgccgttgcaaccaagaacatcactagcactcgtctacgctctgagcgtaatacaacggtagatgaggacgcggacaagagacgtcgcgagcatcagaaggaactcgcgcagaagaaacagaaggaaggcttggccaaatacgccgaatctaccgctgatgagaatggcgtcgaaatcaaaaagttcaagcgcttcgaatcttacaagcgggataatcaattcccgcccaaggttaaggatatgggcatcgttattgatcaaaagaacgcgaccatagtactgcctgttatgggcaggccggtacccttccatatcaacaccatcaagaacgcaagcaagagtgacgagggcgagtggtcattcttgagaatcaacttcctatctcctggccagggtgtgggtcggaaggatgagcagcccttcgaagatgcatctgcgcacttcgtcaggagcttgactttcaaatcaaccgatggcgataggtatgctgacattgcaaaccaaatctcgaacctcaaacgagacgctgtcaagaaggagcaggagaagaaggatatggaggacgtagttgagcaggacaagctcgttgaaatcagaagtaagtcgctttcccggatcaattgtattgcaacatactaattaactatcagaccgtcggcccgccgtattggataatgtcttcatccggccggccatggagggcaagcgtgtgcctggtaaggtggaaattcaccagaacggtattcgctaccagtcacctctcagcacaacgcaacgcgtggatatcctcttttccaacgttcgccaccttttcttccaaccatgtcagcacgagttgattgtgatcatccacatccacctcaaggatcccattatcattggaaacaagaagaagacgaaggatgtccaattctacagggaagccaccgacatccagttcgacgagaccggcaatcggaagcgcaagtatcgttatggtgatgaggatgagttcgaggctgaacaggaggaacgccggcgccgcgcagagctggatcgcctgttcaagtcgttcgcggaaaagattgccgaggcgggccgcaacgaaggcattgaggtggacatgccactccgcgaccttggtttcaacggtgtaccgttccgcagtaacgtgtacatccagcccaccacggagtgtctcatccagatcaccgaacctccattcatggttatcacccttgaggacattgaagtcgcacatctggaacgtgttcagtttggtctcaaaaactttgatctggtgtttgtcttcaaggacttcacgaggccaccataccacatcaacaccattcctgtcgagtctttggaagacgtcaaggagttccttgactcgtctgacattgccttctcagagggtcctctcaacctcaactggggtgtcatcatgaaaacggtcactgccaatacccaccaatttttcttggatggtggctggggcttcctgcagaacgacagcgacgacgacgaagtggaggaggaggaagaggagagcgccttcgaaattgacgagagcgaattggaggacgcttccgagtctagcgaagaggattccgaatacgactccaacgcctcggaggaggccagcgatgaggcggaagacagcgaggaggaggagggcgaggattgggatgagctggagaggaaggctaagaagcgtgacagggagagcggcttcgacgacgaggaggaacgtgcggcacccaagaagcggagaaagtagact

SEQ ID NO: 27065 - DNA, 1463 bp, Neurospora crassa
aagcccgacgaggctccggctgccgcccccgaggctgcgcccgtgtctgcccctgcgtccgaagagcccaaggcccccgagaacgagacctccatcgaggagagccagagcaaccttgtcaagaacgagtacgaagtcgagattaagttgagcgatcttcagaatgacaccgaaagtcctctctactccgtcagctcgttcgatgagttgggtctccccgaggctgtcaaccgcggtctgctcgccatcaacttcaagaaaccttccaaggtccaggagaagtgccttcctctcatgctctccgaccctccccgcaacatgattgcccagtctcaatccggtactggaaagactgccgctttcgtccttaccgttctctcccgcatcgacctgtccaagccccaccagcctcaggcccttctgcttgctcccagcagagagcttgcccgccagatccagaccgttgtccagaccatcggtcagttctgcgagaatttgattgtcgaggctgctattcccggtgccatctcgcgcgagacgggtgttagaggcagcgtcgtcgtgggaactccgggaactgtcatggaccttgtcaagcgcaggcagttcgatatctcgcagttgaaggttcttgttattgacgaggccgacaacatgcttgaccagcagggtctgggtgaccagtgtgtccgcgtcaagaagtaagttcatctttgggcactagtgttatgcgacctttactgacattaagtagcatgctccccaagaccattcagatcctccttttctctgcgacgttcccagacaaagttttgagattcgccgagcgcttcgcacccaacgccaaccagatgaagctcaagcataaggagcttacggttaaaggtatttcgcagatgttcatggactgtcctaccgagaaggacaagtacgacattctttgcaagctgtatggtctcatgaccattggttcttccgtcatcttcgtccgggtatgttttttcccctcgaatactgttgtagacatttgctaacgtgctttcttccagacgagagagacagccaacgagatccagaagcgcatggaagcagatggtcacaaagtttcggcccttcacggcgcctacgaaggccaaagccgtgatgttcttctcgatgaattccgctccggacgttccaaggtcctcatcaccaccaacgttctggcacgtggtattgatgtttccagtgtgtccatggtcattaactacgacattccgatgaagggacctggcgaaagggagccggacgcagagacataccttcaccgtattggtcgtaccggtcgtttcggtcgtgttggtgtctcgatcagctttgtccacgaccgtaggagcttcgaagcgctctcccagatcgctcagttctacggaatcgaccttatccagctgaatcccaacgacctggatgataccgagaggaag

SEQ ID NO: 27066 - DNA, 2056 bp, Neurospora crassa
cagcaactactcgaaatatggaacaaggctaaggggaaggagcgtgacgctatgctctggggtgatgaggtgcgtttttggttctcatgccttgagctactaattccttggctcctaacaccccgcttagatcgagtacttggtcgtcaactattccaaagatgagcccaaggtcctgctctcccttcgccaggccgatattctcaaagccttggccgacagcaagactcttaaggtaacaggagactgcgctcctggaactgaggccaacgcagatgccgggaacgtaactcttcccgttttccatccggaattcggaagattcatgctcgaagccacccccggaaagccatggggcatcgacttcaaggacctgttgaccgttgaggccgacatgaagttgaggaggtgcattgccaaggaccacatgctttcgaatgagcatcccatcacgctcactactttcccccgcatcggcagcccaggagtattcactgaaccatcatatcccgtctccggtcccaagctgcgatcgcaatttgtccctgacgagatcgccaatcctcatattcgcttccctacccttgcggccaacatccgttcgcgccgcggccgcaaagtccaggtcaatgttccagtgttcagagacgagaacaccccttggccatggaaggacccaaccgtcaactacgacctacacaactggcccgaggacgatgatgttcgtaatggtgccgctcccgacaactttattcacatggatgccatggctttcggcatgggcagctgttgtctgcaaatcaccttccaggccaagaacatcaccgaaggcaggaagatgtacgaccagctgagccctctaggtcctatcctgcttgcgctcactgcggcaacaccagtgtacaagggattcattgccgataccgatgtcaggtggaaccagatcagcagggctgtggacgaccgcacacctgaggagctgggagaaaaggtaggaacaacactttattaaaggtctgattcgatgctgacctttctatagccccttaagaacgacagatggcggattcccaagtcgcgttatgcttcgaactcaacttacatctctaccgactcccgattgcgacctgagtacatggatcctaacctcgtcatcgaccccgagatcaagcagcagttgctcgacggtggcatggatgaccgtttggctacccactttgcccatctcttcatccgcgatcctatcgtcatcttcaacgaagatctccaggagcttgacctgaccaagacggatcattttgagaatatccagagtactaactggcagcacatgcgcttcaagccacctccggctgacaacagcatcggttggcgtgtggagttccggcccatggagattcaaatcaccgactttgaaaacgccgccttctccgtcttcatcgttctcatcacccgtgccatccttagcttcgacctcaacttttacatccccatcgtgaaggtagatgagaacatggagaccgcgcatgcgcgcaacgccaacctcgaaaagaagttttggttccgcaagaatccattccccgtccgcacaacccgcaggggcggcagtgcctccagatcggcttccggcaccagcacacccaatagcggatcaagcagacctgccaccccgcccctgggccctgtcgaggacgagtacagactcatgagcgtcaacgaggtcatcaacggcaccgcgtacgccaaggcgacttccaaggaggtgaccgaggatgccgaggagggcgaagagttccccggtctcatccccttggtggaaagctacctcgacagcgtcaacatggacgtcgctacccgttgcggactcgcccgctaccttgatctcatccgcaagcgcgccagcggtgagctctggacggcggccaagtggatccgtgagttcattgcgaagcaccccggatacaagaaggacagcgtggtctcggaggaaatcaccaaagatctcgtcggcgccgttatcgagatcggcgagagggagaagcgcgggctgggcatc

SEQ ID NO: 27067 - DNA, 4135 bp, Neurospora crassa
aaggccgcaggcccatcagagggcgatttcattgtctttagcaattccgacaaggaacctaagggcaagaggggaggagctaaagctggtccctccaagcccgcggaggagcttgacgccgggcccccgaagccgacggttaagcaactcatcggtggtcactcctggacaggcaagctacccgtgaaccttctttcggagcactgccagaagcaaaagtgggagagacccgactacaacaccatcaagaccaaggatgggttctctgtctttgttactctcagcgcaaagaacccaaagacgcaggaagtcaccacgctgccgccattcaagctgcctccaagccatgtgcacctcgcctacaagcccactgccctcgaggccaagcatttcgccgctacctatgccctgtaccgcgtttgcagcatgaaaaacatgcacatgacgcttccgccagattacaggtcgctgtggaaggagtttgaagccctcaagaagcaggatgtcaaggagggcaaggcatggatgtacgaggccgaccctttccaagctcagagagagcgcgaggaggcaaaggccgccgctgagaagaagagagctcagctccaggccgccaaggaaaaggccgcaaacgaacccggtgtttccttggcattcaggggcagtggctccgggggcgcaggtggtggtggcgcgcacaatgtcatgaggggatgggctaatgttcccaagatcgagatgggcaacaagacgcgatcgcagctcgaggatttgctccgcagggagacggtctggaatccgaacggagtggtcatgtcggcctcgcaaaaggccgccatcgtcaaggagttcaaggatttgggattccgccaaagccatatcgaggaggccgtggaggagtgcaaagacagagaagaggccttggaatggctcttggttcatattcctgaggatgatcttccgcggtgggctctccctgagaagtatagcgcaggcgttactgtcgctgccactgatctcaagagagagggcgccattacgcgactcgctcagtccggatactctattgacctctgtcgcaagctcttggcgctccataacggagatgaggctaaagcggcagaagacctgcagaagcttcttctggcgagcggctccgagtccattgatgactcctcgcaggatgcggatggtctagacacctggagggatgctgacgagtgctgggaagaggagatggccacgttggaggcgtgcttcggcgaaaagttttccaagatttctccagaaatttgcgagatcaagctggagggtgtcaagaatggcagccaaaccaacgtggatgcctgcgtgcagttccgtaaatcagagcagtatcctactcaggttattctggctatggtggctgctcttccgtcctacatcaagctcagtgtcatcaagcaggcattggcatatgctcttacgctggaaggcgaggagatgaagattttctacgttgccagctgggtgcaagaaaacatcaacgacatcatcgaaaagcctggtcgcatccgcgaagttgccgctgtggcatctgcagcttcagaggaacccaaaaaggccgttaagcgggcacgaagggcccctcgttgccccaagcctatcaactggtcgcctgatcctcgtagcacggaggagtggcgtgccagaacggaaagcccctcttacaagaagatgctgtacgcacggcagaatctgccagcatggcaggtacaggattacctcatccagacggtgtcggaaaaccaagtcaccatcatctctggagaaaccggttccggaaagtctacgcagtccgtccagttcatcttggatgacctctacagcaaaggacttggaaagagcgcaaacatcattgtcacacaacctcgccgtatctctgccctgggtttggcggacagagttagcgacgagcgatgttcacaggtgggccaggaagtcggttactcgatccgtggcgaaagcaagacgagcccgaacaccaggatcaccttcgtcacgactggtgtgctgctacgacgcctccagacctcgggcggccgcgtagaggatgtggtcgcatcgcttgccgatgtcagccacgtggtggtcgacgaggtgcacgaacgcagtcttgatactgatttcctgcttgccattattcgtgatgtgttgtacaagcgcagggatctgaaactcattctcatgagtgccacgcttgatgctgcgtctttcaaagactactttaccgttgatgggaagaatgtttcggttggcctggttgagatctctggccggacataccctgttcaggactactacctcgacgatgtaattcacatgacgggcttcagcattggtaacaaccgcgagtactactatgacgacaacgctggcagcaagtccaaagaggaccccaacgatgaccctatcaacaagatcatccaaagaatgggcagccgcatcaactacgacctccttgtggagaccgtatgtgccattgatagcgaactcgccgagactcaaaaggctggtggtattctgattttcctccccggcgttgctgaaatcaaccgcgcctgcaacgctctgcgagcagtgccttctctccatgttcttcctctccatgcctccttggaaaccaaagagcagaagagggtgtttgcgtccgctcctccaggcaagagaaaggtggtcatcgccaccaacgttgccgagacgtccatcactatcgacgacatcgtcgcagttatcgatagcggcagggtcaaggagacctcgttcgaccctcagaacaacatgcgcaagctcgaggagacatgggcttcgcgtgccgcttgcaagcaacgtcgtggtcgtgccggccgtgtccaagcaggcaaatgctacaagctcttcacccggaacctggagatgcaaatggctgagcgtcccgacccagagatccgacgtgttcccttggagcagctgtgtttggctgtcagagcaatgggcatcaaggacgtcagccacttcctctctcgtgccccaacgccgcccgaggccacagccgtcgaggcatcgatcacgatgcttaggagaatgggtgccctcgatggcgaggagctgactgcccttggtcagcaactggccatgatccccgccgatctgcggtgcggcaagctgatggtctacggctccatcttcggctgtcttgacgactgcgtcaccatcgccgccatcctgagcaccaagagcccgtttgtctcgccccaggagaagcgcgaggaagccaaagaagccaggaagaggttctcccaaggcgacggcgacctgctcaccgacctccgcgcctttcaggagtggaacgaccagatgcaagagcgcatggggcaaagtcgggttcgtgcctggtgcggcgacaacttcctcaactaccagaccctgtccgacattgcctcgactcggtcgcagtactactcggctctgaaagagatgggtatcatcccgcacaactactccgagtccaataacagccaacaaaccaagtccatggctctcctgcgcgccctcaccgcctcggccttcagcccgcagatcgcccggatccagttccccgacaagaagtttgcagcatccatgactggtgccgtagagctggacccggaggccaagaccatcaagttcttctcgcaggagaacggcagggtgtttatccatcctagcagcacgctgttcgacagtcagggattcacgggcaacgcgtcgttcatgtcgtatttcacaaagattgccactagcaagatctttatcagggatcttacgcgtaagtttgttcttgtacccgtttctttttccttgtagtactgggatattaacaccgtcattagcattcaacgcatacactctcctccttttctcgggtgccattgatttggatacccagggccgcggtcttgtggttgatggctggttgcgcctccgcggttgggcccgtatcggtgttctggtgtcgaggttgagagggctgattgataagttgatcacgatgaaggtcgaaaatccgtcgctggatgtcgagaagaatgatatcatcaagacggtggtgaagctcgtcgagcttgatggtcttgat

SEQ ID NO: 27068 - DNA, 1884 bp, Neurospora crassa
atgatctcggcatacccttccacatatgcttccgatcgctctgttgtgttcttacatacctctcgaaataaaacaagctttacaacgagcagtgtcgccatgaagccatttctggggctcagaggtcagcccctcaacctggccgtgggcgcagttgccggatgtgattttcttcttttcggatacggtatgtaatgagacatagatgagtcaaatatggccaaaagaacttttttctaatcatcaatgacaacagatcagggtgttatgggcggaattctgactctccccgagttcctcggttactttgaacaaatcaatccagacgcaccgggcctcacaccacacgaatcttctatgcgatctacttaccaaggcatctccgtcgcttcctacaacctgggatgttttatcggcgccatcatcactatcttcattggcaatccctggggccgtaagaaaataatattgctcgggacttctatcatgattgtcggtgccattcttcaggccagcgctactactctaggccatttcatcattgggcgtatcattaccggcattggaaacggaggaaacacatctactgtgcgttataactctacctttcggtaaattttcaggtcaagctctaaccagtcgcaggtccctacttggcaatccgagacttcgaaagcacacaagcgaggcaagatggtcatgatcgaaggatctctcgtcaccgccggcatcatgttgagttactggattgacctcgggttaagttttgcccctggctcagttgcttggcgcttccctcttgccttccagatcatcttctgcatcctcatcctcatctttattcccttcctgcccgaatcacctcgttggttggttttcaaaggccgcgacgcggaagccaaggaaatcctggccgccctcaacgacgtggaacttgacgatcccattgtcgacaccgagttccatttcatccacgatacggttgtcgagatgtccaaaggcagcttcaaggacctcttcaccatggacaaggaccgcaacttccaccgcactctgctggcatacctcaaccaggttttccagcagatctctggtataaacctcatcacctactatgccgccgtcatctacagcggacttggcatgtccgacttcctggcccgtctcctcgccgccctcaacggcaccgagtacttcattgcctcgtggccagccgtcttccttgtcgagcgcgtcggccgccgcaagctcatgttgtttggtgccatcggccaagcggccaccatggccatcctggcaggcgtcaactcccggccagacgacaagccataccaaattgcgggaatcgtctttctgttcgtcttcaacacggttttcgcggtcggctggctcggcatgtcctggctctacccagccgagatcgtgccgctccgcatccgcgccccggctaacgcgctatccacgtcggcgaactggatcttcaactttatggttgtcatgatcactccggttgcgttcaacaaaatcaagtatcagacgtacatcatcttcgccgtcatcaacgcctttattgttccagtcgtctatttcttctatccggaaacggcgtgccggtcactagaggaaatggatatgatcttccacaaggttgatgggtggaaggggtacttcacggtagtgcaccaggccaaggttgagcctaaatggtacgacaaggatggccagcgcattggcggggctgactttgagaagactgctgggtaccagagccactcgattccggagtcgtctggatttgaaaagccgacgaaggcgcatgttgagtcgcctagggcggatgacgggatcacttcgtcgagtagtgatggaggtaatcgggagtcg

SEQ ID NO: 27069 - DNA, 2377 bp, Neurospora crassa
atgatggccaggaagcaggccactgaagccccggcggtctcaaacggatcacccaagaaacggtccagcgccgacagcgataatcacaatgtcaaacggcctcggctacaggagagcaccgataaggcgcgttggcgtttgagcagtgagggcggccgacacacatggcactatctcgaggacgacgaggctgcaaaagaatggccgcagtcatatgctgacaagtacttcctgggaatgcctctggtaaaacatccagccgtaagctcctatgataccgatgtcacatgctaatcttgctcgccaaccttacaggagctccccgaacttcccaaggcgacgaaccccctcgatgcggtacgaaacggccttactttcttcgaaaagctccagctccccgagggccattggggttgcgagtacggcggtcccatgttcctcctccccggtgttgtcatcgctcgctacgtcaccaagaacccagtcccttggtactatgctaccgagatcaagaactacctgtttgcgcgagcgaaccccgtcgacggcggatgggggctacacattgaaggcgagagcaccatgttgggtacgacgctgaactatacgacgttgcgccttgtgggtgtggaggcagaccatccggtcatggtgaaagcgcgagcaacaatgcataagatgggaggtgctatttacgcgccacactgggccaaattttggctcacggtattgggcattatgaaatgggacatcgtaaaccctgtcccgcccgagctttggcttctccccgactgggtgccgattgcgccgtggagatggtggattcatatgcgccaggtcttcctgcctatgagttacctatggtccaagaagtggcaggcggaggagacggacttgattcgggagttgcgcaatgaattgttcgtggaggactggaacaagattgattgggctggaaaccgcaacaccattcatcccaacgacaactaccacccaaaaaccgccttcctcaacaccgtcaactggcttcttgtaaacatctggaatcccgtcttccgaaccaagtacttggtagagaaggcagaggcatgggcgtcggagctcatcgacatggaggacgaaaacacggattattctgacctagccccggtcaacgccgcgatgaataccgtttgctgttatgttcgggacggacctggggcctactctgtacgaaggcatgtggaaaggctggatgaggtactctgggtcaacgccgagggtatgctctgcaatggcacaaacggcgtgcaatgctgggacactgcctttgcaatccaggctatcatggacgccggcctgactgaagacccacgctggaggccgatgcttatcaagtcattggaattcctggaggaccagcagattcgagaaaacgtcaaggatcaggataagtgctatcgccatccccgcaagggtgcttgggcatttagcaacaaggaccaagggtatgcagtcagcgattgtgtctctgaagcgttgaagtccgtcatcatcctgcaaaagacgccaggcttccctactctgattgatgaccagcgtatttttgacgccgttgacacaatgcttacctaccaaaacccatctggcgcctgctcatcctacgagactccgcgcgccggccagtggatggaggttttgaatgccgcggaagtgttcggcaacatcatggtcgaatatgaatatcccgaatgcaccacggccgttctcactacactctcgcttttcaagaaacactggcccaatcatcgcacagccgagattgacaacttcatcacccgcgctgtcaagtggattaagagcaatcagaagcctcatggtggttggtatggcaattggggcatttgcttcacgtacgccactatgtttgctttggagagtttggccagcgttggtgaaacgtatgagaacagcagatatgccaagaagggatgtgatttcctcgtcgccaagcagagggaggacggtggttggtctgagagctacaaggtaagtctcttcgtgcctggaccatcctagatcttgtatgaagctaaccagagagcaggcatgtgagacgggcgagtacgttgagcatccaactggatcccaagtggtcatgaccgcctgggcccttgttgggttgatcaaggccaaatatcccaataacgacccgatcaagaagggcatcaagttgatcatggaccgtcagcagcctaacggagagtggcggcaagaggctatcgagggtgtcttcaacaagagctgcatgatttcttacccgaactacaagttcagctttccgttgaaggcactgggcttgtttgccacacggtatccggacgagaaggtcgtttga

SEQ ID NO: 27070 - DNA, 992 bp, Neurospora crassa
gtccagcccaccgacctcaacggccgcgtagctgtcgtgaccggcggcgccttcggcatcggctttgaagtttctcgcgccctcgccaatgccggctgccgtgttattatggtgaaccgcaaggaagagcaaggcgacgatgccaaagccaccatcacggccgagacccccggcgcagtcgttgaatggcgcgaatgcgacatgggcaacctctcacaggttcgctccgttttctcggagctgcgcgagcagctcgaccggctcgatttcctggttctgtcggcaggcatcaacacgaaccagtacggactggacgcggacgggatcgatcggcactttggtgtgaactacttgggacagtattatgtggtcaaccagctctacccggtgctgaagaagacgagcaagttgccgaatacccccgcgccgagggtggtgtttgaggcgagcgagatgcatcgggcggcgccgagcgcagtgcattttgctagtctcgatgagatcaataacccggacttgggaccgacggagttgtacgggaggaccaagttggcgatgattctgtttgccaagtacgggctggcggagaaggtgattaagaagaacggagacaatatctatgcggcttcggtgcatcctggtgcagtaagtttattccttctctcgcatcagaaacattgcctctgttgatatcggcttgctaacgtggaatacaataacaggtcaacaccgccatgcaacaacaatggaaggacgcctaccccggcatcaccggcaagcttctcacatgggccacactggcctttggccgtgatgtgaagcaggggtcttatagtgccttgtgggcgcttactgaccccaagatcgaggaacagaacttgaacggatggtacttcagtgaccccgaccagcctggcaaggagacttcccaggcttccgaccccgttctgggtcaggctctctgggatctgagcgagcgtatcatcaaggat

SEQ ID NO: 27071 - DNA, 1395 bp, Neurospora crassa
ctcaaggccctcgacgccatgggctatgcaaacatgacgcccgttcaggaaaaggtcctcaacatgggctccttcacccaggactgcctcgtccaagccaagaccggtaccggcaagaccattgccttccttctccccgccttgcacacgctcttgaacgccaaggaccttgacccttcccaggttgccttgttgatcctggctcccacgcgtgagctcgcccagcagatcgtggatgagtgcgagaagctggtcagccagtgcaatccccgcttcgagtgccatcttgccgttggtggtagcgccaaggcctccagtctcagcaagttccttcgtggcaagcccaccatcctcgtggccacccccggacgtcttgacgattacctttccgacgagcgggtaaggcaaaagttcaacaacctccgctgcttggtcctggatgaggccgactgcatgcttgatcaaggctttttgcccgccctgaccaaaatcctcacaagcttgcctaagaagcaacaggctggctggcagggcatgtgcttcagtgccacgctccctccgtcgatccacaaagtgctgcaccacgttctcgctcccaagcacgctcacatctccactgtcgacgaaaacgaggcccccaccatcaacagcgtccctcagtcatacatgaaggtcgattcagttgacgatgtcctccccactctgcacaaccttctgtcagctgaacgctatgacaaccccaagctcaaggctgtcgtgttctgctcaaccgccagacaggccgctctgttgtacacccttttcggtcacacgggtggcgcttcccccgcgaagctacctgtgtggcagatgcaatcgcgcatgaaccaggcgcaacgcaccaggacgaccgaggagttcaagaacaccgacagcggtatcctctttgcctcggacgtggttggacgtggcttggactttcccgatatccaccttgtcatccaggtcggaattcccctcaacagcgagcagtacgttcaccgtgtcggaagaaccggtcgcgccggcaaaggtggccgcgccgtcatgattatcacccccgaagatttttggtttgtggagcgcaaccgccagttccccatggcccagtccaagctggaccatcccaaggcggccgccgtcgactcggcctcgatcatcagccagtcactggccaaggttcccgatcaggtcaaggcccaggcctacgttgcatatcttggcttcgtcaacactatgcgcagcaagatgaagatcactcccgcccagatggtccaggtcgccaatcgctacgccttctccctcggctgcgaggagcccccggccattgaggcgtctacaattggcaagatgggcctcaagggtgttcctggcctg

SEQ ID NO: 27072 - DNA, 816 bp, Neurospora crassa
aaatccgccatcatcaccggcgccgcccgcggtatcggccgcgccatcgcccaccgcctggccgccgacggctacgctctcaccctcaacgaccttccctcctcctccccttcctcttcctcttcatccgaccccgacgacgccctaacatccctctgccacaccctccactccctcggctaccccaacatccaccccttccccgccgacatcacctcgcccgactccgtttccgccctcatctcctcccatgtttcggttcacggctctctgtcaacaatggtcgccaacgccggcatcgtcgccgctcaaccccttctcaccgttaccccgcaggaccttctccgcatgtttaccatcaacgtcattggcgtcttcaactgctaccgcgccgctgccgagcagataatcaaacaaggcacctcgggaaaattgatcggcgcatccagcgtggctggattgcggggtttgccgatgctgggaccgtatgtggcgagcaagtttgcggttcgaggattgacgcagacatttgcggccgagttggcgggcgaggggatcacggctaatgcgtatgcaccgggggtggtggacacgaccatgtgggatacgattgcggagggggtgataagggcgggagggggcaacgcggaggaggacgaaggagcgaaggcccaggtgagcaagagctttgtggatacattggtgccgttgaagaggtcgtgtacgcccgaggaagtggcggctttggttgggtttttggcgagtgaaggggcggattatattacgggccagacgtatgctgttgatggtgggatc

SEQ ID NO: 27073 - DNA, 1509 bp, Neurospora crassa
atgtctggcctcggagttcccgccattcccgccaactacaccttctccccttccgagggcactccttaccttaccatcaaccacgatgtcgctgccgacctcgactccaccaatgcctttgaaggccccgagaagctcctcgaggtctggtttgcgcccagcgccaaagctctccctgccggtgtcaaggagggtggcctgaaggccgtcaatcctgactcgtggacccccatgcttgatttggttcactgcaaggtcctgtccatcatcaactccgagaacgtggactcataccttctttctgaatccagcatgtttgtgttcccccacaagatcatcctcaagacatgcggtaccaccactttgctgcttggtctggacttgatgttgcgcatcgccgccgtcgaggctggatttcctttccataacgtggcttcgttggaggaccccaaggttgccgctactcctctgcgcgtgttctatagccgtaagaactttttgttcccccagaagcagcgtgggccccacaagagctggagagatgaggttacctttttggataacatgttcgagaacggcagtgcctacatggttggcaagatgaacggtgaccattggtacctttacattacttcccccaccagctccctgactcctccacgcacccccacttccagccgtggtgtcagccctagtcgtaggtccaagattcctaccggtattgtggccccctttggaggtgtgatcgaaaacaacgcggacgagactttggagatcctgatgaccgacctggatcccgagaacgccaagaagttctaccttgaggaagcgaccgcgatcgccaaggagaagctcttttccaaatctgaggcgaacggagatgcctcttttgacgtcttcagcagctccggagactgcgatgctgatggccaggctattcttcccgaagcccttaccaccgagggtcacgccttgggtactgtcgtgtcggaagcatgcggtctttccgccgtgtatcccacctccacctatcctgatgctcgcatcgatgcgtaccagttctccccttgcggcttttccgccaacggtgttgtaccacctgtcgcgggcgccgacggcactatccccaagtccggccactacttcacggttcacgtcactcctgagccccagtgctcttttgcctccttcgaaaccaacgttcccggaggccagaatggacgccagacagctgaagttattgagcaggtcgtcaacatcttccgccctggacgtttcagtgtgactttgttcgaggccaagggcgcattggccaccacacctggcgaggatgctgatgattcccgtcgcagctggggcgccgctgctaagcagcgtatggagcgcatcaacggatatcgtcgcgttgaccgcattgttcacgatttcgaggattacgacctcgtgttccgctactacgagcgcgaagactgggttggaggtggaggagcaagaatgggcgaggagttc

SEQ ID NO: 27074 - DNA, 1057 bp, Neurospora crassa
ggcttcaagaaaaatgtcaaccgggcaacgacccaggtgatgatgaagacgggtcatgtcgagaagaccaacgatcgcgactatgaggttgaggagaggtatgattgttttcggtttagatacgacatgggaaggagagggacttgggctaagcgtctttgacatgcagacgattcaagactatggaggcggcatccctacgactacaaaaagaggccaagggttatcttgattcactacgaggtatgatagacacccacccgtcgctttggcagacgagtcatgtgagctaacgtcaatgtcccgggacagcaatgacggcctcacagatgcgcatcgccgaaactattgacgctttctacggtgaagctggtgctaaagacggagtcagcaagagttacaagcaagcagtggaagacttggacgccgaaacgatcaaggccttggacggaccatatcgaacaacagtcctagatcccattacccgattttgtgcctatttccccgacgttaacgaatgtaggtcttggccgtctccacctcttcatctccctggcaatcagttgattgctcttccgctcccgaaacatattcctccctttttctttgtcgacaacgccctgctgtccgtacataaactgaccgccatgaactcaaaaaaacaggcatcaagaagcgcggccacaaactcctcgactacgacgccctccgcgccaaagtcaagaaactggtcgagaagcccgacaaggatgtgacgaagctcccacgcgccgagaaggaaatggagatggccaaagcagcctacgagcagctcaatgagcagttgtgtaccgagctaccgcagcttatcgacctccgcgtcccttacctcgacccatcgttcgaggctcttgtcaagattcagctccgattctgcgccgaagcctacagccgcatggctcaagtacagcaatacctcgatccagacacgcgggagcagtacgcccagggtcagctagataccagggtcgagcaagtgttgcaggagatccgggaactgagtatcagcggaactgtt

SEQ ID NO: 27075 - DNA, 711 bp, Neurospora crassa
cgctgctgcctcaccggcttccgctggtccggcacgcccacaggcaccgccctccctgcaggttccatcccaggcaccaccaacgccgtctacaaaacgggcacgaacccgcgcgtcgccatcctgatcatccacgacatcttcggctggactttccccaacgtccgcctgctggccgaccactacgccgccgaagcgaacgccaccgtcttcgtcccggacttcttcggcggctttgtctgtccgcccgagttagtgctggaggagcgctggggggagatcgacattgcgcgcttcatgaaagagaatgcgcgcgaggtgcgcgagcctgaaatctttgcgtttgcgaaggcgttgaagagtgcggaggggggcgggtttgagaaggtcggggccgtggggtactgttatggtgggtgggcgattttcaggttggctgctgctgagcatgaggagggttctggggattctgaggggcacggcaagaagttggtggacgcggtgacgactggtcatcctacctttgtgacgaaggaagatattgagagggtttcaaagaacgtgccggtgcaggtgttggctccggagtttgatcaaaggtatacggaggagttgaagacgcatacgtttgtgacgctgcagaagctgggagtgccatttgagtattcgcattttccgggggtgcatcacggttgtttcatcaggggcgat

SEQ ID NO: 27076 - DNA, 1716 bp, Neurospora crassa
ttctcctcctcttcctcctcctccgctgatgcagggccggactcggactgggggtcaaccccggtatctatacgggataggctgcagaaacctccccagtaccccgtcaccaagatgagacagctgccgacagggcccccttcgagactgcccacagtacagaccaccttcggcccggagtctgacaatgaccgaaaggtacgcctcgagagacaagctgccgtcaaagatgcctttcttcgctgctggagctcgtatcgcaccaaggcatggatgagtgacgagctggagccagttaacggcggccgtaaggatacctttggaggatggggagcaacactggttgatagccttgacacgctatggatcatgggtttgaaggatcagttctacgaggccgttgctgcggcagccaacatcagcttcgagaccacctcccgagccgaaatcaacgtcttcgagacaaatatccggtatctaggcggcttcctcgccgcatacgacctcagcggggacaagaggttgctgcaaaaggccaaggaggtgggtgaggtcttgtacctggccttcgacactcccaacaggatgccccagacgagatggaatttccatgacgcttcccgtggagagcgacaagtcgcccatgatgctgtcctccttgccgagattgggtccttctctctcgagttcattcgtctctccatgttgacgggtgatcccaagtggtttgatgctgtgcaaaatatcatggaggctctccagaaacaacagcaaaagacacgccttcccggcatgtggcctgtcgtagtcgatgcaagacggatggactttggcagacacaaccattacacgctaggtgcaatggccgactcgctctacgaatatctccccaagactcatgcccttgtcggcggcttgctccccatgtacgccgacatgtacaatgcagctatggatacggccattcgctacaacctcttccgtcctatggtgcctgatcagaagaacattctaatggcgggcatggtcctggtcgggtcagaaaatggaaagagagtgacacagctgcgtccagaaggccaacatctcgcttgttttaccggcggaatgcttgctctcggaggcaaactcgttcaaaatgacacccatctccaaaagggagagcagctcatggacgggtgcgtgtgggcgtacaaatccatgcccttgggtataatgcccgaggtcttccacgtgctgccctgtgactcgaccgatcactgtccgtgggatgaggaaaaatggaagttggccgtcgttgaagaggctggctgggggctgtccgataacaaagaaaatgatttgcataaggcgaatagaatcattaaccacaaaaggctacctcaaggtttcgtctcgattccagacgcgcgctatatccttcgccccgaggccatcgagagcgtctttctcctttaccgcatgacgggtcgccgtgaccttccagactcagcctgggccatgtttcaggccattgactccaacaccaggaccgaactggccaactcggcgctgctcgacgttaccgtaaaggggggcaaaccacccatgatccattccatggagagcttctggctgggggagacactcaagtacttctatctcatgttcagcgagccggatctcatcaacctcgataacttcgtcttcaacacagaggcacatccattcaagcgc

SEQ ID NO: 27077 - DNA, 1054 bp, Neurospora crassa
gatatctccagccagctccatggcggttatgcccatcctcttgcccgctcgtggcaggccgagcgtcaactaacaaaggtgcgcttcccatcgcctctcttgtttgtttgatgactcttcgtcgctaaccaatcgcctttgcaaacagtccatgctcatctatcccctattcgtttccgataacgacgatgaagaggttctgattccttctctcccgaaccaatatcgccgcggcatcaacagactcgttcccttcctcgagccgctcgtccacaagggccttcgctccgtcattctcttcggcgtccctcttaagcccggtaccaaagatgcgctgggaaccgctgccgatgatcccgagggtcccgtcatccgcagcatccgcctgctgaggcaaagattcccccagctatacatcactgtcgacgtctgcttgtgcgagtacacttcccatggtcactgcggtattttgcgcgatgacggcagtctcaacaaccaattgtcggtcgatcgcatctcggacgttgctcttgcctacgccaaggccggtgcccactgcgttgctccttccgacatgaacgacggccgcattcgtgccatcaagctcaagctcatcgaggagggtattgtgcaccgtgtgacgctcatgtcgtacgccgccaagttctctggctgcctttacggtcccttccgtgacgctgccggctcatgcccttcgtttggcgaccgcaagtgctaccagctgcctcctggaggccgtggtttggctcgtcgtgccattgttcgtgacatcaacgagggtgccgatatcatcatggtcaagcccgcaagccagtacctggacatcatcagtgacgccaaggagctcggaaaggacttgcccgttgctgcttaccaggtcagcggtgaatttgccatgatccatgctgctgcaaaggcgggtgttttcgatcttaaggctatggccttcgaagccaccgagggtattctccgggctggcgccaccatcatcatcagctactttgttcccgagttccttgactggctctccaca

SEQ ID NO: 27078 - DNA, 823 bp, Neurospora crassa
tcggcatggccacgggacaacattcttcgacaatgcgcttccatcctgttgatcacccaggtcggtgctacgctcctatactgggtgtttagcgccttctcgtactattttatctttgaccgccgtctcgagtaccacccgcgcttcctccagaaccaggtacgccaagagatcatctcatccatgaccgccgtgccttggatcaacatcatgaccctgccatttttcctggcggaggtgcgcggaaagagcttgctctacactcgcgtggacgagtatggctgggcatggatggccatctcaacagtgctcttcatgatctggaatgacctcatgatttactggattcatcggcttgagcaccaccccagtgtctacaagtacattcacaagccacaccacaagtggattggtaggcgcacaccccctggacggaatcccagcgttttccagctaacacgacatagtgccgactccgtgggcagctctggcttttcacccactcgatggatatgttcagtccctcccttatcagtgagtttctcctgtcctctgggctccattgtgggcgaccttttaacgtgttgatagtgtgtttgtctttatttgtccggtgcaaaagtacttgtatatggttcttttcgttctggtgcaggtgtggacaattctcatccatgatggtgacatgatctcgggccactggcttgaaaagtatatcaacagcccggcccaccacacactgcatcacatgtatttcaccgtcaattacgggcagtattttacatgggccgacaactacttccagtcgcatcgggcgcctcgt

SEQ ID NO: 27079 - DNA, 1799 bp, Neurospora crassa
atacctctgtacaagatgggcttgtcactcaagaagcctgaaggtgtgccgggcaagtcatggcccgccattgtcattggcttgtttgtcgcctttggtggtgtactctttgggtgtgttcccacactcaagaccctcaaacaacgattactcgtgttgctgtaactaacatccatgtaggtatgacactggcactattggcggtatccttgctatgccctattggcaagatttgttttcgacaggttacagaaacccagagcatcacttggacgttaccgcgtcgcagtctgccactatcgtctccattctgtctgctggaaccttctttggcgctcttggtgccgctccccttgccgactgggctggacgacgcttgggccttattctgtcgtcgtttgtgtttatcttcggtgtcatcctgcagaccgcagccgtcagcattcctctttttctggctggccgattctttgctggattgggagttggtctcatatcggcaaccagtaagtcaactcgataactctgttcaacggtagtgctagaggctatcttgcctccaactgcgatcttgaaagagtgtttagtccatgtgacattgactaacacatattaaaagtccccctctatcaatccgagactgccccgaaatggattcgtggtgtcatcgtcgggtcctatcagctagccattaccatcggtcttcttcttgcctccattgtcaacaatgccacgcataacatgcagaacaccggctgctatcgcatccccatagctgtccaatttgcatgggcgatcatcctgatcgttggcatgatcattcttcccgaaactccacgctttcatatcaagagagacaatctcccagccgccactaggtctctagctatcctccgccgtctggagcagaaccatccagcgatcatcgaagagctttccgagatccaagccaatcatgaatttgagaagagcctcgggaaggcgacctacttggactgcctcaagggcaatttactcaagcggctccttactggctgttttctccagagcctgcagcagttgactggcatcaactttatcttctactacggcacacagttcttcaaaaactccggattctcagactcgtttctgatatccttgatcactaatcttgtcaatgtcgtgtcgacccttcccggactctacgccatcgacaaatggggccggaggcctgttttactctggggagctgttgggatgtgtgtctgccagttcatcgttgctattcttgggacaacaacgacaagtcaagatgcaagcggaatgatcattgtgcataatctcgccgcacagaaagcagctattgcattcatctgcttctacatctttttcttcgctgcatcttggggtccagttgcctggtaagtgatcccactctcctcatcacgccaatttctaccagcagctaactgttaggttccagggtcgttacaggcgagatcttcccccttaaagtccgcgccaagtcgctctccataactacagcgtcgaattggctgctcaactgggccattgcttacagcacaccttaccttgtcaactacggccctggcaatgcgaacctgcagtccaagatcttcttcgtctggggcggatgctgcttcatctgcatcgcattcgtttacttcatgatctatgagacaaaaggtctcacactggagcaggttgacgagctatatgaagaggtctcggatgccaggaagagtattggttgggtgccgaccatcactttccgggagatccgggaggaaaagaaa

SEQ ID NO: 27080 - DNA, 1694 bp, Neurospora crassa
tttgacaaatcctccgacccggaggctgtcaagaccgcccctgtggcggttagcgacaatgatgactccgtcggtgaggttcaagcagctgagaagttcgcctttggcgaagaccgaaagattggtatcaccggcgccgtcttcttgattctcaacaagatgattggtaccggtatcttttcgacaccttccgccattttcgccgctacgggctccgtcggtgtcagtctgttcctttggattattggtaagttgaaagttctcaccagtcttgcttcagccatacagttgggaaattcccatcttgctgagacatatcatttctcaccttgggggttactccgttctaaccatatgcctacataggtggcttcttgacctgctgcggtctcagcgtctggctcgaatttggtcttgctattcctcgctccggtggtgagaagaactacctcgagtacatctacaagcaccccaagtacctcgcctcctgtgttctcgccgcccagatgatttttctcggtttctcctccggaaactcgctcgcctttggtcgctacatcctttacgccaacagcggagattcaaaagacagctacgcagctcgcggtattggtgttgcctgcgctacctttgcctgcgccctgcacgccttccttcctaagtggggtgtccgcttggtcaatgtccttggcatcttcaaggttgtcatcgtacttttcattgtcttcgctggttttgccgccctagctggccatcgccacgtccccgatcccgagaacttcaagcacgccttccgcattgaaacgaccgagtcctacggtggtggcggtgcttatgcttactccaacgccctgctcaacattgtctacagctacaagggttgggaaaacgccaactattttatgagcgaactcaaggatcctcgccgtaccttgaccgtcgccgctcccatcgccgttgccggtgtcactgttctctacgtcttggccaacgttgcctacttcgctgctgtctccaaatacgaaatcgctacctctgaggttcttgtcgccggtattttcttcagaaacgttttcggtgacagcgctggtgtcaaggcccttcccgttttcgtcgccctcagcaacttgggcaacgtcttggctgtctctttcgcccacgctcgtctcaaccaggagttgggcaaggagggcttgcttcctcttagcaaattctggggctccaacaagccttgcaatgcccctgcagcttcgcttttcctgcactggctgatcactatcatcatcttgcttgctcctcctcctggacctgcctacaactttctggtcaacctctacacgtaccccggtgtttggatcaacggtttcgtttctggcggtctcatctacctccacttcttccggagagatacctggaagcccacgtggcgctgctgggagcctatcctctttatcttcttccttctcaacgtcttcttggctgtcgtccccttcatcccccctgttggagactggaacgccgagggctacccctactacgtcttccccatcgtcggtgttgctgttctgctccttggtgcctcctactggtttatgtggaccaagttctggccctgggttcgcggacacaagatcgtggcggagagattcatcgacgaggatggcaatgaggtcatcaggtacaagaaggttaag

SEQ ID NO: 27081 - DNA, 999 bp, Neurospora crassa
acgatgcgcgcctggcagtattcacagaccacgggtggcctggaacaaaacttggtgctcaaggacgatgttcccgtgcccaccctctcgccgcgtgtgggagacaaggagctgctcattgaggttctcagcgcgagcatcaacccttcggactacaagatcgccgaactgcccctgaatctgggccgtgctgtcgttcgcacgcctgccactcccgcctgggacttttgcggccgcgtcgtcaagaccaccaacatcgtcgacaactttcgtgtcggcgagattgtctttggccgacaagcccctactcagcacggcgcttgcggccagtacattgtggcaagcgcaaatgcttgtgcctccctgccctcgggtgttgatgttgacgaggctgcctctctgccctgtgctggattgaccgcctatcagaccattgcccccaacgtcaagcctggcgacaaggtcttcctcaatggcggttccggtggtgtcggctcctttggcatccaaatcgcaaaggccctcggctgccatgtcaccgtctcgtgctctgccgccaaggccgagcaatgcaaggctctgggtgccgacgacatcattgactatacagctgtcgatgtctgccaggccttaaaagagcgcggtcaggtcttcaagctctctgtcgacaatgtcggtcttccggcggaactgtacaaggccggcgatgactatctcctgcccgatggaaagttcgtgcaggtcggtgggcctgtgtccttggctgccctatcttcaaccatgtccaggctattaagaccctcgtttctcggtggcggaaaacgcaagtttcagttgtacactctgatgggcgatcaacaccaagacttggctatactcggccagatggtcgcagagggcaaaatcaagcctgtagtcgagcatgcctatgattttgaggatgtcccgacagccttcagggacctcaggaagggcaagactcatggcaagctggtcatt

SEQ ID NO: 27082 - DNA, 1516 bp, Neurospora crassa
atctgctgtgttggcgctggctatgttggtgagtcttgccaaactgtgagggttacagtcgagcgttcgtagactaatagatcttcaggcggccctactgcggctgttattgcctttaataacccccatatccgagtgacggttgtcgacaaggacgagaagcgcattcgacgatggaactctgtacatccccccatctacgagcctggcttgaaccacattctgcgcattgcccgtgacggatccaaggaatgcaccatcgagactaggtccctctccacgaccaacacaacatcttcgaatacgccagatgtatcggatgcgtccactccggcctcagaatgcggcagccagtgcggagacaatgtttcgaagcctattcctgcccgccagccaaatctcttcttcacagccgatgtagccaagtctatcagcgaagccgacatcgttctgattgcggtcaatacgccaaccaagagccgtggtgccggcgcaggttctgccacggacatgactgccttcgaggctgtcaccaatgtggttgcgcagcatgcccggccgggtgccatcattgtagaaaagtctacagtcccctgtcggacggcgcagtttgtacaagacactgtaaggacaaccgatttgtgtatgtaaagggattggctcgctaactgtgccccagcttgcactccataggcccggtattcacttcgaggttcttagcaaccccgaatttttggctgccggaactgctattaaggatcttctcaacgcagatcgtattttgatcggttccagtgcaacaccatctggtcagcgcgcagccgccgctttagcatctgtctactccgcttggatcccaaggtcacggatcatcactactaatgtgttcagctctgagcttgccaagcttgtcgcgaactccatgctcgcccagcgcatcagcagtatcaactcgattgcggccgtgtgcgaggtgactggcgccgatgtcagtgaggttgcaggtgcgattggtgccgacccccgtatcggcagcaagttcctcaaggccggtatcggtttcggtggcagctgcttcaagaaggatgtgctcagtctggcttacttggccgagagcctccaactacccgaggtagcagactactggcgaaatgtcatcaccatgaacgagttcgccaggaacaggttcgcttcgcgtgtcgtgaggtgtctcaacaacaccctcattggcaagaaactcaccatgcttggctacgccttcaagaaggataccaacgatacccgtgagtcgccagcggtggagattatccgaaccttggtggaggaagggcctcgggagattgccgtctacgacccctgctgcaacccagcgcagatggccgaggatatcggtcgctatgtcggcgccgaggtactacagagaaacggaggccctgtcattgtctacgcagacgcttacgaggcctgtcactcctctgacgcgctactaattaccaccgagttcgatgagttcaag

SEQ ID NO: 27083 - DNA, 765 bp, Neurospora crassa
cccgccgtcggattcggcacctttgccaacgagggtgccaagggcgagacctacgcggccgtcaagaaggccctcgaggttggctaccgtcacctcgactgcgcgtggttctaccagaacgaggacgaggtcggccaggcgctcgccgagttccttgagaaccacaaggacgtcaagcgcgaggacatcttcatctgcaccaaggtgtggaaccacctgcacgagcccgaggatgtcaagtggagcttgcagaactcgctcgacaagctcaaggttgactacgtcgacctcttcctcatccactggcccattgccgccgagaaggacgaggccaccaacatgcccaagatcggccccgatggcaagtacatcatcaagaaggagctcaccgagaaccccgagccaacatggcgggccatggaggatctcgtggatgccggcaagacgcggtccattggtgtttccaactggaccatccccggcctgcagaagctcctcaagtttgctcgcatcaagccgaccgtcaaccagattgaaatccaccccttcctccccaacacggagctcgtcgagttctgcttcaagaaccagatcatccccactgcctactctcctctcggctcgcagaaccaggtcccatcgacgggcgagcgtgtccgtgatgaccccactctcaaggccgttgctgagcgcagcggacacaaccttgcccaggtgctcctcgcctggggtctccgcagaggctacgtcgtgctccccaagagc

SEQ ID NO: 27084 - DNA, 960 bp, Neurospora crassa
accaccacgacactacagcttaccaaggtctccgtcctcggtgccgccggtggcattggccagcccctctccctcctcctcaagctcaaccccagagtctccgagctcgccctctacgatatccgtggcgcccccggtgtcggtgctgatctgtcccacatcaacaccaagagcaccgtcaagggctacgagcccaccgcctccggtctcgccgatgccctcaagggctccgaaatcgtcctcatccccgccggtgtcccccgcaagcccggcatgacccgtgacgacctcttcaacaccaacgcctccatcgtccgcgacctcgccaaggcctgcgccgagtcgtgccccgaggccaacatcctcgtcatctccaaccccgtcaactccaccgtccccatcgtctccgagatcttcaagaaggccggtgtctacaaccccaagcgcctcttcggtgtcaccaccctcgacgtcgtccgcgcctcccgcttcgtttccgagatcaagggcaccgaccccaaggacgagaacatcaccgtcgttggcggccactccggcgtcaccatcgtccccctcttctcccagagcaagcaccccgaactctccaagaacgagcagctcatccaccgcgtccagttcggtggtgacgaggtcgtcaaggccaaggacggtgccggttccgccaccctctccatggccatggccggtgcccgcatggccgagtccctcctccgcgccgcccagggcgagaagggcgtcatcgagcccacctttgtcgactcccctctctacaaggaccagggcatcgacttcttcgcctccaaggtcgagctcggccccaacggtgttgagaagatctaccccgtcggccccgtcgatgaggttgagcagaagctccttgatgcctgccttgttgacctcaagaagaacatccagaagggcaaggactttgtcgccgcc

SEQ ID NO: 27085 - DNA, 1674 bp, Neurospora crassa
gatctgggcggtacagcccgaaccctggaccgggccgacgggcgcattcctctcgagccgggcatcttgtcacgcaaagcctacgccgtgctcgatgacagcgcctccatgctgttcgaagatggatggatcgcaaccaggaaaccgggccgcaaggatggctatctctttgcctaccacggcgatcacaaagctgccatcaaggacttttaccgtctgtcgggcggtcagccgttgcttcctcgatgggctcttggaaactggtggtccaggtaccatgcctactcggacaaggaatacctggctgtcatgaggaggttcgcaaccgagaaaatccccctcagtgttgccgtgatcgacatggactggcacaaggtcaacatccctgccaagtacggttccggatggacaggttacagctggaatcccgacttgttccccatgcccgaaaacttcctctgcaatctccatgacatgggtctcaaggtgactgtcaatgatcatccggcagacggcattcgggcctttgaagaccaatacaagattgtggccaaggccctgggtcacgacacgtcaaaggaagaaccgattcggtttgattgcaccgacaaaaagttcctcgacgcttactttgatattctcaaggccaatttggaggatgagggcatcgatttttggtggattgactggcaacagggcaaccgatcgcgcattcctggcgttgaccccctctgggtgctcaaccactatcattaccttaccagccgtcgcaacgtcaaagctactgcgacgcccatcactttttcccgttacgccggcgccggctcccatcgctatcccatcggcttctctggcgacacgctcatcacctgggcctcgttgcacttccagcccgagttcacagcgacagcgtccaacattggctatggctggtggagtcacgacattggcggacattacgctggtgtccgctccaacgagctgacggcgcgctgggtccagtttggctgcttctcgcccattttgaggctgcactcggaaaagagtcagtggaactccaaggagccatggctgtacgagcccgaagcccgcaaggtgatgacggactacctccaacttcgctaccgcctcatcccgttcctctacaccatgaacgtgcgcgcctgctatgaattcgagcccctggtgcaacccatgtactggaaccacaaggacgaagaggcctacacggtgcccaaccaatactactttggtcccgatctgatggttgcgccaattactacgccaaacgatccagccacgctcatgggcagcgtccgcgcctggcttcccaacacgggccgtcgttacattgacattctccagcccagtctcgtctacgatggaggccgctacgtggacatccaccggcctctgtcggagattcccgtctttgccaaggagggaaccattatcccgctggacacggctaaatctgcgaaatacgacaaacacggtaatagccggccccaagcgatcaccatccaacttgttgttggcgcagatgcctactttgagctggtggaggagccaagcagtaccgtgccagcggccaaggctgaccggcctgacccctccactttggtgcgcaccccgatccggtggaatcaaaaggagggcgttcttagcattgga

SEQ ID NO: 27086 - DNA, 1461 bp, Neurospora crassa
ctggctgtcctttccttctcttcattccttgtggatgctgcgcctgcgcctatgtgcccgggcaccaacgttacctctacctctgctgacaccaacgtgactgtccctgatcgtgcagacagtagcggatacaagaacgttgtgtactttacaaactggtatgtgcctgcctagaggtatcctcaaccttcgggctgaacagcttgctgactttcctttcctatccaggggcatctacggccgcaactaccaggctgccgaccttccagccgacaaaatcacccatgtcctgtactcctttgccaacctcaaagaagacggaactgtcttttcctcagacacctggtctgacacggataagcgctatcccactgactgtacgtgttttcatccccaatcttctttcctaggtcgtcaacaacataacccacccagtcttctaacacaacaatcccagcctggaacgacaacggcaccaacgtctacggctgcgtcaaacagctctacctcctcaaaaaagccaaccgcaacgtccgcgtcctcctctccattggcggctggacctactcccagacctctcccagccgcttcgcgctgaccgcctccaccgccgaatcccgcaccaagttcgccacttcggccctggccctcgtcaaagactggggtttcgacggcatcgacatcgactgggaatacccggcctcggaaaccgaagcccaaaactttttgcttttgctcaaagaaatccgctcgcagatggacaagtacgcggccgcccacgccgacgggtaccacttcctgctgaccatggccgcctcggcgggtccgtccaagtacggcgtcttggagtcgtcgatgaaggaaatcggcgagactttggactttatgaacctcatggcctacgactacgcgggcgcgtgggataagaaggccggccaccaggctaacttgtacccggacgagaagaacccggacacgacgcccttctcgaccgatcgggccgtcacggactacatcaagttcggcatcccttccaacaagatcgtgctgggcatgccgctgtacggccgcgcgttcgcgtcgacggatggaccgggtaccgcctactcgggcgtcggcgagggatcgtgggagaagggtatttgggattacaaggtgttgcccaagagtggagccaaggttttcctggatgaaaaggtcggcgctagctggagttatgatgagacgaacaaggtcatggtcagctacgatacgcccgagatggtcaagcagaaggtgagctacatcaaggagaaggggctgggcggtgccatgtactgggaggcgtcgggcgatcggacggataaggacagcttgatgacggtggtcaaggatgggttgggaactttggacagcgagaagaacttgttggagtatcccgacagtcagtatgataacatgaagaagggcatgtcttcgtga

SEQ ID NO: 27087 - DNA, 1513 bp, Neurospora crassa
atgtccaataccgacttcctcggccgcgccatcgagcaagtgcgcaaagccatcgaagccgacaacgccgcccagtacgacaaagcctaccagctgtactaccaatcgctcgaactcttcatgctcgccctaaaatgggagaagaacccgaaatccaaggagatgatccgggccaagacgggcgagtacatggaccgggccgagaagctcaaagcgcacctggcggacgcggaagcgaagcggaagaagcccgggatggtgggcgcgaacgggggttcgacgggcgggacggggaaggggaaggaggccggggaggacggtaatggcaatggagaagcgttggatgaggatagcaagaagctgagaagtgcgttggcgggcgcgattctgcaggaacggccgaacatcagctgggatgatgtggctggtctagagggtgccaaggaggccctcaaggaggcggtcttgttgccaatcaagttcccgcatctgttccaggggaagaggcagccgtggaagggtattttgctgtatggcccaccgggaacaggaaagagttatttggccaaggcagtggcgacagaggcgaagagcacgttcttcagcgtgagcagctcggatttggtgagcaagtggatgggtgagagtgaacggtatgttttgtcctgttgtctctgtccttatgccactatcgtgactgagaagctaacgattttccaacaaaaaacagtctagtaaagcaactcttcgccatggcccgagaaaacaagccctccattatcttcatcgacgagatcgacgccctctgcggtccgcgcggtgaaggcgagtcggaagcctcgcgcaggataaaaaccgaacttttggtccaaatggacggtgtcggcaaagacagcaagggcgtgctgatcctgggcgccaccaacatcccctggcagctggatgctgctatccgtcgccgcttccagcgccgcgtgcacatcactctgccggacctggcggcgcgcaccaccatgttccggctggctgtgggcgacacccacacggcgctcaaggcggaagacttccgcgagctggcgcgcgcggcggagggttattcgggttcggatatcagtattgttgtgcaggatgcgttgatgcaaccggtgaggaagattcagcaggctacgcatttcaaaaaggttcgttcttttttgtttttctcttttctctcccatccctgaccctcaacccctacttctacctctattcatgatgcgagattgttaacttttgttactacaaaaaacaggtcgtccacgaaggcaaacaaatgctcacgccctgctcgccaggcgatccggacgccatcgaaatgacgtgggagcaggtaccctcggacgagctgctcgaaccatttgtcgacaagaaggactttatcaaggccatcaaggccagcaggccgactgtgtcgggcgaggatctcaagaggaatgaggaatggacaaaggagtttggtagtgagggtgcgtag

SEQ ID NO: 27088 - DNA, 2638 bp, Neurospora crassa
gactcgtcacaagggttcgaatgggatgacagccagcaacaacttacgataacgggaaagaggacaccgggtctaaatgtgtgggataccgcctgcacagcggagaacaacaccctcttttcgaccacactctatcgcgcggccgccgagattcgggccaatcagacaccggtcgatgcggcaccgtgttggagacccggggcggttcccattcagatacaggactatgaaaactggcaagagcatgggtgtaaagatgggtttctttgtacgttgatcctgataccttccctcacctctcccttgtcgactactggcaaaccttaacacgctgctcacaggttcaaacaacaccgtcaactcgttgccacagtactgtactcccatcaccgaatgccagcttgccagactagggggcatcgactgcaaactgaatggcgtcaatattggcatgggtccttttgagcccgtcatctgccaggctggatggtactgccctcgagaagagaagggaatggtcaccctcaagtgtccatctggccattactgccaggcaggcgcacctacacctacgccatgtgcagttgggagcaggtgcccagagggctcgtcctttgaacgttaccttcttcccattgtccttctcctcgtcatagacgtgttgctcatccttgggatgatccatctcggtatccggaagagacgccgcaattcctccgccagcgccatccgccaaaatcacttcgcagctgtcattggtggttacaagcaggttgcgaagaaacgccatgaggaagtcgaccacgagccagcgctgcggagccaagtcgagcgtcaagacacctttaggggtctcggcgatcagctccacgagcaagcgcctcctctcagtcacagaaagaccgtccgccacaaccctgaccccgaagtctcgcctactatcagagcctttgtcgtctcaatgcgcaaagccacctctgcttcagagtttggtctgtcgtttggctacgaccaactgacctttgcactcaaaaacagcaagaggccaatcctccagaatgtcactggatctatcaacagcggaagcctaacggcagtaatgggcggttcaggtgctggcaagtcaaccttcatcaacgttctcatgggcaaggcgcagtataccaaaggcagcgtcacggtcaacggcatcccgggaaagctcaagcagtataagaagctgattgggtacgtgcctcaagacgacattgtcttacctgagttgaccgtctacgagaacatcatgcactcggccaagattcggttaccgcgcacctggaaagattccgatgtcgaaactcacgttaatgttgttatcgactgtctggaactctcccacgtacgtgacagcttagtcggcagcgttggaaagcctgtcatcagtggcggtcagcgcaagcgtgtgagtattggcatggagttggcggctgctcccatggccatcttcctggacgagccgacctctggtctcgatgctacttcagcgagctctatcatgagcacactcaaggctcttggaaaactcggtataaccgttatcgtcatcatccatcagccgcgagtggagatctttgagatgttggacgatatgatcctcctcggaaatggacagctaatatacgaaggacctcagagtcaagcgaagaccttcttcgaacagatgggttttgtgttccctcctggtgccaactgcagcgacgttatcacagatatcatcacaggaaatggtcggcggtacaaggaggagggagatatatccaaagatgctctcattgcccaatgggcccaaggctccagagtgagcctcctgaccaatgaaagcgtggatacgttctggcaatctagtcactcccgaaacccatctgacatgaccctggccggcagcgagagcagcgacgccgacacatcccgccacaatcgatcttctctaatgtccatcagcaagctcaaagcaggcgcacgtatctcaatgctgtccatctccaaccctcagctatcccgcatcctgaagcatcgcggcgcccctcgttggcgacaaactttgctatgcctatcgcgctctattctccagcagtaccgcacccgctccaatttgtggttcgaaataggcctctctactcttgcaggcgtcttgctcggactcgctcaaaagccaaaaaatggcgccttctttcgaggccagtacaacaagccatacgaaatcctgtctctttcagcagactatgttgcggccccgcagatggcgatgctcatcaccctagccattggtctttccagtgccgcgccaggcgttaagcttttctccgaggatatgctcgtgtaccgccgcgaggcggaggctgggcactctcgagtggcatacttccttgcaaaaacgatcagtgtgcttccaaggatggcattggcttgcttgcacttctctgctccgttgtttctgattagcatgcctgtaattccgttctggacggcattcttagccaacttgttatatgtgtattgcatctacggattggctagctgtatgagtatggtggtgagacgggaggatgcgccgctgttggcgacgatggtcagcttgattgtcggcatcttaagtggt

SEQ ID NO: 27089 - DNA, 2713 bp, Neurospora crassa
agttccccgcttcgcgacaacccgtcctctgccaaccgtggcgccgttcccagggccactcgcaagcgtgcgcgtaacgatcacgatggtgcttcctcgcttccccgcgcttcgagccctgtcatgccctcttctcctcccgccttcccagttgcccatggcgcagatgaggacgacgacatcgaggaagacgtcgccgctgaaatcgaagacgacattgacgacctcgacgagttggccgaagacgatgtagatttgttccgcgaaggcttcgagcgcgattatagggaacgagacgaaaacgacgcctacgaaggaattgacatcgacgatgacgagtatgaggccctcgaccccgccgcaaggcgccgtcttgaagccaagttggcccagagagaccgtcaagtgaggatgggaatgggcaccacgtatcttcctggtgatgacgacgatggtgatatcgaccttaccaacctggaacgccgccgaagaatccgctacaatgaagaccccgatgtcgatatggatggcgacattatggactcggaacttcccctcgaggccctgatggatgtcaaggctgccactttgagcgaatggatctcagtcccggctgtacaaaagaccatccgcagagagttcaaggctttcctcacagaatacaccgacgagagcggttcgtccgtctacggcaaccgcatccgtactcttggtgagatcaacgccgagtctctcgaggtctcctacgagcacctcgctacagccaaggccattctcgcatacttcctcgccaatgcgccaaccgagatgctcaagctcttcgacgaggttgccatggaagtcgtccttctccattaccccgactacgagcgcattcacgccgagatccacgtccgtatcttcgaccttcctatccattataccctccgtcagctccgccagtcgcacctcaactgtcttgtgcgcgtgagcggtgtcgtcacccgccgcaccggtgtcttcccccagctcaagtatgtcaagttcgactgcaccaagtgcggcgtcactctcggtcccttccagcaagagtccaacgtcgaagtcaagatctcttactgccagtcctgccagtctcgtggccccttcacccttaactccgagaagaccgtctaccgcaactaccaaaagctcaccctccaagaatcccccggcaccgttcccgccggtcgtctgccccgtcaccgcgaggtcattctcctctgggacctgatcgacaaggccaagccgggcgaggagatcgaagtaacgggcatctaccgcaacaactacgacgcgcagctcaacaaccgcaacggcttccccgtcttcgccaccatcctcgaagccaacaacattgtcaaatcccacgaccagctcgccggcttccgcatgaccgaggaagacgagcacgagattcgccgtctctcgcgcgacccgcacattgtcgacaagatcatcaactccgtcgccccttccatctacggacacaccgacatcaagaccgccgtcgccctctccctcttcggcggcgtcgccaagcaagtcggcgcccaccacatccgcggtgacatcaacgtgctgctcctcggcgaccccggtaccgccaaatcacaagtactcaagtacgccgaaaagacggcccaccgcgccgtcttcgccaccggccagggtgcttccgccgtcggtctgacggcttccgtccggcgcgacccgctcacgtccgaatggactctcgagggcggcgccctcgtcctcgccgacaagggcacctgcctgatcgacgagttcgacaagatgaacgaccaggaccgcacgtccatccacgaagccatggagcagcagaccatctctatctccaaagccggtatcgtcacgaccctgcaagcccggtgcggaatcatcgccgctgctaaccctattggcgggcggtacaactctaccattcccttttctgccaacgtggagcttaccgagccgattctgtctcgtttcgacatcctttgcgtcgtgcgcgacacagtcgagcctgaagaagatgagcggctggcgcgcttcattgtcgggtcgcattcgaggagtcatccgttgatgaacaacaacacgcaggacgctagcggtggtgactccatggaggttgaacacgatacccaagctgctgcggaaacccaacaaactggtgaacacggccgtaaaaaagagggcgaaatcccacaagagctgttgaggaagtatatcctttatgcccgagagcggtgccagccaaagttgtatcacatggatgaggataaggtggcgaggctgtttgcggatatgagaagggagagtttggcgacgggggcttatcctattactgtaagttcttccctctttcctttttccttttttttttttttttttttttttttttttttttttttttttttttttttctttcttcctccgtcacaaaatacaacacaataacaactgctaacctcacccaccaccaccttaggtccgtcacttggaagccatcatccgcatttccgaagccttttgccgcatgcccctttccgagtactgctccgcccaggacattgaccgcgctatcgccgtgaccgtcgagtcctttgttggctcgcaaaaggtcagctgcaagaaggcgcttgccagggcttttgccaagtacacgcttaacaggcctggtactggt

SEQ ID NO: 27090 - DNA, 2487 bp, Neurospora crassa
cgcttttcccacctctacacccgactactctccctcccggtgctcaaccaaaagtgggccatcctctactttctataccagctctcggactcgccagaccccaatgagcccctccctttaagcccgcttgcccgacagcaacctcatttcgaccctcagttccacccccagatccaggcgcaaacacctcctcaaccgtcagcatggcctgccgaacccaggatcccggcatatgacgaggttcaggatgaggaggtcatggaggatgccccttctcccgaaggctctcacaatctccccccagaaaggccaagacatggtcgagaccaaggtcatacgcctgtccagagtcaccaggctggccctgcttcaagagacgaaagggatgtggcgcatgacccttcggagccggccttgttgagggacctgcccttcaccctgcagggcctttcatcggcaactctcccctttctcaacgacacaacgttgaagctaccaccaacgcttcctatccccatcatctctcttctcaacacgctggccgagccttcgcttctctacagaggactaaacgagtttaccaaaacgccggcaaacggactactgggccagagtctacgggctgccatcagcaaggagcttcggtcatatttgactctggtggctaccctggagactcaaattcgccgcgctctctctgagcttgacgagtctgctccccgtggtggcattggaaaaacgggcgttacgctcaagcgatgcgtggtatggacccgtgaggctactatgggcttgcgcctcatgtctctgattgccgaggagagcaagaataagcatggtgggcagttggtcaccctgatccacaacttttcgtcttcacacggcgatcctgtcgtagctgcattcgctgagcgcttgcttgttgacgtgactcggccattctacgatatcctacgccgctggatctatgacggagagctcctcgatccccatatggagttttttgttcgggaacagaaccccctcgatgaggagaggaaagacgccaaagctaagggccaaatgagtgtctggaactccaagtatgagcttgttgaggacatggtcccgagtattatcacacgcaactttgctgacaaggttttcctcatcggaaagtcccttaacttcatccgccacagctgcggtgatcacaaatgggtcgaggactacagtaaaaatgcgtccagggagctcaaatatggtgacacagctaccctggaagcctggattgacgaggcacacagggagacaatgagccatcttatgcgcctcctaaatgaccaattccgtgtctttgatcatctagaggcgctgaagcggtacattctgctggggcagggtgatttcattgctctgctgatggagtcgctggctcctaacctagatcggccagcgggcgcccagtatcgacatacactcactgcgcagcttgagcatgccatccgaggctcaaacgctcaatatgatgatccagaaatcaccaatcgcttggatgctcgcatgcttcagcttagccatggtgatatcggctgggactgctttacgctcgagtacaagattgacgcgcccgtggacgtcgttgtcaccgagtggggcaatcgacagtacctcaaagtcttcaacttcctttggcgtatcaagcgtgtcgagtttgccctggcctcgacctggcgcaagtgcatgactggcgcccgcggcgttctccagacgtcggacgagacggtgcttcaaacatggaagagcacacggggtgtcctcgccgagatggtccattttgtcggccaattacagtactacatcctctttgaggttatcgaaagcagttggaccgaactgcaaaagaacattcacaaggagaactgcacgctcgacgacctaataactgcccataccaaatacctcacatctatcacacacaagggtctcctcggtgccaaacgacgaccgtacccgcagacaggcgaccctgtctcagcatcttccacgaccgacgaagatcgcaactcctacatggtccagctaagcgagctgctccggataatgctcgcctacagagacagcgtagacggtctctacagctggtccgtctccgactttacgagacgtcaggagaaggagacagccgggctgatctactcacaccgcggcgggagcacccgaaccacgacgcgagaccgagcagattcccaagctgcgtcgtccatggctgactcgatggatctcgatccgccatacgagtacttcgacgccgcggccaccagtgacgcgggatcagttaagagcgagttcccagcgttgcaggaccggttgaagcaattgggcgccaattttaagaccaggttgcagattctcttgggagatttggcgtaccagccggatgtggatatgcggttcttgggagtgtcgatgaatttcaatgatgtgtatcaacctgtgaggaggaag

SEQ ID NO: 27091 - DNA, 1326 bp, Neurospora crassa
catatcgaggtcacccctgataacaacggcaacctgttcttctggcacttccagaacaaacatatcgccaacaaacaacgaaccgtcatctggctaaatggtggtcctggttgcagttccgaggatggcgcattgatggagattggtccctacagactgaaggacgaaaacaccttggtatacaacgatggcgcatggaacgagttcgccaacgtcttgttcgtcgacaaccccgtcggcactggcttcagttatgtcgacaccaacgcctatatccacgagttgaccgagatggccgccaactttgttacctttttggagaggtggttcgctctgttcccagagtacgagcatgacgatgtaggtgccacactctgaacctcttcgattcgttctgtctaaccgatttctcagctttacattgccggagagtcttacgccggtcagcacattccctacatcgcccaagctattctcgaacgtaacaagaacgctggtcccgtcaatcgcaaatggaacctctcgggcctcctcatcggcaacggctgggtttcccccaaagagcaatacgacgcctacctccagtttgcctacgagaaggacatcgtcaagaagggtaccgacctcgccaacaagctcgaaatccaacagcgtatctgccaaaaggaaatcgccgtcaagcccgacaagatcgactaccccgaatgcgaagctattttgcaagacatgctccaactgactgctggcggcgtcggcgccagcggcaagaaccaatgctacaacatgtacgacgtccgcctgaaggacgactacccctcatgcggcatggcctggccccccgacctcaagagcgtaaccccctacctccgcaagaaggaagtcatcaaggccctcaacatcaacgataacaagtctaccggctggactgaatgcaacggccaggtaggcatgaactttaaccccaagaccaagccgtccatcaccttgcttcccgacatcctctccgccggcgttcccatcctgctcttctccggcgccgaagacctcatctgcaaccacctgggcaccgaagccttgatctccaacatggaatggaacggcggcaagggcttcgaactcaccccgggaacctgggcgccgcggcgcgactggaccttcgaaggcgaaccggccggcttctggcaacaagcgcgcaacctcacctacgtgctcttttacaactccagccacatggtccccttcgattacccccgccgcacgcgcgacatgctggatcggttcatgggcgtggatatcagtagcattggcggacagcctacggactcg

SEQ ID NO: 27092 - DNA, 584 bp, Neurospora crassa
aggaagcagtggcgaaaggaccatccctttggcttctatgcccgtccccagaagaaccagcagggtgtgctcgacttgaagatttgggaatgtggtattccgggcaaagaaaagacaatctgggagggtggtctgttcaagttgaccgtcacgttccctgatggtatgcgccctgcaccggtcggtgtctttagtcagaagaatacacgtgctgacttgacgtttcctgcatgcagaatatcccacgaaaccccccaagtgtacgccgaaagctagccctcgtccatccccccttgctacgatcacatggctaacatgttggcgtctgagcaggcaaattcgtcccccctcttttccaccccaatgtctacccatcaggcacggtctgtctctcgatcctcaacgaagaagaggcatggaagccggccatcacgatgaagcagatcctgctcggcatccaggacttgctcaatgaccccaatcccgagtccccagcccaggctgaggcgtacaatctcttcaagaaagatcgtcaggaatatgaacgtcggatcaagcgcgtcgtgcgggagaatgccgcccca

SEQ ID NO: 27093 - DNA, 1328 bp, Neurospora crassa
atgaacggctacgacgagaagcgtcaactagacgaagacgcctttggcgccaaggggagcatagtcagcgcctttgacgctttccgtacgtccctccctcccctccctcccacatccaatgcgctttcatacatcttcaaataaactaacatgaaagtcctacctactactacacagccaaatccaaaccccaatacgtaacccgcaccaccgccggcggcaaatggaccgtcttcgtcggcctcatctccttcatcctcttctggtccgaagcctcccgctggtggcgcggctcggaatcgcacacctttgccgtcgaaaagggcgtctcccacgccctcgacatcaacctcgacattgtcgtcaaaatgaagtgccaagacatccacatcaacgtgcaagacgcggccggcgaccgcatcctggctgcctcccggctgcatcgcgacccgacggtgtggcagcactgggtcgacaacaaggggattcacaagctgggacgggacgcccagggcaaggtggttacgggcgaggggtacatgcaggggcaggggcatgacgaagggtttggggaggagcacgtgcatgatattgtttctttgggcaggcggaaggccaagtgggcgaggacgccgcggttgtggggggcgacgccggacagctgtagggtgtttggcagtctggagttgaacaaggtccagggcgactttcatattacggccaaaggacatggatatatggagtttggccagcatttggatcattctggtttgttttcttttctctttctcttacctttgccgaaacttcaaccatccaactctattttccacaacaacagctactaacaacaacaaaaaacagcattcaacttctcccacatcatctccgagctctccttcggcccctttctcccctccctcgtcaacccgctcgaccaaaccgtcaacatcgcctcggccaacttccacaagttccagtattttatttctgtcgtccccaccgtctactcgtcgtcaggcaaatccatcgtcacgaaccagtacgccgtcacggagcagtcgcaggaagtcacggagcgcatcatcccgggcatctttgtcaagtacgacattgagccgattctgctgcacatcgacgaggaacgggattctttcctggtttttatcatcaaggtcgtcaatgtcattagtggtgcgctggtggcgggtcattgggggtacaggattagtgattggtgtcaggaggtgtgggggaagaggaggaggagggccggagggccgagtgagggtatgttgggtgggaagggacatgagcgtgatgattag

SEQ ID NO: 27094 - DNA, 1412 bp, Neurospora crassa
atggccccctccgaccccgttaatcccccgggtacccccgccccctccctcctcgaaggccgtctctgggtcgacggctgcttcgacttcttccaccacggccacgccggcgccgtcgtgcaggcccgccaactcggcaccgagctgtacgtcggcgtgcactcggacgaagccatcctcgagaacaaggggcccaccgtcatgacgctgcgcgagcgtctgctcgccaccgacgcctgccggtgggtgaccaagtcggtcgcctacgcgccctacgtcacgcagctggactggatcagccatttcgggtgcaagtacgtggtgcacggggacgacatcacgtccgacagctcgggcgaggattgctaccggtttgtgaaggcggcgaatcggttcaaggtggtgaagcgcacgccgagtatcagcaccacggatctggtgggcaggatgctgttgtgcacgcggacgcatttcatcaaggatttggaaaagatgttggagggggaggaagggaatgggacggcggaggagaagaagaaggtcggggaggagatgaaggagaggatcaggctgtacgcgacggatgagacggccaaaaaccctggtgcgaatgtgtggttttggaagggggatgagaagaagaagaagaaggaggatgagggcaaggaggaggagaagggggtgttcagggagttgtttggagggattggacccaagccggggcagagggttgtttatgtggatggaggctttgatttgttctcgagcggacatattgagttcctgcggctggtgacgcagaaggaggaggagctggcgcgtcaggaggggtggtattcgcagcaggcaattgacgagaggaagggcaagggcgcggattacggtccagcgtttgtggtggctggtgttcatgatgacgaggtcatcaaccgcgaaaagggcgtgaactatcccatcatgaacgtctttgagcgtggtctctgcgtcttgcagtgcaaggtatgtttttatcaacagagtcgtcgagagattgatgttgacattcgctacagtacatcaacgccgtcgttttcggcgctcccttcaagccaaccaagggctatctcacctctctcccctggggcactcctgatgcggtctaccacggtccgacctcgttcatgccgcacaccgaagacgtgtacgcggttcccaaggagatgggcatctacaaggagattggccaacacgagtacaaggacgtgaatgccggcaccatcgtccaaagaatcatgaagagcagggatctctatgaggctcgccagaaggccaagggcatgaaggccgacatcgaggccgcccaccgggagcgcgagttgctggaggaacagcagaggcagaaggaggaggccatcgccgcgcaaaaggagtag

SEQ ID NO: 27095 - DNA, 1211 bp, Neurospora crassa
atggctggtctttttggttccgccgccgcatccgcgagcaacaccctcggcgatcttaagcaggatgtcgagctcggccaaccccccgaggacagcatcagcgaccttgccttcaaccccaaccccgccgaccagaaggacttcctcgccgtagccagctgggacaagaagacacgcatttacgagatcttgagtaatggtcaaggtcagggacaggccatgattgagcatgatgcccccgttttctcttgcgatttcttcaaggtatgtttgcgtcgattggcctggcaggtagcccgacaaaacactgacatgcacttctcccaacaggacggcacaaaggtcatttccgccggcgccgacaaggccgccaaggttctcgatttggccaccggtcagtcgatgcaggtcgctgctcacgatatgcccatcaagtgcgttcgctacttcgaggccaatggcacgcccatggcggtgacaggtggctgggacaagcagatcaagtactgggatttccgctccgcgaacccggccgccacggtgcaggcccaggagcgcgtttataccatggatgtgcgcgacaacttgctcgtggtcggaaccgctgatcgctatatcaacgtgatcaacctgaaggaccccggcaagttctacaagacaatgcagagccctcttaaatggcagactcgtgtggtcagctgcttcaacgattctcagggctttgctatcggctcgatcgagggtagatgcgccattcaatatgtggaggacaaggattctgcgtacgccttcacctcctccccctttactatcccatctgccgaatacgctgactaactgacttgttttccagctccaacttctctttcaaatgccaccgcgaccccgcccaaggcaacaccacggccgtccacgctgtcaacgacatctccttccacccccaacacggcaccttcagcacagccggtagcgacggcaccttccacttctgggacaaggacgccaagcaccgtctcaagggttaccccaacgtcggcggcagcatcacctcgacaacgttcaacaagaccggcagcatctttgcctacgccattagttatgactggagcaaggggtaccaaggcaactcgcccacgtacccgaccaaggtcatgctccacccagtacagcaggacgagtgcaagccccgtccgagcgttaagaagaggtag

SEQ ID NO: 27096 - DNA, 2450 bp, Neurospora crassa
cgggcaattcaagccaagcagctcccctcgcgcgtcgcatgcgcttcggcccgctccttttcttccacctcctccaacaacaccggcgtgcttcctcccagatatgagaccctctacaacaagtattccgaggtccgccgcgtgctgggttcgcagcgcctgaccctggccgagaagatcctctactcccacctcgacaatgtcgaagagtcgctcctctccaacaccaacggcggccgtgacgtccgcggcaaggccaacctcaagctcaagcccgaccgtgtgaacatgcaggatgcctctgcccagatggctctcctgcagttcatgacttgcaacctcccccagcccgttattcctgccagtattcactgcgaccacttgattgttggatccaagggtgccgatgaggacttgaaggccggtattgccaccaacaacgaggttttcgacttcctcgagtcggctggcaagaagtacggtatcgacttttggcctcccggtgctggtattattcaccagaccgtcctcgagaactacgccgtccccggtctcatgatgctcggaaccgacagccactctcccaacgctggtggtttgactaccattactatcggtgtcggcggtgctgatgctgttgaggccctcgttggtgccccttgggagctcaaggcccccaagattctcggtgttcgcctgactggcaagctcaacgactgggtcagcgccaaggatattattcttcaccttaccggccgtcttaccgtccgtggtggtactggctacattgttgagtacttcggccctggtatcgagtctttgtcgtgttctggttcttcaactctttgcaatatggggtgagttctccctaagctttccccctcgccatttagaatgtattgactgaccattgttgctacagtgctgagattggcgccactacctcaatcttcccctttaccgaggcttccagccgctacctcaaggccaccaaccgcgagcaggccgataaggacgccaagaacttcgagaacttcaccaagggcaccggtcaggactcgttcttcaagttcaaggccgacgagggcgcccagtacgatgagttgattgagatcgacctttccaagctcgagccccatatcaacggtcccttcactcccgatctttccatccctctttccgagttcaagaagactgtccaggagcaaaagtggcctgagaagctttctgctggtctgattggtagctgcactaacagctcctatgaggacatgacccgttgcgagagcattgtcaaggccgccgagcaggctggtatcaagcccgcttccgacttctacattacccccggttccgagggcattcgtgccactcttgagagagacaacacccttcagacttttgagaaggctggtggtattgtcctctcgaacgcctgcggtccctgcatcggccagtggaagcgccaggatgacatccctaagggcactcccaacgccatccttacttcctacaacagaaacttccgcggtcgcaacgacggtaacctcgagaccatgaacttcctcgcctcgcccgaaatcgtcaccgccatggcctacgccggttccaccaccttcaaccccatcaccgacagcctgaccacccccgacggcaaggaattcaagttccctgcgcccaagggtctcgagggtcccgaaacccccttcgaagccggccgcgaggtcttccaagtccagtcgggatcccccaacccgaacgtggaagtcgccatctcgccctcctctgagcgtctcgccctcctcgagccctttgagcctttccccgaatcggacctctccggcctgcgcgtgctcgtcaaggtcaccggcaagtgcacaaccgacaccatctccgccgccggtccctggctcaagtacaagggtcacctgcccaacatctcggagaacacgctcaacacggccgtcaacgccgccacgggcgaggtcaacgtcgcctacgacctcgatggctccaagcacaccattcccgagctggccaagcagtggaagcagcgcaaccagccctggctcgtcgttgccgagcacaactacggcgagggctccgcgcgcgagcacgctgcccttcagccccgttacttgggcgcccgcatcatcgtcaccaagtcctttgccagaatccacgagaccaacctcaagaagcagggtgtcgtgcccctgacgttcgccaacgagcaggattacgatctgatcgacgccggcgacgaggtggctactgtcggtctgtacgagatgctcaagaacggtggccagggcgaggtttccctccgggttaccaagaaggacactggcaaggtggtggagatcaagaccaagcatgcggtttccaaggaccaggctggctttattctggccggtagcgcgctgaacttgctcgccaagggtaactaa

SEQ ID NO: 27097 - DNA, 1365 bp, Neurospora crassa
atgggttctatgtaccaagtccagtcaaagctccgtcaggaccttggcctccacaaggttcaggctgttcgcaagcccggtcgtgaactcaatggcaccaaggcatacgtcagtgcaatggcccgctacggtttcaatcccaccgaggagtccaggttcttccacttgaagaaaaccgatctcaccaaggagtttcaacgccgcggctacattcgtcactgggagcagctggttaggacaccccaggaacgtcccgacgatcctcacacagacaacgagcctgtccctgccgaggatcagcagtacgacactcagtatctctgcgagattggtattggcactccgcaacagaaggtcaagcttgactttgacacaggatccgctgatctttgggtgagtactcaacacaaccctactcttctgtcatgacactgactaattgctttcaaggtccgttgcacagattcatcccttctccatcacgccgacaagaagttcgacccgaagaagtcagataccttccaggagagcaagaccgaccagacctggaagatccagtacggcgatggaagcaccgcttcgggcaccgtcggtacggatgtcattactgttggtgggcttcagatcaagaaccaggccatcgaacttgccaagaaggtgtccagtgccttctcctctggcgaagctgacggtcttcttggacttgccttctccacgatcaacaccatcgagagcgatggcaaaccggatccacagcccacacctgtcgagaacatgatcagccaggaggacattcccaaggaggctgagctgttcacatccgccttctacagtgctcgtgatgacaagtcagaggagaaatccttctacacctttggctgggtcgatgaagatctcgtcaaagcttccggaaaagatatcacatggacacccatcgacaactcggagggcttttggaagttccccagtgagagcgctacagtcgacggcgataatgtttctgtgagcggaaacaccgcaattgctgatactggtaccacactggcgctcgtttcagacacggtttgcaaagcgctctacgcaaagatccctggctcaaagtacagctaccgataccaaggttacctcatcccgagcacaatcacagctgatcagctccctcagctgagtgtcgcggttggtggagagcagtttgtgattcagaatgaggatctgttgctggcaccggctgacgatgaccattggtacggcggtgtgcagtcgaggggtactatgcctttcgatatcttgggtgatacatttctcaagtccatctacgctgtaagctcacgcatctccgatagagtgaaattgttgctaacgcga

SEQ ID NO: 27098 - DNA, 1470 bp, Neurospora crassa
agcaatcagcccacctccaagaacctgaccgctctctcagcggcttcccgctacgcagttgacccgacccgtccccaatatcactacactccctaccagggctggatcaacgaccctgccggcctgatccagtggggcggcaaataccacctcttcaaccagtacaaccccgtcgcccctctttggggtcccatgtactggtcgcacgccgagagcactgacgccgtacactggagggacctgcccgttgccttgaccccgccgtatgtcaacaacacgcaggacaccagcgggcgctacaccggcagcgccgtcaagaaccaagacacgggtgcgctgcaactcatctacaccgacgccaccaacgtcacctaccacccgcacgccgtgcccgaagtcgtctcctcggccgtcagctccgacggcatccacttcgacctctacagcggcaaccccatcgtggccgaggcgcctcccacctcttccgccggattccgtgaccccaaggtcttctgggaccccaccgccaacaactggaagatggtcgtcggttccggcgacggccacaccggcaacgtccagctgtacaagtccaccggcccatcctcctccgagctcctctcctgggagtacgtcggcgtgctgcaccaaggcgacggcagccggggcatcatgtgggagtgccccaacttcttccccattgacgacaagtgggttctcttctacggccaagacaaggggttcaaggggtggtacgaagtcggctccttcaacggcaccacttttgtttccgagaagctgggcctgttcgactctggccccgacagctacgcgacgcagtggttcgtcgacgacgccggccgcaacctggccgtcacgtggatcaacaactggaacacgaccaagtggcctagcagggtcaacggctgggccggcacgcagtccatcatgcgcgagctcttcatccgtgaagacggcgggctcggccagaagcccgtcgaggaagtgtccctcttggcgagcggccctgccaagtcgcttggtcagacggacgtgtttggaacctacgaggttggattcaccgacacggcgcgtctgcaggctactgtcgacttggccgctagcgatgcgccggccttcaccattgagctgtttgcttccggtgccgagtctacttcgcttgtgtacaactttgccaaccggtcgttgaccattgacaccatgaacgccggatacggtcaggctggtacgtgggaggccaccattgctaagccggctgacaaccgtctgtcgctggatatcctgattgatcgctcgagcatcgaggtgtttgtgggtgatggaaccgccatgactgtcagggtgttcccgcgctaccaggagtccaagaacattaggatcaccagcgatggaggcaagaagactgtctttgatgatattgttctgacgcccatggggtctgcttgggaa

SEQ ID NO: 27099 - DNA, 2786 bp, Neurospora crassa
atggatcctcgaatgcatacggcgcccccggcgggccaccccatacagccaggctaccagttggaggacaacccgtaccaccaccagcaaggcttcgatatcccggccggccctgggagatacagtcctggagatgcgctacacattcagactcctgtgagtatagctgctatgtctgtggggaacaagaggctaatgcgccgagcagcaaccgatcgagggcatgggcggatacaacgccccgggccaacattatacccccgattacgccgtgaacccggaagagcaccacgatgcctactacaaccagccctacgagccccaagttggccatgatccatatgccgcggctcccacacccccagtggccggctaccaggcgcacgacgaccaacggcccatgctgatgcataccgattcccaagtcggccagagcgatccttaccacgacgaaccccaaccgccaacgaacaatgcgcccatcaagaggtggaagacagtcaagcaggtgcttctgtaccgcggtaacttggtgttggattgtcccatccctccaaagctgctgaaccagctaccccacggcgagcgcgacgagttcacccacatgagatactcggctgccacctgcgacccttccgagttctacgaggagaacttcactctgcgccagaagctcttcagcaagcctaggcacacggagctcttcattgtcgtgaccatgtacaacgaggacgagattctgtttgcgcgcaccatgattggtgtgttcaagaacatcgagtacatgtgcaagcggacggaaagcaagacctggggcaaggacgcctggaagaagattgtggtgtgcgtcgtcagtgacggtcgtgccaagatcaacccgagaacgagagcgttgttggccggtatgggtgtctatcaggagggtatcgccaagcaacaggttaacggaaaggatgtcacggcgcatatttacgagtacacgacccaggtcggcatgaccatcaagaacgatgtcgtccagctcatcccgaagcagcagcccgttcagatgctgttctgtctcaaggagaagaaccagaagaagatcaactcgcatcgttggttcttccaggcctttggtcgcgttttggatcccaatatctgcgtgctcatcgatgctggtactaagcccggtggcagctccatctaccatctgtggaaggccttcgatctcgagcccatgtgcgccggcgcctgcggtgagatcaaggccatgttgggcacgggcggcaagaacctgatcaacccgctcgtcgccactcagaactttgagtacaagatgagtaacattctcgacaagcctctcgaatccgcctttggcttcatttccgtcttgcccggtgccttctccgcttaccgctacgtcgctttgcaaaacgacaagaacggccagggccccttggaaaagtactttgccggtgagaagctacacggcggcgacgccggcatcttcacggccaacatgtacctcgccgaggatcgtatcttgtgtttcgagctcgtcacgaagcgcaactgccattggatcctgcagtacgtcaagtcggccacgggtgagaccgatgtgcccgccgacttgacggagttgattctgcagcgtcgtcgttggctcaacggttccttcttcgcggctatctatgctattgtccacttccaccagttcttccggtccgatcactccttcttgcgaaaaattgccttcttcatcgagttcgtgttccagacggtcaacatgatctttgcctggtttgctattggcaacttcttcctcgtatttaagatcttgacgacgggtctgggcgacgaaaagcttttagggactgtcggccagattttgggcgtcgtgttcgcgtgggcctacggtgtgactctgataacatgcttcgtcttatccatgggtaatcggccggctggttctccacggttgtacatgggtatggttgttttctgggccattatctttatgtacgtttgctcctcccctctcttatttcacttggaagcccctttactaacagtactatcacagctacctaatgttcgcagccatctacatcgccgtcgttgccatccaaaccgacgtccaaaagggcctctccttcaccgacctcttccgtaacgagctcttctacaccctcatcgtctccgtcgtctcaacctacggcatttggctgatcgcctccctcctcatgttcgacccctggcacatggtcacctccatggtgcagtacatgctcctctcgcccacctacaccaacgtcctcaacgtctacgccttctgcaacacccacgatatctcatggggtaccaagggtgacgacaagcccgacaagctgccgtctgtcaacactaaggacggccagggtaagacggatcttcccgacgaaggcgatctcaacgcctcgtacgagcgcgaactccaggtgttctcgaggaaatacgtgaagccggtgacggcgccgacgagtgcgcagttggaggagaagcagatggattattaccgcggtgtcagatcgatggtcgtgttggtgtggatgattacgaactttgcgctgtgcgcggtggtgttgagtacagctggtctcgaaaggatcgatccggaggaaggaagccaggagcagcagacgacgaagcgggcgacgatttatatgagcgtggtgttgtggagcgtggcggttctgagcgggttcaagtttgtgggggcttgttggtttttggtagtgaggatgtttaggggtgtttgagtg

SEQ ID NO: 27100 - DNA, 1412 bp, Neurospora crassa
tctttgcacaacgcgcccattgtgctcgacaatggctcgggcaccattcgcgccggcttcgcgggagacgacgtaccaaaatgccacttcccctccttcgtagggaggccaaagcacctacgagtgctggccggcgcattagaaggcgaggtgtttatcggccaaaaggcggcctcagagttgcgcggactgctcaagatccgatatccgctggagcacggcatcgtgacggattgggacgatatggagaagatttgggcatatgtatacgatgaggggttgaagacgctcagtgaagaggttcgttctcccatattcttttggtcagaacaagacaaaaaaaaaaaaaaaaaagcggtagctaacaacgggtccaactgctagcatccagtcctcctaaccgaaccacccctcaacccgcgcgcaaaccgcgacacagccgcccagatcctcttcgagaccttcaacgtacctgctctctacacctccatccaagccgtcctgtcgctctacgcctcggggcgaacgacaggcgtggttctcgactcgggcgacggtgtttcgcatgccgtgcccgtctaccagggcttcaccgtgcccaacagcatccggcgcatcgacgtcgcagggcgagacgtgaccgagtacctgcagacgctgctgcgcaagagcggctatgtgttccatacgagcgctgagaaggaggtggtccggctgatcaaagagagcgtcacgtacgtggcgcacgatccgcgcaaagaggagaaggagtgggcggcggccaagatggatccggccaagattgccgagtatgtcttgccggatggaaacaagttgaaggtatgttaagttttattcctctcctgccattaccaatggcgtgaggttgggaaagaaaaagagacatcgatgcagatactgacacccaccaaagataggagcagagcgtttccgcgccccggaaatcctcttcgaccccgagattatcggtctcgagtatcccggcgtgcaccagatagtggttgactcgatcaaccggacagacttggacctgcgcagggacttgtactccaacattgtgttatccggaggcagcacgctcacaaagggtttcggcgatcgcttgctcacggaagtgcagaagctcgcggttaaggacatgcggataaagatttttgcgccgccggagaggaagtactcgacctggatcggtggtagtattttggcgggtttgagcacatttagaaaggtatgtcctcacatttgtctctgtgtttgcgcgtggacgagaaggaaacttcgaaaaatggggccatgatgtgtgctaacaaatgtgtgacaatgaacagatgtgggttagcattgacgactggcacgagaatccggatatcatccatacgaagtttacatga

SEQ ID NO: 27101 - DNA, 2490 bp, Neurospora crassa
atgacttcccagccttcttcaggcaaaggccggggtcgcaacctgtcgatcgacgagtacaatgtctatgacgacgcgaagacatactataccaccgaggaccgccatcacaaccaccgcgctggagccagaacccgcacctactctcaggtaagcactcccccgagccaggattgtcacgcttgggcgagcatccactgattccgccgcctacagaacagcttgttcaagcagtttgaacgtctaggccttcagaaggagccctaccgcagaggcagccatggtacgaagacaatcacttgccagcgaacgatcccgtgcaaaacatactgatcagacgtttgacagacgagtcaacgatcccgcaatcccgccgattccttatccaggtcgagcccacgctgcagagtctgcaatcgcaggaggacacggatggcaacatgcagatcaccatcgaggacaacgggccaaaggtacgcggaaacgccatcaaggggttagaagttgcagttggtattacacagcgctaacatggtgcaaccccccaggtcctgtccctcagaaccgctgcatccaatggctacaaccgattcgacatccgtggcacttacatgctctccaaccttcttcaggagctttacctcgccaaggaatacggtcgcaagcagattatcctcgatgaggctagactcaacgagaaccccgtgaaccgactttcgcgactgatcaaagaccacttctgggagggtctaacacgccgcattgatgcttccagcattgaaatcgctgcgcgggatcccaaggactggactgacgatccccgaccccgcatttacatccccagaggagcaccggaacaacacgagtattataccaaggtggccttggacaggcctgagcttcgcctggatgttcaatatcttcccgagaagatcacccccgagattgttcgggacatgaatgccaagcctggcctgctggcggtagatatggaagaagtggttgatcccaagaccggtgaaaagactctacgcggccgccctttcgtggtgcccggaggtcgcttcaacgagctgtacggatgggacagctacatggagtctctcggtttgctggtcaacgatcgggttgatctggccaagtccatggtgcaaaacttttgtttctgcatcaagcactacggcaagatcctcaacgctactcgttcctactacctttgccgatcgcagccccccttcctaacggatatgactctgcgcgtctatgacaagatcaagcacgaaccgggtgcgcttgaattccttcgccaatctctgttggccgccatcaaggaatactatagcgtctggacagctgagcctcgccttgaccctgtgactggtctctccaggtaccgccctgaaggccttggcgtccctcccgagaccgaggctggccacttcatccatattcttgagccctatgccaagaagcacaacatgagctttgacgagtttgtgtacgcttacaaccacggtgagatcaaggagcccacgctcgacgactacttcatgcacgacagagctgttcgtgagtccggccacgataccacataccgcttcgaaggtatctgcgctgatctggccaccatcgatctcaattcgctcctgttcaagtatgagaccgacattgcgcgtacaattcgcaacgtcttccacgacaagtttgaggtgccggatgactggctcgctaccaacaaccccgctgctagcaagctcgagacatcggcaatgtgggatcgccgtgccaagcgcagaaagctggccattgacaagtacctgtggaacgaagaggcgggcatgtacttcgactacaacacggccacgcgcaagcagtgcaactatgaaagtgccaccactttctgggccctgtgggcgggtgtcagcaaccccaagcaggcagctgccatggtgaccaaggccttgcccaagttggaggcttttggtggtctgctttctggaacaaaggagtctcgtggtgagattggtctagagcgccctaaccgtcaatgggattacccttacggctgggcgccgcagcaaattcttgcttggacaggtctctaccggtacggctttaacgaggaagcggagcgcctggcctacaagtggctgtttatgattaccaaggcgtttgtggacttcaacggcgtcgtggtggagaagtatgatgtgacgaggcccattgacccacacagagtcgatgccgagtacggcaaccaagggttggatttcaagggagttgccaaagaagggtgagtttgtctactgctatgtttttttttttttttttgtttttttttgttttttttcccgagagaagcacaatcgctgacatgatgaacgcagtttcggatgggtcaacgccagttatgtctacggcctgcagatcgttaacgcgcatatgcgccgtgcgctcggcactctgactccctacgaaacctttatgaag

SEQ ID NO: 27102 - DNA, 1565 bp, Neurospora crassa
cagctcaaagatccatccctcttcaaaaaggatgtttgctacgtcaatggcgaatgggtaaaggcccactcgggcaagacatttgaagtcaatggtatatgaacctatctatgcctgcatttccatgctgtgtcttcgcattgatgcgcatatcacttacatacaactaactccgcttcgttcctacctacaaagacccagcaacaggcaagctcatcggtacctgccccgaattcgatgcacaagacaccaagaaagccatcgatgccgccgagaccgccttcgagaccttccgccacaagacgggccgcgagcgctccaagctcctgcggaaatggtatgacctcatggtcgagaaccacgatgatctcaccacccttatcaccttggagaacggcaagccgctagcggacgccaagggcgaagtcacctatgccgccaacttcttcgagtggttcagcgaggaagccccccgcatctatggcgataccatcccctcctcagtcccgggtaaccgcgtatggaccatcaaggagcccgtcggcgtgtgcggcctcatcacgccctggaactttcccgccgccatgatcacccgcaaagtcggccctgccttggccgtcggctgcaccgtggtgtgcaaagcccccggtgagacgcccttcacggcgctggccattgccgagctcgcccaccgcgccggcatccctcccggtgtcgtcaacgtgatcaccgccctcgaaaacacccccgaggtcggcagcactttgaccaccgaccccgtggttcgcaagatctccttcacgggctccacggccgtcggcaagctcctcatgaagcagtgctccggcacgctcaagaagctctctctcgaactaggcggtaacgcgcccttcattgtcttcgatgacgccgacgtggacgcggccgtcacgggcgccatcgcctccaaattccgctcctccggccaaacatgcgtctgcgccaaccgcatctacgtgcaacgaggaatttacgacgagttttcccagaaattcgccgagcaggtcaagaacaacttccgggtcggcaacgggttcgaggaaggagtcacgcacggcccactgatccaccatcgcgccattgaaaaggtcgagcagcacgtccgcgacgccgagaagaagggcgccaaggtggtggtgggcggtcacaggctcgaaagcctaggccccaacttttacgagccgaccgtcatcacgggtatgacccccgacatggccatggcgtcggaggagacgtttggaccggtggctggcttgttcccctttgacacggaggatgaggtggtcaagctggctaacgcgacccaagtcggcttggcgggctatttcttttctagagatatccaccgctgcgtgagggttgctgaacaccttgaggttggcatggttggtatcaacacgggcttgatttcggaccccgcgagtccgtttggcggtgttaaagagagtggtttcggaagggaaggttcgctttatggtatcggagaataccaggtgaccaagatggttacggttggaggtatgggt

SEQ ID NO: 27103 - DNA, 1983 bp, Neurospora crassa
gctctggataggcaacagctttcaatgcagcttcatcttcgaacacaagaggccgttgagagtgaatatcgctttgcgcgcatggcagaacttggcccggttggtttgttcatcgccgacagtcatggacgcatcaactactgtaacgagatgtggtggaggatctctgggcatgaacggagcgcaagcactctcgacgcttggatgcagagcataagggacgaggatcgcgaaggcgttgtgaatgtttggcatcacttggtccaggagaaggtgccggtgacttacgagtttcgattcaatggtacgcggaaaattgtcgatggtcacaccgttgatacatgggctctgatgagcgcgtaccccgaacgagacgaaaccggtgagctcaagagcatcttcggatgtataaccgatatttcgcagcaaaagtgggccgaggacttccagaaacgaagacgcgatgaagctgttgaactcaaacggcaacaagaaaacttcatcgacattaccagccacgagatgcgaaatcctctcagtgccattcttcagtgcgccgacgaaatcgcctcgggacttaacaggtttcgacaagagaatccggcgttccgagggcccgacactttggagacgctggttgatagctgcctggaagctgccaacaccatttccctctgcgccagccaccaaaagcgaatcgtcgacgacatcttgactctctcgaaacttgactcgcagctcttgcttgtgacaccagtcgatgttcagccagtccaggttgtggaggaagttttgaagatgtttgaagccgaactcaattccaatgatatcacgggtcatttccagatcgagcagtcctatcgcaatctcgaaattgactgggtgaagttggacccatcacgcctaaaacaggtcctcatcaacctgatgactaacgccatcaagttcacccaaggtcgaccaacacgggcaattaccatcaacctaggtgcctcaaaggatgtgtcatcggccgggctttcgtattttccaccgcggcatccagaccaagaggatcttacggacgacgcagagtgggctaccggcgagaagatcaacctgcacttggcagtttcagacaccggaccgggcttagatgagaatgagaagaagatcctcttccagcggttttctcaaactagcccccgaacacatgtccaatacggcggctctggcctaggcctcttcatctgccggatactaaccgagctgcaaggcggacagattggagtctattcggagaagggcgagggaagcacgtttgctttctatgtcaagagtcgtaaagcggagaacccgcagccggttccgactgttgtcgacaactcgatgtccatccagccacttcagcagcgcgtcagtccccaaacacagggtcagatcagccatcggtcatcatcatcagccgcattctctctgctcggacacggccgatcacatgcgccacctactagaacacaatccgctcccgttctcgccgataccacccagacaagatcccttgacgtcctcattgtcgaagataatttggtgaaccagagagtcttgcagcgtcagttgcaattgtcgggcaataacacgttcgtggccaaccatggcggagaggccttggtggagttgcgaaagtcacgcttctggaataaggagatcgctgcgacggacgatgctgcatcagcgctcccgaggagcaacaagaaggccgtaaacgatggcggaactgatggctcgcctgatggtgaagaaaacagcaacaacaacatttctgttatcctcatggatctcgagatgccagtcatggacggaatgagttgcacccgcgaaatccgtcgtctagaaaatgtgggcgtcattacgcggcatattcccattattgccgtcactgcgtacgcacggcctgagcaggtcgaaagtgccagggccgctggtgtggtaagctctctctct

SEQ ID NO: 27104 - DNA, 1050 bp, Neurospora crassa
ttcccagaaaaggccgccgttatcgaagaacgcgacggcgaaatcgaattccgtgtggtcaacaatgatggcgaacgcgaaagcctgatcattctcaccggtctcaagtgcatcttccagaaacaactacccaagatgcccaaagactacatcgcccgccttgtctacgaccggacccatttgtcgatcgccatcgtcaaaaagccgctcgaggtagtgggtggcatcacataccgaccattcaagggccgccagttcgccgaaatcgtcttttgcgccatttcttccgaccagcaggtcaagggctacggtgctcatctcatgtcacatttgaaggactatgtcaaggctacctcggacgtcatgcacttcctcacatacgccgacaattatgccattggctacttcaaaaaacaaggcttcacaaaggaaatcacactcgacaagtcagtatggatgggctacatcaaggattatgaaggcggcactatcatgcagtgcagcatgcttccacgagtacgctacctcgagatgggccgcatgcttctcaagcaaaaggaatgtgttcaggccaagatccgtgcctacagcaaatctcacattgtccaccagccccccaagcagtggaagaacggcgtaacacccatcgaccctctttcagtcgaggccatccgcgcttcaggatggagcccagatatggacgagctcgcccgtcagccacgccacgggccaaattacaaccagctgctgcacctcctcaatgatttacagaatcatgccagtagttggcccttcttggtacccgtcaacaaggacgaggtacatgactactacgatgtcatcaaagagcctatggacttgagtaccatggaggacaagcttgagaaagatcaatacaacacgcccgaggatttcatcaaggacgccaagctcatattcgacaactgccgaaagtacaacaacgaaaacaccccatatgcaaagtgcgccaacaagctcgagaagtacatgtggcagcaaattaaggcgattcccgagtggtcacacctc

SEQ ID NO: 27105 - DNA, 1943 bp, Neurospora crassa
ccatgcgactcgccaatctattgctatggcgagcttctacaccaggtcgagctagctcgtccattctccgattcaaagaccttcgtcgatatgtaagtctttggcccaacatcctctggtgtataagcatggcattgacccaacttccttgtaggcccaccatcaaacccgtggatgaggtgcttgaagctttcagcaagctaaccctcccattgagcaacaactcggagctccacgaattcctcagcacctatttcggacccgctggtggcgagcttgaagcagtaccaaccgaccagctccatgtatcgccgacatttcttgacaatgtcagtgacgatgtgatcaagcaatttgtcgattcggttatcaacatctggccagacctcaccaggaaatacgtgggcgcgggcgaattatgcacgggatgcgctgacagcttcatccccgtcaaccgtaccttcgtcgtggctggtggccgcttccgtgaaccctactactgggactcgttctggattctcgaaggtcttctgcgcacggggggtgccttcaccgagatctcgaagaacattattgagaacttccttgacttggtggagcagatcggatttgttcccaacggagcaagactctactaccttgaccgctcgcagcctccactcctgacgcagatggtcaggatctatgttgaacacaccaacgatacaagcatcctcgagagagcggtgccagttctgaagaaggaatgggagtggtggacgaccaaccgcacggtcgaagtcactgcggatggaaagacatactctctccagaggtgagttgaacgagcggaagaacgatctggcatgacccgagcatgtctagctaacatcctttctcgcagataccacgtcgacaacaaccaaccccgtcccgagtcttaccgtgaagattacattaccgctaacaacaactcttattatgctacctctggtatcatttacccagagacaactcctcttaatgacacccagaaagcgctgctctacgcaaacctcgccagtggcgccgagtcaggatgggactacagttctagatggctgaagaaccctggcgacgctgcccgcgacgtgtacttccctctccgctcgctcaatgtcctcgagattgtccctgttgacctcaactcgatactttaccagaatgaggtcaccatcggcaagtttctcgctcagcagggcagcaaggacgaagctgaggagtgggccaagaaagccgaagagcgcagcgaagccatgtacaagctcatgtggaactcgacgctgtggagctactttgattataacttaacatcgtcctcccaaaatatctatgtgcccgccgaccctcaagtcttccccttcgaacagcccagcggcacccccgagggctaccaggttctcttctctgtcaaccagatgttccccttctggactggtgctgccccagaccagctcaaaggcaacccattggctgtcaagcttgcctttgaacggatcaagaacttgctcgacaacaaggccggtggcattcctgctaccaactttgtcactggccaacagtgggacgagcctaacgtatggccacccctcatgcatgtcctcatggacggcctcctcaacaccccggccaccttcggcgaggatgacccggcgtatcaggagacacagactctggccctccgtcttgctcagcgttacgtcgactcgaccttctgtacctggtacgccaccggcgggtctacatcggagacgccgaagctgcaaggtctcggttccgacctcaagggcatcatgttcgagaagtactctgacaactcgaccaacgtcgctggtagcggaggcgagtacgaggtcgtggaaggcttcggctggaccaatggcgtgctgatttgggccgcggacaagtttggtgataagctcaag

SEQ ID NO: 27106 - DNA, 879 bp, Neurospora crassa
cagcaggcctcttcggagcagagccccaagctcaagaccttccagatctaccgctggaaccccgacaccccgaccgagaagccgcgcatgcagagctacaccctcgacctcaacaagaccggtcccatggtgcttgacgcccttgtccgcatcaagaatgagctcgaccctacccttaccttccgccgctcgtgccgtgagggtatctgcggttcctgcgccatgaacatcaacggcaccaacaccctcgcctgcttgtgtatgtccatgtcgcagcatccaccgagatatatgtctctcggggcggacggaatgcttacttttccaaaccacaggccgcattcccgccgacaacagcgctgagatgaagatctacccccttcctcacacctacgtcgtcaaggatctcgtccccgatcttaccctcttctacaagcagtacaagtccatcaagccctacctccagagggacactccctcccctgatgtaagtggatacgcttttataagaagctgcgcgcacagatcgatgctaacctacgtcatcacgtgtagggcaaggagtatcgccagtccaaggccgaccgcaagaagctcgatggtctctacgagtgcattctttgcgcctgctgctctacctcgtgcccctcctactggtggaactccgaggagtacctcggccccgctatcctcctccagtcttaccgctggctagccgattcccgtgacgagcgcaccgccgagcgcaaggacgccctcaacaactccatgagcttgtaccgctgccacaccattctcaactgcacccgcacctgccccaagggtctcaaccccggtctcgccattgccaacatcaagaaggagcttgccttttaattg

SEQ ID NO: 27107 - DNA, 1197 bp, Neurospora crassa
cacaggccggcgcctccacctccaccaaagatgtcagttgtcgagactgcaacagctgcggctggagcttctgcgactgctggggcggccaagaaaaggcaggtccttttgcgagtgaacggccgaacatacacccgcattgactgtattggacgaggtggttctggcaaggtttatcgtgtttccgctgagagtgggaagatgttggccttgaagagggtgtctctcgaacatgccgacgaaaacaccgtgaagggattcaagggcgagattgatttgctgaaacgtttgaatggtgtggaacgggtcattcaactcatcgaccatgagctgaatctggagaagcaggtactcagtgtggtaagtgattcatcaacttcaaaggattcgtactgaatactaaccccaccatagctcatggaagtaggcgaactcgatttcaacacgcttcttaaaagccgccaaagcaccgcagaaggcgctcgtctcgatccaaccttcattcggtattactggaaagagatgctcgaatgcgtgcaagccgtgcacgcccgcgacgttgtgcacagtgatctcaagccggccaactttgtccttgtccagggccgcctcaagctcatcgatttcggcatcgccaacgccatccagaccgaaatgacagtcaacgtgcaccgagaaacgcaaatcggcacgcccaactacatgtcgcccgaatctctgatggactcgaaccaatacgccttcacgtccgcccagaacggcaagttctgcatcccgccgccgctgaaccaccgccagcacggcgcgcccaagctcatgaagctcggcaagccctcagacgtctggtcgctcggctgcatcctgtaccagatggtgtacggcctgccgccctttggcaagattgccaaccagatgtcgcgatgccaggccatcatcaactggtcgtaccagatcgattttccggaagccaccgaggacggcagccgcgtgcccccctcggtcatccgcaccatgcgccgatgtctcaaccgcgagcagcgcgagcgccccacgtgcgacgagctactggctgacacggacccgttcctgtacccgcaggagttcgatccgtcagtgtacgcggcggcggagcatggtagggtcctgcctgtcacagaggagctattgtcgaggcttatacagagtgtggtgcagaga

SEQ ID NO: 27108 - DNA, 1570 bp, Neurospora crassa
atcaccccaaaggatcttttcctgctaacctttacatctccatgacaggcctgcttcggcgccatgtctttcggctgggattcctccgtcatcggcggcgtcatcgaactcgaaccctttaaacacgactttggcttcatcggcaacgataaagccaaggccaacctgggcgccaatatcgtctctaccctccaagccggctgcttcctcggtgcgctgatcgcctcacctataaccgatcgcttcggccgcaagtggtgtctcatcgctgtctccctggtcgtcatcatcggtatcatcatgcaagccgccgcctcaggcaacctcgcacccatgtacattggccgtttcgtcgccggcgtgggcgtcggcgccgccagctgcatcaaccccgtctttgtgtctgagaacgctccccgctcgatccgcggtctgttgacgggcctctaccaactcttcattgtcaccggcggcatgatcgcattctggatcaactactccgtctctctgcacttcaagggcaaatccatgtacatcttcccgctcgccatccaaggtcttcccgccggccttttgtgcgtctgcatgctcctctgccacgaaagcccgcgctggctggcccgtcgtgaccgatgggaagaatgcaagtctgtgctggcgcgcatccgcaacctccccccagaccacccgtacatcgtcgacgagttccgcgagatccaggaccagctcgaacaggagcgtcgtctccagggcgacgccacttactgggacttgacccgcgatatgtggaccgtcgccggcaaccgcaagcgcgccctgattagtattttcttgatgatctgccagcaaatgacgggcaccaacgccatcaacacgtacgcgcctaccatcttcaagaacttgggtatcaccggcacgtcgactagcttgtttagtaccggcatctatggtattgtcaaggtcgttagctgcgtcattttcttgctgttcttggccgactcgctgggtcgtagacgttcgctgctgtggacgtcgattgcgcagggtcttgctatgttttatattggcctttatgtccgcatctcgccgccgattgatggccagccggtgccgcctgcgggttatgtagcgttggtgtgcatatttctgtttgctgcgtaagttctttggtctttttttttcttttccttttttactccatctaaacccttttcttccctttgcttctacttcctttcccccaatgcccattatttgtacgctactaaacgttgtaccacttaacagtttcttccaatttggctggggtcctgcctgctggatctacgcctcggaaatccccgccgcccgcctgcgctccctcaacgtgtcctacgccgccgcgacgcagtggctgttcaatttcgtcgtggcccgcgccgtgcctactatgctggtcacggtcggcccccacggttacggcacctacctcatctttggcagcttctgcctcagcatgtttgtctttgtctggttcttcgtgcccgagacaaagggtatctcgcttgagcacatggatgagctgtttggc

SEQ ID NO: 27109 - DNA, 1281 bp, Neurospora crassa
acgatccttaccgccgctcttgcggccaccggcatggcggctgctatccctagccgtgacgacaccacggccaacaaaggcaccgcttcactgctgcaagtccgcaatccgagcttcgagttcaggcatggcccccttgcgttggccaaagcataccagaagtttggcgccccgatgccggaggatctcagagccgccatcgctaggttccgccaaaaccagaagcgaacgactggcaccattgcaacggatcctgagaagcacgacgtcgagtacctaacgcccatttccgttggtaccccatcgcaggatctcgtggttgatttcgacacagggtctagcgacctctgggttttcagcacggagatgtccacgagtgacattaaaggccaaactgtgtatgatccgaacaacagctccacatccgagaaggtccagggatcgacttggaagatcacttacggtgacggcagctcgtcgagcggcgacgtctacctcgacacggtcacaattggcaacttgactgtccctagccaagccgtggaggcggccaagaaggtttcatccgagttcaccgacgactcacacaatgatggcttgttgggtttgggctttagtgctatcaacgcagttgagcctaccccacagaacacattcttcgacaacattaagggcagccttgacgctcctttgtttaccgtcgatctgaaacatgggacccgtaagcttgcctcccctgcccaagagcaattcatgagaagaaactaacacttttaacatatagcgggcagcttcaatttcggctacattgatcccgcagcatatatcggcaacatctcttggacgccggttgacagtagccagggctattggggtttcacctccccaggatatgcggttggcactggagcgttccgtaatcactcaataagtggtattgcggacaccgggactacgctactgcttctgcccaagtccgtcgtcagtgcatactataaggagatccagggcgcccagtatgacagtgatcagggcggttatattttcccttgcagccctactccacctgactttgtctttggcgtcaacaagggcattgttactgttccaggagacatggtctcttatgcaccagctgatagtgccaaccagaactgttttggtggcattcaaacggatacaggtatcggtttttcgattttcggcgatgtcgcgctgaagaccagctttgtcgtatttgatgctggcggcttgcagcttggttgggcggcaaaaaaccta

SEQ ID NO: 27110 - DNA, 6245 bp, Neurospora crassa
tctctgcggccgctcaccgtctctcacgggtccctcgaaacctctttcttgatacccaccggccttcatttccacgctactcagctaaaggagcgttttgctgctatccttcccgcccctactgacgagctcgcgcaagatgacgagccctcgtccattttcgagcttgttgccagatacatgggctttatcgcgaccgaggtgacacaaggcgaggacgacgctcagggttcatacgaggaggtactcaaaatcatcctgaacgagttcgagagggcgttcctgcggggcaacgatgtccatgccctggtctctacaatggagggaatcgacgacaagaagctcgaagtcattcgctgctactacctcgcgcgatcagctagcaacagagccatcaagccttacgagtcggctctgttccgcgccgctggtgaaaacgcggccaagatcttcaccatctttggtggccagggaaacatcgaggagtacttcgaagagctccgggagctgcaccacacctatccggcattcgtcggcgagctgatcaccacatccgccgagctgctccagaccctgtccagccaccctgatgccgagaagatgtaccccaagggccttgacgtgcttggttggcttcagagcccagaggccacccccgacgtcgactaccttatctctgcccccgtcagcttccccttgattggtttggtacagctggcacactatcaggtcacctgcaaggtgctgggtgtgcatcctggcgtccttcgtgagagaatcagcggaacgacaggtcactctcaaggtgttgttctttccgctatcactgcggccgcggattcgtgggaaagtttcgaggagcatagcaaggctgccttgaccatcctcttctggatcggcgctcgcagccagcaaaccttccctagaacttccctagccccctcgatgcttcaagactcggctgataatggcgagggtgttcctacccccatgctcagcattcgagaccttccccaagccgaggttcagaagcatatcgatcagactaatgcctaccttcctgaggaccagcatatttccattgctttgatcaacagcccccggaacatggtcgttgccgggcctcccagctctctgcacggtcttaacttgcagctgagaaagctcaaggctgctactggtcttgatcagaccagaatcccccataccgagcgtaaggttcggttcgtgaaccgtttcctgcccatcactgctcctttccacagcaagtacctcgccaaggcttccgacctgattgccgaagacctcaaggacgttcaaattgactctcgcaccctgggtatgcccgtttataacactttcacgggcaaggatcttcgggaggaagttgagggcaacattgttccttcccttatccgcatgattacgggcgagaccgtccactgggagaaggccaccgtgttccaggatgccacccatatcctcgattttggccctggcggtatctctggtctcggcattctgactagccgtaacaaggagggtaccggcgttcgcgtcattcttgctggcacggtgaacggaactgtcactgatgttggctacaagcccgagttgttcgaccgtgacgaggagcaggcagtcaagtttgctgtgaactgggtcaaggaatacggtcctagactggtcaagaactctgttggtcgtacatacgttgataccaagatgagcagacttcttggcctcccgcccttgttggtcgctggtatgactcctaccactgtgccttgggacttcattgccgccaccatgaatgctggctaccagatcgagcttgctggtggtggctactacaatgccaagaccatgaccgaggccatctccaagattgagaaggctgttcctgctggtcgcggtatctgcgtcaacttgatctatgtcaaccctcgcgccatgggctggcagattcccctgcttggcaggctcagagctgagggctatcccatcgaaggtctcaccatcggtgctggcgttccttccatcgaggtcgcgcaggagtatatcgaaactctgggactcaagcacatctctttcaagcctggttcgggtgaggctattcaggccgtcatcaacatcgccaaggccaaccctaccttccccgtgattctccaatggaccggtggcagaggtggtggtcatcactcgtttgaggatttccatcaccccatcctcaacctctatggccgcatccgccgccaagaaaacatcattctcgttgccggtagcggtttcggaggtgctgatgacacttacccctacctcactggtgactggtccatcaagtatggctatccccccatgcccttcgacggctgcatgttcggtagtcgtatgatggtcgccaaggaagcccacaccagcctggctgccaagcaggctatcgttgacgctcctggtcttgacgacagtgactgggagaagacctacaagggcccagctggcggtgtcatcactgtccgctctgagatgggtgagcccattcataagctcgccactcgtggtgtccgcttctgggctgagatggaccagaagatcttcagccttcccaaggagaagagggtcgctgctcttaaggctagccgtgattacatcatcgagaagctcaacaaggacttccaaaaggtctggtttggtcagaacaaggagggcaaggccgttgatcttgaggacatgacatatgctgagattgttcgccgcctggtcgagcttctctacgtcaaggatgaggctaggtggattgatcagtcgtacaccaagcttactggtgactttatccaccgtattgaggagcgatttactaccacgcctggccagccttccagactccagagttatgctgacctcaaggagccctactctgctgttgagcagattctctcgcactatcccgaggccgagaagcaactcatcaacgctcaggatgtccaacatttcctcctgctctgtcaacgtcgtggacagaagcccgtcacctttgtgcctgttctcgatgagaacttcgagtttttcttcaagaaggattcgctctggcagtcggaggatcttgcggctgtcgttggcaaggatgtcggccgtacctgtattcttcagggtcccatggctgccaagcacgccactaaggtggacgagcccatcaaggacatcctcgacggaattcacaacggtcacatcgccttgctcacccgtgatatgtatggcggcgatgagagcaagatccctaccattgagtactttggtggtaagctgatcgagtcagaaattcctctcgatatcgagggtcttactgtctcctatgatgagcacaagaacacctatcgtctgtcctcatcgccttccgttcaacttccttcgctggacgcctggctttcgcttctcgccggacaccaaagaaactggcgtttcgcccttctccagtccgacgtcctcgtccaaggacaaaaataccagaccaaccccatgcgccgcatctttgcgccggctcgtggtctgtttgtcgagattctacacccgaacaaccccgagaagacggtcattctcgtcaaggagcagccacgccccaaccgctacgctgaggtcattgaggtcaagctggacggcaagaacgagattgtagtcaacatgatcaaggataccacggccctcggaaagccagtgcccctcactctcaagtttatctacaaccccgaggctggctatgctcctattcatgaggttatggatggtcgcaatgatcgtatcaaggagttctactggcgcgcgtggttcggcgatgagaagctcgacctcgattcctccgttcatgaagtcttcgacggcggcaagaccaccatcaccagcgaggccatcaatgagtttgttcacgccgttggcaacaccggagaggccttcgttgacagacccgacaaggtcatgtatgctcccatggactttgctatcgttgttggctggaaggctatcaccaagcctattttccctcgcaccattgacggtgacctgctcaagctcgtccatttgtccaaccagttccgcatgatgcctggtgctgagcccctcaagaagggtgatgtggtttcgactactgctcagatcaacgctgtcatcaaccaggagtctggaaagatggtcgaggtctgtggtaccatcactcgtgacggtgagaaggtcatggaggttacttcgcagttcttgtatcgtggtacctacaccgacttcgagaacacattccagcgcaaggtggagacccctatgcagcttcatcttgccacctccaaggacgtggccgtccttcgctccaaggattggttcatgatggatgatgttgaaaaccctgatattgagcttctcggccagaccctcaccttccgtctccagaccttggttcgcttcaagaacaagactgtcttcagccacgtggagacccagggccaggttcttcttgagctcccgaccaaggagattatccaggttgccactgtcaactactacgctggagaatctcacggaaatcccgtcatcgactacctccagcgtcatggttcctccattgaacagccgatcaactttgagaaccctatccctctgagcggaaagacccccctccaactcaaggcgccctcgtccaacgagacttatgcccgcgtctccggtgattataaccccattcacgtttctcgtgtcttttccagctatgccaaccttcctggcaccatcactcacggcatgtactcgagtgccgcggtgcgcagcttggttgagacctgggctgccgagaacaaggttggccgcgttcgcagcttccacgcctctcttaccggcatggttctgcccaatgatgatatcaacgtgaagttgcagcacgtcggcatggttgctggccggaagattatcaaggttgaggctagcaacaaggagaccgaggaaaaggtgctcctgggcgaggccgaaattgagcagcctatcaccgcttacatcttcaccggccagggctcgcaggagcagggcatgggtatggatctttataacagcagccctgtggccaaggctgtctgggatcgggccgacaagtatctcatggacacttatggtatgtcccttactattgtctttttgttgattccaatgctaacaggtctataggctttgccatcaccaacattgtccggaacaaccccaaggagctcactattcactttggtggccctcgtggcaaggccattcgccagaactacatgtccatgactttcgagactgtggctgccgatggctcgatcaagtcggagcgcatgttcaaggagatcgacgagaagactacctcttacacttaccgctcacccaacggtcttctctcggctacccagttcacgcagcccgctcttactctaatggaaaaggccagcttcgaggacatgaaggccaagggacttgtgccccgtgatagcaccttcgctggtcactctcttggcgaatactctgcgctggctgcccttgccgatgtcatgcccatcgagtccctcgtgtccgtcgtcttctaccgtggtctcaccatgcaagtcgctgtcgagcgcgatgagacaggccgctccaactatggcatgtgcgctgtcaaccccagccgtatcaacaagactttcaccgaagaggccttgcggttcgtggtcggtagcatcgcagagaccaccggatggcttcttgaaatcgtcaacttcaacgtcgagaacatgcagtacgtctgtgctggcgacttgcgtgcgctcgacacccttggcggtgtgtgcaacgctatcaagatgatgaagatcgacattgagaaaatgcgcaaggagtactctgccgagactgtcaaggagcagctggtcgagatcatcaagtcgtgcgccaacgacactcaggctaagcccactcccctcgttctccagcgtggctttgcaactatcccgctccccggtatcgatgtgcccttccactcgacattcctgcgctctggtgtcaagcctttcagaagcttcttgctcaagaagatcaacaagactaccatcgacccatcgaagcttattggcaagtacattcccaacgtgactgctaagccattcgcaatcaccaaggagtatttcgaggatgtctaccggttgacgaactcccctaagatccaacagatcttggcaaactgggataagtaccaggaggag

SEQ ID NO: 27111 - DNA, 5718 bp, Neurospora crassa
atgcgtcccgaacttgagcaagagctcgcccacaccctactcgtcgagctccttgcttaccaattcgcctctcccgtgagatggattgagacgcaagatgtcttcctcgcggagaagacagccgagcgggttgtcgagattggtcccgccgacaccctcggtggtatggccaggaggacgctcgcctccaagtacgaagcattcgacgctgccaagtcaatccagagacagattctttgctacaacaaggacgcaaaggagatttactacgatgtagaccctgtggaagaagagcctgagccggttgcggctagctcatcatctgctgctcccacccccgctgccgctgctgctccggctgctgccgctgctgctcctccgcccccgagtgctggccccgcggcttcagttcccgatgccccagttcccgctcttgacattgtcaggtcgttgatcgcccagaagctcaagaagccctttgcagagattcctttgagcaaggctatcaaggacttggtaggaggtgagattataccacattctgttactggccgacatgacaatgactgacagagtttgcgtacaggcaagtccactctacaaaacgaaatccttggtgatctaggcaaagagttcggatccacaccggagaagcctgaagatacgcccctcgatgagctgggtgctgctatgcaggctaccttcgatggtaacctaggcaagacaacccagggtcttatcgctcgtcttatttcgtccaagatgcccggtggcttcaacatcacatcagcacgcaaatatctcgagacaaggtggggtctcggttctggccgtcaggacggtgcgcttctgctcgccatcactatggagcctccagctcgtcttggctccgaggccgaagcgaaggcttatctagatgatatttctcaaaagtatgcctcgcatgctggcatcagcttgtccaccgcggccgcggctggccctgctgccggaggcggcggcggcatgatgatggatcctgcagccattgaggcccttaccagcgaccagaaggctatgttcaagcaacaattggagcttatcgccagatatctcaagatcgatatccgcgccggagacaaggctttccaggcgtctcaggaatcttccaaggtcctgcagtcacagctggatctctggatggccgagcacggcgatttctacgctgccggcattgaacctgtctttagctccctcaaagctcgtgtgtacgattcttcctggaactgggctcgccaggatgctctcagcatgtactatgatatcatcttcggcaggctgaaggccgttgatcgcgagattgtcagccagtgcatccgcatcatgaaccgctctaatcccaccctcctcgagttcatgcaataccacatcgacaactgccctacggagcgcggagagacgtatcagcttgccaaggagttgggctatcagctcattgagaactgtaaggaggttctcaacgttgaccctgtctacaaggatgttgccgtccctaccggcccccgtaccaccattgacgctcgtggcaacatcaagtacgaggagattcctcgtgcaagctgccgcaagcttgagcattacgtacagcagatggccgagggtggcaagatctctgaatacagcaaccgtaccaaggttgagaatgatcttgctcgcatttacaagctgattaagcagcagcacaagctctccaagaactctcagctcgagatcaagtctctgtatggcgacatcatcaggtctctgagcatgaacgaaagccagattatgcccaaggagtccagcaaggtcagcagcgtcttgtccaagtcgtcgtccaagtccaagggcaagaccgagacaattcccttcctccacctgcgcaagaagtccgagcacggctgggattacagcaagaagctcaccggcctctaccttgactgcttggagcaggcggccaagaatggtgttaccttcgccaacaagtacgtgctcatgactggtgcgggcgccggttccatcggtgccgaggttctccagggtcttatcagcggtggtgccaaggtcatcgtcacgaccagccgtttctcgcgtgaagttaccgagtactaccagtctatgtatgctagatttggctctcgtggctctcagctcgttgtggttccctttaaccagggtagcgtgcaggacatcaacgccttggtcgactacatctacgacaccaagactggtctcggttgggatcttgactacattgttcccttcgccgccatctctgagcagggtcgccagattgatggcattgactccaagtccgagttggctcaccgcatcatgttgaccaacctcatccgcctccttggcagcgtcaaggctcagaaggccagccgcggtttcgaaactcgtcccgcccaggtcatcctcccgctctctcccaaccacggtacctttggtagcgatggtctctactccgagtccaagctcggcctcgagactctcttcaacaggtggcatgctgaggactgggccaactacctcactatctgtggtgccatcattggttggactcgtggtaccggcctcatgtctggcaacaacctggttgctgagggtgttgagaactttggtgtccgcaccttctcccaacaggagatggcctttaacttgcttggcctcatgtcgcctactattgtcgacttgtgccagaacgagcctgtcttcgctgatctgaacggcggtcttcagttcatcaccaacttgaacgagaccatgactagtcagcgcaagaaccttatggagaccagcgatattcgcaaggccgtcaccaaggagactgctattgagaacaagatcgtcaatggcgaggactccgaggctctgtacaagaagaaggtcatcgagccccgtgccaacatcaagtttgacttcccgaccttgcctgactggaagtccgaggttgctcctcttaacgacactcttaagggtatggttgatctggagaaggtcgttgttgtcactggtttcgctgaggttggcccctggggtaactccagaacccgctgggagatggaggcctatggtgagttctcacttgagggctgcattgagatggcctggatcatgggtctcatcaagaaccataacggtcctattaagggcaagccctactctggctgggttgatgccaagactggcgagcccgttgatgacaaggacatcaagcccaagtacgagaagtacatccttgaacacgctggtatccgtctgatcgagcccgagctattcgacggttacgatcccaacaagaagcagcttctccatgaggttgtcattgaggaggatctcgatcctttcgaggccaccaaggacaccgctgaggagtttaagagagagcatggcgataaggtcgacatctttgagattcccgaaactggtcagtacactgtccgtctgaagaagggtgcctcgctctggatccccaaggctctgcgctttgatcgtctggttgctggccagatccccactggctgggacgccaagcgttacggtatccccgacgacatcatttctcaggtggatcccgtcgctctcttcgtccttgtgtctactgtggaggctcttctctcgtctggtatcaccgacccgtacgagttctacaagtacgtccatgtctccgaagtgggtaactgcgttggttctggtatgggtggtgcaactgcactccgtaacatgcaccgcgacagataccttgataagcctgtccagaacgatattcttcaagagtccttcatcaacaccatggccgcgtgggtaaacatgctcttgatctcgtcttctggacccatcaagacgccggtcggtgcttgcgccaccgctgtcgagtctatcgacattggctacgagaccattatggagggcaaggcccgcgtgtgcttcgttggtggcttcgatgactttggcgaggagggctcgtatgagttcgccaacatgaaggctaccagcaacgctgttgatgagtttgctcatggtcgcacgcccaaggagatgtccaggcccactaccaccacgagaaatggcttcatggagtcgcagggtagcggtgttcaggtcatcatgactgccaagcttgctttggacatgggcgtccccatctatggtgtccttgctttgaccaccaccgcttccgacaagattggtcgctccgtccctgcgcccggcaagggtgttcttactactgctcgcgagcgccagggtagcctcccctcgcccctgctcgatatcaagtacagacgtcgccagattgagcgccggaagaagcagcttgagaacgagaaggaggaagagcttgagtatctcgccgatgagatcgaggccctcaaggccgaaggcaggccgcagaaggagattgacgactatgcccgccacagaacccaacacattgaagaggaggccgaaagacaggtcaaggaagttctccgcagctacggcaacaacttctggaagggtgatgctacgattgctccccttcgtggtgccctcgctacttggggcctcactattgacgatcttgacgtcgcctctttccacggtacttccaccaaggccaacgacaagaatgagtcgtctgtcatctgccagcagctccgtcatcttggccgcaagaagggcaatgccgtgctcggcatcttccagaagtacctcactggtcatcccaagggtgctgctggtgcctggatgatgaacggctgcttgcaagtgctcaacagtggcctcgtccccggcaaccgcaatgccgacaacgtcgacgctgtcatggaggagtttgactacattgtttaccctagcaagagtatccagactgatggtgtcaaggccttctccgttacatcgttcggtttcggccagaagggtgctcaggccattggtgtccatcccaagtatctttatgccactcttgatgaggaggtattcaacgcttaccgcaccaaggtggaggctcgccagaagaagacctaccgcttcttccacaacggccttatcaacaacaccctgttcgttgccaaggataaatctccctactctgatgatcagcttcaatcggttctccttaaccccaaggcccgcgtcaccgaggacaagaagaccggccagctcacgtatcccgccaacttcatggagttggagccagcacagaagctgcagaagaagagcgaggaatctcttgagtcgactgttgcccgtgctgcaaaccgtctcaagaacagcaacacccgtgttggcttcgatcttgaggagatttcctccatcaacatcgacaatgaaaccttcttggaacgcaacttcaccgaggctgagctccagtactgcaaggctcctagcactggtcggtcgccgcagaagtcgtttgctggtcgctggagcgcgaaggaggccgtctttaagtcccttggtgtcaccggccagggtgctggtgcatccctgaaggacattgagattctctcagatagcaacgggggtcccgttgtgaaggtacgtgtctccttttttgtttttgttttttgtcattagaatcagttgctaacatgttgatagttgcatggtgctgctttggaggccgcgaataaggctggcgtttccaaggtcaacgtgacgctgtcctattctgacagccatgctgttgccattgctacggctcacttc

SEQ ID NO: 27112 - DNA, 914 bp, Neurospora crassa
ttttccttttgaacgtaacactctttcactcaggtgtccaagacacaacgttcgttctccctcacgtcgcgaccaagcataatattcccaagtacacgcgcgctgagtttccgcgaaagatatggcagacttggaaagtcaatccgcttgcgtttgagcaacgcgatctcgacaccgcgcggtcctgggtgggacagaacccctcataccgatacgaagttctgaccgacagcaatgacatgcagtacgtcgagtggcatttcggccccgacggattcaaccgacccgatatcgtcaacttttaccgaagcgtcaaggctgcaattgtcaaggccgatctcttgcggtacctagtcatgtacgctgagggcggtctttatgccgacatcgatgttgaagccctcaagccgctttcgaaatttgtgccggagcggtacgacatggctgatattgatatggtcattggtgtcgaaatcgacgagccggactggaaggaccatcccattcttggacccaagtcccgctcgttttgtcagtggactttcatgtgcaagccgcaactgccagtcatgatgaggctgattgagcaaatcatgacctggctgaacggggttgctaaagagcaaggtgtgccgcttgctgaagtcaagctcgattttgaccagatcatcagcggaacaggcccatcagccttcaccaacgccatcatcgccgagatgaacgatgccagccataatccgggtaaaccgatcacctgggatacgttccacgatctgggggaatccaagcttgtgagccgcgttttggtcttgacggttgaggcctttgctgctggccagggccattccaactcgggcaaccatgacgcgcgcgccgccctggtaaagcaccactaccacgcctcgaattggccc

SEQ ID NO: 27113 - DNA, 684 bp, Neurospora crassa
tacacggacaacggcggttcgacgcttgccattgctggcgctgacttcacaatcatggccggtgacacccgcctgacatcaggctacagcatcaactcgcgataccatcccaagctattcaagatcggaggcaccacggcagaccagaaggacgccaccatcgtcttgtccgtcgttggctttgcggcggatggagaggccttgaaagaacgtctcgacgctatttgcaaaatgtaccgctaccgccacggcaagcccatgagcgtcaaggcatgcgcccagcgtctgtcgaccattctataccagaaacgtttcttcccctactacgtctatgccattcttggtggtttggatgaggagggcaagggcgccgtctattcgtacgatcccgttggaagttacgagagggaacagtgccgggctggcggcgcggcggccagcttgattatgccgttcttggacaaccaggtcaacttcaagaaccagtatgagcctggcagtggtgttggccatgcgctccaggagcgcgagcgcaagccgctcacacgatccgagggcgaggttttggtcaaggatgccttcgacggagctgttgagcgtcacatcgaggtcggtgatggcctgcagatgatggtcatcaccaaagacggaattgaggaagtcttgctcccattgaagaaggac

SEQ ID NO: 27114 - DNA, 1246 bp, Neurospora crassa
tattatcacaacaagatcgaggccatgaagctcgagatcctcaagggccaagccgtcctccgccgtctcgaagcgcaacgaaatgactacaactcgcgtgtgcgcctgctcagggaagagctcggtctgctacaacagcccgggtcctatgtgggtgaggtcgtcaaggttatgagcacaaagaaggtcctcgtcaaggtacaccctgagggcaaatatggtatgcgcactccgcctccttctggagtgtcctgttttacggatgggtaaacagatggaagtaactgacctattgccccgccgcctaccagttgtcgatgtatccgacaatgtcgacatcaccaagctcaccgtcggcaagcgcgtcacccttctctcagactcgtacaagctcgaaaagatgcttccctcctcagtagacccgctcgtgtccctcatgatggtcgaaaaggtgcccgacagtacttacgatatgattggtggtttggaccagcaaatcaaggagatcaaggaggtgatcgagctcggcctcaagcaccccgagctgttcgagtcgctaggtatcgcccaaccaaagggtgtcctgctctacggccctcccggtaccggcaagaccctgctcgcccgtgccgttgcccaccacaccgactgcaagttcatccgtgtctcgggttccgagctcgtgcaaaagtacatcggcgagggttcccgcatggtacgcgagctgttcgtcatggcgcgcgagcacgcgccctccatcatctttatggacgagatcgactccatcggctcttcgcgtgtcgagggttcgtctggcggcgactccgaagtccagcgcaccatgctcgagctcctcaaccagcttgacggtttcgagcccaccaagaacatcaaggttatcatggccaccaaccgtctcgacattctcgaccccgccctcttgcgccctggccgcatcgaccgcaagatcgagttccctccgccgagcgtcgaggcccgtgccgacattctgcgcattcacagccgcaagatgaacctgacgcgcggcatcaacctgaccaagatcgccgagaagatgaacgggtgctcgggcgccgaactcaagggtgtctgtaccgaggccggcatgtacgccctccgcgagaggcgcgtgcatgtcacacaggaggactttgaactggccacggccaagattctgaataagcatgatgataaggaggtgtcgttggccaaattgtggcgttaa

SEQ ID NO: 27115 - DNA, 1221 bp, Neurospora crassa
atggccccctctacccccaaggtcgacgccgtcgtcgagaaggctaaggctgctgctgctcccgagatgagcgctgccagcctctacggcagattcgctcttgctggtgccatctgctgctccgtcacccacggtgccctcacccctgtcgatgtgtatgttgtcccgccttcagcttctgtatacactgtcatggcattgggcgcattgaattcgcagcccagtgcctctgtctcgtagatatcacgaatcgcgctgctgacacgtctgcataacaacagcgtcaagactcgcattcagctcgaccccgtcacctacaacaatggcatgatcggtggcttcaagaaggtcgtccagaacgagggtgccggtgccctcctgaccggtgtcggccctacctttgctggttacttcctccagggtgccttcaagttcggtggttacgagtctcattcaagcagcagagcatcaactatgctcggccttgatgaccgccaccaacaacacgcactgccgtctacctcgcttcctccgccgctgccgagttctttgccgacattgccctctgccccctcgaggctacccgtatccgtctcgtctcccagcccacctatgccagcggcctcatcagcggcttcggcaagatgctgaagaacgagggtatcggcgctttctacgccggcttcggacccattctcttcaagcagtaagtcgccatgttgcccatgttccggtcatcatgacatgcccctaaccgtgctttttttcttccaggatcccctacaccatgtccaagttcgtcgtctacgagaaggtcgccgaggccgtctacagcgtctaccccaagaaggatatgtccgactctgcccagaccgccgtcaaccttggctccggtctcattgccggtttcgccgctgccatcgtctcccagcccgccgataccatgctctccaagatcaacaaggtaactatgccagacaatccaatacccagccggactatgctaacgtgcttcactcccagacccccggtgctcccggcgagtccaccacctctcgtctcgtcaagatcgccaaggagctcggcctcaagggctcttacaccggtatcggtgcccgtctcttcatggtcggcacccttactgccttccagttcgccatctatggtaagttcgtccttattctcgccagcgagatgggcttgtggtggtattgggaatcc

SEQ ID NO: 27116 - DNA, 1455 bp, Neurospora crassa
atggccttccgcaccgccctccgccgggtcgctgccgtcaacgcggcgcctgccacccgcctcgccggcgccggtgccggtgctgctactgctgcccgccgctcctatgccaccgcctctcagctcacccaccccgatccgaccgaggattcgcccagcggcaagatggtccgcgagcacgtcccctacatggtgaccacctactctcgccctcctcccgtcttcgtcaagggcaagggctcttacctttgggacttggaggaccgcaagtacctcgacttcacgtcgggtattgctgttaactcgctcggtcattgtgatgaggagttttccaagatcattgctgagcaggtgcgtcataatcaactcctccttgtattcaagatggataattgtcaactgacttaacgattgcctcgacaggcccaggaactcgtccacgcctccaacctctactacaacccctggaccggcgcgctctccaagctcctcgtcgaatccacaaaggcctcgggcggcatgcacgacgcctcctccgtcttcgtctgcaactccgggtccgaagccaacgaagccggtatcaagttcgcccgcaaagtcggcaaggtgctcgacccctcgggttccaaagtcgaaattgtctgcttccaaaacgccttccacggccgcaccatgggttccctctccgccacgcccaaccccaagtaccaggccccctttgcgcccatggtccccggcttcaaagtaggcacctacaacgacattgccgctatcccctctttggtcaccgaaaagacctgctccgtcatcgtcgagcccatccagggtgagggaggcgtgatgcccgccactgaggaattcctcgtggcgctgggtaagcgctgccgcgaggtgggcgcgctgctccactacgacgagatccagtgcggtttggcccgcacgggaaccttctgggcgcactcttccttgcccaaggaagctcaccccgatatcttgacgaccgccaaggccatcggcaacggcttccctatcgccgctacgatcgtcaacgagcacgtcgcttccaagatcaaggtcggcgaccacggcactacctttggcggcaacccgcttgcgtgcagactggcgcattacattgttggcaggctggccgacaagcaactgcaggagggagtcaaggccaagagcgaggttttcctgcgagggtttgagaagctcaggaacaagttcccgagcttggtcaaggaggtcagaggcaagggacttatcttgggcctgcagctgagcgaggatcctacccccgtgatcaaggctgcgagggagaggggactgctggttatcaccgcgggaacgaacaccctcaggtttgtgccgagtttgttggtgacggagggagagatcgaagaggggttgaagatcttggaggagagctttgaggctgttatggttaaggct

SEQ ID NO: 27117 - DNA, 641 bp, Neurospora crassa
tttcggatgctcttctctaccttcaagctgctcgccttcacccacctcttcctcgaacacgtcctctccatggcgccggcctccggcccctctatgctccccacctttgaagtggtgggcgagtggctcgttgtctcgcggttccacaaatatgggaatggagtgaaggtgggcgatctggtggtttatcagattcctgttagtacgagtggggagctgggggtgaagaggatcatggggatgccaggggattatgtgttggttgatacgccgatggcgggtggagggactgtggagggggaggtgttgggggacaggggcgggctcggggagggggatgaggttatgattcaggtatgttttggactctattctcggtgatgatgagcacatggtgcgaatgggtggactggggcgacgacgtaaagtggaacaagtattgctaacgaatgtggtaaatgatttaggtgccggaaggtcattgttgggtggtaggcgacaacttgacggcctcgcgcgattcgaggacgtttggccctgtgccactagcactgatcaggggcaaggtgtttgccaaagttcaatcgaactggctccctaagttgataagaaatcctttggagagggtagagcttgaggag

SEQ ID NO: 27118 - DNA, 1003 bp, Neurospora crassa
atcacaagctggatggctctcatggagaccatgtttccatctattgccaagatggagagcattggagactcgtacgagggaagacccattcactctttccgcattggagatcacagcggcgacaacgcaaacaatggcaccaggaaaacgatcctcgtcaccggcgggctccacggccgtgaatggatatcgacaagcacggtgacgtacctgttgtggtcaataatcacggcctatggaaaggagtcgatggtcacgaagcttctcaagcacttcgatatcatcttcattcccgtggtcaatccagatggttacgattacacgtggaagactgatcggctgtggcgcaaaacaagacagcaaaccaaggtgtcttggtgccacggcttcgatctcgaccaggcttttggctctgtatcgggccaaaccaactttcaagtcgacccgtgttcagaaagttatggcggtgacaaaccgttccaggcagtcgaggctacccgcctggctgactggggaagaaaccagactgagaacggtgtcaagtttgtcgggttcttggacttgcactcgtactcgcagcagatccttttcccttacacctccacatgcgatgaggacccaccgaaccgcgaaaatctcgaggaacttggcgttggtttggccaaggccatccggctctccagcgggaacttctatacggtgagctcagcatgtgagggtactactacccgtcaagatgccgcgaatgaggccactggtggctcagccattgattgggtctatcgtaagttttctttccatcacttctagccatcacgtggtgggatgttcggaacagcatatactgacatgcaacgcagatgaactgtactcccggtatagctaccaggtcaaactccgtgataccggcatctatgggtttttgcttcctagatcgcagatcatacccactggagaggagatgttgaatgctctgaaatactttggtgactttttgctggga

SEQ ID NO: 27119 - DNA, 3704 bp, Neurospora crassa
agctacaaggagcaaaccgtaatcgaacccttttcccccggtaccaatgttattgttggtcgcaacggttcaggcaagagcaacttcttcgccgccatccgattcgtcctcagcgatgcctacaccaacatgagtcgcgaagagcgccaggccctgcttcacgagggttcgggctcggccgtcatgtcggcatacgtcgagatcatcttcgacaacaccgataagcgtttcagcgaacccggcgacgaggtcgtcatcaggaggacgatcggtctcaagaaggacgaatattcagtcgacaagaaggtgcagactcgtgccgatgtcctcaagattctggaaacggccggcttcgccaaggaaaaccccttctacatcgttccccaaggtcgtgtcgcagccatcaccaacatgaaggagaacgaaagactcaacctgctcaaggaaattgccggtaccaacctttacgacgacaggcgcatacagtcgctgaagattatggccgagacaaatagcaagcgcgagaagatcgacgagttgctcgagtacatcaaggagcgtcttagtgaactggaggaggagaaggacgaactccgcgacttccaagaaaaggaccgcgaacgcaggtgtctcgagtacgcccactggcaccgcctacaggagaccaacaacaacactctggagcagatcgaagaggtgcggcagggaggtgctggcgcaacgactaaggaccgggtccaactccagaaaacggaaaaggaaattgctgccctcgaccacaagttccaggagctgaagcagactcttgagctcctggccatcgaacggcgccagttggatgaggacaggaaagacaccgcgcgttcgcaggcaaaggcagagctgaagctgaaggatctcgacgagacacggcattcgcgcgagaaggcccagcagcaacaggaagcggagctgaacgaggtcaggcgaaggatccaggctgccgagtcagagcttgccaaaatcacaccagactacgagaaatggaagaaggaggaggaagaagtggcggccgcaagggatctggcggccactggtcgtaccaggttgctgacgaagcagacgcgaagctcccaattcaggacaaaggccgagcgcgatgctttcctgaagagcgagatcgaggagacgaccatgcagcttgcgaaccagcgggccaatgagatggatgcgaaggaacaggtcacgctggtcgagaactcgatcaagcaactagagaaggagatccaaaacatccgtgacaggctcgaaggatacggtgaggaccggtcatcaatcgccgagaagctgaccaaggctcaggaggccagggaacacttgtacgaagagcgaaagagactgcgtcgtgaggaggacaagctcagttctttgcttgcgaatacccgtgcagatagagacaacgcggaggcggacctctcacatgccatggattcggcgacagctaggggtctagcagcgatcagacgcctcaaaagagagcgggatattcccggtgcctatggtactctggcagagcttatgaacgtgccagtagacgcttacaggttgccggtcgaacaggtggcgggtaacagccttttccactatgtcgtcgacaacgaaaaaacgggcactatgctgtccgagtatctccacaagaactatggcggtcgtgtcacatttatgccgcttgagcaactacggccaaggcaggtgaagatgccaagggcctcggacgcccagccacttatcagcaaaattgagtttgacccgatatacgaaaaggcattccagcaggtctttgggcgcacaattgtctgccccaacttgtcgatagcctctcagtatgcacgcacacacggtgtggatgccatcacccctgaaggtgatacaaccaataagcggggtgctatgaccggtggctttgttgatgctcgccgatcacggctggaggcggtccggagactcgaagagcttcgggaactttacgagcaacagctggaagacttggacaggatcaagaaggaagatgagattctggagcaaaagatcacgagcgctaatggcgaggaacgtaagctcgatcaacaattgcgccagttcgagtcaggtttcgatcccctgaaggtcgacttgcggacgaaacagcttcagctggagcgcgagcggcgacatcttgaagacgccaagatgcgctgggcggccatcgagaagaacctgaaggagtttgacgagaacctcacagcataccgggccgaaatggcttccgagttcaagaaggcgctatcagccgccgaggagcgtcagctcgaggagttcggtgccgaagagcaccgcctgcagatgcagttgaaggaaatcagcaagaagcgtctggagctggaaggccgcaagaagtcactggagacggaacttcgtgcacatctcaggccgcaggaggatcagctgcgcagccaggcctttgagaactccgctactggtggaagcgggagctttaaggacgctcagaaggaactcaagaagcttaagaaggctgctgctgaggtcgacaggcaattgcaggagaacgaggagaagacggagggcatcgccgccgaaattgccgagctagaggcccacaaggcgcaaaaggagcaggaacaacaagagctccagaagcggatcgatcagtatcaaaagaagttggagaagaactctcaaaccaaggctcgtctgctccaacaggcggctgagtacgccaagaacattcgtgatcttggtattctgcctgaggaagcctttggcaagtatgagaagatgaagtctgagcaggcaagttatcatccttggacaattcttgcttgatctgcatactaactagaaaaaaaaaacagattgaaacaagactgcgcaaggtcaatgaggctctcaagaagtacaagcacatcaacaagaaagcctttgaccaatacaacaacttcacaacccagcgtgagcagctcctgaagcgtcgcaaggagctcgacacctcgcagaagtcgattgaggagctcattcagcatctcgaccacgccaaggacgaggccattgagcggacgttcaagcaggtgtctcgagagttctccaccatcttcgagaagcttgtgcctgccggccacggccgtctggtcatccagcgcaaggctgccggcagcaagaaccgcaatccagaggactcggacgaagatgggccttcctccgctaagggcgtcgagtcctacagcggtgtgggcattagcgttagcttcaactccaaggttatggatgagcagcaaaagattcagcaactcagtggtggacagaagagtatgttatttttctttctcatccttacctttccccccatcccccttactaacaccgtatgatcaccaggtctctgcgccctctgcctcatcttcgccctccaggccgccgaatcctccccctttgtcatcttcgacgaggtcgacgccaacctggacgcgcagtaccgtaccgccgtcgccgcgctgctggactccatctccaagacgcagaagacccagttcatctgcaccacgttccggccggaaatcgtcctggtggctgataagtgctatggcgttacgttccataataagacgagtacgattgattgtgtgccgacggaggatgcattgaatttcgtagagggtcaggttagtggg

SEQ ID NO: 27120 - DNA, 1613 bp, Neurospora crassa
gatggcgccgtccttcgcaatatcgatgcctgcagggccatctcctcgaccgtccagacctccctcggcccctatggacgcaacaagatcgtcatcaaccaccttcagaagatgatcctgacctccgacgccgctaccattctccgcgagctcgatgtcgtccaccccgccgccaagctgctggtcatggccagtcaacaacaagaatccgagatgggcgatgccaccaaccttgtcatcatccttgccggtgagctcctgaagaaggccgaggacctgttgcgcatgggtctcaagacttccgacattgtcaccggttacgagcgcgcccagaagattgccctggacaccctggaggagcttgttgtcgacaaggtggaggacttgcgctcgcaggccggtttgagcaaggccatcaggaccgttattgccagcaagcagaacggcagcgaggacttcctcgctgatctggtcgccgaggccatccttgccgttctccccaagaaccccgccaacttcaacgttgacaacatccgcgttgtcaagattatgggtggcaacctcgaacagagccgggtcgtcaagggcatggtcttccccaaggagcccagcggcaccgtcaagaaggccaagaaggccaaggtcggtgtctacacctgccccatcgataccagccagaccgagaccaagggcaccgtcctactacacaacgcccaggagatgctcgacttcacaaagggagaggagaaccagctcgagacgatgatcaaggagctctacaactccggcctcagagtcgtcgttgccggttccacagtcggtgagctggcgatgcactacctcaacagatacggcatcctggttctcaaggttctgtccaagttcgagctcaggcgcgtatgcagagttgtcggtgccactcccctggcccgtctgggtgctcccatgcccgacgagatgggcagcatcgacgttgtggagactatggagattggcggtgaccgcgttaccgtgttcagacaggaggatgaggtcacaaggacagcaaccctcgttttgcggggcgctactcagaaccacctcgatgatgttgagcgtgccgtcgatgacggtgtcaacgtcgtcaaggccatcacaaaggatgctcgcttggtccctggcgccggcgccactgagatccagctcgtcgagaggatacaggctattggcgagagaacccagggtctcgcgcagtactcgatcaagaagttcggtgaggcattcgaggtcgttcccaggttattggccgagagcgctggtctggatgccaccgaggtgcttagcaggctctacgccgcccatcagaagaaggacacttggtccacaggtgtggatatcgaggtatgtttcatccacctattcatcctgattccagcagtgaactgacaagttcacagaacaacgacaacaccggtacccttgatgccgtgaaggagggtattctcgatctcctcgtaaccaagcagtgggctatcaagctcgccaccgaggctgccaggacagttctttccgttgatcagattatcgttgccagacaagccggtggtcctaagccccccggtcccaaccccgta

SEQ ID NO: 27121 - DNA, 1004 bp, Neurospora crassa
atggacggcaggaaacacccaagttctttccagcagcttgaaaagctgggagagggtacttatgctactgtaagagatctctccttggcccagaactgtccctcggtgaacagggagaagtatttgtagggtgcaaatggctgacactacgtcctcaggtcttcaaaggccgcaaccgacagacgggcgagcttgtagctctcaaggagattcaccttgactcggaagaggggacaccgagcacggcaatccgcgagatctcgctcatgaaagaactgaagcacgagaacattgttgctctacacgatgttattcacaccgagaacaagcttatgttggtgtttgagtacatggatggcgatcttaaaaagtttatggacaccaacggcgagaggggagccctcaagccacatgtcatcaagtccttcatgcatcagttgctcaagggtattgacttctgccacaagaacagggtcctacatcgagacctgaagccgcagaacctccttatcaacagcaagggcgctctgaagctgggtgatttcggtttggcgagagcattcggtattccagtcaacaccttttcgaatgaggtcgtcactctttggtatcgagctcccgacgtgcttcttggaagtagaacctacaacaccagcatcgacatttggtccgcgggatgtatcatggctgagatgttcaccggcaggcctttgtttcccggcaccactaacgaggatcagattgttcgcatttttaggataatgggcacgccgacggaacgtacatggcctggcctcacctcgttccccgagtacaagcctaactggcaaatgtatgcgacacagagcctgtcatccatcttacctcagattgaccgcgacggcatcgacttgcttcagcggatgctacagttgcggcccgaattgcgaatctcggctcacgatgcgcttcaacaccactggttcaacgacctggtccaccaacagcatcatcaccaagcgcag

SEQ ID NO: 27122 - DNA, 2042 bp, Neurospora crassa
ggacaacaacacaatcgtccatcgatgacaccgtcaccctccaacgccatgtcccgcctacccatccctttgcggctcccgacatgagcctcattttcgacttctctcctgtcccattactcctcctgtcctcgtcgtgctgcatcacccgggtctcaaaacgcttctgccaagactggcatgtcaccgaagaggactgcatcggcaagttcctgctgcccttcctcgagagccagatccgcgaaacgggcgccagcaaatcaagactcattgccgaagccgtcgatgatgccgtcgccgctcgatccgagcgcacttccaaggccattaccgtcaagagtgccttcacctgtcgcgcccgcgtgatacccatctttcgggatgccgagctggtctccatctacctcgaatggcacgagcgtccatcgtccgaggtcctcgacaacgagcaggtccaaccgggcctatccacggatgaagcctttcgcattctcgtgcaagccaccaaggactatgccatattcctcctcgatacaaaaggtcacatcgcaacttggaatactggcgcgcaactgctcaagggctacactcgggaagagatcatcggcaaacacttttccattttttacggcaaagaagatttggacatcaagaagccagacatggaactggacatttgtcttcgcgagggtcgtgtcgaagacgaaggctggcgctacaagaaggacggaacgcgcttctgggccaacgtcgtcatcacggccgtctacaagaatggcgtccacgtcggctttggcaaggtcacgcgcgacttgacggagcgtaaggcgtccgagtcccgcctgattgctgcctacgaggagagcgagaagctcaagtcggacttcctcgccaacatgagccacgagatccgtacccctatgcacggcatgctttcggcttgcgcgttgctgctcgactcgccccttaccgagaggcagcgagacattgtcaacatcatggatgagtcgggtcagatcttgttgcaggtcatcaacgacatcctcgactattccaagctagcttcgggcagtttctcagtcagctccgatgtagttggtgtcgccagcatcatcacctcagtggttcgcgctgtccagacgacgttgccaccagcagtccactttgagctcttcctcgcccctaaccttccaaagtccgtccaaggcgaccccctccgttaccgccaaattgtccaaaacattgttggcaacgcagccaagttcaccgacaaaggtagcatccgcgtcaaagcttcggttgactcggaggacaacgacagctacaccatcttaaccgaagtcatcgacacgggcattggcatccgcgagtccgcctctgcctcgcttttcacccccttcagccaattcgacctcaccaccaccaagcgttacaagggcacgggtctcggcctctccatcgccaaatccctcgccgagctcatgggcggccgcatcggctaccgccccaaccccgaacgccacgggtctgtcttctggttcaccgcacgcttcaagaagattaagagccttgaacagatccaagactggaagcaccagatggccgctaaggacggttcacccatctcgcctattcagcccgacgtcacggttctccaacaacgacttgcctcggtcgccggcaccaaaagtattttgctcgtcgaagacaacgttatcaaccaaaaagtcatgctgggcatgctgcgctcacttggctttaggagcatcgacctggcagctgatggcgccgcggccgtgaagatggtcaccggaaaacctgtcgggtatgatatcgtgctgatggatattaacatgcctatcctggatggaaacgaagcctcgcagaaaatccgtgacgctggagtgaaggtgcctatcattgccatgactgcttacgccctcaagggggaccgtgaaaagtgcttggaatacggcatgaacgactatgtccccaagcctgtcgacaggaagttcctcatcaaggtcttggctacctggatc

SEQ ID NO: 27123 - DNA, 1296 bp, Neurospora crassa
ttcatcccgctgattaacgacaactttggccgtcgatggtgcatcatgtttggttcctgcatcatgatcatcggcacattcattcagggtttttcgaagaacggtgtgcccacttcatgctacgacttcttcgctcggtcatactaacgtcctccagcccccatgtacatcattgcccgcgccatcattggtttcggtctcccctacgccattgtcgccggctcatgcttgattggcgaactcgcataccccaaggaacgtcccattctgacatccctcttcaacgcctgctacttcatcggcgccatcgtggccgctggctgcacgtatggtacacaacgaattacaaacgattggtcatggcgaattccctcccttcttcaaatggctccttccctcctccaagtcatctttgtcttcttccttccagaatctccgagatacctgatgagtaaacatcgacttgaggaagcaaagaatgtgctcatccgctaccatgccgaaggaaacgcggacagtgacttcgtcaaggcggaaattgccgagatcaaagtcactctcgagattgagttggagcattcgaagcagtcgtgggcggatatgatccggaccgccggtatgcgtcgccgcgtgctcatcggttctttgctcggccttttcactcaactctcaggcaatgtcgtcatttcgtactttctcggtgacgttctcaagttgatcggctacacggatcccagctttcagaccaagtataacttgggtaaccagtgctggagtttggtctgcggtgtcagcgccgcgatggtggttatgcggttccggcgcaggaccatgtacctgacgggcatcttttcgattttggcagtctacgttggctggacggtgtgcacggcggtgtttattgcgtacaagaatcccgtggccgccaagtttagtttgttctggatctatgcttatagtccggcttacaacttgtgtttcaacgctcttacctatagtcagtcctccttttatcatttaccctgctctctttcgtctggtgttttgttcagatgctaacaaatggcagcctacctcgtcgaaatcttcccctacgcccaacgcgcccgcggcatcgccatcttccagttctggggcaaggcggcgcagttcttcggcaccaacgtcaacccgatcggcacccaggccattggctggaagtacctgcttgtgtactgctgctggatctttgccgaggcggcgctcatctggttcttgtggccggagacgtcgaatcgtagtttggaggagttggct

SEQ ID NO: 27124 - DNA, 676 bp, Neurospora crassa
ttcatggccaagctcttcggcaccaaagaagtccgtgtgctcatgctcggtctcgacgccgccggcaagaccaccatcctgtacaagctcaagctgcaagaccacgtcaccaccatccccacggttggcttcaacgtcgagacggtcaccctccgaaacatcaagttcaacatctgggacgtcggcggccaggacaagatccgtcccctctggcgccattactactcgggtacccagggtctgattttcgtggtggacagcgcggaccataacagaatcgacgaggcgcgggtggagttgcatcggattatcaatgatcgcgagatgaaggattgcttgttgttggtgtttgctaacaagcaggatattgctggtggtgagtactcccttcttcttcttcccttggaattgtattttcgacgaggtgtccgctgcgctcggctctctttttctttgctcgctgcgctcgaactggggtttttgggacaaaagcctgaggggtatggatgaacctatgctaaccagacattctacagccatgactccccaggaagtcaccgagaagctccagctcaacaagctcaaggaccgcatctacgccgtacaacccaccattgcgatagacaaggccggtctgcaggagggcttcaactggctgtccgataacatgaaggct

SEQ ID NO: 27125 - DNA, 1448 bp, Neurospora crassa
cagtccgacactaaccgccctcagtctcagaccagcgtagcaatgccggccccctaaactaccaaaccaaggtccgcattaccgaccgctacaaagtcatcggcttcatctcctccggtacctatggccgggtctacaaagccaccggccgacaaggccaaaccggggaattcgccatcaaaaagttcaagcccgacaaggaaggtgaagccgtcgtcaactacacgggcatctctcagtcggcggtgcgtgagatggcgttatgctccgaactgcgaaaccacgccaacgttatccggctcatcgagattatcctggaggacaagtgcatcttcatggtattcgagtacgcagagcacgatttgttgcagatcatccaccatcacacgcaaacgccacgacatccgatcgcgccagggaccatcaagtcgataatgtaccagctgttgcagggggtgcaatacttacacaccaactgggtattacatcgagacttgaagccggcgaacatcatggttacttcttccggagaagtgaagattggcgatctcggactggccagggttttcaagcagcccatccacaacctctacatgggcgataaagtggtcgtgactatatggtatcgcgcgcccgagctgctgttggggagcaagcattacacgacagctatcgacctgtgggcggtgggatgcatctttgcggagctgctgagtcttcggcccatctttaagggggaggaggccaagatggatagcaagaagacggtgccgtttcagaaacatcagatgcagaagattgtggacgtaatgggcctgccgacgagggagcggtggcccttgttagccagcatgcccgagtatagccagttgtcgactttacagccgcccttgctgtcgaccaacacctcccactcccacggcggcggccaccacccctacggccatcgctcccagcaacaaccgcccgcgtcgcaaaacacgcacggaaacctccagaaatggtaccaccaaaccaccgtctccacccctctgacctcgctaggagcagaaggctacaaactcctcgcctccctcctcgaatacgaccccgagaaacgcttgacggccgccgacgccctcgtccaccccttcttcacctcgcccacctcgaccccgctggcttctctcaatagcaacacggccaatagcacttctcaaggaacaggagcagcagcagtcaactggtcaccaaccaactgcttcgaaggactcaaaaacgagacgtacccgtgcagacgcgtgtcgcaggacgacaacgatatcggcttcggcaccggaacaggcaaccagagtgggtcgcgggtgaacacggctgcggccgggacggggacggggctggtgatgggacaagcgcagtcgcaggttcaggctatgggaggttcgttggggaatatcggcggacatgga

SEQ ID NO: 27126 - DNA, 1226 bp, Neurospora crassa
gtcctcgatggcggtaccggcttcctcaaggtcggctacgccgcccagaatttccccgaattccaatacccctcgatagtcggccgccccattctccgcgccgaagaagccaaatcgctttccgactcctccgacattgtgatcaaagacatcatgtgcggtgacgaggccgcggccgcccgtaccatgctccaaatcagctacccgatggagaacggcatcgtcaagaagtgggacgacatgcagcacctatgggactacacttttcacgagaagatgaaggtcgatacgcggggaagaaagatcttgttgacggagccgcctttgaacccgttgaagaacagggagcagatgaccgaagtcatgtttgagcgctacgactttgggggtgtctatgtcgctatccaggcggtgctggcattgtatgctcagggtatgtcaccgctcctttacacggcgacttgaggaaacaagtagctgacagacaacgcgcaggtctctcctctggtgtcgtagtcgactcgggcgacggtgtcacgcatatcgttcctgtctacgaatccgtggtcctcaaccaccttacccgccgcctcgatgtggccggccgcgacgtcacccgcaacctgatcgccctccttctccgccgcggctacgccctcaaccgtactgccgacttcgagaccgtccgccagatcaaggaaaagctctgctacgtctcgtacgacctcgagctcgacaagcgcctgtccgaagataccaccgtcctcgtcgagagctacacccttcccgacggccgcgtcatccgcgtcggctccgagcggttcgaggcccccgagtgcttgttccagccgcacttggtggattgcgaccagccgggtatcgccgaattcctcttcaacaccatccaggccgccgatgttgacgtgcgctcctcgctattcaaggcgatcgtcctgtcgggtggttccagcatgtaccccggccttccaagcagactggagaaggaactgaagcagctgtggttgacgcgcgtgctgggaggcaaccccgagaggctgagcaagttcaaggtcaggatcgaggacccgccgagaagaaggcatatggtcttcttgggtggtgcggtgctggcgaatatcatggcggataaggagagcatgtggattacgaagcaggagtgggaagaacagggcgcgagggtgttggagaagttgggtcctaggtaa

SEQ ID NO: 27127 - DNA, 1566 bp, Neurospora crassa
aacctccgcgacctaacgatgtacctggtggtgctgataatcgtcagcaccctcggtcctcttcagtttggtttccatttggtatgcgccccttcctttccaagcccgacatatctctactaacaatctttccaggcagagttaaacgcccccgaagatgtcatcacctgccgcaaaacctccatctcctcgaccatctccagcctgctgtcctacgtcaagaactcctcgagcgatgtcgactgcatccccatgacccgaccccagtttgctaccgtctccgccatcttcaccatcggcggtctcttcggcgccctgatggccgggcccttcacctcctctcgaggccgttggctctccatgcagctgacagccgccttctatatcgtcggctccctcattgagaccctctcccactccgtccccgtgctttcgacaggccgtttcctgaccggtgtcggtgccggtgccagcacggtcattgtccccctctacatcagcgagatcgcgcctcctgcgcagagaggattatttggtgcttttacccaaatcagcattaacctcggcatcttgatctcgcaaaccatggggtacttcttgagtcacgattcggcctggaggtggatactaggatctggagtggtggtggcagctgctcagggattcggactgctgttggcgccagagagcccaaagtggacagcgagcgccaggggcgatgtcgcgcaggcgaggaggacacttcagcgcatccgtggcaagaacgctaatatcgacgaggaagtcgagtcatggggccagggaagtgggagacctactagcgaggaggaatctctccttcacagtgtcgaggaccgcatggagggcctgtcgcgcagagacacctcctctcgctccaactctccatccccttccacctcttcgcgtcctcatccccacaaggccagcaaaccccatctcggtttcgtgcaggttctcaaggatcccaatacccgtcccgccatcattgccgtggtgggcatcatgttcgcccaacaactctgcggcattaattccatcatcatgtactcggtctccctcttccgcgacctgctcccgccttctttttcttcgggcctcctcaccatctgcatctccatcatcaacctaggcactactactgcctgctcgcctctgcccgacaagttcggccgcaaggcttgtctcttggcttctaccattggccagggcgtgtcgtctctcgtccttgctctctccatcatgttcggcgtcaagatcttgtccgccatagcggccctgttctttgtggctttcttcgcggtcgggctgggcccagtgccctttatcctggcgagcgagctggtgggtgaggaggcggtgggtgctacgcagtcttgggcgttgggtgcgagttatattgctactttcctggtggcctttgggttcccagtggtgaatgaggctctgaacagaattttgggaggcgctggatgggtttactttatctttgcagggctggcggcgttttgggccttgtttatcgtgaggatcgtgcccgagaccaaa

SEQ ID NO: 27128 - DNA, 1732 bp, Neurospora crassa
atgccgaccgttcacctcctggattacgtcgccggcaacgtgcgcagcttggtcaatgccattgagagggttggctacagcgtcgagtgggtccggtcgccggaggaggttgccaatgctgatgtatgcgccaacctgaatagcttcacggaaacctgaccattgctgacacgaacctgttcccatgtggtagaaactcatcctccctggcgtaggccacttcggccactgcctctcccagctcgcctccgccggctacatggcccccatccgcgcccacatcgagtccggtaagcccttcatgggcatctgcgtcggcctccaggctctcttcgaaggctcgtccgaagaccccaactgccccggtctgggtgtcctccccggcaagctcgaccgcttcgacgacacctccaagtccgtcccccacattggctggaacgacgcctcgtgcccgaccaacccgaacctctttggtctcaaccccgactccaaatactactatgtccactcgtacaagatgccctacaccaagggccagctcgagtcgcaagggtgggcggtggctaccggtgtctatggcggcgagacctttattggcgccattgccaagggcaacgtgatggccacccagttccaccctgagaagtcgggtgtcgccggtctgcgcgtcatccgggccttcctcgatggctctggcgccgctgctctggcttcccaccctccccaggaggtccccaacgccggcgacgatgccctcgtcagcaaggagggcctcacccgtcgtgtcattgcctgcttggatgtgcgcaccaacgaccagggcgacttggtggtcaccaagggtgaccaatatgatgtccgcgaaaagtctgacgaccgcaacgtccgcaacctcggcaagcccgtcgagatggcgcgcaagtactacgaacaaggcgccgacgaagtgaccttcctcaacatcacctccttccgcgactgccccgttgccgacctgcccatgctcgagatccttcgcctgacctccaagaccgtcttcgttcccctgaccgtcggcggcggcatccgcgacaccgtcgacacggacggcaccaaggtctccgccctcgaaatcgccaccatgtacttccagtcaggcgccgacaaggtgtccattggctccgacgccgtcatcgctgccgaggagtactatgcctccggcaagacgctctttggcaacacggccattgagcagatcagcaaagcctacggaaaccaggctgtcgtcgtctcggtcgatcccaagcgcgtctacgtccccaagcccgatgccacgagacaccacaccgtcaagacgtcgtaccccggccccaagggcgaggaatactgctggtacgcctgcacgatcaagggcgggcgcgagacgagggatctggatgtggttgaactcacgcaggccgtggaagccatgggctgcggcgagattctgttgaactgcattgacaaggacggcaccaacagcgggtttgatctggagttgatcaggcaggtcaaggcggccgtgaggataccggttattgccagctcgggggcgggcaacccgggtcactttgaggaggtgtttagggagacgacgacggacgccgcgctgggagcaggcatgttccaccgtggggagtatacagtacagcaggtcaaggaggagctgaaggcgagggggttggtggtcagacagtttgagggagatctctga

SEQ ID NO: 27129 - DNA, 962 bp, Neurospora crassa
atgcttccctcatacaaccaccaactacctggcggacacgaaagtggccagtatctggcggtcgacattggtggctcgacacttcgcgtgggtgtggtggacctgaagggccgacaaaccacagatgatgacgacagcaccattgtccatatggacagctacaaaatcgacaggaacgtccgattgcttcgaggggcatttttcttcaagtggatggctcggaaagtagagacaagcttgaagaaagcaattgacgctgggcacatttcgaaagcggaatatgagttgggaaacccaatgccaatgggtttggcgtggagcttccctctagagtatgtcaaacactttattctacattcatcccaagatcagccaactaacgacacgacaggcaaacatcgcccaatggaggaaacatctgtcccatgggcaagagttttcttgcatgcgacggactgatgggacaggacttgggtgccacctgtaacaagattctccaagaactccgagtaaacgtcgaggttgtctcgatagtcaacgattccaacgccactttgctttcgtcggcatattccagcccatcggcacgcttcggactgattcttggaactggcgtcaacattgctgcccaccttccggtaaatctgattggaaaatccaaatttggggaacgacccgacagttggtatgagcaagcgagccatgtcatggtcaacaccgagttgggcatgtttggccgtgacattttgcccctgacgcgatgggacaagatactcaaagccggacacgaaaggcccgacttccagccgcttgagcatctggtaagtgggtactacctcggtgaggtgttccgaattgccttattggaggcgatcaagacgacgggtctgttgggaggaaagattccaccactgttgttggatgcgtattcgatggatacgggaaccatgtcattaatcatc

SEQ ID NO: 27130 - DNA, 1923 bp, Neurospora crassa
aaacactccatcctcgacagcttgaacaatgcccaggcacgcgccgtgacctcggatgctgccactgtcgctatattagccggcccaggtagcggaaagacacatacacttacctcccgagtggtctggttggtcgatcatgtcggctaccaaccacaagatgtcgttgtcgcgacattcaccgtcaaggctgctcgggaaatgaaggagcgcatcggcaaggctctgggaaacggccgcgaaaacaagatcattctgggcacattccacagcattgctcgacgctatcttgccgcgtacggccgccacattggactgagcgaaaagttcagcattgccgacgataacgactcgagatccatcatcacgagaatatgcaaaaggctacaactgggtctcgatccgcccatggcaaaggcctggataagcaagaagaaagccaagggaatggaacccagtccttcctctttgccccaaccgccaaagaagcagccggtacaacgaggtcagcgggatctggaagtatgctataccgagtaccagacccacttggaacgatcaaacttgctagactatgacgatctgctggtccgatgcgtggaacttcttcgcaagtttccttcttgtgtgtctaatatacagacggtcctgatcgacgaataccaagataccaacggcgtacaatacgagcttatgcgtctgcttgcccaaaagcatcagaggattacaattgtcggcgacccagatcagagtatctacggatggcgctcggccgagatcaagaacttatggagacttctccgcgattatccgaaaaccgacgagatttcgctcgaagagaactaccgctcgtcccaagctatcctcgacttatcactgctggtgattcagcaggacaagaaaagatatcaaaaggtgttgaaaccagtccatgacagaggctcccgtcctgtcttgcgcaaactcaaaaacgcttccaccgaagcagagtggatcgtcgccgagatacgccgtgcgcttctcatgtcggggtcaatgttgacccacaacgatgtggctgttcttctgcgctcagcatcgctgtcaaggcacgtcgaaagtgcccttggtaaagcgggtatcccctaccgcatggttggcggtttcaagttttacgagcgttcagagatcaagactattcttgattatctacgagtcatccatcagccagacaacaatgatgcgtttgggaggatcatgaacgtccccaagcgaggcataggcgacggcactatcaaaaaccttatcgaagaagcagaaaagtcatctctcagcctttacagtcttcttgtcaaacattgccggggggaccgtactgccaagaccaagatcaccaagcatgctgaacagaaaattagtggtgaactgattcgcatgttgaatgggatacggaagaagatggaagaggctgcagagagcaacccgttcggcttggtcgatttgattgagcatttgctgacagccttgaacttccaaaattaccttcaggtgacatatcctgacgaccacgagcaaagatgggccaacgttcaggagttcattagtcttgccaatgactttgtgcgagacttgcatgtgtctggcgaggatgctctgccagaaatcgaggggcttgaacagtcaaaggaggaggaagttctcccgcaattcttggccaacgtctcactcgcctctgacgctcaaaaaggagaagagggtcaggagaacaagccactggttaccatatcgaccattcacgccgccaaaggtcttgaatggcctatcgtcttcataccagcagtctacaatggctctatcccgcatatgcggtcggaagacggagatgaagagcgaagattgctatacgtcgccatgacacgggctcaatccttgctatacctcagc

SEQ ID NO: 27131 - DNA, 4217 bp, Neurospora crassa
atggaccccattgccagtcactggaccccttcccaccaacactccaattctctaggacagaggtctgaaatgcgccagtccacctctttcgacagcagagatagtcgcccgacaagtcctcacaatgtctccagccctgtcacctaccgtcccatggacccccaaaacttcctgtcagtccccggcgctgctggcaggtcacgccaaaactcagtcaactccaacgatgagacccgctcgatagcatcatcgcaaggggagacagttattggaggttcttcccaccaaggcgacaagattggccgccccctgtccagcaacacatcagacaacgcccaaatcatgaacgacccagatgctctcaagccagaccaaggaagggaggccgacttcgaggttgtcgacaatcccttcgcctacacccctggtcaactcaacaaaatgtttaaccccaaaagtctttccgccttctggaagttgggtggtcttgccggtttggaaaagggtctcaggactgataggaaagccggtcttagcatggatgaggttgaagttgatgggcgtgttactttcgacgaggctactgcccgtccgtctgggaacccacccgcccagcccaaggctgccaccgaaaccgtgctcgccaagaccgacagccacgcagcagcagaccaccacaagaagcatcatggagacgaccattacacatcgagaaagcgggtcttttccgacaacagactgccagagaagaagggcaagagcttgttggagctgatgtggatcacctataatgacaaggtcctcattctcctttcgattgccgccgttgtttcgctcgctatcgggctgtatcagacgtttggccaggcgcataaacccggtgaagccaaggttgagtgggtagaaggagttgccatcattgtcgctatcgtcatcgtcgttatggtcggatccttgaacgattaccaaaaggaacgtcaattcgcaaaactcaacaaaaagaagcaagatcgtctggtcaaggctatccggtccggcaaaacggtggaaatctcggttttcgatgtcctggttggtgatgtgctgcatcttgagcctggcgacatgatccctgtcgacggtatcttgattgagggctacaatgtgaaatgcgacgagtctcaggccaccggcgagtccgacatcatccgtaagaggcctgctgacgaggtttacgctgccatcgagaacaacgagaacgtcaagaagatggatccctttattcaatctggtgctcgcgttatggagggcatgggtacctacctggtcacttccaccggtatctactctagctatggcagaaccctcatggcgctcgatgaggatcccgagatgactcctctccagtccaagctgaacgttattgccgagtatatcgccaagctcggtggtgctgctggtctcttgctcttcatcgtcctcttcatcatcttcctcgtcaagcttcccaaatcacagcacactccggccgaaaagggtcagcagttcttgaacatcttcattgtcgttgtcacaattattgtcgttgccgtgcctgaaggcttgcctcttgccgtcaccttggctttggcctttgccaccacccgcatgttgcgcgacaacaacctggttcgtcacctcaaggcttgcgaagtcatgggcaatgccaccactatttgctcggacaagactggtaccttgacccagaacaagatgcaaatcgttgctggcaccgttggcaccacgcataggtttggtggtgttggctctgccggtggtctcaaccccgagactccggacagcccgactgaggccgacgttaccgcaaaggaagttgttgcctcgcttgatgcctctgtcaaggaattgcttctcaagtccatttctctcaactccactgctttcgaaggcgaaattgacggtgtcaaatctttcgttggctccaagaccgaaaccgcccttctcgaattcgctaaggagcatctcgccatgggccctattgctgaggagcgtgccaacgccaagatccttcatctgatccctttcgactctggacgcaagtgcatgggcgttgttgtggcgcttgacaacggcaaggcacggctttatgtcaagggtgcttccgagatcatgctggaaaagtgcacccagattctgcgcgacccctccaacggcattactgctggccccttgacccaggagaatcgtgagaccgtcttgaagctcattgagacatatgcgagaaactcgttgcgcaccatcggcatcatctaccgggactttgctcactggcctcctgccaaggcgcgccgtactggagaggacaaggaggagatcgtctttgaggatatttgcagccaaatgaccttcgtcggcatggttggtatcaaggatcctctgcgccctggtgttcccgaagccgtccagctgtgccagaaggcaggagtcgttgttcgcatggttactggtgacaacaagatcactgctgaagcaatcgccaaggactgtggcatccttcaacctaacagtctcgttatggaaggccccgagttccggaacctcagcaaggccaagcaagaagagattattccccggttgcacgtacttgcccgttccagtcctgaggacaagcgcattttggtcaagcgtctcaaggatatgggcgagattgttgctgtgaccggtgacggaaccaacgatgcccctgccctgaagatggccgatgtcggtttttcgatgggtattgctggtactgaagtcgcaaaggaggcatccgctattattctcatggacgacaacttcaactcgattgtcaaggcactgaagtggggacgtgctgtcaacgatgccgtgaagcgcttccttcagtttcagcttactgtcaacgttactgccgtcatcctcaccttcatctctgctgtctccaacaaagagcaggactcggtccttaccgccgtgcagcttctgtgggttaacttgatcatggatactcttgccgctttggcgctggccaccgatcctcctgccgacagtgttttggaccgcaagcctgaacgcaggggttctggcatcatctcgacgaccatgtggaagatgatcatcggtcaagccatctaccagctggccatcaccttgttgatctatttcggcaagcaaggcgttctgcccaactacgatgacaacgtcacggatgatcagatccagactcttgtcttcaacacgtttgtgtggatgcaaatcttcaaccagtggaagtaagtaatatgaaatatgtcactgccacccaaaacatgccgctaaccgcattcaatagcaatcgtcgtctggataacaactttaacattttcgaaggcctcaccaagaacttgttcttcctgggcatttccgccattatgatgggcggacaggtcttgatcgtctttgtcggtggccaagccttctcaattgccaaggaaaagcaaacgggagccatgtgggcgtacgctctgattctgggcttcatctccatccctgtcggcatgattatccgtctcattcccgactcgctgtttgagcgtatggtgcccgaatacatcaagaggagggctaacaagacgcccgacttgaccgtgtctgatgatgagcggttcgagtactacccgccggcttttgccgaggtccgggacgagctggccttcctgaagcagttcaagggtggacgtatcaacaacctcaagttcgccatgaagcatcctcgcgagaccttcatgcccaagaggagcgcttcccacagcaggtccaactccaagtccaactcgatcaacgttcccatgacacccatccgcaaggatagcaccggcggcgctccttccatcgctccccctacacctgattctaggagacggagcagaagcacgcggtccaggtccaacagtgctctcggagcgtccatggtgatgactggtatcatcgctggcagtgttgccgcgggatgggcgccgtcacctgtggagcgccgaccggattccgattttggcctgttccctcctaagtcgagcccacatgccgagtcttcgcaatccgaagtgcagccctcgcagcggtctcttactccttcgatcaatgaggagcaggagacgcccgatattgtccccagcatcgtggagcagactgttcctatcctcagcgtgcctaagccaccagggcaaaagtcggcctaa

SEQ ID NO: 27132 - DNA, 928 bp, Neurospora crassa
caccatgtcctattcacaactcatcggttcaagatcagaactggtcccccccgtcccaccctccggcatctgggcctcccccataaccctcttcaacctccgcgacatcatcgacttccagtcccaaatctcttatttccaatacctctcctcacccaaaatcggtctcgcgggctttttcgtcttcggcaccgaatccgaagcctccctactcacccgcaaagaacgctgcgacctcctccgctgcgcgcgcgactcggttccttccggatttcccatcatggcaggcgtttcggcccccagcgtgagacaggtgcgtgagcacatcatcgatgcgattgcattcggggctaattacgtggttgtttcaccacctgttggatctgaaccgaacaaaaagggaaccaagcaagaaaatgaaacggtggacgcgtttttcgacgatatcgtccactactccgagttacggatcctcatctctgacgaagacggcgggatcgacctcaccagcgaacttataatccgtcaagccttgcgccacaaaggcaagatcgtcggcgcccacttgcggtccggcaataacgtggtcggcaaaatcacccgactagccagggaattccccccctctcaaaaagaatttgccatctttgcggggcaaagcgattacttggtcggcgggctggcagccgggtcaagcgggtgcatcacggcgtttgcgaatgtgctgccgtgggcgttggtgtggcagtatcatgagtatgtgaatggggagaagaataatgataaggtgaagaaggcggatgcgctgcgcgtcagtgggatgttggctaaagtggagacacagctgttagagagtggtggggggattgccgcgatcaagtttgctgcgagcttgtatacgggttggagggccggggtggtgaagggg

SEQ ID NO: 27133 - DNA, 2044 bp, Neurospora crassa
cgtgaggcggctatcgtcagccttctgaaccatcagtacatttgcgggctccgcgataacttgcgaacaaggtggcattggtacatgctttttgaatacgttaatggcggccaaatgctggactacatcatttcccacggtaagctcaaggagaagcaggctcgcaagttcgcccgccaaatagccagcgccgtcgactattgccaccgcaacagcattgtccatcgcgacttgaagatcgagaacatcctgatcagcaagactggcgacatcaagattatcgatttcggtctcagcaaccttttctccccagaggaggataggaaactcaagacatactgcggcagtctgtactttgccgcgcctgagcttctgcaggcaaggccgtataccgggcccgaggttgacgtatggagctttggcgtcgttctgtttgtgttggtgtgcggcaaggttccatttgacgaccagtacatgcccgctctccatcagaaaatcaagaagggcgcggttgactatcccaactggctttcttccggtatgtttcaacactcagttcctggctccgctcaaagttatgctaacttggctgtctgcagaatgcaagcacctgatctcgcgcatgttggtaactgaccccaagcagcgagccaccatgcaggaggtcatgaaccacccttggatgctcaagggttacaacggaccccccgataactacctcccgcgccgcgagcccctgacgcttcccctcgaccccgaagtcatctcgcagatgactggtttcaagtttgggcctccagagtatatcacagcagagttgaccaagcgcatcaagtcgcccaagtaccaggccgctgtgcgccgcctcgagaaggagagagaacggccggaaccaatcgcgaaggatgccgagaaaaagcgtggctttggtttcgatttctacaagagaaggaactcggtgacgagcaaggacacgctgactgccgccagttcagagggtctttcccttggcgatgatcctcttaacgcgttcgatcctcttatttccatctactacctagttcgcgagaagctcgagcgcgaacgcaaccacgtctacattgacttgcaacaaccatccaaggcacagcagcctccaccttcgtcatcacagacagtgatgccagtacctccttctcccgttatccgaccaaaggagaagcattccctcgccgatatcgtgccaccacagcctgtccacaatgctgagccacggagccgacaaaggacaaggtcgcacagtgaggatcagcctagggagcccatccagggtggcctactgtcgcccgatatggtccccgctaagaaagagagcacggccgccggtatcctccgcagacttagcacccgtgacaggcgaaaggagcctccagcaacagctagctcaacggacggcaagccgccccttcggggttccatgtccatgcgcgccaagtcgctcggtcacgctcgtagggagtctatccagatgcgacgagccaagcgcgaggctgaggctgctgctgctcagcaggctcaatcacaaaccacagagccacaaagaagctaccagagccaccatcactctgtccgcgaagagacggatgctgagctggtggatagcgacataagaggcgagacctcgggcggttccaacgagaggctagagcccgaagatcccgatctggtcaagcctgtgttcctcaagggtatcttcagcgtatccacaacctcgaccaaacctctctcagaaatacgggcggatatcaagcgagtgttgcgggtgcttggcgtggagttcaatgagatcaagggtggcttcagctgtcgccacacacccagcatcaaccacgctgaacgccaaccgacggtaatgaccgaaggcggcaacgagatcgaattcgagatcttgatcgtcaaggttccgattgtcagtctccacggtgtccagttcaagaggctcgccggaaacacatggcagtacaaggccttggcggagcagatcgtcagggagctgcgactatga

SEQ ID NO: 27134 - DNA, 3072 bp, Neurospora crassa
catttttagatcctcatcgtacaggctgatagaaccaactctgtgcgaacgatccatcttcgaggcgactggtttgatactcccgcaagcgtcagcgcatacgtccacattatcggccagttcgaagaccagggaaaatgtgtcctcgacaacaaccagaatatgctgatcctgcacccagatcagctcatctcatccactgtcgttgccgactcattcagctgcatgcggcgtgcggtcttgcaggacagagtcaaagccaccagtgacttgacacccgcgcttgtctacggtactattctgcacgagattttccaggaagctttggtagccaacaaatgggatccggcattcctcaccaacgtcatcaacaagactcttgagaagcatcttgaggacctgtacatcctcaaggtcagcatggacgatgcaaagagtcatgtgcaatccaagatgcctgaactccggtcttgggctcagctgttcgtaacttcccagccaaagcccgatgctatcgtccaaggtcggaacggtgacaaggctaccatgtgtgtcagcaagcttctggatgtcgaggagcatgtctggtcacccatgtatggtctcaagggcaacattgatgccaccgtccaggtcactatgcgcgatcccccagcaaggggctcaagctcaaaggcgccaacgaccaagaccttgaccgtccccttcgaggtcaagaccggcaagaatgtcaacagcaaccatcaggcgcaaacagcactctacaatttgttgctctcggatcgctacgacattgagattgtctacggtatcctctactacatggagacatcgcagacgttgcgcattcccgccgttaggcatgaaatccgccacatgatcatgcagcgcaaccagctggcttgctacattcgtgagcggagtgtccaactgccccctatgaagaagaacaagaacgcgtgcggcagatgctatgcccagacgacctgtttcatctatcacaagcttgctgatgacggagatggggagacgagcgcaatgaacgagaagtttgatgaagtagtccaccatctcagccctacccacaaggcgttcttcttgaaatgggaagaacttctaaccaaggaggaaaaggaaagccaaaagcttcgccgagagctatggactatgatcagcacagagcgcgagaaggttggacgttgcttcgccaatgtcatcatcgaggagggctcagcatacgagaatcaccaacagatgggcaagaccaaccgtttcgcctacacctttatcaaggaaaagcctgctcccggcttttcgtttctggactcgcaactgactgtgggtgagcccattgtcatttctgacgaacaaggtcactttgcacttgcgctgggctatgtcacctcagtcagaaagactcgcatcgctgtggccgtggacagaagactgcacaatgcgcgcgtccggcagcctggtttcgacgaggccgacaatcagacctttgccagcatcatgcaggttcctggctctggtggtaacgccccggaagaccgtgaagctggcccggtccgctatcgtctagacaaagatgagttcagcaatggcatggcaacagtacgcaacaatcttgttcagatcatggccgatggagtgcttggatctaggcagatcaggagtttggttgtcgaccttgaggccccccgcttcaaggctgtgccaacgcagtatattctcccttctaccgcgtcgggtcaaggtctgaacgtcgatcagaaggcggctgttgagaaggtcatgtctgctcaggactatgcccttgtgcttggtatgcctggtacgggcaagacgactaccattgcgcacatcatccgtgccttggttgcacagaagaaaacagtcttgctaacttcctacacccacaccgccgtggacaacatcttgttgaaactcaaggatgacgggattccgattcttcgtctcggtcctcccgtcaaggttcaccctgaggttccttcgttcgccaccctcgccggcgtgccaaagacttctttttcggagatccacgaggcctggaacgacaccccgattgtggcgacgacttgcttgggtatcaaccaccctgtcttcgccgagcgcatcttcgattactgcatagtcgacgaggcttcccagatcacgcttcctatctgtctcggtcccatccgtatggcacgcaagtttgttctagtcggtgaccataaccagctccctcctctcgtacaaaacgaggaagctcgccttggcggtctcgacgtgagcttatttaagctgctctccgagaaacacccccaaagcgtagtcaatctcgaacaccaataccgcatgtgcgaagacatcatgaccctctccaacacgctcatctacaatggccggctaaaatgcggcaccgaagcgttacgcactacatccctcgagattcccgacatggacgctctagcaaccaagcactttgacgccgattctttcctcgcccactcccagcaacacccgctcaaagaaggagataaactctccttctgcccctctcccacccccactacctgctggctccgtgaccttctcgacccctctgcgcgcgttcgcttcatcaacaccgactccctccttccgcactcacgcgaagagaaatccactcgcggtcagcgcatcgttaacccgcttgagtcccgcatcgtctgccagctagtcgactcgctcctgaccgtgggcgtgcccgcctctgaaattggtgtgatgacgcattaccgctcgcaactagctttgcttaagcacaatatgaaaaacaccctaggcggtagcgcgggagccataagagcgggcgtcaaagtggcggccgaggaaatcgagatgcataccgctgatcgcttccaaggaagagataagagcgttgtggtgttatccctggtgcgaagtaacgaggggtgtagtatcggcgaactactgaaagattggaggaggatcaacgtggcgtttacaagggcgaagacaaagctgcttgttgttggtagccgtgaaactttgcgaggggcgtct

SEQ ID NO: 27135 - DNA, 4834 bp, Neurospora crassa
ctacctcgacctgcaggagtgggcacagaagaacgcagaacggagtaccgagatggcctcggcccttcttcagttcctgatgatcaaggcgaatctcgaactgcagtatcagcgttctgggcccggtgcccctaagcagagcaccaccctgcaggttcggacagtgtctgccatgcttcagatcctggaggagtttctgcccaagtcgccgatcccggagcttattgtggtccaaaggcaatgtatcaccgcgtacccgaggcttatcaattacggcgaagggttcgatgacattattgacgccaatggtcgtgatgggaattccttaccccaggctgctaatgttagaatggaggagcactacaagaaaatgtacagcgacgaagtcgcggtacgaaccatcgttgaggttctcgaccagtacaagcactcgcgagatcctctcgaacaagacacctttgcttgcatgattcacggcctgttcgatgaatacgcgcattatgagaattatcctctggaggcgctcgccaccacggctgtgctcttcggcggcatcatctctcacaagctcgtttcggagttgcccctcaagatcggacttggcatgatcctcgaggctgtccgggaccatcaaccccaggagcccatgtacaagtttggcttgcaagctcttcttcaactcctacctcgcttacgcgaatggccagggttttgcacgcagctattgctcatcccgggtcttcagaataccgaggcccgcaagaaggccgaagatgttcttcgtgagcacgaggaggagacgatgcgcgcccgcggaggcgccttaccgcttggcgcgaccatgggtaacgacaacatgacaaacggtaaccttgacgaggctcacggttcggagcagcacccgccgccattcgcgtcggtcaacgttgatccgcctccaccgggggtgatttatgaggacccaaccgccgaggcccagggcaagattcagttcttcctcaacaaccttactgaaactacactgcagaccatgtacaaggaccttcgcgacatgttggagaccaagcatcagcagtggttcgctagccacctggttgaagaacgtgccaagatgcagccgaactaccatcaagtttaccttgacctggtaaagatgtttgaggataagtcactgtgggccgaggttttgagggagacctatgtcagcgtccagagaatgctcaattccgacgttacgctacagaactcaactgagaggacgcacttgaagaatttgggcggctggctcggtcttttgacgctcgcgagaaacaagcccattaagcatagaaatatcgctttcaaacagttgcttatggaagcgcatgatactaagcgtctcctgattgttatacctttcgtctgcaaggtcctcgctcaaggagcttcatcagaggtcttccagccacccaatccctggctgatggacattatccatctcctgatcgagctgtaccacaacgccgagctgaagctgaacttgaagttcgagattgaggtcttgtgcaagggcctcaagctggaccacaagagcattgagccgtctggcgagattctcaaccgggttcctgtcgaggaagttcctgatctgaatgggcaagagcttgagccctacgacaacacctctattaacggtatgggtagtgtcgcgggtggcctccccgctcatgcctctcttccgatccccgacctttccgccagcctctcgatcccgccaaccgaagtcattgatcaagccaaactgcacagcattacctctcaagcagttacgcgagccctgcaggagatcatccagccagtggttgacaggtccgtgaccattgcggcgatagccacacagcaaatgatccacaaggactttgccaccgagcctgatgagaaccgggtgcgggacgcggcgatcaacatggtcaagtcaactgcgggcagtcttgccctggtcacgtccaaggaaccccttcgctccaacatggccaactaccttcgtgctctctcggctgagatcggtctagtgctgcctgagggtatcatcatgctctgcatcaactcgaatttggatctcgcttctagcgtaatcgagaagtcggctgaagaccgtgcggttccggagatcgaggagatgattcaacctgaaattgaagccagacgccggcatcgtgcgcagcgtccgaatgagccatacatggatcctggactcactcgctgggcctggaccattcctcatcccttcaagttgaacccaagcatgactggtcttaacgcggagcaaatggctatttacgatgactttgcccgacagccgagggcagtcgcttcgacgacaggaccgtcccacgcagcctccacatcggatgccaggtctctcgcaaatgaagtcctcggagatcagttcaacaccatttcggcccttcccacacctgcggagacaccttcgcttcctcacctcggtggtcagcttcagcactacccccagggaagtggcggattggcaaacggacgtcaagccgggcttaaccaggtggatgccaggaccattgctgacagagtcaacaagcttttggagtcactgaccgcggccgccactggtgccaccgaggaacacttcaatgaactgccccgcgctcaccaagtcctggacatcattgacgctcttgtgcaactcattatcaagactcagcagacgtctgaagagtttgcagcatatgccgcaacccagatcgcccagttgatcttcagacagccaggcgataccctcttgcttgaaagtctcgtccatgtcctcgaaaccctccgtaagattgccggtccggccacgagccagcagatcaggagtctcttccatcaacaaccagcggaatacttcctcaacctttcgctcattgcagcactgctcggcacggacctgctcgactggagaagcattgatgcagccatgtctatggccctccagcaacgcaaagagggatccgtcgagttcctcgagcagcttgtggatcttacgctgctgagtgagagccctcttgcgctctatgctgactttgtccgcagtttggaggaagcatgggcctggatcagtgagaatccggatgttccaggaggccagagtctcaagtccaagatccttgcccctcctccggacttgcctgaaggcctcactccggcagagatcctcgccatccgccaggaccagatggagtatgtctttgacgaatgggttcacctttgcaacaaccctgccgcctcctcctccaagtcatcgacgatctttgtacagcagatgcgctccagaggagtcattgctagcactgatgatttcctcatgtttgcacgcctagccattgacaagtctgtggaccgcttcgagcatgttgttcaccttaatggaacgataacggaggcgtaccaggcgattgatgctttaggcaaaatgatcctcatcttcttccagtcccacgaagataatgccgacggacaaacggctcgtgctgccttcattgattccatcctcgcccttggggtgctggtattgaatagccaccacgtcaagcgtggcgacgctttcaactcacgggtgtttgttcggttcttctcctacctccttcacggcattcactctctggaggagcttccagaaaatgagcgtgatcgcttcatgcttagctttgccgagcgtctttacgacctgcggccgagcctctacccaggcttcgtccttggctggctcacacttgtcacccaccgtgtcttccagccagccatgcttcaaatggctaacaacgcgggctgggaggcgtacaccaagatccttcgggatttgctctcttaccagggcgagctgctgaagccgctcgagctctcgatcttcgccaaggaaatgtaccaggccgtcctaaagctcctcatcatcctggggcatgatttccccgattacgtgtctgccaaccatgtgctgctgtgccagagcttgccgcctcacgcaacgcaattaaggaacatgatcttactggctactcctgcttcggccgcgaagccgaccgatgccttccagcccggcttgaaattggatcagatcgcagatatcaaagaagcagcgatcagtgtctacgatcctgccgagcagctacgccaactggggctgcttgacattctggatcaggctttgcagaacggcccgtccgaagatgccattgcgcagattacacacgctatcactaggactggtagcggaacgacggactatggctttgttcccattgacgtcaaccgtcaagtcatcgacgccgtaatcacgcatattggcaactttgccgtcaaccgcgccgccaccaggaacgacgcctctgtgttcgtccccggcgcaccagacctcaagacactgcaaatgctcatcacggaactctcccccgatacgaggtacttcgttctgaacagcatggcgaactggctccgcttcaccagcgcccacacgcactatttcattcaagtcttccttgacttctttggccacgacgtcgcctccacggatcccgaggagatggacattcggcagcagattgttcggatcctccttgaacggttaataggctactggccgtacccgtggggtctgatcatcaccaccatggagctagtcaagaacgagaagtacaacttctttgagctgcctttcatcaaggccacccctgaggtgcggagagtgtttgaggataaggttcgccagcactagaaccgctcgataaccggtggggagcagatgagatgggggttcggccgttcgccgatccagggctcgctg

SEQ ID NO: 27136 - DNA, 889 bp, Neurospora crassa
atggatgctatccagacccacccgtccaacgccgctcaggcgaaggctttcactgcgcccggttccctgtccttccccggtgcggccggcgagctcacgccgcccacgtccaccgcgaacagcgacaagagcgccgcggtcaatggagctatcggtgcgcaggccgccaacggcaatggggtgacacccgcaacccccgcggctacgcccgcagcgaaccagggtcccaccagtggcatgacccctactctacagtaggaagaccttggcttttcttttttccctcaaggggctgtgggctgacccaaacaggaacatcgtcgcgacggtcaacctcgattgtcgtcttgatctgaagacgattgccctgcatgcgagaaacgccgaggtacgtgacgggttggattgcggggtcccttgaacttgtctgtcttggccatggttgtctaacagccgcaaacagtataaccccaagcgttttgctgcggttatcatgcgtatccgtgagcccaagaccactgccttgatcttcgccagcggtaagatggttgtcaccggtgccaagtccgaagatgactcgaagcttgcgtcgcgcaagtacgctcgtatcatccagaagctcggtttcaacgccaagttcacggacttcaagattcagaacattgtcggttcttgcgacatcaagttccccatccgtctcgagggtcttgcttccaagcatcacaacttcagctcatacgagcccgagttgttccctggtctcatctaccgcatgatcaagcccaagattgtgcttttgatcttcgtcagcggaaaaatcgtccttaccggcgcgaaagtgcgtgaggagatctaccaggccttcgagatgatctaccctgtgcttcaa

SEQ ID NO: 27137 - DNA, 2681 bp, Neurospora crassa
aaggaggagtcaattgtttcttctactgggcatctacctggtctggctgttcccttgctgccgcatcaggttgagggtgtcagatggatgattaaccgcgagcttggccctttgaagcgcggccgtgttcccaagggtggactcctcgcagatgatatgggtatttagactctgtgttggcctgtttttgactctatgctaactttcatctaggcttgggcaaaacattgcagtccatttccttgatcattggcaaccgaaaacccgaatcgtcctccgccccaggctggaaagcccacttcaaagacatcagcaaggccacacttgtcgttgcgccactggctctcatccgacaatgggaggccgaactgaaggatcgcgtcatgcccgacttgaacatcaaagtatgtgttcatcacggcccaaagcgatctacagttcccgccgagctcgccaaatatgatgtggtcatcaccacctaccagattctggtgtcagagcacgacaagtctcaccccgacccaaacaagggcgcgcaagcaggctgttttggcgtacactggttccgcgtcattctcgacgaagcccataggtaaattccgaaggtcatatatatactccaaagcttcacaaagactaacatatgacaccacagcatcaagaaccgcaacaccaaggccgccaaggcatgctgtgccttgcgctccgaataccgctggtgtctcacgggcacacctatgcagaacaatctcgacgagctccaatcgctcattcacttcctgcgcattgcaccttacgacaacctaaccgagtggcgagcccagatcgacacgcccatgaagcaaggcaagggccacattgccatccaacgcctgcacagcatcctccgctgcttcatgaagcgccgcaccaaggaagtcctcaccgaaaagggcgcgctcgtggccggcggtaaggaagctctggccaaggccgaagagaatggcgaaaaggcacctgaagccgccttcaaagtcacggagcgtaaagtagtaaccatcgagacggagttcagccccgccgaaagtgccttctacaaggccttggaggagcgtgccgaccagagtctcgagaagatgatgaagggccgcacggtcaactacgccaacgcgctcgtgctgctgttgcggctgaggcaggcttgtaatcaccctagattggcgcagacgaagcttgacaaggaccgggatgcgttggcggtggactcggcgactgcgccgacggctggtggcaaaaagaagaagaacgcctatgattcgcaaagtcagaccagtagtgtggatgacttggcggatatgatgggcgggatgggcatccaggctaggcagtgtgacatgtgtctgggggagatgacgaagaaggagattcaggaggggcagttgagatgtcaagggtgtgaggatagtttgagccagttgatgaaggagcaggagagtacgcaggagagcgtggagagcaaggagagcaagaagcacaaaaagaagaaggtgagcgtggtgaaggagaaggtgaaggttgagaggaagaccaggggaaggggtaggaaggttgtggtggacagtgatgatgaggaagagggaggagagtgggaggacgaggaggagacacctaagaaggacaagaaatctcgcgataacaggaagcgagtcgtcgatagtgacgatgaagaggatgaaggcacttggctggtgggagagtcacagagaagcgcactcgacctcggtgttgctggcggcacagacgacgagaacgccgagggcaccggtgaagacatcgactccaacgaagagatctccgaagactcagaggacccggaagaggacagcttcgtcgtcaaagatagtgacgatgacgacgatgacgacgacgaaagcgtcaactcagatgagatagtcggctccggtgacgaagacgataccttcgcctcggtctccaagctcagctcgcaagtcgtcaagcaatccgaatccgaggaatcagaaaccgccgcctcctcctctgaagactctgccatctcggactcagaactcgaacactcctccgaaaccgactccgaagccgaatacggcaccaagcgcagccccaaaggccccgtgcaaatctcctccaagatccacgagctcatcgccatcctccgccgcgaagcccccacccacaagttcatcgtcttctcccagttcacttcgatgctcgacctcgtcgagccctttttgcggcaccacttaccggacatcaagcacgtccgctacgacggcaaaatgtccaacgacgcgcgcgaagcgtctctgcattccctgcgcaaagacccgcgcacccgtattctgctgtgctcgctcaagtgcggatccctgggactcaacctgacggccgcgacgagggtgattatcgtcgaacccttctggaacccctttgtcgaggagcaggctattgatcgcgtgcatcggctgacgcagacggtcgatgtggttgtctacaagttgacggtgagagggacggtggaggcgaggatcctggaactgcaggagaagaagagattgttggcgcagacggcggtggaagggtcgacggagagaggggggaacaagaagaagaagggccaggggttgaagttggggttgcaggagattttggacttgttcaag

SEQ ID NO: 27138 - DNA, 816 bp, Neurospora crassa
cccttcatcaatggtggtctcagcggcatggtggccacaacggtcatccagcccatcgacatgatcaaggtgcgcatccagctggccggcgagggcaaggccggcggccccaagccgacccccctcggcgtcacacgcgatattatcgccagtggcaaggccatggacctctacactggtctctcggccggtctcctccgacaagccgtgtacacgacggcccgcatcggctgcttcgacaccttcatgagccggctctcggcgcgggccaaggagaagggccagtcggtaggcttcaaggagcgggcctcggccggtctcgcggccggtggtctcgccgccatgatcggcaacccggccgatctcgccctcatccgcatgcaaagcgacggcctcaagcccgtggcggagcgcaagaactacaagtcggtcattgacgccctcggcggcattgcgcggaacgagggcgtcgcagcgctctgggccggtgctgcccccacggtggtgcgcgccatggcgctcaactttggtcagctggccttcttctcggaggcaaaagcgcagctgaaggccaggacacagtggtcgagcaaggtgcagacgctcagtgccagtgctattgccggcttctttgcctcgttcttcagcttgccgtttgactttgtcaagacgagactgcagaagcagacgaggggcccggatggaaagttaccatataatggtatggtggattgctttgctaaagtggcgaagcaggaaggcgtgtttaggttttatcggggttttggaacgtattatgtgcgcattgcgccgcat

SEQ ID NO: 27139 - DNA, 1427 bp, Neurospora crassa
ttgtctttcccctcccacaggaaaatcagcgaaaagtacgacaaggtcttcgtcaccggctgccttgagcccgacaccagcaagccccgcgccaatggcgccttcgtcgtcctcgcgagaaacaaggagctggacggtgtcatccagtccatcaagtccatcgagcgccacttcaaccgctggtaccactacccctacgtcttcctgaacgatggcgactttgacgacaccttcaaggacaccgtcaagaactacacctctgctcccgtcgagttcggcaaggttggcccggacatgtggggattccccgactgggtcgaccccaaggtcgccaaggagggtatcgccaagcagggtgatgccgctgtcatgtacggtggcatggaaagttaccactccatgtgcagattctactctgggtatgtattgcgattcaagtcttaagcaagctacatctgctaacacagcacagcttcttctacaagcacgagctcctccagaagtacgagtggtactggcgcttggagcccgagatcaagtacttctgcgacatcacctagtacgttctttcactcttcgctttccctctgtgcgcatctcgctaacatagtaccgcttcccagtgaccccttcctcaagatgatcgagaacaacaagacctacggcttcaccattgcggtcaaggaactccgcgagaccgtccccaacattttccgctatgcctccgcctacaagcgtctcaacaacattacctcgcagggtctgtgggaaatgtttgtcgagccccagcccgagaagaagcccgaagcccccgagcccggccttcctgaggagatcctgcgctccgaccccggcgctaacaagctccccgatatcgaccccgaggcgatggagggcgagaagtacaacatgtgccatttctggtccaactttgagattgcccgcttggatttcttccggtccaaggcgtacgaggatttcttccagatgatggatcacagcggtggcttttggatggagcgtgtatgtttcctttccttcttttttacccattttttccccagttcagccgctaacaatcaccacagtggggtgatgccccgattcactccctcgctgccggtgccctcttgggcccccgcgacatccattacttccgcgacttcggttaccgccacaccaccattcagcactgccccgccaacgcgcccgcccgccagctgccccgcgagccctacctcgagaagaccacgctggacgaaaagaagcgcatcgaggaggacaagtactgggatgaatacgacacccccaaggagaacggcgttggatgccgctgcaggtgcgacacggacattgtcgacgtcgagggcaaggaaggttcttgcttggccgagtgggtggatgttgcgggtggctgggccagtcct

SEQ ID NO: 27140 - DNA, 1296 bp, Neurospora crassa
tggacaaaggaaccgcatttgaggaagctctatggcatgacctccttccttctggtggcatcggcaacgacaggctacgacagcatgcttttgaacacatcacaacagatccatgcgtggaaccacttcttcttcccggagacgaagcttaacccggaccttgcagatcccgttgaggatagcaagctggcaatcttgaataacatgttcaacatcggctcaatcttgtcgttcgttataaccccgtacgtggccgataattatggacgaaagccctccatcgtagctggttgcatgttcatgatatttgggggatttctaactggtttttgcaacggttacggaagtaggtacctaccttttctctcgccttcttcagggagtttactaacaatgacagtgtacatgggtggccggttcctcctcggttttggcaactcactcgcacaaatggcctcccccctccttctcaccgagatcgtccacccgcaacatcgcggccccgtcaccgccatctacaactgtctttggaatgccggcgcgctcttggtgtcgtgcatagcatggggcacgtccaacattgcctccaactggtcctggcgctccatcacgctcctgcaggttctgccctcggccgtccagctcgcaggcatttggtggcttcctgaatctccacgataccttattaacaaggaacgccatgatgaagccctcgacatactcgccaagtggcatgccggcggtgatagactcaacagaacagtacagttcgagtttcgtgagatcaaagagacgattcgcatccagaaggagctggatgaggcatcgacctatgtcgattttatcaggaccaagggaaataggtggcggttggccattatcatctcgctgggtgtcattagccagtactctggcaatgccctgttcagcaattacatgaatgctgtatacggcggggcggggataacggagcagagccataagctggccatctcgacggggaaaatgatcctggatctgatcgttaccatcttcgccgcgctgaatgtcgaccggtttggacgcaggccgctgttcttgatgtcgacgtgcggtatggtcgtgagctttgcgtgctggacggcaacgggcgcggcgtatgaacatgatggggagacaaatatgaccattggctatacgcagttggtgttcatctggatctttggtatcttttacgatattgggttttcaggaatgttagtggcatatgcgctggagatcctgccgtttcatctaagggcgaaaggcatgatgttg

SEQ ID NO: 27141 - DNA, 1172 bp, Neurospora crassa
gcttcagcacagctcgacaagtacgccaaactcgccggcctctcctatttcggcacagccgtcgacaaccctcgtctatacaatgagcagtacatgtctgtgcttcaggggtctggcgagtttggctcgctgacacccatcaatgcacagaaatggaagaagaccgaggaggtccaaggagtattcacctttgcggaagcggatgctatagcgaatacggcgaaagctggggtgggaggaatgaagacgctgaggtgtcataccatggtgtggtataaggggttgccttcttggggtatgtcctcttatgtgtgcagaggagtggagcgaggaacaaatggaaactgacgagagagaataatgccttagttgagacgacgtactcccgcgacgacatggaaaagatcctcgccgcacacatccagaatctggcacagtacttcaaggggaggtgttatgcttgggatgtggtgaatgaagccatcgacgagaacggagtgtttagacagagtccaagtacgtctttccatgctggccttcatgctctttcaatcccgcccataccttggttattttaagctgacatcccgcaagtgtacaaagccatgggcctcgacttcatcactttctccttcaagaccgccgccaaagccgaccccggcgccaagctctactataacgactacgccctggaatcaccgtccctctccccgggccccaaaatttctattactctcgccatgctccgcaccgtcaaggcccaaggcggcaccgtccacggcgtcggcttccaatcccacctcaaagtcggccttgtccctgcgcgtgccgagattgtcaatacaatgcagcagttcctggaggtggtggatgaggtggccatcacggagctagatattcgacacagcccgctgaaggtgccgagcacaagggaaatgtggaacgcgcaggcaagggattatggagaggtggtgggcgcttgcttggatgtcaacaaggggtatggagggaggaaatgcgtgggggtgactttgtgggatttcaccgacaagtattcgtgggtgccgagcgagatccccacagagggggaggcgtgcatgtgggataacaattatgttaagaagccggcgtattggacggtgttgaatatgttcaaggcgtatgcggcgggc

SEQ ID NO: 27142 - DNA, 1395 bp, Neurospora crassa
aaccatagtctcaagtcgcgtcacattcagttcattgctctgggcggaactattggtaccggtctcttcctcggcatcggaaatgccttcacccacgctggccctctctccatcctgctcggttataccttcaccggtctcgctgttttcggtatgatgcagtgtctcggtgagatggccacatggcttcctcttcccggtgctatccctcagttctgcgctcgatacgtcgacgatgctctcggttttgctgtcggttggaataactggtactccgccgccatcactctatgcgccgaaatctcggccgcctctcttgtcatcggcttctgggaaggtgctcaaagcgtcaacgtcgccgtgtggatcagcatcatctgggttgttattatttttctcaacatctttgccgtttctctctacggcgaggccgaattctggtttgcatctatgaagcttatcaccattgtcggcctgctcatcatggccttcattgtcgaccttggcggaaacccgcgccacgaacgtcttggttttcgctactggaagaacccgggcgccatgaaagagtatccaccccaggtgcacggcgaccttggtcgttttttgggtctcttttctaccctcgtcaacgctgccttctcctacggcggtgtggaaatggtcgccgttgccgctggtgaggccgaaaacccacgcaagaacatccccaaggccgttcgtcgtgtcttctggcgtattctctttttctacgtcttgggttctctcgccattggtgtccttgtgtcttccaacgacaagggcctccttgatgctcaggccgaaggccgctccgacgctgctgcctccccatgggttattggcatcaagaacgctggcatctccgtcttgccctccatcatcaacgctgtcatcttgacttccgcgacttcctctggcaatgccttcctttacaccggctctcgctacctctacgctttggcgcagaaccgtcaggccccacgtatcttcctcacttgcagcaagaagggtgtcccctattacgccgttgccgccacggctatcatcggcggtctcacttacctctctgtcgatcccaacggtggtgccgcaaaggcgttcagctggttccagaacttaacgaccatcgctagtctcttcacctggtgctccatctgcgttgcttaccttcgcttctacaaggcgctaaaggctcagggcattagccgcgataccttggtcttcaagagcaggtttcaaccatacacggcatggttcgcgcttatctactttgctgtcattatcattttcagcgggtttgctgtcttcatcaaaggcaattgggatgtcgctggtaagtctcccttgacttcgtccatgtcaccgttttgccta

SEQ ID NO: 27143 - DNA, 817 bp, Neurospora crassa
tgcttccaggggcgagccaaccggcaccatgaccaaggtcgccgacaagtgggacgcctacatcgcccagcccactggctcccagaagaccggcaaagccctcctcttccttcccgacatcatcggcatctggcaaaactccaagctgatggccgaccagctggccgcccagggctaccttaccatggttctcgacatcctcaacggcgacccgctcccgctcaaccgccccgacgacttcgacatcatgggctggctgaccaagggcagcaccggcgataacccgcataccaaggacttcgttgatcccattgtgcaggccggaatcaaggctttgaaggagcagtatggagcgaccaagatcggagcgttgggatactgctttggtgccaaggtaagctccgtccctttctcttttctgcccccccactggaagcgctggtcttttcgcctttcagttgccaacagtcactgacatgcccaaaagtcccttgtccgcaacatgacggccaccgccccctacaccggcatcgacgtcggctttgtcgcccatccctccttcgtcgaggaggaagagctcgccgccatctccggccctttggccattgccgccgccgagactgactccatcttccctgccgagctgcgccacaagtccgaggagatcctcaaggagacgggtctgccctaccaggtcaccctgtactctggcgtctcccacggcttcgccatgcgcgccgatctcagcaagaagccggagaagtttgcgagggagcaggcgtttgcgcaggctgtcgcttggtttggagagtatttg

SEQ ID NO: 27144 - DNA, 793 bp, Neurospora crassa
acgcagttcacaagagaatacaagctggtggttgtcggtggcggtggtgtcggtaaatcgtgccttaccatccagctaatccagggtcacttccttgacgaatatgatcctacaatcgagggtgcgttacaacctggaccctctcaatccacgttccaattttcttggtcgtggttgtggcctagtgaaccgtggactaacttgagctcaatagattcgtaccgcaagcaatgcaccatcgacaatgaggtcgcccttctcgacattctagataccgccggccaagaagagtactccgccatgcgcgagcagtacatgcgcactggtgaaggcttcctgctcgttttcgccatcaactcgagggaaagctttgaggaaatcagaatctaccagcaacagattcttagggtcaaggacagggactcgttccccatgatcatcgtcggaaacaagtacgatttgaggggagagcgcgttgtttcggaacagggtaggttttcacttcttcatccttgcgagggccaggacagtacgctgacaacacttgacaacagagggacaagctcttgccgccgagttcggtaccaagtacatcgagacttccgccaagacacaacacaacgttgagaacgctttctacgatctcgtccgcgaaatcaggaaagaggacaagaagctcggcgagaaggtcggcggcacctcattcgccaacaacaatggggcagttaagcagatggacgtcggtgacgaggacgtccaagcaggctgctgcgccaagtgcataatgatgtga

SEQ ID NO: 27145 - DNA, 2949 bp, Neurospora crassa
atggctgagcaattgaggtttgacggccaggtcgtcgttgtcaccggcgccggcggtggtcttggtaaggcctactgcctcttcttcggctcgcgcggtgcttccgttgtcgtcaacgatctcggtgcttccttcaagggcgagggcaactctaccaaggtaaccatttcccctactcaactcgccatcgccgccactggctgtcaatcaccaatcacatgctaacgagttctcaacaggctgccgatgtggttgtcaacgagatcaaggccgctggcggcaaggccgtcgccaactacgacagcgtcgagaacggcgacaagatcatcgagaccgccatcaaggagttcggccgcatcgatatcctcatcaacaacgccggtatcctccgcgacatctccttcaagaacatgaaggacgaggactgggacctcatcttcaaggttcacgtcaagggctcctacaagacggcccgcgccgcctggccctacttccgcaagcaaaagttcggtcgcgtcatcaacaccgcctctgccgccggtctcttcggcaacttcggccaggccaattactcggccgccaagctcggcatggttggtttcaccgagaccctcgccaaggagggcctcaagtacaacatcatctccaacgtcattgctcctatcgctgccagccgtatgactgagaccgttatgccccctgaccttcttgccctgatgaagcctgagtgggttgttcccctcgttgccgtccttgtccacaagaacaacaccagtgagactggctccatctttgaggttggtggtggtcacgtcgccaagctccgttgggagcgctcttctggtcttctcctcaaggccgacgagagctacacccctggcgccatcatcaagaagtgggatcaggtcaccgacttttccaacccccagtaccctaccggtcccaacgacttccttgccctcctcgaggagtccctcaagctcggccccaacgaccccggtgagaaggtggacttcaagggccgtgttgccctcgtcactggcggcggtgctggtatcggccgcgcctactgcttggctttcgccagggctggagcctccgttgttgttaacgaccttgtcaaccctgacgatgtcgttaacgagatcaagaagatgggtggcaaggctgttggcgccaagttctccgctgaggacggtgatgccgttgtcaaggccgccattgatgcctttggccgcgtcgatatcgttgtcaacaacgccggcattctccgtgacaaggctttccacaacatggatgacagcctctgggatcccgtcatgaacgttcacgcccgcggtacctacaaggtcaccaaggctgcttggccctacttccttaagcaaaagtatggccgtgttcttaacaccacctctacctctggtatctatggtaactttggccaggccaactactctgctgccgtaagttcttgtcctttggatgcccaatgaattctagctaacttgtgtagaaatgcgccattcttggcttctcccgcgccattgctctcgagggtgccaagtacaacatctatgtcaacaccattgctcccaacgctggtactgccatgaccaagaccatccttcccgaggagctcgtccaggctttcaagcccgactacgtcgctccccttgtccttgccctctgcagcgacaaggttcccaagaagcccactggtggtctctacgaggtcggctccggttggtgcggccagaccaggtggcagcgctctggcggccacggctttcccgtcgacgttcctcttacccccgaggaggtcgtcaagcactggaacgatatcgtcaccttcgactcccgtgccgaccaccccgagaaggcctccgacagcattgagaagatcatggccaacatggaaaaccgtgtcggcgagggcaaggtatgattcccttcttcctgctgccacgaaagaatgtcatgtattttcccgttcccccatgtataatagccatacatacctagtgtagaatacttggataattgttaacgactcatctttttctcctgtagtctggcgctgccgagaacgagcaccttgctgccatcaagaagttcaccggcgtcgaaggtaagggcaccgagtacaccttcaccgagcgtgacgtctgcctctacaaccttggcatcggcgccaagcgcaccgacatcaagtacatcttcgagggcaacgaggacttcgaggtcgttcccaccttcggtgtcatccctcccttcaacaccgagatgcccttctctttcgacgacatcgttcccaacttctcccccatgatgctcctccacggcgaacaatacctcgaggtccgcaagtaccctatccccacctcgggccgtctcgtctccaagggcaagctcctcgaggtcgtcgacaagggctccgccgccatcgtcaagcaaggaatcaccaccttcaacgccgaaaccggcgaggagctcttctacaacgagatgaccgtcttcctccgtggctgcggtggctttggcggtcagaagaagcccgccgaccgtggcgcttccaccgccgccaacaagcctcccgctcgctcgcctgacgccgttgttgaggtccagaccactgaagagcaggctgccatctaccgtctcagcggcgactacaaccccctccacgtcgatcctgcttttgccaaggtgggcggcttcaaggtccctatccttcacggtctctgctcgttcggtattgctggcaaggccgtttatgagaagtacggcaagttcaagaacatcaaggtcaggtttgcgggtaccgtcaaccctggccagacgctggtgacggagatgtggaaggagggtaacaaggtggtgttccagaccaaggttaaggagacgggcaagttggctatcagtggtgccgctgctgagcttgcttaggct

SEQ ID NO: 27146 - DNA, 1101 bp, Neurospora crassa
cagaagaagcgccaggagctcatctcccagctcaacgagatccgtcagcagcaggccggtggcaagaatgcccgcacctccaagctcgaccagatcaagcgcctcgatgagcagctccgcagccgcattgccgagcaaaagactgcccgcagcaaggtcaacttcaagtccaccgaggaactcgaccgcgagattgagcgcctggagaaggaggtcaacggcggcatgatgaagctcgtcgacgagaagaaggccctcgccgagatctccaacctccgcaagcagcgcaagagctttgctggcttcgacgatgcccagaagcagatcgacgacctcaaggccaagatcaaggagatcaaggacagcttggaggaccccgaggccaaggccctcagcgaaaagtacaacaagctccaggccgagcttgacgccatcaaggccgagcaggacgaggcctacaagaacctctccagcctgcgcgacgagcgcaccaagctccagcagctccagtctgaaaagtaccaggccatcaagaagctcaaggatgagtactacggcgctaagaaggagttcgccaagtgggagcgtgagcagcgcgagaaggctcgcgagagacagcaggccgagcgtgagcgcatcgccaaggagcgccgcatggagcgtgcccagaagatgcttgccgaggcttctgaccccgcctacctcgaggagatccgccgtgccaactctctcctcaagtacttcgaccccagccacgaggtcgccgagaaggctcctctcctggccgacaagggtctcggtgcccaggctcttcgtaaggttgacgactctggcctcaagggcatgaagctcgtccgcaaggaggagcgtgatgacgactacctccctgccgtcaagaagggcaagaagtccaagaagcccaccggtgctgcccctgtcgccaccggcaagaccttcagcctccctccctcggtcattgaggactgcagcttcgtcggtgtcgagccccccatggctgctaccgatatccctgctgccgtcgagaagatcaaggccaagctcgagcagtggaaggctgaccagcctgagcagactcgcaag

SEQ ID NO: 27147 - DNA, 619 bp, Neurospora crassa
gacgcagcaaactgttcatgctgctggtccaaggacatggagaccggtcaaccatggctttgtatagccggggcggatgcaaaggtgaaagtctacgatgtcaaacagggcaagttagtcaaggtttgtttgtatcccttcccttcttacccttcaagtccccagatactaatgacagaaacagaccctcgtaggccacggcggcggcatcaacgacctcgtcacctccccgctcaccccctccctcatcgcctcctgctccgacgacaccaccgtgcgcctctggtccctcctccccatccactccgcgcaaccgtgcatgttcatcctaggaggcgacgcccacacctgggacctgctgagcatcgctttccacgacacgggccgctacttactgtcagcaggccacgaccaaaccatcaacctgtggaccatcccgccttgcccttccgaacccgtcactcacccgctcgtcatccactacccgcacttttccacaaaggaaatccataactcgctggtggactgcgtctcctttttcggcgacctcatcctatctcgcgcctgctgggaagagactatagtcttgtggtctatatcaggcttttcctcctcctcc

SEQ ID NO: 27148 - DNA, 780 bp, Neurospora crassa
acaaggaagactaataatcatgcctacagcaccttctcccccgaaggccgcctcttccaagtcgagtactccctcgaggccatcaagctcggctccaccgccatcggcgtcgccacctcggagggcgtcattctcggcgtcgagaagcgcgtgacctcgaccctgctcgagacctcgtcggtcgagaagattgtcgagatcgaccgccacatcgggaccgccatgtccgggctgcaggccgatgcgcgctccatgatcgagcacgcccgcgtcgagtgccagagccacgccttcaactacaacgagaagctgcgcgtcgagagctgcacgcaggccatctgcgacctggccctgcgcttcggcgagagcgccgacggcgaggagagcatcatgtcccgcccctttggcgtggcgctgctgattgccggctacgatgaggacggcccgagtctgtaccatgccgagccgtcgggaacgttttatcgctatgatgcaaaggcaattggaagcggtagcgagggcgcgcaggccgagttgcagaatgagtaccacaaggtgggttatctagggtgcccgggactgtattagggccttattgctaattttcatcttgttatatagtccctcaccctcgaagacgccgagacgctcgtcctcaagacgctcaagcaggtcatggaggagaagctcgatgccaagaacgtgcagctggcgagcgtcaccaaggacaagggcttcaggatatacacagacgaggaaatggccgctgttgttgcgcgg

SEQ ID NO: 27149 - DNA, 288 bp, Neurospora crassa
acagacccaaaaaaagacacccgcgaaccaggtgaactccaccaaacaggccgcatccccaccgccatcaacatccccatcaccacctccccagactcctttttcatttccgaagacgaattcgaagaccgctttgggtttccccgcccctctaaagacagcgaagtcgttttctactgcaaggctggcgtgcgcagtagaggggctgcgggactggcgcgagaggccgggtgggagaaggtgggtgagtaccctgggagttggctggattgggcggcgagggggggc

SEQ ID NO: 27150 - DNA, 1597 bp, Neurospora crassa
agcggctggactattgtctttactcttcttgctgttcttgttgcttgggatcagagtatgttccagtctcgctgggcgcaaatgtcaaacgattagagatactgacaagtcttgctgcgcgcagtcaagtacgtcctcaacaagggcacaatcgctggtccatcatggaagattccctttatcggacccttcttggagtcccttgaccccaagttcgaggaatactatgccaagtggctgagcggtcctctcagctgcgtttccgtcttccacaagtaagtcgaacccccgcgtatgacttgcgccgagaaatcctggtcggaaaactaacgccaccaatcgcaggtttgtcgtgattgcctcgactcgcgatatggcccgtaaggtcttcaacagccccagttatgtcaagccctgcgtcgtcgatgtcgcccacaagctcctcggcgccgataactgggtcttcctcgatggccccgcccacgtcgagttccgcaagggtctcaacggcctcttcactcgcagggctctcgagatctaccttcccggacaggaggaggtgtacaaccgctacttcaagtccttcctggagatcaccaagaacgccggcggaaagcccgtcccctggatgccccacttccgtgaggtcattactgctgtctcttgccgttccttcgtcggtcactacatttctgatgaggctgtcaagaagattgccgacgactactacctgatcaccgccgctctcgagcttgtcaacttccccatcattattccctacaccaagacgtggtatggcaagaaggcggctgatatggtccttgccgagtttgccaagtgtgctgcgaagagcaaggtccgcatggctgctggaggcgaggccacctgcatcatggatgcctggatcaagcagatgattgactccaagaagtggcgcgaggccgttgccagcggtaacaccgagggtctggagaagcctactcacctgctccgcgacttcaccgactatgagatctcgcagaccattttcaccttcctcttcgcttcccaggatgccaccagctccgccgctacttggctcttccagatcatggctcagcgccctgatgtgctcgaccgtgtccgtgaggagaacctcaaggttcgcaacggtgatatccacgctcccatcaacatggagcagcttgagtcgatgacctacacccgtgccgttgttcgtgagctcctccgttaccgccctcctgtgctcatggtcccctacctggtcaagaaggctttccccatcactgaggattacaccatccccaaggggtccatggttgttcccaccacctacatggctctccgcgaccccgaagtttaccccaaccccgactactttgaccccgagcgttactactcgggtgatgccgaggccaagggtgccaagaactatctcgttttcggcgttggtccacactactgcctcggtcagcactatgctcagctcaaccttgcccttttcgttggcaaggcttctcttctcctcgactggaagcaccaccccactcctctgtccgaggagatcaaggtgtttgccaccatcttccccaaggtg

SEQ ID NO: 27151 - DNA, 3086 bp, Neurospora crassa
aactctccttgatacccaggtggaccacagcaacaccataacacaatggcaacaccaatggcacactccagcgatgctggcttcatgatgtcggacggaatcgcttcgcgaggaggagctactcccagggcgcgaaacggtcatcccagttcctcttcagctcgtccacgaggccccccctcagaaagcctcggagcggccagcgaagacgagggcgaggaagggttcgctgatgatcaggtccccgtccgctcgaggcctcggaacattgccgacatccccagggttcaggataggattggtgtcatggtccagagagcctttgaggccttcattgacgggtatgaagatccaagaaaccagccaaacatgtactacttggtgtacttgctgacaccggcgccagctacgtcgaaacacccacctcgtccggccaaccaacctcgagcgcagtcacgacagacaagtactacgtcgcccagatccacggcatgaggacctactcgttatccaccttctacgtcgactacaagcacgtcgcctcatggcaagacggcaccctcgccgaggccatcaccaactcgtactaccgcttccttcccttcctcacagccgccctccatagccgaatcgccgcccacgaaccccaatactttaacgaacatcgccagcccacggcatccagcgcccactccacgacagccgccagcacacgaggcgccaacgcgagccagtccgactttggcatcaagaaccccaaccaacaaaccgacaagctctttgccattgccttctacaacctgcccctcgtctcgcgcgtgcgctccatgcgcgcccgcaacgtcggccagcttcttgccattagcggcaccgtcacacgcacctccgaggtccggcccgagctggctctggccacctttgtctgccaggcctgctacgccgtcgttcccaatgtcgagcagacgttccgatacaccgaaccgacgcagtgtcccaacttgacgtgccagaaccgcacttcgtggcagctggacatcaggcagagcacctttgtggactggcaaaaggtgcgcgtgcaggaaaacagtagcgagattcccacaggaagcatgcccaggacaatggatgtgattttgcgcggcgaactggtggatcgcgccaaggccggcgaaaagtgtatctttacgggtgcgctgatcgtggtgccggatgtcagtcaattgggtctgccgggtgtgcggaacgtgtcggtgcgtgatgatcggggtgcggatgccggtggcagtggtgtttctggtctcaaggccctgggtgtgcgcgatcttacctaccgtttggcgttcctggcttgcatggtcacgcctgatgtgtcggcaatcggtgcttctggcgatgcccttctgatggacattgttggtaccctcaacagcagcgcggcggccgaaacagccgagaccatcaaggaagcccaggaagctctgctgagctcctacacctctgccgagatggaagacctccgtgccatggtgcacagcgaccacatctacgcacgccttgtccagtccttggcacccacagtctacggtcacgaagtcgtcaagaagggtatcctcttgcagcttttgtctggtgtctccaaaaccaccgccgaaggcatggcactccgtggcgacatcaacatctgcatcgtcggcgacccctcgacgtccaaatcccaatttctcaagtacgtcgtcaactttgctccccgggcagtctacacctccggcaaggcctcttccgccgctggtcttacggctgccgtggtcaaggatgaagaaaccggtgaattcaccattgaagccggtgccctcatgctcgctgacaacggcatctgctgcatcgacgagttcgacaagatggacattgccgatcaggttgccatccacgaagccatggaacagcagaccatttccattgccaaggccggtattcaggccacgcttaatgccagaacctcgattctagcagctgccaacccggtcggaggtcgctacaaccgcaagaccaccctgcgcgccaacatcaacatgtcggcgcccatcatgtcgcgtttcgatctgttcttcgtcatcctcgacgagtgcaacgagcaggtcgaccgccacttggccgaacacattgtcggcctgcaccaaaaccgggaccaagccatcgagcccgagttttccaccgagcaactgcagcggtacattcgtttcgctcgcactttccgccccgagttcaccgacgaagccaaggaagtcctcgtgcagcgctacaaggacctgcgcgccgacgacgcccagggcggcatcggcaagaacagctaccgaatcaccgtcagacagctggagagtatgatccgtctgtctgaagccattgccaaggccaactgcgtcgaggaaatcacgcccgattttgttaatgaggcgttccaccttttgcggcagtcgatcatttccgtcgaacacgacgacgtcgaagtagacgacgaggaagacgctcccgaaccacccgccgactcccccgaggccttgcaagccgccgccgccgctgcttcgcgcgtgcccgaggccgatatggacggagatggcgacgtcgacatgggtggtgaagctgcccgacagccgtctgcggcaccctcgcaagcgcatcgcgagaagcagacgatttcgtacgacaagtacatttccattgtgaacctgatcgtctccaaggtggccgaagacgagacgcaaggctcaggggaagggatcgaaggcgagcagctggtggagtggtacctggagcagaaggaggaggagatggcaacggaagaggagtatcacgaggagaggaggttggtgggcaaggttttgaagaggatggtcaaggtatgtttctgccccctttttcttcctgcagattgagcgactgctaatgaaattgaaaaaaaacaggacaacatcctcatggcgatccgcggacaaggaattgttggcgaagaaggtaccgtgggagaaggtacctcggcaagggcagagggcaacattgtctatgtgttgcatcctaattgcgcggtggag

SEQ ID NO: 27152 - DNA, 1211 bp, Neurospora crassa
ttccacaccaccaaccgcctgcttgctacacctcgcgacccctacggcgtactgggtgttgaccggagcgcctcgcaatccgacatcaaaaaggcctactacggcctagccaagaaataccaccccgatacgaacaaggacccccaacgccaaggacaagtttgccgagatccagtccgcctacgaaatcctatctgatcccgagaagaggaagcagttcgaccagttcggcgctgctggcttcgaagcaggcggccacccccggccctggtggtgaaccgtttggcggcgggcacccctttggcggcttcggcggacgcggcggcttcggcgcaaacatcaacctcgatgatctcttctcagcatttaccggtggtggccgtggtccctttggcggcggcggcggcggtcggggtccgttccagcccgagattttcgagggtgacgatatcgaggtgcaggtgcaggtgtcgttcatggaggcggccaagggaaccaaaaagacgattacgatcctgcctctgaagcaatgcggcacatgtagcggtagcggtttgaagaagggcactcaaaggtcgacgtgcaagtcgtgcggcggttccggtcaaaaggtcgtcacggtcatgggcggtttccagatgggcaccgtttgcaacgcctgcaacggcagcggcacggtgacgcccaagggttccgagtgctcgacttgctcgggcgacggtgtggtgagggagcgcaagaccttggtggtggatattcccggcggtatcgaggacggcatgaagctacgcatcagcggcgagggtgacgcgcccccattaggcagacagtcaaaccccaacgcccaaggcacccagggcgacctgtacgtccacgtccgggttgcgcccgaccccaagttccagcgtcacggctccgacatcctctacacggcaacgataccgctcaccacagccattctcggcggcgaagtcaccatccccacgctcgagggcgacgccaaggtccgtgtcgccactggcaccaacaccggcgacaagatgaccatggcgggcaagggcatgcccaagctcaagggccgtcgcggggccaagggcgacctgcgcgtcgagttccgcgtcaacatgcccaagtatctgagccccaaccagcgtaccatcatcgagatgctagcggacgagatgggcgacaagacggccaagcgcgttatg

SEQ ID NO: 27153 - DNA, 1649 bp, Neurospora crassa
acccatcggaagctcaagtcgcgccatatccagctgatcggtgcggtatatcctgttcttcctgtcctatccactgactaacacaagtcaccaaaaacaggcatcggaggcaccatcggtacggccttttacgtccagatcggcaaaggtctcctcaacggagggcctgccagcttgtttctggccttcaccatctggtgtacctttatcctggccatcgccatgtgcatggccgaaatggtcacctatctgcccatctcttcgcccttcattcgctttgcgggccggtacgtggacgaggcctttggattcgctgcaggctggaactttttcatcttcgaagcggccatggtgccctttgaactcactgcttgtaacctgatcatccactactggagcgacgccgtacctgtaggcggcatcattgccattacgctggtcatctacggcttggtcaacctgctggctgtggagtggtatggtgaaaccgagttctgggctgcgctgggcaagtttctgctcattgtgggattgctcatcttcacctttgtcgtcatggtgggcggaaatcccctgggagatcgatttgggttcagatactggaaggaccccggcgctttcaccgagttgtattacactggttcccttggccgctggctgggcttccttcagtgcttgattcaggcaagctttaccattgctggaccggattacgttgccatggtgtgtatccctttatccacataatcaacccaaacaaaacaaaactgacacctacaggccgccggcgaagcagaaaacccccgtgtcgtcatgccccgcgccttcaacgccgtcttctaccgtctcaccgctttcttcgtcctcggctctctcgccgtcggtattctcgtcccttacaacgacgccgagatggccctcgccttttcctccggtgctcccggcgccgccgcctctccctacgttgtcgccatgaaccggctccgcatccgcgtcctccccgacattgtcaacgccatggtcctcaccgccgccttctccgccggcaacagctacgtttactgcgcctcgcgctccctctacggtctggcgctcgagggcaaggcccccaaggcgctgctcaagtgcacccggtccggagtgcccatttactgtgtcatgatcgtgctgtgctttggcttgttggcgtttctgcaggtcagcaacagcgcggccgtggtgctctcgtggttcattagcttgatgacggctagccagctgatcaactatagcgtcacttgcacttcgtatctgaggtggtacgcggcgctcaaggcgcagggggtcagtagggataagttgccgtacaaggggcttttccagccctatgcggggtggtatgggctttgcgggtgctttgtcatgacgtttgtgggaggatatacggtgtttttgccggggcagtggagcgttgctacgtttttgttctcgtgagttgttctgggcaccgtgctttcggtggtgatgtggctgacagtctcaggtacaccatgattggggtttgtcctgtgctctttgtggtgtggaagattgtgaagaagacgaaattccacaaggccgaggaaattgacttgcacaagaatctggacgaagtggaggagtatcaggca

SEQ ID NO: 27154 - DNA, 2144 bp, Neurospora crassa
gcccatctgcttggtgaggacttgtacaagaagctggccaactacctgacagaccaccttaagcacctagtctccgaagcggaggctcacaaggacgaggccttgttagctttttacattcgcgaatggcaacgctacaccaacgccgccaagtatatccaccatctcttcaagtacctgaatagacactgggttaagcgcgagatggatgaagggaaaaagaacatttacgacgtctacacgctccaccttgttcagtggcgtgacgtgttgttccaggctgtctctaagaaagtcatggacgccgttctcaagctagtggaaaggcaacgcctcggtgaaaccatcgagtacacccagatcaaacaggtggtcgatagcttcgtctcactcggtatggacgaaggcgacaacaccaagacgacgctggaagtgtataggtaccactttgaaaggccgttcctggaggcgaccaaagtcttctaccaaaacgaaagcaaacagttcgtggccgagaatagcgttgtcgagtacatgaagaaggccgaggctcgcctggctgaggaggaggagcgcgtacgcatgtatctgcatccagatattgccctacatctgaagaggacttgcaaccaggccctcatcgcggagcactctaccctgttgcgtgaagaattccaggccctgctggacaacaaccgagaggacgacatgaggcggatgtacagcctcctttctcgcattcccgacggtctggagcctctgcggactcgtttcgaggcccatgttcgcaaggctggtttggcggctgttgccaaggtggctgcagacgccgacaagctggagcccaaggtctacgtcgacgctctgcttgagatccacactcagtaccaggggttagttgagcgcgctttcaacaaggagcctgacttcaccagatctctagacaacgcgtgcaaggagtttgtgaaccggaacgaggtctgcaaatcgggctccaacaagtcaccggaactgctggccaagtacacggacgtgcttctccgcaagagcagcaccggagtggaggaggcggagctcgagaacacgctgacgcagattatgactgtgttcaagtacatccaggacaaggacgtgtttcaaaagttctactcacgcatgctggcgcgccgcctcgtacacagcaactccaactcggacgatgccgagacctcgatgatttccaagctcaaggaggcctgcggcttcgaatacaccaacaagttgcaacgcatgttccaggacatgcagatctccaaggatctcaacacaggcttcaaggagcacgtcgcctccctcaacatggacggcaagccgctcgactcgacgtactctatcctcggcaccggtttctggccgctcgttccgccaaacaccagctttgttgcgcccgccgagatctcggccgactgcgatcggttcacccgcttctacaagaacaagcacgaaggccgcaagctcacttggctgtggcagctgtgcaagggcgacatcaaggcgaattatatgaagggcgctaagatgccctatatctttagcgtgtcggcgtaccagatggccatcttactgcttttcaacgagaaggaccagtacacgttcgaggagcttgcgagcatcactcaactcaacgcggacgtgcttgaaggcgccctaggcatattggtcaaggccaaggttcttaccgcggagggtggagaaggtggcaagattggaccgggagcgacgttttcgctcaactacgacttcaagaacaagaagtatcgcatcaatttgaatgtgggcatgaagagtgagaccaagcaggaggaggcggagacgaacaagacgatcgaggaggatcgcaagttgctgttgcaggtgtgtgaccccctacacccagtaagcgtgttgattagaaagctaacgcagaaaccacacagtccgctatcgtccgtatcatgaaggcgcgcaagaagatgaagcaccagcagcttgtctcggaaaccatcaaccagattaaggcacgattcatgcccaagattggcgacatcaagaagtgcattgagatcttgctcgataaagagtacctggagcggttggaggatgatgagcttgggtatcttgcctaa

SEQ ID NO: 27155 - DNA, 1396 bp, Neurospora crassa
atgggcgcatgcatgagcaagaacgacgaggagacggagcagaagaagaggagccagaagatcgatcgcgacctagaggaggactccaagaagctacggaaagaatgcaagattctacttttgggtgcgtacccctgttgtccttcgctaaaaacgtttttgctaacatgcgtgcgcgtacaggctccggcgagagcggtaaatcgaccattgtgaagcagatgaagatcatacatctcaagggctattcagatgaggagctcacaaattaccgaccaaccgtctacaagaatctgttggaatgcgcaaaggcggttgtgaatgctatgcaccagtttgatatccagccagcagatccgtcgctacggccctacgtcgagttcttgcaggactacaacatggaggggtgtccaccaggacagtcgatagaccccaaagtcggcacagctatccaggcactatggaatgatccagcaaaggagcaactcatggagaggcaaacagagttctatcttatggactctgcagaatagtgcgtgtccggttttttttctttttttttcttttttttttttttttcttcttctccataggagctcacgttcgctgacttgcacagtttcttcaccgaggtcatgaggattgtggccgaagactaccgaccaaatgaaatggatgtacttcgcgccagaacaaagacgacgggtatctacgagacaagattcaagatggggcagctcagtatccagtaagtgtgcctgatagacatctgttaccctcgtgcccctcagctcacacaatgatctagcatgtttgatgtgggcgggcaacgtagtgaacgcaagaagtggattcactgcttcgaaaacgtcacatccatcatcttctgtgttgccctgagcgagtacgaccaagtattgctcgaggagagcagtcaggtatgtccaccaaccacgtcaccccctggtacagagatggtgctaacatgtaacagaaccgcatgatggagagtctgctgctcttcgattcggtcgtcaattcacggtggtttatgagaacgagtatcatcctgtttctcaacaaggtcgacatcttcaagcagaaactggggcggtcacctctagggaactatttcccggattattccggtggaaacgacgtcaacaaggccgccaagtatctattgtggcggtttaaccaggttaacagggctcaccttaacctatatcctcagtatgtccgctccatctgtcctgtcttggtgtatgcaccatcatgctaacattgtcacagcttgacacaagccaccgatacctccaacatccgtctcgtgtttgctgccgtcaaggaaaccattctcaataacgcccttaaagactccggtattctatgatga

SEQ ID NO: 27156 - DNA, 1431 bp, Neurospora crassa
tgtattgccatggtgatgaaagaaggccaattacgacgagcagagatcctcagtatcaaagacaccaagtccggccggcaattctactgcaactttgacaacttcaacaagcgtctcgacgaatgggtgccggccgccagaatcgatttcgagcaggacgtcgagtggcccaacccggacaaggacaagcagaaggacgccaagaccaagaaaaacaactcgacggtatccaagaagcaaccgtccaagaagaacaaccagaaaaaggccagcaagagggagcagtcagtcgcatcggacgggcagacaccacacccatggaccgagtttgtcgaaagccagccagggaagaataacaggcaacgggggaagacggaagatggaaccgacgtcaacgccagtttggaggttggtggggacaagggagtcaagaggaaagccgacgagatcgatatggatgaggacgaaataccagccgctaagaaacaacgccagccgtctttttccagggaacaagagattgaaaagttgcgaacatccggctccatgacacagaaccctaccgagatctcgcgcattcggaatatctccaaggtggaattcggccgctacgtcctcttcccgtggtatttctcgccctacccgcagatctttgaccaagaagactgcatctacatctgcgagttctgtctctcgtactacggcgagttgaaatcctttgtgcgtcaccgacaaaagtgcactctacaccacccgcccggaaacgaaatctaccgggacgactacgtctcctttttcgaaatcgacgggcgacgtcagcgcacctggtgtcgcaacctctgcttgctgtccaagatgtttctcgaccacaaaaccctttactacgatgtcgacccgtttttgttctacgtcatgaccacccgcgacgaccgggggtgccacatcatcgggtacttctccaaagaaaaagagtctacggacggctacaacgtcgcctgtatcttgacccttccgcagtaccaacgcaagggatacggtcgcctgctcatccaattctcgtacgaactgtccaaaatcgaaggcaagctcggctcgcccgagaagcccctgtccgatctgggtctgctgtcatatagacagtattggtccgagaacatcatcgatatcttgctcgggtacaacgagcgaaaggaagcttgcacgattgagaacattgctgttgccctggccatgacgacacaggatgtggaacatacgttgcaggcgctcaagatgcaggtgtaccacaagggcgagcacaagattgtggtaccggagaagctgatcaagcagagggagaagagcaaagcgaagcaaaagaggctgattgatcccgagaggatccagtggaagccaccggtgttcacggcgcttaatcggacatgggggtgg

SEQ ID NO: 27157 - DNA, 371 bp, Neurospora crassa
caaacagtcggcaagacgtcgctcatcacacgcttcatgtacgactcgttcgataacatgtaccaagccaccattggtatcgatttcctttccaaggcatgttcgacccccgtctcccattcaattctttaccgcccttccttcccagacagacaatgcgcgacagttgcaaagacccaagaactagtagaacaagatgagagcctttggctaactttacgggggggaaaaagaccatgtacctcgaagaccgaacagtccgcctacagctctgggacacagccggccaggagcgtttccgctctttgatcccttcgtacatccgcgactcgtcagtagccgtggtagtttatgacatttcgagtatgtta

SEQ ID NO: 27158 - DNA, 4566 bp, Neurospora crassa
acacaacccatagtcgccagaatcgcatacctggcctccgatgtcgtcgtctcggtgcagccctcgctcgccgccgagtccgacttctcggccactctcaagagcctcgcctcttccaggacacaaagccttgtcgccaaggccgccgatgccgtcaccgagatcattcccgtcagacacaacaacgaccctcttctctcagtattcacacccatccgctccggccgcctggtctcggtaacaaccacctccgaggttctgctccccagcatcgcccacctctacaagctcgcccagctcccagtcgtcctccacgttgcgctgggccccaagagcctcccagactacaccgccatcacctcgataaggaattccggctggaccttcctgcagtccaactctctccaggaggctcaggatctggccctcactgcccatgctctcgccgtccagtccggcaagggtgttattcacttcttcgaccccagctctagcgcttccgagcagcccattgctgctgaggatctcagccttgtccaggagattctcaacctcgacaatgttcgccgcttccagtccgcctccatctcgggctcttccatctacgccaacgacggccgcgtagccgttgtctctgagcagtccgagcctgttgccagccagaccgtccttgacgcccgccaagttgaggccgctactgctactgcgaccgattctcttgcccctgcccaggacggctccgatgagtccgcccagaccagccaggaacaaagcgaggccagcgaggccagcgcgacccccagtgcctccgtcgccaccaccatcgacgagcaggcccccgttgtcacctccgagcacatctacaagtacgtcactgccatctgggccaagctcaacgaccttgctggcaggcaatacagcgctttcgagtactcgggtccttccaacgccgagaacgccctcttcgtcttcggctctggctctcctctcttcgcccaggccattgcccaggcccagtctgacgacagcttcgccaaggccggtgttctcactgcccgtctctaccgcccgtggctgggcgccaagctcctcgaggccatccccaagtctgttaagcgcgtagctgtccttgagcaggtctcgaggaagactaccaagtggggtcccctcctcatcgatgttcttacctcggtcaagagcggccctggcggtgtccagaccattgttggccaccagcttggctacatctctcaggagaccgttgtccaggccctccgcggcatcttccagaacctcacctccgagaagcccgttcagaacctcgaggttggtgagcgcgaggcccccaaggaggcttccgagtacggccttgagaagcccaagctcgagactgcctacaccaagatcctcgaccagctcttcggtgagcgcgcctacatcgccaactccatcgagaaggacaacgccggcatttccaacaccatctccgccactcccgagtacggtttcggtgccctcctcgcccgcaaggagcgcaagcaaaagttcgtttccgaggtcaaggaggccgccagcaacggccagttctcctctgacgctcccaagcaggctcttgccaagtgggttgccaacgctgaggactccaagaaggtcgaggaggtcgcttctgaggctgtctccaagctctctgaggatggctctgacctctccaagtctctcctcgagtacaagcagttcttccgcaagcagtccctctggctcgttggctccgatgcctggtcctacgacctcggcaactcgggtgtccaccacgtccttgcttccggcgagaacgtcaacctgctcatcatcgactctaccccctactctgagcgcgctgctgccgatgccaaccgccgcaagaaggacattggtctctatgctatgaacttcggtaacgcctacgtcgcctctaccgctgtctacagctcctacactcaggtcctccaggctatggatgaggctgataagttcaacggtccttccgttgtccttgcttacctcccctacttcggtgagcacgactctgctctcactgtcctccaggagaccaagaaggctgttgatatcggctactggcccctttaccgctggaaccccgagaacgagaagaagggcgagcccagcttctccctcgactccgagcgcatcaagaaggagctcaaggagttcctcgaccgtgacaaccacctcactcagctcatgaagaaggagccctcgttcggcgctgttctttctgaggactttggtaccgagatccgtgcccagcagaagcgcaaggccaaggatgcttacaaccagttgctggaaggcctgtttggtgctcccctgaccattctctacgcttccgataacggcaatgccatctccctctccaagcgtctgggtaaccgcggccgtgcccgtggtctcaagactactgtcatgtccatggaggactaccccgttgaggacctcgccactgaggaaaacatcgtcttcatcacctctaccgccggtcagggtgagttcccccagaacggtctttccttctggcacgccgtcaaggacaacacctcccttgacctcgccaacgtccgttactccgtcttcggtctcggcgacagccactactggccccgcaaggaggacaagatctactacaacaagcctgccaaggacttggatcgcgtccttgccaactttggtgctaagcctctggctcccattggccttggtgatgaccaggaccccgatggtttccaaactggttactccgagtgggagcccaagctctgggaggctctcggcgtggccaacgtcgatggccttcctgaggagcctgccccgaggaccaacgaggacatcaagattgagtccaactacctccgtggtaccatcgttcagggcttgaatgacacttccactctcgccatctctcccgacgactgtcagctcaccaagttccacggtacttacatgcaggatgaccgtgatatccgtgatgagcgcaaggcccagggtctcgagcctgcttactccttcatgatccgttgcagactgcccggtggtgtgtctaccgctaagcagtgggtccagatggacgacattgccaacgagctcggcaacgagaccatgaagctcaccacccgtcagactttccagttccacggtgttgtcaagagcaagctcaagcccgccatgcaggccatcaaccgcgctctcatgaccaccattgccgcttgcggtgatgtcaaccgtaacgtcatgtgcagccctctccccgctcactcaaagtaccaccgcgcggttcatgcgtgcgccaagcgcatcagcgaccacttgctccccaacaccactgcctaccacgagatctggttgaccgatgacgatggtgccaagacccaggttggcggtaacgctgtccaggactttgagcccctctacggccctacctaccttccccgcaagttcaaggtctccattgccatccctccccacaacgacgtcgatgtctacgcccacgatatcggtctcattgccatcaagaacgaggacggcagccttgctggtttcaacctgctcgccggtggtggtatgggtgccacccacaacaacaagaagacctacccccagaccggtcgcatgctcggcttcgtcaccgccgccgacgtgcaccttgcctgcgagaaggtcatgcttgttcagcgcgacaacggtgaccgcaagaaccgcaagcacgctcgtttgaagtacaccattgacgacatgggtgtcgatgtgttcaaggccaaggttgaggagtactggggccagaagtttgaggagcctcgtgccttccactttgactccaacgtcgacaccttcggatggaccaaggacgagaccggtctcaaccacttcaccatgttcattgagaacggccgtattgaggacaccgccgagttccagatgaagactggtctccgcgagatcgccaaggtccacaagggcgagttccgtctcacccccaaccagcacttgattctctccaacgttgccgacgaggacaagcctgagctcgagaagctccttgcccagtacaagctggacaacctgcaccactctggcctccgcctatcctcgtctgcctgcgtggccttccccacttgcggtcttgccatggctgagtctgagcgctaccttcctgttctcatcaccaagctcgagggcgtccttgaggaggttggtctcaagcaggacagcatcgtcatgcgtatgactggttgccccaacggctgcgctcgtccctggttggccgaggtggctttcgttggcaaggcctacggtgcttacaacatgtaccttggcggtggttaccacggtcagcgcctcaacaagctgtacaggtctagcatcaaggaggaggagatcttgacgatcatgaagggtctccttaggaggtacgccaaggagagagaggagggcgagaggttcggtgactggactattcgtgcgggcatcatcaaggcgactactgatggaaggaacttccatgagggggtgagt

SEQ ID NO: 27159 - DNA, 2891 bp, Neurospora crassa
atggagtccagaatcagcaaccggttatcgagttccgccacaaggacggtacgagccttcagaaatcgatggtcatgccaggccagggacaccgggatcgagttacggaaatgcgaggcgaccgcttccctcggcaccagcgcctttacactacaatagcccaagtcgcgcagcgagtcattatccacggtaccatggaggttatgcggacgacgtgacagttagcatgggaccggacgacgatcgtacagatatctttggccccgaaaccgatctcagcgaaacgcgccacctcaacgacgcatacgggtttcggtcatcccagatcaccctcagcgaagatccccacggcacccacgcgcgttcccggtacgacgacgaagacgatgtgagcaccacttattcctccaacacgggcaccagcgcttcaggtgtcgacaagttcgagcattacggtcccattccggaggaaggcaagcacgagcggcgcggcgtgcgaccaccacagatgtcgaggaaggaagtccagctcatcaacggcgaactcgttctcgagtgcaagattccgactatattgtattcgtttttgcccaggagagacgaagtggagtttacgcacatgcggtacacagccgtcacttgtgaccctgatgactttgttgccaggggttacaagttgcgccagaatatcggtcgtaccgccagggagacggagctgttcatctgcgtgaccatgtacaacgaggacgagttcggattcacacggactatgcacgcagtcatgaagaacatttcgcatttttgttcccgaaacaagagtaggacgtggggagcggatgggtggcagaagattgtggtctgtgtggtttcggatggacgagagatcattcacccccggaccttggacgccctcgcagccatgggcgtttaccagcacggtatcgccaagaactttgtcaaccagaaggcggtgcaggcccacgtttacgagtacacgacacaagtgtctctggacagcgacctcaagttcaagggcgccgagaagggcatcgtgccctgccagatgattttttgcttgaaggagaagaaccaaaagaaactcaactcgcatagatggttcttcaacgcctttggcaaagccttgaacccgaatgtgtgtatcctcctagacgtcggcacccgccccggcggcacaagtctctaccatctctggaaagccttcgacacggattccaacgtggcgggggcctgcggggaaatcaaagcgatgaaggggcggtttggcgggaatttgctcaaccctctggtggctagtcagaactttgagtacaagatgagcaatattctggacaaaccgttggagtcggtgtttgggtacatcacggtgttgccgggcgccttgtcggcgtatcggtaccatgcgctgcagaacgatgagacgggccatgggccgttgagtcagtatttcaagggcgagacgctccatgggcagcacgcggatgtgtttacggcgaacatgtacttggccgaggaccgaattctgtgttgggagttggtggccaagaggggtgagaggtgggtgttgaagtatgtgaaggggtgtacgggtgagacggatgtgcctggtgagttgccccccttttttgctgtgtgataagttatactaacgagttgtagacaccgtcccggaattcgtctcgcaacgtcgtcgttggctcaacggtgccttcttcgccgccgtctactccctcgtccactttcgacaaatctggaaaaccgaccacacctttatgcgcaaagcccttctccacgtcgaattcctctaccacctcctgcaactcctcttcacctacttctccctggccaacttctacctcgccttctactttatcgccggcggtctcgccgatccccacgtcgacccttttaactcggacggccacgtcgcgcgcatcatcttcaacatcctccgctacgtctgcgtcctgctgatctgcacacaattcatcttgtccctcggcaaccgtccgcagggtgccaaaagaatgtatctcgcatccatgatcatctacgccgtcatcatggtgtacaccaccttcgccaccatcttcatcgtcgtgcgacaaatccaaccctctcaaaaatccgacgacaagcccgacctcgaactcggcaacaacgtcttcaccaacctgatcgtctccgtggctagtaccctcgggctctacttcgtcatgtcctttctctatctcgacccctggcacatgttcacctcggccatccagtactttgtcctgctgccttcctacatctgcacgctccagatctacgccttttgcaacacccacgacgtcacatggggcaccaaaggcgacaacgtgatgcgcaccgatctcggaggcgccattggcaagggaagcaccgtcgaactggaaatgccttcggaccaactcgacatcgactcgggatacgacgaatgtctacgtaatctccgcgatcgcgtcatggtccctgccgttcccgtgtccgaggaccagctgcagcaggattactacaagtcggtgcgcacgtacatggtggtgtcgtggatggtggccaacgcgacgctggccatggcggtctcggaagcgtatggcgattcggaaattggggataatttttacttgcggtttatcctgtgggcggtggcggccctggcgctgtttagagcgttggggtcgacgacgtttgcggcgattaatctggtgagtgctctcgtggagggcagggtcaggctgaggttgaatatgaaagggtttaggtggattaaggagaagtggggggatgcggatgtgaagggcaagtttgaggggttgggggatcgggcgagggggttggcgaggcggtgatgt

SEQ ID NO: 27160 - DNA, 1203 bp, Neurospora crassa
actgacgtcgtcatcctctcctctctccgcacccccatcacccgctcctacaagggtcacctcaaggatgcctacccggaagagctcctctccgtcgtcctgcgcgccaccctcgacaaagttcctgagctcaacccatccaaaatcgaagacgtcgccgtcggcgtcgtcctctccgagcttggcggctccaaagccgcccgcatggccctgaaccacgtcggctttgactcttcgtctacctctctctacaccgtcaaccgcgcctgctcctcctcactgcaagccatcgcctccatcgcggcctcgatccgcaccgaggctatcgatgtcggcatcggcgccggcatggagagcatgacgcgcaactacggctcgcgcgcgatcccgacttcgtactggcctgctctcaaggagagccctgtcaaggacgcgcgggactgcgtcatgcccatgggtttgacttcggaaaacgtcgcgagccggtatggtgtctcgcgcgaggaccaggatgcgtttgccgtcaagtcgcaccagttggctgcgcaggcgcgcgctgagggccggttcaaggaggaaatcgttccggtgacgacgcagtatcaggaggtcgacaaggccgggaacaaggtgggcgaaccgcaaacggtcacggtcacggaggacgacggcatcaggccgacggcgtcgctggagggcatggcgaagctgaagcctgctttcaagccggacggcgccagcacggcgggtaattcgagccaggtcagcgatggtgcggcggcgacgctgttgatgaggaggagcacggccacggcgttgggattgggagaccgcattatcggcaagtttgtggctgccaacacggtggggtgcaagccggatgagatgggcatcggccccgcggtggctatccccaagttgttgggccagctggggttggagaacaaggacgtcgataggtgggagatcaacgaggcttttgccagtcaggcgatctactgcttgagggagctggggcttgaggaggcttggaaggatggtaaggttaacccggatggtggtgcgattgctttgggtcaccccttgggcgccactggtgcgagaatggtgagcactctgttgcatggtctcggaaggacgggtggtgaggtgggtgtggtcagcatgtgtgttggtactggcatgggcatggctggtgtcttt

SEQ ID NO: 27161 - DNA, 1120 bp, Neurospora crassa
gtcgagggacaggatcccctcatccctcctgctcttctcatttccgagattcccatgacggatgccgctctcgagactgttgtcaagggcaggaaggaggccgtaggtgtcatcatgggcaaggatgaccgtctccttgtcgttgttggcccctgctcccttcacgatcctgctacagctctcgagtactgcagcaggctcaaggctctttccgagaagctcaaggacgacctcgttatcgtgatgagagcctacctcgagaagcctcgcacgaccgtcggctggaagggtctcatcaacgatcccgatatcgactcttctttcaagatcaacaagggtcttcgtatctccagacagcttttctgcgatttgacctctgccggtatgcctattgcttcggagatgttggacaccatctcccctcagttccttgccgacttcatctctgtcggtgctatcggcgcccgtactaccgaaagccagcttcaccgcgagcttgcctctggtctctctttccctgtcggtttcaagaacggaaccgacggaaacctcggtgttgccattgatgccattggcgctgccgcggctaagcaccacttcatgggcgttaccaagcagggcttggccgctatcacccgcaccaagggcaacgagcacggtttcgttatcctccgtggtggcaccaagggccccaactacgacaaggagaacgtccaggctgcgaaggagactctcatcaagaagggccagaagctcgccatcatggtcgactgctctcacggtaagtctacaaccttgacatttgcacattccaacagtgactgacaaatgaccaggcaactccaacaaggaccaccgcaaccagcccaaggttgccaaggtcgttgccgaccagattcgcgagggcgagaaagccatcattggtgtcatgatcgagtccaacatcaacgagggcaaccagaaggttcctgctgagggtccctcggcgctcaagaagggcgtcagcatcaccgatgcctgcattgactgggagtccactgtctcgaccctcgaggagctcgctgaggcggttcgcgagcgtcgtgaggtgaacggtggcctcgccagcggtgtggctacc

SEQ ID NO: 27162 - DNA, 1566 bp, Neurospora crassa
caacagctcctcgagtacttggagaagctgccaggtacagcttttaggagactgtaccagtcaccagcgacagctttggccatcttccgccgtatgctgtcttatcatggtatgcaattgttcctcgagtcagataccgaagtcttggacgccgaatctatagcatgtagctaactcctttgtccctcgatagccaaggttattgtccgaggtctactgtacatgcccgacccattcccgttaacctcccttgacatatggttccctccagagggcggcggaaagatacatcgcgatcgcaccattgccgctctccgatccctccacatcctacaggtctcaccaccaagcaaggaccgaacccaagaaatccaaatcacggcgagcttcaagaaaggcctacaactagccttcgaagggggcggcgaagatggcagctttggcgtccctagttctcttcccgtcgatccctccatcgacatcgcctacctggacaggtacgctcgtaagaagtgggacgacatcctccactacgttgtcaacagtcttggggtccacggcagctcagaaggggtcagcggacccaaggccagtgtgaaggaactactcttggccggacgcctcgtcgaacgacgtccagacacccgtacaggaatcggaattacgcaagccggtttcaccttccttctccaggagtccaacgcccaagtatggacgctcctcctcctctggctcgaagcagccgaccacacggccgactcgggcatggacagcattgacatgctctccttcctcttcatgctcagctcgcttgagcttggaactgcctacgatacttcggccctgaccgagacgcggcggaatatgcttccctcgctcgtcgacttcgggctcatctacttcccgcgcgacacgcgccagtttttccctacccgcctggccaccacactgaccagtaccgcctcggccctgcgcaccgtctcctcggctttcacggccgcaaccgccaacccctcgggcgagcccggcaccacgaccagcaccagcggcggccccgccgccacccccgacaaaacacagacagcagccaagggcatcatcatcgagaccaactatcgtatctacgcctacaccacctccccgctacaaatcgccgtcctggctctcttctgccagctcaacatgcgtttccccaacatggtctcgggccgcctaacccgcgactccatccgccaagcaatcggcttcggcatcaccgccgaccaaatcatttcctacctacacgcgcatgctcatcaacaaatggtgcgcgaagccacggtcacgggtaaaccggtgcttcccccgacggtggtggaccagatcaggctttggcagctggagaacgaaaggatgcagaccacggcgggcttcttgttcaaggactttgagagcacggaggagtacgcggcgctgagcaggtatgcggaggagattggcgtactagtgtggaagaatgataagaggcagctcttttttgccagcaagcatgagcagttgagggattatttgaagagtcggaagaag

SEQ ID NO: 27163 - DNA, 1423 bp, Neurospora crassa
atgccgttcaccaactttgacttcaaggaaaggtatcgctaccagaatggcttcgattcctacctagagtaagtctcgtattctcttccacttttaaatcttacctctgcttacccaaacttccaggtccgaagccgtctccggcgctctccccatcggccacaactcgccccagaagccccctctcggcctttacgccgagaagctttccggaaccgccttcacagctccccgccacgagaacaaacaatcatggctctaccgcatcctgccctcatgctcgcacccgcccttcgtccaggccactccacgtaatggtcaggagcccgtacttgagcgatcgccagccagactgcactacattcccaaccaactccgctgggaccccttcgatcatgaatccgacaccgacttcgtctccggcctgcgtctcgtcgccggcgccggcgatcccaccctcaagcaaggtctgggcatgtacatctacgctgccggcaagtccatgtccgcccaatcagccttctactcagccgacggcgaccttctcatcgtagcccaagatggcgtgctcgacatccgcaccgagttcggctggctactggtcaggcccatggaaatcgccgtcatcccgcgcggcgtgcgctaccaagtctttcttccctccggtcccgtccgcggttacgcactcgagctttaccaagggcacttccagctccccgagctcggccccatcggcagcaacggcctcgccaacgtgcgtgacttccaagctcccgttgcctgcttcagcgaagaccacggatcgatcgcgctcgacgggcccaacagctacaccatcacagccaagttcaacaataccctttttgagaccaagcagccgcacaccccctttgatgtcgtggcgtggcacggtaactactatccctacaaatacgatctcggtagattcaacaccatcggctccatcagctttgaccatccggatccatccatcttcaccgtcctctccgccccttcagaccacgcgggaaccgccattgccgactttgtcatctttcctcctcgctggctggtcggggaagacacgttccgcccaccttggtaccaccgcaacacgatgagcgagttcatgggactgatcacgggagcatatgatgccaagaagggaggaaagggcggtttcgtcccggggggcgcgagtttgcataatgtcatgagcggacatggccccgatgcggcgagttatgaaggggcgaggaacgctgacctgaaaccgcaaaaggtcggagaggggagttgtgcgtttatgtttgagagctgtttgatggtgggtgtgacggattggggactcgagacttgtcataaggtgcaggaggattataatgagcatagttggggtggggttaaggtgcattggaagggc

SEQ ID NO: 27164 - DNA, 954 bp, Neurospora crassa
agctcgtcgggcgttccagagtcatggatcgcatctttctgctccctcctgggacacgagtattttgccgaagtgtcagaagaattcatcgaagatgacttcaaccttactggcctgcagacccaggtcgccatgtacaaggaggctctcgaggtatgcttgttctggaacctttttgtccgttacgtcagcagctaatcattgtggttttaacctgactagatgatccttgatgtcgagcccgaggacgatgatgacgaggaggaggaggacgaggaggacgaggaagacatgtccggtggcgacggcatcaacaagccccacggcgaaaggagacatcacagccgcatcgcgagcgatctttctgtgatcgagtcctcggccgagatgctgtacggtctgatccatcagcgcttcatctgctcgcgggcgggtatccagcaaatgtcggaaaaatacgagctcggtcacttcggcatctgcccacgcacaaactgcaaccagacccgcacgctgcccgtcggcctctcggacacgcccggcgaagacacggttaagctgttctgcccgtcttgcttggacgtctacgtaccgccaaacagccgcttccagacggtggacggcgccttcttcggccgcacctttggcgcgctcttcctcatgaccttccccgaatacgacttgaccaagaccggcgctgagagcgttagcaatctcacacgatccggctctgacgacaccaccgtcattaacggcatgtacgcgcgcaacatagcgccggggctgggcaggggcaagatttaccagcccaagatctacgggttcaaggtgtcagaaatcgcgcgttccgggccacgcatgcagtggttgcgcagcaagcctgacgacttgagcgtgctggacgaggctcgtcgctatgcggaacaacaagggtcggatgacgaggacgagagc

SEQ ID NO: 27165 - DNA, 799 bp, Neurospora crassa
ttgcgcctgcacagtaccgagctcatcaaccacaataccaagaaattgcgtttcgaacttcctgaccgctctcagcccagcggtatgggcctcacctctgctcttctgaccatctccttccccaagggacgatggctccctgttatccgcccatacacccctacaaatgacctaagtgagttaccgactctaaataacctatgatctcactaacgacatccacctcccagacgaacccggcttcgttgagctcatggtcaagctctaccccggcggcaagcaaagcactcacctgcactcgctccagcctggcgacaccctaaccgtagcccccattcccgagctcaagtggactctcaacaagcacccgcacgtggccatgatcgccggcggcgccggcatcacccccatgtaccagctcgtccgcggtatcctgaccaacccggccgacaagacccgtatcaccctcgtctggggcgtcaacacggacgaggacatttttctgcgtgaccagctcgccgagcttgagcagaactaccctggccgcttgaagactgtttacgtcgttgctcaacctgcagcacagtccccgcatcagaaggggtttgtgactaggcaggtgctggaacaggccgggctcaatggtgcgacggagaagagcaaggggaccaaggtgttgctttgtggaccgccggccatggagaaggcgttgaagggaacgaagggatgggtaggaggtggcaagaagggggtgttgcaggagttggggtatacccaggatcagatttacaacttttag

SEQ ID NO: 27166 - DNA, 2358 bp, Neurospora crassa
atggcggacgacggtgacatgttcctcaactttgagatcggagatgctccgatcaagcagacggtcaagtacacaggtggccggtggagggacagagtcaaggcgcaaaagggcgagaagggtggacaggatcagtcaaaacaggcctcgacagctcgacgagataccggcgccgactactacacgaacagagccgcgaaacgtcaacggacagaagatggcgactctggcagattctccaagaccccacgaacaggcaatgccgccgagagaggtccgccgccgccgccgacacatgccatgaagactggcctcgtatcgtcgcgactgtttacttcgaatcccgttcccgtaaccgacttcgaggagcttccccaagccgaagaagccgagcctgcacaaccttcgaacgctcccctcagtgccgaagcagagaacttcctctcgttgggtctctcccgacgtgtatcccagcacctggcgacgaagctcgagatgaaggccccgaccgccatccagaagaacacgataccacaactagtcaaggaggatagcgatgccttcctccaagccgagacgggttccggaaagacgctagcataccttctccccattgtccacaggatattggccctcagtcacaacgaggacggtaccccaaagaccaccaaagtgcaccgcaactcgggactctttgctatcattcttgctcctacccgcgaactctgcaagcaaattgccgttgtcctcgaaaaggtgctgcgctgtgctccttggctagtctgcaccacggtaataggtggtgaaagcaaaaagtcagagaaggcgcgcatcagaaagggtgtcaacatcctaatcgctactcccggtcgcttgacagatcatctcgacaacacaaaggttctcgacgttggtacggtccgctggttggtactcgatgaaggtgatcgcatgatggaaatgggtttcgaggacgatatcaagactattgttggcaagatcagggctggtacactacagaagaagaacgccgagggtgtggttttggacggcgttctcccttcgaggagagtcacggttctttgctcggctacaatgaaaatgaacgtccagaagctgggtgagatcagtttggaggatgctgtccacatcacagcgtccaagagcgatatggagaaggatgcggagactggtgctgttgagacggcattctccgcgcccgcccagctaaagcaggccgctatcgtcacacccgccaagttgcgcctggtgacgcttattgccttgctcaagtcaacttttgccaggaagggctcggtcatgaaggctatcatcttcatctcgtgtgctgactcggttgactatcactttgagcttctcaagtctaccacaccgcgtgctgagcccgagcccaagcctgaaggcgaagctcccaccaagccgaacatccacatcgagtcgaccgtcgcgccagcaacatacattacctccccagccaaccctacggtgatgctacacaagctccacggttcgctcgcccagcccgtccgtagcgccaccctcaaggccttcagcgaatgcaaggaccccgccgtgctcatcaccaccgatatctcctcccgtggtctcgatgtcccggccgtcgaacttgtcatcgagtacgacccggccttcgccgtgcctgaccacgtccaccgtatcggtcgtaccgcccgtgccggtcgcgccggtaaagccgtgctcttcctcctccccgggtccgaagaaggctacatttccatcctgcccaaatcgacccccatcgcaccccagctgtacgattccatcctccaaaagggcttcgccacaaacatcaacgtgcctggcaccgagtccggagtcctcgaaaccgatcgtcaatcttgggcctcccgcgccgaagctcttcaactacacttcgaacagcgtctcctcgctcctctgcccggcgccacgcccgtctttgaatccaaaagcgagaaatttgccgcctccaagcagggcaagaagggcaagaaggacgccaagaaggatgagaacaaaacacctgacaaccctctcctcgtctccgcccgccaagccttccgctcgcacattcgtgcgtacgccacgcacgttcgcgaggagcgcgtctactttgacattaccgcgctgcatctcggtcacatggccaaggcgttcgggttacgcgaggctcccggtggaattggcggcggtgtttccaggaggacgcacaggcccgtgcagccgggtgacaagacaaataagacgagcaagtctgtgggcgatggcaccgctaggaggccgaagaaggatgatgatgatgagagggactttggt

SEQ ID NO: 27167 - DNA, 1804 bp, Neurospora crassa
tttggccgaggtcagcactctttcaccaccgcaatggcggaccaaaaaccccttacctcttcgcctgaagaggccacagaggcgggcaccactaccactaccaccatcccccaagcccaaatccaagacgacgtcgtcctcgtcgaagccaaacacgccgccgacaccgagcacgaaatgaccctcctccgcgccatccagctctaccccaaagccatcggctggtccgtcctactctcttcgaccttgatcatggagggctacgacctcgccctcctggggagcttatacgcctcccccgttttcaacaagaaattcggcgagctcaacccggccacgggcaagtacgccgtctctgctgcttggcagtcgggtctgtccaacggggcaagagccggagagatttttggcttgatctttgctggatgggcggctgatcggatcgggtacaagaagacgacgattgcgagtctggtgttgatgattacctttatttttgtcttgttttttgcgccgaatgtgaaggtgttggtggttggggaggttctttgtggtaagttcacttgcaagcctgtcttcatggatgtaccgactgttccttcgcaagggtcgatagacacaaggcggcttcgggatgtagtatacctgatggaaggtcaacgttgtatgcttgctaatcaccttcgctcggtccgaaccaaaaacaggtatcccctggggtgcctttcagagcgttacacccgcctatgcctccgaggttgcgccgatggtgcttcgcccgtacctgacaaccttcatcaacatgtgctgggtaattggccagttcttcgctgccgccgtcaacaagggctccgtgggccggactgatcagtgggcgtacaggattccctttggcgtgcagtgggtgtggccaattcccatcctcgccgggctcgtctttgctcccgagtcgccttggtggtatgtccgacatgacaggagggaggaggccaagcagtcgctcctccgtttgacttcgaggaatcaacccgggttcaacgtggacgagacgctggctatgattgagcataccaacgagctcgagaagcagatgaaggagggtgtcactttccgcgactgcttcaggggtgttgatcttcgccgtacggagatcgtcgtgggcatttggcttgtccagaccctcggcggccagaacctgatgggttacttctcctacttcctcacgcaagccggcatggacccgagcaactcgttctcgctctccatgggccagtacgccctcggtatggtcggcaccgccgggtcgtggttcctcatgtcacgcgtcggccgtcgacgcatccattttagcggtctctgcgcgcagttctgtctgctcgccatcgtcggctgtctctcctttggcggaaacaaggcctctgtgtgggccatcggcggcgtactcgtcgcgttcacgttcgtctacgactttgctgtcggtccggtgacgtactgtctcatctccgagctgtcgtcaactcgtctaaaggccaagaccatcgtgcttgcccgtgcagcgtacaatgctagtaacatctttgtcaatgtaatgacgaattaccagctgagctcgacggcgtggaattggggcgctaggacggcgttcttctgggcgggcagctgcttgttgtcggctatatgggtgttctttagactgccggagccgaaggggaggacatatgccgagttggatattttgtttgagaagaaggtgacagcgaggaagtttaggaagaccaaagttgatccttttgacttgcgcagt

SEQ ID NO: 27168 - DNA, 1773 bp, Neurospora crassa
tggtggaaagaagctgtcttctaccaagtctacccagccagcttcaaagactccaacaatgacggctggggtgacattcccggcctcatcgccaaaatcgactacctccacgacctaggcgtcgattgcgtgtggctgtctcccatgttcgagtctccccaaaaagacatgggctacgacatctccgattaccaagccgtctactcccgctatggcaccctctccgacgtcgacaacctgatcgccgcctgccacgtccgcggcatgaagctgattcttgacctggtcgtcaaccacacttccgaccaacacccgtggttccaagaatcgcgctcctccaaaaccaatcccaagcgcgactggtacatgtggaagccggcccgctacgacgccaacgggaaccgcataccgcccaccaactggcgcagctactttgccggtcccacctggacctgggacgagctgacccaagagtactacctgcacctgtacgacaactcccaacccgacctgaactgggaaaacgaggagtgtcgcaaggccatctacaacgaggccatgcgtttctggctcgatcgcggtgtcgacggctttcgtatcgacaccgtcaacaagtactccaagcgcactgacttcccggatgcgccggtcaccatgccgggcgagacggaccagcccgccgcggaaatgtggtgcaacggcccgcgcattcacgagttcatccgcgaaatgaacgagcaggtgctggcgccgtacaatgccgtctcggtgggcgagctgtccaacacgccgctgccgagccaggtcctgccgtatgtctctgctgcggccaaggaactggatatggtgtttgagtttagcaccatccgcttgggcacgggcgggccgtttcatggcaagtatctctatagagagtttccgctgtcggagctgaaagcgtatgtggcgacgtggcagcagtggctggagggtacggatgggtggcacacggtgttttgcgagaatcatgataacgggcgggcggtgtcaaggtttggagatgattcgactgtggagtcgtgggaggcgagcgcaaagactattgccttgtggcaggcgacgctgacggggacgattttcttgtatcaggggcaggagattggtatggtcaatatgccgaaggagtggcggattgagcaggagtataaggatgttgagagcttgaacttctacagagaggccaaggcgtttggggatgcagagaggataaggaagacggaggagggtctgaggatcctggcaagagatcactcgaggataccgatgcagtgggatgcatcacccaatgcgggcttcacttctgctggagtgacgccgtggatgagagtgcatgatgggttcaaagatctgaatgtggagaagcaggagggagatgatgagtcgatccttgggttctacaagaagatcctgaagttgaggaaggaatacagcgggctgttcgtgcatggtgcgttcagaccttcactgcaagaggacgagacactgtttgtttacgtcaaggacgatcaaggttcggaagagagtggtgtccaggcagacaagaggaggaaggcgttagtcgtcatgaatttctctgggcagccagctattcttcgggagcataatctcaacgtggcagccacgctgggatgcaaacaaggggaggagcggctgttagtgactactctgaagaagaaggatacgcctagaatggaagctggcgttttggagccatgggaaagcagaatgtatctg

SEQ ID NO: 27169 - DNA, 1356 bp, Neurospora crassa
acgacgaccaccaccgccaccaccaccaccacggctacccccaccgagcccaccaaagctgccgtcgtcgatccctcgagcctttcccgccgtctaaagctctccgcctatgccaccgctcttgctgccgtcctcggtgtcggctactactacgccacagacacgcgcgcctcggtccaccagtacctcgttcctcccctccttcgcaccatcttccccgatgccgaagaagcccaccatgttggaaccgccgccctaaagggtctctatgagactggcctccacattcgcgagagggttcccgagagtccgaacggccccttgtcggtcaatgtgttcggcaagcagctcctcaaccctatcggcatctctgctggtctcgacaaggacgccgaaatccctgatcccctgttcgccctcggtgccggtgtcgtcgaggtgggtggctgcactcctttccctcaggagggcaaccccaagcccagagttttccgcattccctcggtcgacggcctgatcaaccgctatggtctcaactcccgcggcgctgacgccatggctacccgcctgcgcgaacgccttcgcaagttcgcccgctctgtcggcctcaccgataacgaggtgctgaacgaggagggcactgatggcatccctcccggcagtctccaccccggccgtctcttgtgtgttcagatcgccaagaacaagaagacggacgagaaggacgtcaatgcggttattcgcgactacgtctactgtgtcgacaagctcgccccctacgccgatgtccttgtcgtcaacgtcagcagccccaacacccccggcctacgcgacctgcaggctaccgaacctttgaccaagcttctttctgcggttgtggatgcggcccagcaaaccaagaggaagaccaagccgagagtcatggtcaaggtttcacccgatgaggatgatgacacacagatggaaggtgttgtggaggctgtgtggaacagcggtgtcgacggtgttattgtcggcaacaccaccaagcgccggaccggcatcgttcccaagggcgtcaagctgatcgacgacgagcccaagattctccacgaggagggaggcttctctggccctgctctcttcgatcgtactgttaatttgattgggaggtaccgcaagatgctggacggctatgctctcaagtccgagtccgacaagagccctgcgcaaaaggttctgtttgcctctggtggaatcaccaacggtgagcaggccttgagggttctcaatgctggcgctagtgtggccatggtgtacaccgccatggtctatggcggttctggcaccatcaccagaatcaagtccgagatgaag

SEQ ID NO: 27170 - DNA, 1265 bp, Neurospora crassa
gttatcgccgttctttacttcatctctacgccgtcatccgtcgtgacccccctaaaagataactttggcaaattccaacaatccaccggaaactcgaagccatcgactggaagtactaccggaagcactgccggaagtaccaccggaggcaccaccgaagtcgcccacgatgaaaagacacccgctaagagcaatggcgccgactacgatcctgcccagtacccgttggccatgactccgaatgacccgggctggaacgacttgtctggggttaagggcggccctcgcatgaacgcgacctttgtcaccttggctcgcaacggcgatgtgtgggaaattgcaaagtcgatccgctcggtcgaggaccgcttcaaccgccgctacaactacgactgggtcttcctcaacgacaagccatttgacgaaaccttcaagaaggttacctcctcgcttgtgtccggcaagacgtactatggcgagattccgaccgagcactggtcgttcccgcctcacattgaccaggagaaggccaaaaaggttcgcgaggacatgagacagcgcaagatcatttacggtgacagtatcagctaccgccacatgtgccgctttgagtccggcttcttcttccgccagcccctcatgatgaactacgactactactggcgcgttgagccgagcgtcgagttccactgcgacatccactacgatcctttccgcttcatgcacgagaataacaagaagtacagcttcgtgctcagcctttacgagtacttcgagactatcccgaccctctgggacagcgttaccaagttcatcaagaaccaccccgagcacattgctgagggcaactccatggctttcctcagtgacgatggtggcaagacctacaacaagtgccactttgtaagtattttccgtgaggattcacagcttgcgacaagtttagtctaacaatgttattatagtggtccaactttgagattggtagcctcaactggcttcgctccaaggcctacaccgactacttcgagtctctggatcaggatggtggtttcttctatgagcgctggggcgatgccccggtccactctattgccgccggcttgatgttgaagaaggaggaaatccacttcttcaacgacattgcctactaccacgttcccttcactcactgccccaccggagagcagttccgtctcgaccgcaagtgccactgcaaccccaaggagaactttgactggaaggggtattcttgtaagtcttac

SEQ ID NO: 27171 - DNA, 1143 bp, Neurospora crassa
cccattacccacttctccgaggttgagaccgccatggctgagactgtccagaagttcgccaacgatgtcattcttcccaaggtccgcgatatggatgaggccgaggctatggaccccgccattgtcgagcagcttttcgagcagggtattatgggtgtcgagattcccgaggagtacggcggtgccggcatgaacttcaccgccgccattgtttgtattgaggagctcgcccgcatcgacccctcggtatccgtcatggttgacgtccacaacacccttgtcaataccgccgtcattcgctggggtagcgaggcgctcaagaagaagtacctccccaagctggctaccaacaccgtcggttccttctgcttgtccgagcccgtctccggctctgatgctttcgccctcgccacacgcgccgtcgagaccgaaaacggctacaagatcaacggcagcaagatgtggattaccaacagtatggaggccgacttctttattgtcttcgccaatgtcgaccccagcaagggctaccgcggtattaccgccttcatcgtcgagaagggcatgaagggcttcagcatcgccaagaaggagaagaagctcggcatcaaggcctccagcacgtgtgtgctcaactttgacgacgtcgaggtccccaaggagaacattctcggcaaggtcggcgagggctacaagtacgccattggcatcctcaacgagggccgcatcggtatcggcgcccagatgaccggtctcgcgctcggtgcgtgggagaacgcggtcaagtacgtgtggaacgaccgcaagcagttcggccagctcgtcggcgagttccagggcatgcagcaccagatcgcccagtcctacaccgagatcgccgccgcgcgcgcgctcgtctacaatgccgcccgcaagaaggaggccggcgaggatttcgtcatggatgccgctatggccaagctctacgcttcccaggttgccggccgcgtctccggtctcgctgtcgagtggatgggtggcatgggcttcgtccgtgagggtcttgctgaaaagttcttccgtgacagcaagatcggtgccatttacgagggtaccagcaacatccagcttaacactattgccaagactctccagaagcagtac

SEQ ID NO: 27172 - DNA, 3747 bp, Neurospora crassa
aacgacgaagacaaggtccacgacatctccaagaagatcgagcgcgaaaaggctctgatcaatgctgcgcaggccatgcgccagcagacaaacaatgagcaggtccgctccaagctcgacacccagatgcgcgaagggaggaggaatctcgagttcttcgaggagaagctgcgcgaactgcagatgaggagactcggccatggcgtcgacaacatgtcgcttggtgccagcccaatgtccggctcccaccgacagtccgttgatgacttcgagggctacggcgccccctctcctccccccaaggaggacgtacgcggccacagctctcaccagagtcagggcagcggtcctctgatgcccgcctctgctccttatcccggtggtcctcctgactctaatgttccacgggcgcgtcctaattatacaaggctcggtaagttggacatcttccttggaccagtccccctttagacatattctgtgtgactgacgttgagggaactgcagatctaatcaagttcgataccccacatcttggacctcgcatccagctgatgttgtcccaaatccagttcaagctcaacgtggaagaacagtacctaaagggcattgagaagatggtacagctctatcagatggaaggtgataagaagagcaagcttgacgctgccgccaagcgtgtcgaaagtaaacaaaagattgtcctcttgaagcaggcactcaagagatatgaagagttgcacatcgacattgatgttgatggtccagatggtagaattccttcccccacatgctgctttcaccagcactccttttactaactttgaatgtgactatagacgacagcatcaacctgccagcccttaggaaacccctgagcggtactctttctattcgcattctcgctgtaaaggatgtcgaccatgcgcccctcggtcgtttcgctcgctcccccgaaacattcatcgctgttaaggccgaagatatagttgttgcgcgcacaaagccttcgcgaaacgacaagtgggaagccgaattccacactttcccggtcgataagacgaacgaaatcgagtttacggtttatgataagcccgccgagcatcccgtgcctatcgccatgctctgggtcagaatctcggacatcgtcgaggaacttcgccgaaagaagatcgaggccgaaatgacgtccgcaggttgggtttcggcggaccgcgttggctccagagctcctccgccgcaattcccaatgggcgcccagagtcctcagtttgcggcaccgccaacatcccctggatcacaggagcaaaacaccatgatcccaccccaggcgcctccgccatcccaagttgtttcacagcctgtagacggttggttcaacctggagccttatggccagatccacctcagttttaacttcatcaagggggctcgtcctcagggcatggacaggctgggtcgcaagggtgctgtccgccagcgcaaggaggaagttcacgagatgtatggacacaagtttgtccagaagcagttctacaacattatgcgctgtgcgctatgcggcgatttcctcaagtactccgctggtatgcagtgcgaggattgcaagtacacctgccacaccaagtgctacaccagcgttgttaccaagtgcatcagcaagagtaatgccgagactgatcctgacgaggaaaagatcaatcaccgcatcccccatcgcttcattcctttctccaaccttactgccaactggtgctgccactgcggttacatgctaccaattggatccaagaagaactcgaggaagtgttcaggtatgtcgagttcgcccctgttttggagccccatatgctgacaattatgacagaatgtgctcttacagcccacgcgcaatgcgtgcatcttgttcctgacttctgtggcatgtctatggctgtcgccaaccagatcttggagggtatgcgaacgcagaagaagactcataaggataaggcgtcctcgatgagtgagcgtacccttaggccggggagcaaaacttccatctcgtccgggtcgatcgctcaggcatcgacgtatagcggttcgactgcttatacgtcaatcgcttcgcccgaggcaactgaggctgccaagcttatgtacagccagacaacgcccaggccaggcggccccgacaggacctctaccagctcaacaaccgcctcggcggctgcggctgcggctatggcaccaaagcatagctctcagccttcgcaagccggttcgatacccgactttggtggttcccctggctatggacgaccggattctcgggacgacgagtactccgcccagcagcagcagggatatggctcgccgcagcaacggaagtataacccggcggactatgctaatatcgacgcctactcaagcccacaggctcgtccacaacagcaacagcagcagcaacaacagacacctcagcaggtctcaccaatgtatcagcagaatcctcagacgcctattagcaagcctcagcctgtggcgccatcctatgataaccaggtggtaccgtccgcctccggagtgccagttccgaccaagaagccgctaccatcggccactgatcccggcacgggtatgagaatcggtcttgaccatttcaacttcctcgctgtgcttggtaagggtaacttcggcaaggtcatgcttgcggagaccaagaagagccggaagttgtatgccatcaaggtgttgaagaaggagtttatcatcgagaatgacgaagtggaaagcatcaggtcggagaagcgcgtcttcctgattgccaaccgcgagcgtcaccccttcctgacaaacctccatgcctgcttccagactgagacaagagtctacttcgtcatggagtatatcagcggtggtgatttgatgttgcacattcagcgtggaatgtttggcaccaagcgtgctcagtaagttcttctttgtgttttctgaagttactgcagtgactgactcgttccagattctacgccgctgaggtctgcttggcactcaagtacttccacgagaacggcgtcatctatcgtgatctgaagcttgacaacattctcttgactcttgacggacacatcaagattgccgactacggtctgtgcaaggaggacatgtggtacggttcgactacgagcaccttctgcggtactcccgaattcatggcgcccgagattctcctggacaagaagtacggcagggcggtggactggtgggcatttggcgttctgatctaccagatgctactccagcagtccccattccgtggtgaagacgaggacgaaatctacgatgccattctggccgacgagccgctttaccctattcacatgcccagagacagcgtgtcgattctgcagaagctgctcacgcgcgagcctgaccagcgtctgggtagcggcccgaccgacgcccaggagattatgtcgcagcccttcttcaggaacatcaactgggacgacatctatcacaagcgggtgcagccgcccttcctgccccagatcaagagcgcgacggatacgagcaacttcgatagcgagtttacgagtgtcactccggtgctcacacccgttcagtcaggtaagtcttatcacatcagaacccaactaggcaactttctcgtaactaaccccgtccgtttgtatagtcctctctcaagccatgcaagaagagttcagaggcttctcgtacacggccgactttgagtaaacaacc

SEQ ID NO: 27173 - DNA, 1470 bp, Neurospora crassa
atggccgctccgtcaagtaggccagaatcaaacccgcccctctacaagcaagcccttgatttcgccctagatgtcgccaacggtcgccatgctctgtcgaagctcatcccgcccgccctcttcctggtcgatgcgctcctctgcggcctgatcatctggaaagtgccttgtacgtaacaggtaccgtggaatggagtacggttacccgtatgctcacgatcgtaaactacagacaccgaaatcgactgggcggcctatatggagcaagtctcccaaatcctctcgggcgagcgcgactacaccaaggtccgcggcggcaccggtccgctcgtttacccggctgcgcacgtctacatctacaccggactataccacttgacggatgaggggaggaacatcttgcttgcgcaacagctgtttgcgggtctttatatggttacgttggcggttgttatggggtgttactggcaggccaaggtatctttctacaagtggctttgcgacaacgctggatgagagagaagctgacagagtgaaaccccccccccaaaaaaacaggcaccaccatatctattcccgctcctgactctctcgaaacggctacacagcatcttcgtcctgcgctgcttcaacgactgcttcgccgtcctgttcctctggcttgccatcttcttctttcagcggcgcaactggcaagccggcgcattactctacaccctcggcctcggcgtcaaaatgacgctactactctccttaccagccgtaggcattgtcctcttcctcggcagtggcagttttgtcaccactctgcagctcgtagcaacaatgggtctggtccagatcctcatcggcgtccccttcctggcacactaccccacggaatacctctcccgggccttcgagctctcccggcaattcttctttaaatggaccgtcaactggcgcttcgtcggcgaggaaatatttctcagcaaggggttcgcgctcacactgctcgctttgcacgttctcgttttgggaatcttcatcaccacccgttggatcaaacctgcgcgcaagtctcttgttcagctaatctctcctgtcctcttggcgggcaaaccgcctctgactgtccccgagcaccgcgctgcggcgcgggatgtgacgccgaggtacatcatgaccacgatcctgtctgccaatgctgtgggcctcctctttgctaggtccctccactaccagttctatgcctatgtcgcatggtcgactccattcctcctctggcgcgcggggttgcaccctgtcttggtgtacctgctatgggcggtgcatgagtgggcgtggaacgtgttccccagcacgccggcgagctcggcggtggtggtgggcgtattaggcgttacggtcgcaggagtgtggtttggcgcacgggaggagtgggagcccgggatgaagtcgtcatcgaagaaggaggaggcggcgatgcgg

SEQ ID NO: 27174 - DNA, 1027 bp, Neurospora crassa
atgcgcgagagcaatgtcgtgcatgttcgcgcccccgttacggttgtcggtgacatccacggccagttctatgatttgatagagatattcaggatcggtggctactgtccagacacgaattatctatttctaggtgggtggtgatcttggtggtggtgatggaagcaagacgcgggcggcgcgtgccctccatgcgggtgctgtgctaaaatgacgacgtttgactaaccttgggagaaaaacaacaggcgactatgtcgaccgaggcatgttcagcgtcgaaacgatttctcttcttgtttgtttaaaactgagataccccaaccgcgtccatttgattcgaggcaaccacgagtcccgcggcgtaacgcagtcttacggcttttataccgagtgctcgcgcaagtacggcaatgccaatgtctggcattactttaccgacatgttcgatttcctcacattaagtgtggtcatcaacgaccaaatattctgtgtacacggaggtaagataccccctttctgggcgccaggtgtacaagctagttgctaaacctcttcttccgcgccaggtctctccccttcgattcactctatcgaccaaattaaagtaatcgaccgcttccgcgagattccccacgaaggccccatggccgacctagtatggtccgatcccgatcccgaccgcgacgagttcagtttatcaccccgcggcgctggctacactttcggagcgcaggtggttaagaagttcctggcggtgaacaacatgaaccacattctgcgcgcgcaccagctctgtcaggaagggtatcaggtgctatacgacgaccggctgagcacggtatggagcgcgcccaactactgctaccggtgcggaaacatggcaagtgtcttggaggtcagcgatactggagagcgcttcttcaatgtgtttgcggccgctcctgagaacgacgccgttaaggatcagcagatgaatcaggacaagtcggcggaggggggcgcattgccggattactttttgtaa

SEQ ID NO: 27175 - DNA, 476 bp, Neurospora crassa
tacaaggaggcgttctccctgttcgacaagcgcggcaacggccgtgttgccctcgacagcttgggtgacctgctccgcgcttgcggccagaaccccacgctcgccgagatccgcgagctcgagaagaacgttggtggtgattgtgagtaatacccgagcggaaacaagtagttcatctgagattagttactaacagatgcccttctcatccgacagtcgacttcgagaccttccagcgcgtcctcaaccggccaggtggcttccgtgatcccggcgagcccgaagagtactgccgcggtttccaggtgtttgataaggacatgacgggtttcatcggcgttggacagctcaagtacatcttgacaaaccttggcgagaagatgacggacgaggaggtagacgagctcctcaaggccgttgatactagctccggccaggtgaactataccggtatgtcagcctcagcacttgctgtt

SEQ ID NO: 27176 - DNA, 2259 bp, Neurospora crassa
ccaccccagcccccagggctccgaaaccataccccagaaagcgttactgccgccttcgaagcatgggccgacaaacaccgtgctgcgctagatgcgatcgtagccgatgtcaacctgagtgacccgcagactgtcacatttgagaacgtcatgcgcccccaactcgagtttgagaatcaaaagttctcgcacaacttgcgcttttaccagcacgtttctgagaacagcgatttgcgggagaccactcgcaaaatggcaaaatggtacgataacatctggacggacatgaacatgcgcggggacgtcttccgtgcgagagaagtcctgtatcacaaatctggtctcgcggcaagtaggaaacagaattccgctcggtacataaccgaggacattgcaaagaatgcaggttttgaggatgctgagagtgctatcgctctggaggaagagtggaaagaggcaatcaggttaggattgggtttaccgtccaaaccccagcgtgatcgcttcaatcaaattcaaaagcgcgtggaggcaatcaagagcgagttcaagaaccaccacgcttctgataaaggctgcaactggtttacccctgcagagttggatggcatggacaacgatattattgaccagttggcgaagggaacgggcgagaatgaaggcagacttaaggtcaccttcgaccccagtcattacgacatctttctcagagacgtcaagaactcggaggctcgaaagcgcatgtggactgccatggagaacaaagtacgctgtacatggtaagtggttactgatgcttacaaaagcctactgacaatgccccgttagtgcccagaaaacgtcccgctctttaaagaagccatgcttctccgagacgaggctgctcgcctcttgggttacccagatcatgccacattgaggattgaaagccgaatggcgaagacacctagggctgtcaacaacttgctgaatgacttacgaacccgccttgcaccccttgccaccaaagagctcaaccaactactacaaactaagaagaaggactgcgagactcgaaacttgccgtttgatggcagtttctatcactgggactgggctttctacgcctcccaaatttccaagcaagaacatgaccttgacaacaagaaggttgccgaatacttcccgatcgattccgcaatcacaggcatgctccgcctctttggggtgctctttggcatcgttttcgttaggttgaccgcagaggatcttgagcgtatctcccctactggcgtcgccgatgatgtcatgtatcacagggacactatcatgtttagtgtgtggaatgacgaatccgagggtaatgactttctgggatacctttacatcgacgcccatccacgcgagggcaaatacagacacgtagcaaatttccccctggaacttgggcaccagagaacggacggtacgaggttttacccatccacggctattgtttgcaacttccctgcgccaaccaaggacaaaccgtcactccttgaccacgaacatattgttgacctatttcatgaattgggacatgggattcactctctggtttcacgcactcgcttctctcgtcatcacgggacagcaggcaagcgagactttgtcgaagcccctagccagatgcttgaacattggacatggagagccgagtatatcaaacgcatcagcaaacattatttaacaggcgagcagatgtctgacgacatggccgagcggattgcggcaagcagacatttccttcaggcgttgaggaacttgtggcagttatcatccgcgatttttgacatggaggttcattcgcccaaatcacgcgctgcccttgaaaacatggactttaccaagcgatacaacgaattgagaaacgaactaacaggaatgaagggacccgaagctattggtgaaccgatgtaagctctaatgctgtcaacctcattacttccttcgtatcttggtaggtatctgacagttcatggtaggacgcatgggcatggcaatcttcagcatctgttttatgcttacgatgccggattatacagttaccattggtctaacacctactcctacgacatgttttacttcgcctttgctaaagatccgatggataaatctcaaggtcaccgattcagacacacggttctcgaaaagggcgcgtcgcaagacgagatgctcatacttgagcagttcctgggtcgcaaaccaaccaccgatgcgttttgcatggagctggggctg

SEQ ID NO: 27177 - DNA, 1472 bp, Neurospora crassa
atggactcgcaatacgagacaaaaaagaatgacccaaacgccatcatgccgtacccagagtcaaacgatgagcatgttggcgaggtccgcggcttgggcggcggcatcatggacaaggagcctgaggcccaggagggccatgccaagttccaccgtctcggctggaaacgtctgacggtcgtcctcatcgtcgaggccattgccctcggctctctctcgcttcccggcgccttcgctacccttggcatggtgcctggtgttattctctctgtcggcatgggactcatctgcatctacacggctcacgttatcggacaaaccaagctcaagcaccctgaaatcgcccactatgccgacgttggtcgtgtcatgtttggaagatggggatatgaaatcatcagcttcatgtttgttctgcaactgatcttcatcgtcggctcccacgtcctcactggcaccatcatgtggggcaccatcacggataacggcaacggtacctgctctctcgtcttcggcattgtctccgccatcattctcttcctccttgccattcctcccagtttcgccgaggttgccatccttggatacatcgatttcgtctccatctgcgccgccatcctcatcaccatgattgctactggcattcgctcgagccaccaggagggtggtctcgctgctgttccctggtcttgctggcccaaggaggaccttagccttgctgagggcttcattgctgtcagcaacatcgttttcgcctacagcttcgccatgtgccagttcagctttatggatgagatgcacaccccctccgactacaagaagtccatcgttgctctcggcttgattgaaatcttcatctacaccgttactggtggcgtcgtttacgctttcgtcggccccgaggtccagtctcctgccttgctctctgctggccctcttctcgccaaggttgctttcggcattgccctccccgtcatcttcatctctggcagtatcaacactgttgtcgtcagcaggtatctgattgagcgcatctggcccaacaacgtcattcgctatgtcaacaccccagcgggttggatggtttggcttggttttgactttggcattaccctcattgcctgggttattgctgaggccatccctttcttctctgatctgttggccatctgctcggctctcttcatttccggttttagcttctatttccctgccttgatgtatttcaagatcaccaggaacgatgccaagagccagggcaagaagtacttcttggatgccctcaacatgctctgcttcgtcatcggcatgggcattcttggtattggtacctacgccgctattcaggacattgtaagtttggcccgcttttctgtttactctttgcacacaaatgctaacttgcttctcagatggaccgttacgaccatggcaaggtttcgaagccttatagctgtgctcccttggcttaa

SEQ ID NO: 27178 - DNA, 1435 bp, Neurospora crassa
atggatacgaatatggaggatgtcgggcgcgttcccgccgagcttacctcgtccaacttcgagccaaccaccatcccgacactggacggctggattgagagcttgatgaactgcaagcagttggccgagtctgacgtccagagattgtgcgagaaggtcggttccgccatcatttcgcccgccgtgtaataccgcgatcgcgcccgcgccggcaagcttcccgcacatcaaacccccctgccgctgtcgccgccgctgctgctaccgtggggaaggaccgttctgccgagggttgtcggtcgcgtgcgcaccgttgtttggggtctgatgctgacatgacaaattgattttaggcacgcgaagtcctccaagacgaatccaacgttcagccggtggtatgtgtcctgttccttccacatgtcctacccaaactagccaggcgcgctgaccgatgccagaaatgtcccgttaccgtttgcggagatatccacggtcagttccatgacttgatggagctcttcaagatcggaggttcgtgcccggacaccaactatctattcatgggtaagtctccaatctcagcagcttccgccatgccatggctgccgtcgctaatgcgatccgtcccggtgtataggagattatgtcgaccgtggatactactcagttgagaccgtcactctgctcgtcgctctcaagatccgataccccaaccgcatcaccattttgcgcggcaaccacgagtcgcgccagatcacacaagtatacggcttctacgacgaatgcctgcgcaagtatggtaacgccaacgtttggaagtactttaccgatcttttcgactaccttcctctcaccgccctaattgacaaccaaatcttctgcttgcacggcggtctttcccctagcatcgacacgctcgacaacatcagagcgctcgacagaatccaggaggtcccccacgagggccccatgtgcgacctgctgtggtcggatcccgatgaccgttgcggatggggaatctcgccccgtggtgcaggctatacctttggccaggatatctcagaagctttcaaccacaacaacggtctgacactgattgccagagcgcatcagcttgtgatggagggctacaactggtcccaggacaggaatgttgtcaccatattctcgggtaagtggactccttgaacacctatctattttctacccaagacttttctaacctggtcatacagcgcccaactactgctacaggtgcggtaaccaagccgccatcatggaaattgacgaacacctgaaatacacattgtacgtcctatttcctccatgaagccttttcgatgttctgcccagtgacgctaaccaaaacgctagcctgcaattcgacccttgcccgagggctggcgaacctatggtttcgagacgtaagatttca

SEQ ID NO: 27179 - DNA, 765 bp, Neurospora crassa
ctcgctgcgatgcagaaggagaacaacaacaacatctgctgcgactgcggtgccccaagcccgcaatggtgttcaccaaagttcggcatctttatctgcctctcgtgtgcgggcgttcatcgcggcctgggcgtgcacatctccttcgtgcgctcggtttccatggacgccttcaagcaggccgaaattgagcgcatgcggctcggcggcaatgacacctggcgcacctttttcgagaaccattccgacaccaagttgcgcggaatcagctgggacgatgcgacgattgcggagcggtacagcggcgatgttggcgaagaatacaaggagaggctgagtgccaaggttgaggggagggagtacgtgcctggggagaagaagccactggcccagcagcaggaaacaagtcagagtccaagcagcgtggctggtggggtgccattgagcggcacgagcagtaggacggccagccctaagccgggaacgacgatcaaggtggacgacaagtactttgctaaactgggtgctgccaacgccagcagaccggacaatctgccgcctagccagggaggaaagtatcagggctttgggaacacagtgtcgtcgcagccaaagaatgatggcggcgcaagcttgccgggtctcgatgagttgcaaaaggatcccgtggcggcgctgagtaaagggttcggatggtttaccaagacagtgacccagacggcgaagacggttaatgagggttatatccagcctacagctaagcag

SEQ ID NO: 27180 - DNA, 1424 bp, Neurospora crassa
atgttctctcgcttggccgctcgtctccccaaggcttctgccctcaatggcgtcgccgcccgtcaggttcgcaacctgagccagcccgccattaccggcagcaagggcaggaacatgcccgcccgtgagccgcgcactactgccgctgccaccggcgccgaggccaccttcactatcagggtgcgtacctacaactagtcttctctcgtggctaaacctaacattttctcgctcaggatggccccgttttccagggtaccgccttcggtgccaacaccaacatttctggtgaagccgttttcaccacctcccttgttggttaccccgagtcgatgaccgatccctcgtaccgcggccagattttggtcttcacccagcccttgattggcaactacggtgtcccttcgaatgagcgtgacgagttcaacctcctcaagtacttcgagtctccccacatccagtgcgccggtatcgttgtctccgatgtcgctacccagtacagccactggactgctgttcagagcttgggcgagtggtgcgccagcgagggcattcccgccatctccggtgttgacactcgtgcgattgtcacctacctccgtgagcagggttcctctctcgccaggatctccattggcgacgagtacgacgccgatgaggatgagggcttcattgaccctggccagatcaaccttgtcaagcgcgtgtccaccaaggctccctttgtggttaccaaccccaacgccaagttccacgtcgctctgatcgactgcggtgtcaaggagaacatccttcgtagcttggtcagccgtggcgcctccgtcaccgtcttcccctacaattaccccatccacaaggttgccgagaacttcgatggtgtcttcatttccaacggccctggtgatcccacccactgccaggagactgtttacaacctcgccaagcttatggagacttcccctattcccatcatgggtatctgccttggtcaccagcttcttgctctcgctgttggtgccaagaccatcaagctcaagtatggtaaccgtgcccacaacatcccggctcttgacttgaccactggtcagtgccacatcacctcgcagaaccacggttacgccgtcgatatcagcaccctccctagcgacttcaaggagtatttcgtcaaccttaacgacggctccaacgagggtatgatgcacaagacccgccccatcttctctacccagttccaccccgaggctaagggtggtcccatggactcttcctacctctttgacaagtacatggagaatgtcgagcttttcaagagcaactcccaggtctaccgtgacaacaggcctactcagttcatgattgacattctcagcaaggagcgtgtcggcgttgagcccactcctctttctaacgctgcttaagcgacg

SEQ ID NO: 27181 - DNA, 768 bp, Neurospora crassa
gacatggatatcatcaacgtcgacttcgagctgttcaattacgacaaggacatcgacttccacggcgtcaaaacgcttcttcgtcagctcttcgacgctgacgcccagctcttcgacctgtccgggctcagcgacatgatcatcgagcagaacaccatcggctcgacgtgtaaggtggacgacaaggccaacgacgcctacgccttcctgaccgtgctcaacgcgtgggagcaccgcgagaagaaaccggtcgcgcagctgattgagtacctgtccgacaaggccgtcaaggccggtgattccagcctgtctgtgctgcctgagttgttcacctccggcaaggcccaagtgggcatcgtcctgtcggagcgcctcatcaacatgccggccgaagtcatcccgcccatgtggaacatgatgatcgaggagatccaggacgccgtggacgacaaagagccatacgagtttacgcactacctggtggtgtcgcgcgcgtacgtcgaggtcgagtcgagcttggaccaggaggagcagaagcgcaagcggctacgcgatgagaagggcctgcagtacttccaccctgaggacgaagagatgcgcaagcatgctgtcggtgcgggcacctacacttttaccaaggagggagactcagccgacagcaagcgtgcgttccaagagctgggcgtcaagtcacagggtttcatgatgcttattgaggcgggcaggttcaagcaggctgtcaaagctatcggggattgcattggcgcg

SEQ ID NO: 27182 - DNA, 2757 bp, Neurospora crassa
caagatgtcgatggaaagacccccgcaaacggaaagaaggaggaggaacagaatggtgggtttctcggccactccgaccgacttgaggtatcggcgccgggcttctgctgacagcgctttgcgttagcttccgaggaactcagtgaagaggatcagcagctcaagagcgagcttgagatgctcgttgagcggctaacggttggtgcttcgcaatgacgtgatacaggctgaagaccggcttctctaacagtacaatgtcttcaggaatccgatgcgaccctctacaagccggccctcgaggccatgaagaactctatcaagacatccacatcctccatgacggcggtaccgaagccgctcaagttcctgcgcccgcattatgaaaccatgacgaaactctacgacgagtggcccgctggcgatgataagtcatctctcgcagatgttctatcggtgatcggtatgacatactcggacgaggaccgccaggatactctgaaatacagacttctttccccaacacaggacattggctcgtggggtcatgagtacgttcgccatctcgccctcgagattggcgaggtctacgccaagcgcatagccaatgatgagccgactcaagagctggtcgatcttgccctggttctggtgccgctcttcctcaagagcaacgctgaagccgatgccgtcgatctgatgagtgagctcgagatcatcgaggagcttcccaagtttctcgacgagaacacctattcgagagtctgcctgtacatggtctccatggtcaacctcctaacctatcctgacaacgagacgttccttcgcgtggcgcacagcatctacaagaaatacaaccagcacacccaagccatggtgcttgcgattagactcaacgatcttggactcatcgagaaagatttcgaggcggcggacgaggatcctgcgcttcgcaagcagctcgctttccttatcgcgcgccagggcattccattggagtttgaaaggagcaatgatgacgacgaaaagatctacgagtgcctttccaaccagaagctgtcggagtatttcaagtcgctcgggaaggaactcaacatcttggagccaaaaacgactgaggatatttacaagagccacctcgaaagcagccgtgttgctggtatgaccaactttgattctgcccgacacaatcttgccgccggcttcgtcaacgcttttgtcaatgccggctttgggagtgacaagatgatgctcgttggtaaagacaaggacagctgggtgtggaagaccaaggatgagggtatgatgtctacagtggcgtcgctgggaaccctgctcctttgggacgtcgagaacggtcttgaccacgtcgacaagtatacttatctcgaggaggagcaaatccaagctggcgcatacctcgcgatcggtatcatgaatactaacgttaggacggactccgagcccgcgatggccctgttggctgatcccgacaagcttgcgcacaagaacccgctcatccgcgtagctaccattatgggtctcggactggcatacgcagggtcctgcaaggaggagcttctctcgttcttggtcaacattatcagcgaccctgaggagagcatgcaggtgtcggctatggctgccctggcctgcggtatgatctttgtcggctcctccaattccgaagtcagcgaggccatcgtgactaccttgttggacgaagaaagtggaagccgcctcaatgacaaatggtccaggttccttgcgcttggcttgggtctcctctattttggtcgccaggaacaggtggacgttattcttgagacgttgaaggcggttgagcaccctatggcgaagccaactgctgttcttgctgagatttgcgcctgggctggcaccggtgccgtcctcaagattcaggagctccttcacatttgcaacgagcacattgaggatggagaggagaagaagggcgaggagttgcttcaggcctatgccgttctgggtattggcttgattgccatgggcgaagatgttggacaggaaatggttctccgccattttggtcaccttatgcactacggcgaagctaacatccgacgagcggtgccgctggctatgggtcttatcagccccagcaaccctcaaatgaaggtttacgacactctgtcacggtacagccacgacaatgacaatgaagtggccatcaacgccatttttgctatgggtctcctgggtgccggtacgaacaacgctagacttgcccagctgctccgtcagctggctagctactatcacagagatcaggagtctttgttcatggtccgtatcgcacaaggtctcttgcacatgggcaagggcactctttccgtcagccccttccacacagatcgtcaagtgctttcaaacgtggcgacggctggtctcctcgctgtcttggtcgccatgattgatgccaagcagtttattacatcgaagtctcactatctcctctactggattgtgacagcaatgcaccctcgcatgcttgttaccctggatgaggacttgaaacctttgacagtgaacgttcgtgttggtcaggctgttgatgtggtgggtcaggctggtcgccccaagaccatcactggctggcagacccagagcacaccggtactgctgggctatggtgagcgtgctgagcttgaggatgaccaatacatcagccttagcagcacccttgagggtctcgtcattcttcgcaaggtacgtgcagat

SEQ ID NO: 27183 - DNA, 775 bp, Neurospora crassa
cacgatgaggaacagatccgcttgatggacgaggtctgcattgtcaccgaccagaacgaccttcccattggtactgccagcaagaagctctgtaagtgcctgcctgaggaggaacaagaaatcccatcgacactgtccgctgaccgacactactactcctacaggccatcttatgaccaacatcgataagggtcttcttcacagagccttctctgtcttcctcttcaatgacaagaacgagcttctcctccagcagcgcgccaccgaaaagatcaccttccccgacatgtggaccaacacctgctgctcgcatcctctgaaccttgccaacgagactggatcgacccttcccgatgctatcgctggtgtcaagaacgctgccaggaggaaattggaccatgagctgggcatcaagcaggagcaggtcccctttgaagatttccgtttccttacccgtatccactacaaggctcctagcgacggaaagtggggtgagcacgagagtaagtactgcacaacagcgaggttgggggagtgatagtttgctgacagatataccctagttgattacattctgttcatcaaggccaaccccgaggtcaacgccaacctaaacgaagtccaggccacacagtgggtttctgccgagaagctcaaggagatgttcaaggacccctccctcaagtttaccccctggttcaagctcatctgcgagtctatgctctttgagtggtgggcttcccttgacaacgggcttgaaaagtataccgacgag

SEQ ID NO: 27184 - DNA, 756 bp, Neurospora crassa
tctctcgtccaacaacagtacgccgacgagtccctccgccccgtaaccataaaacagcttctcgattgggaagagaccttccccggcgccgagcttgccatcgacggccacccagtaacccaagtgaccattgtgggccaagtgcgctcggtcaagccgcaaccgactaacatcacgtaccggattgatgacggcacgggagccatcgacgtcaagaagtgggtcgattcggaagcgcaaggcggcgaggacggtggcagcggtgccggcacgatcgcgcccgacgccttcgtgcgcgtgtggggccgtctcaagtctctcggcggcaagaaacacgtaagcgccaacttcatacgccagattgaggatttcaacgaggtcaactaccacctgcttgaggcgacgtatgtgcatctgttctttaccaagggagctcctggtagtggtggtggtgccaaacaagaaggtggcggaggggacaacatgtttgtggatcagggatacggagcaggaggcggcgatgttgctatgggcggcgctggccccggtggaggaaacagtgcgatgcaggcgagattggcgacgtgctcaaggaacgcgcagatcatgtgcaatttcatcaataactcgcctggcgggacggagggtgtcaatttgcatgtgattgcgcagggcacaagaatgtcggttagagatatcacaaatgcggcggatgagttgctggggcagggtattatttacactacgcaggatgat

SEQ ID NO: 27185 - DNA, 2670 bp, Neurospora crassa
aatggcgagggcgatgatgacgaagcctttatcgcttcgctcacacggagctcgcagagaaagtcctccaacattcagggcaaatcagtcaagaagggtggaggtttccaggcaatgggtgcgtagtcttccgtcccatggcataagttgatgatgcttggggcagctgctgatactctcctaggtctaaacgcccatctcctccgagcgattaccagaaaaggcttctccgtcccgacccccattcagcgcaaagcgatccccctgattttagaaagaaaagatgtggtcggcatggccagaaccggttccggaaagactgcagctttcgttatccccatgattgagaggttgaaggggcacagtccacgtgttggctcgagggcgctcatcatgtctccctcgcgtgaacttgcgttgcagaccctcaaggtcgtcaaggaactcggcagaggtaccgatctaaagaccgtattgctcgtcggtggtgacagcctagaagaacagtttggtatgatggcgtcgaatcccgatattatcatcgccacacccggtcgtttcctccatctcaaggttgaaatgaacctctctttggcctccatcaaatacgttgtcttcgatgaagctgatcgcctcttcgaaatgggtttcgctactgagttgaccgaaattcttcacgccctccctccttccagacagacgcttcttttctctgcgacgctcccatcgtccttggtcgaattcgccagagccggtcttcaagagccaagccttgtcaggttggatgccgaaaccaaggtgtcacccgacctcgagagtgctttcttcgcagtaaagggaggtgagaaggagggtgcccttctccatcttctccacgacgtcatcaaggtcccgctgggtccgcccgagggcacaaaggaagagagtgacgaattgcaggcgaggaaaaggaaacgcgagtacaggcccaatcctaaggagaagccgacggaatactcgaccatcatcttcacagcaacgaaacatcacgtcgagtacattgcgaacctgttgaaactcgcaggctttgccgtgtcctacgtttacggttcgcttgaccagacggcccgtttgatccaagttgacaacttccgtcggggaagaacacatattctcgtggttaccgatgtcgccgcccgtggtattgatatgcctgctctcgccaacgtcatcaactacgatttcccatctcagcccaagatctttgtccatcgtgttggtcgtacagctcgtgcgggtcagcgtggttgggcctatggtttggtccgtcagtcagacgtaccatatctacttgatctacagctcttcctgggaaggaaacttattatcggccacgatcagaagaacccttccttcgcggcagacgtcgtagttggaacactaaagagagatggagtggatgttaacattgagtgggttgagaaggcgctcaaggagagtgccgatctcaaggcgctgaagggtgttgccgcaaaggccgagaagctctacatgaagacgaggaattctgcgtcgagccagagcgcaaagagagcccgcgaagttacgcagtccaggggctggacacagctccatcctttgtttggagaagaagccgctgaagcccaggcagctcgcgatgatcttctcagcaggataaaccgcttcaagccccaggaaaccatctttgaacttggccctaagggcaagtctagccgcaataaggccgcggaagttgtacgaaacatgcgttccagattcaaggagcgcaagactaccaacgacgaggatgatgaggacgtggacatggaagatgccgagggtaaacctgacggcgaggagaccaatgcgttcgaagactttgaggatgaggaagaggagggagaggcggaagaggcagaagaggcggaagccaaggaagacccatacgccgacgactcggattcggagatggaggttacagtatccagcagcatgcatacgaagaagaagggtggcccggtcaacttccaagaccccgagatcttcatgtcctacacgcctcgcaccactagccttgcggaggagaaggcttacggtgttcactcgggcggctacagcggcaacagcttcgtcgaggccgctcgcgacgctaccatggacctgaccaacgacgagagtgccaagaacttcggtctgcccacgaaatccaagatgcgttgggacaagcgtcacagcaagtacgtggcggtcgccaacgatgaggacggctccaagggcgccaagatgattcgtggcgagtccggtgtcaagattgccgcctcgttcaagagcggccgcttcgaccggtggcgcaaggataaccgtctcggcaagttgcccacgattggcgagacggagaagtcgcagctcatccgcaacttcggagcccaacctggccaaccgcggtacaagcacaagatggagaaggcgcccaaggatgcggacaagttcagagacgattaccacgtccgcaagaagcgtgttgctgaagccaaggagaagagaatcggcaagtacaaggatggtgagggtagcaagagggagctcaagactgccacggatatccgcaaggcaagagcggtcgcggagaagaagcgcgagaagaatgctaggccggcgaagaggcagaag

SEQ ID NO: 27186 - DNA, 2802 bp, Neurospora crassa
tttctgctttcgtcgacgacattttccccggcgctttttctatcccaggtccatgcgactgacagtaccgaagcgttactcaacggattggaagtgttgaaccagtcgatcgaccaaaaatcggcatccctcaaggttctcgtcgagtcaaatttcgaacgcttcgtcagggcaaaggctacaatcgacaatgtttacaaggagatgaagtatcgcggggctgagccagcagctccccgtgccagggctcactcaaggcacgctagtcggaatagttttcagagtaccagtgccgctggtggcctggcaaactccctgggcccgacgattgaccctcgaaagaagaatgcgttgatccgggagagtgagtacggtgtcatgggcgtaaaggctcccttgctcgatgtttctgccaaggctgaggatttctggggacccgcattgggcggacgtgagaaggaggaacacttaaagacagtgggatcctctcttgacacctacaaagactatgtcgagatcagtgctgcattggccgagagtattaaacggaaagatcacgagagtttggttgaggagtataacagggccagacgattcgctgatgaagcgaagcagatcgcccagaatatcgggtcaggcgaacccactgaggcacaactgtacaagatcctccttgcagcacgaatgtggcatgatgtcgacgagcagatacagttgttcaggagagaagtgtggcgaagactcgtgtcccctcaggcaatggccaagtcggacgcaacaccaggacaagcgcatgatcagcatatggacctgataacgcttctcctggaactaggtgttgaggagaaccccatctgggcatggttacagagccgagttgcgtatctgaaaagtagaattcaatcgacagccgagaagtcaaaggtcgaaatcgaagtgctgcgacggcgtctagcaaatgttgagaagcctagccctcagtcaatagcgtcaaatctgagaggactcggcaggcagtccatcgaaagcaaaacaccgacttttgactcggccgaggttctggatgtttgggagacgatagtggctttcatgaacaacctcatgtcgcctcagggcattttgggtgaagtcgttgaattctggcaaacagtacaaggcttcatggacggcaatactcagagaactctccctcttggctacaagggggaatcgcagggacatcatagactcacccagcagagctcccaggaactgcagagggccacggtcgagctggttgacatgatcagggagcatgttctgtccttctttaccggccctccaccggaagacctctctgcgcttgtgtctcctttaccgtcaacaccgaacacaccgaacccatccacaacaccagggtcagccattcagaccactaccctacgggttcctatcaatctcgacccgaataaccttccgcccccatcaccgaagcgaggagaagcctgggagaagtttgcgttctggccaccgtggtccaactcaatcagcggagcccactacctcgcaaaaatgctcactcttgtcggatctggggcttctgatatggcctctcttgctccggtcggcaagggtgacccttcagagctggagcaactgagaagtctcgtgaacgcaaccagggagagatgtgtaactgctctttgcgccgcatggaacagagattccgagaacatcaaatatgtggaggactggaacaggtcaccgacccggaaggatgtgacaaagatgcccgccagctttgccgcatttgagagggctttgctaagcggaatgcaaaagatcctatatgtttccgaagccatgactaagcccggggccgaggatattgtcctaccgcctgcgacgaaactgctacaaatggtgcggagtcagtacgtcaccacgctctacaaagccctccatggcatggtagaaaacgcagagctacccatcaagaagcctgacgatgactggacgacggatgccaatgattttgttcttgtcaataacccctctaggctgcgggtatcaacaatcgggggcgccaccattgacgccggcgatagtgtaagcggttccaatcccctacttgatactccatcctcggcacagattgctaacgaccatccctagaatgtccgcatgcttctcaccctcagcaacctccaagctctccgctccgaagttgtcccgaacctcaacacccaattcgagaacgccttctccgttaagctcactgacgaaaccaagaccatccgggacgtcctcggtcagatcgacgcccgcctcttccaatcctacacccgcccctcgatcgagtccctacgtcgcatcatccgcgccggcgtgaccgcctctgactggcctcccccctcgggccagaagccgcgcgaggtgaagccctacatctacgaagccctgctcgacctcgtgctcgtgcacacgcaggtttccacgacggccgcctccttgaccagccaggtgctctctttcttgcttgagcagacgtcgcgcgagctgcttgaggcgttcaaaacccgcgcccgctacgacctgggcatgctcatgcaggccacgcttgacgtcgagtttgtcgcccagacgctcaaccactacaccaccgaccgcgcctcggagctccaaagtgccgtgtaccaggagctggatagccggacggacaatgatgcgaggacgcggttgcaggctgagttgcctgagatgcgggctgtcttgaagcgcttgagggaggcaagcaagagcgagtttgcgtgctttaggaag

SEQ ID NO: 27187 - DNA, 1135 bp, Neurospora crassa
ggcaagtacactgtctccttgatcgagggtgatggcattggtcccgagatcgccgttgccgtcaaggacatcttcgctgccgctcaggttcgttcaacacctccgcctgcctgtctactatatgggcatcgacgcgtggtctgctgacacttgaaactagacgcccattaactgggagcctatcaacgtcgaccccatcctcaaggatggcaagaccgctattcctgatgccgccattgagagcatcaggcgcaacaagattgccctcaagggtcccctcgccgtatgttggcctcctggcttccgaatcgcaaagacgacagccgtactgaactctgtctagactcccattggcaagggccacgtttccctcaacctgaccctccgcaggaccttcaaccttttcgccaacctgcgcccttgccgctccgttgccggcttcaagaccccctacgatggcgtcgacaccgtccttatccgtgaaaacaccgagggcgagtactctggcattgagcacgtcgttgtcgatggtgtcgtccagtccatcaagctcatcacccgcgaggcttccgagcgtgtcctccgctacgctttcgagcaggcccgcgctatcaaccgcaagaaggtccgcgttgtccacaaggccaccattatgaagatgtccgacggtcttttcctcaacaccgcccgcgaggttgcccaggacttccccgatatcgagttcgatgccgagcttctcgacaacacctgcctcaagatgaccaccgaccccactccctacaacgacaaggttctcgtcatgcccaacctttacggtgacattctctccgacatgtgcgccggtctcattggtggtctcggtctcaccccctccggcaacatcggtgatgagtgctctatcttcgaagccgtccacggctccgcccccgatattgctggcaagggtcttgccaaccccaccgctctccttctctcctccatgatgatgctccgtcacatgggtctcaacgagtacgccgacaagattgagaaggctgctttcgacacccttgctgaaggcaaggttctgactggtgatcttggtggcaaggcctccaccaaggatttcacttctgctattatcgacaggctatga

SEQ ID NO: 27188 - DNA, 1689 bp, Neurospora crassa
atgcatatccgggagatgcttgccgatgccgaaaggacgaaggccccgtccttctccttcgagtatttcccgcccaagacggcacagggtgtccagaacctctacgaccgcatggaccgcatgtacaactttggtcccaagttcattgacatcacatggggcgccggtggtcgtattgccgaacttacctgcgaaatggttgcccaggcccaggcttacctcggcctcgagacgtgtatgcatctcacctgcaccgacatgggtgaggagaaggtgaacaacgctctgcaaagggcctacaaggccggttgcaccaacatcttggcattgcgaggtgatcctccccgtgagaaggagaggtgggaggctgctgagggcggtttccagtacgctcgggatttggtcgcccatattcgtaagctgtacggcgaccacttcgacattggtgttgctggctatcccgagggttgcgatgacaacaaggatgaggagtctctgctcgatcacctgaaggagaaagtcgacatgggcgcgtccttcattgtcactcagatgttctacgacgttgacaacttcctgcgctgggtcaagcgggttagggagagggggatcacaattcctattattcctggcatcatgcccatcgccacctacgccagtttcattcgccgcgcgaaccacatgaactgcaagattcccgaggaatggatggcgaagctcgagcccgtcaagaacgatgatgtggctgtccgtgagattggcaagactcttgttgccgaaatgtgccgcaagattgtcgacgcgggtatccgccacttgcatttctacaccatgaacctcgcccaggctacgcgtatggttcttgaggagcttgactggttgccttctcccaaccggccgctcaagcgcgctcttccctggaagcagtctttgggttctgggagaagggatgaggatgtgcgccccatcttctggcgcaaccgcaacaaatcctacatcacccgcacccaagactgggacgagtttcctaacggccgctggggtgattcgagatctcctgccttcggtgagcttgatgcctatggtattggcttgacgggttctaatgagctgaaccgcaagaagtggggcgagcctcaaaccgtcaaggacatcgccaacctcttcgtgcgctatcttaaccaggagctcgaatacctgccatggagcgaggcccctatctcgagcgaagctgagctgatcaaggatgacctcattgctctcaacaaccgtggcttgatcaccatcaactcccagccggctgtcaatggcgtcaagtcgacacaccccgtccatggctggggtcccgcgaatggttatgtctatcaaaaggcttatctggaactcttggtctctccagaactcttccccgaaatcaagcgccggatcgaggaccaccccgacatcacctactatgccgtaaccaagtccggtaacctccacaccaatgcgccatccgaaggacccaatgcagttacatggggtgttttcccaggcaaggagatcgtacagcccaccatcgttgagagcatcagcttccttgcctggaaggatgaggccttccaactgggtcttgagtgggcccgctgctacgacgccgatacccccagtcgcctcctgattgaggagatcatggacaagtggtatttg

SEQ ID NO: 27189 - DNA, 3592 bp, Neurospora crassa
ggaaaccgatggcatctcgattgcttccgttgtaacacatgcaacacgctccttgattcggatgcgaatctccttctgcttggagacgggtcgctgatttgcaacaactgcacatacagctgtagtgcttgcggtaataagattgaggacttggccatcctgaccggagaccaggccttttgcgcaacatgcttccgctgtaggaattgcaagagaaagatcgaaaacctgcgctacgccaggacggctcatgggatattttgcatgaattgccacgagagtctaatggcacgaagacgcaagaaagcaaaagcagcggctcaagcaaaagctcgagacaccgacaaatcccttcctgcgctaccgccaaacgctgtacccccttccagcacaggtttcgcagccgaaaagcttgcggcggactctgatacccctaccgaactatcaccacgaccgcgaaatgcttatggacggcaggactcatcgtcgcggagcagttcgagacctgaccgctcccccgaaagattggcggaaacgaacaaggaaacggtgctggccccgccagcgccaaactatagacacaaccgcaattcaaccatgttttctgctgatctcagcgggggggatgctgaggacttcttcattcccgtcgcgcttgaccagagtcccgcgccgtccatcacgcctcagtccacggcagacacaatttcagacacgagccgtaaaaacaaagattattttggctcggccaggtcaaacgctgtccagccagacaagaaggaatcgacggcgccaacaccccacattgcattgatggcgcagatggcccaagagaggcagccgtcgtctgactatgaaagtcctcaacaggagcggctcccaccccggaagctctctcgagcggccgatgtgattggtaacacaaaaccggcccatatcgctagcatcttggccgaagtctacaatcagcagcccaacaacgaggacttcaagctgcagaatgtacccaaaagcaagaggcttgtgggtaaccggagcgaatctcaagcaagcaacagcatcgagaatggaactacgccacggaacaaggagagtcctgagccccctttaactatgagtccagacaggatcatgacccctaggtcctctcaggattctcgtcctagggatcccatgagcgatgagatacggccgtccagcgactctgtaacctcgcgctcagaagtctcgaacgctgggcgatccattccacggaaagaggtcccgcctcctgtatccagaaactgtacgtccccgttccagtcctgcgtgattgtatcagctctgtttactgacgtattgcaagtagccgatggcaaacctctgccggttcctgggtcgaacagttccgagggtcctgctctcccgatccgtcccccgccgcctgaggcgaagcttagtaacacgtatatgcaacctcgcgcaccgcctttgcctcccactcaggcccagacccccaaaaaccagtcgacaacaagtggtgaagtccaggagctgaaaccatcccccaagctacctaggtggagctctggggtcgagttcagcatggatgaggatatggccaggatattgggaacagatgagggctcatcgtcaatcctccgccgggtctcaaacgcagtacgacatggacggaacagcagtggtgaaacaggcgctactcctggcaggatttctcacagtaggagcgtgagcgaaaccactcgaggaactacttcgccccgttggccgagaactccgattgttgaggactactccgccggtaatatcaacgatataacgagtccgttgtctttggctagtacgacacaggatgatccagcctatctgaagcggcaactcagaagctccgagcagcgggtggcagagctggagcgacagttcaacacggaaaaggatcttaagagtcttaacaagaagttgatcgagaagaggaagacagtttcggtgcttgatactcagactgagatcatgatcaggcagcttgaggtcttggccgggtatgttgagcgtgcaaagaagactaacgagtcgtttgacgctcgcgagttggaggagtccgcaatcaaggagtttgtccaaaagctagaacgtctcaagcacaacatgacctctgcgatcgagcaactcatcgcggagagagacgatttggtggaggagaaaaaccaagccattgccgaccgcgatcgcgctctgctcgagtttgagcagctgtcttccaagaacgctcagttggccgatatgaacaatgatctcactcaccagattcaggagagattcaagcagcagatcaataacggcgagctcaagtcacccaatggtttgggtatttacggccacaccaagggtgcttcactcaacatggacgccgcgagcttacagacagctacgactatggttggtcctgatatggaagatcagcttgtggaaggccctaccgtggtgaacatccgcaagggccaggtcaagaagttcaactggaagaagggctccagcaaggtggcgcacaatatctcgaagggtatccgtggtgcagcaggcgcattccaaggacaggaaggaacccagaggcagcagcagcagcagcagcagcagcagcagcagggctccttgaacggagacaacattggtcttccttatgccatgacagttgcccaggttgaggctccggtcactgtcgttcccccaccagccaacaccatcaaacctgtgatggttgataacgcgcggcaaggtggaggaggtggtggtggagggtttggtttcttcggtggcaaaaagccgaacgcgcagcaaaagtcgatgtcggtgaccaatatctctacccctgcggttgcagaagcccccactactctcttcggttccgacctgattgagcggactgaacatgaacgccgtcagataccaagcgtggtcacgcgctgtatcgaggaggttgagcttcgtggtatggatgtcgagggaatctacaggaaaaccggaggcaactctcaaatcaagatgattcaagagggctttgagaagcagcaagatttcgacatttccgacccggagatcgatattactgctgtgacgagtgtccttaaacagtacttccgcaagctccccaaccccttgctgacgttcgaggtgtatgaaagggtcttggagtccaatagtaagtccatccccaattgacgggtgtagacggatgctcaccagctttttccacagatattcaagacgtagaggagaaatgcgctcacctgaagaaaacggtcaacatgcttccaccaaagcaccgcgactgtctcgagttcctcatgtttcatcttgctcgagtagcgagcagagaacgcgagaatttggtaagtctgccgttccaatggtctcttttccctgtactcgggaaattcggctgactggctctcatcagatgtcacccaaaaacttggctgtggtgtttgcgcccaccatcatgagagatcacagtctcgagaaagaaatgacagacatgcacgccaagaacaatgccgtgcagttcctgatcgagaacagtgcgctcatctttgag

SEQ ID NO: 27190 - DNA, 3697 bp, Neurospora crassa
ggcttcaagtcgtacgccgttagaacggtgatttcgggatggtaagggcacaaatccatcagggcgatggaaggcatcctcccaactgcataactaaccggccgtcacagggatgagagcttcaactccattaccggcctcaacggcagcggtaaatccaacatcctcgacgccatctgcttcgtcctcggtattaccaacatgtcaacagtccgcgctcaaaacctgcaggatcttatctacaaacgaggccaagctggtgtcacgaaggctagcgttaccatagtgttcgacaatagagacaagaaaaagtcaccaatcggattcgaagagtatgcgaccatcagcgttacccgccaaatcgtgctcggaggcacctcaaaatacctgatcaacggtcatcgtgcgcagcaacaaaccgtacagaacctcttccaatcggttcagctcaatatcaacaaccccaacttcctcatcatgcagggccgcatcacaaaagttttgaatatgaaggccgttgaaatcctggccatgatcgaggaggcagctggcacaaggatgttcgaggacaggagggacaaagcactcaagacgatggccaagaaggagatgaagttacaggagatcaaagaactcttgcgggatgagatcgaaccgaaactggagaagctacgaaccgaaaagcgcgcattcctcgactttcagcaaacacaaaacgacctggagcgattgacaaggctcgtggtggcgcacgattacgtaaggtgtcaggagaagctacaacagtcagcatcggatcttgaggcgaagaagcagcgccagaaagaacttgaggaatctgctatccggctgaaaaatgagatatcccatctggaggaggacttacaacgggttaaggcacagcgcgacaaggaattacgaaaaggtggcaaggctcaagccctggaagaagcagtgaagaagcacgccaacgagctggtaaggcttgctactgttgtggatttgaagaagagcagtatgaaggaggagcaggaacggaggaaagctggagagaagaacgttgcggacctggaagcggcgctgaaggagaagacgaagacgtacgagaagatcaaggcgaaatacgatgccgccaaggagacgcttgaaaagcagaggcaagaagcagacaccaaggaagagctgctacaaaccctgcaaactggtgttgcgtccaaggagggacaggagaacggttaccaaggacaactacaagacgcgagaaacagggccacggctgcggcaactgaacaagagcaggcaaagatcaaaatcgcccatctggagaagcgaatcaaaggggaagaaccccgggccaggaaggccaaagagcaaaacgccggcttgctgaaggatctcgatggcctgaaagcccaggctcagaggcttgagaaggagcttggaaggcttgggttccaacccgggacggaggaagaaatgtataagcaggaaagctcgctccagcagactatccgcaatctcaggcaagaagccgatgcgcttaaacgcaaggtggcaaatatcgacttcaactacgccgatccagtcccaaactttgatcgatcaaaagtgaaagggctagtcgcgcaactcttttcattacccaaagagtatatggaagctggaacagcgctggagatctgcgctggaggccgtctttacaacgtggttgttgacaccgaagtcactggcacacaactactgcaaggcggtagattgcgaaagagggttaccatcattcccttgaacaagatctctgctttcaaggcttctgcacaaacgattgccaatgcgcaacgaatcgctccaggaaaagtgcacctggctttgtccctagttgggtacgacgatgaagtgtcagcggcaatggactatgtctttggaaatacgctcatttgcgctgatgcagacacagccaagagagtgacgttcgatccaaatgtccgcatgaggagcatcacagtggagggtgattcgtacgatccatctggtacactatcgggtggaagtgcccccaactcgagcggcgttttggttactttgcagaagctcaatgaaatcaatcggcagctgaaggaagcagagaccgccctcaatgagctacgcggccaaatttaccgggaaaaaacgaaacttgaccaagcaaagagaatcaagcaagaacttgacctcaaagcccatgagatcaagctagcggaggagcaaattggcggcaactcatcatcatcgatcatccaagagattgcaaatatgaaggaaacaatagtccaactcaagcagtcgatcatggaggccaagcagcgacaggcagaagccaccgccgaagccaaaagaatcgaaaaggacatgaaggactttgacaataataaagacgctaagcttgtggagctgcaagcttcagtcgacaagctacgtgcgtccctggacaagatgtctgttacaaacaaggcgttgcaaaaagagcttcaggaggcgcaactggactccgagcaggttgctgcggatctcgcagctgcgcgggagcaggttcaagatatcgacgttgctctcaaagcccagcaggaggagatcgacgacatagtgaagcaaggaacagtccttcaagagacccacgacgccgtcctagcacagctggaagacgaacggaccaaactgcatgtgtatgacgacgagctccgggctttggaagatgctaccagatccaagaatgctcgaatcgccgaggaggggcttgaaatgcagaagctcggtcaccagatcgagaagttccacaaggagcagcagcaagccgcgcagacagcctcacacatggagcgcgagcacgactggatcgccgagaccaaggaccagtttggccggcccggaacgctctacgacttcaagggccagaacattgccgagtgcaagtccacgctgcggaacctgacggagcgtagccagggcctgcgcaaaaagatcaacccaaaggtgatgaacatgatcgacagcgtggagaagaaggaggtgtcgctcaagcacatgatgcgcaccgtcatccgcgacaagcgcaagatcgaggaaaccattcttagtctggacgactacaagaagaaggcgctgcaggagacgtgggagaaggtcaatgccgactttggacagatctttgccgagctgttgccgggcagtttcgccaagttggatcctcccgaaggcaagaccatcagcgagggcttggaagttaaggtgcagcttggtaaagtgtggaagcagagccttaccgagttgagtggtggtcaaaggtaaatttttgtttttcaaaatctttttttcttcttctttttctttctaccgcctcccccaattcaactcacctcagcccgtcctttcatccaaaaatctcccatcaagcctactaactttgtcgtcgtccagatccctaattgccctctccctcatcatggctctcctccagttcaagcccgcgcccatgtacattctcgacgaagtcgacgcggcgctcgacctgtcgcacacgcagaacattgggcgtctgatcaagacccggttcaagggctcgcagttcatcgtcgtcagtctcaaggacggcatgttccagaacgccaaccgcatcttccggacgagattcagcgagggaacgagcatggtgcaggcgctcacg

SEQ ID NO: 27191 - DNA, 1497 bp, Neurospora crassa
ggctatgagaacatgaccgaagtccagtctatgaccatcagccccgctctcaagggcaaggacatgtatgcctagatccgtcacctccatttccgcgctttaaacagttgctaacgtgaagcttccagtgttgctcaggccaagaccggaactggcaagacacttggtttcctcgtccctgtgatccagaagatcatcacccaagatcccgacctcgcccacaggtttggtggcaagagagctcgttctgatgacattcgcgccatcatcatctcgccaacccgcgagcttgcggagcagatcggagaggaggctcgtaagttagtcaagggaaccggtatcatcgtccagactgccgttggtggtacccagaagaacgccatgctgtacaagacccgtcagcagggctgccatatccttgttggcacacccggtcgcctgaacgatttgctttccgacagccacagcggcatcgacgcccccagactctcgacccttgttctcgacgaggccgatagaatgctcgaagttggcttcaatgaggagcttcgccagattatcaactaccttcccgatcgcaaggttcttccccgccagactctgctctactctgccaccattcccaaggatgttgttggtctcgccagaagctacatcgacaagaacaacttcgaattcgtccagaccgtcaaggccgatgaggtcctgacccacgaccgtatccctcagtacatcgttccctgcaagggtttcgagaacatttacccggccatgctggagctgatcgagaaggcactcaacgagtccaggactaaccccgaggctcttcctttcaaggccatcgtcttcttgcctactaccgctgaggttatcatggccaatgcgatcttcaagcgccttcagtggaagttcaagcacattcccaagacttgggacatccactccaagctcactcagaacgccagaactcgtgccgccgacgagttcaagaacgcgcgtaccggtatcctcttttcctcggacgttaccgccagaggcatggattttcccaacgtttcccacgtcatccagacccacatcccccccaacagggagcagtacattcaccgtctcggacgtaccggcagagccaacaagcctggccagggctggcttatcgttcccgacatcgagctccacgcggcgagaagcagacttcccggtctccctatcaagcgtaatgacgagctcgagtgcgcttccgtcaacgccgctgattccggtgctgacaagcacgccaacttccagcacatccttgacgcggcgtccagactccctgaggacctcttcaaggactgctactcgtcctacctcggtggcgctctccagggcattgatcgccaagccttggtctatgctctcaacgacctcgccaagtttggttggggcttggaggagcctcctgccgtccgccagagcatcatgaagcacatgggccgtgttcaaggtctgagagtc

SEQ ID NO: 27192 - DNA, 1883 bp, Neurospora crassa
atgcagcgcgcgttgaccagagcttccgtcggcaaggcggccactcgtcttcccgcccagcagctccgctttgctcacaaggtacgatccgggtcccggccatgccgtcatggctatccgatgacaattggcgcatactgacagctctcgcccactacacaggagctcaagttcggtgttgagggccgtgccgctctcctcgccggtgtcgagaccctcgccaaggccgttgccaccactctcggtcccaagggccgcaatgtcctcatcgagtccagcttcggctcccccaagatcaccaagggttagtataccatgtctcggggtgtgatggggaaacatggcatgtgtgtcagagtgactaacccctccacccaacagatggtgtcaccgtcgccaagtccatcagcctgaaggacaagttcgagaacctcggtgcccgcctcatccaggaggtcgccggcaagaccaacgaggtcgccggtgacggtaccacctccgccaccgtcctcgcccgcgccatcttctccgagaccgtcaagaacgtcgctgccggctgcaaccccatggatctccgccgcggtatccaggctgccgtcgaggccgtcgtcgagtacctccaggccaacaagcgcgatgtcaccacctccgaggaggttgcccaggtcgccaccatctccgccaacggcgacaagcacattggtgagctgattgcctcggccatggagaaggtcggcaaggagggtgtcatcacctgcaaggagggcaagactctctacgacgagctcgaggttaccgagggtatgcgcttcgaccgcggctacgtctccccctacttcatcaccgaccccaagtcccagaaggtcgagttcgagaagcccctgatcctcctctccgagaagaagatctcccaggcctccgacatcatccccgccctcgagatctccagccagacccgccgccccctcgtcatcattgccgaggacattgacggtgaggctcttgccgtctgcattctcaacaagcttcgcggccagctccaggtcgccgccgtcaaggcccccggcttcggtgacaaccgcaagtccatccttggcgacattgccgtcctgaccaatggtaccgtcttcaccgacgagctcgacgtcaagctcgagaaggccacccccgacatgctcggctccaccggctccatcaccatcaccaaggacgacaccatcatcctcaacggtgagggctccaaggatgccattgcccagcgctgcgagcagatccgcggcgtcatggccgatccctccacctccgagtacgagaaggagaagctccaggagcgtctcgccaagctctctggcggtgttgccgtcatcaaggtcggcggtgcctccgaggttgaggttggtgagaagaaggaccgcttcgtcgatgctctcaacgccacccgcgctgccgttgaggagggtatcctccccggtggtggtactgccctcatcaaggcttccgtccacgctctcaagaacgtcaagcccgccaacttcgaccagcagctcggtgtcaccattgtccgcaacgccatcacccgccccgccaagaccatcattgagaacgccggtctcgagggctccgtcgttgtcggcaagctcactgacgagttcgccaacgacttcaacaagggcttcgactcggccaaggctgagtacgtcgacatgatccaggccggtattctcgaccccctcaaggtcgtccgcaccggtctcgttgacgcctccggtgtcgcctccctcctcggtactaccgaggttgccattgttgaggctcccgaggagaagggccccgctcccatgggtggcatgggcggcatgggcggcatgggtggcatgatgtaa

SEQ ID NO: 27193 - DNA, 1225 bp, Neurospora crassa
atgttgtcgcgacaggccctgctccgccccgcgcgggttctcaacacccaggtccgcacctatgctgctgccgccgccgcctccagcaaggtcaagcctcccgtgactctcttcggtctcgacggcacctatgccactgctctggtacgccctcgcgccccggaccccgacgtcacaagcaattgaagcaccctcgagctcccgtgttcgtagggttatgtcgattggagctctcccacatcagccaaaccgacaaccgaacgcaatggaccgatagacagaatatcagagagctaacatagttccctgcgtcatttacacatgatatagtacacggccgccgtcaagaccagcgccctcgagcctaccgccaaggccatcagcagcctcggcaacctccttgctaaggaccctaagctcgccagcatcctcgagacccccaccctctcccccgccgacaagagcgccatcgttgccgagctccagaagagcgtcggtgtttccaacgagaccgtcaagaacttccttgccaccctcgccgagaacaaccgcctcggtctcctccccagtgtcgtcgccaagttcagcgagctcatgagcgccgcccgcggtgaggttgagatggtcgttaccagcgctcaggtacgctcgctttgttccgttacgttgtttgatggtgggcaaaagaagaatcagaaggaggagggaaactacgagggcgatgacggaaggggagccgagcttatggggggattttatacgaccaggaagaggaggacgacaatgaaattgggcttggacattggcggaagctctggctggaattgggatcctgggtgaaccgaaacacaaggagatgggaaacagaagcgctaacgaaatgctgaactaccaccatatagcccctcgacaacaagaccctcaaccgcctcgagtccgctgttgccaagtccccctacgtcggctctggcaagaagctcaaggtcaccaacaaggtgcgtttatctcacaccattccaacccggcaaaactggagctatacccgacccggctgcttggtgaaattaggcaaaacaactacttaccttctctcttttaatttgaacaggtcaacgccgacatcatcggtggtctcgtcgtcgagatcggtgagcgcaccatcgacctttccgtctcctccaagatcgccaagatgaacaagctccttagcgaggccctgtaaatt

SEQ ID NO: 27194 - DNA, 2672 bp, Neurospora crassa
atgactcttactgaagttcgcactttcactcctccgagagctttcggtgacgctatcagccaaccagttgtcacaccagttatcacaacttcgacaacaccgcgctccatccccgaactccagatcacactcaagcccgccatcagcccatcaccaaaagcacgtcagaacagcatggcctctactcccgaagaaaagtccaaaggcggcgtaacatttgcccaccaggacaagctccccaagcttcctatcccagaactcgaaagcacctgccagagatatctcgcctccctaaaaccgcttcagacccacagggaacatgccgagacaaggcgcgccgttcaggagtttcttcaaacagatggccccgagctgcatgaaaagttgaagaaatacgctgaggaccaaacaagctatatcgagcagttctgtatgtttcctccgacacaaaggccctttacagtccatgtttggctaacacgtcttcagggtatgattcgtacctcaactacgacaaccccgtcgttctcaacttgaatccctttttcttgctcgaagatgatccgacaccggctcgcaacaaccaagtcactcgggccgcctccttgattgcgtcggctttggagtttgtaagggcagtccgcagggaggagcttccaccagacacggtccggggaacccccctagacatgtaccagtactcacgcctctttggtaccgctcgtgttcccaccgattccggatgccagattcagcaagatgacaagacgaagcacattgtcgtcatgtgccatggccagttctactggttcgatgttttggacgataactctgatgccatcatgaccgagaaggatatcgccatcaacctccagaccattgttgacgacgcccgacaaacccctatccaagaggctgccaagagtgccctcggtgtgctgagcacagagaaccggaaggtctggtcgggacttcgtgacgttctgacgagtgatcccggttccaacaacgccgactgcctgagcatagtcgacagtgctctcttcgttgtctgcctggattatacggaaccaaccaccgctgctgctctttctcagaacatgctctgtggcactagcgagattgagaagggagttcagattggcacctgcaccaaccgctggtacgacaagcttcagatcatcgtgtgcaagaacggcagcgccggtatcaactttgagcacaccggtgtcgatggtcacaccgtgctgcggtttgccagcgacatctacaccgacaccattctccgctttgcccggtctatcaatggcaaggctccctcgatgtgggcttcaacgagtcccgacccgtcgaagcgtgaccctgagagcttcggagacgtgagcaccaccccccacaagctcgagtgggacatgggtcccgagctcagcgtggctgtccgcttcgctgagacccgcctggccgatctcatagagcagaacgagttccaatgtctcgacttccacggctacggcaagaacttcatcacctccatgggcttctccccggacgcctttgtgcagatggccttccaagcagcctactacggcctctacggccgcgtcgagtgcacctatgagcctgccatgaccaaaatgttcctgcacggccgcaccgaggccatccgcaccgtctcggacgactcagtcaactttgtccagactttctgggctgacgcccccggcgacgccaaaatcgacgccctccgcaaggcctgccaggcccacgtcaacaagacccgcgactgcgcgaaagcccagggctgcgataggcacttgtacgccatgctctgcctctggcagcggatgcaggatgacgacgctgccagcaccaccaccgacaacagcatgaatggctattcttttgaagacggctccatcatcggctcgccatccaaggactccgtcttctcccaatccatggagtctcagtctgtcaacggcggtggtcgcgaacgtggcgactccatcaactcccacatctccgccaccccctcccaacgcggtggtgtacctcaaccactacccgccatcttcgccgacgccggctgggacaaactcaacaccaccatcctgtccacttccaactgcggcaacccgtccctccggcactttggctttggccccgtctccggcgaagggttcggtatcggctacattatcaaagatgagtgcatctccatctgcgtgtcgtctcgccatcgtcagacccgccgcttcgttgacactctggaatcctacctgcttgagatccgccgtattttgcgcatcgctgcaaggaacgccgcctccgccggtggtgttggtgccaccggtactaccggaaacaagggtatgagcagggctcgggagattgacgcggctgctatcaaccagaatggacaggaaaagctggctcgccccaagatcgggaacaggattaagtcgagggggaggttgatcacgggtcaaagcagcgggcttatgggtcacggaggaccaacgagcatgtacaccaatggaggcggcagcagtgtggggaacattaagggggcgggagggggcagtgttagtagcgcgatggaggagagcgtggtgatgagtgaggatgatgagattggtggttgtaagttttttttctccccttacacttga

SEQ ID NO: 27195 - DNA, 2388 bp, Neurospora crassa
atggccagccacgacgacaaaggcgtcaagagatccaacatggacggcaacgaccaggactcaaagcgcatcaagcgtgccgagaatggcgatgctgcccccgaaaagtacaacccctacctcgcccatctcaacgaggacggcaacggcaacggcaccaatggcgacttcgaatcgcccctcgacgccttcgagaggcacaagaccaccgccgcccaggccgcccaggccgaggactcggagctcaacccgtggaccggccagccgcactcgcagagatacttcgacatcctcaaagtgaggcgcgacctccccgtccacaagcagcgccaggagttcctcgacatgtaccacaacacccagatcctcgtcttcgtcggtgagacgggttccggaaagaccacccagatcccccaatacgtcctctacgacgagctcccccacacgaacggcaagctcatcgcctgtacccagccccgaagggtggcggccatgtcggttgcccagcgtgtcgcgaacgagttggatgtcgaactgggccaggaagtcggttacagcattcgtttcgagaaccggaccggccccaagaccatgctcaagtacatgacggatggtcagctcctgcgcgagtccatgcacgaccacgacatgtcccgctacagctgcatcattctcgatgaagcccacgaacgtaccctcgcgaccgatatcctcatggccctgctcaagcagatcgccgcccgcaggtcagacctcaagatcattgtcatgtctgccacgctcgatgcccaaaagttccagtcctacttctacaacgccccattgctcgccgtccccggtcgtacccatcccgtcgagatcttctatacccccgagcccgagcgtgactacctcgaggccgccgtacggaccgtcctccagatccacgccactgaacccgagggagacatcttgctgttccttactggtgaggaggagattgaggatgcttgccgaagaatcagcttggaggtggacgacatgattcgcgagtcggatgctggccccatgaaggtttaccctctttacggcactctccctcctgcgcaccaacagcgcattttcgaaaaggcccccgagcccctgcgcaagggtggcaggcctggtcgcaaggtcattgtctcgaccaatattgccgagacgtccttgacaatcgatggtatcgtctacgtcgtcgaccccggtttcagcaagcaaaagatttacaacccccgctctcgtgttgagtctttgttggtttctcctatctcgaaggcctctgctcagcaaagagctggtcgtgctggtcgtacacggcccggtaaatgcttccgtctttacaccgagaaggctttcaagaaggaacttattgagcaaacctatcctgaaattctccgatccaacctggccaacactgttctggagttgaagaagcttggtgttgaggatttggtacactttgatctcatggaccctcctgcgcccgagaccatgatgcgcgccctggaggagcttaactacctcgcctgcttagatgacgatggtgagcttacgcgtctcggtggtttggcttccgagttcccgcttgaccccgccctcgccgtcatgcttatttcgtcgcccgagttctactgctccaacgagatcctttccattgtgtccctcctctccgtcccttcgatatgggtacgccccaacaacgcgcgtaagcgggccgacgagatgaagatgcagttcgcccaccccgacggcgaccacctgacgctgctgaacgcctaccacgccttcaagggtgccgagaccaatggcgacgacatgaagcgctggtgccacgagcacttcctctcataccgtcacctgtcgagcgccgataacgtccgggctcagctcaagcgtattatggagacgcacgacattagcctggtcagcacgccgttccaggacaagaactactacaccaacatccgccgcgcgctcctggctggcttcttcatgcaggtggccatgcgcgagagcagcaacagcaaggtgtacaagacggtcaaggacgaccagctcgtcatgatccacccgagtacgtcggtgacgagcccatacgactgggtcgtctataacgagttcgttctcacaaccaagcagtacgtcaggacagtgaccaacattcgtcctgagtggcttcttgtacgtattccccttttatgaattccctttgtcaatggcatcttgaaactgacctatgtaaaccaggaaattgcccccgtctactacgacctcgatacctttgagaagggcgagataaagtcggcgctcactcgtatcaccgacaaggtcaagcggaggcaagccatcaagggcagcggcagcgcgcgt

SEQ ID NO: 27196 - DNA, 2589 bp, Neurospora crassa
atgtcttcaaatcgcgggtttaaccccgagtccgagtctttcgagcaacggccgcccttttacattggccagcatgatgtccaacgacatgagtcgcccactgacaatcagtacggccagatcttggacagtggtgtaagtctttccttacattaaagtaggaagagaaagaagaacgagcaacagcataaattctaacacacatgagatgagaatagttcaactttgtcaccacccccatcaccaacgagcactttcaccagcgcgtgatcgacttgtacaagagccatctccaagaacgggaacagtgggtcaccgaacggggactcactgacgcccaaaaggccaacccgtcgctgccacttcctacggttcctaccttgactgacgacgatacatccctgtttcccagcagctatgttggctcgctcatcgcctatgccagcccatggatcgacctctgctctgccgatcccatcatctcagacatctcccgtcaggtgctgaacctcgagctcgcctacgccaacttctgcggctccaggaccatcattatccccggcccaagacaggacgatggccgtgccgttgctcagtatgcacgtgccattcaggaggctcaggaagtcggtggtcgtgtgaatctggtcattcacttgcccatgtaccgcgagcctggtttggaggaggaggcagagacgctttcttctctccttgctggtgacggtagtagcagctccaactccaaggagaccgtcaagaccgatgctgccaagggcaccgagatcgatctcttcagcacctgggacagttggcacaccatccggaccgtctgcaagtacagcggtcgtctgtttgttgccctgcgcattcccaagcgggtacctgaaaaggacctgcaggagcgctggttctccgagccgctgcactacctgaccctcgataagaagatcttctcgctgaacaaggccggtcatccttcccttacccgccatcatcaggacttgatcaaccgttatatgcgcctcaagaaccacccgtggctaatcctgattaatgtcggtccgtcgacggaaagtctcgtcgaggcccccagcaagatggaggttgacttccctcctttgtccgaggctagcaaggcagtcaaggagaaccgcaagccgtatgctcctccctacaacgagtacgtcgattacatgaagtacctcgagagacaccagcccccttattcggccatggaaactccttcgctcgtcagcttccaggactggctccagtcccctctccagccgctctcggacaatctcgagtcggccacatacgaggtctttgagggcgatccggtcaagtacgatcagtacgaaaaggccgtggccgaggccatgctcgaatggaagaagtacaaccggcccgtctcctccgtgacgcccgagacgcccgacggcaaggacctgatcgtggccgtcgccggcgccggccgcggccccttggttgcccgcgttctccgggccgccgcatccaccaacactcctatccagctctgggctctggagaagaaccagaacgcctacgtctacctcctgcgccgcaacaagcgcgagtggaacaactcggtaacggtgatcaagaccgacatgcgcgagtgggaaggtcctcgcctcgcagccaacccgaacatcatcaccaagctcgacattctcgtgactgagctcctcggttccttcggcgacaacgagctttccccggaatgcctcgacggcattcagcggcacattgcccgcccgcacggcatctccatcccctactcgtataccgcccatctctcccccatcgcgcacccgcgcatcttcgccgacctgtccaaccgcgtcgtcagcgaccccaacgccttcgacatcccctgggtgacacgtctgttccagctcgcctacgttgcccaaaaagtgcccaagcacggccggttccagcaggcctgggagttcgtgcaccccgtcgaggtgtcgcgggccgacgacttttctgcccaaaacgggcgcgcgcgcaagtatgttactcacggcagcggcagcatgtacggctccagcggcatcaacgagcataatgctcggcactgccatttgacgtttgtctgtcccacgagaggtgtgatccatggtctggcgggctacttcgagagcgtgctgtacaagcatcaggaggagggcaagacgccagtagaaattagtatcttgccagatcagattgatcggaagagcaaggacatgatttcctggttcccgattttcttccctcttagggtgagtttttatctcttcttccttcatttcttgtttttcttgacttttcgctcctcgctcctgctttggtgacgattactgaccctgtttcttcgacgatacatagcaacccctctacttccctcaggacaccgagctagaagtcagcatgtggcgccagaccgacgacaccagggtgtggtacgagtggatggttgaagtgtatgcttgggtgggtcccaagacccgtatcaaggttggcgcttctgagatgcatagcagtcgtaaggttgcctgcatttttggttagaag

SEQ ID NO: 27197 - DNA, 2667 bp, Neurospora crassa
atgacgcgttcgcgttcttggtctgtaaaaaaccagataactaacttgccggcaaacaacagcgatctcccagttctgtttccttacccaaggatatatccaggtatgtgagctcatccacattggtacaccatcacaagtgctgacagaccgactacacagaacaatatgcgtacatggtggacttgaaaagtgagcattcaacaaatagctcacactcatcacacgtccactgaccaccaccactccccacagaaaccctcgatgcaggcgggaactgtgtcctggaaatgccttcgggcaccggcaagaccgtcacccttttgtcactcatcgtcgcctaccagcaatactacccagagcaccggaagctgatctactgctcgcgaacaatgtccgaaatcgaaaaggccctcgttgagctgagagcactcatgaagttccgagccgagcggctggggcacgaagaagagtttcgcggtctcggtctgacaagtcgaaagaacctgtgtctgcatccctcggtcaagcgggagaagagcggtgccattgtcgacgcgaggtgtcgcagcttgacggccggcttcgtcaaggagaagagggaaaagggggagaatgtggagacgtgcgtctaccacgacaatctcgaccttctagaaccgcataacttgatccctaacggaatttggacactggatggcctgatgaggtatggcgaggaaaagaaacagtgtccttatttcactgccaggaggatggtaggtctcttctcaacaccccaggatgcggatgtaatagctcgagatgccatacatactaacagctcatatgtagatgcaacactgcaacgtcatcatctactcctatcactacctcctagaccccaagatcgccgagcgcgtgtccaaggatctatccaaggactgcatcgtcgtctttgacgaggctcacaacatcgacaacgtctgcatcgagtctctaagtaccgacatcacccaggactcactgatgagggcaaccaggggtgctcagaacttggaggccaaaatcagcgagatgaaggactctgatcaagagaaacttcagtccgagtacgaaaagctagtcgaaggactcaagggtctagatgaagggcgacaggaggatgcttttatggctaacccaacactacccgacgatctgctcaaggaggctgtccccggcaatatcaggcgagccgagcacttcgttgccttcctccggagattcatcgaatacctcaagacccgcatgaaggtccgccaggtcatctccgaaacaccaccatccttcctcgcccacctgaaagaatacaccttcatcgagaagaaaccgctccggttctgcgccgagcgtctaacctcgctagtacggaccctcgagctcaccaacattgaagactaccggccactccaagaagtagccacctttgcaaccctcgtcgccacctacgaaaagggcttcctactgatcctcgagccctacgaatccgacacggccaagaccccgaacccagtcctgcacttcacctgcctcgacgccgccatcgccatcaagcccgtcttcgaccgattcagctccgtcatcatcacctccggtaccatttccccccttgaaatgtaccccaaaatgctcaacttcgaaaccgtcgtgcaggaatcctacgccatgaccctcgcccgccgctctttcctccccatgatcgtcacccgcggctccgaccaggcctccatctccacctccttccaagtccgcaacgagcccagcgtcgtgcgcaactacggcaatctcctgaccgagttcgcccgcatcacgcccgacggcatggtcgtcttctttccctcgtacttgtacatggaatccatcatctccatgtggcaaggcatgggcatcctcgacgaagtgtggaagcacaaactcattctggtcgaaaccccagacgcgcaagaaacctcgctagcgctcgagacgtaccgcaccgcctgttgcaacggccgcggcgccatcttgctctgcgtcgcgcgcggtaaagtgtccgaaggcatcgactttgaccaccagtacggccgcaccgtgctctgtattggcgtgcccttccagtacaccgagtcgcgcatcctcaaggcccgcttggagttcctgcgcgaaacgtaccgcatccgcgaaaacgactttctctctttcgacgccatgcgccacgccgcgcagtgtctggggcgcgtcttgcgcggaaaagacgactacggagtcatggtgctggcggaccggcgcttcatgaagaagcgcgcgcagctgcccaagtggattaaccaagctttcttggaagcgaacacgaatctgagcacggatatggcggtggggaatgcgcgggcgttcttgaagcagatggcgcagccgtttagtgccaaggatcaggagggcgtgagtatttggggaatggaggacctcaagaggcatcaggagaagatggcggaggatatgattgtggagctgaagacggcgagggaggaggaggaaagggagaggaagaggagggaggaggaggagaggaggaggttcgaggaggagagagatagggttagtgattacgagatggatgaggatgatgaggcggagatgatggcgctggatgcgaggattggttagttg

SEQ ID NO: 27198 - DNA, 903 bp, Neurospora crassa
tacttcaacgacagccaccgcagcctccagaaggccatccgcaagttcaccgacgaggtgatcgcccccgaggctctcgagaaggagcgcaccggcgagctcatcagccaggacctgatcgacaagatgtccaaggccggcatcttgcacatgcgcatgggtcccggcaagcacctgcacggcgtcaacctgctggacggcgccgtcaagggcgaggagttcgactacttccacgacatgatcatggcgcaggagcaggtgcgcgtcgcctgccgcggcttccaggacggcaacatggccggtatggccatcggcctgacgtgcatcctcaactacggcgacaagaacccggctctcaagaagcgcatcactgaggaggtcttcgccggcaagaagaagatctgcctggccatcaccgaggcctttgccggctccgacgtcgccggcctgcgcaccacggccaccaagacccccgacggcaagcactacattgtcaacggcaccaagaagtggatcaccaacggtgtcttctgcgactacttcgtcaccggcgtcaagaccgacaagggtttgagtgtcctcctcatcgagcgcggcgagggcgtcgagaccaagcccatcaagacctcgtactcgcccgccgccggtaccacctacatcaccttcgacaacgtcaaggtgcccgtcgagaacttgctcggcgaggagaacaagggcatctacgtcatcctctccaacttcaaccacgagcgctggatgatggcctgcgccaccatccgctacatgcgcctcgtcgttgaagagtccctcaagtggtctcaccagcgtcttgtctttggcaagcgtttgatcgatcagcccgtcattcgccaaaagttggccaagatgattgccctgtgcgaa

SEQ ID NO: 27199 - DNA, 2709 bp, Neurospora crassa
cgttcgcctcccatcccaggcagggcatcaccaaccaaatctggtcagcaaacacagagtcactgtcgcagttggtcgaacagatacaccacaccaatggcgtcaaaacgatatgccttcgtccccatggacgatgagcctgctgccccatccaagagcgacagaaaagaccgagacagagacagcaaaagggacaggaaacgcgatcgatccaggtcgccgcgccgacacaagagcaggcgacccgatgacagcgactctacccgacgccagtcccgctcgcgatcaccacgcaaggacgacagccgatcagactcgagacgcgatcgcgaagaccccaagatgtcagatctcagactcaagtcccgatacgactacctgaagaagagagaggccgagaagcttgccctcctacggaaacaagtcgccgaggaaactgccgagttgcgatccggtgttcgtctgtctgaaaaggaaaaagccgaattcgcaagaaaccgggaaattctacgcctggccgaggagcgagcacgcattgacgactaccaagacggctaccgcctaccggaccagtatggcaccgacaccaagaagaaagaggaggctttataccagcgtcacgtcgagagggacgagtatggtaacgaaaagatggttaccgaatacgacgagtgggagcgcgagcaaaccgtcaaggccaaggcgcaaatcgcatcgcgcggcgagcgcgaagacggaggagaatacgacttcttgctggacgaggatgccatcaactttgtccgtgatgctgccgccaagttcatacaaccgaccgacggcctgacgccggagcagaggatcttaaaggagaagatcgaggcggccgagcgggcggccaagtcgatacaagaagtgcgcaagagtcttcccgtttatgcttaccgggacgcttttctggatgccatcaaggagtaccaggttcttatccttgttggcgagactggttcgggaaagacaacacaaataccccaatacctccacgaggctggatatactgagggcggcatgaaggttgcctgcacccagccgcgtcgtgttgccgccatgagtgttgccgctcgtgtggctgatgaaatgggagtcaaggttggaagggaagtcggttactcgatccgtttcgaggactgtacaagcgacaagaccattctcaagtatatgacggatggcatgcttctgagagaaatggttacgtcgccaacactggagggttactcggccatcatgatcgacgaagcccacgagagaacagtccataccgatattctactagcacttatcaaggatcttactagggcgaggccggatctgaagctcatcatttcttctgcgacactcaacgccgaaaagttcagcacgtactttgatgatgcgcccatcttcaacgttcccggtcgtgtgcatccggtcgatgtatactacacttcagcaccagagagtaactacctagaagctagtttggtgacagtgttccagatccatgctacacagccagagggcggtatcctggtgtttctcactggccaagaggagattgacaaggcatgcgagcgagtagaagagatcaaaaagaaactggggggtcgagtacccgaaatcatacctctacccatctacgccaacatgccctcggaactgcaggccaagatcttcgagccgacaccaccaggggctagaaaggtggtcttctcgaccaacattgctgaaacatcccttaccattgacggtatcgtctatgtcatcgactgcggctacgtcaaggagaacacattcagtcccgtcggcacaacaggacagtccacgctcgccgttgtgccgtgctcacgagccgctgcgaaccagcgtatgggtcgtgccggtcgtgtccgtccaggcaaatgcttccgtctctacaccaaatttgcctacctctctgaaatggacgagtcaccaacacccgaaatccaacgaacctcgttatcgagcgttgtcctccaactcaaagcgctcggtatcgaagatcttttgggtttcgacttcctcgaccccccaccaaccgaacttctcatcaagtccctcaacatgctctacgccttgggagccctcaactccgccggccaacttacccgcgtcggccggcaaatgggcgaattccccgccgaaccgatgctagccaaggcgctcatcgctgccacggccgagggctgcgtcgacgagatgctcactatcgtgtccatgctcggcgaagtagccactctgttcttccgccccaaggacaagaaggtgcacgccgatagcgcgcgcgcccgcttcactgtcaaggacggcggcgaccacttgacgcttttgaatgtctacaaccagtgggtcgacgccgattactcccccatctgggccaaggagaacttcctcacccagcgatcgctcacccgcgcccgtgacgtgcgcgaccaattagccaagctatgcgatcgcgtcctggaagggtccacatctacctgcggcggagtctccaacatgcagcccatcctacgggcgctcacagcagccttcttcctcaatgctgccaggctaaaccgaggcggagacggatacaggacgctgaagaataacatgacggtgtatgtgcacccgagctcggtggttaaggggatggacccaccaccaaaggttatcatttatcatgagctg

SEQ ID NO: 27200 - DNA, 1512 bp, Neurospora crassa
ctccaggccgccatccagggcgccgataacgatgtggccgtcatcatcccctccaagccgcaggcgctcacagtcacctacgccgacctgaagcgtgaaaccgcttcgttccagaagaagctggcagacattggcatcaccaagggttctccggtctccatcgccaccgtcaactcgtacgagttcatcgtctctttccttgccgcctcgtggcagcgcggcatcgccgcccctctcaacccggcctacaagcaagatgaattcgagttctacatcgaggacgtcaagtccgccatcgtgatcgtccccaagggcgcctacgcagccggtgctcccgtcgttaaggccgcgcaaaagttcaacgccgccatcgccgaatcctactgggacgccgccaaaaacgaagtcgctctcgacgtcaaggaactcggccaactcaccggcaagggcgcccagcccgtgttgaagccagacgccgacgacatcgctctcgtcctgcacaccagcggcaccacctcgcgccccaaggtcgtcccgctcacgcaccgcaacctgacgcgcaccatgaagaacatccgcaacacgtaccagctcacctctgccgaccgaaccatgctcgtcatgcccctcttccacgtccacggccttttgtgcggtcttttggcccccctcctgacaggcggcagcatgatcgtccccgccaaattctccgccaccgatttctggtctgacttcatccagttccaagcaaactggtacaccgccgtgcccaccatccaccaaatcctcctcaagcacccggtccccaaccctctgcccaagatccgcttcatccgctcctgctcctcccctctatcacccaccgtcttccacaacctcgaaaagaccttccaggcccccgtcctcgaagcctacgccatgaccgaagccgcccaccaaatgacttccaacccgcttccctcggtcggcaagcgcaagcccggcaccgtcggcctcggccaaggcgtggaagtcgtcattctcgacgacaaagacaacatcttacccgacggacaagaaggcgagatctccatccgcggcgaaaacgtcaccaaggggtacctcaacaaccccgaagccaacgcgtcctcgttcacgcgtaaggggggctacttccgcacgggcgaccaaggcaagaaggacgaggacggctacattgtcattacgggccgcatcaaggagctgatcaacaaaggcggcgagaagatctcgccgattgagctggataatgtcctgacgcgccacccggccgtttccgaggctgttagctttgcgatcccggatgaaatgtacggacaggaagtcgcggtggcgattgtgttgaagcctggtcaacagaaggtggatgcggaggagtttaagcaatgggtgggaagcaagctggccaagttcaaggtgcccaagaagatctactttacggatgtgatgcccaagacggcgacgggcaagatccagaggaggattgtggcggag

SEQ ID NO: 27201 - DNA, 1175 bp, Neurospora crassa
gaagagctggaggagacagcagcagcagggcaagacataacagaggagataatagactcagcctcggccgacccaatgcaagaggaccccaaccggataacgggcctggaaagatgggcaatgaatgcttcggactcgcagttcaatgcgctcgccggcgcagtgggaggcttcatgtccggcgtggtcacctgcccgctggacgttatcaagaccaagttgcaagcgcagggcgcgggacagcatgtgggccagcccaggatgtacaatggcctggtaggcacggccaaggtaatatggaggcatgagggcattcgcggcatgtataggggcttgggtcctataataatgggctacttgcccacctgggctgtctggttcacagtctacaacaaaagcaaaatatggctacgccaatacacgggtatgtcttccttttggtgttggtacggaacgggacgttcaaggctaacatagatgtgacagacaagccaattgccatcaactttggcgcatccatcatagccggcgctagtagcaccattgcgacgaacccgatatgggtcatcaagacccgactcatgtcgcagtcggcatttcaagacgcgcgcccctcgatgcactcccattggcactacaagtccacgttcgatgccgcacgcaagatgtacaccaccgagggccttctctccttttactccggattgacacctgctcttctgggtctctcccatgtggccgtccaatttcccacctacgagttcctcaagaccaagtttactggacaaggcatgggcggcgccgccggcgaccagaacgccaagccaagctttatgggcacttttgccgcctccgtcctctccaagattatcgccagcagtgcgacgtatccccacgaggtcatcaggacgagactgcagacacagcgcaggccgattccgggacaggagcacttgcagggtctgggagtggttgccaagaacggcgccgagtcaaagcagctggcaacatcagggcccaagtacagaggcgtggtgagcaccttcaagatcatgctcaaggaggaagggtggagggcgttttacgctggtatgggaaccaacatgatgagagccgtccccgcggcgactgtcaccatgctcacgtacgagtacgtgatgaacaacctgaagcag

SEQ ID NO: 27202 - DNA, 891 bp, Neurospora crassa
atgtcccaaccactcaagggcaagcttgccattgtttccggctcttctagaggttagtaactcttatgcttcttgaattcacattcaagacactaagaatctccaggcatcggcgccgccatcgccgagaacctcgcctccaaaggctgcaacctcatcctcaactacaccaccccctcctccgcctccctagcctccgagctgtccgaccgtctcaacaagacctactccatctcctccgtgcccgtccaagccgacattggcactcccgaaggcccccaagccatcatcaccgccgccacgtccgccttctccaaggccgatggctccctccagatcgacatcatcatcaacaacgccggcatcgcccgcaacgacctgattcccaacgtcaaggtggacgactttacggaaacctaccgtgtcaatgtcctaggccccttgctgctcgtccagactgcccagccttacctccccaaggaccgctctggccgcatcgtcaatatctcctccgtctcctcctccactggcttcataggccagtccgtctacggcggctccaaggcggccatcgaagccatgacccgtacctggagccgcgagctggctgagaactgtacagtcaacgctgtcaacccaggcccggtcgagggacccatgtatgcatccaactcggaggagtttctggagggcatcgaggggtggatcaagcacacgccgctgatgaaggcgcgggaggatctgcatggcaaggaggccgtggaggaggcgaagcagtggcatggcaggctggcgaagacgggggagattgcgggggtggtgggcatgttgtgtggtgaggaggcggggtggtgtacgggacaagttgtttgtgctaatggggggatgttg

SEQ ID NO: 27203 - DNA, 760 bp, Neurospora crassa
atggatattcgcgtcctccgcccctcggacatccctctgatccagcacgccaacatcgagaacctgcccgagaactacttcctcaagtactacctgtaccacgcgctctcatggcctcagctgtcgtatgtcgccgtcgacgtgagccgcccggccaagagcgcctacgactaccccaagatcgtcggctacgtcctggccaagatggaggaggagccgacggacggagtgcagcacggtcacattactagcttgagcgtgatgcgcacccataggcgactcggcattgctgagaagctgatgaggcagtctcgtacgtcgtttcccccccttctcccccctttctctccttatcttcctttctctccttatcttcctttcctttctttctttcttccttttttttctctctcctcgctccgctcgacctctaccctccacacaaaagcaccaccaactaacctatcatctcactgacgcggtgtgaaaaaacagaacaagcaatggtcgagaccttcggcgcccactacgtctctctgcacgtgcgcgtctccaacgccgccgccatccacctgtaccgcgacactttgggcttcaagacggagaagacggaagccaagtactacgccgacggcgaggacgcctattgcatgaagctcgacctggcgcccatccgcgaggcgcttttggccgagcagctggacgagaaggacgccaaaccaaaaatcgaggaaggaaagggatcggaaggggtggatga

SEQ ID NO: 27204 - DNA, 869 bp, Neurospora crassa
tctctcgaggctaaaatagtcgttctcggctcccagggcgtcggcaaaacatccctcgtgacgcgcttctgcaagggtgccttcaacccagcccaaatcacctcgaccgttggcgccagcatgatgaccaagcgcgttatcgacactgataccgataccgtggtgcgattacagatttgggatactggtatgtcgtggtggtgatttacacttgtcgatataaatcacatgcatatgttccatcactgcctccatatttacctacccatgtcctcctcccccagcttgccccacccatttactatatatatataaatgtagtatccgtccccatcactccccacataggaaacagcaacaataacaagagcatgaggctgacttatacccgaaacataaaactatttgaaaaaaataaacagctggccaagaacgtttccgctccatctcccgtctctactaccgcggcgccaatgcctgcatcctatgctactccatcaccgacgccgcctccttcgccgagatgggcatgtggctaaccgaactacggcgcaacctgcctcaggacatagtcctgcacgtcgtcggcaccaaggctgacatggtcgcccgcgacccttccaagcgagaagtgccctttgagcgctgcatcgcctatgtagccgaaaacctgaacccgggcgtgggatcgacgccaccacctacggccacgccgttggggatgcccggggtagggggctctttgaattcaaatagtggtggtggcttaggagggtgggcaggtacaggaacaggaacaggggcgacgacgacgacaacgacgacaggtactgggactacaccagcaacaacaaccacagaaagaccag

SEQ ID NO: 27205 - DNA, 1568 bp, Neurospora crassa
ggacatttcactaacaccaatacagttgccagctattatgacaaccttgacgaccggaatgttgtgtctaccgtagaacctggctaccttcggaagcttctgccatccgaggccccggtcgaaggcgaggcatggaccgatattcacaaagacattgagggcaagatcctccccggtatcactcactggtacggcgacctcaccatgttcattttcaattttctctctttcttatttctcacccagaaccaaagactgactatacaaccaggcaacaccccggcttccatgccttcttcccctgcgccaccagcttcccctccatccttggtgagctctacagcgccgccctctccggcgcctgcttcaactggatctgcagcccagccgtgaccgagctcgagacgatcgtgctcgactggctggccaagatcctcggccttcccgaatgctacctgtccaccggccccacccgcggcggcggcgtcatccagggctccgcctccgaggccgttctgaccgccatggtcgccgcccgtgacaagtacctgcgcgagactgtccctctcgagcagttccccgagggctccgaggcgcgcgaggacgccatcgcccacaagcgcagcaagatggtggcgctcgccacgacagccacccactcgtccaccaagaaggcctccatcatcctcggcgtgcggtttcacaccatcgccgtccacgccgacacgggctactcgctcaccgggccagtgctggccaagacgctcgccgaactgcgcgcccgcggtctcgagcccttcttcatgaccgccaccatgggaacgaccgacacgtgcgcggtcgacgacttcgcgggtatcgtgtcgacactcaaatcggaccccgtgcacccagccggtacccctggcgagttgtgggtgcacattgacgcagcctacgccggctcggcgctcgttctcccctctgtgcgggagcaagtctccatctcgctgatcgagaacttccactcgttcgacatgaacatgcacaagtggctcctcacaaatttcgacgcctcatgcctcttcgtgcgtgaccgcaactggttcatccaagccctcaccatcaaccaggccgtgtacggcaacaaggcgtccgagggcgggctggtgacggactaccgcgagtggcagatcccgctgggccgacgcttccggtccctcaagatctggttcgtgctgcggaactacggcgtcaagggcctgcagagttatatctcacgcaccctcaagctgggcgaggagtttgccgactcgctcaagtctaggccggatctgtttgagattttgaccggccctaactttgcgctgactgtgttcagggtcgccggcaaggagcagggtaagagcgacgaggagctgaatgcgcttaccaaggctgtgtgcgaaaagatcaacgcttccggcaggatgtgggtgactagcacggtgctggatggcaggttcgccattcggatggtgactagcgtgagtacgactgagaaggagcatgttgaccgggcgtggaagattctggttgaggcggcggag

SEQ ID NO: 27206 - DNA, 1129 bp, Neurospora crassa
atgtcgctctcaaactgccgtttctatgaggagaagtatcctgaaatcgactcgttcgttatggtcaatgttaagcaagtacgatacactggggtcccggtggtgcgcatgcgcatgtggatgcgtcagagctgacccccagattagattgccgatatgggcgcctacgtcaagcttctcgagtacgacaacatcgacggcatgatcctgctctctgagctttccagaagacgtattcgttccatccagaagttgatccgtgtcggtcgcaacgaggtcgtcgtcgttctccgtgtcgacaaggagaagggttatatcgatttgtccaagcgtcgtgtgtcccccgaggatatcgttcgttgcgaggagcgttacaacaagagcaagatcgtccactcgattatgcgccacgttgccgagaagactcttgttcccatcgagcagctttacgagacaataggatggcccctcaacaagaaatacggccactcgcttgatgccttcaagctttcgatcacgtacgtcattccgggaaataggcgtacagctgtgggacaaaatggcggtattggacaagatgctgacatggatgtgaagcaaccccgacgtctggaatgacatccagttccccaccgaggccgttgccgaggagctcaagacctacatcagcaagcgtttgactccccagcctaccaaggtccgtgccgatgttgaggtcacttgcttcggctacgagggtatcgatgctatcaagaccgctctccgcactgcggaggctcgcaacactgaggaaacccaggtcaagtgcagacttgtgtcccctcccctttatgtgtaagtctttgccagaaatagtcttgcaatgttgaagacagagtggaagctaataactatacacagccttaccaacacctgcttggacaagaatgccggtattgcccgccttcaggaggccattcaagacatgcggaccagcatcgaggctgctggtggccaccttgtggtgaagatggagcccaaggctgtcactgagtccgatgatgctgagctccaagctcttatggagaagcgtgagcgtgagaacgctgaggtcagcggcgacgagagtgtcagcgagtccgacgacaat

SEQ ID NO: 27207 - DNA, 559 bp, Neurospora crassa
attcggaacggattcctcggtcagttctcacactacctcattcgctacgcaacatggatccctccattggtggtcttcaacggctgggttgccgagatcacacaaatcaaggggccgtccatgtatcctttcttcaacccgcactacaatgagtcaacacgtcgggacatcgtactggtctctaagtggtacccggaccggaacctcaagcgcggcatgattgtgacctttaggtgagatccaaaatctcatcctacagcatctggcgtgccgcattcggggcattggttgggaacctgacgactaactgtaacccagaaacccactgaacccaaagggaaaggtcgtaaaaagagtggtcggaatagcaggcgacgtgatccgtaccaaggcgccttacccgcatgaatacgtccaggtaccagaagggcacatctgggtagagggagacggcgacaagaccaaggacagcaactactacggcccgatatcagcgtgcttggtcaccggccgtgtcacgcatattctgtcgccgtgggatcgatttgggcgggtaaag

SEQ ID NO: 27208 - DNA, 1512 bp, Neurospora crassa
gatgtggtagtagtaggcgccggcgtctttggttgcgcggccgcgtacgcgcttgccaaccagggccggagcgtgatcctactcgagagatggatgcacgagcccgaccggatagtgggcgagttgctacagcccggaggtttacaagcgctgcagaagctcgggctgggccactgcgtcgaagggatcgatgccatcacctgctacggataccacgtcgtcttccacggggaggaggtggccattccttacccggtggtggacgaccaaggaaaggtgtactctggcgaagcggccgcacgggtagagtcgacggcgacgacaacgacaagcaacgggacagcaggcaaggcaaatagcgggcccaagctacgacgacccgaaggccgatcattccaccacggccgcttcatcagccaactccgcaaggcctgcgccggccaccccaacatcaccatcttcgaaacaaccgtgacctcggtcatccggggctcgcactccaaccaagtcctcggcgtcgagaccctcaccaccactgaccgcgacaccggcgaaaaacagcctgacttcttctttggccaactaaccctcatcgccgacggctacgactccaaattccgcaaacagctcctgccttccggccccgacaccacccctgtcgtgcgctccaagttctacgccctcgaactcatcgactgcccgttccccccttccggctacgggcacgtcgtcatcggcaaaacctcgcccattctattgtatcagatcggcacgcacgaaacccgtgccctcatcgacgtcccgctcgacctccctgccgcttcggcagccaacggcggcgtaaggggatacatcgagaacaccgtcgtgcccactctcccttcctccgtccgcccttcggtcctcgccgccctaaaagacggcaagatcccccgctccatgcccaactcttatctccccgcttcagggaaagccaacacggcccgcacccccggcgttctgctgctaggagatgcgtacaacatgcgccaccccttgacggggggcggcatgaccgtcgccttttccgatgtggtccttttggcgtcccttttgcatcccgatcgggtacccaacctcgctgactcggctgctatcgaaaccgccatgaaggaattccactggcgtcgcaaggcgtggacgagtatcatcaacaccctggcccaggcgctgtattcgctttttgcggccaacgattggcagcttgatgccttgaggaagggctgcttccggtacttccagatgggaggcgcaaagacggatgaacccgtggcgttgatgggcggacttttgcaacggcccgtggtgctggcgagacatttcttcacggtggcgtttgtggccatctggttgcatatgtgtgagcgggtgggcagtgtgtggggattgtggagggcgccgttggtgttggttgaagcggtcttgattctttggaaggcgtgtgtggtgtttttgccgacgatttggaaggag

SEQ ID NO: 27209 - DNA, 5638 bp, Neurospora crassa
cctgtttccatcatggctgccaccgtctaccgccccgccacggcccccatcgccgatgcgccttgcgaaggccttgtttgcctggagcttgaggatggctctgcctaccaaggctacagctttggtgcgcccaagagcattgccggcgagcttgtcttccagaccggcatggtcggctaccctgagtccgtgaccgatccttcgtaccgcggtcagattctcgtcattaccttccctcttgttggaaactatggcgtcccctcgcgggagaccgtcgatgatctgcttaaggatctccccgcccacttcgagtccaaccagattcacattgccggtctcgttaccgcctcttatgctggcgaagacttctcgcacttcctcgccacctcgtcccttggaacatggctcaaggagcagggcatccctgccatgtacggtgtcgatacccgcgccctcaccaagcgcatccgcgagaagggtagcatgcttggtcgcatgctcctccagaaggaagacttggctgtcagcgctccttctctcggagttcctggcgactggaagcctcacttcgagactatcgaatgggttaaccccaacgagaagaacctcgttgccgaaggtaagcaacatttgccctccgctaagatggacaggccatttctaacacgctactttcagtctcgatcaaggagcccaagctctacaagcccgatgaggccactgccctcaagcacccctcgggtcgcaaccttcgtattctctgcctcgatgtcggcatgaagtacaaccaactcaggtgcttcatcaagcgcggtgtcgaagtcctcgtttgcccatgggactacgatttctcaaaggaagaatatgatggtctgttcatctccaacggtcctggtgacccgaaggtcatggacaccactgtcgagcacatctctgccgccctgcagaagaacaacacacccatcttcggtatctgcttgggtcaccagctgctcgctcgtgctgccggtgccaagacggtcaagctcaagttcggtaaccgtggccacaacattccttgcaccagcatggtcaccggaaagtgccatatcacctcgcagaaccacggttatgctgttgacgctaccactctccccaccggatggcaggagctgttcatcaacgccaatgatggcagcaacgagggtatcatgcacgtcgaccgcccccacttcagtgtccagttccaccctgagagcacccccggcccccgcgacaccgagttcctctttgatgtcttcattcagactgttgccaagtgcactaccgataacactctcctccagaagggtgtcgaattccccggtggaaccactgaggagaatgagagactccacccccgtgtcgatgtcaagaaggtcctcgtcttgggcagtggtggtctcagcatcggtcaggctggtgaattcgactactcgggatctcaggccatcaaggctttgaaggaagaaggtatctacactgtcctcatcaaccccaacattgccaccattcagacctccaagggcttggccgacaaggtctacttcttgccagtaaacgccgagttcgtccggaaagttatcaagtacgaacagcccgatgccatctactgcacctttggtggccaaaccgctctctcggtcggtatccagctcaaggatgagtttgaggctcttggtgtcaaggttctcggtacccccattgataccatcatcaccacggaggaccgtgagctctttgctcgcagcatggagtccattggtgagaagtgtgccaagtccgcttcggccagcagtgttgaggaggccctcaacgcggtcaaggacattggttacccggttattgttcgtgcagcctacgctcttggtggtctcggcagtggcttcgccaacaacgaagctgagctcgttgacctgtgcaacaaggcgctggcagccagtccccaggttcttgtcgagcgcagtatgaagggctggaaggagatcgagtacgaggttgttcgtgacgcccaggacaactgtatcactgtgtgcaacatggagaacttcgatcctcttggcattcataccggcgattccattgtcgtcgcgccttcccagacgctttccgatgaagactacaacatgcttcgcactactgctgtcaacgtcattcgccatcttggagttgtcggcgagtgtaacatccagtatgctctgaaccccttctccagggagtactgcattatcgaagtcaatgccagattgtcgcgttcctcggccttggcttccaaggctaccggataccccttggctttcattgctgccaagttgggtctcggtattcctctgaaggagattaagaacaccgttaccaaggtgacctgcgcttgcttcgagccttctctggattatgttgtggtcaagatgcctcgttgggatttgaagaagttcacccgcgtctccactcagctcggctcttccatgaagagtgtcggcgaggtcatgagcatcggcaggacatttgaagaggccatccagaaggctattcgtgccatcgatttccacaaccttggcttcagcgagtccaagggtgcgctcatgtccgtcgacgacgagctccagaccccctctgaccagcgtctattcgccattgccaacgccatgcacgcgggctacactgtcgacagaatctgggaattgaccaagatcgacaagtggttcttgtccaagctcaagggcctgagcaatttcgccaaggacatgaccaaactcacggctaacgatgttgttggtcgtcctgatctgctccttcgcgcgaagcagcttggcttctgcgaccgtcagcttgccaacttctgggattccaacgagctagctattcgtcgcatgcgtcttgaggcaggaatcactcctttcgtcaagcagatcgacaccgtcgccgctgaattccctgccttcaccaactacctgtatctgacctacaacgccagcgagcacgatgtttcgttcgaagaccgtggtgtcatggttcttggttcgggtgtgtaccgcattggttcttccgtcgaatttgattggtgttccgttcgggccattcgcacgctccgcgagtctggcttcaagaccatcatggtgaactacaaccctgagaccgtcagtaccgactatgatgaagccgacaagctgtacttcgagaacatcaacctggagaccgttctggacgtctatcagatggaggacgcaaccggagtgttgggagctatgggtggccaaacccccaacaacattgctctgccccttcttcgtgctggcgtcagagttctgggtacttctcctgagatgattgacactgccgagaaccgctacaagttctcccgcatgcttgaccgtatcggtgtcgaccagccgacttggaaggaacttaccagcttcgatgaggcgaaggccttctgccagaaggtatcgtacccggtgctggtcagaccttcctatgtgctttctggcgctgccatgaacactgtctactccgaggccgatcttgagtcctaccttcagcaggctgccgatgtctctcctgagcaccctgtcgtcattaccaagtacatcgagaacgccaaggaaatcgagatggacgctgtggccaaggatggaaaggttgttggacatttcatttctgaacacgttgagaacgccggtgttcactctggtgatgcaacccttatcctgccgcctcaggatctggagcagaccactatccagcgcatcgaggaagccactcgcaagatcggtgccgctctcaacgttaccggccccttcaacatccagttcatcgccaaggacaacgacatcaaggtgattgagtgcaacgttcgcgcttcgcgctctttccccttcgtctccaaggttatgggagttgatctgatcgagatggccaccaaggctatcatgggtctgcctttcgtagagtaccccgccatcgatcgtccttctggcggtgtcggtgtcaaggtcccccagttcagtttctctcgtctgtctggcgctgaccccgtcttgggtgttgagatggcttccactggtgaagttgcctcctttggtgttgacaagtacgaggcctacctgaaggctttgatgtccaccggcttcaaggttcccaagaagaacattttgctctccatcggttcatacaaggacaagaaggagatgctgccttctgtggccaagctttctcagatgggctacaaactcttcgctaccgctggtaccgccgatttccttcaagagcacgacatccccgtgcaattcttggaggttctcgccaaggaggacgatcagaagtccgagtactccctcacccagcacttggctaacaacatgatcgacctgtacatcaacctgccctccaacaacagatacagacgccctgccaactacatcagcaagggttaccagacacgtcgcatggctgttgattaccagattcccttggtcaccaacgtgaagaacgccaagatcctcgtcgaggctatcgccaggtaccgtgacatggagatcggcgagcgtgactaccagactagccataccccacttcagctctctgggcaggtcaacttcacccttcaggactcgctctccaggcctcactctttcaagaaagcccacgttctctccgtagagcagtacactcgcgccgacttgcatcttcttttcactgttgccgaggagatgcgcctcagtgtccagcgcggaaacgtcatggacattcttaagggacgcatgcttgccactctcttctacgagccttccacccgtacgtcggcgtctttcgaggcggctatgaagcgtctgggcggtgaagttatttccatcgctacgcaacactcctctgttcagaagggcgagactctgcaggacacgctccgtactcttgcctgctacgccgacgccattgttctccgccatcccgacgagacctgcgttgacgttgccaagaagtacagcccggtgcctgttgtcaacgctggtaacggaagcagggagcaccccacccaggctttcttggatctcttcactgtccgtgaggagctgggcactgtccagggcttgaccttcacgttcgtcggtgaccttcgctatggcagacctgtgcattccctggtctacttgcttcgtcactattcgggagtcaaggtgcagctcgtctcccccaagggacttgagttgcctaccgatgttcgtcagcaactggtcaaggccggccagctgctctgcgagtctgagacgttgacccctgagattctcggcaagactgatgtcttgtactgcactcgtgtgcaaaaggagaggttcccgagcgaggccgagtatgagaaggtgaagggttcttaccgcatcgacaaccagacccttaagcacgccaagagcaagatggctatcatgcacccgctccccagaaacgaggagattgctgaggaggttgacttcgaccagcgggccgcatacttcagacaggtaagatcctcctttgacattgtttccgctacaatgcggcttcaagttcgtttgctgacagattgtagatgagatatggtctctactgccgtatggccctcctggcgttggtcatgtctggttag

SEQ ID NO: 27210 - DNA, 1914 bp, Neurospora crassa
caggactacaaaacacaaaaggatgcagtactatttgccattgatgtgagcaaatcgatgttgaaaccaccgcagaatacgggggataagaaagccgacaaggactctgccctgacagcagccctgacctgcgcctaccaaatcatgcagcagcgaattatctcccagcccaaagacatgatgggtgtgttgctctttggaaccgaaaagtccaaattccgcgatgattcgggcaatggcacaggatatcctcactgctatctgctatccgatctcgatatacccggcgccgaagatgtcaagaagctcaaggccttgatagaggatggcgacgatgaagacgaaatcatggttccgtccaaagaacccgtcatcatgtccaacatgctcttctgcgccaaccaggtcttcaccaccaacgcagccaactttgggtcccgtcgcctgttcattgtcaccgataacgatgatcctcatgccggtgataagcaggcaaaatcatctgccgctgttcgagccaaggacctttacgacctcggcgttgttatcgaacttttccccatcagtcgggaggacaagaagttcgacctgtccaagttctacgacgtaaggaagcgtgcatgtcaagttactgaactctacgctgatgttgtataggatattatctatcgcaatccggcagctgaagctggacagtcagaaagtcccaagacttccaagtctggcgacggtttgacgttgctcaactccttgatctccaacatcaactcgaagcaaaccccgaagcggtcctatttctcaaacttgccctttgagcttgccccagggctcactatctctatcaaagggtacatgccactcaacagacaaacccccacccgctcatgctacgtatacgaaggagaggagcaggctcaggttgtccaatcggagaccgcgcaggttgattttgctgcccgaaccgtcgagaagtcagaactgaggaaaggctacaaatttggcggcgagcatatatgcttcaaacccgaagagctggcggaacttaaacagatgggcaagaaaacacttcgaatcattggattcaagaagcggtccaagatcccgtcctgggcttcggtcaaaaagtccatattcatatttcctagcgaggagcaatatgtcggctccactcgcgtgttctctgctttgtggcagaagctcctcaaagatgacaaggtgggcatcgcctggttcgtcgcgagggagaatgcccatcccgtcatggtagccatatttccttccggaaacccggacgacgaggaggcaaacacgccgtacctacctgcagggctttggctctatccacttccgttcgcagatgatgttcgaagcgtggaccacgtaacagcgcctccaaggcccgcagacgaacttacagaccagatgaggcaagtcatccagaacttgcaacttcccaaggctatgtatgacccgcgcaagtatccaaacccttcactgcaatggcattacaagattttgcaggccaaggcactcgacgaagaaacccctgatgctatggacgatgtcacgttgcccaagtacaggcaaattgacaaaagggtcggcggttaccttgctgaatggaaggaaatgcttgcaaagaaagccaatgatcttcagaacaccagagcattcaagcgtgagttcgaggaagatgacgaaaggccggcaaagcgcgcgaaaccaagcaaaaaggctgccagtggtggtggcggaccggccaacagcaacgcagacctgaagaaagcattcgaacagggcacgcttggcaagatgacggtagctgagctgaaggacattatggcaagcaagggcataagcacggccggtaggaaggctgagctagttgagagacttgaacaatgggttgaggag

SEQ ID NO: 27211 - DNA, 1369 bp, Neurospora crassa
tgtgcaaggccgcgaggtcttcgagcttccggccgtcgttcagatgcgctcagcagcagacgaggtggctcgccacgccgacaactcaccccgtcacccagaagaatgtcggcacagcaatggtcttcctcaacatgggcggcccatccaccttggatgaagttggagactttttgagcagactctttgtatgtttttgaatcatgatgatggcgataccctgtgtgtggctcgccattttcatattgaggctgtttgtgttgaccaacccgtgcaggctgatgccgatctcattcccctgggtcggctccaaaactacttggggcctttgatctcgaagcgccgaactcccaagattcagaagcagtatggtgcgattggcggcggttccccaattcgcaagtggtccgagtaccagtgcgaagaaatgtgtaagattctggaccaaatctcgcccgagacggcgcctcacaagccttatgtcgctttccgctatgccaatcctctcaccgaggagatgtacaagaagcttctggccgatggcttcggaaatggcaggggcggccgggccgtcgctttcactcagtacccccagtactcctgctcgaccacgggcagcagtttgaacgagctatggaagtggaggcaaagactggagggcaaggctgggccatcagaggatggcaaggacggtaccattcggtggagtgtgattgacaggtggcctactcaccctggccttgtcgaggcctttgcgaggaatatcgaggagaagctggccgagtaccccgaggagcgcagaaaagatgttgtgttgctgttctcggctcacagcttgcccatgtctgttgtcaacagaggtatgccgatctcctctctattgaccttgcaatgggatatactaataacgcctaccttaggtgacccttatccccaggagattggcgcaaccgtccaggcggtgatgcagcgtcttaacttctccaacccttacaggctatgctaccagtcacaagtcgggccccagccgtggctcggtccccagacgcaaacctctgtggaggagtacatccacaagggccagaaggacctcgtgttgatcccaatcgcctttacgtctgatcacattgaaaccctttacgagcttgaccaggaggtcattggcgagtctggacatcccgacacggtcaagcgcgtggagagtctgaacggtaaccccgtcttcatcaaggccctagccgatctcgccaaggagcatcttgatagcggacttgcttgctcgcaccagaacagcctgagatgccccggctgcaagagcgagaggtgtgcggcgtccaagaagttctttgctggacaggagatcctccct

SEQ ID NO: 27212 - DNA, 1329 bp, Neurospora crassa
cgaaacattgtccgaaggaagctgacgggatacgttggtttcgccaaccttcccaaccaatggcaccgcaagagcgtccgcaagggcttcaacttcaatgtcatggttgttggtatgtgacgctttctgtgtccattgaaggagatttactaattctagacatgcaggtgaatcgggactcggaaagtcgaccctcgttaacactctctttaacacttcgctttaccctcccaaggagcgcaagggacctagcctcgacattgttcccaagactgtcaccattcagtctatcagcgccgatattgaagaggctggtgttcgcctccgtttgaccgtcgttgacactcctggcttcggcgactttgtcaacaacgacgagtcttggcgtcctattgtggacaacatcgaacagcgcttcgatgcttacttggatgccgaaaacaaggtgaaccgcatgaacattgtggacaacaggatccatgcctgtgtgttcttcatccagcccaccggtcactcgctcaagcctcttgatatcgaggtcatgaagcgtctccacaccaaggtcaacttgattcccgtcatcgccaagtcggatactctcaccgatgacgagattgctgctttcaaggctagagtatgtcttcgggccctactggttctgcgatcaatactaacagtttatcatagattcttgcggatatcaagtaccacaaggtgcaaatctttgagggccctcgctacgaactcgacgatgaggagaccatcgcggagaacaacgagatcatgtccaaggtccccttcgctgttgtcggtgcgaccaacgagatcacaaacgccgatggccgtaaggttcgcggtcgccgttacccttggggtgtgatcgaggtggacaatgaggagcattgcgactttgtgaagctccgccagatgctcatccgtactcacatggaggagctcaaggagcacaccaacaacgtcctttacgagaactaccgcacggacaagttgatcgctatgggcgtctctcaagatccaagcgtcttcaaggaggtgaacccagccgtcaagcaggaggaagagcgcgccctccacgaacagaagcttgcgaagatggaagccgaaatgaagatggtcttccagcaaaaggttgctgaaaaggaatccaagctgaagcagagcgaagaggagctgtatgctcgtcatagggagatgaaggagcagctggagcgccaacgactggagctcgaggagaagaagtcccgaatcgaaagtgggcggccaattgagaaggagccgacaaagaggaagggattttctctccgataattt

SEQ ID NO: 27213 - DNA, 1411 bp, Neurospora crassa
tctttggtggatagggcgatcgctcagctgcgagcatgccggccaataccagaatcagacgtccgcgaactctgtcacaaggcccgggaaatcttgatcgaagaaggaaacgtagttacagtcaatgcgccggtaacggtacgtctcgaactatccagatcgaaatacacacatgtcgaatctaacccaacggcaacaagatatgtggagatattcatggccagtttcacgatttgatggaactgttccgcgtcggcggcgatcctcccgataccaattatctgtttatgggtaaggctgtccctggtctgtcaatcatgtcgtcaaaatcatgttaagctgactattgtattgtcggatgttgataggtgatttcgttgaccgtggcttctactcgctcgaaacattcttacttcttctctgccttaaagttcgataccccgaccgcatgaccctcatcagaggcaaccacgaatcacgacagattacaactgtgtacggtttctacgatgaatgttacaggaaatatggcagcgcgaatgtttggcgctactgctgcgatgtgttcgactatctcgccttgggcgctattgttcttggggcctccaataccatctcaccaagcgccggcgagtccagtataccaacaacacctgaaggaggcgaggtggaaatcgaggtgtgcaacgcacagggcgaggtaatgagcaggtttcctcggcctaacaacggggcagacagcgatgtacagagcaggaccaacgggataccaccaccgagtaatacaggcccgcctggctcaggagcgtcgggattgagcagaggatcagtgggcaacccagccggcgccgttctatgtgtgcacggcggccttagtccgctgatagacaaggttgacaaaatcaggctgctggaccgaaaacaggaggttccacatgagggtgctatgtgcgacctcttgtggtccgatccggacgagattgacggttgggggttgtcgcctcggggtgctggcttcctctttggtgccgacatcgtcaaagtgttcaatcatcgcaatgacctcagcctgatcgcccgtgcccatcagctggtcatggaaggttttaaggaaatgttcgatgccagcatcgttaccgtttggtcagcaccaaattactgctatcgctgcggaaacgttgctgcacttcttgagctatcggaagacgattcaggcttgggtgtgcttgcccgcagtaatggcgatgtcaatcgcagtaatggcggtgcaggatcttctggagggcttggagagggtgagctacaaccgatgaagggtccagcaaggcgttaccgggtcttccaggcggctcctcaggattcaaggggaatgccagccaagaagccagtggccgactacttcctgtaaacc

SEQ ID NO: 27214 - DNA, 2676 bp, Neurospora crassa
gccgacgatgttgatccagcaaaggctaccaaggccgatctcttcccctatggcgttgctgctaagatcaccggcgtcgaggggcgtggtaccggcgagtttaccttgctggtcgagggtgtgacacgaatccatgtcgaaaaggttatctcggacaaggcttatctggaaggcaaggtctcgagttacgccgatcccgctctaatcacagacgccgccctcgaggagctgttcatgtctctcaagcttctgtccaggcagtttgttacgatcctccgcctgtcctcacttctgccacagtcttctggcacgcctggcctctcacctctgcttgctcggcgcctcgacttctacatcgcaaagcagaagtatcccggtgccctcgcagactttatggccaacattgtcgaatcttcatatgaggaaaagctcgagatcctgactttgatcgacgtcaaggaacgtgtggccaaggttattgagctgcttgaccgccagataacaaacatcaagaacagcatgagggtcaccaccatcacagccacgaccttgccattcccgatggaccctgatgcggcgaaacatggaaaaatcaagccgcctgtaaaggctccagggcatggcgcaggaatgccgttttcaccacagggcggtttcatgggacgaggtggaaatgcggatgaagatcaggagcccaacgagattgaggagctgcagaaacgacttgatgccgcacgactcagccctgaagctgccaaggtcgctgaccgggagatcaagagactgaaaaagatccatcccgcacaggctgagtatgctgtgactcggacatatcttgaaactttggcagagatcccctggacaactactacggatgatcgcctaggtcccgatacgctgaaccgggcaaggaagcaactcgacgaggatcactatggactagacaaggtcaaaaagcgcctgctcgaatatctagcagtccttcgcctcaagcaagccatcaacgatgacgtggacagccagattaaacagctcgaacaggaactcggggtagcatccgagagcagtaaagaagacgctgctcaatctacccctatcgaccttggtgttgatgaaaaggccaaggccggtggagacaagcttgaggctttgaagagcaggcgcatggtggacaagtctcccatccttctccttgtcggacctccaggcgttgggaagacgagtcttgctcgatcagtcgccactgctttgggaaggaaattccatagaatttctctgggtggtgtgagagacgaagcagaaatccgcggtcacagacgtacctatgtcgccgccatgccaggtcttattgttcagggtttgaagaaagtaggcgtagcaaaccctgtcttcctccttgatgagattgataaggttggcggctcaagcattcacggcgacccttcggcggctatgctcgaggttctcgaccctgagcagaaccataatttcaccgatcactacgtgaacgtgccgattgatctcagcaaggtgctgttcatcgccacagcgaacagtctcgacaccattccggcaccgttgctggatcgaatggagacgatctacattccgggctacacgactctcgagaagcgccacattgcgatgcggcatttagtccccaagcaactccgggtcaacggccttgacgaatcacaggtttcctttaccccagaggtcgtgtccagaatcatcgagtcgtacacgcgggaggccggcgtgcgcaacctagaacgggagatctcgtccgttgcgcgtggcaaagccgtcgagttcgccgacgccaaggactcgggacaccctgagaactacaacccacagctgaccgtggatgacctggagaagtttttgggcattgaaaagtttgaagaggaaatcgccgagaagactagccgtccaggaatagtgactggtctggtagcgtacagctcgggtggaaatggtagtattctctttatcgaggtggccgacatgccaggcaacggcagcgtccagctaacgggcaaactgggtgatgtgttgaaagagagtgtcgaggtggccctaacttgggtcaaggcgcacgcatatcagcttggactcactcagagcccgagtgagaacattatgaaggacaggagcattcatgtgcattgcccctccggtgccgttcccaaagatggacccagcagcggcatctcgcaggcaatcgctctcatttctctgttttccggcaaggctgtcccaccaacaatggccatgacggtaagtatttcccaatcccattacttcggtcccctcacccccttttagttccattacttgtcttttgacttttccttctcttgggactcgaaacacaacgaaagcagggcaaggcaaagcggatcttacgtccgtttgactttcccgatatggataagaggacgaaataccgtgcctccatgttatgtgtgcaaggctaacacggcgtttgtttctgtgtcacagggtgagatttccctccgaggacggatcacggccgtcggaggcatcaaggagaaactcatcggagcgctccgggcgggtgtcaagacagtcctactcccagcgcagaaccgcaaggacgcaaaggacttaccccaggaagtcaaggatggattggaaatcatccatgtc

SEQ ID NO: 27215 - DNA, 1782 bp, Neurospora crassa
atgagtacccctcagaagactgccggaggcaacaacgcctaccacaacttttacaatgactttcttcacatcaaggatcccaacgagaggcgacgactcgccctcgccgaagtcgacagagcgccattcggatggtatcacgttcgggccgttgccgttgccggtgtcggtttcttcacagactcttacgacatcttcaccgtctctcttttgaccctcatgctcggcattgtctacttcccaggcgaaggcaagatgcctacaacctccgacacagccatcaagctcgcaacatcggccggcacggtcattgggcaggtcggcttcggcgccgctgctgatgtctttggtcgtaagagcatgtacggattggaattgttgttcatcatctttgccactctcgctcaggccttggcctccgggtcaccttccatcaacatcatcggtatcattatcttctggcgtgttcttatggtaagcaattattcagacgaacccctctcacaagaaacgtataactaacatctattacaacagggggtcggtatcggtggagactatcctctttccagtattatcacctccgaatttgctacaaccaagtggagaggtgccatgatgggtgccgtctttgctatgcaaggtcttggccagcttgctgccgcattcgtcatgttgttcgttacactcggtttcaagaagtcgcttgaggccgcccctactctggcttcgtgcaccggagactgtgccgttgccgttgacaagatgtggaggacagtcattggtgtcggtgctgttcccggctgcatcgcgctctactaccgcttgactatccccgagactcctcgctacaccttcgacgtcaagagggatgttgagcaggccagtgacgacatcgaagccttcaagacgggcaagcccaagggccagcccgacgaggccacccgcatcgtcgctaagcaggaggccgaaaaggagatggagatccccaaggccagctggggcgacttcttccgccattactccaagcgcaagaacgccatgctgctcgccggcaccgccctgtcttggtgcttcctcgacatcgcctactacggcgtctcgctcaacaacgccaccatcctcaacgtcatcggctactccaccacaggtgccaagaacacgtacgagatcctctataacaccgccgtcggcaacttgatcattgttctcgccggcgccgtccccggatactgggtcaccgtcttcaccgtcgacactgtcggtcgtaagccgatccagttcatgggcttcggtatcctcaccattcttttcgtggtcatgggtttcgcctacaagcacctctcgcctcacgcgctgctcgccattttcgtccttgcccagttcttcttcaactttggtcccaacgctaccacctttatcgtgcccggcgaggtgtttcccactcgttacaggtctacctcgcacggcttgagcgccgccatgggcaagatcggctctatcatcggtcagggcgccattgcgcccctgcgtaccaggggcgctgtcaagggaggaaacccaaacccgtggatgaaccacgtgttggagatctatgctctcttcatgttgcttggtgttggtaccactttcttgattcccgaaacgaagcggaagacgctggaggagttgtcgggcgagttcgatatgagtggtgaggaggaggcgcagagggatacgaccctcactgagcataagacggaggcacccacgagtagtgctgctgtgaacgcttgaggaggt

SEQ ID NO: 27216 - DNA, 924 bp, Neurospora crassa
gccaaaaccgttgtcgcaccgcttgatcgggtaaagatcctattccaggctcacaatccacacttcgtcaagtacgcgggctcgtggtggggctttggggaggccataaaagaaatatatcgacaggatggggttaagggtctgtttagggggcattcagcaaccctcctaaggatctttccgtacgccggtatcaagtttctagcctacgagcaaataagggcactcgtcatcactcggaaggaccacgaaacccccctacggcggcttgtgagcggctcgctcgccggcgtcacgtccgtcttcttcacctatcccctcgaactcatacgagtacggctagcgttcgagacaaaacgggaaggccggtcatccctccgatccatcattaggcagatatacagcgaaaatgccctcacggttcccaaaaacgcaccggcttcagcacacgcgcccgctctgatcccgcggaccgggctcgccaacttctaccgcggcttctctcccaccctcctcggcatgcttccctacgccggtatgtccttcctcacacacgacacggttggcgacatcttccggcacccgagtcttgcaaaatggacaacactaccgcaaccggaaaacgcgccggccggtaaggctgcccccctgcgctcatgggcggagcttacggccggtggtatcgcgggattggtctcgcagacggtgtcgtaccccctggaggtcatcaggcggcgcatgcaggtcggcggagcggtcggcgatggtcataggttgaccattggcgagacggccaagctgatcatgcgggaacggggggtccgcggcttctttgtcggcttgactattgggtatgcgaaggtagttcccatggtggctacgagcttttacacctatgaaaggttaaagacattttttggcatc

SEQ ID NO: 27217 - DNA, 2974 bp, Neurospora crassa
agctcctcggcagcagatccctttgccgccaggctcaacagtgatgtccgccaacggcatcctaccgcatcggcgaccagcaagaatgtagagggcacttcgcagcagaagcagcagcagcagcagcagcaatcagaggccaatgccgctgcgtcaagggtcaaaaagacatacggcaaaacgccagatggcacaggtaaggaaatacttcggcgtcttgtcttcaatgtctacagccgagttagacttgggatgaactaacacaacccctcccaatgtttagtcttcgtcgtccccacgacccatgacatggtcacccagctgctcgaccctcgcgagcccaagaacttatcagatgtcgccgtgctcgccatcatcgctctacacttcctcgccgcttactacctgccgtggggtgtcaagaggcctctctttgccgccatcttcatgttctggagattggcttacaacgtcggcattggttacctgttgacgattcagtccaagtacaagctcctggtgacttgggccaagaggtggaagctgtttgagaaccccgcgactggcaagaacccgcgcccatggctttacaatctactcaagaaggaactcgagaccaagatccctcaggactacaagtttgaagaagctccgatcgagtacaacacttggctcaccttccgtcgcgtcgtcgacttgattctcatgtgcgacttcatctcctactgcctgttcgctatcgtctgcgcgcacaagccggacggagagggtttgttcatgtgctttgcccgttgggctgctggaatcacgctggttggcttcaacctatgggttaagctggatgctcatcgtgttgtgaaggactatgcttggtactggggtggtaagtcaaactacttccgccaactctcgcaagacacgggaactgaccatattagacttcttctacctcattgagcaggaactgaccttcgacggtgttttcgagctggctcctcaccccatgtactccatcggatacgctgggtactatggtatctccatgatggccgcgagctacgacgtcctgtttatctccattatcgcccatgccgcccaattcgcctttttggtaatcgttgagaatcctcatatcgagaagacctataacccgcctcagccacgtgtgaggtgcgagtcggaggctggtagtcagttgcaggagtttgcttccgagtactctgtcccttccacaaccggaagacatgacaataccccgctgcccgtccacaacctcatcggtctcaagaacctcgacttcttccgtatcacggacgttgccatcgtgctcctctgtgcttaccttgctgtcgtcactatggtcactcccaacacccgcttttaccaagcccttttcgtgttgcatgctttggcttggcgtttgtggtactctgccggtttgggagtgattttgaccatgcagtctgaggagaagatgttcactaggcacttcttgaagtacggcgagagcgtgggcgaggcctggcgccagtggaagggcatctaccacctgagcaactgcctctgccatgcctcctttatcgctgcctcttacaagatgtatgaatttcccgccgattggacctacggctgggcgcttctcaagcacgtcgttggcctgagtttgattgccctccaggtctggaccgccaccagcatctacgagtcgctaggcgaattcggatggttttatggcgatttcttcttcgacagcaagaggcagctgacttacacttctatctaccgcttcctcaacaaccccgagcgcgtctttggtactgctggcttatggggcgctgccctgatcacctggtcccgcgccatcttcctcatggctcttgccggccactttctcactcttgcgttcctcgcgtatgttgagaagcctcacatgcaaaaggtctatggccgtaatctgcgtgatgatgccggcgtcaccaagttcatcaagcgttctctacctccccctgttactgagtggcagcagagtatcgacaaggtcctggatgagacaaagcacttcatcgacgagttcgtagatgctgctcgctccagactcgccactggatcatctaccattgtcaaggatacttcagccctgttcaacaaataccccgctcgtctcactctcagcaagatttcacccgaccttgcgggctacgatcccaagcattatggtctgtctctggctggtacacgtgttgtgggcacgaatgaaaaggccacgggcaaggaaagccccaacgcccgcgtactgaaggacgtcaagacccaggcgttcgagtacggagccccgattcgcgtcaagtggactgcgcccgccaaccacagcaagaaggactgggtcggtctctacatggtcacggacaatcgctctagggaggtcaccgaggttccatctcttggccgttgggtaccaaccaaccctggggagtacgacaccaccaccgaccagggtattctcgtctgggaccagcctgtcgagaagaagtctgaggatacagatctcgtcgagggtgagatggtcttcgagggtgacaagctttggtggacacagggtgtgttcgaattccgttaccaccacggtggcggacaccacgtcatgtccatctcggagcctttcgaaatccagattcccaagttcgacgacgagcacatgggcgtcgatatcagcggagaagttggtgagcgcgccgttgaggcagctctcctgccagtcatccgtaactgcctggaccgcgaccccgatattgcgcccagcaatgcggaagagcgtttcggcggccatgtcgaaagggatggcaagtatgccaggcgtgttgtgtacgctattcggcatatgttcggtatcgactttgcccctgcggttgtgcttgcggacggaaacgtccgcaggttggcttggaggatatgtcacgccaaggaagttctggta

SEQ ID NO: 27218 - DNA, 988 bp, Neurospora crassa
cgcctcgcgggcaagaccattgtcataaccggagcgtcctcaggaatcgggcgtagcacagccttcgagtttgcgcggaccgcgcccaaccacggcctcaagctgatcttgacggcccgccgcgtcgatgccctggagcagattgccaaggagatccgccaagaggttggcgagggcgtgcaagtgctgcctgtcaagctggacgtcagccagccggaggaggtcagggggtttgttgggaacttgcccgaggagtggagggatatccatgtgctggtcaataatgcgtgagtttctgtgaccccgtcggatgataatgatcaaggagaatgagaagaagggaaaccaaaatacgatttaaaaaaataaaaataaaaagaaacaaaaatggctaatgaaaaatgatatatgtatagtggtctcgtaaaaggaggtttgtgctgctccctaacctaactaacctccaaaacctcacttgaaaagctactgtactaaccctccgaaacaattaaaaacaaaaaaagtcgcccaagctccctccatcgccgaagaagacatcaacgtcatgtttgccaccaacgtcaccggcctgatcaacatgacccaagccatcctgcccatcttcaaggcccgcggctccgagggtggttcgggagacattgtgaacatcggttctattgccgggagagaaccatacgcgggaggctccatctactgcgccaccaaggctgctgtgcgcagcttcaccgacgcgctgcgcaaggagctgatcgccacgcgcatccgtgtcatggagattgaccctggccaggtcgagaccgagttcagcgtggtgaggttctatggtgataagaacaaggctgatgccgtctatgccggtgtcgatcccttgacgcccgatgatatcgcagagatcgtggtgttcgtcgtaacacgacgggagaacgttgttgttgctgatacgttggtcttccctagccatcaggta

SEQ ID NO: 27219 - DNA, 1068 bp, Neurospora crassa
gatcgcgaggccgtcttccccacacggcagtccttgggtattatgaaggccaaactcaagggcgccgagacgggtcacagcttgctcaagagaaaaagtgaagctctcaccaagttcgttgttcccctcccggcccatgtccatccatacctttacacagagcttgatactgacatattgatttcactcaacaggcgtttcagaggtactagccactctcgcacacaccagatatccgcgaaatgtagacactctaacacacctgtctcctcacagagattacccgccgaattgacgaagccaagcgcaagatgggccgcgtcatgcagatcgcttcgctctccctcgccgaagtcacctacgccgtcggcggcaacattggataccagatccaagagtcggccaagtcggcgcgattccgcatccgggccaagcaggagaacgtctcgggtgtgctacttcccgccttcgaagcctaccaggccgagggcaacgacgacttcgccatgacaggtctgggtaagggtggtcagcaggtacagcggtgtcgtgagacgtacgccagagcggtggaggccttggtagagctggctagtctgcagacggcgttcgttatccttgatgaggtcatcaaggtcgtcaaccggagagtcaatgcgatgtaaggcgaaccaaacctgtcttccctgcaagatagaatgggggacactaacacggagtttctagtgagcacgtcattattcctcggaccgaaaacaccatcaagtgtaagtagatgtaaaccccaaggttccggcactagggtagattactgacagctattatagacatcaactcggaactcgacgagcttgacagagaggagttctacagactcaagaaggttgctgccaagaagcaacgagacaatgcggaaactgacgctcagatgaaagcaaagaaggcagagcagcagcggctagcccttgcagactctgagaatgctgaaggtgaacaaaccgaaaacacccctgccgatatcttggctgccgaggaggacgaagacgtcatcttctagtttgatgtcaa

SEQ ID NO: 27220 - DNA, 1556 bp, Neurospora crassa
gaagcaatgacagggcgatggggtgttatcttggacgccgggtcctcggggacacggctacacatatatcgttggaaggatcccgagaaggcgcttgtagatgcgacgcccgaggagttgcgcagtctgcccaagatcacgacgaaaaagaagtggacaaagaagattagacctggaatatcgacatttggggagaaggctggggtagtcggccaagattatctgaaggaactcatcgaccatgcgctcgacatcatacccgcggacaagatccacgacacccctattttcttaatggccacggctggcatgcgacttcttccccaggtccaacaaaatgctataaccggcgctgtctgcacatacctgcgcaagaatacgaacttctcacttccggattgcgacctacatattcaggtcattccaggcgaaacggagggattgtatgggtggattgcgtctaactatcttcttgggggttttgatcatccagagcaacatgcgcatggacaggatcatcacacatatgggttcttggacatgggaggcgcatcagcgcaaatcgcatttgcacctaattcaacagaagcccaaaaacatgcaaacgacttgaagctcttacgattacgcacactcgatggatcgccagctgagtacaaggtgtttacgacgacatggctagggtttggcgtcaaccgggcgcgggaggcgtatgtacaaagcctctcagacttgtacaccacttccgatgccggagaactccccgatccgtgtctaccaaaggggctcaggttgtcactggatggaactccagtttcgaaaccgaagaagggcgagaccactctaattggtacaggcgcttttgacgaatgccttaggaagacttatcccctgcttggcaaggacaaaccatgtgcggatgacccttgtttgatcaatggtcagcacgttccagccattgactttgacgtcaatcacttcgttggagtctccgaatattggcacaccacacacggtgtctttggtggtaaggaaaatgaggcatacgacttcaccacttaccaaaagcgggtcaaggatttttgcggccgagactggaacagcatcgaaccaagcctggatgcccacaagaagtttgcggtcaaggatgctcaagaagcttgtttcaaagcttcctggcttataaacatcctgcatgagggtattggtgttcctcgaattggtgtcgaagaacttcccgctccgggcctcaacgcctcgaagggcgccatcgagacggccaaacagaagggtttcctagatccgttccatccggtggacaagatcgatggcattgaagttagctggacacttggcaagatggttctctatgcagcaggccaagtacctcccaagacaggtgacgatcgatttcctgtcggctttggtactaatatcccttctgccggggcaaccgagctaccacctgatttccagtacgcaggttcgacgtggacaccactcagcggcggagccagccacaacgactcgccctaccgtccggccgtcaatgggac

SEQ ID NO: 27221 - DNA, 3337 bp, Neurospora crassa
gcagtcgacccggtctccctcgtcatatccgagtgtattgcgatcacgtccgctattcagaaacatgcccgctcgccgcattcgtccgtgtcagccatcttggggggcagcccgaacctgatccagctggttcccccttcaggcccggctctgcgtcgcgatcagaagaagatggctgggtcctcggccgctgatgactccagtgacttggctaccaaccgatggggcttaagggggaagaaagggaagagcatattggacaatccgctgatatcaggcttcggaaggcttcgacaggagttgacgggcgtcaaaggtagctatacagacgacgctgttgctcgcgtcatgtcaatggaaaggcagaaaggcctccaatgatcaaacttttgggctaatcgcatactcacagatatccaccagttcgatgccctagtcctactctacccgttcctccagattatacaagccaagggcaccgccgctccgatcacgattcttgcgctccgtgctatccaaaagtttctgtcctatggcttcatcgcgccccaatctcctcggttcgccctggccatgcagtctctctctgcagccatcacccactgccagttcgacattagcgactcggcgcaagaggaggttgtcttgctcatgatattacacttgatggagaacatgctggctgggcctggcggcgacattctgagcgacgagagcgtctgcgacatgatgggtcggggtctcaccatctgctcccggtcgaggttctcggcggtgttgaggcagacggcggaagcgtctatggtccgcatgtgtcagatcatctttgaggatctgaagcacttggaggtggaagctggcgaggagagcgaggcactagaccggcagactagcggcgatatggatagtgttaagctggaccctgtcgccaacggaacggacgtcccggtcactccagtggctacggagctgctagtagcgcaggggaacgaaaggccgggaacggctacgtcttctgctgatccgcggccttctacagctgttgagacggaaaatggggatcgcagcagcactgcgagtgcagcagacgctcgtcgcagcagcaccagctcgggaactgggagcactgcgtccattgatctccgcccttactcactaccatccgttagggaattgttccgcgttctcgtgagcttcctcaacccccatgaccgtaagcatcctgatcagatgcgggtcatggcgctccgcatcatccatgttgctcttgaggttgctggtccatccattgccagacatcccgcgctcgccaccattgcagaggaccagctgtgctcctaccttttccagctcgtacggtcggataacatggctgtcttgcaagaggcgctggttgttgctggtactctgctctcaacttgcaggggggttctcaagctccaacaagagttgtatttgtcatacttggtcgcttgcctacatccagccgttgaaatccctcgggaacctggcattgacccaagtctctattcgggtattcctcaggcacccaagcttgtcaagccgccaccatcacaggccggtagtggccggtcgacgcctgttccagtcaaggaccgccagaaactgggcctcgaaggaggcgcccgaaaaccagatgccagacaggccatggtagaaaatattggtgttcttgtacgaatgccaagcttcatggtagaactgtttgtcaactacgactgcgacgaagatcgggtggacctctgtgaggacctgatcggactgctagcaagaaatgccctcccagactcggcaacgtggagcaccaccagtgttccaccgctgtgtctggatgcgcttcttcgttttatccagtacatcgccgagaggctggatcaggcgccggaaacggagggtcttcccgacccagaagaactgagggaaaggcgggcgaggaaaaaggtgatcatcaaggggacgaacaagtttaatgagaaccccaagggaggcttggcctacttgaaagaaaaagggatcatcgccagcgatactgaccctgtgtgcgttgcgacgtttctgaaggggacttccagggttaataagaagatgctcggcgagttcatttcaaaaagaggaaatgaggcgatcctggaccacttcatcggtatgatggatttcaccggcaagcgtgtcgatgaggcgctgcgagttctcttggaaaccttccgtttgcctggtgaggcacagctaatcgagcgcatcgtcacctccttcgcagaaaagtactgcgccggtagtactcctgaagacgtggcagataaggacgccgtctacattctcacgtatgcgatcatcatgctcaacacggatcagcacaaccccaactttagggggcatgctcgcatgacttatacagactttgcccgcaatctgcgcgggcagaacggcggcaaggatttcgcacccgaatacttgcaagacatatatgatgccatcaagtccaacgagatcattttgcccgaagagcacgataatcaacatgggtttgactacgcatggaaggagctccttctcaagacggagtcggctggcccgctggtcctctgtgacacgaatatttacgatgccgatatcttcaacacgacgtggaatgccatcatctcttgcctgttctttgtcttcatgtcggcaaccgacgacacggtgtatgccagggttatcaccggcttcgatgagtgtgcgcggattgctaccaagtatggcaattcagaggcgttggatgagctcgtctaccgcctgagcttgatctcgacgctgagcagcgagtcgctgtccaacacacagctcaacaccgaggtccaggttggcgagaacagcgttatggtgagcgagctggcggtcaagttcggtagagatgttcggccgcagctggctacgcttgtcctgttccgcgtggtgacaggttcggagcatatcattcggaatagttggaaatatgtgagtgttcctggctgagtgagggaagtgttttgatgctaatcgtaaacagattgtccggatatggctcaacctatttgttaattcactaataccgcccttcttctcgacggaaccagaccgacttgctttgccagcgataccgctgcagagcccctccaacgtaatcgaccggcagaaacagaacgaaaccagctttttctccgctttcacctcgtacatctcgagctatgcggcggacgacccgcctgagccgtcggacgaagagctggagagcaccctttgcaccgttgactgcgtcaatcagtgccacattggcgatgtttttgccaacatctcg

SEQ ID NO: 27222 - DNA, 1653 bp, Neurospora crassa
caagcagtcatggctgacagcgcagtcttcacggaccagagcatcccgctcaacgcggtcgaggcccagctcaagggtctcctcatcgacgttgccaagtacattaacgagtctcaagaagccgccgaaggagagaaggagggcaagaacgtcaacgagccggtgattctccgatgggcaggcggctgggtccgcgacaagctcctcgggaccgaaagcaacgacatcgatgtggctatcaacaacatgacaggcgaagccttcgccctgcgtctgcgcgactactgcgatgccgacccggcccatcgggagcgccactccatcggtcccgccgacgtaggcaatctgcacaagatcgcgcgcaacccggacaagagcaagcacctggagacgactaccatcaagcttttcgggttggacgtcgaccttgtcaacctgcgcaaggagacgtataccgaggatagcagacacccgcaggtcgaatttgggacggccgaggaggacgcgctgagaagggatgcgacggttaacgccttgttctataacttgcacactggcaaggtggaggattttacgggtgggatgaaggatatggaaaggaagctgatcaggacgccgctggagccgcttcagacgttcatggacgacccgctgagagtgctgaggctcatcagatttgcgtgcaggcttggctttacaattgacgaggagacaaaggcggtcatgggtgacgagagggtgttggaagctctcaagctgaagattagcagagagcgagtcggtgtcgagttggagaagatgctcaagggtaagtcttttcttttcctctcctccaactacaatctttctaccaaatgttaacaccacctactgccaggccccgaccccttctcctccctaacctacatcaacaacctctccctctaccacacgctcttcaccgactccgcccgctcggacttcccgcgccctccgctcacctcctggcccatcgcctaccaaaccctccactctctctccaccaccctcgctaccccaggctccatctactccctcctcgtcacctctccagaatccgcctacttcgcctggaacctcgccgccctcgtccccttcgcctctctgcccgacgaccctccccttaagggcggcaaacctgccccgccgctcgccacccaggcggcccgcgaaggctaccgcgcgcccaacaagctcacggacgtaatcacggcgtcgcacagaaatcgcacggcgatcctcgctatgcgcgacttggtcgttcgtcctgctgctggcgatgaggggaagaagatggagagggacaggttgggcttggcgatccgggagtgggattcgagaccgggcgcaggcgccaactggcgactgcaggttttgtatgctgtgctcgtggatgttgctgagcggaccactagtgaaggtaaagagacggtggaggatgtgctaaaggagtggcaagcctttttggatcatctggtagaaatggacctgatggatgcgccgagcgtgaagcggatcattgatggcaagcagctggcaaaggcactgggggtcaagccagggaagtggatggggcaggcgctggaggtggtgatggcgtggcagttgaggaatccgacggttagtgatccggag

SEQ ID NO: 27223 - DNA, 3304 bp, Neurospora crassa
ctgcagatccaccagatccaatctggtcaagtcatcgtcgacctttgctccgtagccaaagaactcgtagaaaacgccctagatgctggagcgacgacaatcggtacgtcgcaagatatctgtccatgcgaggtatgaacagacactaaagaaatcaccagatgtccgatttaagaatcaaggtctcgattcgatcgaagtccaggataatggcagcggaatctcatccagcaactatgaatccatcgcgctaaaacactacacttccaaactatccaactacgatgacctgtcaaccctacaaaccttcggcttccgaggcgaggctttgtcctccctttgcgccctgtcacacttcaccatcgtgacatgcacccagaaagaggcgccaaaggccaccaaacttgagttcgagacatccggaaagctcaagagcaccagtgttgtttccggtcagcgaggtacaaccgtctcggtcgaaaacctgttcaagagtctgcctgtccgccgccgcgagctcgaaagaaacattaagcgagaatggggcaaggtggttaacctgcttaaccagtatgcctgcattcaaaccagcgtcaagttcacagtgtcgcaacagcctaccaagggaaagcggatggtcttattctcgacaaagggaaaccccaccacccgagaaaatatcatcaacgtctttggcataaagacaatgactgccctgatcgctatggacctcaggctgcaattaaaacctaccaatactggactcctggccaagatgactgctcaggacgacgacgccatgaccgaggttcgtatttgtggacacatctctcgcccagctcacggagaaggccgccagacaccagatcgacaaatgttctacgtcaatggaagaccgtgtgggttgcctcagttcgccaaggtcttcaatgaggtctatcggtcatataactcgactcaatcgccttttatatttgctgatattcagctggacacgcacctttatgatgtcaatgtcagtccagacaagcgcactatcttgcttcacgatcaaggacaaatgctggataacttgagggagtctttgatagagctttttgagttgcaagatgtcacaatccccgtctcacacactcaactactcaaaggctcaaccttcagggggccatcaacagtccccttggggtcattgaccccggcccgagagaaagacagcagggatgcatcggaagaaccgggcagttctctgccttcaaatagacctgaaaacggaccacagggcaacagggcaactaggcatgctgtcaatgaggactcggatgaggccgtcagcgatgaggataacgcgccaaatactctgtctactggtccgaaaacgagggctgggccatgcgaatcaacacctgctaacacacaggcgtcaaacctactcgcccggtggcttgagcgaaagtctgaggcccgaaaacaaccggtttcagctgctatcaatgcgaatgacagcagaagggagaaatcgcctgtcgaaaaggagccacaatctccgaaaagggccagaagatatgacacaaaggatgccgagtcggacgccgaacaggatactgcagaagacaatgaacacgtggagaacaattcgatgactcaggacgtggtcgatgataaggaaatggatagacaagaactgacaatgccatccattccacccccaactcagccacctattccaaaagggagcctcttatcaatatcacgtccaccgaaaaggtcagcacaagaggaggtggcaacgatcactattggcggtcattccatcaccagcgtcattggttcgtccaataaaaggtcccgactgtcggagggcatgaggtcagtcagtcttgggagttccccaacgaaagggattaggaccgtgcccgtgccttctttcggtggccgtttgacccagctattttctgcttcgggtggtgcatctcgcggggtatcaaaggacctcgaaatgacgactgaggatgtggaaatggttgatgaggaagggaaaggggaggaaaacgaagagggtaacgaaacagagaaaggagtggattctgatgatgaagcacttttcgtgagccaaacgaaagatgtgcccgcagtcgagtatgatgatgttgacgaacaagctgaacactcaactcgtgaaaatagcccagctgatgaagagggtaatggtcccatcagtggccagaccaatcaaagtgtggcggagggcgatgataatggcgaagttgaactttcagaagatgcaccttccgagtgttgtcatcatggcgacgacgacgaggagtacattgatgaagacgagaagaaggctaaagaagagaagaaggtgcaagagatgatcaaagcagctgagaaaaaagcaaatgagcccactgaagagggcgaaaagcgatctcaaagttttgtgaaaggacgactgaaacgcaaagacttgactttcaaccttatccaacgtctaaagacaagcgaaggcgacatccgttctcgtatggaaatctgggcaaagcatctgccgagagcgggcacagcttcctcctctacacaagagagcagcgatgggaaaccaaccataggtctcgatgccgccgacgccgaagagaaactctcactcaaaatatccaaatccgactttgccaaaatgaaaatcgtcggccagttcaatctcggcttcatcattgccgtcagggaagcctcctcctctcattcattagagcattccccttctcaacaaagccccgctgccaccacccaagaagacgatgaactcttcatcatcgaccaacatgcctcagacgaaaagtacaactttgagcgcctccaatccaccaccaccgtgcaatcccagcgtctcgtccagcccaaaccgctcaccctcaccgccgtcgaagaagaaattatcctcgaacacctacctgcgctcgcggccaacgggttccaagtgcgcgtcgatacctcgggcgagtccgctgtcggttctcgctgccagctattatctcttcccctttcgcgcgagacgaccttcggcgtagcagatttggaggaactgatcttcctgctgggggataacccgacctcgagcgccaccaccgcgataccgaggccttccaaagtgaggaagatgtttgccatgagagcgtgcaggagcagcatcatgatcggacgggcgttgagtcggccgcagatggaaaaggtggttaggcatatgggcgagatggagaagccgtggaattgtccgcatgggcggccgactatgagacatctttgt

SEQ ID NO: 27224 - DNA, 1941 bp, Neurospora crassa
gcagaagttgacgtcctcaactcgcgcctcgaaaagacatcccaactcacaaagaagattcaggcctgcctggccaggctggatgccaccggcaagagtgttcgggatgttgccgggcctctcagtggcgagactaggaagcttcaagttctgggcaacagcaagtcatccggcccttcatccccatatcttgttcatcgttgactgaggctgaccgtcgaattactgtatgtagacatcgacgccgttatcgccgccatagaaaaactacgatcccccgccgacagtaagaatgacgaagaacaaatcatccgcatgggccctgaaaaggctggcctccccaactacctggcatctatcaagcgcctgaacaaggcattgaatgacatgaaggcttccaatcttcgatcaacgcagcagaccgtcgccgaccttcagcgtctagtcaagactggaaattcccagctcgagagttcattcgacaaactactacggagcgaaacaccccgagccatcgagcctctgcactatctcaccaagaacatgcccttcccggtgctctcccaagaaaagatcaccaggctaggtctcatgaactcgtacctaaccggggtgcaccaacagaacactggggcaggaagctcgcaagagtcgcccgtcatcaagatctatgccgaagtccgggctcagtacctgctatcaactttgggcaacctggctacggcaagcaccaacacagccaagaaaaagactccagaggcagtatacaaggcgggcaccaacggtatgggaacctacgcccaggccatggagggtctattcctagccgaatacgacaacatctgcagcatcttcatgagggaggactggggccctgtctttcaggcaacatgtcaaccagccctggtggagctgggcaggacccttcgggaactgaacagccacatcaagtcgcatatcaccacagactgctacctcgcatatgagatcgtcgagatcatttccagtctgtccagtaaccttgagaaccgaacgggcgagctgaagagctctcttgctgcggccctgaagcccatccgggaaacggccaaatcatcgctcgtcgacttgctcgaggagaccaagcgccaagtcaacagcctgcagacgctgcccgcggatggcgcgcccaccccgctcgcaacacaaaccatgcagcggttgcagtccatggtcaacttcttgcggccgatatccagcatcatgatttccattggcgatggcggctggaagtcggccgctgcgtccaaaggaggggctactgataccatccccagcctcgtttcgttcgatgtcggtgcggacgggcaagagatctttgcccactactgtgccgacaccatcgagaccctcctttcttcgctggatgcccgtgctcgtgtcctatatcagcagaagaaggcagtcattggtgtgttcctggctaacaatgtcaccgtcattgagcgtatgatcaacgaatctggcctggtaacccttctccagtctcgccttcaagtgctcgacgtatggagaaagaaagccactgctctctacaccgagacctgcaaggaaatcagtatccatctgtttgatacggtccataccaaccgcaccgcgcgcccgggttccggtcagggcatggtaagctcggcttcgatcatgaagggcctcagctccaaggataaggagaaaatcaaaggcatgtttacggccttcaattccggcttcgaggacatggttgcccgtcacaagcagttcaccatggagaaagaggtgcgccagatgcttgcacaggatgttcaacacatgctcgagccactttacaatcgattttgggatcgttaccacgagatcgacaagggaaagggaaaatacgtcaagtacgacaaagggtcgatcgctgctgttttccgcagtctt

SEQ ID NO: 27225 - DNA, 1551 bp, Neurospora crassa
ctcaatccaacggtgggcgccacggatgccgtggcgtcttccaagcactcggcagttcttcataggcatctggacacaacctttttgaacatgacgaggtctgaaggaaactttttgatcctcgaggatgaccgcaagatattcgatgcttcggggggcgctgcggtcggttgccttggctggggcgaccagagagttgcccaagctgtcacaaaccaggtacttgccgcaccgtactgtgcgaccattttctacaccaccagggttcaggaggagctatgccgcgatttggtccaatcgacaaacggggccatggcgcgtgcctacatcgtcaactcaggtaagacaatcacctcccaactttccccgacagcaactgacacttgccaggctccgaggcaatggaggcggctgtgaagctcgccaggcagtacttcctcgagattgaccagccacagcggacacgatttatttctcggaagcagtcataccacggcatcactcttggcgcactatccgttggaggccacgaggttcggcgggccaagttcgagccactcttgatcaagaatgtctcgagagtgtcgccgtgcaacgcattccgcggcaaagcccccggcgagtcagatgaggaatacgccgagaggctggccaaggagctcgatgacgagtttcagcaagtaggcccagagaacgtttgcgcttttgtcgctgagcccattgttggagctgtaagttacttcacgtgatcggagttgagcgtgcgcgaatactgactgttgcttttcaggcccttgggtgtgtgcctgcggtcaagggttacttcaaagccgtaagggacgtgtgtgacaagtatggcgcactcttgatccttgacgaggtgatgtgtggtatggggaggagcggcactctgcacgcatgggagcaggagggtattgtacctgatatccagaccatcgggaaggccctcgggggcggttaccaacccgtagccggcctccttgctggtcaccgggtggtcaatgcactcgaaaagggttcctcgtgagttgtgtccccgacagtccaacagtgacgatatactaactgaagccaaccagtgtcttcgtccatggccacacataccaaggtcatcctgccgcatgtgccgcagccttggaggtgcagcggattgttcgagaggagaaccttttgagcaatgtccgcgcaatgggtgatcttctctcgagcaggctgcgtgaaatactcgcaagccatccgaacgtcggtgatatccgtggccggggcctcttctggggcatcgaatttgttgcggacaaggagaatatggcccctttcccgtcagaggaccacgtttgcatggaaatctgtcaactggggctgaccgacaagtatgggatcaacgtgtatccaggcggcggatcagttgatggaattacgggcgaccacattatcatctcgccagccttcaatatctcgcgtgaagatgtcgagtggatcgcggcaacagtaggccggcttgtgtccgactatttcgcagcaaaggccggg

SEQ ID NO: 27226 - DNA, 2316 bp, Neurospora crassa
acagatgaccagcaccagcgaagctacagaccagacattgtgttgatgctccagaagaaccagaggagactcgtcgtcaatatcgatcatgtccgcgatcacagctctgaggtagccgagggtctacttaccgatcccttcaactggaccctcgccttcaaccatgcgctcaagactatcgtcagcaccgtcccccaggcccgccccgatcaaatagaccccgacgtcttatactattgtgcctgggctggcagctttggtctacacacctgcaaccccaggacactgtcctcccaacacctcaacaatatggtctcgatcgagggcatcgtaacaaggacgtccctgatccgccccaaggttgtcaagagtgtacactacagcgaagccaagaagacattccactaccgcgagtaccgcgaccagaccatgacgaacggcattgtcaccaacagcgtctacccgcgcgaagacgaggagggcaacccgctcgagaccgaatacggcttttcgacctaccgcgatcaccagaccatttccatccaggaaatgccggagagggcacctgctggtcagctgccccgaggcgtcgatgtgattctcgacgatgacctggtagaccgcgtcaagcctggcgaccgtatccagctcgtcggtattttccggacgttgggtaacagaaacacaaaccacaatagcgccctgttcaagacggtcattctggccaacaacatcgtcctgctgtcctccaagtcgggtggtggtgtggctacagctaccattaccgacaccgatattcgcaatatcaacaagatttccaagaagccaaaagttttcgagttgctttcacagtcactggctcccagtatctacggacatgactacatcaagaaggctatcctgcttatgctgctgggcggcatggagaagaacctggagaacggtacacatttgagaggtgacatcaacatcctgatggtcggtgatccttccaccgccaagtcgcagctccttcgtttcgtcctcaacactgctccattggctattgccacgactggtcgtggttcttccggtgttggtttgactgctgctgtcacatccgataaggagactggcgagcgtcgtctggaggctggtgccatggttatggctgaccgtggcgtcgtctgtattgatgagttcgacaagatgtcagacatcgatcgtgttgccatccacgaagtcatggaacagcaaactgttaccattgccaaggccggtattcacacctcccttaacgcccgttgcagtgttatcgccgcggccaaccctatctttggacagtacgacacccacaaggatcctcacaagaacatcgccttgcccgactccctcctgtcgcgtttcgatcttctcttcgtagtcaccgacgacatcgaggacacccgtgaccgacaggtatccgagcacgtccttcgcatgcaccgctaccgccaacccggcaccgaggagggtgctcctgtgcgcgagaacgccggtcaggccctcaacgtcgccctcaacgggcaatccgagtcccaaaagcccaccgagatgtgggagaagtacgacgccatgctgcatgccggaatcaaggtgcccagcggccgcgggtctgccaacaagaagcccgagatcctcagtatccccttcatgaagaagtatattcaatacgccaaaacgcgcatcaagccggtactgacgcaggaggcttccgaccgcattgctgacatctacgtgggcctgcgcaacgacgacatggagggcaaccagcgcaagacgtcgcccatgacggtccgtacgctcgagacgctcatccgtctggccaccgcccacgccaaggcacgcctgtccaaccgcgtcgaggagcgtgacgccgccgctgccgagtccatcctccgctttgcccttttcaaggaggtggtccaggacgagtcgcgcaagaagcgcagaaagacccgacccgccgagggcgaggatggcatgtcctccgactctgacgactctgatgacgatgacgacgacgtggcaactcaaaccaccacagcccgctccagcgctgccagagcttctcgcgcttcccgcgcttcccaacgcgccagccgacgcactcccgccaatggcgcttcctcctcctccgcagcaaacgccaacggcactcccagagaggaagaagaaacccaaggagcagaagaagaggaagaagacatctacgacgccaccccgcgccgctcaacaagatctgctcgcacaaccggcgactcacaaccatccttcgcctcttcccttcccgcctcg

SEQ ID NO: 27227 - DNA, 1652 bp, Neurospora crassa
ttgcgcagacttgaggcggccaccctccgtctggaggatatggcttcgtccaccatcccccctattggctcccaggccgtcattgagccggcttcctccgccccctccgcccccgcgtccactgctgtgtccactcctgcacccgctgccgcagtaccaattcccgaatctgtcgaaaagttcgacgacttcttgaaccaaactgttcagaaatatgttaagaccagcaatcttatcggtggcttggttgctgagcaggtacctatcctgcacagttctggatctattttgtgggcagagagcgggaagctgaccatttttatcaggctgcgagtgtcctcaagggatttgccgagacgcgcaagttcctactcgccgcctcccagtccaagaagctcgacatgaactcggtcgatttccaggaggctatcaagcctatcagcgaggccatccaggccactcaggaaatcaaggacaagaaccgcggttctcccttcttcaaccacctcggcatggtggccgatggaatcatgctcctcgcttggatcactgttcagtctaggcctgacaagctcattgatgaaagcctgtcatctgccgaatacctgggcaacagagtcatgcaggcaaacaaaaacactgatccccagcatacagaatgggtcaagaccttctaccagatcttcaaagacttgtcggaatatgccaaggattactacaacaacggcattgtgtggaaccctaacggcaagccttacaaggaggtcgtccagtgtcttgaatccggcagcgctccctcggcacctgccgcgtctccagccccgtccggaggagctcctcctccgccacctcctcctcctggacctcctccggtactcaagattaatgagcagaaggcggaaccggcccaaccgggtggtttcagttccgtcatgtctgagctcaacaagggcgaagcagttacaaagggtctcaagaaggtcgacaagtcgcagatgacacacaagaacccttccctcagggcaggatcaaccgttcccgacggaccagcggcacggtccaagagccctgcgccgcctggaaccaagccgcccaagcctgagagtatgcgtgcgaagaaacctgcaaagaaggctctcgagggcaacaagtggattattgtaagttctccagccggacattgtggtgtaaattcaaggtttttgacagtgctttaggaaaactacgatgctgccgctggcaacgttgagatcgaggcctccatttcccagtccatcctcatcagcaggtgtaatgaagtcgtcatcgtcgtcaagggcaaggccaacgctgtcaacattgacaactgcgacaaggtgtcgcttattgtggacactcttgtttctactgtcgacgttgtcaggtccaagaacttccagctccaagtcaacgagacgatccccactgtgcttttggatcaagtcgagcaagccacaatctggctgagcaaggagagcatctcgacaagggtgttccagagcaagacggacaacgtcaatatcatggttgtggacgagaacgacgactccaaggagcttcctcttccttcccaaatctgctcgtattacgatcccgagaagaaggagcttatcagcgagatcgtttctcactgt

SEQ ID NO: 27228 - DNA, 1819 bp, Neurospora crassa
gccatggcgcaaacaaggaagaacagctccctccccgccggctatgtcgaggacaagtccaaaggccccatgctccgcttccaggagtctctcccccgtcttcccgtccctaccctcgaggagacggctgcccgctactaccagtctttgaagccccttctcagtccccaggagctcgagaacagtaagaaggccattgacgccttcattgcccccaatggccctggtcgcaagctccaggagaagctggtcgcccgtcgcgaagaccccaagcacaagaactggctctacgagtggtggaacgatgcggcctacctctcctaccgcgaccccgttgtcccctacgtcagctacttctactctcaccgcgatgaccgccgccgccgcgaccctgccaagcgcgctgctgccatcaccaccgccgctctcgagtttaagaagatggtcgaccagggcactctcgagcccgagtacatgaagaagctccccatctgcatggactcttacaagtggatgttcaacgccagccgcgttgctgccaagcccgccgattaccccgtcaagttcagcgccgacgagcacaagtacatcctcgccatccgcaagaaccagttctacaagatctaccatgaggttggcggcaagcagctcaacaccgctgagctcgagcaggccttcaagcgcgtctatgagctcgctgcctcgcgcgctcccgctgtcggtgctctcacctccgaaaaccgcgacgtctggaccgacgcccgcgctactctcctctccgccgaccccaagaatgctaaggctctcgaggccattgaggcttcttccttcgtcgtctgccttgacgatgccgcccccgtcaccctcgaggagcgcgctcaccagtactggcacggtgacggccagaaccgctggtacgacaagcctctccagttcatcgtcaacgacaacggcacctcgggtttcatgggcgagcacagcatgatggacggcacgcccactcaccgcctcaacgactttgtcaacgacgtcattttcaacaacaagctcgacttctccgacccctcggtgcgctccaacctgcccgagcccgaagccgtcaagttcaccgtcaccaaggaggtccaggccgagatcgaccgggccattactgacttcagcaacgtcatcggccagcaccagctcgcggtgcaggccttccagggctacggcaagggtctgatcaagaagttcaagtgctcccccgacgcctacgtgcagatgatcatccagctggcctactacaagatgtacggcaagaaccgtccgacctacgagtcggccgccacccgccgcttccagcagggtcgcaccgagacgtgccgctccgtcagcgaggccagcgtggccttttgcaaggccgccaacgacgcgagcgtcgacgacaagaccaaggtcgagctcttccgcaaggccattgactcccacctcgagtacatctcggccgcctcggacggcaagggcgtcgaccgccacttgtttggcctcaagcgcctgctcgagcccaaccaggaggtccccgctctgtaccaggatcccgcctacggatactcgagttcgtggtacctgtctacttcccagctgagctccgagttcttcaacggatacggatggagccaggttattgaccagggattcggtattgcttatatgatcaacgagaacaggtcagttgctccacctctttcttttcccgcatacatgacaatcagatgaaaatgctaacacgtgagactttcaacagcctcaactttaacattgtctccaagggcctcggctc

SEQ ID NO: 27229 - DNA, 889 bp, Neurospora crassa
aacgagtacgagagccaggtagcgctggaagtagttgcgcccgaggacatcccggttgggttcgacgatatcggcggtctagacgagattattgaggaggtcagggaagccatcatttacccgctcacgatgccgcagctctattcgcatggcggcacgctactgtccgcgccttcgggcgtcttgctatatggccctcctggctgcggaaagaccatgctggccaaagctgtggcgcacgagagcggcgcctcgttcatcaatctgcatatctcgactcttacagaaaagtggtacggcgactccaacaagcttgtacgcgcagtgttctcgcttgcgctaaagctgcagccggccatcatcttcattgacgagatcgatgccgtcttgggaacaaggagaagcggagagcatgaggctagcggcatggttaaagccgagtaagtgaccctttgctctacttcaaaatgcgccctgtgtaaccttgggcttccggagctaaccttaaaactacaacaacagattcatgactctctgggatggtcttacatctaccaactctcttggtcaacccgccaggattatggtccttggcgcaaccaaccgcatcaacgacattgacgacgccattctccgcagaatgcccaagaagttccccgtcccgcttccaggcaaggaccagcgccggcgtatccttgagctcgtcctcgccgatacaaagcgcgaccccgaatttgatctggagtacattgctatggtaacggaaggcatgtctggaagcgagctcaaagaggcctgccgtgatgcggccatggttcccatgagggaggctatccggaaccaaaaggccgcaggaaagtcgataaagaagctggatcccaatacggtg

SEQ ID NO: 27230 - DNA, 1428 bp, Neurospora crassa
atgtcgactcccaacagtgacagcccggccgcgcaagccgctaagaaggtcttctctcgtcttgaccttgacggccacaatctcccgccatcacccgcaccctcgagccctcacaatggccgaagatatgccttggccaccgagctcgtctacaccgaaaccaaggaccagtatggcgcctcgagcatccccatctaccagtccgctaccttcaagcagtcgtcttccaacggcggcagcgagtacgattacactcgctccggcaacccgacccgtacccacctcgagcgccacttggccaagatcatgaacgcgaaccgctgcttgtccgtcagttccggcatgggcgctctcgacgtcatcacccgcctgctcaagcccggcgacgaggtcatcaccggcgacgacctgtacggcggcaccaaccgccttttgacctacctcaagaataaccagggcgtcatcgttcaccatgtcgacaccaccaacgtcgaaagtgtgcgccagatcatctccccgaagaccaccatggtcctgctcgagacccccacgaaccctcttatcaagatctgcgacatccccacgattgcgcgcatcacgcacgaggctaacgagaaggctgtggttgtcgtcgacaacaccatgctctcgcctatgctgtttaacccgcttgacgtgggcgctgatatcgtctacgagtccggcaccaagtacctgtcgggccaccacgacatcatggcgggtgtcattgccgtcaacgacacggagttgggcgacaagttgtacttcaccatcaacgccacaggctgcggtctgtcgcccaacgactccttcctcctcatgcgcggtgtcaagactctagccattcgtatggaaaagcagcaggccaacgcgcagcgtatcgccgagtttctcgagtcgcatggtttcaaggtacgctaccccggtctcaagtcgcacccgcagtacgacttgcactggtcgatggcccgcggcgctggcgccgtgctgtcgtttgagacgggcgatgtggcgctgagcgagcgcattgttgaggccgcgaggctctggggcatctcggtcagctttggctgcgtgaactcgctgatcagcatgccttgccgaatgagccatgcctccattgacgctaagacgcgcgccgaaaggcagatgcccgaggatatcattcgcctgtgcgtgggtattgaggatgccgatgatctgattgatgatctgtcgcgtgctgtaagtttacctacctgaatggttttcttatctgaattgaaactaacccaatacgtaatacagcttgtccaagccggtgccgttactctcacggtagatgggttccacgctaacaccgcggaaggtgctgctgctgctgctgctgggtcagaggcggccgagaccaccaccactgctgctccc

SEQ ID NO: 27231 - DNA, 1818 bp, Neurospora crassa
agcttcatcggcaagaccggtggtgaaatcttccatgagatgatgctcagacacggcgttaagcacattttcggctatcctggcggtgccattctccccgtcttcgatgccatctacaactctccccatttcgatttcgtcctcccccgccacgaacaaggtgctggtcacatggctgagggttatgcccgtgcttctggcaagcccggtgtcgtcctcgtcacctccggtcccggtgccaccaacgtcgttacccccatggccgatgcccttgccgacggtactcccatggttgtcttctccggccaggtccccaccaccgccattggcagcgatgctttccaggaggccgacgtcattggtatttctagagcctgcaccaagtggaacgtcatggtgaagagtgtcgccgagcttccccgccgcattaacgaggccttcgagatcgctactagcggcagacctggtcccgtcctcgtcgatctccccaaggatatcaccgctggtatccttcgccgggccatccccaccgacaccgccatccccaccagccctagtgccgcctcccgcgctgccattgagctgagccgcaagcagctcgatgcctcgatccagcgtgttgccaagctcgtcaacattgccaagaagcccgtcatctacgccggccacggtgttgtccagtctaagggcggtcctgcgctcctccgcgccctttccgagaaggcctctatccccgtcaccaccaccctccacggtcttggtgctttcgatgagctcgatgaaaagtctcttcacatgctcggtatgcacggtgccgcctacgccaacatggccgtccaggaggctgatttgatcatctgcctgggtggccgtttcgacgaccgtgtcactcttaacctcaacaagtttgctcccgctgctaaggctgccgctgccgagggtcgcggtggcatcgtccacttcgagattcttcccaagaacatcaacaaggtcgtccaggctaccgaggctgtcgagggtgatgttgccaccaacattgagctcctcatccctcaggttgacgccaagaccatggccgaccgcaaggagtggttcggcaagatcaacgagtggaagtccaagtggcctctttccgactacgagcgcgccgagcgcaccggtctgatcaagccccagaccctcatcgaggagctcagcaagctcaccgagggccgcaaggagaacacctacattgccactggtgtcggccagcatcagatgtggaccgctcagcacttccgctggcgccacccccgtaccatgatcacctccggtggtctcggtaccatgggcttcggtctccccgccgccatcggcgccaaggttgccaagcccgatgctcttgtcattgacatcgacggcgacgcctccttcggcatgaccctcaccgagctctccaccgctgctcagttcaacattggcgtcaaggtcatcgtcctcaacaacgaggagcagggcatggtcacgcagtggcagaacctcttctacgacgaccgctactcgcacacccatcagaagaaccccgacttcgtcaagcttgctgatgccatgggcgtccagtctaagcgcatcatcaagcccgaggaggtcgtcgagggtctcaagtggctcatcgactcggagggccccgcccttctcgaggtcgtcactgacaagaaggttcccgtcctccctatggtccctgccggctgcggtctggatgagttcatcaccttcgaccaggagcgtgacaggaagcgtcgtgagctgatggtcaagcgtaccggtggtgtccacggt

SEQ ID NO: 27232 - DNA, 2770 bp, Neurospora crassa
ttctatggacatttcggttcgtaatccatacctccgactgctgcctactttccacgctaattcaagacagatggcaagattgtcggtgtgcgatactacaacggcgtagcctctcccggtgaagtggttgtctgcaagagagaaccacagaaccagtacgaccccaatgctattcgtgtagataacgtgttgggcacacagataggtcatatcccgaggaccgttgctgccaagctagccccttacatggtaagtatacccctcgattcacttcgcccgtttccttttctaattcaatccaggacaacggcgaccttgtagttgagggcatgcttactggagagaaagaattctacgactgccccgttcgactctatttctatggcacgagcgcgtcacttcaacgagccaggctcgaggaacggctgaaaaaggacaaactcgtcaaagccacccaactcaaccagacacgcaaagcaaatgaggagcagagaaagaaacagacacttgaactcaggggcaatggtacctatggcttccctagccaaacgcaagagccggagccccaagttacaatggaacagttggccaagatgagcgaggtcatcagcttccgctccgggggtgatatgatcaagtccctcgccatgagtgaggaggacctggccaaccttccaatggcttcccagcccgaaaagttgcgcgcaaagttgcttccctatcagcttcaaggccttgcttggatgatctctaaagagaaccctacaatgcctgcaaaggggtctaccgactcagtacagctctggcagcataccgccgacggccggtatcacaacatggcaacaggcttctataacaagtctcccccacagctactgtcaggcgccatatgtgccgatgacatgggcctcggcaaaactatccagatcatcagcctcatcatgaccgaaggcctgggtaccggacctactctcatcgttgcccccgttggtgtgatgagtaactggaagcagcagatcagacgccatgttcacgaggaacatcagccaaagatcgtcatatatcatggaagtaaacgcaaagaatttgccaaagcgcttcaagaccaagatgtggtgattaccagctacggaaccttgtccgatgacgctctagtaaagactcgctggagaagagtggttcttgacgaaggacacaggtgggtcaaacaatgcatggtctgggttccctacgtacaatgctaacaaaattgatctagcattcgtaatgccaaagcccaagtagctcagaatgcttgcaaattggaagccaagtccagatgggtacttaccggaacaccaatgtgagttgccctggacaatcaacaatctggagactctacgtgcagtactgacaagactctccacgtagcataaactcgatccgtgatttgcattcgttactcaagtttctccgcataacaggcggaattgaacagtcagaaatcttcaacactgttctcacaagaccacttgccaacggggagcccaagggtgaagctctgttgaaaagtttaatgaaagatctctgcattcgcagaaagaaggatatgaagtttgttgatttgaagcttccggagaagacagaacacatgtctcgcatcaccttctggcccgatgagcagaagaagtacgatgctttactgtaagctccgccgcatcttctaatcttcacaatgctagcgagctaacacatggatcaggtctgaggcacagggcgttctggaaaactaccggacgcagtcgaagcgctcacagggacaatttcagggtgtcctggagagactgctaaggcttcgacaaacgtaggtaatccaaggtgttgagcatagtgaagatgctaaccagactctagttgcaatcattgggtgttgtgcaaaaagcgcatcacagaagttctcgagcttctcgcagacaaagatgtggttgatctcaccgatgaaaaccgcgccattctgcaacaggcacttcaactctacattgagagtcaagaggagtgtcctatctgcattgacccgctgagcaacccgatcatcacacattgcaagcacgtcttttgtcgaggttgtattgacaaggtcattgaagtgcagcaaaagtgccccatgtgccgcgctcccctctcggaagacaaacttcttgaaccagcgcccgagcactcggccactcaggacgaagaggaacttgaatctgagaccaagagctccaagaccgaagctgtgttggcgcttgtcaaaggcacccttgataaagaaggttccaaaattatcatcttcagtcaatggacctccttcctcaccatcatccaacaccagctagacgaagccgggtacacttacacccggatcgacggcagcatgaacgccgcccagcgcgacgccgccatccgcgccctagactacgaccccaacacgcgtatcttgctggctagcttgggcgtgtgcagcgtgggcttgaatttggtttcagctgacactgtcattcttgctgacagctggtgggcacccgccatcgaagatcaagctgtcgaccgagtccatcgtcttggtcaaaccaggccgacgacagtgtggagactggtcatggacaattcgattgaagaacgtgtgcttgacattcagaaggagaagagagagttggtcggcaaagctttccaggaaaagcaggatggtaagaagaaggtcaaggagacgaggatggctgatattatgaagctgctttcttagtgtctg

SEQ ID NO: 27233 - DNA, 817 bp, Neurospora crassa
ctacagcgcaagatcaaggttgtcacagaacaacacaatatcaacaagccggcggcacaggagggctaccccatgaaggagtggacggtcgagctctatattctcgaccaagatggcaaggagaggcccgccaggtgcttcacgaaggtgacctacaaccttcacccttcgttcgcgaaccctatccagagtaagtagacaccggagcggccgccggtcacctctccccatctctgttgtgtctcgagagccagaggttggctaacgcgtcgcaaattcagctttcaacgatcctcccttcaaatgcaccaacgagggctggggtgaatttgagatgatcatcgatatgtacaccaccgagaaaggcggcaagatctcgatcgcgcacgacctgaacttccagcaatcagagtacgaaaacatccataccgtcaccttccgtaacccatctcaggcgctccagcagctcctgagagagacgggtcccttgccctcggacgaggagcgcaagcagaagaaggcggtggacggcggttccaagaagaagcggccctacgacatcgagcgtatggcggatggcttgacgaagctgggcgaggatgacctcctgcaggtcattcagatgatccacgatcacaaggatgacaatacgtacatccagaacaacctcgatggtaagtttgcccgctagggagtgtggcccctggaggcaacacgagctgatggctgactggacatgtctatagcgggcgagttctcggtggatctctacactcttcctgacaacctcatgaagatgctctgggagttcttggta

SEQ ID NO: 27234 - DNA, 1260 bp, Neurospora crassa
atggactcccgatcaagcgatgtgtcgccagaggcgatgcaggcacgaattcaacaagcgcgtcgcgaggccgagaatctcaaggacagaatcaggctgaagaaggaagggctcgccgatacttcccgtgagtccccttgtcggcaggtcgcgaactgcgccgttgtccgcccatgcatgccgtcgtcaacggcggattgaccgctgcatagtgttgctgacatgatgtgtagtctacgaggtcgcgcaacaggcccatgagccacttccgaagaacaacatgatgaaaacaaagaagacgctgaagggccatctggccaagatttatgcgatgcactggtctaccgaccggaggcatcttgtctcagcatctcaggacggcaagctcatcatctgggacgcttatacgaccaacaaagttcacgccattcccctacgatcgtcttgggttatgacttgcgcctatgccccgagcggcaacttcgttgcctgcggtggtcttgacaacatttgctctatttacaacctgaactcgaaccgtgatggcccaactcgtgtctaccgggagctttcaggtcatgcgggctatctctcttgctgccgtttcatcaacgaccgcagcatcctcacctcctccggcgatatgacatgcatgaagtgggatatcgagacaggaacaaaggttgttgagttcgccgaccatttgggcgacgtcatgagcatcagcttgaaccccacaaaccagaatacctttgtgtcaggtgcttgcgattctttcgctaagctttgggatatccgcgctggcaaggccgtacaaacattcgctggccacgagtccgatatcaacgccatccagtttttccccgatggccactctttcgtaacgggttccgatgacgctacttgcagacttttcgatatccgcgcagacagagagttgaactgctatcgcgtgagtaacctgtggattattctcctctcggttcttgatttttttttctcttggtggctttagagctaacatttgggtagtccgaatctattctttgcggcattacctctgtcgcgacatcagtctctggacgtttgctctttgccggttacgatgactttgaatgcaaggtctgggatcttactcgcgctgaaaaggttggctctctcgtcggtcatgaaaaccgtgtcagctgtctgggcgtttccaacgatggaataagtttgtgcacaggctcttgggactccttggtaagtttctacccgcaa

SEQ ID NO: 27235 - DNA, 2125 bp, Neurospora crassa
ccacagattgcccaagagttctctgtcctcaagctggatcttaatctgggctctctacaccaggccgatctcgtacattcgctgcagaaggagtcagtggcttctttgctcgatggtaaaattcgctccagtatcaaacatctttattcgctgcgcgagagaatcgaggatacttcaagcaaggttctggttaccggtgatctgaatgcgggaaagtctacgttttgcaatgccttgctccggcggaaggttcttcccgaagaccaacaaccctgcacgagtatcttttgcgaggtcctggacgcgagagagaacggcggaattgaagaagtccatgcagttcacagggacgcaatctacgatcgtcacgatgaggccacctacgatgtctattccctaaaggagctggagagaattgtcaccgataacgagacctaccagcaatgcaaaatctacatccgggatgcgcgaactatcgacgagtctcttctgaacaacggcgtagtcgacattgcgctcattgacgcccctggtttaaatatggacactaccaagaccacggccatatttgcgcgacaggaggagatcgacgttgtcgttttcgttgtttcagctactaaccatttcacacaaacggccactgagttcatcagggctgctgctgctgaaaaggcctacctctttatcgttgtcaatggcttcgacaccattagagataaggagcgttgccagaagctcatccttaaccaagttaggggtctgagccctgcgacccacaaagaggcggatgagctggtacacttcgtctccagtactgcgattcccatggctccatcgcctcctggtggttcctatggaggtggatcgggcagcgcaagcggtggcggtggcggtgatgatggcgacgatgatgatcccaagggcaagggcaagaagaaggagatggctcgggacttttcgaatcttgaacagtctttgcggagattcgtcttggagaagcgggctcgctcaaagttggcaccggccaagacctatctcaccaacattctgaacgacgtccacgtcctcgctactgtcaaccaggaagttgcccagtcagagttcgaccggatgaatcaggagctgcagaagcttgagccagaacttgagcggagcaagcaggccaagcaggagatcaacgagaaggttgaccagacgatcgaagaaacctgccaggagatttacgaattttcgcgcaacacgattagcagctcgatcgaacacgccggtgatggcaacttcggaatcccttatcctggtctcttcagtgcgttcgagtatgccgaggaactcaaggaggccatgctttcgcagattgctggctcagtcactcagtgcgaggaacacgcaagagccaggaccgttgacggtgtcaacatgatcaagcaacttggaatcatgcatctaggtaacgagtacaccgatctggccttccgcccggatgtcatgttccgccgcaagaaggatgctcttgcacgccaagtcgacattcccaccgagctgtgggactttgttgactggtctaccgtgcttcaaaaggaggaaaaggccggcatggcactcaccgttgccggtgtcgttggtacaagtgtgctcagcggctacagccagatgaaccttgctcttcgtgcagcccagatcctgggaaccgacaacgtgcgccgcctcattattcctggtttgattgcggccggtaagtctagattctcttgagcagttcccgtctgaacattgcgctgactttgactcctctacagccgtggcagcgacatattacgtcctgaaccagattcctcactctcttccccaccgtctgaaggagaagatctccactcagctcgctgccatcgactacgttcactcgaacagcattcgtatctccggttcggtgcggaaggtccttcgcttccccgccgactccctccgcgttggccttcagcgttctgtagagaagcttgacggacgccgtaacgaaactctgcgtgtcaaggccgagagcgacgttgcgctcaagtattttgccaatcttgtccgcgaaagcgctcatcagcgtcgggttgtcgaagctgtcgatctcgatggccat

SEQ ID NO: 27236 - DNA, 1145 bp, Neurospora crassa
ggtgaatcactccccgggccgcgctccacgttcaaggttggtgtctgggaggaccgcaacaagaagtgcagacgtactatggaagacacacatgctttcctctacaactttctccatactcctgcccctgttttgggcgccgagggctcggctcagaagcaatcaaaatcagcgaacgaatcacatgagaagcgcagtagtagttccgccagtcagaatgcagacatgatcgagacggacaatggctactttgccattttcgatggccatgccggcacctttgctgctgactggtgcggcaagaagctccacataatccttgaggatatcatcaagaagaacccgaatgctcctataccggaactccttgatcaaacgtttaccactgtggacaccgagctagaagcgcttccgctcaaaaatagtggctgcacggctgccgttgcggttctgcgctgggaggaccgagttccgagtaaccagtcggcgaccggctctcaagctatcgcccccgcggttgtcaaggccactgaggatgctcttaaggtggaggatgggcagtccgagaaaagcctcaactcttcaatcccggaagctacacacgccaagttgaagaattctgccacaagacagagggtgctttatacagccaatgtgggagatgctcgcatcgtcttgtgtcgctctggcaaggcgttgcgcctgtcatatgaccacaaaggcagcgatgaaaatgagggcaagcgtatagcaaacgctggaggtctgatcctgaacaaccgcgtgaacggagtccttgctgtcacccgagctcttggcgatacttatatcaaagacctcgtcactggtcatccttacaccacggagacggttatccaaccggattgggacgagttcatgattattgcttgcgatggggtaagtaataccaacagctctgcagtccactttccccactgtgcctgaagatacataaactgacaaattttttacagctttgggacgtttgctcggatcaggaagcagtcgaccttgtgcgcgatatccaggaaccggtgattgcggccaagaaactggtcgatcatgctctgtctcgtttcagcaccgataacctctcatgtatgattgtccggtttgacaaacaa

SEQ ID NO: 27237 - DNA, 2301 bp, Neurospora crassa
ttcggtggtacctctagcggtgccatttccgccagttcaagaccttcagcgactaccgacccgttgacgactcgacccgcgaatagtgctccgcgaccacctcccaactacggcagcagcggcagtggcagagcgtttgcgtcgctctacaacgcttctgactccttcaatgataccccagatgtgatcgaagtttccatgcaatcgacaaggcgacctcagcatgatttaacttcgtcggtatacattgaggatgacgacttcagcgatgacgagaacctcgatttggacttcgaagccccatccgccttgccagtcctcccaactgggcgaataagcctcgaacaacatcgggagttgcaaaagcagcaggaggaggaagtgaaagaatctcggttccgcgagcccccgtcagggactcataccagtgttctttcttggccggagtcgtcgccatcccatcttcaaccccccaagcgcgagctgaatccccctcccaataccaacacgaaacacgcccgcctgcaagacgacgacttcgatttcgaaccgcccgccgctgtgaagaaaccaaagcgcgaactaccttggacgatggaagcagaatcaaaggaggaggactggaaacatgccgaaaaatacccactagagaagagcggatatgctcccacgccggaatcgaagcccaaggggtccatgctatggaacactacggcaagcgcggtcaaggaacagaagaagcagctcaaagacaggcaaaagtcttcctcggtcgctcccaagacggaaatacccatggacgaaatcaagaaggttgtttcgtcccatcttagcaaggcgtcagccattacattgagcggcgagcagcttcacgtgaagagcttggtggtagaaaaggggcagagtgtcttcttcacaggtccggctggcacaggaaagtcggtgctgatgagagcgatcatttcagaactcaaaaagaagtttgctcgggagccggaaagagtagcggttacagcttcgaccggccttgcagcgtgtaatattggcggcatgacattgcacagcttcgctggcatcggtctcggcaaggaggatatccaaacgctcgtcaagaaaatcaggcgcaatcaaaaggccaaaacccgatggctcaagaccaaggttctcatcatcgatgagatttccatggttgacggtgagctttttgataagctgtcccaaatcggtagaattatccgcaacaatggcaggccttggggtggtattcagctggtcatcactggtgatttcttccagctgcctcctgtactggacaaagatctgaacaagcagagggatgtcaagtttgcctttgatgcagcaacatggaacatgtccatcgaccataccattgggttgactgaagtgttccgtcagagagatcctggtaagcagttcaactctgggatatcaagtccaacatgcggctaacagcctttagaatttgcagagatgctcaacgagatgcggttgggaaggatcagtgacaggaccgtcaaaaatttccaacaacttagcagacctctagcctttgatgacgggcttgaagtaacagaactgttcccgacgagaaatgaagtcgagaattcgaacagacaacgactcgctgccttgaagggcaaaatctaccgctacgaagcgtacgataccggtgagccggcggtccgcgaaaaacttcttgccaacatgatggctcctcccgtaatagagttaaagaaggatgcccaggtcatgctcatcaagaatatggacgagacgctcgtgaacggttccctcgggactgtcgttggtttcatgaacgaagcaacatttgagctgaaagctggcagtgactttgacgacgatgaggatctggacaagaagagaagaatcaaggccttcaccagcgcgctttccaatgcagctattgagaaaggcgacaacacagagtatccgttggtgcgattccacgccgtcgatgggaccaggagagacatcctgtgtcagccggaggactggaaggtggaacttcctactggcgaggtccaggcttctcgaaagcagcttcccctgattcttgcatgggctctgtcgatccataaagcgcagggccaaacgcttgaacgcgtcaaggtcgacctcggcagggtttttgaaaagggacaggcatacgtcgcgctcagtagagctaccacgcagcagggtctgcaggtgctccgcttccagaaggacaaggtcatggcgcacccgagggtcgtcagcttctacaacaagctttacagc

SEQ ID NO: 27238 - DNA, 978 bp, Neurospora crassa
aatcgcatctcagacatccaagcctttggcgatgaggctctcctcgagaagtacggcctcaaggccaacgacgccatcctcgccgaggagaagcaccagggcctcttcgaggacctcctccagaactacgatgctaagctgattgccggtggcgctgcccagaacaccgcccgcggtgctcagtacctcctccctcccaacagtgtcgtctacctcggcggtgtcggtgacgacaagtacgctgccatcctccacgatgctgtcaagcaggctggcctccgcgtcgagtaccgtgtcgaccccaagatcagcaccggccgttgcggtgttgtcatcactggccacaaccgctccatgtgcactgagctcggtgccgccaaccactacgaccttgagcacttgaagaagcccgaggtttggtcccttgtcgagaacgccgaggtctactatgtcggcggctaccacttcaccgtctgccctcccgccatcatggagctcgctaagcaggctgccagcggcaacaagcccttcatcctctcgctctccgcccccttcatctgccagttcttcaaggaaccccttgatgcctccgctccctactgggactacgtgatcggcaatgagggcgaggccgccgcctacgccgagtcccacggcctcaacaccacagatgttaaggagatcgcaaaggctcttgccaaccttcccaaggagaacacccagcgcaagcgcgttgccatcatcacccagggcaccgagcctaccattgttgccatccagggcgaggatgaggtcaaggagtaccccgtccactccatcgaccccgccaagatcaacgacaccaacggtgccggtgacgccttcgctggcggcttcgctgccggtgtcgtcgagggcaagtctatcgaggagtccattcacatgggccaatggctcgctaagctctccatccaggagctcggtccctcgtaagttctc

SEQ ID NO: 27239 - DNA, 2320 bp, Neurospora crassa
gtcatcaagcaaggttgggccagtgtcaaggagagcaagaacttcatcaacccttggaagaacaagtacctgatcctacgaaaggagtcactggatttccacaaggccgagagcagtaaagttgcctataccctctacctcaaggacgttatcaatgtcggccgtgtggaggccgcaggaaccattttcgagatcaagaggcagtctagcggtgcctccacgagtcccggagaggaggaaaatggcatcaggacccttcagatccgcgtgaaggccgacgacgacctttatgaatggattgactttatttacgcgcgttgcccaggcatgggcggtgtcagtaatcctaccaacttttcgcatgccgttcacgtcggattcgatccccagaccggcgagttcgtcggcctgcctcctgagtggtcgaagctgctcaactcttcagccattacccaagaagactacgaaaggaaccctcaagccgtctttgaagtcctcgatttctattccgatttcaacaagaatggcggccaagcgcccacacccaactttcccactcccccatcgaacagcgcacagagcaagcagctcggatacccgagcggtggaaactccgtcgcgccgccgcgccctacgcagccgttgcaacaacgcaacccaagctccaactacccatcctcgccgcagcagcaaggtggcaccagttctcgctcatcaccccccgagcagcgccagcaggcgtcgccgagctacaactctgagcgcgcgagagaggagcaaaggcgcgaactggagcgccagcagagagagatggaggagcgggatcgccgggatcaggaagcttataatgcgtcccttcccaagacgaagactcctatggctcagcaggagattggaggtggtggttatggtggtgccgatcgcttcaacccaacacgcgccgctccaccagcacccaagggcttgcagcaagcaccgagtctcaaagctcagagacctgcgcctcccccaccaagttccagttcgagccgcccgcccgtcgcacagcagtccagttccagctcacagcgtgatcttgcccaggcgcaggcgcagagacgggccgaacagcaggctcaggcgcaacggagccagaacggccaggccccgccacgaccacctcacccatcggccaaccagccatccaagattcctacgaccgtgaagccgcttaacgtgggtcccaagcagcctcaagatggcgtcaaggccgctgaagcagcccttacgtccaagcccgctgcttctgagcgttccaaggatgttcgcatgtcgaccatgtcggagaaggaggttatgcagaagctaagggaagttgtgtctcacgaagaccccgaagccaagtactccaagcagaagaagatcggacagggtgcctctggctccgtgtacgtcgccaagatcagggagagaccgggccaggatcccaacgtttccagaagacgcggccaggttgcaatcaagcagatggatctcgcgcaccagccgcgcaaggagttgatcgtgaacgagatcatggttatgaaggacagcagtcaccccaacattgtcaactttgtcgaagctttcctgaagaataaggactcggaactctgggtcgtcatggagtacatggagggtggtgcgttgactgatgtcattgagaataaccccgttatcacggaggagcaaatttctacaatctgcttggaggtgagttgccgtgcaggcctaatattgagagtgatacgatcctttactgactaaaacttgtacagacatgccgcggtctgcaacatctccatgaaaggaacattatccatcgtgacattaagagtgacaacgtcctcttggatgcccgtggcaatgtcaagattagtaagtttctccacaatatgtccttatttacgctcaactaactctgtaatcagccgatttcggtttctgcgccaagttgaccgaagctaagtccaagcgcgccaccatggtcggcacgccctactggatggctcccgaggtcgtcaagcagaaggagtacggccccaaggtcgatatttggtcgctcggtatcatggccattgagctgatcgagtcggagcctccttacctgaacgaggagccgctcaaggccctctacctcatcgccaccaacggtactcccaggctgaagaaacccgagaagctcagtaaggagctgaaagctttcttgtcggtgtgtctctgcgtggatgtcaagagccgtgcatcggcggatgagcttatcgagcacgacttcttgaagcatggatgtcccttgagcagc

SEQ ID NO: 27240 - DNA, 1258 bp, Neurospora crassa
atggcccgaactcaaaagaacaaggcgacatcctaccatatcggacagctgaaggcaaagctcgccaagctcaagcgtgagctgctcacgccctcgggcggcggcggtggcggcggtggtgctggtttcgacgtcgccagaaccggtgtggcctcgattggtttcatcggtttcccctcggtcggaaagagtacgctgatgagcagactgacgggccagcactctgaggcggccgcgtacgagttcaccacgcttacgagtgtgccgggtcaggttacctacaacggtgggcagccctttttcttcatcttctcatcctccggagcgttacaaacaaggtccaggttgaactgacattttgcatacatacaggtgccccactacaaatcatcgatttgcctggtattattgagggcgccaaggacggccgtggtcgtggtcgtcaggtcatcgccgtcgccaagacgtgccatcttatcttcatcgtgctggacgttaacaagccgctgacggacaagcgcgtcatcgaggccgagctggagggcttcggcatccgcatcaacaaggagccgcccaacatcacgttcaagaagaaggacaagggtggcctgaacatcaccagcacggtaccgctcacacacatcgacaacgacgagatccgcgccgtcatgagcgagtacaagatctcgtcggccgatatcgccatccgctgcgacgccactattgatgatttgatcgacgtgctcgaggccaagtcgcgctcctacatccctgttatttacgtcctcaacaagatcgacgccatcagtatcgaggagctcgacttgctgtaccgtattcccaattcggtccccatcagttctgagcacggctggaacattgacgagttgatggaggccatgtgggagaagcttaagctcgtgcgcgtgtataccaagccgaagggcaagatgccggattattcggctcccgttgtgttgaggagcaataggtgcacggttgaggatttcgtaagttttttttctcttttgtttttgtttttttctcgttttcctttgttttgatgcacctgattgagcaaaagaaacatctggggtgagaatgaggtgagctaacagctgatgaaccgcagtgtaacactattcacaaaaccatcgtggatcagttcaaggttgctattgtttacggcaagtccgtcaagcatcagcctcagcgtgttggtctcagccacgaattggctgatgaagatatcggtatg

SEQ ID NO: 27241 - DNA, 869 bp, Neurospora crassa
tacgatatcctttccaacctcggcctgctcaacaagcatggcaagctgctcttcctgggtctcgacaatgccggaaagaccactcttctacacatgttgaagaatgatcgcgttgccattctccaacctactcttcatccgagtcagttcaaccacctgcagctgccacctgccactgtttctccgtcaacgccgggaccttgatacccgagcaccttccgccttctcccccttcgcctcgactcttcccgtccctactcccgttcctggctccatacaccgaatcagatatgcgcgcacatgtgagggcgagatgtttagagaataattatggctgacatgattcgttgtagcttcggaggagctttctgtcggcaacgtcaagttcaccactttcgatcttggcggtcatcagcagggtgagtggataatcatctcctatttagggcttatgtcaaatcctctcgggacattgacaagccgctctactgctgcggtctcgactaacaaatgacgtatctacagcccgtcgtctttggaaggattacttccccgaagtaaacggtatcgttttcctcgtggacgccaaggaccacgagcgtctccccgaggccaaggccgagatcgacgcgctcctctcgatggaggagttggccaaggttcccttcgttgtgctcggcaacaagattgaccatcccgaagccgtctctgaggacgagctcaggcagagactcgggctctggcaaacgaccggcaagggcagggttcctctcgagggcatccgccccatcgaggtgtttatgtgctctgtggttatgagacagggatacggagaggctatcaggtggttgtcccagtacgtttaaggg

SEQ ID NO: 27242 - DNA, 1548 bp, Neurospora crassa
ataaagcccaacatggaagtcgagcttacggcccccaacggcaagaagtggatgcagccactgggcttgttcattaataacgagtttgtcaaaagtgccaatgagcagaagttgatttccatcaacccaacgtatgtctcaaatcccatatcactcacttgactacgagtactaacgatcatccccagtaccgaagaggagatctgctcggtatacgccgcaaccgccgaggatgttgacgccgcagtatcagcagcccgcaaggcctttaggcacgaatcatggaagtcgctatccggcactgagcgcggcgccctgatgcgcaagctggccgacctagtggccgagaatgccgaaatcctagccaccatcgagtgcctggacaacggcaagccgtatcagacagcccttaacgagaacgtgcccgaagtgatcaacgtcctcaggtactatgccggctatgcggacaagaactttggccaagtgattgacgttggccccgccaagtttgcctacacggtcaaggagcctctcggcgtatgtggccagatcatcccctggaactacccgctagatatggccgcctggaagctggggccagctctctgctgcggcaacaccgtggtcctcaagctggccgagcagactcccctgtccgtgttgtacttggctaagctcattaaggaggccggcttccctcccggtgtgatcaatatcatcaacggacacggcagggaagcgggtgccgcacttgtgcaacatcctcaggtggacaagattgcctttaccggcagcaccactacgggcaaggagatcatgaagatggcttcctataccatgaagaacatcaccctggagactggcggcaagtcaccgttgatcgtgtttgaggatgccgaccttgagctggcggcgacatggtcacacatcggcatcatgagcaaccagggccaaatctgcacagccacttcacgcattctcgtgcacgagaagatctacgacgagtttgtcgaaaaattcaaggccaaagtccaggaggtttcggtactcggcgaccccttcgaggagagcacgttccacggacctcaggtcaccaaagcgcagtatgagcgtgttctgggctatatcaatgtcggaaaggaagagggtgccacggtgatgatgggtggtgagccggctccgcagaacggtaaaggtttctttgtggccccgactgtcttcacgaacgtcaagccgaccatgaagatcttcagggaggagatctttgggccctgcgtggccattaccacgttcaaaacggaggaggaggcgttgacgctggccaacgacagcatgtatggcctgggagcggctctgttcaccaaggacctaaccagggcacacagagtggcgcgggagatcgaggccggcatggtctgggtcaacagcagcaacgattcagactttaggattccatttggaggcgtgaagcagtctggtattgggagggagttgggagaggcaggtctggcaccttattgcaacgtcaagagtatccatgtaaacctg

SEQ ID NO: 27243 - DNA, 2258 bp, Neurospora crassa
cttctaccgttgagcggccttattggcactgctctagcggcatgcccctttgccgacccttctgctcttggtcgccgtgccgagggcggtgaggttgacgcccgtcagaggttgaaggaggttgaggttgacgacaacggccaattcatgacaacagatttcggcggcaacattgaggaacagttcagtctgaaggctggtggccggggctcgacattgcttgaggacttcatcttccgtcagaagctccagcacttcgaccatgagcgcgtatgtcttccctgccatggcccaattagcatcaagaatcctagctaacgaaagtttgataccagattcccgagagagtcgttcatgcccgtggtgccggtgcccacggtatcttcaccagttatggcgactggtccaacatcaccgccgcctccttcctgggcgccaaggacaagcaaacaccggtcttcgtccgcttctctaccgttgccggttccaggggttccgccgacactgcccgtgatgttcacggcttcgccacgagattgtatgttgaccacgtaacaacccttcccttcacctcttcagcagggcgttaacttgactccagctataccgacgagggcaactttgatatcgtcggcaacaacattcccgtctttttcatccaggatgccatccgcttccccgaccttattcactccgtcaagcctagccccgacaatgaggttccccaagccgccaccgcccacgactccgcttgggacttcttcagctcccagccctccgctctccacaccctcttctgggccatgtctggcaacggtattccccgcagctaccgtcatatggatggtttcggtatccataccttccgtctggtgaccgaggacggcaagtccaagctcgtcaagtggcattggaagacgaaacagggaaaggccgctctcgtctgggaggaggctcaagtcctcgccggcaagaacgccgacttccaccgtcaggatctctgggacgctatcgagtccggaaacgccccttcatgggagctcgccgttcagcttattgacgaggacaaggcccaggcttacggcttcgaccttcttgatcccaccaagttccttcccgaggagttcgcccctctccaggttctcggtgagatgaccctcaaccgcaaccctatgaactacttcgccgagaccgagcagatctccttccagcccggccacattgttcgcggcgtcgacttcaccgaggatcccctgctgcagggtcgtctctacagctacctcgacacccagctcaaccgccacaggggccccaactttgagcagctccccatcaaccgccctgtctctggcgtccacaacaaccaccgcgacggtcaaggccaggcttggatccacaagaacatccaccactacagcccgtcttacctcaacaagggctaccctgcccaggccaaccagaccgtcggccgcggcttcttcactacccccggccgcaccgcgtctggcgtcctgaaccgcgagctcagcgccacctttgacgaccactacacccagccccggctcttcttcaactcgctcacccccgtcgagcagcagttcgtcatcaacgcgatccgcttcgaggccagccacgtcaccaacgagcaggtcaagaagaacgttctcgagcagcttaacaagatctccaacgacgtggccaagcgcgtggccgttgcgctcggcctcgaggcgccccagcccgacccgacctactaccacaacaatgtcacccgcggcgtttccatcttcaacgagagcctccccaccatcgccaccctccgcgtcggcgtcctctccaccaccaagggcggctccctcgacaaggccaaggccctcaaggagcagctcgagaaggacggcctcaaggtcaccgtcatcgccgagtaccttgccagcggtgtcgaccagacctactccgctgccgacgccaccgccttcgatgccgttgtcgtggccgagggcgctgagcgcgtcttcagcggcaagggcgccatgagccctcttttccctgctggccgtcctagccagattcttactgatggttaccgctggggtaagcccgttgctgccgtcggcagcgccaagaaggcgctccagagcatcggggtagaggagaaggaggccggtgtttatgccggtgctcaggacgaggttatcaagggcgtcgaggagggcctcaaggtgttcaagttccttgagcgtttcgccgttgatggc

SEQ ID NO: 27244 - DNA, 3905 bp, Neurospora crassa
ttcagccaaacgtcggatctcggaaactatcaacgctatgccgaggactctgacgactaccctgacgagagtaccacgtcctactaccaacatggcggagctatccccccggactcggcggctgcccgcgacagcgcgcgcgcacggaatagcgtcctgagcatgggtggcggtttgatcggtcgtgccaagaacatgcttggaatgggccctgagggatactcggagatggacctccccttgacggatccgcgagcgaccgcacgggtagaccactctcacgagcctcctcctccccagaagccagccaagaagtttgatttcaagtttgggtttgggggcggaaagccggatccagcaacccttgggccccgtatcatccatctcaacaaccctcccgccaacagcctgaacaagtatgtcgacaaccacgtctcgaccgccaagtacaattttgcgacttttttgcccaagttcctcttcgagcagttctccaaattcgccaacatcttcttcttatttaccgccggtctacagcagattcccggcctgtctcctacaaacagatatactacaattggtcctctagctgttgtgctcttggtttcggcgggtaaagagatggtcgaagattatcggagaaaacaggcagataaggcgctcaatatgtccaaggcccggatcctgaggggttcgacattcgaggaaacgaaatggatcaacgtctcggttggagacatcattcgagtcgaatctgaggagtccttccccgccgatcttgttctcttggcgagttccgagcccgagggtctttgctatatcgaaaccgccaatctcgacggagagaccaacctcaagatcaagcaagctctgccagaaacgtcatctatggttagctccagcgagttgagtcgtctgggaggcaggattcgctccgagcagcccaacagcagtctttacacttacgaagcgaccttgaccatgcaggctggaggtggggagaaggagcttcctctaaaccccgagcagttgcttctccgtggtgctactctgcgcaacaccccttgggtccacggtgtcgttgtcttcactggccacgagaccaagctgatgcgcaacgccacggccgcgccgattaagcgcaccaaggtcgagaggcagctgaacacgctcgtactcttcctcgtcggtatccttttgatcttcagcgtggtctctactgtcggtgatctcatccaacgaaaggtggagggcgaggaaggtctcgcttatctcttcttggatcctatgaacggtgcctcggctgttgctcgcatcttcatcaaggacatggtcacatactgggttttgttttccgctctcgttcccatttcgctcttcgtcaccattgaaatggtcaagtattggcacggcattctcattaacgacgaccttgatatgtattacgacgttaacgacacccctgccaattgccgaacttccagtctggttgaggaattgggcatggttgagttcgtcttctcagacaagactggtaccttgacctgcaacatgatggaatataggcaatgctcgatcgctggaatcatgtacgccgacaaggtgcccgaggatagaatcccgagtggtgaggacggagaggatggaatccacgacttcaagcaactgcagaagaatctcgagagccaccaatctgcgcaggtcattgaccaatttctcacccttctcgccatctgccatactgttattccggaacaggctgaagacggaagcatcaagtaccaagccgcgtcaccagatgagggagcgcttgtcgatggtgcggtacagatgggctacaggttcgtcgctcgcaagccgcgcgctgttatcatcgaagccaacggccagcagcttgagtacgagctcttggcagtctgcgagttcaactcaaccagaaagagaatgtccacgatttatcgttgccctgacggcaaggttcgttgctactgcaagggtgcagacaccgtcatcctggaaaggctcaatgaccagaacccccacgtcgacgccaccctgcgacatcttgaggaatatgcttctgagggactacgcacgctctgcttggccatgagggaaatcccggagcacgaattccaggagtggatgaaggtttacgagacggcgcagacgaccattggtggtaatcgtgcagatgagctggacaaggctgccgaactcatcgagcacgacttctaccttcttggtgccaccgctatcgaggatcgcttgcaggacggtgtgcccgagaccattcacaccctccaggaagctggcatcaaggtttgggtcttgaccggtgacagacaagagaccgccatcaacattggcatgagttgcaagttgcttagtgaggacatgatgctgctcattgtcaacgaagagagtgcggaagctacgcgggataatcttcagaagaagctcgatgccatccgcaaccagggcgatgccaccattgagatggagaccctggctctcgttattgacggcaaatcgctaacgtacgctctggagaaggacatggagaagctcttccttgatcttgccatcatgtgcaaggccgttatctgctgccgtgtttcccctctgcaaaaggccctggtcgtcaagttggtcaagaagtatcaaaaggagtcgattctcctcgctattggcgacggagccaacgatgtctctatgattcaggctgcccatattggtgtcggtatcagcggtatggaaggtctacaagctgcgcgcagtgccgatgtgtctattgcccagttccgttacctccgcaagttgcttctcgtccatggcgcctggagctaccatcgtgtgtcgaagaccattttgttctctttctataagaacatttgcctttatctgacacagttttgggtatgtgttccatgcaggtaaccatttctgattcaaaaacactgacctgaaacagtacactttccaaaacgtcttttccggtgaagtcatctacgaatcctggactctctctttctacaacgtcttttttacggtccttccgccgctcgcccttggtatcctcgatcagttcgtctctgcccgcctgctcgaccgctacccgcagctctacaacctcggccagcgcaacaccttcttcaagatccgtgtcttcggcgaatggatcatcaacgccgtctaccactccatcattctctatgtaggcggctgtctcttctggctcaacgacgggcctcaaggtgacggtttccctggcggaaagtgggtctggggtacagccatgtatggtgccgtcctacttaccgtcctcggcaaagccgcgctggtgaccaacaactggaccaagtaccacgtcatcgccatccccggttccatggctttctggatcttattcgtggcagtctatggcgaggtggcgcccaagctgaacatcagtgttgagtactttggcgtcatccccaggctgttcacgagcccgatcttctggatccagatgcctacgctggcaatcctctgtttgctcagagattttgcgtggaagtttagcaagcggttgtggagaccggaggcgtatcatcacgtgcaggagattcagaagtataacattcaggattataggcctcggtatgtttttgccatgattcgtcgtccccccctcctctccttacttttttaccctgcctctattcgattgctaacgcaaggacaacagcatggaacaattccaaaaagccatccgcaaagtccgtcaggtccagcgcatgcgcaagcaacgcggttatgccttttcgcaggccgacgagtcgcagacccgcgtgctccaggcctacgacacaacacagcatcgtggtcggtatggcgagatggccagttcaagaccgaatcaa

SEQ ID NO: 27245 - DNA, 1038 bp, Neurospora crassa
ctcgacacaggctcaagtgatacttgggtgaattctcccagttcgattctttgtcaagatgaagacaaaccatgcgaatactccggcacctacctagccaatgactcgtctacttatgagtacatcagcaatcatttcgacatcaagtatgtggatgggtctggcgccagaggggactatgcctccgatactttcacaatcggcaacaccaaactgaaccggctgcagtttggcattggctactcttcaactaacgcgcagggactgctcggtatagggtacaccctgagcgaagtgcaaacccgtgccgggttgccagcctataacaaccttccggcgcaaatggtcgccgacggcttgatcaactccaacgcctactccatctggctcaatgacctcgatgccctcacgggtaccattctcttcggcggcgtcgacgccgccaagtacgagggcgacctgctcaccctacccgttcaaaccccagaaaagggcacgtacaagaacctcatggtcaccatgaccggcctgtctctatctcagtcccagtcctcctccagcgacaagggcaacggtgatgacaccacccagatctccaaagacaacctcgcccttgccgttctcttggacaccggctcaaccctcagttatctccccagtgagctcgtcaaaccgctctacgacgcgatcggtatcgaatacataacagaccccgacggcaaagtagatggctacgcgccctgccatctcatgtcctcgtcgcaatccgtcatgttctccttctcctccccgcttcagattgccgtgcccatgaacgagctcatcgtcaaccggaccttccacggaaaactcccacgcatgccggacggcgtcacagacgcctgcatctttggcatccaagaacgtaatggcacgggagcaaacaccttgggcgacacgttcctgcgcagcgcgtatgttgtgtttgatttggacaacaacgagatctcgatggcgcagacgaggtttaatgccacggcgacggacctgaaggagatt

SEQ ID NO: 27246 - DNA, 591 bp, Neurospora crassa
gaatactccgtcatcctcctaggcctcgacaacgccggaaagaccacctttcacgaacaagtcaaggctctcttccaccccgaccagcccgagcccaagttgagaacggttcctacggtcggccaaaatgtctccaccatcacccttcccgacatgtacctgaagctctgggacgtcggcggccagctctcccttcgcgccctgtggcactcgtactactcgtcctgccacgccatcatcttcatcatcgacagcaccgacatcggcgacggccaaatcgagcgcgatcagaacaacgggcggctggacgagtgtcgggcggtgttggaggatgtgttgcagcactcggagacagaaggcgtaccgctgttgatattggcgaacaagcaggaccgggaagactgcgtagaggtggtgcggatcaaggaaggcttggtaaagaaggtcttcgagggcgagaagagcgcaagtatcagagactcgagggtgttgccggtgtcggcactaacggggacgggcgtgagggaggcggtggagtgggttaggtcaagggtaaagtggaacaaggagtcgaggccgccggttatgcgg

SEQ ID NO: 27247 - DNA, 958 bp, Neurospora crassa
gccacggccggcgctgctggtgccgctttcgccaacgtgcttgtatacccacttgatctgtgtgtacacccctcttctttgcgctctctctagcagtcactgactttgtgagaactgcagcatcaagacaaaacttcaagtccaagtcaagaagtccgccgacgttgaaaagcaagaggctacggccagcaatgaggttcactacaagggaacatgggacgccctcaccaagatcaaaaatgccgagggtattgcgggtctttatgctggcatgaacggtgcgctactgggtgtcacgtcgagcaacttcgcctacttctactggtattcgatcgtccgcacgctttatctccagtaccaaaaatcggacgcccacccctcgacggccgctgagttgtcccttggcgccgttgccggtgcgctcggccagcttttcaccatcccagttgcggtcgtcaccacccgccagcaaacgcaaagcaaggaggacaggaagggcatcatcgataccgctcgggaggttgtcgagggcgaggatggcattaccgggctctggagaggcttgaaggctagcttggttctggttgtcaacccggctatcacatatggcgcgtacgagaggctgaaggatattcttttccctggaaagaacaccttgaagccctgggaggctttccgtaagttcgagtcctcggaggattatgcgatatgcttggctaacaattgttctgtagttcttggcgcattgtccaagtcgattgccaccatcgtcacccagcccctcattgtcgccaaagtaggcctgcaatccaagcctcccgcggctcgcaacggcaagcctttcaagagcttcgtcgaggtgatggagtttattgtcaagaacgagggcgctttgagtttgttcaagggtatcgggccccagcttcttaagggctttttagtacaaggtatcttgatg

SEQ ID NO: 27248 - DNA, 1224 bp, Neurospora crassa
agtgaggactgtctgtttctgaatgtttggactccttatcttcccgcagctggccatggtgggaagaaaggaaagggcaaggacggtgatgaaaagaaaaggaaggatttgagaccggtagccgtttggatccatggcggtgccttcactagtgggacttcctctgattcaacctttgacggcggtaatatggcttcgcgaggagatgtggtggttgttgctatcaactaccgcctctccaccctgggcttccttgcgctcgcagatgggaaaaccaacggcaattatggcctcggtgatcaggtcaccgctctgcagtgggtgcgcgaaaacatcgccaagttcggtggtgaccccgatcatgtaactatcttcgggcaatctgctggcgctggctccgttcgcgcgctgctggccagccccaagaccaagggcttgtttaagggtgcgattccgttgagcaaccttggtggtatcaactacggtaccacctacagccggtactacaccatcgccgaggagacagccgtagtcggtaacgccatcctcgctgccacaaactgcaccgacgtagcctgtctgcgccaggtccctgcggagaagcttacctcaggcaccgtagcccgctacctcgtcgtcgacggcacctacctcgtctcccccgagctcgacctctcgcgcaccgccggccccagcggcatcgacctaatgatgggcataacccacgatgacggcgcccccttcatcagctacccgtccaccaccaaccaaaccgcctacctgctctcccaaggcttctctccctcccttgcctcgccatccctcttccccatcccgccaaaccccaacggcacccttgccctcttcaactcctcgtcccgcctcgcgaccgacagcatgttccgctgcatcgaccaagccaccgtgcaagccgggttggccaacaaccgcttctcgcgtgttttttactatgagttcgaccggacctaccagacaggcggctggcccaacctggacgtgtgcgagcctcccaagacagcatcgcacccgttcggggatccgagcaagccgtatctgcgatgccactcgggcgagctgtactatgtctttggcaacttggccagacagggtttacccgtgcgggacgagaaggatttgccgtttgaacagttcgtgctagatagctttgcgagcttcatccggacgggcgatccgaatcctgag

SEQ ID NO: 27249 - DNA, 1659 bp, Neurospora crassa
ccaggcgagatcctagcctgcatgggcccttcaggatccggcaagaccactctactcaacttcctcgcgtcccgccccctcccttccgcctccggcggtggcaccactacctccgggtccgtcctcatcaatggccaacctacttccacctctaccttccgtgagatcacccgcttcgtcgagcaggaagatactttgatcgggtcgctcacggtgagggagactctcgacttctcgtttcgacttgccagctcgtccaaggttctccccaagagggagagaattgccaggattgaaggattacttgatgcttttgggctgagagggcagaaggatgcgctgatcggcacgccgattcgcaagggaatcagtggtggacagaagaggagggtgagcgtggcaagtcagttgatcaccagcccgagaattctgtttctggatgagccgacgagtgggttggatagtaaggccgggtgggaggtggtcaagtatttaaaggaggttgcgaggaggaataatgtgaggctccttccttgtgctgatgtttgctgggaactcgtggctgacaggaacaaaaacagttgatcgtcattgcttcgattcaccagccctccacagcaacgttcaatctctttgataaactcatgctcctttccgctggcaagatgcactacttcggccctgtcacgggcgttacggagcactatgaggccttggggcacgaggtgccgcttcatgtcaatccggccgagttcctgcttgacttggtcaacatcgactttgcttcggagcgcgaggaggcagtaaaggctttggatgacatgcagactgcttggcaaggatctgagagatcgagacagttaactgccgcggtagcggaggcggaagccagaggtggtgatcaagttgatatttctaccgccggacttgggggaaagccgggtttaatcggtagtacggcaacactactccatcggagtttcgtcaagagttatcgagacgtggtggcgtatggcatcagggcagcaatgtactttggtctcgccatcatggtcggtactgtctgggtgagactggatgctgctcaagagtctatcattcctttcatcaacgctctgttcttgtaagtcttactttctcttaccatttcttctcgacctccgtgctaatcatggttttatgaccatcagcggctccgccttcatgtccttcatggccgtcgcctactgtcccgcctggctcgaagattacttccaatacgtcaaagaacgtcgcaacgggctctacggccccacggctctgatcatctccaacttcctgattggcatcccctacctctttggtttttcgttgctgttctccgtcatctcctactggcttgttaacttccagcccacagcgactgccttcttcatctgggtattctggctcttctgcgaccttttggcggcagaaagtctggtggtgtttatgtcctcgctcttcccctcctttgttatttcccttgccttggtcgccttcgccaacggcctgtggatgagcgtcgatgggttcatggtgcagccgacgatcttgaacgtgttttacaaatacgtgtttcattactgggactatcagaagtatgtgtttgagaacatgatgatcaacgagttcaaggat

SEQ ID NO: 27250 - DNA, 532 bp, Neurospora crassa
gcttccgtcacctcgctggacaaggacctgcgcaagctgcgcgccgaaaagtacacgccccaggccgccggcgaggcaaagtcctggatcgagtccgtcatcggcgagaagctgccccagcccgatttgctcgatgccctcaaggatggcgtcgctctgtgcaagtgagtccttacctttctaaaatatccgtccttatcaaacagactaacccctaggcctgttcaggctcgtcaacaaggtgctgccaccacccggcgtcaagttcaagcagtcggccatgcccttcgtccagatggaaaacatctccatcttcctgcgatcgtgcaaggccccgccgctgaacctgctcgagcacgacgttttcctgacggtcgatctctacgagcgcaaagaccccgcacaggtacttcagtgtatcggtgcttttagccgggctgccaacgccgccaaccccgaggcaatcccgactgtgatcggtcccaaagtcaatgctcacaacaccgccaaggtgatcagtccccagcccact

SEQ ID NO: 27251 - DNA, 2262 bp, Neurospora crassa
gcgggcaataacaccactacgggcggccaacccatggagaaactataccgcggggtggaagatatctgccgacggggcaagaaggagagtggggaattgtacgagtggttgaaggatcggtgcaaggggtggttgaacagtgacgaggtgctcaagtcgttattggcggctgctccgtccatagcttcagacatgggaggcgaagaggatgtgatcctgctcagggcggtgctggccgcttggaagaggtggattgcgcagcttttggtgatcagatggatcttcagctacttggataggagttatctacttcccggtggtagcgggactagcgcggaagggaagggtaagagtgctagtggaaaaagggaggggccaacgagtgtcaatgatatgggcatcagtgcgttccgcagcgccatgtatagctcgaggagcaggaacggcgcaaatatgctgaccatcggcgcacgggtggttaatgctgtgtgcgtgttggttatgtttgatcggctcgatgacagcagattcgattcgcagctgttgagggaatcggtggccatgttgaggctctggggcgtgtacggcaaggagctggagcccaagttcatcaacgagtcgagagagtacgtgaggaggtttgcggaagagcgcagcgagtcgtgcgggctcaaggactacattgttgcttgcgagcggctgctcaacaaggaaagcgagcggtgcgatgtgtacaactttgacagcaccaccaagcgccagctcaaggacgacgcgcacgacattctcatcttcaactatgcggagaagctgctggacagcggcagtgtcgcaaagttgctggatgcaaacgacctcgattccatcaaggccctgtacgagctgctaaagttgtcaggtattcagaagaggctgaagggaccgtgggagcagtacatcagaaaggcgggtgcggccattgtcagcgatacagctaggggcgacgaaatgattattcgcatcttgcagctgcgtcgcgcgctagacgtaatggttcgtgatgcgttcggcagagacgaagatttcacgtacgggttacgcgacgctttcgggttcttcatcaacgacaagtcggtatcatcgtcgtggaatacgggcacctcgaaggtgggcgagatgatcgccaagcacattgacatgttgctacgcggtggtctcaagacgttacccaaggcactgttgtccgatgtcaaggacaggcaggatgccgaaaggagcggcattgctagcacggcagatgaagatgctgagctggatagacagctggatcacagcctggagcttttccggttcatccagggcaaggacatcttcgaggcgttctacaagaaggacctcgcgcgcagactcctcatgggtcgcagtgctagccgtgacgcggagaggaacatgctggccaagctgaagaacgagtgcggttcaagtttcacccacaatctggagatcatgttcaaggatcaggaactggccaaggacgaaatcgcctcctacaagacctggctagccggtaggggcgaggactcgcccgtagccaattcggagctcgacctgagcgttaatgtcctatcagccgccgcatggcctacctaccccgatgttcgcgtcctgttgccgcaaaatgtgctggatcatatcactacgttcgacacgtactacaaatccaagcataccggccgccgtctgacatggaagcacaacctcgcgcactgcgtcgtcaaggcccgcttcgaccgcggaccaaaggaactactcgtctcggccttccaagccatcgtcctcgtcctcttcaacgaagccgaagaaaagtctccggacgggatcctctcctacgagcaactcgcctcagcaacggggatgcccgaccccgagctccaacggactctgcaatccctagcctgtggcaagacgcgcgtcctcaacaaacaccccaagggtcgcgacgtcaacaagaccgacaccttttctatcaacaagtccttcaccgatcccaagttccgagtcaagatcaaccaaatccaactcaaggagaccaaggaagagaacaaggagacgcacgaaagggtcgcgcaggacagacagtttgagacgcaggcggcgattgtgcgcatcatgaagagccggaagaagatggcgcatgcgcagctagtggccgaagtgattaaccagacgaagcagaggggggcggtagatgcggcggatatcaaggcgaatatagagaagtac

SEQ ID NO: 27252 - DNA, 207 bp, Neurospora crassa
gaggcccaggtttgggacatcttgatccgcgaatttgcgcccaccaacctcgtcgtgcgagacatatcgggaggctgcggctccatgtatggcgtcgacatctgctctgagaagttccgtggcctcaacatgcttaagcagcaacgcctggtcaacgccgctctcggtgacctggtcaagcagtggcatggcatccagatcaagacc

SEQ ID NO: 27253 - DNA, 1284 bp, Neurospora crassa
atgtctgtccccgaaaagttcaccggcttccaggtcaacggccccgagacctggaccgagttccacaagaacgagttccagcccaagccctttggtgactacgacgtcgacatcaagattgagtgctgtggtgtttgcggtagcgatgttcacaccatcagcggcgggtggggcgagcagaagttccctcttgctgttggacatggtacggtccttgccctacatatgatgcctgccatactgtcctatctctccgtcaaccagctagtgaactccaagactgactgactgactgattgaaaacccatagaaatcatcggaaccgccctccgcgtcggtcccaaagtgactctcatcaagcccggccagcgtgtcggcgtgggcgcccagtcctactcgtgcctcgactgccgtcagtgcaagaacgacaatgagacatactgccgcaagcaactagacacttatggcgccgtgtggcctgataccggcatcgtcagccagggcggttactcctctcacgtccgcacccacgagcactggttcgtttttctttttttctctctctcttttttctccccttctgttccctccctccttttaaaaccccaactgacacattcgtgccccccttgatatgatagggtcttcccaatccccgacgccctcccctccaccgtcgccgctcccatgctctgcgccggtctaaccgcctactcccctctggtccgcaacggctgcggccccggcaagaaagtcggcatcgtcggcctcggcggcatcggccacctgggtctcttgttcgccaaagccctcggcgccaccgtctacgtgatctcgcgcacgcactccaaagaagccgacgcccgcaaaatgggcgccgacggcttcctcgctactgccgaccccaactggaacgaagagcacattatgacgtttgatctgatcatcaacacggccaatagctttgaggggttcgacctggatgcgtacttgagcttgttggatgtccatggcaagtgggtcagtgtgggattgcccgaagatgaggaggggattcgggtgcggaaccagacgttcttgaagaatgggtgttttttcgggagtagtcatttggggagccgcagggagacgttggagatgttgcagcttgcggcggacaagggggtcaggacgtgggtggaggaggtgaagattaatgaggaaaacctaaagggggtgatgcagaagatgaagggtgccggggggaggtatcggttttgtttgaccgggtatgaggaggctttt

SEQ ID NO: 27254 - DNA, 852 bp, Neurospora crassa
caagagctccttcaatggatcaacagccttctccaactcaacctgaccaaggttgagcagtgcggtactgggttagtttgccatgcccctccatcgccatccgccccgccccgcgcccgaccgttgaacgagagccccttttgctaatcgcccccggcccgcaacagcgccgccctctgccaggtctacgacagcattttcggcgatgttcccatgtcccgcgtcaagttcaacgtgaactcggaatatgcctacattcagaacttcaagatcctccagagtgagtagccggttcccctgccaagccgcacagtgagttgagttactgacgacggctttcctccagacaccttcaccaagcaccagatcgaaaagtccatccccatcgaggcgctcgtaaaatgcaagatgcaggacaacctcgacttcctgcagtggaccaagagattctgggaccagtactaccccggcggtgattacgatgccgctgcccgtcgcaagggtggcgctctccctgccaccatgagcggtgcctctcgcgcctccgccggttcggctgccgcgagacgtcccggtggcgccacccccaccggtggtccccgtgtcgctgccagagcccccgctgctaactcggccgccacccaggctctccagcaagaggtcgcaactctcaaggaggccgtcggcggcctggagcgcgagcgtgacttctacttccacaagctgcgcgacatcgaggttcttgttcagagcgctgtcgaggaggaccccgaactcgagaagcaggaggacggtctcatcaaggccatccaggccatcctttactcgaccgaggagggcttcgagattccc

SEQ ID NO: 27255 - DNA, 2112 bp, Neurospora crassa
gagattatcagaaggaggagagagaggaaggctgctaaggaggggaaaaccacggcgacaaaagaggaggaggataagatggaggttgatgaggaagaagacgacatagaagagattgatgtggatttggatgatgatgaggatggtgtcttggctgacgatgcttttggtatgggtgttgggtcggacgtggaagaggaggaggagaagcaggatgcgaagatggggggtgttgatggggaggatgaggatagtgagggtgaagatggggagaagaagggagaggatgaagacgagggcgatgcgtcggatgatgactcggttgctacggccgttgagcatcctgatgatgtgcagtcatcggatgatgaagagggtattgatgaggaggaggaggccaagatgaaggagttctttgcgccggaggaggagaatcagcctaagaagaagggcgagatgtcttcgttccaggagatgtctctctcccgtcctatccttcgcggtcttacttccgtgggcttcaccaagccgacgcccattcaggccaagaccatccccatttcgcttatgggtaaggatgtcgtcggtggtgccgtcaccggttccggtaagacggccgccttcgtcgttcccatccttgagcgtctcctctaccgtcccaagaaggttcccaccacccgcgtcgttattcttacgcccacccgtgagttggctatccagtgtcacgctgtcgctgtcaagctcgccagccataccgacatcaagttctgtctggctgtcggtggtctcagtctgaaggtgcaagaggccgagctccgtcttcgcccggatgtggtcattgccactcctggtcgtttcatcgatcacatgcgcaactctgccagcttcgccgtcgacaccatcgagattctcgtcctcgatgaagccgatcgcatgctcgaggacggtttcgcggacgagttgaacgagattcttaccacccttcccaagtcccgccagaccatgctgttctctgccaccatgacgtcgtctgtcgacaggctcattcgcgccggtctcaacaagcctgtgcgcatcatggccgattcgcagaagaagactgccggtacgcttgttcaagagtttgtccgtctcagacccggtcgcgaatcgaagagggaaggatatctgttgcacatctgcaagactatctacacggagcgtgtcattatcttcttcagacaaaagaagattgcgcacaagatgaggatcatctttggtctgtttggattgtcgtgcgccgagttgcacggtagcatgaaccaggctcaggtatgtttacgatttacgatgctccagatggatgagtgatactaacaggatccatagcgtattcaaagtgtcgaggacttcagagatggaaaggtcaacttcctccttgccaccgatctcgcctcacgtggtcttgatatcaagggtgtcgacaccgtcatcaactacgaggctccccagacccccgagatctacgtccatcgtgtcggtcgtacagcgcgtgcgggccgcagcggtaccgctattaccctggctgctgagcccgatcgcaaggtcgtcaaggctgccgtcaaggccggcaagtctcagggcgccaagatcagcagtcgcatcatcgatcccgcggacgccgacaagtggcaggccgagatcgacgagttggaagatgagattgaggagattatgcaggaagagaaggaggaaaagcagctgcagaacatggagatgcaggtcaagaagggcgagaacatgatcaagtacgaggacgagatcagctcgaggcccaagcgcacgtggttcgagacgcaggaggacaagaagaaggccaaggcggcgggccgggccgagctcaacggcgtcagggacaagctcaagtccaagaacgagggcaagttgagcaacaaggacaggaagaagctcgacaccatgcaagagcgcaagcaggagaggacatacaagaagggcagcgccgagagagccggtaagggcgcggtgctgaacctcaagaaggtcgtcaagaaggtgggacggtctgctgggcctaagaagaagggcggcaatgctggtaagggtggtaagggc

SEQ ID NO: 27256 - DNA, 1331 bp, Neurospora crassa
agagttgatgatgatgatggtcacatgattgtgattcccggaaatgatcttacggagagatgtaagtcgagcgactatggtcacctgccgagggtaatcgacaaactaacaattgttgcagacgagatacttaaattgcttggccaaggcacttttggtaaagtcgtgcaggccaaagacaagaagcgcaacaagcttgtcgcgatcaagatcattcggtctgtgcagaagtacagggacgccagtaaaatagaacttcgtgtactggcaactttgaaggcgaacgacgaggagaataggaaccgttgcatccatctccgggattgcttcgatttccgtggccacatctgcatcgtcatggatttgcttgggcagagcgtgtttgacttcctgaaggacaacaatttcgtgccctttcccaacagtcagatcctggcctttgctcgtcagttgttcactagcgtggcttgtaagtatctcttttttctgtcttcattgtattactgaagagggtactaacgagaaactagtcttgcacgacctcaacctgattcataccgacctcaaacccgagaacatcttgctctgcaatcaagagtatcagacgtttacatactcccgcaccattccgtcatcttccacgctcaccaatcgcagagccgtgcatagaaaggttcttctagacacagagatcaggctcatcgattttgggtccgccacctttcaagatgaatatcattcatctgtcgtaagcacgcgacattatcgtgcgcccgaaatcatacttggactggggtggtcctttccctgcgacatctggagcattggctgcatcctggtcgagttttacacaggtgacgctttgttccagacgcacgataacctggagcatctcgcaatgatggaggctgtagtcaaccataaaattgacccttcgcttgtccaacaagtcaacaggatgaccaggaatggtggaaacccggccgcgaagtatgtgcctccccttgtttttctcagaagtttcactgggctaatcgcggctatcgaacttgtttaggtttttcaagcgctcgaaactggactaccctgctcccgataccacccgtgcatccaagagattcgtaaagggcatgaaacctctcgatgtcagtattactgaaggatcccatttcaagtggacgctccgctgacacaatgcacaggagattatccctgctagaaatagtcgctttcttgctctgttcctggatcttctaaagaagatctttatgtatgatcccaataagcgtatcaccgccaggcaagcccttgagcacgaatggttcagagag

SEQ ID NO: 27257 - DNA, 850 bp, Neurospora crassa
atgctgtcaatcctaagaaaagcgaagctcaaggacaaagagcttcgcatcctcatgctgtaagcaatcacatgcctgcttccagtccgattgcactatgcgcaatttgctgacaggtaccaacgcagaggtcttgacaatgcaggcaagacgacgattgtcaagaaaatcatgaatgaagatgtgaacacggtcagcccaacactcgggttcatcatcaaaaccatagactatgagggttacaagctaaacatttgtaagtggtaaattcctgttacatgggcacaggtttggaaaaactcattgtgacctattctaatcacaacaatccgtataggggatgttggcggccaaaaaacgctgcggtcgtactggaggaattactttgaaaagacagatgcgttgatctgggtcgttgatgccacggacaggctgcgcatccaggactgcaaagatgaactccacggtctgctccaggaagaggtaagtaatccccgctcaaatatgatttgtactccagtctgccaatttcgtccatgtaattgacccaaatttacacatccagcgactgtcgggagcaagcttgcttgtgtttgccaacaagaccgatgtaagggggtgcatgtctgaggacgagctgcgggaagtgagtacctatacttgatgatcttttctatgaatcttcacattgcgaaagtagtaatgctgatgtgtttctccccaggctttgcgactcgatgaaatcaggacgcataagtggaatattctgcggtgtagtgccatgacaggcgaaaatctcaaggagggcttggcgtgggtggttgaagatgcaaaggctcgtcttttcctg

SEQ ID NO: 27258 - DNA, 1068 bp, Neurospora crassa
atgtccgaggaatcgctgctcgagcgcaagtactttgacgggatctacatccccgctggccttttggtcttcggcaccgtcatcgtcaagaaggaatggactctctacgccgcccttgcggccctcatcttgggtgccatcaagtattttaggatgcgtacgttttccccgttatctcgagatgctgaaaaattcacgcgctaacgacctctcgctgcagtccccaagaaggttctcaagcccgctgtcttccaggagttcgagctcaaggagaagaccatcatctcccacaacgtcgccatgtacgtatttctcttaaccccctatcacgtatagaagccaaaaacaaagactaacggttcccccttttgcaacagctaccgcttcaagctccccactcccgactccgtcctcggcctgcccatcggccaacacatctccatcggcgccgccatcgagcaacccgacggctccaccaaggagattgtgcgttcctacaccccgatctcgggcgaccatcaacccggctacttcgacctgctcatcaagtcctacccgaccggcaacatctccaagcacatggcctcgctgcaagtcggccagaccatccgcgtcaagggtcccaagggcgcctttgtgtacacccccaacatggtccgtcactttggcatggtcgccggcggtaccggcatcacgcccatgctgcaagtcatccgcgccattgtccggggccgcgccgcgggcgaccgcaccgaggtcgatctcattttcgccaacgttactgcgcaggacattctcttgaaggaagacctggatgcgctggtggctcaggacaagggtatcagggtccactacgtcctcgatcgcccgcctgagggctggaccggtggtgtcggctttgtcacgcaagagatggtggagaagctgctgcccaagccggcgagtgatgtcaagattctgctgtgcggccctcccccgatgattagtgggttgaagaaggcgacggaggcgttgggcttccagaaggctaggccggttagcaagttggaggatcaggtgtttgctttc

SEQ ID NO: 27259 - DNA, 2400 bp, Neurospora crassa
atgacgccaaataatgttaccgtctcccttttgctaaggcaggccatctactaccatctcgacaattgtgcctacgagagcgcacttttctttgccgagcgactctatgcccacgaccaatccttttgcgattccgcctatctcctcgcctacacccatctgcgactcggcgacgctcgaaccgcctaccatgtcagtcggggctcgggatatagaggttcgcatttagggtcctgctacgtcttcgctcaggcgtgcttggagttggagcgatacagagacggaatcacgggcttggagaatgggaggaaacaatggtccaaggcggacaacttggggaaacatacctcttttaccaggatgccatatcccgatgcggctgcctttagctgtctcctgggcagactttaccgagcatatgacgataagaaaaaggccataccatgttttgaagaggccctacgacgaaatccgttcatgtgggaggctttcacaaacctatacgacatgggagtgagcgtcagagtgccgaatgttttcagagcgagcgatggtcttgcgcaaaccctcgagcatggcctcaacgctacgccgattcttgcttggattgcaggtccttctccgcaaccaccagagcccttgcagctaaagaagaccggccagcaacaaaacagacagccaagcgatccattcgggccatatgggacatcccaggaatcggcgtcatatccagactcggaaaatggctttatatccaagatgtatctttctcagtcaggcattacatcaagtcagccagggaaaccgcttgaggaaaccgatacgcaatctgcgcctgctccaaccgcccataatcctcaggtcactcgtgctgtacaccaggcagagccgccgcaagcgccacctcggagaactcgggcggcccaggcaacagactctactgtaactgatgcaccacccagaacgggacaccgtctgggaacaagaagaaaagataaagctcaagaatcagcgaaagaccatgcggaatcaggtaccaaaacatcaacggtttccagctcaattactgaaagaaaacgcacggcagcagggcatccagtccaaacaagatcgatgaacaatgaggaacctaggcgaagtgcaagacttaatgtagttccaagaccaacggcaacgaaaacaacgagcgcgggagcaacccgtgagctgaggaaggctaggcccccaatatctcgatttgctcggccgggctctagtggagcaaacgttggtcgagttatcagtggcagccggaagccgccacaggaggatattggtatggacattgaccacgccgaggcagtaccacgcaccaaggagccgccggtgctgcaggcggcaccacctccaccccccgcccctaaaccagcggagtctgagtttgtcaaggcggttgaagaagctttgaaaacaatatttgatttgttgaagaagttggcatccggttatgcgctttcatcccagttccaatgccaggaggcagtggcggcgtacatgtcacttccgaggagtcaccaggacacaccctgggttttggcacagatgggaaggactcaatatgaacaggccaactatgccgaggcagagaaatacttcaagcgacttcgcgttattgctccgactcgccttgaggacatggaggtctactcgactgttctgtggcatttgaagaaagagacggagctctcattccttgcccatgagatgatcgactcagtatgggattcaccagaagcatggtgtgcccttggaaacgcatggtcgttggcatatgatcatgagcaagccctgaggtgtttcaagcgagcgacgcaactggatcccaagtttgcgtacgcctacaccctacaaggacacgagcatgtagaaaacgaggaatacgacaaagccctcacggcctaccgacacgccatagcggcagacaagcgccactacaatgcatactacggcatcggaagggtctacgagaagctgggtaactatgacaaggcactgagccattatcacgctgcctcggtgatccatccggcccatgcggttttaatctgctgcataggctcggtcttgcacaggcagaaacagttcaaacaggccctaccgtacttcaccaaagcgaccgaactggctccacgtgcccctgatgtccggctaaagaaggctcgtgcccttttgcagatgggacagttaaaggcggcgcagacagaactcatgattctgaaggacttggctccagacagggctcaggtgcacttccttttgggcaagctctccaagacactgcacgataagaaatcggcggtgcgccactttaccattgctttgagcttagatccaaaggtgagtcttgtactgaaggaggcg

SEQ ID NO: 27260 - DNA, 2715 bp, Neurospora crassa
cccaaacacaagagaaccctcaccggcttcggtcctggagagatcaagaatgttgaaggtatggttggtcccttgacaccaacactacctcctggtaccaacactaacatcatttgttgatatcactcagcctccatccccgagccccagcgcaaggcttggctcgcccaccagaccagcggcttcaaggacaaggacggcttcgaaaccgaggttgtgcgccatgtcgagaccacccttgcccgtagcatgtacaactgcgacgaacaggccgcctactctgcctgcagtctggccttccgtgaccgtctcatcctcgagtggaaccgcacccagcagcgccagaccttcgccgacagcaagcgtgtctactatctctccctagagttcctcatgggccgtgccctcgacaacgccatgctcaacatcggtcagaaggacgtggccaaggctggtctggccgaactcggcttcagaatcgaggatgtcatcgaacaggagcacgatgctgctctcggaaacggtggccttggtcgtctcgctgcctgcttcctcgacagtctggcttccctcaactactcggcctggggttacggcctcaggtaccgctatggtatcttcaagcaagagatcatcgacggctaccaggtcgaggtgccagactactggctcgacttcaacccatgggagttcccgcgtcacgatgtcaccgttgacatccagttctacggccatgtcaccaagcgcactgatgacaacggcaagaccatcgctacctgggagggcggcgagatcgtcaaggctgttgcttatgacgtccccattcccggttatgccactccttcgaccaacaacctgagactgtggtccagcaaggctgccagcggagagtttgacttccaaaagttcaatagcggcgactacgagaactcggtcgctgaccagcagcgtgccgagaccatcagcgctgtgctctaccccaacgacaacctcgatcgcggaaaggagcttcgtctcaagcagcaatacttctgggttgccgcttccctctacgacattgtccgccgtttcaaaaagtcgaggcgcccatggaaggagttccccgaccaagtggccattcagctgaacgacacccacccgactctggctgtcgtcgaactccagcgtatccttgttgatcttgagggccttgactgggaggaggcctggaatatcgtcactaacactttcggttacaccaaccacaccgtcctgcctgaggctctcgagaaatggtccgtccctttgttccagcatctcctgccccgccacctccagctcatctacgacatcaacctgttcttcctccagagcgtcgagcgcaagttccccaaagatcgcgagatgcttgcccgtgtctccatcatcgaggagtctcagcccaagatggtccgcatggctcacttggctattgttggttctcacaaggtcaacggtgttgctgagctgcactctgatctcatcaagaccaccatcttcaaggacttcgtcgaggtctttggtcctgacaagttcaccaacgtcaccaacggtatcactccccgcagatggctccaccaggccaaccctcgcctctccgagcttatctccagcaagacgggtagccagaacttcctcaaggatctgacggagctggccaagattgagcactacaaggatgacaaggcgttccgtaaggagtgggctgagatcaagtatgccaacaaggtccgtctggccaagcacatcaagaagactaccggtgtcgatgtcaatccctctgccctgtttgacgtccaggtcaagcgtatccacgagtacaagcgccaacagatgaacatctttggcgtcatccaccgctatcttaccctcaaatctctctcgcctgaggagaggaagaagttccaacccagagtttccatctttggtggcaaggctgcccccggctactggatggccaagcagattattcacttgatcaacgctgtcggggccgttgtcaacaacgacaaggatattggtgatctgctcaaggtcatcttcctcgaggattacaatgtcagcaaggccgagatgatcattcccgcttcggatctcagcgagcatatctcgactgccggtaccgagtaagttttccgttgtgagggttgtgaaagttagaagctaaccttgaacagggcctctggtaccagtaacatgaagttcgtcctcaacggtggtctcatcatcggaacatgcgatggtgccaatgtaagcaacaaccctctgttctatgccatgtcttctctcgctaaccctctccagatcgaaatcacccgcgaaatcggcgagcaaaacatcttcctctttggtaacctcgctgaagacgttgaggatatccgccacaaccatacttacggctcgtacacggtcgaccccgacctcgtcaaggtgtttgaggccatcgagaagggcaccttcggtgagcccaacgactttatgggcatgatctctgccgtccgcgaccatggcgatttctatctcgtttcagatgacttccacagctacattgagacgcaggagctcgtcgacaaggcctaccgcgaccaagagggctggatcaccaagagcattgagagcgtggcgaggatgggcttcttcagctcggatcgctgcatcaatgagtatgcagagggcatctggaatattgagcctttg

SEQ ID NO: 27261 - DNA, 1590 bp, Neurospora crassa
acaatggccgaatttatccgcgcccagatcttcggaactacctttgagatcacctcgaggttggcctccccgcgacgaacccttctgtcattatgcgctctagtctgatcccgcgataggtattccgatctccagcctgttggcatgggagcctttggtcttgtctggtatgttttccgcttcgctatctggtcacatccgccagacgcacccagctaataatgatgaccgctgcgcagctccgcgaaagaccagctcaccaaccagaatgtcgccatcaagaagattatgaagcccttcagcacaccggtccttgccaaacgcacgtaccgtgagctgaagcttctcaagcacttgaggcacgaaaacgttggtctaccagattccattgcacaagcaattgggaaccacgcgactaacatgcttgcgcaacaggtcatctctctgagcgatatcttcatctctcctctcgaggatatctactttgttaccgagcttctcggaaccgatcttcacagacttcttacgtccaggcctcttgagaagcagtttatccagtacttcctgtaccagattatggtaagtcatcccctgtcaatgtcgcatgaaaacgacggtagccactaactccaggattagcgcggtctcaaatacgttcactccgccggtgttgtccaccgtgacctgaagccaagtaacatcctggtcaacgagaattgcgacttgaagatttgcgatttcggccttgcgcgtatccaggatcctcagatgacgggctacgtttctactcgttactaccgcgcccccgagatcatgctcacttggcaaaagtacgacgtcgaggtcgatatctggagtgccggctgcattttcgccgagatgctggagggcaagcccctcttccctggcaaggaccatgtcaaccagttctccatcatcaccgagcttctcggcactcccccagacgatgtcatcaacacgattgctagcgagaacgtgtgtacccccactctgctgaaggctctgcgacaccgtcactaactctccgtcagaccctgagattcgtcaagtcccttcccaagcgcgagcgtcagcccctgaagaataagttcaagaacgccgattcatcaggtacgtctcagccgctggccatcgccggatacacaagatgctgacctgtcttagccgtcgatctgctcgagcgcatgcttgtctttgaccctaagaagcggataactgccaccgaggccctttcacacgagtaccttgctccttaccacgaccccaccgacgagccggttgccgaggagaagttcgattggagtttcaatgatgctgatctcccggtcgacacatggaagatcatgatgtgagtttcaccgcatcaatatgatgagttgagaaccacacaccactaactgaatcacaggtactccgagatcctggactatcacaacgtcgaagcctcggggcaaatgatgttccaggaagatgttccgccgcaataaaacacggcaacggcagggtccgagacatggcgccgaatcttcaacacaggggtggagtagaagtcccctggcttcatgatac

SEQ ID NO: 27262 - DNA, 1210 bp, Neurospora crassa
gaaagacgaaccatcgaagaacctgagcttggtgagcttcaggttgctgtcaagacgacaggaatttgcggctccgatgtctcatactacaagaagtttgcgaatggcgacctttgcgcctgtatgcctctctctcttggtcatgagtcctcgggcgttgtcgttgccatagggccccaggtctcgggctttagccttggtgacagggtagcgcttgaagttggtgtggcctgcggtcaatgcaccatctgccgcaaaggccgttataatctttgcaaaaagatgagattcaggagtagtgccaagtcagttcctcactaccaaggtaccctccaagagaggatcaaccaccctgctatctggtgtcacatgtaagctcatccaggatttataggtatcaacacaatgctaacaactttgtagactccctgatcatatttcctttgatgctgcagctcttcttgagcctctttctgttggtatacatgctgtcaaccgagcaagtcccgctcccggctctacggctttggtactcggggccggcacggtcgggctactcaccgcagctatggcacgtcaggcaggttgcacacaggtgacgattaccgatgtcgaccaaggccgcgttgatcacgccatcttcaaaggcttcgcaactcacggctacctcgttccccgatcacaccacatctcttccagcagctcctcaatgttccccaacagcaacagcaacagcagctccggctcatccaccccatcagatggcatcgccacaccacccagcaccctttcttttcgcagttcgcttgactccgccaaagctcttgccgccgacgtgctaactcaaacccaaaaccctgtccttgaccgcgatgatgaagacattggcgtcgacgtcacctttgagtgcaccggcaaggaagtgtgcatgcacacagctctgtacgcaacccggccagggggtaaagtcattatggtcggcatgggtacgccaatccagacgctgccgttgtcggttgcccatctgagagaaattgacattctcggcgtctttcgctatgcaaacacgtatgctaccggtattcgaatgctttgtaaccagaaaggatctggtgctgggttcactctcccgagcttggatgacatggttacccaccggtttaaggggctggagaacgccaagggagcgtttgaactggctagtcggacg

SEQ ID NO: 27263 - DNA, 1322 bp, Neurospora crassa
tcggccgagaccattgttattctgaacgatgcatgctatggacatcgctattctcgaccccggacatccaaggcaagcctgagcaccatcgtcgaacgacccgagaggattaaggccagcgtcttgggagtgtcggccgcctatgtacgtctgggcgagcgacaccaagacggttcgttcccgattcatccggatcagcatcccagcaacctcccttcggtaccttttctcatacaaaagacgactcgacgactggccatcacatctccgacagtaaccaacgtacatggcacgaaatggatggaggaactcaagatcatgtgcgataccgctgaagcgaagctggcgacgaatggcaaagaacttcaacgtccggatatggatcgtggacctgatgcggaagagcctccaaagttccatgaaggtgacctctatctgtgtgcagaatcactagatgctatggaaggagctctcggcggtgtctgtgaggccgtcgatgcggtgtttaagcctgagggtccgaaaagggcttttgtagctattcgcccgcctggccaccactgctccgcctcgtatccttcgggcttttgttgggttaacaacgttcatgtgggcattatgcacgcaattctgagccatggcttgacccatgccgccattatcgactttgacctccaccacggtgatggctcccagcaaattgcttggcagcacaactcaagaggcgtaaaggctgcaaagaacgcagcgatgtggaagaagacctccattgggtacttcagccttcacgatatcaactcgtatccttgcgagaccggcgacgacgaaaaagttatgaacgcgagtgtatgcatcgacaacgctcatggacagaatgtgtggaatgtgcacctacagccctgggagacagaagaggatttctgggcactctacgagtccaagtacaccgtcttgcttgagaaggcgcgcagctaccttgtcacacaggcggagcgcttgcgagcagcaggccaaaacgccaaggcagccatctttctttctgctggtttcgatgccagcgaatgggagggcgctggaatgcagagacacgaagtcaacgtccccacagagttctatgctcgattaacccgagatgtagtacggattgcagcagaagtggatacggctgtagagggccgaatcgtcagcgtactggagggaggatatagtgatcgggcgctttgctctggcatcatgagtcacgtttgcggccttgctggagctggttctactggaaatggcaaagctcatgatcagtacaacccttcgtggtggtctgctgc

SEQ ID NO: 27264 - DNA, 13239 bp, Neurospora crassa
atgatggattcggtgccttcgccccctccccagccgagcccggacgccaatggcgttgcgaccacgccttttgctgctgttgaccctgtcaaggttgtcgaccatctcgtcctcctgcttgaagctactctcggcgcaaagcgagacgagctcgaagcgcccggcagtctcctgtccaaggttcgctattcggacaccgttcagcgttgctctcgctttgccttggatacccaggttgccctgtacatacagaaagatcttgctcccaccactacacttgatggagataatggagccgaggcggaagagcgtacgttcggtgcttccactttgcacgcgttgagaaatgtagctaacacacgctttactgcgacagccgagcctacccatgtgtataccatttcaagcgatctgacctcgtccccaacgacggttgcctacctcgtcttgctgaaacgccctcagcctctcgacccgatcgtcccgcttacctcccagatccagatgctcaacctgccgggccctgcatacctatcaacgagcggcagcgagcagggacctaccagctccccttacgagattctccagctgtatctccacaacggtcttgctccatatttcgatgcgagcaccaaaagtcagcagttgctcaacggtgccaggggccgtcccgatgttgatgccaagacgggaattcctgtgaccaagaagcgctggacggagctggaactgagtctgtctcacctccagcaaaatgtcgagatccccgaggtgtctctgccctttcaccctcttgtacagagtacgcttgaggaagcggccaccaagaatgtcaaaccctccatcgaccttcttccagccaccgtgctagcggacagcacgttccttaacaacctgcaggccaccgtcaacaactggatcaagtctattcaggtgattaccaagatgacgagggacccgacgaccggcacggccaaccaagaaatcaacttctggttgtccatggaggcagccctcgagggaatcgagaaccaactgcggagtgagggcgttatgctcacgcttgatattctcaagcatgccaagcgtttccaggccactgtcagtttcacggctgatacgggcttgaaggaggccatggaaaaggttcaaaagtacaatcagctcatgagagatttcccgctcgatgagctgttgtctgccactaccctcacaaaggttcaggaatcgattgggcagatctttggccacctcaacaagaagctgaggatatgcccatatcccattcgccgcgcgcttcccttggtcgaagccatttctggtgacttggacgaggtcctacaccgactgcttcctggaacggagctggtcaaactcgactatgaagagttcaaaggtgtcatgaagcaggcgggcagcatcttccgcgcctgggacgaaagcatcaaagaattcaccaatgttgctcgtgaagtgactcgccggcgtaacgagaagtttattcctatcaagattaacccacgccacgctgagctgcagtctcgcttggactatgtccacaacttccgtgataaccacgagcaactccaaaggacgattatcaacgtgctgggtccgaaggccactgttaatggtattgttacggcgtccggcgctaatggcgtcgctgtagtcgaggaaatcggcgatgtggacgcggttgatgaggttaagcaagcttgggaggctttgaaggatgtcgatttgcttgattgtacccgtgaaggcaccgaaaaatgggtacgcgcagagaatatctacaacgagcgcactgctcgtgtggagaattccatcatcgcccgccttcgtgatcgtctggctacggccaagaacgccaacgagatgtttcgcgtcttctccaagtttaacgccctgttcgtgcgccccaagattcgtggtgctatcgcagagtaccagacacagctcatcgacaacgtaaagcaggccattagctctctgcacgagcgtttcaagcagcaatatggccactcggaggcccatgctatggctcagcttcacgatctgccaccggtgtcaggtgctataatatgggccagacagattgagcggcaactcgaccagtatatgaaaaaggtggagcaagtccttggctcagactgggctcttcataccgagggccaaaagcttcagaatgagagtgatctgttcaggaagaagctggataccaggcccatctttgaggcttggcttcatgatgtccagaggaagcagatatccatctccggcttgctgttcaccatcaacaggattcgctctgctggaaacatcctcgagttggccgtgaacttcgacgcgcaggtcatcgcgttgttcaaggaaacccgaaatctgctttggctcaactaccctgtcccccattcggtcaacaacgtggccaaagaggcaaagcgcgtatatccctttgctgtcagtctgatggaaagtgtcaggacgtttgcccagacaaaccgccagatttctgacatgtccgaggttgctgtgctgctgagcggccaccgcaacgatgtgtacacgctgatctccaagggcataccgctccgatgggagacattcgtcaatacctacgaagtgcacttcaagccaactttcaatcccaacaccccactgggccagacaggctccaaggtcagcgagacgaagcatgtcatgttcatccgcgagttcgctgcttcggtttcgttgctgcagtccaagactctccttcttgccaatatttatgtcacggtacaaaaggcactcaacgagctcaagacctgtccttacgaggcatcggccttccagtcacgcctcgaaaccatccagcatgcagttgaccagctgaacttggagcagtacgtcaaccttggttactgggtggagcgcatgaacaggcaaatcaaggatgttctgtatactcgcttgcaggtcgcaattcaggcttggatacaggcatttgaagacgaggatgttgagcgtccgagcgagcgcaagaggcttctggaaatcgcttctcctgatgcggcgaagtcgattggcccggttatcaagagtctggtgcacgaaattaccatgcggaatcaagttatttatctcgacccgcctctcgaatacgcaagagccagctggtttgcccagttgcaggactggattggggttatctgcaacctaaagaagatcaaggcgaccaggtacaccatgagccttagcacagaagtggttgatgagccgcgcttcaatgatcttcccggcgattgtactgaggagcttctcagggtgcagacttcagtggagaagaagattcgcgagattggcgcttatgtcgacaagtggttgcagttccagtcgctctgggatctccaatccgagcatgtctatgatgttcttggtgaccagctttcaaggtggctccagcttcttcaggagattcgcaagaccagacaaacattcgataccactgaggttagccgctcgtttggccacatcaccattgactatgatcaggtccagacaaaggtcaatgccaagtacgatcagtggcagcaggatatcctcatcaaatttgccagccgcctcggaaaccgcatgcgtgaagtgtatgccgagctcgagaaggctcgcaaggacctcgagggccaggcaatgacggccaactccacggccgaggccgtccggttcatcacgattgtccagagctgcactagacaggttaagctgtgggctcccgagattgaaacctttaggcagggtgaatcgactcttgtccgccagcggtaccatttccagaatgactggttgcatgccgagcaggtggatggcatgtgggatatgctcaatgaactgcttgcccgcaagagcaagattgttaccgaccagtctgatgcccttcgcgccaagattactgccgaggacaaggtggtcaacgacaagatcgccgagatcgcgcaccagtggaacgaagagaagcccgtgtctggcaccattgctccggacgtcgcctctgccaccctcacgcattttgagcagcgcattaccaagttgcaggaggagtcggccatggttgccaaggccaaggaggcgctcgatctggcgccaactcctgacacttcgcttggtgttatcctcgaagaagttcaagacttcaagtctgtttgggcgtcactgtctaccatctggaagaacctcaatgagcttcgtgagacgctttggaacagtgttcagccgagaaagatccgtgcgtcgatcgataatctcatcaaaatgaccaaggagatgccgagcagaatgagacagtatgctgcgttcgagcacatccagaacgtgctgaggcagctgatgaaggttaattctattctgggcgagctcaagtcggaggccgtgcgtgataggcattggaccaagatctacaagcaaatcaagccaggtaaacgctactctcctgtctcaatgacccttggagatgtctgggacctgaacctcgtcgctactgaggtgattgtcaaggatatcattatccaggctcaaggtgaaatggccctcgaggagttcctcaaacaggtccgcgagacatggacgaactacggtcttgagcttgtgcagtaccagcagaagtgtcgccttatccgtggctgggacgacctttttgctaagtgcagtgagaacttgaactcgctccaggccatgaagcactctccttattacaaggagttcgaggaggaggcgtcctcttgggaagagaaactcaaccgcgtccatgtcttgtttgatatctggatagacgtccaacgccagtgggtttatttggaaggcgtattccacggcaacgcggatatcaagcatctgctgcccatcgaatcttctcgcttccagaacattaacagtgaattcttggcggttatgaagaaggtctacaagcagccaaatgtcttggacgtgctgaacatccccaatgtccagaagtctcttgagcgcctcgccgagctgctcaacaagatccaaaaggcgctcggcgagtatctcgagaaggagcgtgtctcattcccaagattttacttcgttggtgacgaagatttgctggagatgattggtaacagcaacgacaccatgcgcattgccaagcatttcaagaagatgttcgctggcctcaacggtcttgtcatggatgatgagggagtcatctccggctttaccagcaaagaaggcgagacagtcagactcaagaaggagatcaacctcgtgaagacccccaggatcaacgactggctcgcgctgctggagaatggtatgaaggttacgcttgccgaactgctcgctgaggcagtggacgagtttacacccattttctcgagcgaaaacgttgatcgcgacgcactgatcaagttcatgaacacctaccccagtcagatcgtcgtgctcgctacgcaggtggtttggaccaccgcggtggaccaggcactcgccgatggcggaaaggacctccagttgctgtttgaccgcgaagttcaggtccttcggatgcttgctgatactgttctcggcgatcttgaagtcctgcttcggaagaagtgcgagcagcttatcactgaatgcgtccaccagcgcgatgtgattgagaagctcgtcaaacttaacgccaactccaacacacactacatgtggcttctgcagatgcgctatgtttacaacccagaaggggacttcctccagcgtctgcacatcaagatggccaatgccaagcttaactatggctttgaatatctcggtgttcctgatcgacttgttcgcacgccgcttacagacaggtgcttcctcactctcacccaagctctgtgccagcggttgggtggttcgccatatggtcctgctggaacaggtaagacggagtccgtcaaggcgctcggtctacagctcggtcgcttcacgctggtcttctgctgtgatgatacctttgacaaccaggccatgggccgtatcttccttggtatctgccaggtcggtgcttggggctgcttcgatgagttcaaccgtcttgaggagaagattctctcggctgtctcgcaacagatccaggatatccagctcggcctgaagatgggcgccgaagatgaaaaggcgcagatcgagcttgacggcagacaaatccacgtcaacgccaacgccggtattttcattaccatgaaccctggttacgctggccgttccaacctgcccgataacttgaagaaactgttcaggagcgtggccatgtcgaagcccgacaaggagctcattgctgaggtcatgctgtactcccagggcttcaatcaggcaaagcagttgagtaagcataccgtgccgttcttcgaccagtgctctgaaaaactgtccaagcaggcgcattacgacttcggtctcagagccctcaagagcgtgctggttagttccggtggcctgaagcgcgccagactgctggagaccggcgatgctgagtcgcttggcccggaagatgttgtcgagcctgagattatcgtgcaaagcatcagagaaacaattgcccccaagttgatcaagtccgatgtggagatcatgatggagattgaaagcgtttgcttccctggtgtgaagtacgtacctgccagccttgaaaagctgcaagaggccatcaggcgtttggcggcggaaaggcagctggtggtcaacgacatctggatgaccaaggtcctgcagctttatcagatccaaaagattcaccatggtgtcatgatggtgggcaactctggctcgggcaagtcggctgcatggcggttgttgctcgacgccctacagcaaacggagaacgtcgagggcgtctctcatgtcattgacagcaaggtcatgtctaaggaagctctctatggcaacctggattctaccaccagagagtggactgatggtctgttcaccagtattctccgtaagattgttgataaccttcgtggagaggacgccaagcgccactggattgtctttgacggtgacgtcgaccccgaatgggttgaaaacttgaacagtgttctcgacgacaacaagcttctcactttgcccaacggtgagcgtctcaacctcccacccaacgttcggatcatgttcgaggtcgaaaatctcaaatatgccaccctcgccactgtcagtcgatgcggtatggtctggttcagcgaggacaccgtcacccccgacatgatggtttccaactacattgagaccttgcgaaccgtcgccttcgaagacctcgacgaggatgcggtcgctacaggccagagctctgctaaggcactggctgtccagagccaagccgctgatctgctccaagagttcttgacgagagacaacctgatcaatgaggttctcaaggaggctgcaaactacgagcacatcatggaattcacagtcgcgagagtgcttagtaccttgttctcgctcctgaacaaggctgtcagagatatcatcgagtacaattccgctcacgttgatttccctatggatccagagcaggtggaggggtatattgccaaaaaggtgctccttgctttggtttgggcactcactggtgattgccctctcaaggaccgcaaggcctttggtgacaaggtcgcaggattggcgagcttcgggtcaccgccattggatggcacgagctcgttgattgacttcactgtcacaatgcctcagggcgaatggcagacttggcagcagcatgttcctaccatagaggttaatacccactcggtcactcagactgatgtcgtcatccccacgctcgacaccatccgccacgaggatgtgttgtactcatggctggctgagcataagccgctgcttctttgcggtcctccgggttccggtaagacaatgacgctgtttagcgctctgaggaagttgcccaacatggaggtcgtcggcctcaacttctcgagtgctactacaccggacctgctcatcaagactttcgagcagtattgcgagtacaagaagaccttgaacggtgttatgctttcgcctacccagattggacgctggcttgtcatcttctgtgatgaaatcaacttacctgctcccgacaaatacggtactcagcgtgccatttccttcctccgccagctggttgaacacaatggcttctggagaacgtcagacaaggcatgggtcactcttgatagaatccagtttgttggtgcttgcaatcctcctaccgatgctggtcgtacgcccatgggtgcgagattcctcagacacgcacctctcatcatggttgattaccccggtgagctgtcgctcatgcagatctatggcagcttcaacgcggccgttctcaaggtcattccctcgctgcgcggatacgccgaggcacttacccaggccatggtgcgcttctatctcgagtcgcaagaacggttcacacccaagattcaaccgcactatgtctacagtcctcgtgaattgacgagatgggtgcgtggtgtgtacgaagccatcaggccgcttgagaccttgtccgtcgagggcctcatccgtatctgggcccacgaagcgctgcgtctgttccaagacagattggttgacgaggaagagcgcaagtggactgatgatgcggtgcgcagaattgccatggagtacttccctacgatcgatgaacacaaggcgcttggcggacctatccttttctctaactggctatccaagaattacgtaccggtcgatcgcgagcagttgcgcgatttcgtcaaggccagactcaagactttctgcgaggaagaagttgatgtgcccctcattctgttcaacgatgtcctggagcatgtcttgcgcattgatcgtgtgttcagacagccccaaggccatttgattctcatcggtgtcagtggctcgggcaagacgacgctgtcaagatttgtggcttggatgaacggtttgaaggtgttccagatcaaggtgcatggcaagtattcggcggaggactttgatgaagatctgagggaggtgttgaggaggtgtggttgcaagggagagaagatctgcttcattatggatgagtccaacgtgctggattccggtttcctcgaaaggatgaatacccttctggctaacgcggaggtgccgggtctgttcgagggcgatgatcttgctgcgctcatgacagcttgcaaagaaggcgcgcagcgccagggcttgctgctcgattcacaggaagagctgtacaagtggttcacgggccagattgtcaagaatcttcacgtcgtgttcaccatgaacccgcccggtgaggacggcctgtcgtccaaggctgccacgtcgcctgcgctcttcaaccgttgcgtgctcaactggtttggagactggtccgatcaagcactgttccaagttgcgcacgagcttactcattctgtggatttggatcggccgaactggaccgcaccggataccattcccgttgcctacaggggtctcaacttgccgccttcgcacagagaggctgttgtcaacgcgatggtttacatccattactcgctgcagcgcttcaatgccaagctgctcaaacagcagggcaagatcactttcctcactccccgtcacttcctcgatttcgttgcccaatacgtcaagctatacaacgaaaagcgggaagatctcgaagagcagcaacgccatctcaacgttggtttggagaagttgcgtgacaccgtcgacaaggtccgtgacctcagggtcactctctcggagaagaaggctcagttggagcagaaggacgctgaagccaacgagaaactgcagcgcatggtggctgatcaacgcgaggccgagcaaaggaagaacatctctctcgagattcaggccgcgctagagaagcaggaagccgaggttgcatcccgcaagaaggtcgtgcttgaggatctcgccagggcggagccagctgtcgaggaggccaaggcttccgtcagcagcatcaagaggcaacatctcacggaagtcaggtctatgcctactcccccctctggtgtcaagcttgcgcttgagtccgtttgcacgctcattggccacaaggcgaacgactggaagacgatccagggtattgtgcgcagagatgacttcattgccagcattgtcaacttcaacaatgagaagcagatgaccaagagtctcagggtcaagatgcgcaacgagttcttggccaacccggagtttacctttgagaaagtcaatcgcgcgtccaaggcctgcgggcccctcgtgcagtgggtggaggcgcaggttaactatgctgagattctggaccgtgttggtccccttagggaagaagtcatgttgctcgaggaacaggctttacagaccaaggccgaggccaaggctgttgagcagacaatctccacccttgaaaacagtatcgcgcggtacaagaccgagtacgccgcactcatcagcgagacgcaagccatcaaggcggagatgtcgagggtgcagttcaaggttgacaggagtgtcaagcttcttgacagcttgtcgagcgagaggactcgttgggaggagggcagcaggtcttttgagacacaaatcagcacgcttgtcggcgacgtcctagtcgcggcggctttcttggcttacagcggtctgtacgaccagaccttccgcaagtcgatgatggaagactggctccaccagctgcacttgtcgggcgtccagttcaagcaacacaacccgatgaccgagtatctctcgactgcggatgagaggctcagctggcaggagaacacgctgcctgtggacgatttgtgcacggagaatgcgattatcctcaagagattcaaccggtacccgctcatcatcgatccttcgggtcgcgctaccgagttccttaacagggagtctaaggatcgcaagcttaccgtcacaagtttcctggacgattcgttcaccaaggtccttgaaagttcccttcgtttcggtaaccctattctcattcaggatgctgaacacctcgatcctgtgctcaaccacgtgctcaacaaggaataccagaagaccggtggccgtgtcctcatccaacttggcaagcagcaaatcgatttctcgcctgcattcaagctttacctctctaccagggatccatctgctacgttcgcgccggatatttgcagtaggacgacctttgtcaacttcacggtcacgcagagcagtttgcagacgcagtcactcaacgaggttctcaagtctgagagacctgacgtagatgagaggcggtccaaccttatcaagctgcagggcgagttcaaggtccatctccgccaacttgagaagaagctgctccaggcgctcaacgagtcgcgtggcaacattcttgatgacgaccatgttatcgagacactcgagaccctcaagacggaggcggccgagatttcagccaagatgagcaacaccgagggcgtcatggccgaagtggagcagatcacactgcagtacaacatcattgccaggtcttgcagtgctgtcttcgccgtactcgaacagctgcactatctcaaccacttctaccggttctcgctgcagtacttcctcgatatcttccattctgtgctccgcggaaatccccatctggcaaacgaaacaaaccacaatgttagacgggatatcattgtcaaggatctctttgtggccaccttcaagcgcaccgcgctgggtctcttgcagaaggaccgcatcactcttgctatgcttcttgcgcaagcttcgccctacaagatggacaagggcctgttggatatcattctcgacgagcgtatcgagggtaaggatgtctcgattgatcagaacacccgcgaagaagcatttgcgcgggcgaagaagattcctgctctcaagaacaagatcgacgcagttccagaagcggattgggagaagttcttcaccgaggagttggctgaggactttgttcccaagatctggaacgacgaaactgagccgaacgaccgcgcgcttatgtcgctgctgcttgtcaagctcttccgcctcgatcgtttcgtccctgcggcggagcgcttcgtcactcttgtcttcggctcagacctgtttgacattgtcgaggacctcaagcaaaccgttgatcaagtgtcggccatccttcccatcgctctggtttcctcccctggcttcgatgcctcttacaaggtcgatggtctcgttgagcgcatgcgcgtccgctgcacaaacattgccatgggttcggccgaagctgaaggcagtgccgacaaggccatcgccaacgccgctcagaccggatcatgggttctcatcaagaacgtccatctcgctcccggctggcttcagggcgtggagaagaagatggagacgctcaaccccaaccccgagttcagactgttcttgtcgatggagtcgagccccaagatccctgtcaacttgctgcgtgcctcaagagtgctcatgtacgagcagcctgcgggtgtcagggcgaacatgaaggattccatgtcgagcatctcgaccaggtcgctcaagagccccgtcgagaggacaaggttgtatctgctgctgtctttcttgcacgccgttgtccaggaaagattgcggtatgcgcctaacctaggctggaagggtttctgggagttcaatgatgctgacgtaagttcttcttcaactatatccctcttgcttaccttcaatggttgatggcgctaaccaaaccaaacacagtacgaatgctccgcgcacgtcatcgatacctggattgacacggccgcccacggccgcaccaacatcgctccttccaacatcccctgggagatgatccgttaccttatcgtcgagacctacggcggcaagattgacgacgagaacgacttcaagatgctcaaccagctcgtccacacctttttgacgccgtccgccttcgatattggccacaagcttgtcgaagtcagccatgatgcggaggatgaacagaaggatgcggcgaccggaggtgaccttgtggtgcccagtggcacatcgctgcaggagttcatgagctggatccagaagctaccggagcgcgagccgcctacatacttgggcttgccggcgaatgcggagaagttattgttggtgggactgggtaagagtttgattgggaacttgaagaaggtgacggatttgttggatgagggggaggcgattatggcagaggcttctgaggctgcc

SEQ ID NO: 27265 - DNA, 1033 bp, Neurospora crassa
atggcgttcacgatgcattcccactccgggcagttctgccccggacacgccaaagaccaactcgaggaagtgatcagacacgccatcagcgtcggctacagaactatcggtctgacagagcacatgccccgtacccagctctcggatctctacccggaagaggtacaaccagccgcacacgcacacgcatatccccaatcccaatcaactcatcataactaaccaaactacctcacaaaactccagctcgacccagaccaagggcaaacaactctcgcccagctcgtcccccgccacgcttcttacctcgctgaagcacagcgtctccaagccaaatatgcctcgcagatccacatcctcatcggcttcgaaggcgaatggattcgcggggctgagtacggtcccctgatcagctccctgttatcttccgccccatgcgtcgactactttatcggatccatccaccacacggccgggattccaattgattttgacaagaccatgtttctgcaggcgcaggacgcgtgtgggggtttagaggagaaactgtgggagaggtactacgatgagcagtttgagatgctcaacgcgacgagaccgaaggtggtgggacactttgatctgatcaggttgttgtcggaggagccggataagagggtgaaggggtggagggatggggtttgggagaggatgaagaggaacttggaggtgtgtaaggggttgggggcttggttggaggttaatactagtgctttgaggaaggggctggaggagccgtatccggggagggaggttgctgaggtgagcttgcggtttttgatttcttcttctattttcctcacagtttgaaaggtgatgaacgctaaccaacaacttggtgggtttacaggaatggatcaagatgggcggcaagtttacgttttcggatgatagccatgggattgcacaggttgctacgaactacacaaggggcttggattacttggagagtttgggagttactgaactctggacgctggaaagggttcctcat

SEQ ID NO: 27266 - DNA, 1533 bp, Neurospora crassa
cgcagactcggaatcgaggttgctaggaccatctctctcaactactcgaaccaagaaacctccttcaccgtcggcgagtcggtccgcgacgaagatgtcttcattatccagtctaccaccaccggcgacgtcaacgagggcttgatggagctcctcatcgccatctcggcctgcagaaccgccagtgcacggaggataacggcagtcatgtaaggatctgatccatgagcatgaacaccttcgcgcgcactctttgcgccagccattggggcttcagtggtagcctgattgtgttggcgcaaaagatgtcacagtgcttttgctttggaaaccggacagactgaactgacaatttcagtcccaacttcccctatgctcgccaggacaagaaggataagtcccgcgctcctatcagcgccagactcgtcgccaacatgttgcagaccgctggtgccaaccgtaagccgttctccaattgctcgaggggccctggtcgccgctaactgtgacttagacattgtcaccgttgatctccatgcttctcaggtacgttctgtctttgcgatccatcgtttgtgcgaagtcatatgttaacaatgtcgcctacagattcaaggtatgcccagctctttaccgattgaacgattgaacgattcccttgacatactcgatatggaaaacgcatgctgacgaatctcgaaaacaaaaggcttcttcagcgttcccggtaagcctgccactgccgcatataagaccacccgattctaaccgatgaacagtcgacaacctgtatgcggagccttctttccttcgctacatccgcgagaactacaagcctgaggactgcgtgatcgtctcccctgatgccggtggtgccaagcggttagtactctgcgtttccagcaagacagacagatcgggctgactaacccttcttcaagtgctacctccatcgcagatcacctcaacaccggcttcgctcttatccataaggagcgcccccgccccaacgttgttggtcgtatggtaagaaagtctgaaatggtgttttggtagggccgaaagttgacagtgtaacaacaggttcttgtcggtaatgtcgaggacaagattgccatccttgtcgatgatatggccgacacttgcggcactctcgtcaaggctgcctctgtcctcaaggagaacggcgccaaggctgtcctcgctctcgttactcacggtattctctccggtaacgccattgagaaccttaacggcagtgtcctcgaggcgcttatctgcaccaacaccgtcccgctcggtgacaagattgaaagggttagttttgactgcacttttcgtctcctctggatgtggaagatcgatctccctatcaaacttggcaagataactgaccagcgcctaccctacataatacagtgccccaagatccgcgtcatcgacatctccccgaccatcgccgaggccattcgccgcacacataacggcgagtcggtgtcttatcttttcaaccacgcccctgtctaaactcag

SEQ ID NO: 27267 - DNA, 696 bp, Neurospora crassa
tgcaacgccaggacaaaaaaaaaaaaaaaaaaaaagacagggtggaattagcagtacactgctcaaatgctgatcagaacataaacagaggtcgtgatcgcccctcccgctctctaccttgacttcgtcaagcagaacctccagaagcccaacgttgaggttgccgctcagaacgtcttcaacaagcccaacggcgccttcaccggcgagatcagcgccacgcagctcctggatctcggcgtcaagtgggtcattctcggccactctgagcgccgcaacgagctcggcgagtcggacgagttcattgcctccaagaccaagtacgccctcgacaacggcatctcggtcatctggtgctgcggcgagtccaaggacacgcgccaggccggcgagaccatcaagttcgtcgagaaccagctcgccgctctcgccaaggagatcaacgactggaagaacgtcgttatcgcgtacgagcccatctgggccattggcaccggcctcgtcgccaccaaggagcaggcccaggaggtgcacgccgccatccgcagctggctcaagcagaacgtcagcgacaaggttgctgaggagacccgcatcctctacggtggctctgtcaacgccaagaactgcaaggaccttgccaaggagcaggacattgacggtttccttgttggcggtgccagcttgaagcccgag

SEQ ID NO: 27268 - DNA, 3904 bp, Neurospora crassa
gacccctacaaacacctccccgagagggaagccaagatcctcaaggagcaggtcttcactcccgacgtcaaggttggcattgcaaccctctaccgctatgccacgcgcaacgatctgctcatcattgctgtctcggccatctgcgccatcgctgctggtgctgccctgccgctcatgaccgtcatcttcggtaaccttcagggtactttccaaaactacttcgcgggggtcaccacctacgatgacttcaccgacgagttggcccgcttggtcctttactttgtctatctggccattggcgagttcgtcaccatgtacatcaccaccgtcggcttcatctactctggagagcacatcagtggaaagattcgtgagcactacctcgagagctgcatgaggcagaacattggcttcttcgataagcttggcgctggtgaggtcaccacgcgcatcactgccgacaccaacttgatccaggaaggcatttccgaaaaggtcggcttgacgctccaggctcttgccaccttcattgccgcctttgtcattggattcgtcagcttctggaagcttaccctcatcctcttgagtaccgttgtcgccttgacccttgtcatgggcggtggttctcagttcatcatcaagttctccaagcaaaacatcgccgcttacgccgaaggtggctcggttgccgatgaagtcatcagcagtgttcgcaatgccatcgcttttggcactcaggaccgcctggctcgtcggtacgatgctcatcttactcgcgccgagcactttggcttcaggctcaagggctccattggtgtcatggttgccggcatgatgacggtgctgtatctgaactacggcttggccttctggcagggttcccgcttccttcttagcggtgacaccgagcttcgcaagatcctgactgttatgatgagtgtgatgataggagctttcaacctcggtaacattgccccgaacctgcaggcttttgtcaccgccttgggtgctgctgctaagatctacaacaccatcgaccgtgagtctcccatcgactcctccagcgaagagggtggcaagctcgagaatgtcgtcggtaccatccgtttggagaacatcaagcatatctacccctcccgacctgatgttgttgtcatggaggacgtcagcctcgttatccctgctggcaagaccactgcccttgtcggagcttcgggcagtggcaagtcaaccatcgtcggcttggtcgaaaggttctataagcccattgaaggaaaggtttacctcgatgatgtcgatatttcaaccctcaatgtgcgttggttgcgccagcaaatcgcccttgtgtcccaggaaccgaccctcttcgcttgcactatctacgacaacattcgccatggcttgatcggtacaaagtgggagtctgagtccgaggagcagcagcgcgagcgtatctatgaggctgcccgaaaagccaacgcgcacgactttattaccagtcttcccgagggttatgagaccaatgttggcgagcgtggcttcttgctcagtggtggccagaaacagcgtattgctattgcccgtgctattgtatccgaccccaagatcctgttgctcgatgaggccacttctgctctcgacaccaagagtgaaggcgtcgtccaggccgctctcgaagtcgccgctgaaggtcgcactactatcacgattgcccaccgcctgtctaccatcaaggatgcccacaatatcgttgtcatggcccagggtcgcatcgtcgaacagggcacccacgctgaattgctcgcgaagcgcggcgcttactacaagctcgtcactgcccaggctattgcagctgtcaatgagatgacggctgaagaagaggcggcgcttgatcagcaggaggaagcggctcttatccgcaaggcgacccggaacagccaaaaggaaggaggagctgccggctatgtggaggatcccgaagataacattgccgaaaaattggaccgcagcaagtcgcaacagagcgtcagttccgttgctattgccgcacgcaagaaggaagagcccaaggagtacggcctgtggacactcatcaagcttattgctagcttcaacaagaaggagtggcacatgatgctcgtcggtatcttcttctcggccatctgcggtgccggtaaccctactcaggctgtcttctttgccaagcttatcagctctctgtaagttgctgtcccccaaactgtcttgcttggcaaaatcactaaccgatcataggtctcgccccattgtcaacgaagaaattagagcctccatcaagtcggatgcctccttctggtgtctgatgtacctcatgcttgctcttgtgcagtgcctcgccttctccgtccagggctggctctttgccaagtgcagcgagcgtttgatccacagagttcgcgacatggctttccgctccttccttcgccaggatgtcgagttctttgaccgggatgaaaactcggcgggtgcgctcacttcgttcctgagcaccgaaaccacgcacgttgccggtctgtctggtgtcaccctcggtacaatcatcatggtcctgactacgctcattgccgcttgcactgtcgctttggccttgggctggaagcttgcccttgtgtgcattgccaccatccccatccttctcggctgtggcttctatcgcttctggatgattgctcactatcagcgccgcgccaagagcgcttatgctggatctgccagctacgcttccgaggccatcacggccatgcgtactgtcgcttccttgactcgtgagcaggacgttcttcagcattacaaggactcactggccaagcaacagcatgccagcttgatctcggttctcaagtccagtcttctctttgctgcttccaactctctcatgttccttgcttttgccttgggtttctggtacggtggtactttgattgccaagcacgagtatgacatgttcaccttcttcattgtgttttcgtcggttatttttggtgcccagtctgccggttccgtcttcagctttgctcccgatatgggtaaggccaccgaggccgctcgtgacctcaaggagctctttgaccgcaagccgactgtcgatacctggtcgaacgaaggtgacttgatcaagcaggttgatggtaccattgagttccgcgatgttcatttccgttacccgactaggcccgagcaacccgtcctccgtggtctcaacctgtccatccagcctggtcaatatgtcgctcttgtaggagcttctggatgcggcaagtccacgaccattgcccttttggaaaggttctatgaccctcttagcggcggcatctttatcgacggacgcgaaatcagcagcctcaatgtcaacgaataccgcagcttcattgccctcgtctcacaggaaccgactttgtaccagggtaccgtccgcgagaacatcatcctcggagccaacaacgacgtcacggatgagcagatcaagttcgcctgccaggaagccaacatttatgactttatcatgtctctccccgatggcatgaacaccttggtcggttccaagggtgcattgctctcgggtggccagaagcagcgtatcgctatcgcccgcgcgctgatccgcgatcccaagattctgttgctcgatgaggcgacgtcggctctggattctgagtcggagcacgttgtgcaggcggcgttggataaggctgccaagggtagaactaccattgcggttgcgcatcgtctcagcacgattcagaaggcggacatcatctatgtgtttgaccagggcaggattgttgagcagggtacgcattcggagttgatgaagaagaatggcaggtatgcagagttggttaacctgcagagtctggagaagcat

SEQ ID NO: 27269 - DNA, 1262 bp, Neurospora crassa
cagatttccaaggtcaagcagaagatctccgaggagaggggctgggctcccgagctgcagaagcttatctactccggtaagcatcgcttgcttctcaaacgatggataccgctcccgaatactgactttaccccaacaggtaagatcttgaaggatgaggagaccgtcgagtcgtacaagatcgaggagaagggcttcgttgtctgcgtcgtgaacaaggtactatttcccccgttattactcacgtccttgtacaaagatgaagctgacactttgcgcagcccaagaccactgcccccaagccagccgagtcgtcgtcgtctgccgctgcccccgctacccccgctgccgccgccccggcctcaacacctgctccccctgccgctcccgcggcctccagcgctgctgccgctgccccttcgacgccgacgcccgctagaaccgctgcggctcctgaggcggccccagctgccggtgctcgcgatgccaacgcccttgccatgggcgagcagcgcgccgaggccattgccaacatggaggctatgggtttcgagcgttcgcagattgacgctgctatgcgtgccgcctttttcaaccccgagcgcgctgtggagtatctcttgaacgtacgtttcacaactcattccactttccgatctatgtctggtttactgacacagctttagggtattcccgccaacctccagcaacaaactgcctctcgccagccttctgccgctccggctgctgcccctgctgctgccgctcaggcggcttcccccgctgctgccggtggtgatgatgacgatcaagtcaaccttttcgaccttgccgctcagctcggcaacagcgctggcggacgtggtgctcgtggtgcggagggtgctggtgccgaggccgctggtcttggtaacctcgacttcctccgcaacaacgcgcaattccagcaaatgcgtcagcttgtacaggagcagccccagatgctggagcctatcttgcaacagctcggtgccggcaaccctcagcttgcccagatgatcgcccagaactcggatcagttcctgaacctccttggcgagggtggtgagggtggctctgtcggtattgctgtcacagaagaggaacgcgatgccattgagcgtctcacccgcctgggctttccccaggaccaggccatccaggcctacttcgcttgcgacaaggacgaggagcttgccgccaacttccttttcgatcaaggaccggaggaagatgacgacatg

SEQ ID NO: 27270 - DNA, 1380 bp, Neurospora crassa
ctcaccgccctcttgggccttgcctccgccaccgccatccgctccgaagcccggcccaagcggactgcctacgatggctacaaggtcctccgtgtcgccgccggtgatgacgccgacaagctgaacaagatcatcgccgacctcgagctcgagacctggaagggtgtggccaaggttggcggtcacgccgacgtggtcatcccgccctccaagctcgccgccttcaacgcccaggccgagggcttcgagaccctcaccatgcacgaggacctcggcgtctccatcgccaacgagtctggtttccaggcctacgccggcacggctgaccagacctggttcaacacgtaccacgcctatgccgaccacttgaccttcctcagggatctcgtggctgcccaccccaaccagtccgagatcgtcacctctggcacttcggtcaacggcaacgccatcactggtatccgtttctggggtagcgccggcaagggcgtcaagcccgccattgtgttccacggtaccgtgcatgcgcgcgagtggatcactaccatggtatgtcaaatctttccagacgttccttggacaaaatcaactaacaaaatctccaggtcgccgagtaccaagcctattacctcctgaccaactacggctccgacgccaccgtcaagtccttcgtcgacaagtacgagttctacatcttccccgtcgtcaacccggacggcttcatctacacccagaccagcaaccgtctctggcgcaagaaccgccagtccaactcgggctcctcgtgcgtcggccgcgacatcaaccgcaactggcccgcccactggtccacgtccggcggcgcctccaccaacccgtgcgacgaggcctacaagggcgccaagcagggcgacgcgcccgagacgacggcgctcgctgcgttcttgaacaaggtcaaggccgcgcaaggtctcaagttgtttattgactggcactcgtactcgcagcttttcatgtctcgtatgtttttccccttttttcttctttttttttactttctttcccccactaatactaacacaccgcacagcctacggctacacctgctcctccgtccccgccaaaaactccgagtaccaatccctcgcccgcggcgccgtggccgccatcaagtccgtctacggcaccaccttcaactacggacccatctgcaccaccgtctacaaggccacgggcaactcggtcgactacgcgttcgatgtcagcggcgccgagtacgcgtttacgttggagttgagggatacaggcgccaatggattcatcctgcctgcgtcgcagattttgccgagtggcgtggaggcgtgggcgggagtcaagtatttgttggccaatatgaagtga

SEQ ID NO: 27271 - DNA, 1384 bp, Neurospora crassa
atcatcaaggttgacttcatctcccagctacctcttgaactcggaatccatatcctgggacaattggatgcgtcatcgctggcttctgcttccctcgtcagtaggtcatggaaccatgctgccatgaaccagcatatttggcgcgagtctttcctccgggagaagaccaccacctacgccacgagcggagccgtcaagccgggaaccggtcttggtgtgccagccatccgccctggcaacgactggaaggagatctacagagtcagagaagaacttgacaagagatggaaggagggcaaagctcgtcctatttacctccatggccatacggatagtatctactgcttgcagtttgacgagtatgtccctgatctgctccttcgaaaccgtatgattactaactttacatagacacaaaatcatcaccggttctcgcgacaagaccatccgtgtctgggacatgaagacttactcctgcaagctcgttctgggtccgcccgagattatcaatgactccgacttgtccctcctccacgacgaagccggcaatcccatccactatgcgacccttcccgagctcgacccccacccctcagccagcggtcaaattcaaacccccgccaggagtcacttctcctcaccggccctcttctcaccccccattttccaccgggcttccatcctctgcctccagtacgacgatgagatcctcgttaccggctcctccgacgccacctgcatcgtctacgatatcgcctccggctaccaacccgtccgtcaactccgtcaccactccgccgccgtcctcgaccttgtcttcgatgacaagcacatcgtcacctgctccaaggatgtctccatttgcgtctgggaccgcgccacgggcgctttgctcaaacaactccgcggtcacaccggtcccgtcaatgccgtgcaaatgcgcggcaacaccatcgtctcctgctcaggtgacttccgcgttaagctctggaacatcgaaactggcaagcagatccgcgagttcttgggccacaccaagggtcttgcctgcagccaattctcagaggacggacggtacgtcgcctccgctggcaacgaccgtgtcattcgcatctgggacgccaacacgggcgaatgcgtgcgcgagatgaaggcgcatggcgatttggtccgctctcttcacgtcgacagcgtgtcgggcaggttgatctctggaagctacgatacggatatcaaggtgtgggatatggagaccggcgcacagctgctcgatttcccgcagtggcataatagctgggtgctatccgccaagagtgattacaggcgtattgtcagctccggacaggatccaaagattctcatcatggatttcggtgcggatgtg

SEQ ID NO: 27272 - DNA, 1700 bp, Neurospora crassa
ggcaccgatacctcgcagggcaagccccagatcatctccaacatcaacgcctgccttgccgtccaggccaccatcaagtcgacactcggtccctatggcggtgacctattaatggtggatgccaacggcaagcagacaatcacaaacgatggcgccaccgtcatgaagctcctcgacattgtccaccctgctgcgcgaatcctcgtcgacattgcccggtcacaagatgccgaagtgggtgacggcaccacctcggtcgtcgtgcttgctggcgagatcctcaaggaggtcaaggaacatgtcgaacagggtgtcagctcacagatcatcatcaagggcctcaggagggcctccaccatggccgtcaacaagatcaaggagattgccatcaacaccgccgagtccaaccgccgcgagaccctgagcaagctggccgccaccgccatgaccagcaagctcatcaagagaaacaccgacttcttcacagagagtaagcgattcgcaatgatgcatttgtcgcacaaatacgctacttctagtactgaccgacccgcctgtgcgcagtggttgtcgatgccgtcctctccctcgaccaagaagacctcaacgaaaagttaataggcatcaagaagatccccggcggctccctgaccgactcgctcttcgtcaacggtgtcgccttcaagaagaccttctcgtacgccggtttcgagcaacagcccaagtcgttcaagaaccccaagatctgctgcctcaacgtcgagcttgagctcaaggccgagaaggacaacgccgaggtgcgcgtcgagcaggtttccgagtaccaggccattgtcgacgccgagtggcaaattatctacaagaagctcgaggccgtgtacgcgacaggcgccaaggtggtgttgtccaagctgcccatcggcgatttggccacccagtactttgccgaccgcgacatcttctgcgccggccgtgtcacctcggaggatatggagcgcgtcgtccaggccaccggcgccaccgtccagagcacctgctccgacatcctgcccgagcacctcggcacctgcggcacctttgaggagcgccagatcggcggcgagcgcttcaacttcttcgaggactgcccgtcggccaagacgtgcacgctcgtcctgcgcggcggcgccgagcagttcatcgccgaggttgagcgctccctgcacgacgccatcatgatcgtcaagcgcgccattcgcaacaagaccattgtcggcggcggcggtgccgtcgagatggaggtttccgcctacctgcaccgcttcgccgatcgcgacgttgcccacaagcagcaggccatcatcaagtccttcgccaaggccctcgagatcattccccgtcagctctgcgacaacgccggctttgacgccaccgacattctcaacaagctccgcgtcgagcaccgcaagggcaacacgtgggccggtgtcgactttacgaacgagggcgtctgcgacatgatggagcgtttcgtctgggagcctgcgctcatcaagatcaacgccctccaggccgccacggaggcagcttgcctgattctcggtgtggatgagaccatcaggaacgaggagagccaggcgccacaggctcctggccagaaactgccgcccggtgcggcccagagggctttgaggggaagaggccgcggcatgcctaggcgg

SEQ ID NO: 27273 - DNA, 2687 bp, Neurospora crassa
ccagccaagaaacgcaaactcaactcgggcacaaaacaatctttttctgttcccagcagaggccttgagtactttttcgctaaacaaaagcagaatggtgcttctaaggaaccatctcctttgcccaaggaatccgactcccagcctgctcagcaagggtcgtcagaagagcatttgaatgatgaggagcttgcgcgaaagctgcaggccgaatgggatgctgaagcaagggcctcatcaacaccgagggaaaatgatgttcgctcgcaggatgtcgcagtgtcgacaacagagcccgtggacacagatggcgttgaaccaaccaatgagtcaaatccacagacagtaaccgcaccacccaaggctgaccggcccaaagggaagaatacattgtcactctcttccgcagccgctacagaagaccaggcatcggcatctattcctcttgacgaaagtcccttgaccttcaatccatccaagtacatcccccagctccaggaatcgtgggccactgatggaggtgatgcgtcctacgccctccttatacgatgctttgtcttggttagcagcaccacaagcaggatcaaaattgtcgacacgctagtcaactgtgtccgactgttgattgaaggagatccgtccagcttgttgcccgcagtatggctggcaacgaacgcaatttccccaccgtacgtgtctatggaacttggtttgggtggttctgctatctcaaaggctctcaaacaagtgtgtggcctggacaacaggtcgctcaaagcacttaacgacaagctgggtgacccgggcgatgttgcattcgaggcaaagaagaaacagagctttactctacgaaagccaaaaccgttaacaatcaagggggtcttccagtcactggtcaaaatctccaagactcaagggcagggcagcggtgatgcaaagcagcggattgttgataaactgctccaggatgctcgcggaggtgaagaaagtagatatgtcgtcaggacattatgtcaacatgtgagttgggcctttccgaaccttaccacctggctaacatggattagttgcgcatcggagctgtcaaaaccactatgctcatcgccctagcccgagcttttttgctttccaaacctccaggcgcgaacatcccgacaaaagacccaaatcaactggcgaagctgaagaaagaggagctagccgaggtatatgcgaaggccgaggaaattgtcaaggcctcgtatgcccgacatccagattacaacgaccttgtcccggtactgctagagactggcgtgtctgaggagttattggtgcgatgtggtctaacacttcacattccgttgcggcccatgcttgggggcatcaccagggacttgtcagaaatgctctctcgacttcaagggcgtgatttcgcttgcgagtacaagtacgacggccaacgtgcccaaattcattgtgacgataggggagttgtctccatcttttcccgccatctagaactcatgacagacaaataccccgatctcgtcgcgctcgttcccaaaattaggggtgaagatgtccagagcttcatcatggagggcgaagtggtcgccgtggaccgggccacgggcgagctgaagaatttccagacgttaacgaaccgtgccagaaaagacgttgcaataggggccatcactatcgacgtgtgtctgttcgcattcgacctcatgtatctcaacggacaaccacttctcaacagatcattccgagaacgacgagacatgttgcgatcactctttatggagataccgcaccattttacatgggtcaaaagcatcgatgcgacatcccaagagtcggaaatagtcctcgagttcttcaagtcggccgttgatagcaagtgtgaaggtatcatggtcaagattctcgacaatctaccagagcttgaggcccctgggcctgacgacagcaccgacccaataatacccaccgagctggtcgctacctcctctgatgccgtcgcggtctcggtctcggccaaaaagtccctaaagggaatgggcaaaggcaatcacgcagaaacgaaagcaccttccgatacgcccaaccccaactccaacgaaaagaagcaatcgcgccgcaaaccgctcctagcaacctacgagcccgacaagcgtctcgactcctggctcaaagtcaaaaaagactacatcggcacctccgccggcgtcgacacgctggacctaatacccatcgccgcctggcacggcaccggccgcaaagccaagtggtggtcaccaatcctgctagccgtgcgcaacgaagaaaccggctcgctcgaagcagtgtgcaagtgcatgtcgggcttcaccgattccttctacaaagccaaccgcgaggtttacgacaaggacggctccttcagttccgatggggagcccaagaatgtacatgtggcgaagccgggatttgtcgagtacgcgggaggcaacccggatgtgtggtttgagccgcaggaggtgtgggaagtggcgtttgcggatatcacgattagtccgacgtacacggcggcgattgggttggtgcgggaggataaggggctgagtttgaggtttccgaggttcttgcggaagagggaggataagggaattgaggaggcaagtacgagcgattttttggcggggttgtggaggaagcaggag

SEQ ID NO: 27274 - DNA, 1828 bp, Neurospora crassa
cggcggggcgaagctctcaaggtcaacatcaccgcgggtgagggcctccaagatgtcctcaagtccaacctggggccctcgggcaccatcaagatgtacgcaagctccgatggcaacttactagttttacttttggctaacaacaagtgcaatgcaggcttgtcgatggcgccggtcaggtacgaattccataaagggggtggaaggcggggatggatgccatcatcacagcatactgaccgccctgcgatgcacaacagatcaagttgacaaaggatggcaacgtcctcctccgtgagatgcaaatacaaaacccgacagctgttatgatcgcccgtgctgcgaccgcccaagacgacatttgcggtgacggcacaacgtcggtggtgttgttggtgggagagctcctcaagcaggccgatcgttacatctccgagggtcttcaccccaggataatcacagatggtttcgagatcgccaagaccgaggcgctcaaggtcagcatccctcgtcgcttttgtttgttcccgtccgtggagcactcctgacactgtcgcagttcctcgatcaattcaagctccctcgcgaggtcgaccgcgagctcctcctctccgtcgcccgtacatcgcttgccaccaagcttagcgccagcctggcccagagcttgaccgccgatattgtcgatgccgtcctcgctatctaccagcccccggccaagcccgaccttcacatgattgagatcatgaccatgcaacaccgcaccgcctctgacacccagcttatccgcggtcttgccctcgatcacggcgcccgccatcccgatatgcccaagcgcgtcgagaacgcctatatcctcaccctcaacgtctccctcgaatacgaaaagtccgagatcaactctggcttcttctactctagtgccgagcagagggacaagctcgtggagagtgagcgtcgtttcgtcgacgccaagctgaagaagattgtcgagcttaagaaggaggtctgcggcaacgatcccaccaagaactttgtcatcatcaaccaaaagggtatcgaccctttgtctctggatgtgttggccaagaacggtatcctcgctctccggagagcgaagaggaggaatatggagagacttcagctcgtctgcggcggtgttgctcagaacagtgtcgacgacctttcaccggaggttctcggctgggctggccttgtctacgagcaacagcttggcgaggagaagtacactttcatcgaggaggtcaaggaccccaagtccgtgaccctccttatcaagggccccaatgcgcacaccatcacccagctcaaggatgccgtccgcgacggtctccgcagtgtctacaacatgattgtcgacaagagtgtggttcccggtggtggcgctttccaggttgcttgcgctgctcatctcaagagcgatgccttcacaaagacggtcaagggcaaggccaagtggggtgtcgaggcttttgccgatgcccttttggttattcccaagacgcttgccgccaacgccggtcttgacgttcaagattctcgtaagtcatgtttctcctctaccagctttgcacatgctaactgttcgtcttcagtcgctgctcttcaagacgagcaagccgagggcaatgtggttggtctcgatcttgcaactggcgagcctatggaccccacactggagggtgtttatgattcgttcagagtattgaggaactgcgtcgcttccagtgccggcatcgcatctaacctgttgttgtgcgacgagcttctcaaggcgagacagatgggtagggctggaggtcctggacct

SEQ ID NO: 27275 - DNA, 1585 bp, Neurospora crassa
atgcccggtgtcatcgaaccaaccggctccggccgcttgctgctcatctccaaccgtctgcccatcaccatcaagcgcgccgatgacggccaatacaccttctccatgtcctctggcggtctcgtcactggcttgagcggcctggctaagagtacaaagttccaatggtatggatggccaggcttggaagttcccgaggccgaaaccgccggcatgaagcagcgcctgaaggaggaatacgacgccattcccgtattcgttgacgacgagctggctgatcgtcattacaacggctttgcgagtaagtgcagcagtagtagcagcttcgccactttctgttatccccttctttgtctgacatcggtgcccctccacagactccatcctctggccgctattccactaccaccccggtgagatcacgttcgacgagtccgcctgggctgcttaccgtgaggtcaaccgcttgttcgcaaaggaagttgccaaggatgtacaggacggagatatggtctgggtccacgactatcacatgatgctgcttccccaaatgctgcgcgaggagatcggcgacaccaagaagaacgtcaagattggcttcttccttcacacccccttccccagcagtgagatctaccgcatcctgcccgtccgggaagcgcttctgttgggtatcctcgactgcgacctgattggcttccacacctacgactacgccaggcacttcttgagcagctgttccagaattctgtaagtcggaacagccatttcactccgatgcgtatgatcgttaagcttggactaacaatttcacagccaaacaccaaccacccctaacggtgtcgattataatggcaaatttgtcactgttggtgccttccccattggtatcgatcccgaaaagttcgtcgagggcctcaagaagcagaatgtccagcaacgtattgccgcgctcacacgcaagttcgagggcgtcaagctgattgttggtgtcgaccgtctcgattacatcaagggagtgccgcaaaagctgcacgccctcgaggtcttccttactgagcatcccgagtggattggcaaaattgtgctagtgcaggttgccgtaccaagtcgacaggacgttgaggaatatcagaacctgcgcgccgttgttaatgagcttgtcggtcgcatcaacggcaaattcggcacggtcgagttcatgcccatccacttcctacaccagtccgtctccttcgatgagctcacagccctctatgctgtcagcgacgtctgcttggtcagctccacccgtgacggaatgaacctcgtctcgtacgagtacattgccacacagcgtgaacgtcatggtgtcatgattctgtccgagttcactggcgcagcccaaagcttgaacggaagtctgattgtcaacccttggaacacggaggagctcgcgaatgcgatccacgacgccgttaccatgagtcccgagcagcgcgaggccaactatcgcaagcttgaacgctatgtcttcaagtacaccagcgcctggtggggccagagcttcgttgccgagctgacaaggataagcgcagaggctgaa

SEQ ID NO: 27276 - DNA, 1506 bp, Neurospora crassa
tacaacatctccttctaccacatcaacgatgtccacgcccatctcgatcagttctcctcctctggcaccgactgcaccaacccggccaagggctgctacggcggttattcccgcgtcaagaccatcatcaacgagacccgcccttcgcacaaggactctcttgtcctcaactgcggcgatgagtttcagggcaccatgttcttctcctactacggtggcgagaagattgccgagaccctcaaccagatcggcttcgacggcatgacgctgggcaaccacgagtgggacaagggtgatgaagtgctcggccagttcctcgagaacctcaccttccccatcatctcggccaacgtcttctccgacaacgcgcgcctcaaccgcaccatcaagccctaccacatctacgaggagtatgacctcgccatcatcggcgtcaccaccgagaccgtgccctccatctcctcgcccggcccgggcaccaagttcaccgacgctatccaggccgtccaggacaccatcgaccacatccgctccaccacctccatcaagcgcattgccgccatcacgcacattgggtacgacgaggaccagcgtctcgccaaggaaaccacgggtctctacctcatcatgggcggccacagtcacacccctctcggcgacttccccggtgccgtgggtccttacccgaccattgtcaagaacaaggacggcgacgaggtattcatcgttaccgcctaccgctggggcgagtacttgggatacatcgacgtcacctacgacgccgatggcaagatcctcgagtaccatggcggtccgatccacctgaccaacaccaccaagcaagatgagggtctccagaagcaaatcgacgcgtggcgcgtgcccttcgaggagtactccaagcaggtggtcggcaccagcaacgtcgttctcgagcagtccacctgccagtccaaggagtgcacctttggcgacttcatctgcgacgccatgcttgactaccgccttaacgcttccaccgatggtctcgccccctcgttcgccctcaccaactccggtggtattcgtgcctcgattgacgtcggcccgatcacccgcggcgaggtcctcactgctttccccttcggcaacgccgtcgtcgaaatcactctctccggccaacaactttgggacgtcctcgctggtatcgtcgctcgtgtcaacaaggccaacggcaaggccgtcacgtctttcctccaggtctcccgcggcatcaagatcgagtatcagcctaccaactctcctgacaacggcgtcggtacgctggctgctgtcaccatcggcggcgagaagctggacatgacgaagcagtacaaggtggtcaccattgactttgtcgccggtgggggagacaacttcttcgctgaggcgatcagcaacttggtggtgctggataccttggatgaggtcctggtgaactacatcaaggagaagacgccggtggatgtggagttggatggccgcatt

SEQ ID NO: 27277 - DNA, 1323 bp, Neurospora crassa
gtcaacccgtccaccttggccccccttcctgccgtccccgtctccacaaaggccgatgtcgacgccgctgtctcggccgccaaggctgccttcccctcgtggcgtgacacccctattgagaagcgtgccgcgctcctcaacacctttgcggatgccatcatggccaactttatggactttgcctctctgcttgcgcttgagggcaagccccccacggcggcgcagttcgaggttgactttgctgtcaagcacttgaaggggacggcgcagctgaggttggacgacgaggtgattgaggataacgaggagaagctcaccaagattcggtacactccccttggtgtcggtgtcggtatcgtccccttcaactaccccttcttcttgggtctcggcaagatgggacccgccgtgttggctggaaacgccttcatctggaagccttcgccctacacgcccaacacggcgctgaagctcgttgagctggccgccaagatcttcccccctggtgttgtccaggctttgtctggcgaggaggacttgggtccctggttgactgctcaccccgatatccgcaagatctccttcaccggcagcacgccgacgggcaagaaggtcatggctgcgtgcgccagcactctcaagcgcgtgacgctcgagctgggcggcaatgacgccgctatcgtttgcgacgatgtcaacctggacgaggtcgtgcccaaggttgctctcggctgcttcaacaacgctggccaagtctgcgttgacatcaagagactattcgtccacgagaagatctacgatcagttcctggccaagatggtcgaggtcgtcaagacgttcaagttcggcgggtccgaagacaccgagggcgccttcttccctcctgtccagaacgcgatgcagttcgagaaggttaaggaactatttagctcgattgagaaggagggcctcaagcctgttattggtggcgaggtcgaggccgaggcgggcgcgaagaagggatactacttcaagcctaccatcatcgacaacccgcctgagaactccaggatcgtgcaggaggagccctttggccctattgtgcccgtcgtgaagtgggtcggtggtgaggacgaggtggtcaggatggccaacaacaccgacatgggattgggtgcctctgtctggagcaaggacttggagaaggcggagaggatcgccaggaggctggaggctggcagtctctggatcaacacccaccaggacctggcgcctaacgtgccctttggtggcttcaagcagtccggtatgggccacgactggggtgtcatcggtcttaagggc

SEQ ID NO: 27278 - DNA, 1308 bp, Neurospora crassa
gaacgtctcggttccatcctcaagcacctgaccccaggtaccgctctgagcaacatcacagccaagaaccccgacgacattgtcatcaccctcgccatccgcacccctctcaccaaggccaagaagggcggcttcaaggacacctcgctcgagtatctcgcctatgccaccctcaaggaggtcaaagagcgctgcaacatggatcccgcgcttgtcgaggatattgccatgggtaatgtacggaaccttgtttgtcactgacagcgtcacatggactcgcttcagaggctaataatggctgtgtggttgcaggtctccgatggcaaggccgcctacaagcttcgtgccgctgcccttgctgccggcttccccaacaccgctggtgcctactcgctcaaccgcttctgctcctcgggcctcaaggccgtcgccgacattgcccacgccatctcgtgcggctccatcgaggtcggtatcgccatgggcgccgagtccatgagcgttggcggcgacgccctcgagcagcccttcgacgaggccgttacctcccagtcccaggagtcggccgactgcatgcagcccatgggctggacctcggagaacgtcagtcgtgacttcggcatcacccgcgaggaaatggacaagtacgccgccgagtccttccagcgtgccgagcgcgcccaaaaggccggcctcttcgacgacgagatcgtccccatcaagacccgcgtcaaggacgctaatggcgagtggaaggacgtcaccctcaccaaggatgagggtatccgccccggcactactgccgagagcctctccaagatccgcgttgccttcccccagtggggtcccaccaccacgggcggtaacgcctcccaggttaccgatggcgccgctgctatcttgctcatgaagcgctctaccgccgtcaagctcggccagcccattctcggcaagtacgtcggctccaccgttgctggtctggctcctcgcatcatgggcatcggcccctccatcgccatccccaagcttctcaaccagtacggcctcaccctcaacgatgtcgatgtcgtcgagatcaacgaggctttcgcttccatggctgtctactgccgtgacaagctccagctcgactggaacaagatgaacccccgcggtggtgccattgccctcggccatcccctcggtgccactggtgctagacagattgtcactggcttggccgagtgcaggaaatcgggcaagaaggttctgttgacgagcatgtgcattggtactggcatgggcatggctggtcttttcgtcaacgag

SEQ ID NO: 27279 - DNA, 1188 bp, Neurospora crassa
aagaaaaaggccaacttcatcgagcgcaccctatggaccttcgtcatgattgctggcttcttcgccgccctcttcatgggccacatctacattgtcgtcatcatcacggccgtccagatcatctccttcaaagaggttattgccatctcgagcggagctagtcgcgcccgggacattcagtctaccaagagcttgaattggtactggctggcggtagccatgtactttctacacggcgaaaccgtcatctactacttcaagcatattgtcatggtcgatagagtcctcctgccgctggctacccaccaccgcttcatctgtttcaccctttacgtcgttggtatgcgcagctccttctctccttagaggcaaagaccaagctaacagaattctgctccaggcttcgtcttctttgtcagcactctcaagggcggccacctcaagttccagttcacccagttcgtatgggcgcacatggccctgttcctcattgtcggccagtcgcactttatcatgaataacgtcttcgacggactgatttggttcttcctccccgccgccctcgtcatcaccaacgacatctttgcctacgtctgcggcatcacctttggccgcacccagctgatcaagttgtctcccaagaagacggtggagggtttcctgggtgcttgggtcatgaccgtcctcttcggcattctactcacccatatcctgatgcgctcccgcttcttcatctgccctgctaatgacctgggcgccaacatcttcaccgggctggattgcgagcccaacccggttttcatcccccagacctggaccatgcccgagttgctattcttccccaccaagacgcgctttagcatcaccatggcgccgatgcagatccataccttcttttgggccactttcgcttcgctgattgcgccgttcggtggcttctttgcttcgggtcttaagcgcacgttcaagatcaaagactttggccactcgattccgggccatggcggtattaccgatcgcatggactgccagttcatcatgggcttcttcgcctacatctactaccatacgttcattgcgcagtccaaggtcgatttcgacgaggtgttggagattgtggcgactcggttgactattgacgaccataagaagttgttgcttttcattgcaaagtatctggtcaaccac

SEQ ID NO: 27280 - DNA, 2997 bp, Neurospora crassa
cgatatgccgaccacataggaattcactatgtgctgtgcagcaagctgcgccagttcccctacgaggacatcgagttcttcctccctcagctctgtcaccttatcatcagcatcgacaatgagtccatggccctggaggagtttctcctcgacctgtgcgaggagtcggtcacagcagccttgttggtgcgcagccctctatacaccatctgacgctttgcacgactccgaattgctgatatctcgcccgctcgcagacattctggctcttccaaacatacctacacgacctatccgctaatccacaggccaatgccttcaaaatatgccagagagtgtacaacaaggtgcagcatatcgtctttggcgtctccgacagtgcaaggaacgagaagattacggaaaacgctttgccagtgactgtcctagggagcttcgttctcgccagtatcgccgccccgtttctcccccattgggctggcccgcttgccgtcgcgcaagccagaaagccccgccctcaagtcatcgaacctgtgttggacgctactcccgtcaacgccgccccacctgctcgcgcgcataccgtcactgctggtacaacaaaatcgagacgggcaaaggaggcccgccttacaagctcatcggaccatcagctccagagcaacaacagcagcccggtggcgcatcgccccaagcccaagatcaaggaacctcagcctgactcccggccgacgtcttcggggtcttctatcaaaacgccggtagagaccaagcgacctactcctttcgattccaacgtcttggaggcgcgccttagttcatcttcactgcctctaccaacgtcgaatgccaattctccaggtcttgtacacaggccgaccactccggccctgcggccaacgactggagtgaacaggaggcactcgcaccatgtcaagacgctcttgaaccaagcggacatgagccgcacacaaaagatgcggctactaaaacaaaactacttccactgccaaacagcattcctgaccgcactagaggatatttcaaaccgactagtaatagtaccaaaggctgcacgcctaagtgccctacgcgctgagctggctctaatcgctcaagaactcccggccgaggtcgatatcccagtcatctgccctcctactttggtcaacggctctccttcgcagagccgacatcacaggatagtccgtctcaacccggctgaggccacggtactgaacagtgctgagaaagtgcctttcctgcttatggttgagattttgagagaagatctcacatttgacccggattctcaagataatcagagacttctgacacagcttttggtcgaacaaggaaccaggaggcggatttttgacctttccgagtcttctaggataccagccacaccccgttcacaggagcccgtcatcgatagtgtttttgagccttcctcgggggatctagggcactcgccactaataaaaccgttcaacgacgagccctttgccatacagcataaccccgttcctggcggtctccgccatgctgccactactgggaccagctcgacacaatttgttgatctgacgtcaacgcctcgcagttctggcacttcgggatcctctaccccacctttcaggaggatgaccctccaaagtccgcgcaacaacgcggccgccgaccaacctgatttctctgcccttgccatccatatgcggacagcctcgcaaatgttggcgcagttggatgcaacaagtggcaagcggccgcgtcatgaagtggccgcaatcagggcaaagattattgccagcatgcagagtctggaggaggagagttttgaagtccatgatagccaagggccgaccttcgacatgattatggccaaggccagtgcagaaaacgttatcaacggcaatgtcgccacggacgaagaaatcgaggctcccctggagaaggtcgagtctaacgtgaatccaaacgccggtctagcaaggatggaaaacgatatcaagacaggcggtctccagcgcaagggcgatcgtgatgatcccagcgctgccgtcttcggagaagcttgggagatgaagaaggagcgtatccgcaagtcctctccttacggctggatgaagaactgggatctcgtcagcgtcattgtcaaaacgggtgcggatctccgtcaggaggcattcgcctgccagctgatccgcgtgtgccacaagatctgggtagagcacaacgtgcccgtctgggtgaagctcatgcgcattcttgttacgggcgagtcgtgcggtctgatagagaccattgccaacggcgtgtcgctgcactccatcaagcgcagcttgacactggccacggtcgagtccggtcaaaaccctaggaggaggatcgcgacgctcaaggatcatttcgtcaaggcgttcggtttgcccgagagccaggcgtacaggtcagctgtggacgcgttcaagaggtcactggcggcgtatagcatcatctcatatgtgctgcagctgaaggataggcacaacggtaacgtccttatcgataatgaggggcacatcattcacattgactttggcttcatgctgtcaaactcgcccggttcggttgggttcgaggcggcgccgttcaagtttacatatgaatatctggatgtgctgggtggcgtggactcgcaggattttgcagactttaagcaactctgcaaacaggctttccagggtaggttctctctctctcatcactcgtaccaggcataaataactaacgactgttatagccctccgtcgttcagcagacaacatcatcgacctcgtcgccatgatgggtcgagaatccaagatgccttgctttggtgcgggcatctcgcaggtaacgacctcgctcagggcaaggttccagctgcagctgagtaaagacgaggcggaacagtttgtggagacggatctaattgccaagtcgttgggaagttattatacgcgactgtaagtt

SEQ ID NO: 27281 - DNA, 702 bp, Neurospora crassa
gttccacagtcgtcgctcgtcctccgattcgtcaacaatgactttcaagagaacaaggagcccacgataggaggttagttcctgaagtcatgacgactttctttgcaccagtttagctgacacttttttgcagccgccttcctaacccagaagtgcaacctgcccacgaggacgatcaagttcgagatttgggatacagcaggccaggagcgcttcgcctctctagcgcccatgtactaccgcaacgcccaagccgcccttgtcgtttacgacctgacgaaacctacttcactcatcaaggccaagcactgggtcgccgagctccagcgacaagcgtctcccggcatcgttatcgcgctcgtgggcaacaagttggatctgaccagcgactcggccggctctgccgaggcttccggaggtggcgacgacaatgcggaggattcgggcgacgcacgcaagatctcgacggacgaggccaaggcatacgccgaggaggagggtctcttgttctttgagacttcggccaagaccggacataacgttactgaggttttcacagccattgcaaacgccatccccgagacgtcgttgaagagcgcgcgtgggcctggtgcctcgcatgccggtgtcagccgcacagaagagcagagggtcaaccttaacgggccgcgggatctcgatgcaaaggaaggttgcgcctgt

SEQ ID NO: 27282 - DNA, 1354 bp, Neurospora crassa
tttgacgcactcaatgtccgcccatggctggtccagtctctcgccaacatggccatcaagcggccaaccggcattcaaaagggttgtatacccgagattctcaagggcagggactgtattggtggcagtaggacaggttcgggtaagacggtagcatttgccgttcccattctccagcaatgggctgccaacccatccgccatctttggtgtcatcctcacgcccacccggtaagtccactccgagtaccccttaacccccacaaacaatcaaacaataggtagaggctaaccacttccacagcgaactcgccctccaaatcatggagcaagtcatcgccctctctcagccccacgtcctcaaagccgtcctcatcaccggcggcgccgacatgcgcaaacaagccattgacctcgccaagcgtcctcacctcgtcattgccacccccggccgtctcgccgaccacatccgcacctctggcgaggacaccatctgcggtcttcgccgcgtcaagttcattgtgctcgacgaagccgaccgcttgctcgccaacagtggccacggctccatgctccccgacgtcgaagaatgcttctccgtcctccctcctccttccgagcgccaaacgcttctcttcaccgccaccatgacgcccgaagtcaaggccctttccgagcgcccgcccattcccggccgcgcccccgtctttgtgtgcgaagtcgacacccagcggctcgccatccccgccaccctgcgccagatgcacctccaggtgccggtcacccaccgcgagcactacctgcacatgttcctgctgaccccgcaaaacgtggacaagagcgtcatcatcttctgcaaccgcaccagcacggccgactttttgcaccacttgttgcgcttgctcgaccaccgcgttacctctctgcactccaagttgccgcagagccagagaatcgacaacctcggtcggttccgcgcctcggctgcgcgcattctggtggcgaccgacgtggcggccagaggtctcgatatccccgaggtgaagattgtgatcaactacgacatcccccgcgatccggacgattatattcatcgtgttggtcgtacggcgcgtgcgggccgcaagggtgatgcggtgacgtttgtggggcagagggatgtcgatctggtgctggcgatcgagcagagagttggacggcagatggaggcatggacggaggagggcgtcaacttggagacgagagtgatcagggatgcgctgaaggtggtgggcgagaagaagagggaggccttgttggagattgaggagcagaaggaggtgggcggaaagaggaagagggggaaggagaagttg

SEQ ID NO: 27283 - DNA, 1655 bp, Neurospora crassa
cttcacaccaagcaggccaacccaggtctccaggcaccccaactccaacagggaccatcccccgttcccacaatggcaccagcccccgcacccctcctccggccagccatccccggcgctcgccccggtggtcggggccccccacgtcttggccttgcgatccccccgtctctaagtgtcaagcccgttggtaatcccggcgctcctccggcgcgtgcggcgccaccacaactcaaactcgctacccccatgggtagcaccacaataccacatgagcagcctgccggacgaccaggcgcccaaggctatagcgctagcggtgccagcgatagcagtgcggcgcatagcaggagtggcagctttggtcccgagagcaaccctaccagcgccgacacccggtatagtaatgtttcgtttatcggcgcccaaaggccacacggcacaccagaccctgtctctgcagtgggttctctctactccaatgccagcgagggaggtgtgggtatggaacgagaaaacagcctgcatggattggaagcattcgacaagcttacactggagaaagcgaggacattagatgtcgaagagcttgatgacgatggatggaggatcgccatgatggagaagagagtcgaggagttgggacccctaggtgagggtgcaggaggtgcggtaaccaaagccaagttgaagggcggcaagaccgtatttgcgctcaaggtatggcactccagcttgagatctgatcccataattttgctcgaatccctgctgacgactcttcgattagatcatcacagcgaaccccgacaaggacgttgccaagcaaattgtccgtgaattagggttcaacaagcagtgcgcctccgagcacatctgtcggtactttggtgccgtcgtcgacacccagtccgcgaccatctccattgccatggagtattgcgaaggcggttctcttgacagtgtttacaaggaggtcaagaagcttggggggcgtacaggagaaagggtattgggcaagattgccgagggcgttctacacggattgacatatctgcatagcaagaagatcatccaccgtgacattaagcctagcaacatccttctctgtcgcaacggcgaggtcaagctttgcgatttcggtgtctcgggcgattatggcacgaacggcgcggccaacacattcatcggtaccagttattacatggcgcctgagcgaatcacaggccagtcatataccatcacctcggacgtttggtctttgggtgttaccctgctcgaggttgcacagcaccgcttccccttccccgccgatggtaccgactcacaaccccgtgccggtctcattgacctgttgacgtacatcgtccgtcagcctgtgccgaagctgaaggatgagcctgatgcgaacattttctggactgacaagttcaagtacttcattgactgctggtatgtgcacccactccttattctttttcttttgtccagcaagctaaccaggagaattgtgtagcttggagaaggatcccaaccgcagagcgagcccttggcgtatgctcgaccacccctggatgttggaaatacggtcaaggcgtgtgaacgtggcccgtttcctggccacggtatggggctgggaggatggaaaggaagag

SEQ ID NO: 27284 - DNA, 2038 bp, Neurospora crassa
gagcaacaacaatggatcacggtccagcaaaagacctttaccaaatggctaaacaccaagattgaggttcgcggcctcgaggtcaaggacctggtaaaagacctcagcgatgctgtacgttatggttctcctttgccccactcactaatccaatgtttctttctgtttcaaatctggcagctaacccctttcccacgtcaacaggtcatgcttatccatctactagaatgtctttctggcgactcacttggacgctatgccgccaaaccgaagctcagggtccagcgtttcgagaacgccaaccttgcgctaaactttatcaaatcacgaggtattcagatgacaaacataggtgccgaggatatcgtggatggaaatcgaaagatcattctaggtctcatctggacactcattctgcgcttcaccatcaacgacatcaacgaagaaggtatgacagccaaggagggtctgctattatggtgtcagcgcaagacagcgtgctatgacgaagtggacgtccgtgatttcagcggcagctggaatgatggtctggccttctgcgcccttctcgatatccaccgccccgatctgatcgactacgacgctctcgacaagtcggaccatcggggaaacatgcagctggcttttgatatcgctcatgctgagatcggtatccccaagctgctcgatgttgaggatgtgtgcgacgttgccaagcccgatgagcgttcgttgatgacctatatcgcctactggttccacgccttctcacagatggagaaggtcgagaatgccggccgtcgtgtggagaagttcttcaacaacatgcaaggtgcctgggagatgcaaagcgcttacgagcgtagaatggccgctcttctcaaggctatccgcgagcaggtcgtttcttggaaggggtcaaccttcgatggcacctatgccgatgctaaggcgcaggcgttccagtttgcatcatacaagaagggtaagaagagagagtgggtagcggagaagagcgatctcgcaacattactcggtaatatcaagacaaagttggctacataccgactacggccgtatgacccaccagcacatttgaggatggaggtgttggatgatgaatggggcaacttgtccaaggcggagatgagccggggacagttgatcaacgaaaccatcagagagtatgtatcttttgtttcattgtgttttcgcgctgaaagtttgttggaactgccgctaacacccctacagcatcaaagacgccctccgaaaatcctttgccgacaaagccaacgatttcgctcttgccctcaacaccatgcaactcgccatctccgggcttgaaggcgacgtagaagaccagctgcaccacgtccgcaagctctccgagaacctgcctccactagacgcttacctcaagaccatcgaggccgtcgacctcaagtgccaggaagccaacattgaagaaaacgacttcacaacctacagttacgacgagctctgctacgagctctccctcgtcaagtcctccgtctccaagaagcttgccttcctcgagaaccagatggtggcccgcaacatgaccaacctgacgcccatccagctcgaggagttcgagtccgtgttccgacactttgaccgggacgacaccaactcgctgtccgagctcgaattcagcgccgccctggcctctcttggccttgtcttctccgaagacgaaatgcacgagtacttcctgtctacctcgaatggccgcgaccgcgtcacgttcgagcagttcatccgcttcatggtggacgtgaccgaggaccagaacacggccgagcaggtgttccagtccttccgggaagtcgccgacgggaaaccctacgtgaccgaaatggacctccgccactccttggtccccgacgaggtgatcgagaaactcatcgagatcatcccgaagcacaccggcccggacatgcagagcgaccgcggcatggagcagtacgattacattgcttttatggaaaagttgatatcggaacaggagggt

SEQ ID NO: 27285 - DNA, 2223 bp, Neurospora crassa
gacggcgccacccagttctttggcagcgggaaacgcgacttttcgtatctgaacttgaaacccgaccacgaccagaagccgctgtggatcgacccggagaagggcaccatcatactcgagaagttcagcccggacgccgaccgcgtcaccgacttcctcgtcaccattgccgagcccaagtcacggccgcatttcctgcatgagtatcagttgaccgcccacagtctctacgctggtgtgtccattggcctgcagtcaaaggatattatagacaccctggatcgcttcctcaagacccccctgcccgagtccattcgtctcttcattgagtcgtgcacaaagagctacggcaaggtgaaactcgtgctgaataacaacaagtactttgtagaaagctcggatgccgagttgttgcagaagctgctccgcgatgaagtaatcggaaagtggcgtgtccagggctccggtgatattaccacctcctatgcgcccaccatgggcggcctggtcatccccggcaccaaagatgccgccggtgtgaaccaggcaggcctcaacaagtctggcaacaagaagactgccgaggatggggccgcggacgctgcggcgactaacgaggcagacctctacgcagccatcaatgaggaagacgacgaggacgacaaggacgccgtccatgcctttgagatccccgaaaccgccgtcgagattgtccaacgacgctgtcttgacctaggatttcccatcttggaggagtacgacttcaggaacgactctaataacgcggatctggaaatcgatctgcgaccaaacacacagattcgtccgtaccaggagcagagtctcagcaaaatgtttggtaacggcagagcaaagagtggcatcattgttctgccgtgcggtgcaggcaagaccttggtcggcattacggctgcctgcaccatcaaaaagggtgtcatcgtcctgtgtaccagcagtatgtccgtcgtgcaatggcgccaggagttcctcaagtggtccaacatcaaccccgacgatattgccgtctttaccgctgagagcaagaacaagttctctggtaatacgggtatcattgttactacatattctatggttaccaacaaccgagaacgatctcacgactccaagaagatgatggatttcctcaagagtcgtgaatggggtctgatgcttctcgacgaggtccacgtcgtccctgccgacgtcttccgaagagttatctcttccatcaagtcgcactccaagctgggtctcacagccaccctgctcagagaagacgacaagatttcccacttgaacttcctaatcggccccaagctctacgaggccaactggatggagctatccgaaaagggtcacatcgccaaggtccagtgcgcagaggtgtggtgtcctatgcccaccgagttctacgacgagtatcttcgtgccaactcgcgcatgaagcgcactctttacgccatgaacccccgaaagttccaggcctgccagtacctgatcaactaccacgaagcccgcggcgacaagatcatcgtcttctccgacgagctgtactcactaaaacaatacgccctcaagctaaataaagtctttatctacggcggcaccggccaagccgagcgcatgcaagtgctcgaaaacttccagcacaacccgcaagtcaacacgctcttcctctccaagatcggcgacacctcgctcgacttgcccgaagccacctgtctcatccaaatctcctcccacttcggttcccgtcgtcaggaagcccagcgcctaggccgtatcctccgagccaagcgccgtaacgacgtcggcttcaacgccttcttttactcactcgtgtccaaagacacgcaggaaatgtactactcgtccaagcgccaggccttcctggtcgaccagggctacgccttcaaggtgatcacgcagctggccaacatcgagaacacgcccgacctggccttcgccacggcgcaggagcggcgcgagctgctgcagcgcacactggtcgacaatgaaaagggcgccgaggatgatgtcgagacggacgatctgtttggtaaggtcgggcgcggaaggggtggcgcaaagggcagagcggcggcggttcggagaatggctggaaccctgggcgagctcagtggtggtcaggatatggcgtacattgagcagaacaaggcggcgaataaggggttgaagaag

SEQ ID NO: 27286 - DNA, 867 bp, Neurospora crassa
agtcccgatggacacgttttccaagtcgagtatgccggtgaagctgtcaagagaggtatgcgctgtcgcctagacccagatccgacactgtcccagctcggttggaggtcctacaggtgtctaacgcggagatacacataggtacctgcgcggtgggcgtaaagggcaaggatgtcgtcgtccttggttgcgaaaagaggtcggccatgaagctccaagacacaagaatcaccccctccaagattggcctggtcgacaagcacgtttgcctcgcctttgccgggctgaacgccgatgccagaatcttggtggacaaggctcgcctagaagcccagtcgcaccgtctcaaccttgaggaccccgtcacgattgagtacattacaaagtatgttgccggcgtgcagcagcggtatacacagagcggtggtgttcgtccttttggtattagcaccttgatcgtcggcttcgacaacggcagcgatgttcccagactctaccagaccgagccctcgggcatttactctgcatggtcagtccacacaaacctaccgccacaacacagacgttcctgagcatggatggagctaacacccccgcaggaaagccaacgccatcggccggtcaagcaagacggttcgcgaattcctcgagcgcaactacaaggacgacatggaccgggaggctacgatccgcctgaccatcaagtccctactcgaagttgtgcaaacgggcgccaagaacattgagatcgccatcatggctcctggcaaggagctcgagatgctccctgtggaggacattgagaactacgtcaagaacattgagcaggagaagcaggaggaggcggacaagaagaagaagggccgg

SEQ ID NO: 27287 - DNA, 1446 bp, Neurospora crassa
ttcaccagcgagacctaccctgaactcaagagggatcctcgctatggccaggtcaccaaggaacatgtcgactatttcaagggtcttttgggcaccgagtctgctgtcattgatggcgtgaccaacgagaacgccaccgatgatatcgagcccttcaacagcgattggatgcgcaagtatcgtggccactgcagactcgtcctcaagccaagctcgactgaggaggtcagcaagatcctcaagtactgcaatgacaacaagctggctgtcgtcccccagggcggcaacactggcctcgtcggtggctccgtccccgtgttcgatgagattgtcctcaacatgggtcgtatgaacaacatcatcgagttcgacgaggtttccggtatcctgactgtcgaggctggtgccattctcgaggttgttgaccagttcctggccagcaagggctacatcttccccttggatctcggtgccaagggttcgtgccatattggaggcaacctctcaaccaacgccggtggtctccgtctcttgaggtacggaagcttgcacggaacgactctcggtatcgaggctgtccttcctgatggtaccgttgtcgatgatctctgcaagttgcgcaagaacaacactggctacgatctcaagcagctctttattggctctgagggcactattggtgtcattaccaaggctgtcatccagtgcccccagcgtcccaaggctcagaacgtcgccctgttcggtcttgagtcctacgaggctgcccaacaggccttccgtgaggccaagggtcacttgtccgagattctctctgctttcgagctcatggacgccggcagccaggctcttgtgcgccaagtaaccaagaagaactcgcctctcgagggcgagtaccccttctactgcttgatcgaaaccagcggatccaactccgatcacgatggtgagaagctccagaccttccttgaggacgtcatggagaagggtatcgttgtcgacggcactcttgcccaggacgagacccaggtcaaggctctttggagctggcgtgaaggcatcacggaagcccttggtcaccttggtggtgtgtacaagtacgatgtctctatccctctccctgagatgtaccagcttgtcgaggacaccaaggcccgcgttgaggaggccggcctcctcggtgacacggatgagcacccggtgcgtgctgttgtaggatacggacacatgggcgactccaaccttcaccttaacgtgtctacccgtcgcttcgacgagcgggtggaaaaggttcttgagcctttcgtctacgagtggatctccaagcgccagggcagcatcagcgccgaacacggtcttggcctcgccaagaagaagtacattgggtacagccgtactcccaccatggtcgggttgatgaagcagctcaaggacctctatgacccg

SEQ ID NO: 27288 - DNA, 729 bp, Neurospora crassa
gtaaccctcaaccgccccaaagccctcaacgccctctccaccccgctcatcaccgaactcaacgccgccctcctctccttccagcaatcccccaccatccgcgccatcgtcctcaccggctccgagcgcgccttcgccgccggcgccgacatcaaggagatggcccccttgaccttctccaaggccttcctcgactccttcatcgagtcctggtccaacctgaccttcaccgtcaagaagcccatcatcggcgccgtctccggccacgccctcggcggcggctgcgaactggcgctgatgacggacatcatctactgcaccaagacagccaactttggccaacccgagatcaagctgggcacgatccccggcgcgggcgggtcccagcggctgacgagggcggtggggaagagcaaggctatggagctgatcctcacgggaaagagcttcagtggtgaggaggcggagaggtggggggttgcggcgagggcgtttgacagctatgaggagttgatggagggggcgctcaagacggcagagacgattgcgggatatagcaaggtggcggtgcaggcggccaaggaggtggttaacaagagccaggaggttggactgagggatggcgtggagtatgagaggcgcatgttccatgccttgtttggaagccaggatcagaagattggaatgaaggcttttgcggagaagggcaaggccaagtgggttgatgag

SEQ ID NO: 27289 - DNA, 781 bp, Neurospora crassa
aggtgcgtagtcgtcggtgacggtgccgttggaaagacatgtctcctcatcagctatacaacgaataagttcccctcggaatatgtgccgacagttttcgacaactatgccgtcaccgtcatgtacgttgcccattcttccaattacccgatcccatcaatgcgcgcatgcaccccatgcagcacaagccaacgcccacccgtttctcttcttcatcatctatctggactttagctgatatgcgccacctcccttcaggatcggtgatgagccctatacgctcggcctgttcgatacagcaggacaagaagattacgaccgtttacgtccgctatcatacccccagaccgacgtcttcctcatctgcttcagcgttgcatcgcccgcctcgttcgaaaacgtgtcccagaaatgggcccccgaagtcaaccatcactgccccggcgtgcccttcctcatcgtcggaacgcagaaggatttgcgctccgacaaggaactgagggacaagcttgcccagcgcaagcagtcgatgatagagttcaagcagggagagaagcttgctcaggatcttgacgccgtcaaatacgtcgagtgcagtgcgctgacacaggaaggtctcaagaacgtgtttgacgaggtaggccattcccaggacggctattgtcggtgagtggtgaagttgcccaaagctgacacccactttttttaggccatcgttgcggcactggagccgcctcagaaaaagacaagtaaaagggacaagaagtgcttgattctgtga

SEQ ID NO: 27290 - DNA, 1117 bp, Neurospora crassa
cctgcctacgaaacccggccgcttccagacctgttgccatggatttccgacttttggttgtcgcttattctgccgcacatcgcctactgggtcgtatccatgttcttccacattatcgacgtctatgaccttttccctcagtatcgcctacacacccccgaagaaatcagccaacgtaatcttgcgtcccgctacgaggttgcccgcgatgtcctcctcgaacaagcgattcagattggcacctcggctgtgctgaatctcctcgacgaccagcaactcaccggacatgagaactacgaagttgccgtctgggcgacgcgcatccgcctggcccagcgtggcctccccaccattctcggtttcgttggactgaatgccggcgccctttccaagaacattgctggctcatacccgctgcttgctggcgcgctcgctggcggtttctacccatccctcttcgagctcgatgacatggccggcacggccgttcccgcgttcgcgtcctgggagattctcttggccaaggccatctactggatcatcattccctgcatcaagttctggtttgccgctttcgtcctcgatagctggcaatacctttggcaccgcgccatgcacatgaacaagtggatgtacagtaagtcttccaaaacacaccgcctcaaatttccacgcagctggaccacccccactaacatctgctttccctccaacagccaagtggcatgctcgtcaccaccgtctctacgttccctacgcctacggtgccctctacaaccaccccgtcgagggtttcgtgctcgacaccctcggtgccgccatcgcctacaagtgctccttcatgacctcgcgcgagggcatgttcttctttgtcggcagcatgatgaagacggtcgacgaccactgcggatacgcgctgccctgggaccccctgcagaacatcaccagtaacaacgccgcttaccacgacatccaccaccagagctggggcatcaagaccaacttctcccagcccttcttcaccacctgggatagaatcctcggtactatgtggaagggtgatacctcgatcaagtacgagcgcacgagggccgcggcggccaacaagaagaagggc

SEQ ID NO: 27291 - DNA, 2441 bp, Neurospora crassa
tcaccgacgaccaaaagccctaaatcgaaaaaggccaagaccgaggaggactcggaggatgttgcgcctgccagcaagcggtcgaggagaagtcgcaaggtggttgaagacgacgaggacgaaaccatggaagatgttcccgcgtcttctgcgccggtgaaggaggagaagagcaaaaaagcagcatcacccaagccggcactaaaaaagaaaagttcctctcccgcaccggtagaaaaggcaaatgatgcggaggcatcctcagcatccgcatccgaaatcgaagccgaagaggaagacgaggacgaaaagaccgaagcagttgccaaagaggcccgcaaggtcatccagaccacactcgcaaccaaggtcaaggacccctacccggactggaaggccggcgaacctgttccttatgccgccctctgcacgacgttttcgctcattgagcagacgcggaagagactactcatcatggagtactgctctcttttcctgcgccaagtcctccgtcttacgcccgacgatctgctgcctaccgtcctgctcatgatcaacaagcttgcgccggattatgcaggtatcgagctgggtattggcgagtcgctcatcatgaaggctatcggcgagactacgggccgtagcatcgctgttgtcaagaacgaccagaaggaaattggtgatctggggctggtggctgtcaagtcgaggtcaaagcagccgaccatgttcaagcccaagccgttgaccattcgcggtgtgcataaagggttgatggatatcgctacgactatgacgggcacaggtgcccagcagaagaaggtggatggtatcaagaagcttttgtctgctgcggacgcaaattcgactggcaaggtggacatcaccaaggacaagggcgggcccagcgaggccaagttcatcgtccggttcctagagggtaagttgcggttggggctagcagagaagtccgtcattgtctccctggcgcaagccatgattgcacacgagttcgcccaaaaggggaaaatccccagcgaatccgactttagcaaagccgagtcgatcctcaagactgtctacagcgagttgcccagctacgacgtcatcatccccgccatgctccagcacggcatcatgaacctccgcgagcactgcaagcttcgcccgggcgtgccactcaagcccatgctggctaacccaaccaaggccatcaccgaggtgctcgatcgcttcgagggccagacgttcacgtgcgagtacaagtacgacggcgagagagcgcagatccattacgtggccaaggacgtgcccaagagcgaaggcgacctcagccaggtcgctagcaaggacactggtaaaggtgttgcggctattttttcacgcaactcggaggatttgtcccagaagtacccggatgtgctcgcgaagctgccgacctgggtcaaggaaggcaccaagagttttgtgctggattgcgagtccgtggcgtgggacacggtcgataagaaggtgttgccgttccagcagctgatgacgcggaagaagaaggacgtcaagctggaggatgtcaaagtcaaagtgtgcgtgtttgcatttgacttgctgtatctgaacggccaggcggtggtggagaaaagtctgagggaacggagggagttgttaagagaggcgttcaagcctgtggagggcgagtttgcatttgcgaccagcatggatgggcaagagctggatgagatccagtctttcctggatgagtctgtgaaggcgggttgtgaagggttgatggttaagatgttggatggcgcggagagtggatatgagccatctaaaaggagtcggaactggttgaaggtttgttttctcccgtaattctagagactatttgggatgatgaactgacacaaagaaaacagatcaaaaaagattacctagccggcataggcgactcgctcgaccttgtcgttcttggcgcctaccacggcaaaggcaagcgcacctccgtctttggcgccttccttttggcctgctacaaccccagcaccgacacctacgaaacggtctgcaacatcggcacgggcttctccgatgaagttctacaggaactccactcttctttatcgcccatcatcatcgaccggcccaagcccttttacgcgcactcctcgggtgggcagcaccagccggatgtctggttcgaaccgaaatacgtgtgggaggtcaagacggccgatctgacacttagcccgaggtataaggcgggcatgaaggaaggggtggacccgagtggtgagaagggcatttctctcaggttcccgaggtttattaaggtcagagatgataagaagccggatgaggcgacaacgagtaggatggtggctgagatgtataggaagcaggagagcgtggggaagaataagggaccagctgttgatgataat

SEQ ID NO: 27292 - DNA, 1485 bp, Neurospora crassa
tcgtcgttgggggctgggttgtgcagatttttgcgcgcaatccaaagactgttacttgtcgctactacaactactcctgggaacgtcgataagcttaccatgcaattttgcttcaatctagtcggagaccgagcccttccaggtcaccctcagcgatgagagcttcgagacctacgagctcgacccccctccctacaccctcaatgtcaccaagaaggagctgaagcagatgtactacgacatggtcgtcgtcaggtatgcaaagactacaatcccccttgtcctcaccggggggctctaagcttcccccctcctatctctgccgatctcggcctggaggatcaacatggcttcaccacatagcatatagctaacacattgctctctctgcatatagacaaatggagatggccgccgacagactgtacaaggagaagaagattcgtggtttctgccatttgtccgttggtcaggaggctgtcgccgtcggtatcgagcatgcgatcgagagagctgacgacgtcatcacctcgtaccgttgccacggcttcgcctacatgcgcggcggtaccgttcgctccatcattggcgagcttctcggtcgccgtggcggtattgcctacggcaagggtggttccatgcacatgttcaccaagggcttctacggcggtaacggtatcgtcggtgcgcaggtcgccgtcggtgctggtcttgctttcgcccacaagtacactggccgcaagaacgcttccatcatcctctacggtaagccttttcttggtgggaacaacgttgggggttcggaaggctaatacattgttataggtgatggtgccagcaaccagggtcaggtctttgagtctttcaacatggccaagctctggaacctccctgcccttttcggctgcgagagtaagtagcccaggtttcatggtcttagatactcttactgacatgtatgatggtgcagacaacaagtatggtatgggtacctctgccgcccgctcgtcggccttgaccgactactacaagcgtggccagtacatccccggtctcaaggtcaacggcatggacgtccttgccgtcaaggctgccgtcgcgtacggtaagcagtggaccaacaacgacaacggccctctcgtgctcgagtacgtcacctaccgctatggtggtcactccatgtccgaccccggcaccacctaccgtacccgtgaggagatccagcgcatgcgctccaccaacgaccctattgccggcctcaagcagcacattctcgagtggggtgttgcctcggaggaggagctcaagaacctcgacaaggaggctcgcgcctacgtcaacgaggaggttgccgccgccgaggccatgcctcctccggaggccaaccagcagattctgtttgaggacatctacgtcaagggtaccgagcccgacttcatccgtggccgtacccctgatgagcttttctacttcaagcactaaaaa

SEQ ID NO: 27293 - DNA, 1634 bp, Neurospora crassa
tttctcaaggccaccaccccggagaaaaagcgaatactcgaggacattgtgaacatgtgcaatagccaacagctcagctttattctccagctggtcagcccgcgcttgaagaaggaccccatgatgagcctgcccgatgagttgtgtttacgagtaagtgctgcgtctgttgatattatctcgggtgtatagcccaggttgttaaccccctaactaggttctgtcgtttatcgacgaccccaaagacctggcaagagcttctcaagtgtctcgcaggtggcgggacctggtgagcgatgacatgacatggaagaacctctgtctgaagcacgactatcagcgtaggctatctgaggtacagacttcgatgcagtattccaacttcctacggccagaccctacgagcagcttttaccagccctatagcgctcccgcggcctcagtcacttttgacgacgcatcgagcctgaggaggcccaggtcatacaagtcgcacttcaaacagcgataccttgtggacgccgcctggcggacagggggacgcaacattacgaaaaacatcacccaggaaggcggtgtagtcactagcctccatcttaccaagaagtacatcattgtagctctcgacaacaccaagatacacgtgttcgacacggaaggaaacgaactacgaacactcaggggccacatgatgggcgtctgggctatggttccttgggacgacgttctggtcagtggtggctgtgatagagatgttcgtgtgtgggatctgacgacggggtatgttacaccattttttcttcttcattgttctttttcccaaccagtatcaggaccccctgctgacacatgtgcccagtgtctgtatgcatacactccgtggacatacctccaccgtcagatgcctcaagatgtcggatgcaaacactgctatttccggatctagggatacgaccctccgagtctgggatatcaagaacggagtgtgccgaaacgtgcttgtcggtcaccaggctagtgtgaggtgtttggagatccatggcgacattgttgtctcggggagttacgacacaaccgctaaggtttggagtatctcggagggccgctgcctacatacactttcaggtcactacagccaaatttacgcaatcgcctttgatggctaccgtgtggcaaccggaagtttggataccagcgtgaggatctggaacgccgctactgggtaagtttacaaaccgcatacatactgacccttttgctatctatccacatgctcttgtgctgacatcgagtctagtgagtgtcaagcggttttacaaggtcacacgtctttggtcggacaactacaaatgcgtggtggcaccctcgtcaccggtggtagtgacggctcagtcagagtctggtcgctggaaaggttctgccctatccatcgccttgcggctcacgataacagtgttacaagcttgcagtttgacgacacgcggattgtcagtggtggcagtgatggacgggttaaggtctgggatctcaagactggccagcttgtccgcgagcttatctctcagggagaggctgtttggcgcgttgcctttgaggccgagaagtgcgttgcgatggcactgaggaacagcagg

SEQ ID NO: 27294 - DNA, 1478 bp, Neurospora crassa
cagacagtcagaattggtcgtgacacggaccgagataataatgacgttgtctttgtcgattccactgtctcaagaaaccactttgagctgtattctatcactgttgacgaagaaggtcgccatacatcacttgtgtttgtgcgagaccgacagtcttccaacgggactctgctcaacaaaaagtgcgttgggaagaagccagacatcactccgggaagactactccagaatggggatgtcatctccatatatccttacatcactttcaagttcgttcagctcgagcagggaacttcgtttttgcggctcactgcacgccagcgagaggagctcaaggtactattgttatcttggcgtgcgacgaaaataaaacatgccatgatctgacttagcaacatccagctccttgagaaccgataccttgtggaagaccgcacattaggaaacggtgcccatgctgtggtctacctagccacagatgtcttgacagggcagcaggtggcttgcaaagtgcacaacttagatagacggccccggtcacaccagatactccgtcggatcaagcaggaggcaatgctgttgagctacctcgatcacgtaagtcattgaaagggcacgggacgatggatcaagctaacaaaagtcgtcagccgaatattctttccatcaaggctgccttcgaatcagagcattcggtgtaagaccttcatcacgagcagctagcagggttgggcaactaatgtatctctaggtatatctttacagagctggctactggtggcgatctcttctcacttctatcacgcgagggggcactccccgagctagaaatacgctggatcatacgccagaccctcaatgctgttgactacatccacaacaagggggtcgcacatcgagacatcaagccagagaatattctctgtgccatagcgccaaatgtctcctacaggcttgttctctccgattttggggactcggctgttacgaaccgtggaagattaaggtccgaggttggaacaaccttctatcgcgccccgtgagtttcgcacttcccctcctgggttgacatatgtcactggattgttgagagcaatgctaacgcttgattcagcgaatgctataactccgagcgaggtcattcattgtctgtcgacatctggtccattgggatgctttgccttcagcttttctctggattccaagaacttccgaatcttcgtcatctcgattttaccagccaagacagaatcgaccgctacctcaacatcatcctcaatgacctcggctgtgacattgctgttcaagatggcgatgaagactacggcaatgacaatgagcccattgaccctcaaacctcccgcctccgtccagatgaaaacatctcaagccatgcaaaggacttcattcgcggatgtctcacctacaacagcaaacaccggctcacggcgcgccaagctcttactcatccctggata

SEQ ID NO: 27295 - DNA, 4204 bp, Neurospora crassa
cctcgataacgcctttactttcctactcccaccatggcgggtgtccaaatgcctgctgccgttgcgcagcacccgcaaatggtcatggctgccaacatgagcggccagcagattcaggaagtctatgcggtatgctttcctcttggtcgcatcagggtatcccactgcgattctgtcatggtctcaagctaacttccaacagcgctaccagcaattgaagaagcagggcgtccctcaaaacgatcccgagtttatgaagctccacaacatcatcctggccgtatcccgcagacagcagcaacaacagcagcaacagcagatgcaacgacaacaacaacaacagcaacagcaacaacaacagcagatggcaggcggtgccgttaacggaggtcagcctggccgtgcccccggaccccagcagacagacggtgtctctggagctcagattccaaagacgcctgctgctaagcctgtcggtatgccaactggccagccacaaggaggtgttccctacacaaaggctcagattcagttgctcaaggatcaaataaaggctttccaagcgctaagtcggaaccagggcgtcccagctgcccttcaaaaacaactttacgagttcagggctcggcgcaactctgctcaggttgcgcaagcggtatccaatgcgtctgctgctcagactaactccagtacaccaacccaagacacccccaagaccggcagctccaacggtcaggaggaggctgattcaacaccaaaggcgcgtgagctcaagacagtcaagctgccactagaagccggactggtcaaaaacagcatcaactacctcgagcatgggcgccgcaagaatcgccttatcatccctggcatttttcccacgggtgtcgatttcgagcagttgagagcagaccgtgagaagattgtgttcaatcgcatgagcgcccgctatgccgagctcaagagcctcccgggtaacctggcgcattgggacacaagtaaagatgaagtcgtcgccgatgacacggctaagcgcaaggccattatcgagatgaagaagctggctttgtactccaaacagcgagcgctgagggataaggtcgggaaacaaatgctacactatgataaccttgcgatgacgacaaataggacaatgtaccgccgcatgaagaagcagagtgttagggaagcccgggttaccgagaagcttgagaagcagcaacgtgacgcgcgcgagaatagagaacgcaagaagcacgtcgagtttctgcaagcggttcaaaaccacaaggtggagatacaaaacgtcgcctcaattcagcgtaacaagctacagaagatgggtcgtctcatgtatgcgcatcacttcaacatcgagaaagaggagcaaaagagggtggaaaggacggccaagcagcgtctgcaggccctcaaggccaacgacgaagaagcttatctcaagctgctcgaccaggccaaggatactcgtattactcaccttctccgccagactgacggtttccttcatcagctcgcctcatcggttcgtgcacaacagcgcgaggccgccgagcgttatggcgacgatttgcaaaacatcccagaagaggagagcgatgtggacgaggacgaagaaagtagccggaagatcgactactatgccgttgcgcacagaatcaaggaagaggtcacagaacaagccagtattctggtcggtggcactctcaaggagtaccagctcaagggtctgcagtggatgttgtcgctctacaacaacaacctcaacggtatcttggccgacgaaatgggtctcggaaagactattcagacaatcagtttggtcacatatctcatcgagaaaaagcagcagaatggaccgtacctggttattgttccgctcagtacgctcaccaactggaaccttgaattcgataagtgggcgccatccgttgccaagatcgtctacaaaggtcctcccaacacccgcaagctgcagcaggagaagatccgccgtggggaattccaggtcttgcttacgacatacgagtacatcatcaaggatcgcccgctgttgagcaagatcaagtggttccacatgatcattgatgaaggacatcgtatgaagaacgctaactcgaagctgagcgccaccatccagcaattctacagcacccgattccgcttaattctcacgggtactcccttgcaaaacaaccttgccgagctgtggtccatgctcaacttcgtcctgccgaacatcttcaaatcagccaagacctttgatgaatggttcaacactcctttcgccaacacgggtgggcaggacaagatggaactcacagaagaagagcagattctcgtcattcgtcgtctgcacaaagtgctgcggccattcttgctgcgtcgtctcaaaaaggatgtcgaaaaggatctgccagacaagacagaaaaggttatcaagtgcaagttttcggccctgcagcaacgtctgtacaagcaaatggttacccaccaaaagattcttgtcagcgacggaaagggaggcaagactggtgcccgtggtttgagcaatatgatcatgcagctccgcaagctctgcaaccatccatttgtgtttgacgaagtcgagaaccaaatgaacccgaccaacaccagcaacgacctgctgtggagaacagccggtaagtttgagcttctggaccgtgtgctgcccaagtataaggcaacgggccatcgtgtcctgatgttcttccaaatgaccgctattatggacattatggaggatttcctcaggttccgtggcattcagtacctccgtcttgacggtacaaccaaggcggaggaccgttccgagctcttgaggctcttcaacgcccctgactcaccttacttcatgttccttctctctacccgtgccggtggtttgggtctcaacttgcagactgccgatacagtcatcatttacgattcggattggaaccctcatcaggatttgcaggctcaggatcgtgctcaccgtatcggtcagaagaacgaagtgcgtatcctgcgtctcatcagttcggcctcggttgaagaaaagatcttggaacgtgccagattcaagctcgatatggacggcaaagttattcaagccggtcgtttcgataacaaatcgtccgaaaccgatcgtgatgccatgctcaggactttgcttgagacggcagacatggcggaggttggtgagcaggaagagatggatgacgaggaactcaacatgattttggcccgtaacgaagatgagttggtcacgttccagcagcttgacgatgaaagagctcgcgatccgctctatggtacggcgccgggatgtaagggtatccctcgcctcatggctgagaaggaactgcctgatatctaccttcaagaaggcaatccgattgaggaagaagaagcggtctctctcggtcgtggagctcgtgagcgcacaaaggtcaagtacgacgatggtcttacagaagagcagtggctcatggcagttgacgatgacgatgattcgccggaggctgcggcggcccgcaaggcggcacgtaaggaacgccgtgaacaaaacaggctcaagaagatggcaatcctcaacaatgcttccggttccgtggatgcctcaccaagtgtaagtcgggctagtactgaggaggtggaggtcgccccgccgacgcccaaaaagcgtggtcgtaagcctggcagcaagaatctcgaaaagcgccctagggaggatggtgatgatgaacctcctgtcaccaagaagcgtcgcggacctggtggccggcccaaggcggtgtcgaacggagacagtcgcatgtcagcagaaatgcgcactaagctgcagcagagcatgaggcggatctttgatgggttgatgaaccttgaagtggaggatgatgagcctgccgagcagctagatggtgacaaggacgaagacgaaggcccacccaccaggctgatcattggtcctttcgtcaagctgccgcctaagcgtgaatggccggattactacctcatgattacgaacccgatttgcatgaaggacatcgaaaagaagatgaagaaggaggactaccactcactttcggatatgcggaaagatttggagttgttggtgaggaactgcaggacgttcaacgaggagacatccatgatttgcatagatgcaaacaggatagaggta

SEQ ID NO: 27296 - DNA, 1283 bp, Neurospora crassa
atgggttgcggaatgagtacagaggagaaggagggcaaggcccggaacgaggagattgagaaccagctcaagagggatcgcatgcaacaacgcaatgagatcaagatgcttcttctgggtatgtcatgccccccgacaagccaattgctggcgcggccctggtccggacccttgggtcaccaatgaaatttcacagaagctgacaatatgttgcaggtgctggtgaatccggaaagtcgaccatcttgaagcagatgaagcttatccacgaaggaggttactcgcgcgacgagcgcgagtcgttcaaggaaatcatcttcagcaacactgtgcagtccatgcgtgtcattctcgaggccatggagtccctagagttgccactcgccgatcagcgcgtcgagtaccatgtccagaccatcttcatgcagcccgctcaaatagaaggtgacgtgctgcctcctgaggttggcaatgctatcgaggccctctggagggacgctggcgtccagagctgctttaagaggtcaagggaataccaattgaacgactcggcaagatagtaagtctccgcatgatgagggaggctctggtctccaaccgctaacatgctgtcacagctacttcgataacatcgctcgtatcgccgcgcccgactatatgcccaacgaccaggacgttctgcgatcacgtgtcaagacaaccggtattacggaaacgaccttcattattggcgatcttacgtaccgtatgttcgatgtcggtggccagcgtagcgaacgtaagaagtggatccactgcttcgagaacgtcaccaccattcttttcttggtcgccatttccgagtacgatcagttgcttttcgaagatgaaaccgtcaaccgtatgcaggaggcccttactctgttcgattccatctgcaactccaggtggttcatcaagacatccatcattcttttcctcaacaagatcgataggtttaaggagaagttgccggtcagcccgatgaagaactacttccccgattacgagggtggtgatgactacgctgccgcttgcgactacattctcaaccgcttcgtcagtttgaaccagcacgagaccaagcagatttacacgcatttcacatgcgcgacggataccacacaaattcgtttcgtcatggctgcggtcaatggtatgttatttgtctacttcgaaattttgcgtggacaagaagctaacagaccaaaacagatatcattatccaggagaacctgcgtctctgcggtttgatttgagcactg

SEQ ID NO: 27297 - DNA, 1221 bp, Neurospora crassa
gccaaaaccaaccaaacaacccccgagaccctcaccatctcgctcgagaacaacaccccttcctccaccgtgtacgcctacatcaccggccaaaccctggacggcggcctcttcgtcctctccgccagcggcaacgccgcttacacttatgcctccgtgaacaagaccctgacccccatccccccttccgatatcgccatcccgctcaacgcccccggttcttcgtctcctcgcacggtaaccatcccccgcctggcgggagcgaggatctggttctccgtcgattcgcagctggagttctttttgaacccggtggacggagtgccgcaagatggaaagggagcgggcctggcgctggtggaaccgagtgtcaccaacgacaaagatgtaaactacgagaaggagtgggggtttgtcgagtttacctttaacgagttccagctgtttgccaatgtctcgatggtggatttggtgggcaagtgtcctgcctcgctcggcgtcatcaggaccacggggaagccggaagataaccaagaggttgaagggatggggtatgagactggcttgaacaaggtggtcgatgaactgaagcaggccggaggggattgggaaaagctggtggtgagaaggaagagtgatgggcaggtgacgagggtgatgagtcccaattcggcggtggtgatggctgaagcgagaaaggaaagcttgttcagcgggtactatgacggctatgtgaagcaagtttgggacaagtatgcaaaggaagatttgatggtggatacgcagaacaaatggggggtggttaagggaagggttgacgcggggacgggtctgttgacgttcaaatcgaacaacagcgagacgattacatttgataagccgtcggcggccgatatctactcttgttccacgggcccgttcgcctttccaccgttaccggcgaacgcgaccgaagccgagctcgacatccaggcgttccgaggaaacgtcggggcgcgtctggcggcggccttgaacagaagtacgttgctgatcaacaacaaccaaccagctggtgaggaaatcagtacgttctacaagagcaacaacatcacgaatcactacagcagagtggtgcaccaaaacagcccgaaaggaaaggggtatgcgttcccgtatgacgatgtgtcaaggacggagaaggaaaacgtcgctggtaccgtggcagcgggagatccaaag

SEQ ID NO: 27298 - DNA, 2363 bp, Neurospora crassa
ttcagccgcatgggtgtcctccgtgacctcaagaaggctaacgaggcttactgggctgacaagatctcccaggaggctctcctcgccgagggtaagaggctccgtctcgcccactggaagatccagaaggatgccggtgtcgacatcatcccctccaacgacttcgctcactatgaccacgtcctcgaccacatccagctcttcaacgtacgttagcctccacctataagcagccccacccccatctccacttcctgggattgcgtcaactaactggccccactctctactaggctgttcccgagcgttacacttcccagaagctctcccctctcgatgagtacttcgccatgggccgtggccaccagaagggtggtgtcgatgtccccgccctcgagatggttaagtggtttgactccaactaccactacgtcaagcccactctccaggacaaccagaccttctccctcgccaaggaccccaagcccgtccgcgagttcctcgaggccaaggaggctggtttccagacccgccccgttcttgtcggccccgtctccttccttgctcttggcaaggctgaccgtggttcctccgtcgaccccatcaccctcctcgacaagcttgtccctgtctacgtcgagctcctgaagcagctcaaggccgctggtgccgagtctgtccagattgacgagcccgtcctcgtcttcgatctccgccccgaggtcaaggctgccttcaagcccgcctacgaggccattgccgccgctggtgatgccgttcccaaggtcgtcgttgccacttacttcggtgacatcgtccacaacttcgacgttctccccgctttctccggcgctgctggtctccacgtcgaccttgtccgcaaccccgagcagcttgagcctgtcctcaagcagctcggccctaaccagatcctctctgccggtgttgtcgatgggcgcaacatttggaagaacgacttcgccaagtcgctcgagatcctccagactgccgtcaaggcccttggctctgagcgcgtcatcgtcgctacctccagctccctcatccacactccccacaccctcgccagcgagaagaagcttccctctgatgtctacgagtggttctctttcgccgtcgagaaggtcaaggaggttgctaccctcgccaaggctgtgaccgagcccgaggccgtcaaggctgagcttgaggccaacgctgctgccatcaaggcccgcactgactccaagcgcaccaacgaccccgctgtcaaggagcgtcaggcccaggttacccctgagcagcacaaccgcaaggcccccttcaacactcgctacgccgagcagaagaagcacctttctctccctctcttccctaccaccaccatcggctctttcccccagacctccgagatccgtgtccagcgtaacaagttcaccaagggtgagatctccgccgaggagtacgagcgcttcatcgagaaggagattgagctcgccgtcaagattcaggatgagcttgacctcgatgtctacgtccacggtgagcccgagcgtaacgacatggttcagtacttcggtgagcgcctcaacggctacgtcttcaccacccacgcctgggtccagtcttacggctcccgttgcgtccgtccccccatcattgtcggtgatatctctcgccccgctcccatgaccgtcaaggagtccaagtacgctgcctccatctccaagaagcccatgaagggcatgcttactggccccgttacctgcctccggtggtctttcccccgtgtcgacgttcaccagtccgtccagtgccagcagctcgctctggctctccgcgacgaggtcgtcgaccttgagaagaacggcatctacgtcatccaggtcgatgagcctgccctccgtgagggtctccctctccgtaagggtcaggagcgtgaagcctacctcaagtgggctgtcgactccttcaagctcgccaccgctggcgtcgagaactccactcagattcactctcacttctgctactctgagttccaggacttcttccacgccatcgctgcccttgatgccgatgtcctctccatcgagaactccaagtctgatgccaagctcctcaaggtcttcattgacgaggagtacccccgccacatcggccctggtgtctacgacatccactctcctcgtgtccccacccttgaggagttcaagcagcgcatcgaggagatgcttgcttacctcaagcctgagcagctctggatcaaccccgactgcggtcttaagacccgcaagtgggatgaggtcaagggtgccctctcccacatggttgaggccgccaagtacttccgtgagaagtatgccaac

SEQ ID NO: 27299 - DNA, 675 bp, Neurospora crassa
ctgatggccgccttgaggtcgttccccgacttccccattcccggcatcaactttatcgatatcctccccctcttccaggacgttaagacccacgaggccctcctcgtcgctctccagctccagatcgagctctcccaccagaagcccgatgtcattgtcggtctcgatgcccgcggctttcttttcggcccctctcttgccttgagaatgggtgctagcttcgtccccgtccgcaagcagggcaagatgcctggtccctgcgtcactgccgcctacgagaaggagtacggcaccgacttcttccagatgcaggatggcgccatcaagcccggccagaaggttcttatcgtcgacgatatcattgctactggtaagcattatgtgcccactttttctttcttggcaatcgcttcgtcatgtcccatctttttgctctatcacgccaatcccatctcagcgctacgctggattctggcctcgccccattggcaaccttgcagttcaatttggcttacatcaatttttacaggtggctccgctgctgccgctggcgagctcgtcaagaagctcggtggtgagacgatcggttatctcttcatccttgagattgctttcctcaagggtcgtgagaagctcggcggtgttcccgtcaccactcttctcgagaccgatgag

SEQ ID NO: 27300 - DNA, 422 bp, Neurospora crassa
ccgcggccgctgtctgataacgagcgcgcgcgcctcgaggagttcatcgactctattcactattctactcggtacgccgtggcgcactttgggaagcgctctactgtacggttgctgaccctgccacttgttcctatagctattccgacagcgagtacgagtaccgtcacgtccagctacccaaggccatgctcaaggccatcccctccgactaccacgataaatccaagggcactctaaagctcttgtgggaggaggaatggagagccatgggcattacacaggtgcgcgcgaatatgatcagttgcgatgggaacgcataaggaacgggaagactaacacaaaggttgcgacaacagagtctcggttgggaacactacgaggttcatgagccagagcctcatattctgttgttcaagtaa

SEQ ID NO: 27301 - DNA, 864 bp, Neurospora crassa
cccgagggcggcaacaccaacggcgacgctgccgccgccaaggacgacaagaccgtcaccgtcttccacgacaaggagcacttcaatgtcaagcaccctctctccaaccgctggaccctttggttcaccaagccctcaagcggaaaggttggtttcccccccttccccccccctcccttcgcccaccacctgccccaccatacgatgcagtcagctaacatcatcgcgaccagggcgacaactggaatgatctcctgaaggaggttatcacctttgagacggtcgaggagttctggggtgtatatgtatgtctatgagcgctctcgcaccccacgctttgcgcaacatgcatgctgaccaaaacacgcgcagaacaacatcgccccggtatcagagcttgctctcaagtccgattaccatctcttcaaggagggcgtgcgccccgagtgggaggatccccagaacaagcacggtggcaagtggtcttaccagttcaaggagaagcgcaatgtcaacattgacgagatctggctgcatactatgcttgctgcgatcggcgagactctcgaggatgaggaggacggtgaggtcatgggcgttgtcgtcaacgtccgcaaggccttcttccgtgttggtgtctggactcgcactatcggcaagcacattcccggccgcggcgacggagacatttctggcggcaagggtagatcccctgagaagggcaaggagatcctgatggctatcggccgccgcttcaaggaggtcctccagctcccgcccaacgaggctctcgagttctccggccacacggaatccgctcacagcggcagctctcgcgctcgtgccaagatgaccgtctaaatg

SEQ ID NO: 27302 - DNA, 2113 bp, Neurospora crassa
ataggtactacctactcttgcgttgccatctacgagggtaccaatgtcgagatcattgccaacgagcagggtagcttcaccactccctctttcgtctccttcactcccgaggagcgtttgatcggtgaggccgccaagaaccaggccgccatgaacccgaagaacaccgtcttcgatgtcaagtacgctctatccagtatcccagtctcaaaagaagcagcctcactaacgcacctccaggcgtcttatcggtcgccgcatcgatgaccccaccgtcaagaaggaccaggagtcctggcccttcaaggttgtcgacgatggtgccggcaaccccaaggttgaggttgactacctcaacggtgtccacaccttctccccccaggagatctccgccatggtcctcaccaaggtaagccacagccatatccgagcttccggatctgtacgcataagaaccgcactctaacatgtgcttccacaacacagatgaaggagattgccgaggtcaagcttggcaagaaggttgagaaggctgtcatcactgtccctgcctacttcaacgacaaccagcgtcaggctaccaaggatgctggtgccattgccggcctcaacgtcctccgtatcatcaacgagcccaccgctgccgccattgcctacggtctcggtgccaacaagtccaacaaggagcgcaacgtcctcatctacgatctcggtggtggtactttcgatgtctccctcctcaacatccagggtggtgtcttcaccgtcaaggccaccgctggtgacacccatcttggtggtcaggacttcgacaccaaccttctcgactactgcaaaaaagaattcactaggaaggaatgtagaacccgaaaccgctccctcttccctttcccttctttccggaatttttcccgatttttttcgagttttttttcgatttctttcgatttttcttcaattttttttgtccggggaaaaatcaacgaactgcacgcaaaggatttagactaactcttttttacagaccaagaaggatctctccggtgatgcccgtgccctccgtcgtctccgcactgcttgcgagcgtgccaagcgtaccctctcttctggtgcccagaccaccatcgagatcgactctctctttgatggtgaggacttcaacatcaacgtcactcgtgcccgtttcgaggacttgaacgccaaggccttctccggtaccctcgagcctgttgcccaggtcctcaaggatgctggcattgagaagtccgccgttgacgagatcgtccttgtcggtggttctacccgtatccccaaggtccagaagctcctcagcgagttcttcgacggcaagaagctcgagaagtccatcaaccccgatgaggctgtcgcctacggtgccgccgtccaggccggtatcctctccggcaaggccacctccgccgagacctccgacctcctcctcctcgatgtcgttcccctctccctcggtgtcgccatggagggcaacatcttcgcccccgtcgtcccccgtggccagactgtgcccaccatcaagaagcgcaccttcaccactgttgccgacaaccagcagaccgttcagttccccgtttaccagggtgagcgtgtcaactgcgaggacaacacctccctcggcgagttcactcttgctcctatccctcccatgaaggctggtgagcccgtcctcgaggtcgtcttcgaggtcgacgtcaacggtatcctcaaggtcaccgccactgagaagacctctggccgctctgccaacatcaccatctccaactccgttggcaagctctcttcctccgagatcgagaagatggttgaggaggctgagaagttcaagagcaacgacgaggccttctccaagcgcttcgaggccaagcagcagctcgagtcctacatctcccgcgttgaggagatcgtctccgaccccactctctccctcaagctcaagcgcggccagaaggagaagattgagcagtccctctccgaggccatgagccagctcgagattgaggactcctccgccgaggacctcaagaagaaggagcttgccctcaagcgcctcgtcaccaaggccatgtcttcccgctaa

SEQ ID NO: 27303 - DNA, 816 bp, Neurospora crassa
agatctgttggaattctcggggccggcgtcctgggtcgtcgaatcggcgcctgctgggcatcggccggctaccaagtccacatcagggacccagaccctcgacagacgaacgcggcgttgcagtacatcaccagcgagctatggagatacaagcccatcgttgatccgaacaccatcagcgttcgtggcttccagaatatggaacacgccgtggaggattcttggctggttatcgaatgcgtacccgagaaattgaacatgaaaatcgatttgtttgccgaactcgaaaacatcacccggccggatgccatcctagcctcaaactcctcctcctacaagtcccgcgagatgacggccatggtcaagccagagacggctcaacgaatgctgaacacccactacatggtcccgccgaccatccgtatcgtcgagctcatgacgagtggttctacgcgacccgagatatttcccttcctcttgaaccacttcagagcgtcaggcatgatgccggtgattgcacacaaggagtcgactggtttcatcctgaaccgcgtttgggcagccatcaagcgcgagtgtctcatggtgctggctgaaggcgtggcttctccccaagaactcgacgctgtctggaccgagatgtttatcgagaacggtagtccaccctgcactctgatggactcggtcggcctagataccgtttcgctcatcgagaagcactacatccaagagcgtggcctgcaggacagaggtgtcttgccctttctacaaaagtacattgacgagggcagactcggagccaagagcagcaagggc

SEQ ID NO: 27304 - DNA, 3066 bp, Neurospora crassa
caccccaccatatagaccgtcttcctcgacaagtccataaacaactccgtccgctttctcgcagttatcctgctcaagaacggaatcgacaaatactggcgacacactgcgaaacatgcgatccaacccgccgagaaacagtttattcgctcgaggctactccagggctcagtcggcgaggaggacaagaccctcgcactacacaacgcccttgtcatcgcaaagattgtccgcatagactaccccaacgactggccagacgtcatcccgagcatcatcaatgtcacgaggagcgccagaacagagagtgctcttgccctcagcggagctctgcaggtgctgctgcgggtagtcaaagagctcgcaacagcgcggttgcggaggtcccagaccgctcttcaggccgttacacccgagcttgtccaattgctcggtgagatatataccgagcggacggccgcatggcagcagttcttcgcgaggggtggcagcggcgatgaagatgaggccgactactacatgcagaacagcctcacagccctcaaaatcttacgtaggctggtcaccgttggctacgaacatccccataccgatccgatggtccagggtttctggtcgctgtcgcaatcccaatttgaccagttccttaccggcgtcagctccgagtcgcacatccctgcccctttccaggactcggtgggcaagcacttgatccagttcacgaaactgcacatcgacatgtgcgattcccacccggccagcttccctctgctaccgaattccattccgctcgtcaaggcttactggaatctggtaaagcaattctcaaatgagtttgaaaagtcgggcggcatcaggcaaacgggctccgagaaccacgacggtagcgccaaacacgaaggaccgctctcggagaagctggcccttaaaggtcttttgctgcttagaagctgtgtgtcgattgcccacaggccgatgcagactttcaaatacaagagcccagaggtcaagaatcaggaaagagaggccatggaacttgtcaaggaccaactattgacaaacagcttcctgctggatattgttcaagtaaccatcagtaggctattcatcttccggcagtccgatctcgaggcatgggaagaagacccggaagggtgggaggctgcggagcgtaacgaaggtcaagcatacgagtgggctgttcggccttgtgctgaaaggctgctcattgacctcctgacgcactacaaggagcttgggcaaccacttcttacatactgcgaatttgcgaccaaggtcgatatggatatcgtcaccaaggaggcggcttactgcgctcttgggtgtgcagccgctgttattcacgaggccttcgactttgaccgttttctaaagactacgctggtgaaggacgcacagatccaggattccatgtccaagctgctccgtagacggatagccattctgctcaaccagtggatctcgatcaagatcaccgaggaaagtcgacctgccgtctacgaaatctttagacacttgatgaaccctgacgacccgcataacgatcaggttgtccgtaccactgctgcgcgcgagtttaaggggattgtggacgactttgggttccagggcgagcagttcctaccgtttgcccccgacgtcttcaaccagcttatggggctcctccaggaggttgaaagcgatgagaccaagttgactgttctcgacactattcgggcgattgtgcagcgaatggagactcatattactcagtttggcgacgccattatgctgactcttcccaagttgtgggagtcagctgagaaggaggagtatatgatcaagcagtctattctggccatcatgtctgcgctcgttgactcgatgcgtggggactctcagcggtaccaaccggcgattatccccctgctgcgtgaggctatggaacccgagtctgcccttcacctccaccttattgaagaatcggtagctctgtggaagtccgtaaccacacaaagctaccctcccctccaccccgacctcgtacaaatggttgagcttgctctgccccttcttgagtacgattcggaagtagcaaaccagtgtctcgaagttgtaaagaactacatcctcctcgcgccccgcgagatcctcgacgatcgcctacgccgtcccaccctcgcagccctcgtcaagacactcgatgcccgctctcgcgagcaatcccagaccggtgccaggtccatcgagctgattctgcgcattgccgagaatatcgggggcgtccaagggctgcaggtagttgtccaggacatgctggaaatcggcctcctcaacaccatcttcgagggcctccacagcgcctgggaggcaagcacaacgcacggccccaacaagaaggtcagccagatcaacacgatcaagcagacggactacttcatgctgctagcgcgcatcgcgctcggcgatcctacagtgtttctgaccatgttggccggcatcgcgacgaccgccgggtccaccgccgaacaggtgtgggagtggctggggactttgtggttcaacaactttgattgcatggccgaggtcgaacggcagaagctcagcatgttggcgctcacccgcctctgggagctgccggaccccatggtgcaggaaaagattgtgctcgcgaggctgcaggatttcttggcgatgtggacgagtgtggtgacggagctggcggcgagcgaggatgatcagtcgctgactgaacaacaagatttccgacaatcgataaactcaacatcgaaagagcagctagcgggagggagtactaacccgagggattacctggtatgggatcccaataacttgcctagttacgagtgggataccccactcgatgtgacggaacggcagtttgcgctgaaggatccagtgcatagagtggaagcgtacgagtttgcgagggaacggttgcaggggttggtgcagaggatgggtggtgagcagcagtttgaggcggagtgggcggttaatgtggataaggatgtgctggaggggtttaggaggttgggggagggg

SEQ ID NO: 27305 - DNA, 2172 bp, Neurospora crassa
ctacgatccatcttcgactcgcccgaaacatggaagcagttctccggcgacaagcatggccgaaacgtcggcctcttccgcaacgcatacctcaccagcccccatggcttcctcgactttgcccatgtgagcttgggaaaggctcgtgccctggtcgacaaggtcctcaacgcccaatctctcgacgaataccgcgccattgtccgccatctcgaccgcctaagcgatatcctgtgtcgcgtcttggacatggccgactttgtgcgcgtcacccatcctgaccagcaaatccagcggaccgcctcgatggcctgggacatgatgtacgagtacatgaaccagctcaacaccatgacgggcttgtacgaccagttggtccaggcaatggacaacccacaggttagcaccacctggtctgaggaggagaggatggtggccgaggtcctcaagctcgacttcgccaagtccgccgttcacctgcccaaggacgcccgggacaagtttgtacacctgtcgtcggcaattagccagacgggaaccaactttatccagcacatggaacccaagatcccatacaccactgttgaaaagtcccggatgatgggcatggatcccgtagaggtcaagaggatggcttccatgggcaaagtgtacgtccaaactctgagtccccaggcctcaatagcactccgtactgtacgcgatgaccacgcccgacaccaactattcatggcttctcgcaccgcttcccgcaggactgtccataccttggaggagctcatgttgttgcgtggtgagtcggccaagctctcgggtttcgagagttatggccacctcgtcctccacgaccgtatgatggccagcacccccgagtctgtgagacagtttctccaagctttgtccgaaaacaccagacctcaagctcaacaggaggtggctgatctcacagcagccaagagggcgcacaagggcggcgatgcaaccctcgagccctgggacaaggacttttacgccgagtccatccgtcaggccatcaagtcccggcagaagcgtgaagacctgtcctcttacttctccctcggcaccgttatgcaaggcctttccaggatattcacgcgcctctacggtattcgcttcgttccccgcgagcccatgcccggtgagacctggcaccctgacgtgcgtcggttagatgttgtctcggatgttgaaggccatgtcgccgtcctatactgcgatctattttaccgccccctcaagtcgcccaacccagctcactttactctccgctgctctcgtgagctgtcgccccacgagattgctgaaactgcccatacccaagccgagaacccacatgtgttgattccctccttcgagtctgccgagtttgctgccaatgatgggatggcctactctcgctcccaggatggtgctatcaagcaactccccaccattgctcttgtgtgtgactttccccagcaatcccacaaccggcccgcccttctgtctttctttcagcttgaaacgcttttccacgagatgggtcacgcgattcactccatcctggcccgaacctccttccagaacgttagtggtacccgatgcgccactgatctcgccgagcttccttctactttgatggaatactttgctgctgacccgtctgttctcgccctattcgcacgccactacgagactgacaacccccttccctatgagtgggtcgacaacaagatccgcgaggcccgtcgcttcgaggcgctggatactgaaaatcaaatcatccttgccatgctcgaccaggaattgcactcgtccaaggcggtgcaaggccacattgactccaccgaaatctttcacagccttcagagacagttcagcaccgccccgccggacccccaaggaacggcatggcagggctttttcggccacttggtcggatacggcagcacatattacagttacctctttgaccgggtcttggctcagagggtatggaatgtcgtattcaacagtggacaaggcggagcagcactgcagagagaaaacggagagaggttgaaggaaaacctgctcaagtggggaggtagcaaggacccttggaagtgccttgcgggtgcattgaaggatgagaggttagagggaggtggagagaaggcaatgaagttggtt

SEQ ID NO: 27306 - DNA, 1050 bp, Neurospora crassa
acaggtgaggttgatgctacgcctgtccaattcgatgttcagtatctcgcccccgtccagatcggctccccgccgcagacggtcatgatgaacttcgacaccggctcttccgatctctgggtcttcagctccgagacccctgccaagcagcgcaatggccagaagatctacaacatgacccagagtaccaccgccgagctcgtcgacggtcatgtttggaggatctcgtacggtgacggcagcagctcgtccggaaatgtctacactgacaaggttagcattggcggcgtcgaggtggacaagcaggctgttgagattgccacccatgtgtccgactctttcaccaacgacgctgcctcctccggtctcgtcggcctcgcctttgactccatcaaccaggtcaagccccgcaagcaaaagaccttcttcggcaatgcgatcgacgacctggccatgccgctgttcagtgccaatctcaataaggctgagcctggcaactacaactttggcttcctcgaccatgaggaatttgtcggtcccatcagcttcgtcgacgttaatgcttcccgcggtttctgggagttcgaggccagcggctatacccttcccgcctccaactttaccgagtccaacaacaagaccggtgttttccagtccctgacccacaccgccattgccgacaccggcaccaccctcctcatgctcccccagcccatcgtcgaggactactacggtcaggtcgccaaggcccgcagcgacaatgcttttggtggttatgtattcccctgcaacgccgacctcccggacctcatcatccacattggctcctacaaggctcgcctcactggtgatctcatcaagtacgctcccgccgacaccgatgactttgcgacagccaagtggtgctacggtggcctccagagcgcccagggcttccccttttccatttacggagacatcttcttcaaggcccaatttgttgtgttccagggtggtgtgatcgataaggatgactggtccaagggcgccaagttgggctttgctgccaag

SEQ ID NO: 27307 - DNA, 1559 bp, Neurospora crassa
gaaggcgtcatgggctttataatggacgtaaccgaattaaaggatcgcgaaagggacattgaggctcaagcactggagaagagacaacttctagccaatgaagcagccgcaaaggaagcaagccggctcaagagccagtttttggccaatgtgagttgatcagctcacttcccacattgcttccgaactaatcgttctagatgtctcatgagattcggacacccattaccggtgtgatcggaatggcggaattattgcttgatgttgagcttgatgctgagcaacgagagctaacggagaatattttccgttccgcgaacgcacttctgactgtaatcaacgacattcttgacttctcaaagattgagtctgggcgactggatatcgaagaagtacaattttcattagctgttgttattcaggaggtcggcaagatgcttagcttcaccgctgagcggaaaagcttagcctttaactacgagatttgttcagatattgggattgatctcgtggttatgggagaccctggacgtgtgcggcaaatcatcacgaacctggccacgaacagcatcaagttcacacatgagggtcacgttaagctacatgtctctgtcgaacaggaaacggacgatactattgaggtcaagttcgtgattcaggatacgggcattggtatcgaagaagaagtgctcaaacggctcttccagcctttcagtcagggagatccctcgacagcgcggaaatttgggggtaccggtctagggttgaccatttccaagaacttgctggaactgatgaaagggcgcatggcgctcgcatccaaaaaggacgaaggaactacagccacgttctggatcccattcaagaagccacaaaaagcacagtcgattaccggcccgctatctgacagattacagagcgagacaagcgtgtcttgtaactgcccggctccggctgaccaggagtcaggtgcgctgagcggcgagcagaggtcggcatggagacaatcctcgacaagcctctcccccaccacctcgcaagaggagctctccatgccggaccgcagcaagatctttatcctggtagtcgaagataacgagatcaaccaacaaatcgccatcaggacgatcagaaaactaggcttccaagtcgcggccgcctggaacggcaaggaagctctcgaatacctgtctaaagccagcactggcaagacacggaaaccggacatcattctgatggacgtacaaatgcctctgattgatgggtacctgtgcacccacctcctccggcaccacgccccgtacagaagctacgtgagagatgtgccgatcgtggccatgaccgcctcggcaatccaaggcgacaaggaaaaatgcaagagggcgggcatggatgattacctgtccaaacctgtcaaaagaacaacgctcgaaaggatgttgctgaggtggtgcactaccaaaagggaagaactctcgccgattacgtcgcaatgcacagagtctggtgagcattgtcagagtgctggtattcctgctgttgggctgaatgaagagccg

SEQ ID NO: 27308 - DNA, 1478 bp, Neurospora crassa
tataccgtacccttcttcatcaacggcgaggaagtccgcacgtccaggacttttgatgtcacgtccccagcaacccaaaaggttgtgcacaagtgcagcagcgctacggataccgaggttcaggctgccgtgaacgccgcggcagaagctttcaagacatggaggaaatcacaccctaaccagcgtcgtgaccttttccacaaggcggccgagatcttggagaagagaaaggaggagttgggccagtacgtgatggacgagacgggtgctccacgccaatgggccgacttcaacattcaggttgcaaaggacttgttgatggatgtggccgggagatgcaacacgctggaaggctcgttccccgtagtcaacgatcccgaatcgggggccctcgtcttgcaggagccctatggcgttattctcgccgttgccccttggtgagtccagctttaggcggcggctaagagaaatggtatgtattccactaacaccttgcaaggaacgccccctacattctcggtatccgctccatcctctaccccatcgccgccggcaacaccgccatcttcaaggccaccgagctctgcccacgcaccatgtggggcctctgctccgtcttccacgaagccggcctccccaaaggcgtcctcaacatgctcgtccacgagcccgccaacgccccggccatcaccagctcgctcatctccaacccgcaggtcaagaaggtcaacttcaccggcagcactgccgtcggtcgcatcatcggccgcctggccggcgagaacctcaagcccgtgctgctcgagctaggcggcaaggcctcggccatcgtctgggaggacgccgagctcgacaacgccgcgactcagtgcgctctgggcgccttcctcaactcgggccagatctgcatgtccaccgagcgtatcctggtgcacaagtccgtccgcgccgaattcgagaagaagctcgtccgcgccgtcgaaaacatctttgggcccccgacgcccgctccgatccttatcaactccctcgcggtcgacaagaacaagaagctcctttcggatgccttgtccaagggcgccaagctgctgtacggcaaccctgacgcccaagaagagaccacgacgcgcatgcgcccggtcattgtaagtggaattaccaccgacatggacatctacaagaccgagagctttgggcccacggtggccgtgtacgagatcgagaccgaggaggaggcgctcaggatcgccaacgataccgaatacggattgacgagcgccgtgtttacggaggacttgagaagggggttgcgcatggccaaggagatcgagacgggcgcggtgcacattaatagcatgacggtgcatgatgaggcgacgctgccccacggcggcgcgaaggcgagcggatatgggaggttcaataccagcaggggtttgcaagagtgggttaagagtaagactgtcactttcaagttt

SEQ ID NO: 27309 - DNA, 3282 bp, Neurospora crassa
gaccctaatgaggaactcacggtggttgtgcctttcaggtccaagagaatcagagatggcctgcactttgtcggcgttgaggaaggtgacctgagatacccacacgtttacacccggcattcgctcgagcccggtacggcgtcttgcatcttcccttgcctcgatgatcccggttcgaggcattcctggacaatcaaaatcacatgcccaagaacgctggaggatgccttcgcaccgcctctggctacccaatcagcactgctgactgctctggatggcggtcggaaacgcaaagcctctgatatttctgcacaccagcctggctcatctttcaccgaagaggataagctgagggagattaccgtggtctgctctggcaatctcattggcgagcagatgcaccccaaggacgagcgcaagaagaccatgatttttgagtgcgtcaacaccgctgctaggcacatcggtttcgccgttggcccctttgagcacgttgatcttggggccgagtttagaactgaggaggcggacgagaagctcggggctaatgcagccagaattcacggctattgtctccctggccgtgtggatgaagttcgatggacatgccaagccgtcgtggctgctgccgactacttcgcccctgagttcggccgttatccttatgaagcctacaagatgtgctttgtcgaagacttggttcacgacactgcggttgcaaactccttatccttgtgcagtacgcgtttgctgtaccccgaaacgatcatagatacggacatcgaggttaccaggaagctcgtccatgccctcgccagtcagtacgtgggggtccacattgtgccaaatgagcggtccgacacttggcttatcatcggtctccagtggttcatgacagatctgttcatgaggaccatctgcggaaacaactggtatcgttttcatatcaagtcgctttccgacaagcttgtagaggcggatgtgcggagaccctccttgcatgctctgggcgattatcttcacctaggtgactttgagctcgagtttatggcgctcaaggcgccacttgtcctttacatactcgatcagcgcatgtccaagattcctggctcgacaggtgtcgtccgcgttttgtcgcaaatggtttcggccgctaatatttccaacacggaccccaaggccactaccctctctttccaggacttccgtcgatggtgcgagaaacgcagtcaatacgtccctgatgagctttggaatcaatacgtgtttggtgcgggttgcccgagactggatattcaccaaaagttcaacaagaagaatctcaacgtcgacatccaaattctacaatatcagggaccgaccaagaaaagcatatcaaaggatgagttctggagggagttgcaagaggagatacaccaggtctatgccggcgacgttcccaagctgttcactggtccattcaccgtccgaattcacgaagcagacggtacgccttatgagcactaccagctcattaccgagaaagataaaggtgggacgaatttgcagattgcgtacaatacaaagtacaagcgtctgaaaagaaccaaaaaggccatggccgcggctgccaacagcaatagtgacaaacacgagatccaggaggacgatgttgtctactttaacatgttgggcgatgtcctcaccagccaaaaggatatggaggactgggggttacaagactgggcttcagaggtccaaaccaagatggatcaagaatcctatgaatggatccggcttgatgctaacatggagtggctttgcttcatgaagactgatatgcaggagtacatgtatctggcacaactacagcaggatagagacgtcgtggcccaccaggacgcgatgctcgctttcaagagggaaaagaggcatgcggtccactcgacgatcgagacgcggacagtgatggaccgacgatattaccatggtgtccgagtgatggcattggaagacctcgctaaacaggcacatcctgacttgaattacatcggcatggtccatctgatactctgtttccgcaagtttttctgcaagaaggtaccaattcccggccgggagggtggctatcactacccgatcgctcccaacgattttaccgacaagggccagtatgccatccaatgtgcgattcccgcggtgcttgcacggacgacggacctgcaggaaaaaggaagatgctctaagagggcccgacagttcatcatggagatgctcctgtttaatgacaattcggagaatgagttttcagaccagttctacatcgccaaactcctcgatgctcttaccacctctgtgattccgcagaaggagattaccgagggatacctcatcaaaaacctggatcctttcgatgaagacgatgcggaattcaaaagtttcattgagaagaccattgaggagatcgacaagtttcgcaggatggatgaatggacactgacataccagaacatttggacgacaacggctcttcactgcaagatgaggctcatgaaggctcgtgtcatccctgaatcggccctcgactttgttcagtacctccaggacgacaacattgatcttgtacgtatcaaggcgtttgagtgcctggttgagcttggaatgatctccaaaccccctattctcaagcttctactttcatacatgagcaccgatagttcgcccttcatccgcgatcgattgttcaaggtcttttgccggggaatcgctgccattgcgtttggcgagaacaaagcttcgacacaggaacttgaagctcttaatgatggaggtctcgtcatcgatcaaggtgacgcagagatccaacaacggaagctcgatgcagtacgcagagaagacattgcccacgcgcttaatgcgctcaaggaagagctgagggggaacacggagatgcaaatatccatatggaaggcatttaattctcccgtcatcggtctacaggagaagcgccagctattggagctctgctcggccatgttcgaaccagaagattctctacttgttactatcaagtatcccattgtctggaaggcaactcgcgacccgacaattgtcgccactgcaccacagatcctcggaactccgcccaagaagagatgtgtcgtcaagttcaagtcggagtaccggacgcttcctaagagtaaggatatggttgcgatcgaagctccaccgcctccggcgccattacccgcaccgacaccgtcgaccaacttgtcggcttccagggtagagattaagcctcct

SEQ ID NO: 27310 - DNA, 893 bp, Neurospora crassa
atggcctcccttgcccgccgtcctcctctcctcgtcccagctgtggcccggcacacggccaccgtcatcttcatccacggccttggcgacactggccatggctgggcttcggccgttgagcaatggcgtcgccgccaacgccttgatgaggtcaagttcatcttgccccatgcgccttcgattcccatcactgccaactggggcatgaagatgcctggttggtatgacattgtaagcttacctacctactctgtgtagtacctggctccgtccccgccaaagttaaaagtctaacaccacagctataaaagttcgccatcgatggcagcgccgaagctctccgccgcaacgaggatgaggccggcatcctaaccagccaagcttacttccacgatctgatccagaaggagatcgactcgggcatcccggccgaccgcatcgtcatcggcggcttcagccagggcggcgccatgggcctgttcagcggcctcactgccaaatgcaagctggccggcattatcgccttgtcctcgtatctcctcctcagcctcaagttcgccgagctcgtgcccaagcccgagttcaacaaggagacgcccatcttcatggcccatggcgatgcggatccggttgtcaactataagttgggcacgatgacccgtgacttgctcaaggagatggggtacaatgtcaagttcacgacgtatccgtaagtacctccttcggtatctcagtgccgatcaatttctcgaatgtttccatgctgactgcctgggattgctaggggtatgggtcactctgcctgcctggaggagttggatgcgatcgaggatttcttgaccgagagactgcccaaggtggctgacaagtcggagcagaagtccgagctatag

SEQ ID NO: 27311 - DNA, 867 bp, Neurospora crassa
gcgatgtcagagcccaaagtcatcattgtcaccggcggcagcaagggcattggcctcgctgtcgtgcaggacctactgaaagcctcccacaaggttgtccttgttgccaggacgccagtcagcgagctcgcgaaggattatccaggccaggtcacatttctggctgccgatatgacagtatctgatgtgagttgcgatcacaaccatattgggacatcgcagaatgtaatatgatggaaaaccaaatggatattaacgtatctaagactgcacaccgagctgtagagctcgctctgatctcttacggaaagcttgacgccgttgttgtcaaccatggagtactcactcccatcactcgcctagccgatgcttccatcgaggactggaagagtcactacgatgtaaacgtcttcagtgccctttccattgtgagctttacacccctagaccaatgcgatcaaataacagggctaacacaatggtcaggtcaaagaagccatcccccatctgcgagccaccaagggcaagatcatcttcgtatcctcgggcgccgctattaaggcatatgccgcttggggagcgtacggctcttccaaggccgcgttaaactcaatctgccgccacgtcgccgtggaggagccagacatcacagcagtggcagtcagcccaggacgggttgatactgacatgcaaaaggagctacgcgagaagggccaaggtgtcatgtcggataaggaatacgctgactttgtctcggccttcgaggaaggtcagctcaacaagcccgagtggcctgcccaggtcatcgcgaaactgtcacttgacgccaagtctgatctgtcaggtaaatacgtcgcgtggaacggc

SEQ ID NO: 27312 - DNA, 2812 bp, Neurospora crassa
gctgactccttgtctctagacgcgaccctgcgacatgctgccgaacagcagctcagccaagccgctcagacaaacttcgtatggcctcctcccctcgttgctcctgtgtcgcgtccccacagcaaggccttcataaacgctaacttggctgtttcttagtctcaatacctcgtgacacttgtccaagagttggcaaatgagagcgcccagagccacatccgagcggcggccggtatcgccctcaagaacgccttcagtgctcgcgagttcgctaggcaagcagagctccaagcaaaatggcttcagcagacagaccaagacacaaagacacgggtgaaacagctcaccctcgagaccctcgcctccagcagtacccaggcaagccaggcctcggcgcaggttatcgcggctatcgctaccatcgagttaccacgaaacgagtggccagaccttatgcacgccctggtcaagaatgttagcgagggaagcgagcaccagaagcaggcctctctgaccaccatcggcttcatctgcgagagtcaagatgtcgatctacgaaacagcctggttcaacattccaatgccatcctcacagctgttgtccaaggtgctcgtaaggaggagcccaaccgcgaagttcgacttgccgccattaccgccctcggcgactctcttgagtttgtcggtaacaactttaagcatgagggcgagcgcaactacattatgcaggttatttgcgaggcgacacaggccgaggactctcggatacagcagggtgcttatggttgcctcaaccgcatcatggccctctactacgagaacatgcgcttctacatggaaaaggctttgtttggtctcaccatcctgggcatgaagagcgatgacgaggatgtggccaagcttgcagttgagttctggagtaccgtttgcgaagaggagattgctatcgaagatgacaatgctcaggtacgtttcactgccaccttggttgagcaagaatcccactaacaacagctgcaggttgagagctcggagcagatgcgccccttctacaacttcgcccgcgttgctacactcgaagtggtccctgtgctcctacagctcctcaccaagcaagatgaggatgcggctgatgacgagtacaacatttcgcgtgccgcgtaccagtgtctccaactctattctcaggctgttggtgcggcaatcatccagccagtcatccagttcgttgaagccaaccttcgcgctgacgactggcacctccgtgatgccgctgtttctgctttcggtgccatgatggacggccccgaggagaagttgcttgagcctatcgtcaagtctggcatgcagcccttgatcggcatgatggaggacccctctttacatgttcgtgactcgaccgcatacgctcttggcagaattacagaaacttgctcggaagtgatcgatcctgctgttcaccttgaccccttgatcacctccctgttcaacggcctcatgagcagccccagaatggccgcgtcctgctgctgggctttgatgaacctcgcggagcgttttggcggcgaatatggtgccgcgcaaaaccccattactcctcacttcaaccagtgcgtgaccaacttgctcgccgtgacggcgaagcttgacggtgacgctacagttcgcaccgctgcctacgaggttcttaacgtgtttgtgcagaatgctgccaacgacagtctccctgctgttgcatccctctcggatgttatccttcaacgtttggaggaaacactgcccctgcaatcccaagttgtcagcgttgaagacaagatcactctcgaggatatgcagaccagtctctgcaccgtgctccaggcaatcattcagcgcctggacaaggagatcactccccaaggcgaccgcatcatgcaggttctgcttcagctcttgaacactattaatggcaagtcggctgttcctgaaggtgtcttcgcagccatcagcggccttgcgaacgccatggaggaggactttgccaagtacatggacgcttttgctcccttcctgtacaatgccctggcaaaccaggaagagccgagtctctgctccatggctatcggcctggtcagcgatatcactcgctccatgggcgaacgcagccagccatactgcgatcagttcatgaactatctccttaacaatcttaggagcactgctcttgccaaccagttcaagcctgcaatcttgcagtgcttcggcgatattgctggcgctattggcggtcactttgaggcttacctctcggttgttgctgttgtccttcagcaggctgctaccgttaccgcttccgccgagggctcttatgagatgttcgactatgtgatctctctccgtgagggtattatggacgcctggggtggcatcattggtgccatgaagggcagcgataagagtaagtttcctcggtcttaagcgcgctttgcagagactgacaaatgtcgtacagccaacgttctcgagccctacgttcagtcgatctttgagcttcttaacactattgctcaggatcctaaccgcagcgaagcccttatgcgggccgctatgggtgtcatcgggtaagttggcatgatgttgagacaacacattatagaaacactaacgattatctagtgatcttgcggacgcatatcccaacggccagctggccgaagtcttccgtcaggactggatcaccgccatgatcaaggagactcggtcgaaccgcgagttccagcagcgtaccattgagactgctcggtgggcgcgcgagcaggtcaagcgtcagatc

SEQ ID NO: 27313 - DNA, 231 bp, Neurospora crassa
tatcgtcagcttttgcgccagggaaatcagttttcctcttacaacttcagagaatacgccaagcgccgcacaagagacgctttcagggaaaacaagaacgtggaggatcctagacaggtgcaggaacttgtgcagaaagggttacagaatcttcagatgctcaaggtatgccgggcactcgagctgagacgcgacttggagaatacagagaagttgacattggaatagcgc

SEQ ID NO: 27314 - DNA, 867 bp, Neurospora crassa
tcccccaagcttgacggcaagtttgacgacaacgcctccgtcgactccggcttcgcttccgccaactcctccaccgccaaccttcccttgatttctctcaccaagcctcatctcgaccacctaaacaaacagctcgagaacatggaggccctggacatcctccgcttctgcaagattctcttccccaacctcttccagaccacggccttcggcctgaccggcctcgtcacgctcgacatgctctccaagctggccaaggagtcacccgacgcggcccccgtcgacctgatcttcctcgacacgctctaccacttcaaggaaacttatgctcttgtcgaccgcgtgcaggagcgctaccccaacatccggctgcacgtcttcaagccggccgacgtgtccaacgtcgacgagtttgaggccctctacggcgagaagttgtacgaaacctccgaagaactatacgattggatcgccaaggtggagccgcagaaccgcgcctaccaggaactcaaggtggctgccgtgttcacaggccgccgccgctcccagggaggtgcacgcggctccattcccgtcattgagctggatgaggagcgtggcatcgtcaagatcaacccgctcgtcaactggagcttccagcaggtcaaggcctacattgatgagcaccaagtgccttacaacgagctgctcgataaggggtacaagtccattggtgattggcactcgactagccccgtcgccgcgggcgaggacgagcgtgctgggcgctggaagggcaagaacaagacggagtgcggaatccacaacaagcagagcaggtatgcccagtttctggcggagaacgcgaggaagcaggcaaagggtgct

SEQ ID NO: 27315 - DNA, 1677 bp, Neurospora crassa
gaggacaagactcacatcaacgtcgtcgttatcggccacgtcgattccggcaagtctaccactaccggtcacttgatctacaagtgcggtggtatcgacaagcgtaccatcgagaagttcgagaaggtcagtcactatctgcttagctcaccattcacatcgccattcccctctgctctgccattctgctgtctttgagcctttccccgccggtttggctttgtggcaacccctcaccctctcatggtggggttggggctcaaagattttcgcttggctgcgcacagacccacttaccccgcgttcaaacaccacgacgcaaccccaactcatatacactccacatgatgctgactatcaaccacaggaagccgctgagctcggtaagggttccttcaagtatgcctgggttcttgacaagctcaaggccgagcgtgagcgtggtatcaccatcgatatcgccctctggaagttcgagactcccaagtactacgtcaccgtcatcggtatgtcgcaccatagccccgcattcattccaactcatgctaattcattacctcgacagatgcccccggtcatcgtgatttcatcaagaacatgatcactggtacctcccaggctgattgcgctatcctcatcattgccgccggtactggtgagttcgaggctggtatctccaaggatggccagacccgtgagcacgctctgctcgcctacaccctcggtgtcaagcagctcattgttgccatcaacaagatggacaccacccagtggtcccagactcgtttcgaggagatcatcaaggagaccaagaacttcatcaagaaggttggctacaaccccgctggtgtcgctttcgtccccatctccggcttcaacggcgacaacatgcttgagccctccaccaactgcccctggtacaagggttgggagaaggagaccaaggccggcaaggccactggcaagaccctcctcgaggccatcgacgccattgagccccccaagcgtcctaccgacaagcccctccgtcttcccctccaggatgtctacaagatcggtggtatcggcacagtgcccgtcggccgtatcgagactggtgtcctcaagcccggtatggtcgttaccttcgctccttccaacgtcaccactgaagtcaagtccgtcgagatgcaccacgagcagcttgctcagggtgtccccggtgacaacgtcggcttcaacgtgaagaacgtttccgtcaaggatatccgccgtggtaacgttgccggtgactccaagaacgacccccctgctggcgccgcctctttcaccgcccaggtcatcgttctcaaccaccccggtcaggtcggtgccggctacgcccccgtcctcgactgccacactgcccacattgcctgcaagttcgccgagctcctcgagaagatcgaccgccgtactggtaaggctgttgaggcctcccccaagttcatcaagtctggtgatgctgccatcgtcaagatgattccctccaagcccatgtgcgttgaggctttcaccgactaccctcccctcggccgtttcgccgtccgtgacatgcgtcagaccgtcgccgtcggtgtcatcaaggccgtcgacaagtccaccgctgccgctggcaaggtcaccaagtccgctgccaaggccgccaagaagtaaatt

SEQ ID NO: 27316 - DNA, 1278 bp, Neurospora crassa
caggagaagctaccgaacttgcgggaatacaagtactcggccgtcgaccactctttgacgtccaaatacatcctcaagccattttacaccaatgttgtcatcaagctcttccccatgagcatggctcccaacctgatcacgctcacgggtttcatgttcgttgtcggcaacttcctcactctgctatggtacaaccctaccctcgaccaggattgcccaccttgggtctactacagttgggccgccggtttgttcctctaccagacttttgatgcggttgatggcacccaagcgtaagtcatttctgtgccgtcatgtgtcaaacttacggaaacaaggtagactgacgatgaacctcaacacagtcgtcgtactcgtcagtccggacctcttggcgagctctttgatcatggcgtcgacgccctcaacacctcgctcgaatgccttatcttcgccgcctctcaaaacatgggccagagttggtacaccgtcgcgaccgtctttgcctcccttctcactttctacgtccaaacctgggatgagtaccacaccaagacgctcaccctcggcatcgtcaacggacccgttgagggtatcctgatcctcgtgggcgtttacaccttgaccggttacctcggcggcgcctctttttggcaacagggcatgctctccacccttggcgttccccagaccctcactttcggcaccaccgccttgactctgcccagctttctttacaatttctcctttacggaatggtacatggtccagggcaccgtagtgctcgtctacaacacggtcgaatccgctcgcaacgtgatacgcgcccgccgcgcccgcggcgaccgctcgcggtacgccctcgtcggtctcctccccttctttgccacctgggcgctcgtggtcgcctatttgttcctgcagcccaacattctgcatggccacctggtgcccttcgtgctcttcgcgggcatcgtcaacgcctacagcgtcgggaagatgattacagcccatctcgtcaagctcgacttcccttactggaacgttatggtgatccctctcggcctgggcgtctttgactccctcggccccgtcatccacaagtatgcacccgacggcctcaagaacctcgggtggccctcagctcttggcgacggcgtctatcaggttgcctacatgttctgcatgcttggaatggcggtcggcgtgtacggcagcttcgtggtggacgtcattgttaccatctgcgattacttggacatttggtgcttgactatc

SEQ ID NO: 27317 - DNA, 2385 bp, Neurospora crassa
atgtccaacccaccccacggcggcgtcctcaaggacctgatcgctcgcgatctccctcgccatgctgagctcgaggctgaggctgagactcttcccgctctgctcctctccgagcgtcagctttgcgatcttgagttgatcctcaacggtggtttctctcctcttgaaggtatgctttccttgtcatcctcggaacctgtcttggggtttacatttcattacctcgtccgtcctttggttctggatagcgatgatggtggggttatggacttgggaagggtgaaccccgccatgctggaccacccattgcgctttgcgtgtactcttgaacacgacaaaagcgctggatatgaccatgggagatgatgtacaacttgctaacaactcaattcgtctcggcgaataataggttttatgaaccaggaagactacaatgagtgcgtgtctctctttttttcagttgttgcccctccagggcgagcctttgtcggatgtggagcagcccactaacacgagactttactccaaatagtgtcgttaaggagaaccgcctcgcttctggcctcctcttctccatgcccatcaccctcgatgtgtccgaggaaaccatctccgaactcggcctgaaggcgggcgcccgcatcaccttgcgcgatttccgcgacgaccgcaacctcgccatcctgacggtggatgatgtttacaagcctgacaagtacgtaacaaagatatgaattgcagtggggtgaatttccaccacgaggacataccggatgcgcgggcacattgtgctcttgggcgacgtgggatcaaagaaatctctgggatgaaatgcgtgccaagtggttgcgtcattgcttggcgaatggccgatttgtgatactctagtcatctgcgcgggtggaagtgggatagaacagaagagctaacgttgcgacatttcagggctcttgaagccaaggaggtatttggaggagacgaggagcaccccgctgtcaagttcctttacgagactgccaaggagtactacgtgggcggcaagcttgaggctgtcaacaagctccagcactacgacttcgtcgaccttagatgtgagcagccaagtcccccttcttctcggcctcttcctctccctttcacccgcattgcaatgttgcgactatactgacgcgagatgggataatagactcgcccgcggagatccgtactcactttgacaagctcggctggtcccgagtcgttgccttccagacccgtaaccccatgcaccgcgcccacagagagttgaccgtccgcgctgcccgttcgcaccatgccaacgttctcatccaccccgtcgtcggcttgaccaagcccggtgacattgaccactttacccgtgtgcgcgtctacaaggctctccttcccagataccccaacggcatggccgtccttggtcttcttccccttgccatgcgcatgggcggtccccgtgaggccatctggcacgccatcatccgcaagaaccacggtgcaacccacttcatcgttggccgtgaccacgccggtcccggcaagaacagcaagggtgtcgacttctacggcccttacgatgcgcagtacgccgttgagaagtaccgtgacgagctcggtatcgaggtcgttcccttccagatgatgacctaccttccggacagcgacgagtacgcccccgtggaccagatccctaagggcgtccgcactcttaacatctctggaactgagctgcgcgctcgcctccgcagtggccgtgagattcccgagtggttttcctaccccgaggttgtcaaggtgctgcgcgagtcgcaccctccccgctcccagcagggcttcactgttctctttaccggctaccctaactccggcaaggaccagattgcccgtgccctgcaagtaacactcaaccagcagggtggtcgttccgtgtccttgttcctcggcgagaacattcgccacgagctgtcttccgagctgggctacaaccgcgaggaccgcgacaagaacattgctcgcattgcctttgttgcttctgagctgaccaggtccggtgccgctgtcatcgccgctccgattgcccccttcgagaaggcccgccagaacgcccgcgaattggttgagaagtacggcgatttctacctcgtacacgtcgccacccccctcgagtactgcgagaagaccgacaagagaggtatctacgccaaggcccgtgccggcgagatcgagaacttcaccggtgttaatgacccatatgagacccctgccaagcctgatcttgtcgttgactgcgagaagcaatccgtgcgctccattgtccatcagatcattctcttgttggagagccagggtctcctcgatcgtttctagacg

SEQ ID NO: 27318 - DNA, 891 bp, Neurospora crassa
aacacagtgaaggccatgttcgacaccttggacgccgacattgtggtcatacaggaaaccaagattcagcggaaggatttgagagacgacatggtcctcgtccctggctgggatgtgtacttcaacttacccacgtacaagaagggctactcgggagttgcaatctacactcgttcctcgaaatgttgcccgatacgcgccgaagaaggcattactggcgttctgtgtccgccgaactcgtccacaaagtttcgcgacttgcctgctgatcagcagattggtggctatcccactcccggccaactctccagcgacatagacgaagctcaacttgactccgaaggaaggtgtgtcatcttggagttccctgcctttgttcttatcggtgtatacagcccggccacgcgagacgagaccaggatcgagttccgtcaggccttcatcgacgccatggatgccagagttcgtaaccttgtctccttggggaaagaggtgtttctctgcggcgacctcaacatcatccgaaacgagatggataccgctggtctaccagaacaattgaaaaaggaggccatgacactcgaccagttcatctcgaccccttcgcgccggttcttgaaccaaattgttttcggtggccgagtgattggtgagccagacgaagggcgagagaagcctgtgctgtgggatctctgcagagagttccatccaaagcgtccaggcatgtacacgtgctgggaaacaaggaagaacgcgaggcctggaaattttggtagtcggattgattatgttctgtgtagctctggaatcaaggactggtttgtcgacgccaacatccaagaaggccttctagggtcagaccactgccccgtctatgccaccattagcgac

SEQ ID NO: 27319 - DNA, 3231 bp, Neurospora crassa
agatccgaagctgaactggccatcaacatccgaaaggccaccagcgccgaagagtctgccccgaaacgcaagcatgttcgaagttgtatcgtttacacatgggaccacaagtcttcccaatccttctgggcaggcatgaaggttcagcctatcatggccgacgaggtccagactttcaaggccctcatcaccattcacaaggtcttacaggagggccacccggcgacactgagagaggccatggcaaaccgcggttggattgacagtctgaaccgcggcatgggcggcgaaggtatgcgtggatatgggcccttgatcaaggaatacgtttattatctccttgccaagctttcgtttcaccaacagcaccccgagttcaacggcacgttcgagtacgaggaatacatcagtctcaaggccatcaacgatccgaacgagggttacgaaaccattaccgacctcatgacgctgcaggataaaattgaccagttccagaagctcatcttctctcacttccggaacgtcggcaacaacgagtgcaggatatctgccctcgtccccctcgtcaccgaaagctatggcatctacaagttcatcaccagcatgttgcgcgccatgcactcatctactggcgacgccgaggcgctggaaccgttgcgcggaagatacgatgcccagcattaccgactggtcaagttttactacgagtgctcaaacctccgctatctcaccagtctgatcacgattcccaagcttccccaggatccgcccaacctcctggccgaggatgagaatgcacctgccttgcctgctcggccaaagcacgaaatcgaaaagcgtccgacacctccgcccccagcaccgaaatccgaagagcccgatgacatggccgagttctggaagaatgagcttgacaggcagaaccgggaatacgaggagcagcagcgggttttggaagcacagcagcagcaggcgttgctagcgcagcagcaagcacaactacaagcgcaacgcgatttcgaagaacagcaacggcggttgatggagcaacagcaaagggagcaagaggccttgatggcccagcagacacaatggcagactcaagggcggcttgctgagcttgaacaggagaatctgaatgcccgggcccagtacgagcgggatcaactaatgctccagcagtacgaccaaagggtcaaggccctagaaagcgagttgcaacaaatccagggtaactacgggcagcaaataaacagccgagacgaccaaatccgtgctctccaagaacaactcaacacttggaggacaaagtatgaagcgcttgcgaagctctattcccagcttcgccacgagcatctcgatctcctccaaaagttcaagacggtacagctgaaagcggcttccgctcaggaagcgattgagaagcgggagaagcttgagcgtgagatcaaaaccaagaacttggagctggcagacatgattcgtgagcgcgatcgtgctcttcatgaaaaggacaggctgcaaggctcgaataaggacgaggttgagaagctcaagagggagttgcggatggccttggaccgcgccgataatctggagcgcagcaagggcaacgagctttctacaatgctttccaagtacaaccgcgagatggccgatctagaggaagccttacgtatcaagtcacgagcactggaagaggcccaagccaagctacgggatggaagctcggatcttgaagcgctacttcgcgagaaggaggaggagctcgaggtatacaaagctggcatggaccagacactgatcgagctcaatgagctcaggaacaaccagggtgtctccgattcagcccttgacggccagctggacgctttgatcctctcccagctggagaaggtcaacgagattatcgactctgtgcttcaagctagcgttcagcgtgttgatgatgccatgtatgagctcgattctgacatgcaagccggaaaccagaacgcctcgccttcctatgtcctctcgcagattgagaaggcgtctgcgagtgccacggagttcgctaccgctttcaacgtcttcatcgccgatggtcccagcagcagtccggcggagctgatcaagaacgccaacgttttcgccggcgccatcgctgatgtgtgcagtaacaccaagggtctcgttcgcctcgctactgacgagaagaagggagactctttgatcaacggtgctcgttcatctgcccattcgacagtcaagttcttccgtggtctgttgagcttccgccttgagggcatggatccacttcagaagaccgacgttgtcatcaacagcaataacgatgtccagatcaacctgcaaaagctgaacaagcttgtcgagaccttcgctcctggctttggccagctcgctaacaagggtgaccttggcgacatcgtcgatcaagaactcagcagggcagccgatgccattgctgctgccgttgcccgtttgcagaagctcaagaacaaacctcgcgatggatatactacctacgaactcaaggtccacgactcaatcctcgatgccgccatggccattaccaccgctatcgcgcagctcatcaaggctgccaccgctacacagcaggagattgtgcaagctggtcgtggctcgtcttcgcgcaccgccttttacaagaagaacaacagatggaccgagggtcttatttccgccgccaaggctgttgccaactctaccagcactctcatcgagactgctgacggtgttctttccaaccgcaacagccctgagcagctcatcgttgcatctaataatgttgcggcctccaccgcccagctcgtggctgccagccgtgtgaaggccggcttcatgagcaagaaccaggagagcctggaggaggccagcaaggctgtcggtgccgcctgccgtgcgctcgtcagacaagtccagagcatgatcaaggaccgcagtgccgaggatgagcaagtggactacagcaagcttgggtcgcacgagttcaaggtgcgcgagatggagcaacaggtacgtgattccttcgagatttccttcctctttcatttccggtacccttggtcttgcctattatggttcattgctgaccaattcattctctccccatcacaggtcgaaatccttcaactcgaaaacgcattgaatgctgctcgccacagacttggcgagatgcgcaagatttcgtaccaacaggatgaggac

SEQ ID NO: 27320 - DNA, 5036 bp, Neurospora crassa
gcggccagcatcatggaatttttaagacttcgattgaactgtattgatcactaccaagccacgccaaccagatatgatccccagtttgaccaagatgtgcgcttttcgcgttcgcggaaggccgccaaagtccctgtaattcgggtgttcggatcgaccgacaagggccagaaagtctgcgctcatattcatggtgcctttccctatctgtatgtcgagtatgacggaaatctagaacccaacaagggtgagtgtttccctgtttctacacacatggttcgcgcatacgttccctttctcacatagttttagcctacgaatatatcgcaaaattgcatgcatccatagatcatgcgttagctatcagctaccggaaagatcccattcgcgatcggcccaaatatgtagcacggatttcgctgacaaaaggtatacccttttatggcttccatgtgggttatcgcttctatctcaagatttacctgttcaacccggtggtcatgtcgcgtctcgtcgatctccttcagcaaggtgttattatgagtcggaaatttcaaccatacgaggcccatctgcagtatctccttcagttcatggctgattacaacctgtacggctgtaactacctggatgcggcgatggccacctttcgagcacctgtaccgaagcatgacagcaacattgaaggccgtgaggctgaacatcactgggacgatacaacgatcccgtcagagctgattacggataattacagccttccccgggctagccactgctcccttgaagtggacatctgcgtcgaagacatcctgaatcgaaagcaagtcaaagagcgaaggcttcatcatgattttatcgaaaaggagcagccggtgtcaagccaagaaaagctggtgcacagcatggctggactctggacggatgagacaaaccgcaggaaaaagcgtatgggaataacggaccctgaagtcaacccttttcctccggaagtcttggtatcaatgtctgcggacccacgtcaatcacaggtgatggggtgggttcatgaagctgagtaccgtgctggtattcaacaattggttgctcaggaacagaacaacacagatggacgtcaggagactttctcccgctttgtgcaaccagttccatttgaagaaactatcaagactactttagagtcagtggaagacttatacccagacaacttgagccaagctctgcaaatcgaagcacaatttttccacatgaatgcacaccatctcatcagtatcgatgtcgacgaacgaagcatttttcagctgacacgcgagccgtatgcaaaacacactcgacacgaatacgcgggcagaatctcaccggaggagcctttgaatggtgttggagaaggatttggtgtgggggattcaatgatttatcctatggatgggcggatccgtgtataccaacccagagcttccatccgtcataaacttttgaagattgcccagacttactcttccaacataccagccaatacaggaagacaagccgggattcttggtcctggagagcgacaacgaagatctctcaagcatcccaggccgccgggagaagttgatcatggtgcacctgcaaaacgtcaggtgctccaagctgagtactcaagggagtcacttcacataaaagccgaccctccgcaaagagctttgagaaaggctccgagaaacgcacatgaacaaactcaaggtgcaggtcagccagggcctcagagaaagctccagagtaaccctccggaaagggtttacgaggaaccaaacaagagggttcacgaggaggctcaaccaaaggtccatcgaaaggcccagcaaaggtctcgggaacatgaccagaaacagggccaacagataatacaggaacaaactcaagatcatgatcagggaggatgccagaaggaagttccagaagattcggcattcacgacgccagctctgacagtccagccaatgaaacccaataatcaagatccagcaggagaggaactatcggtgaatagtctgcgggtcgagccaccaaaacctaagacatctcagcccatgaagtctgctatgaagcagagcttcacacaagagttccaaaaccgtacgatcaactttcccgtcgtcaaagatccacaagatcctaacacaagggcgcgactgagccaaaagagtggttcgcagaaaaacgagggtaacgtcaccagaaagcaacttgccttcgaccctcaacccaccattttggggccatcggctcaggcgaaacccggtcagactaaatccaacctaaaatcgtcgtccaggccccttgactcggcccctgtggctttggctccggcactcttgtggagtggctcaaagaaaatgtttgtcttgaacaataaacctccatccctgagcgaagtccgctgtaccatgcaggtacatggcctacctgatgtcatctatcaagacgcatattacagtaaggatgaggatgttccctccagaccgagagaatatgcaggcagggaataccgacttgacggtagctctgttccttggctctccgatttcgacccgactggcacatcttcggcgacatatggcgagaaacctacctccggtgccgactggccgatgctggaggcaatctatgaggctcaacaagaggaatgtgcgatgaggggttgggaaatagcagatcctcctccttctttcaaggaagtcagtaattggtggacagatgaacaaaacgatcgcaatccaaaacgatgccattccacacccctaaggattaaaacctaccgctcccaaattgcgggcgtgacgccaaagaacaagcatggcttcgaacatcccgaaaagacaaaatctgaaagcaaacaggatcaggcacagtacatgagcgccatgagcctagaggtacatgttaacacccggggcaagctagtaccggatcctgaagaagacgaagtgcagtgtgtgttttggtatctgcggtccgaagtaaacgctctccgcggaactcagacgccggatgatacggcacggggcattatcgttttctcagaggatagtctgcttgcagatagaatccgaaagcacacatccgtgccggtggttcaagagacaacagaacttgatatgatggtccggatggtcgagattgtgcggaaccatgatcccgatatctttacgggatatgaggtacatggcagttcatggggctaccttattgagcgagcgagaataaagtatgagctcgacctctgtgatgagttctcacgcatgaagtctcagtcaaatgggcgtatcggtaaggatgcggatcgctggggcttcaacacgacatcctcgattcggattacaggacggcacatgatcaacatttggagagccatgagaggcgaactcaatcttctacagtataccatggagaatgttgtttggcatctgctacaccgtcggattcctcattacagttggaagacattatcggattggtatctgagcgatcgaccgaaggatctggataaagttctccgatattacctgacgagaacgcggcttgatattgaaatcctggaaaagaacgagctcattcctaggacaagcgagcaagcaagactgcttggtgttgactttttttctgtcttctccagaggatcgcagttcaaggtagagtccatcatgttcaggatagccaaacctgagaacttccttctcccttctccaagcagaaagcaagtgggtgcacaaaacgctctggagtgtctacccttagtgatggaaccgcagagtgcattctacagcagtcctttgcttgttcttgactttcagagtctgtatcccagtgtcatgatcgcctacaactactgctactcgaccttccttgggcgtatcgtcagctggcgaggtagaaacaaaatgggtttcatggactacaagaggcaagaggggcttcttagtctactcaaagattacatcaacatcgccccaaacggcatgatgtacacaaagcctcatattcgcaagtcacttcttgcaaagatgcttaccgagattctcgaaactcgtatcatggtcaagtccggtatgaagcaagacaaggatgatagggcgattcagcaactgctgaataaccggcagctggcgctgaagctcctcgccaacgtcacctacggttacacatcggcctcgttctcaggtcgtatgccctgctccgagattgccgacagcatcgtccaaaccggtcgcgaaacccttgagcgggccatagccttcattcatagcgtccaaaaatgggacgccgatgttgtctacggagacaccgacagtcttttcgtctctctcaagggccgcacccgcgaacaggcctttgagatcggccaagagatcgccgacgctgtcaccaagttgaatccgcggcccgtcaagctcaagttcgaaaaggtctaccacccatgcgtactcctcgccaaaaagcgctacgtcggctacaagtacgagagtcgggaccagaccgtgcccgtgttcgacgccaagggcatcgagacggtccggcgcgacggcacacccgccgagcaacggatcgaggagaaggcgctcaaaatcctctttgagactgccgatctcagccaggtcaagagttacttccaggagcagtgccacaagattatgcgcggcgccgtgtccgtgcaggatttttgcttcgcgcgtgaggtcaagctgggcacgtacagcacgtccggtcgcggcggcccggctcccgctggcgcgctcattgccaccaaaaagatgaaggaggacgcgcgggcggagccgcaatatggcgaacgggtgccatatgtggtgatggccggcgcgccggggatgaggctggtagaccggtgcgtggaacccgaggagctgttgaataacgcacatgctacgttggatgcggactactacattaacaagaacatcattccgccgctagagaggatcttcaacttggtcggcgcgaacgtgaggacttggtatgaggagatgcccaaggtt

SEQ ID NO: 27321 - DNA, 1599 bp, Neurospora crassa
gtggtggtgaaacaccaaggaaagaaatacgacgtggatgtcgatacctccgcgaccggcgaagtcttcaagtaccagctttacagcctgactggtgttgaacccgaccggcaaaaagtgctcctaaagggcagccaactcaaagatgataccgatatgagcaaggtgggcctgaagcccggccagatgatcatgatgatgggaacgccaggtgagggtggaggcgcaatcgtccgaccaaccgagaaggtcaagttcgtcgaggacatgacggaggccgaagcagcacaacaagcgggagcgactccggccggtcttcaaaatttcggcaacacctgctacctcaactcgacgcttcaagttctccgctccattcctgagcttaacgacgctctcaagtcctacaagggtgaacaatcaatgctggaccctacgtcgcagctccggaatctttacgatatgatgtcgaaaacacaggagggcattcctccgctcgcatttttgaatgctcttcgtgtcgccttcccccagtttgctgagagggaaagagacggccacggttatgcccagcaggatgcggaagaagcttggtcgcaaatcctaacccaactcaagcaaaagctcaagatttctgagggtgacgccgccagagacgcatccttcatcgacaagtacatgggactcgaacttaccagcgtcctcgagtgtgacgaacccggcgccaaggaagccggagaggagccaaagacctcgaaggagcgtcttctcaagctcaactgccacatcgatggtcagaccaatcatctcagggatggaattgtcaacggtttggtggaaaagcttgagaagaagtcagaggttctggacagggaagcgacgtacactaagcgttctcagatctcccggctacccaagtacctgaccgtgcacttcatgcgattcttctggaaacgtgaggttcagaagaaggccaagattatgcgcaaggtcacatttccccacgagcttgatgtggtcgagttctgcacggatgagcttaggaaggctctcattcctgtcagggacaaggtccgcgaggtgcgcaaggaggagcatgatattgaaagagcccgcaagcgcagaaagatgaaccccattgacggcgaaaacgctcaaggatcccaaccttcgacatcaaaggacaagaagaaggacgagaagaagcctgctggcggtgacgtggagatgaccacagaggagaccttcaagacagacgccgagttcgaggccgagaaggaagctgaagtactggctgccaagaaggagctttacactttgattaaccaagatcttctcaaggacgaaggtgccaaccagtccggactgtatgagcttcgcggtgtgatcacccatcagggcgccagcgccgacagcggtcattatacggcctacgtcaagaagacagggattaaggatcctgtcactggcaaggtcggtgaggaggacggcaagtggtggtggttcaatgatgacaaagtctctgaggtggaggcggaaaagatcactgccctggctggcggtggagagtcacactcggccctgatcttgctctaccgcgcg

SEQ ID NO: 27322 - DNA, 1187 bp, Neurospora crassa
gaccacattccgctcgtcgtatcccgcgaaacaggcgatatcgtaccagagtcacaccaagccgatccgttagtacggccagacaagatcgaagcaaccccctttgcaaaatcatgggcgcactttgttgcaggagggtaagcaagaacaattcctcccacggacgggaagccacttgcgcccccgtcagccaagaagagcgctgagctttaacactttcgcgctctcgcgcacataacagaatcggtggtatgacagccgcagccttaaccgccccgttagacgttctcaagacgcgactccagtccgacttctaccaagcacagctccgagcctcgcgacaatcgcacgtaggagtgcccctcaacccgattcgcgccgcctggtaccactttagcgagaccggccagattctgtcggctgtgtaccggcaagaaggcccccgcgccctgttcaagggcctcggccccaatctcgtcggcgtcgtgcccgcgcgctccatcaacttcttcacctacggcaacggcaagcggctgatcgccaagtacttcaacaacggacaggaaggcacatgggtgcacctcagcgcgggcgtgctggcgggcatcgtgaccagcaccgcgacgaacccgatatggatggtcaagacgcggctgcagctggacaaaaacgtggcggctgagagcggaggcgtgacgaggcggcagtaccagaacagctacgactgcatccggcaaatcctgcgcaacgaagggctccgaggcctgtacaagggcatgagcgcgagctacttgggcgtggccgagtcgacgctgcagtgggtgctatacgagcgcatgaagacggcgctggcgttgcgggaggagaagattgtgcagagcgggcgccaaaagacttggtgggaccacgcggtcaactggacgggcaatgcgggcgctgcgggcggcgcgaagcttgtcgcggccgtcctcacataccctcatgaggtcgcccgcacccgtctacgacaggcacccatggacggcggcaagcccaaatatacgggcctgatccagtgcttcaagctcgtgttcaaggaggagggcatggccggtctgtatggtggtatgacgccgcatatgctccggacggtgcccagcgccgccatcatgtttggcatgtacgaagccatcctcaggcttcttggt

SEQ ID NO: 27323 - DNA, 1385 bp, Neurospora crassa
ccttcccctcttaaacacacaacaccccccttccacccctcgcacgcagctaacccatcccctccccctccttcaataggcacctggcaaggcgaatccacccaggtaaaagacgccgtcgtcgctgccctcaaatctggataccgcctcatcgacacggcttactgctacggcaacgaggagcatgtcggtgccggcctgaaagaggcgtttgatcagggtatcgtcaagcgcgaggatgtgtttgtcgtaactaagctatgggcgacgtacacgagccgtgcggaggaggggctagaaaagagtttgaggaatctgggtttggagtatgttgatttgtttttggtggtatgttgtctcagtcttcagtttttcctctcgctattgtgagctgctttgcttgggggggttagggggttgtgtcaaagtgggggtggaatttaaagagaaaggtgttgaggaaggtgctaacgaatggcgacttgggctataacagcattggccgcttttgatgaatcctgaaggtgagttcgttgagtgggcatacgaaaaaagaagaagagagagaacaaaaagaaaaaagaaagaaaaaaagaccaaggtcgctgcttagtggactgacgaaccgactacaacacataggcaacgatgacagattccccaagcttcccaacggcgagcgcgacattctccgcgactacagccacgtccagatctggaagaacatggagaagctggtagggtccggcaggaccaaggctattggtgtttccaacgtatgcgtttctattctcatgaccttccttgcccaaccctgctcagcctttagccatcccgtcccttcttcgttacctcttacttcgtgatggcggccgttaacctaagccccttacaatacaaacagtatagcaagcgctatctcgaagagctcctcccccacgccaagatcgttccagccgtcaaccaaatcgagaaccacccgcaactgcctcagcaagaaattgtcgacttttgcaaagagaagggcattcacatcatggcgtactcgccctttggcagcaccggtagccccgtgaccagcgccgagccggtaattaagattgctgagaagcatggggtcaagcctactactgtgttgttgagttatcaccgtaggtttattccctgtcattatcctgggttccgagagagtggcgttgcttggggaactacacacaaagggaacagaagtgctgacaagactttactgcaaatccacagtttaccgtggaagcaccgttctgcccaagtcaacaaacccggagcgtatcgaggctaacgccaagctgatcgagttggatgctgaggatcaaaagctactgaatgattattcggaggggttggtc

SEQ ID NO: 27324 - DNA, 958 bp, Neurospora crassa
gtccagaacatgttctccctcgagggccacactgccctcatcaccggagccacgcgaggcattggtcaagccgtggccattgcccttgccgaggccggcgccgatattcttctcgtccaggtctgtccatccgtcgccttctagctccctcaagaccggtacctatccgttccaaaagaaagacccgtttctaaaaaccacccgtcacagcgagacgaaacctccaccaccaccctccaagccatccaatccctcggccgccacgcgcaaatctacaaagccgacctctcctcccccaccgacgtctcttctttagtgccacgcatcctctccgacgggcacaccatccgcatcctggtcaactgcgccggcatccaacgtcgacacccttcccacctgtttcccgactccgactttgccgaagtgatgcaagtcaacctcaacgccgtcttcactctatgtcgggacgtgggcgcgcacatgctgggtctcgacccccaccccgtcaccagacgcaaggggtccgtgatcaactttgccagcttgttgacgttccaaggggggttaacggtgccggcgtatgcggcgagtaagggagccgttgggcaactgaccaagagctttgcgaatgaatggacgagtaaaggcgtgacggtgaatgcgattgcgccggggtatattgagacggagatgaacgaggcgttgttgaaagatgaggagaggttgaagagtattagtgcgaggattccggctgggagggtaagtcattcggttttttattttcttgtttgtcaatttgcagacgttcatggctaacgtgatggctctggccaatttggtattgtagtggggaagtccggaagatttcaagggaacggctgtgtatctggccagtaaggcgagtggttacgtgagcggacatgtgctggttgttgatggtgggtggatgggacggtaa

SEQ ID NO: 27325 - DNA, 1524 bp, Neurospora crassa
cagctcctcgaaaactcgagagcttggaaggatgcctgggcctcaatcgttcaccaccagctgcagtttgtcgttgagctcgaaggcctctacgacccgattgttggcgcctccgacggccatggacgcgaatcagttcctacaccccggctacaactcgagcggacatacaggttgaaacaggcctttggcgaactcaagtcggagctggcagaggaaattggcacaattgaagaccgggtgattcgaccggctgtggaagcacgggattgtatcgccccaattcgcaagacgatcaagaaacgagagaacaagaggctggattacgaaagggcccaggacaaagtcagcaagcttcacaaaaagcacacaaggactccaaaggaggaagcttcgttggccaaggccgaggtggagatggcccaggcaggtgatgtaagtctactctagccacaggcagtccacttgattgattatcagccatactaactatgcacataggagttcgccatcgcagacgaacacctccagtcgaccctgccccccatcataaacgcttccttcagcctggtaccttctctggttgcagccttggttctcatccagaatcgcctcctggggctatactatacgaccattcacggctactgcatggagtctgggttcccctcgcctccgcctcccatgtccgatgtggtggcggcatgggaagctgctttcgttcccgcgcgggatgatttcgagtccgtcagcatcgtagcccgcggcaaagctgcccattcacccatggctctacaggcccctgagggcccaggccgccggatttccgccataatacccgggagaaacgacatgcgtcgcgttacttcaccaatgccgtctacgtccggtgcggcgtcaacctacagcagcggggcaagtcaacccggacgcaacaatctgcgtatcccttctgcaggtggttacccctcccgcgccccgtcacccgcggcatccgatcgatcttcttacgcctccagcccaccggcctcctcttactctggttactctggcagccagaaccaacaaaggagacccgattacctagcgcctaccgacttcaccgcggctactgccctgggcgaccgaggctcggtagaccgcggcacgattgagaataacaggccctttccgaggtctccttccacgaccgctccgtcgatcaacagggtccatagcccccaggctactcggaatgctggcagtgcaaatgggaacggaaacggaaatggaaacgattactttgctcttgcggtagctaagaagcgaccccctccaccaccgccgccgaaacggatcacaagccagcagcaactggttgagtacgtggttgcgcagtatacgtttgcggggcagggcgcaggagatcttgcgtttaacgagggcgacaagatcaagattatcaagaagacgaatactgatcaggattggtgggttggggagttgaatgggaagcggggcaattttccggcgaattattgtaag

SEQ ID NO: 27326 - DNA, 1651 bp, Neurospora crassa
gtgaaagcatctcaacgccttgactctaggggcaacccaacaattcaagtagaagtcaggaccgcccatggtgcgtttccaacttacaattccctctccgacaagtttttgttgacaaggtgggctgcctgactaatatatcgctaggaattttccgcgccctcgtcccgtccggtgcttcaaccggagtccacgaagccgtcgaactccgcgataatgacaaacgcaagtacggaggaaagggggttcttaccgcagtcaacaacgtcaacgagatcattggcccggccctggtcaaagagggctatagctcccgtcgcgacctgaagcagatcgacggcttcatgcgtgaactggacgggactccgaacaaagccaagctgggtgcgaacgcgattttgggtgtgagcatggcttgtgctagggctggggctgctgctgcggtaagtttccgtccttgattgcccatcgttttgttccgtgccccccccccccccccccaggttaggttggttgacaagcgtgaaactcctaaattctagaacatccccctgtacgagttccttcgtcgagagggcggcgaagaagctccttacatggttcccgtcccttttttcaacgttctgaacggaggcagacactccggaaacggcatggcgttccaggagtttatgattgctccgaccggcgctaagaccattgaggaggggattcaaatggcgtctgaaacgtattttgttctgaagcagatgatttctgataagtttggggccatttgtaagtcctgtcctgaaccaaatcagtggatcatactgtgatgtgagaattgataagctgcaaaacagacacgggggtaggcgacgaaggcggttttgcccctcctattacccaacccgaagaagccctcgacttgctcaccgaggctgtggccaaagctggatacaccgataagatcaagttcggcatcgacgcggcatcgtccgagttcttcaacccagagaatgggacttatgacctcggttttaagagaataaaggagggtgaatcacattcggacgatgtcaggaccccagctgagatgatggcgctgtacaagtccctcatcgaaaagtatccgatcccactgcttgaggatcccttcgccgaggatgattgggagtcgtggaccaagttctgcaaggacttctattttgaggagctggtgggggatgacttgctggtgacgaatgtggagagagtcaggatggccgagagcagggtggcgtgtaatgcgatgttgttgaagatcaaccagattggaacggtgacagaggcccttgatgcgtgagttttggcacctccacttgtttccctttgactgcctttgggttggtaaagtgatggtcttgctgactgatttctggtataaagggcgaaactggccaagagcttggggtggggcgtttttgtgtcgcatcgatcgggcgaaacgaccgacgatttcattgccgacttatctgtcgggctctgcacaggtcatatcaagtccggagcaccgtgtcggggcgagcgggtggccaagtacaatcggctgctagacatcgaaacggagttgaaggagagctggaagccgtggtcgtatgcgggcgagaagttccggaagccggaggct

SEQ ID NO: 27327 - DNA, 1529 bp, Neurospora crassa
atccacttcgaacgttccctaacctttctccaagcctgcgccctctacccctccgccatcctgtggtccgccttcgtctccatgggcgtcataatgctcgccttcgacccgcagctcctaggcaacttgtacgccatgccgcaattccgcaaagactttggctatctctataaaaatgactacatcatcagcgcgccctggcagaccggcctatcaatgggtaatcccgtggggcaagtcgtcggcgctttgattgcgggatacccgatggagcggttcgggaggaagtggacttttggggcttgcgtggcgctgacggcttgtcttatttttatccagttcttcgcccgctcgctgcaggtgttgctggttggtgagcttttggggggtctggtgctggggtgttatgccgtcattgcacctgcttactcgtccgaggtgtgcccgatggctcttaggggggtgttgacgagctatgtcaacttgtgctttgttattggtcagttgttggggaacgcagtatgtgctggaacgagcaagttgagcaatcattgggcgtattcaattccgtttgcgctgcagtggttttggtgcttggttatactattggggctggcgtgggtgccggaaagtccgtggtggttggtaaggaaggggaaactggatgaggctgagatggtgctgcgtaggctggcatcggacaaggttgatgtgggaaagacgttgacagtgattgtggaaacggatcggttggagcaggagttggagatggggagtacttattgggactgctttaggggagtgaatctccggaggacggaaatttccatgggtgtttattgtacccaggtcctgagtgggatttacctgatcaattatgggacgtatttctttcagctcgctggtttggacaacgacgaagcatttgacatgggaattggatttttaggtaaggcgcttggctcttggtatccctccactgcttcatgctaaaaactcatttctctacagccgtcggcttcctcggcactatcatttcctggcccctgttgatccgctacggtcgccgaaagatcttcaacaccggcctcctagtcctcgtcttccttcaaatcattattggcattcttgactgcattcctggccggcccagtggcgttatttggaccgaatcctcactgatgctagtgtggaacttcttctacgatatatctgtcggccccgtctgcttcgtcattatatccgaagccagcgccaccagggtgcgatccaagagcattgccctcgcgactgccgctcaaggcgctcttggctgtgtgatgacggttgcgattccttatatgatcaaccctgatcaggcgaacatgcaggggaaattgggtttcttctttgggggtcttgctgcgatgtgcctggtttggtcgtatttgagggttccggagacgagcgggaggacgtatgaagaattggatatcctgtttgagaggaagatcggagcaaggcagtttcaagaatacgttatcgagagt

SEQ ID NO: 27328 - DNA, 828 bp, Neurospora crassa
ttcaacctcgcgggccgcgtcgccctcgtaaccggcggcggcactggcatcgggcttatggccacacaagctctcgccgtcaacggcgccaaggtgtatatcgctggccgcaacaaggagaagctggacaaggtggtggagatctacaacaaggacgtcgagggcgagatcatcgccctgcaggcagacgtgactaagaaggaggacattgccgctctggtcaaggagatcgaatcccgcgagaagtgtctctgcatcttggtcaacaacgccggcatttccagctcgagcgtaaccaccgaggccagcgaccccaaggagctcaagcacaacttgtttgataacgagaacgctactttcgacgactggacggagacataccgtaccaatgtggctagcatttacttcatgacctccgcctttttgcccctcctacaagctagcaccgagcgccacccaggctggtccggcactgtggtcaacatcagcagcatcagcggccaagtcaagtcagcccagcaccacttcagctacaacgctagcaaggcagcggccgttcacctgaaccgcatgctagccgcagagatcgccaacgctgggctcaagattcgcatcaacagcattgcgcctggtgtcttccctagcgagatgacggccgaggaaagcgacgagttccagaagagccatatccccaaggagaagtatcaagacaagttcccgagtgctcgtcctggccgcgatatcgatatggcgcaggcagtactggcattggtatcgaaccagttcatcaatggcgagacgttggccgttgatggtgggtacaagttg

SEQ ID NO: 27329 - DNA, 3699 bp, Neurospora crassa
tacttgacgccatccacgactttctcgacagaatggctgaaccgcctccagcaacgctgggacacacccgtcgaccactccctgctcttccgcatcgctcccacacaaacacgtaccgtcactcgcttccagcgtcatggcctcgagggtcgcgttaccggatatcgcaacgtcaccgtgccagcctcgcatgccactgccaagacgagtacatccatgatgcgaaagccagccagcaagtccgagtttgtgcgcggcggggctggcttctttcccttcgccccaggtggtctagacggtatcgagtctgctgccgcattagaggatcaactaagaaaggacgccgcatcggacgaaggagagagcaaaaagaagctggaaagagtcatcactctcgctgagggtggtcttcttgaagtcgcaccaggaatgtcgcgcggtatcgacatgagcaagagaaagaagacagcagatgcggagagcgaaaaacaggccaaggaagtagaggatgttcttggtcaagagcccgaggacgctcccgacggcgagggcgagagggacgaggtcaacggtgtcaagagggaagagagtgaagataaccaagacgacttggaagatatcgacgccatattgcctgtcgaatttcctgccctcgagcctcgtggcacattggccgcgtccagcgctagaaaagctggtcgggagtgggcacacatggtcgacattaggcgggagatacccaactttagggagttggtacccgacatggcaagggagtggcctttcgagctggatacgttccagaaggaggccgtttatcaccttgaaaatggcgattcggtattcgttgcggcacacacatcagccggaaagacggtggtcgccgagtacgctatcgcactggctgctaagcacatgaccaaagctatctacacatcccctattaaggcgctgagtaaccaaaagttcagagacttcaggcagacctttgacgaggttggtattttgaccggcgatgtgcagatcaaccccgaagccagttgcctaattatgacgacggaaattcttcggagtatgctctaccgcggagcggatctcattcgcgatgtagagtttgtcatcttcgacgaggtacactatgtaaacgactacgaacgtggagtagtctgggaagaggttatcatcatgctgcctgagcacgtttcgctcatcttactgtctgcgacggtccccaatacttacgagttcgcctcttgggtgggtcggacgaagcaaaaggacatctatgtcatctcgacgcccaagagacctgttcccttggaacactacctttgggcgggcaaaaagatccacaagattgtagactcggagaagaagttcatcgagaccggctggaaggaggccaatcttgctatacaaggcaaggacaagccgcccaaagccatcgaggcctcaacaggaccagcgcggggtggtggcaaccaaagaggtcgtgggggtgcgcaaaggggcgcgaatcaaccacgaggaggtgcgagaggaggtggccagcaacgtggaaggggtggcccaccacgtgcaagccacactcccggacatatgggccggacaggtcggccaggaggctttacgtctgctgctcaggacaagaacctgtgggtccatcttgtgcagttcttgaagaaagataatttgctgccggcttgcatcttcgtcttctccaagaagagatgtgaagagaacgccgatgcactcagcaaccaagacttttgtactgcgcaggagaagagccacattcatatgatcattgaaaggtcgattgctcggttgaagcccgaagaccgagtgttgccgcagatcattcggctgcgcgagcttctgtcaagaggtattgctgttcatcacggtggcttgttacccattgtgaaggagatggttgagatcttgtttgcggagactctggtcaaggttctctttgccactgagacctttgcaatgggcttgaacctgccgaccaggacggtcgtcttttctggctatagaaagcatgatggtcaccagttccgcaacctcctgcctggcgagtacactcagatggccggtcgtgctggaagacgtggtctcgatacagtcggctctgtcatcattgtaccgcctggcggagacgaggccccgccggttaccgatctcaggcaaatgatccttggcgagccgagcaagcttcgttcgcagttccgtctgacttacaacatgattctcaatcttctccgtgttgaagcgctaaagatagaggagatgattaagcgttccttctcagagcatgctactcagcaacttcttccggagcatgaaaaggcagtcaagctttccgaagccgatctggctaaaatcaagagggactcgtgccctatctgcgacgttcacatggatgagtgccatcaagcaggagaggatttcaaggtagccacagaggagctttatcgcgccctactggccattccggtcgggcgtaagctgttcacacctggtcgacttatcgtttatatgaaggagggcgttagaacccctggaatcctccttgctgagggaccaagcaaggcgggcaccgctgctaacccgacactgcatgttcttgagatcaagaccggcagggaccttcgcaacgataccgatctcctgccattcaccccgactctggccaaatggttcactcccttgcccgcacacaagaaaaacatctacaccaagaccgttcacattcctctcagcgacgtcgtttgtctcactaagcatatcaccaagagcattgttcccgaactctttgacggtggcgatggttacaccaaagcgaaggaagcactccaccagatttgtaaatcctggtccgcgcccatttgggatgagatggacctcagccgcatcaaatccctctctatccatgagatcatcacgcgccggcgcgacgccgaaatcaagtgcacaaagtcctccgccgtcgactgcgatctcttcctcaagcactacgccatgtgccacgaccagtggctgatcaagaccaagatcgacgagctgcgccagtccctctccaaccaaaacctacagctcctcccggactacgaacagcgcatccaagtcctcaaggacctctccttcatcgacgacgccagccgcattcagctcaagggcaaagtcgcctgcgagatccactcaggcgacgagctcgttctcacagagttgatcctcgaaaacgtcctcgccgattacgagcccgccgagatcgccgctttgctctccgcctttgtcttccaggagaagacagacatggtccccaacttgacgtctaacctcgagcgcgggcaaaagactatcatcgagctgtcagaaaaagtcaacgccgtgcagacgctgcaccaggtgatcctgtcatcggatgaagggtccgatttcgcaagcaagccccggttcgggctgatggaggtcgtgtacgagtgggccagaggcatgagcttcaagaatatcacgaatctgacggacgtgctggagggcaccattgtcaggaccatttcgcgtctggatgagacgtgtagggaggtgaagaatgcggcgagaatcattggtgatccagagctgtatcagaagatggcgacgacacaggagttgatcaagagggatatcacggctgtggctagtttgtacatg

SEQ ID NO: 27330 - DNA, 1724 bp, Neurospora crassa
aagtcattgccttcccaccccactcacaagtcacgaaggttagtaagcttggactaatgcaaaagttgatgataccaggctattgcggagatcagaagagagattgagggcgaggacatcatttcaactgacccggatgacctccacgctcatggatattcggagtggtcatcatccaacccagagggattaccagttgcggtagcctacccccgatcaacagagcatgtgtcaacaatcgcacgaatatgtcacaagtaccgcgtacctatcattccgtactctggagggtccagtttggaaggaaacttttctgcgccttacgggggaatcagtgtcgattttgcctttatggacaagatcgtgcagttcaacaaggacgatatggacattgtcgtacagccgagcattggttggcaggatctgaatgagcagctggctaagatggcgagtggtctcttctttcccattgatccaggtatgtattgtgcccgcaaaagcatgaaggctggcgagtagtgttcaagacactaacgaataacacaggcccaagtgccaagattggtggtatgattggcaccaactgctccggtacgaatgccgtcaagtatggcaccatgaaagactgggtcatcaacctaactgtggtcctcgccgacggctccgtcatcaagacccgccggcgtccacgcaagtcctcagccggctacaatcttaacagtctctttgtgggctcggagggaactcttggtctcgttacagaagcgactttgaagctagccgtcgtccccgaggagctctccgtcgcagtcgtcaccttccccacgatccgcgacgcagcggcagcagccgccgaagtcatgcaacggggtattcctgtcgccgccatggagatcatggacgaggtgcagatgaaggtagttaacataggcggagctactgcgccgcgggtgtggaaggagatgccgacgctcttcttcaagtttgcggggacgaaagcaggcgtacaggagaacattgatttggtgcagagaatcaccaagacaaataaagggagcaactttgagtttgccaaggatgcgagagagcagaagttgttgtggtctgcgagaaaggagagtctgtggagcatgcttgctttgaggaaggagggcgaggaagtttgtaagttttcttttctcttcacttgtgcttgttcgatgaaatcctgacattgaggggaacaaacaaacatcaccgggcgtttgttcacacaaagacagcaatactaacattactggttttgctagggagcaccgacgttgcagtccctttcagccggctggccgacatcatcgaagttagcaagaaggagatggacgatctaggactgttcgctagcatcctgggccatattggtgatggaaacttccatgagagcatcatttacaaccggcagaagaaggaagaaagggacaaggtggaagtgtgcgtgaagaacatggtcaagagggcgctggagatggaggggacgtgtacgggtgagcactcgattggctggggtaagaaggagtcattattgtgggaggttgggccagatacacttggtgtcatggtaagtctttgaactccgggagagttggctaaggggctgggttgcgtgctaactaagtgtacagaaatcgattaagctggcattggatcccaagtggattatgaacccgggtaagatctttgatcgtcga

SEQ ID NO: 27331 - DNA, 876 bp, Neurospora crassa
acagcacaatttgtacacaatgaatggattgaaagctatgatccaaccattgaggactcgtataggacacaggtggctgtcgatgtaagtcttaacttttctattctattaattgaatgtttatgttccagacttgctaacgaggacctccagggacgacaagtgatactggaaatgtgagaccttcctcatttacacttcaccctcactgacacttcactttttgaccgggtaatgctaacatgtagctcatcagcctcgacacggccggtacagaacagttcggtgagtaacagaaccgccctgggtcaactaacaccctccaacttgaaacttgcctcgctaacactttgggcaaaagttgctatgcgagacctgtacatgaaggccggccaaggattcctgttagtcttcagtataacctcgcaagcctcgctagacgagctcgccacgcttcgggaagagatcatacgcatcaaagatgacgagaacatccccatcgtcatggtgggcaacaaggccgacctgctagaccaacgagccgtcgatcgcgcaaaggcctttaccatttctcagcagtggaatgcgccttattatgaggctagtgctaggacgaggagtatgttgttcatgtccctattcaaaaagagaaagattaggtactgacacttccaaaaagcaaacgttgacgaagtcttcatcgacctctgccgccaaatgctccgaagagacgatagcggccaactagatgacgacgatggcgcacgcaatggtagcgggtacggctacggccaagggaaacaggaggatggtcatgggcccatgaagaagaagcggaggagaaagaggaagggcgatcacaagtgcataatcatg

SEQ ID NO: 27332 - DNA, 674 bp, Neurospora crassa
cagacatgtcttctcatctcatacacaacaaatgccttccccggcgaatacattcccacagtgtgcgttcaacccattcgacactcttatctgcgataactaggccaccactaccccggaaactgacacgcgcgctgcgatagcttcgataattactcggcgagtgttatggtcgatggcaagcccgtgagcttgggtctctgggatactgctggacaggaggattacgacagactgcgcccgctttcgtacccccagaccgacgtcttcctcatctgcttttcgctcgtcagccctccgtcgttcgacaacgtcaagtccaaggtgagtaactctgcaatgagggggggaagaggggacgccacgcatatggacctacatgctgacttttccggcagtggcaccccgagatccagcatcacgcccccggcatccccatcatcttggtgggcaccaagctcgatttgcgcgaggaccccgataccattcagagcctgagccagaaacgcatggctccgataacgttcgagatgggtgtcaactgcgccaaggagatcggcgcgaggaagtacctcgagtgctctgcccttacccaaaggaatctcaagtctgttttcgacgaggccatcaggtaagtccatagcacacccggaccctcgcaatcagataagaaa

SEQ ID NO: 27333 - DNA, 1059 bp, Neurospora crassa
acaggcgacttcgctaccatggccaagtacaagccccaggatgccaccaccaacccctccctgattctcgccgcttccaagaagcccgagtacggcgctctcctcgacgccgccatcgccgatgccaagaagggccccggctcccccgaggagaaggtcgatgccgctctcgactacctccttgttcagttcggcaagaagattctcgagatcgtccccggcaaggtctccactgaggtcgatgccgctctctccttcgacaccaaggcttccgtcgacaaggctctccacatcatcaaggtgcgtgtttctgaatatgttgcctactgggctccctgatttagacttgcaatgactgactgaccttgccaccaacagctctacgaggccgagggtatctccaaggaccgcatcctgatcaagatcgcctccacctgggagggtatcaaggctgccgagatcctccagcgcgaccacggcatcaactgcaacctcaccctcatgttctcccttacccaggccatcgccgccgctgaggccggtgccttcctcatctcccccttcgtcggccgtatccttgactggttcaaggctcacaccggcaagaactactccaaggaggaggaccccggtgtggcttccgtcaagaccatcttcaactactacaagaagttcggctacaagaccattgtcatgggtgcctctttccgtaacattggcgagatcactgagctcgctggctgcgactacctgaccatctccgtatgtcttcatcttcatctcatgctgcaatactttgcagaaatatgtgctaacagaacatgaaaatagcccaacctcctcgaggagctcctcaactccgatgctcccgtcccccagaagctcaacgctgccgacgccgccagcctctcgatcgagaagaagacctacatcaacagcgagcctactttccgcttcgacttcaacgaggaccagatggcggtcgagaagctccgcgagggtatctccaagttcgctgctgatgccgtcaccctcaaggagatcatcaagcagaagctt

SEQ ID NO: 27334 - DNA, 1128 bp, Neurospora crassa
ctccgcgagcgcgtgcaagaattcgtccggcgttcccttcccgagaccctcgccgccgaaaccgacaaatccaatgccttcccgcctcacatgtggcaggccctcggcgacgccggtctgctcggcatcacggccgacgaagcctacggcggtctgtcgatgggttaccaagcgcactgcgtcgtcatggaggaactctcgcgcgcttcgggctcgattgccttgtcctatgccgcgcacagccaattgtgcgtgaaccagctgagtctgaacggcaacgccgagcaaaaggagaaatacctgccgggactgatttccggcgaaaaggtcggtgcgttggccatgagtgagagtggaagtggaagcgatgtggtcagcatgcggacgacggccaagaaggtcgagggcggcgggtataagctcaatggaagcaagatgtggatcaccaatggcccggatgcggacgtgattgtggtgtatgccaagacggagccggatgctggaagtaaagggatcacggcttttatcgttgagacgaagaaggacggcgtcaaggcagaggggttcgagtgcctgaggaagctggacaagatgggcatgcgtgggtcgaacaccggcgagctagtgtttgagaatgtatttgtgcccgaggagaatgtgctgggcaaggtcaatgggggcgtgagggtgttgatggagggactggatctggagaggctggtgctgagcgcgggaccgctgggtttgatgcaggcggcgctggatgttgccttgccgtatgctcactcgaggaagcagttcggcaccccgattgcccatttccagctgttgcagggcaagttggccgatatgtacaccaagttgcaggcgtcgagggcgtacacgtatgcgacggccaagacggttgatgagcaaggggttatcaagacacaagactgcgctggtgctattttgtatgcggcagagagggcgaccgaggtcgctctggatgccattcagatcttgggtggtatgggctacatggaggagatgccggtgtcgaggatcatgagggatgccaagttgtatgagattggcgcgggcacctcagaagttaggaggatggtcattggaagggttttcaacaag

SEQ ID NO: 27335 - DNA, 739 bp, Neurospora crassa
tacagccccaaaggttccttcaccgagtacgatggcctaaagacctatgtcaccggccccgacgatgccaccaagggcatcgtcgtcatctacgacatcttcggctacttcgaccagaccatccaaggcgccgacatcctggccaccagcgacgacaccaagtacaaggtgttcatgcccgactggttcaagggcgagccgtgccccattgagtggtaccctcccgacacggacgagaagaagaagaacctgggcgctttcttcagcaagaaccctccccatggcgtcgccgagaagctccctgcctttgtcaagaccctgagcgccaagcatcccaacatcaagtcctgggctatcattggtgtaagtgtggttgtccctaggtatacaagggaacctgtctgactaaagtttacaacagtactgctggggcggcaaggtcgtctccctaattaccaagtccgagaataaccccttctccattggcgccgagtgccacccggccatggtagaccccgaggaggccaaaggcatcaaggtgcccctcatcctgctcgcctctaaggaggagcccgaggacaaggtcaaggagtttgagcagaaccttagcgtgcccaagcacgtcgagaccttcaaggaccaggtccacggctggatggcggcgcgcggcgacttgaaggacgagcgcgtcaagagcgagtatgtcagggggtacaagactgttttggagttctttggc

SEQ ID NO: 27336 - DNA, 3598 bp, Neurospora crassa
aagttcggcaaacaaatacagaagcggcaacttgaggtccccgagtatgctgccagcttcgtaaactacaaagctctcaaaaaggtatgcatcccggttgctgttattgctgttgctgctcgcgtgtatcatcatgatgttaccaggcctggacttaggggcatcatatcagcattcttggtcctttgcgactttgaaaactacatcgttctatcacaacatacggttaactgcgacgcaaatgctgacactttcacatacagcttatcaagaagctatctgcgacccctattctacctccgcaaacggaccttcgacgtgcaccgggcgagcctctagatacccagtctgctcttcaggccaacaaggccacgtttttcttccaaatagtacgtaaggtatttctctcagtaccttgcattattaacaattgtctaggacagagagttggacaaggtcaacgcttgctatgtccagaaggaagccgagctaaagattcggctcaagacgcttcttgacaagaagaaggccctacgatcaagaagcggcgggacctcacgacggtccaccaagttcactacccttcaagagggtttccagcagtttgtcaacgacctgaacaaattgcaacagtttgtcgagatcaacggtacagctttctccaaaattcttaagaagtgggataagacagcaaagtccaagacaaaggagctatatctttcaagagtcgtcgagaaacgaccagcctttaacccaaccgtcatcagcgagctgtcagatcaagcgaccaccagtttacaagaactgggagcgtgggctgatggggacaacgtcagcttcgaaaccaggcccgatcacgaccatgtcgttagcacccaacatctccttgggactgacgagggcgatgccgatacgttactgcttgacaccgttctctcgggaaacatcgactctctcaaagatatgctggaccgtatgaaggccacagcagctccagatggctctgccgatgtctcgctagcggaacgggttacgcggacgttcctggcgtccatcaacgaaggctcgcttgaagcgctcaaggtccttctcgacactggacttgtcgacattcagtcctgggatgatatcaatgagcggaactgtctccaccaggcggccatatatggtaattcgtttgttctggagtacggtctgtccaagggagtcgacgcggagaggactgacgcgtatggacgtgtacctttacactatgccagcatgcatgggcgtctcgacatgattgacgccttgctcaatggtatgctcacactcatctagatgctgttttctggtgcacgactaacctcccggtctgtagcttcccccaagactatcaatcttattgaccacgacaacttcacgcccctggtccattccatcgtccgtaaccatcttgagtgtgtcggtaggttactcgagaggtctgcccggatagacccggtgtctgataccgaccatgtaccactaaaccttgcctgtcaacatggctcagtggcaatcgtcgagctgcttctcaagcatggtgccaagattcttgctgacgccgagggtctttaccctcaacatttggtcgcaagatcagggcagactccggagattctagtgctgcttaagcagtacggagccgatctcgatcagatcgataagctttacggctggacccctttggttcatgcagcaagtgagggtaatgtcccgtgcctgcaggctttgctcgagaccggcgcggatcccaacattctcgacgagaaggaccttcctgccatgtactatgcggcttgggaagggcatctcgagtgtatgaagcttctcacaccagccaaaaaggagaaggcggcaagcgagctcccacctatacacattggaggagccttgcctcccatggctagcagcaccgcgccaatgcccatgtccctcgacgcaattgatcccatccccgcgctcgagttaccgccccctatcattcccctacgccggtacggtcacaactttcttgacaccaaaaccgttgtgcagatcagctttgaggaagacagcgaacaacctctcctattcttccaggacggcaagtatccagccgctcgccttaccatctcatccaagtcatcggacctcatccccaagaatattattcttcccttccaagaagacactagggttgcgtcattccagatcgacaatcttgaatccttcactttggactttgaggtattcccgacgtatggcgccaaggtcattgcgaagactgttgctctaccaaatatcttccgtgcactgctcagcagctctggcaagtgctgcctgccgctatttgaccctcggctgcgcgccattggccagatcagcttccacgtccaaatcatcaaacccttcagcggaacgccgctcgagatcacggactttgagacgtactggaaggccacgagccagttcgacacaaacacaagcaccttcgtcaccggctccagtctgtcgggcgactttgtccagatctacgtccagcacaccaaggacggggttcctgtactctggcccagatggaccattaactgcggcggtatcgacgtccccgtgtccacgcttaccctcgcccagttccagaccgtcacggcagccgccagaaacagaatcaacctctctgagctgtccacttacactctcgaccaaatagccgacgtccatcgcatcctcgccaacatcgggataaccctccacgaggccctcttcttgcttcccaagggcatgcacgtcaacatccaagtcctgtacccgacggccgacgaaaaagctgaagccaagagcagcaccgcggcggacgacgtcaatgagttcgccgatgcgatcctcagcgtcgtcttcgaccatgcccgcgcgcagagggctgaaaggcccgatagcgtccggtcggtggtgtttagttcgtataatcctaccttgtgcacggcgctgaactggaagcaaccaaacttccctgtgttcttgtgcaatgatatgggaagagaggatcggaagcagcagcaacagggatcttgtagcaagggggatggcgatgaggatatgggcgggactacggctgctagtagacgggaggcggcagatgaaaggacactacagagtgacgggaggaggacgagctcgattaaggatgtggtgaggacggcgacgagcaataaccttatggggctgatttgttgttcaaggctgttggtaagttttctctctctgtctctctctttccccccccccccccccccgaccccaacactttcctcttaaagtgaatgttttcactgacggttgtgaatgactacaggacatggtgccagcactggttgacgctatcaagtctcatgggttggctctggtggtggacaaatcgggtgaacctgaggcggcgaatagcaaagacagtggtgataagcagttggggattagtggtgcgttgggaggattggctgggtcagatccctttcccaagttgcccaagggcgtggatgggttgctcaagagtaatggtgtgttgaggtttaatgagtatatcgatgtgtagttgcgg

SEQ ID NO: 27337 - DNA, 1603 bp, Neurospora crassa
tcggctcgtagtgtcgctgatatcatccgatcctgcctcggccccaaggccatgctcaagatgcttctcgatcccatgggcggtatcgtcctcaccaacgacggccatgctattctccgcgagatcgaagtgtcgcaccccgcagccaagagcatgatcgagctcagccggacacaagacgaagaagttggtgacggtaccacaacagtcatcattcttggtagggaaatctttggctacagctgcgccgcataccgttcactgacaggtggtattcacaaacagccggcgagatcctcgcgcaatccctcccccagctcgagcgcaacatccaccccgtcgtcatcatctcggccttcaagcgcgccctcaaggacgccctgcagatcatcgaagacatctcgctcccgatcgacatcaacgatgatcaggccatgtacaagctcatctcgtcctcgatcggcaccaagtacgtttcccgatggtcggaactcatgtgcgggctagcgctcaaggccgtgcgcaccgtgacgtgggagcagggtaatggcaagaaggaggtcgacatcaagaggtatgcgcgcgtggagaaggtgccgggcggcgagattgaggacagcagggtattggatggcgttatgctcaacaaggacatcacacaccccaagatgcgccgcaggatcgagaacccgcgcatcatcctgctcgactgcccgctcgagtacaagaagggcgagtcgcagaccaacattgagatcacaaaggaggaggactggaaccgcattctggagattgaggaggagcaggtcaagcagatgtgcgagcatatccttgcctttaaccccgaccttgttatcacagagaagggtgtctctggtgagttcgactccataaatgggaagcgcgtatcacgtcggtggcaggaaagctaacgatgatttcactcacagatctcgcacaacactatctcatgaaggccaacgttaccgcgctcagacgtgtgcgcaagaccgacaacaacagaattgccagggcgaccggcgctactatcgtcaaccgagtagaggatctccaggaatccgacgttggcactaactgcggcctgtttgaggtcgagaagattggcgacgagtacttcaccttcctcacaaagtgcaaggaccccaaggcctgcaccgtccttctccgcggtccctccaaggacgttctcaacgagatcgagcgcaacctgcaagatgccatgggcgtggcgcgcaacgtcatgttccaccccaggctatcgcccggtggtggtgcgaccgagatggccgtgtccgtcaggttaacacagctcgcgaagagcatcgagggtgtccaacaatggccgtacaaggccgtcgccgaggccctcgaggtcattccccgtacacttgtccagaacgccggcaagagccccgtccgtgtgctcaccgatctccgcgcgaagcatgccgagggcaagaattcgtggggtatcaacggcgatactggtgccattgtggatatgaaggattacggagtctgggagcccgaggccatcaaggtgcagagcatgaagactgctatcgaggtatgtttggacttt

SEQ ID NO: 27338 - DNA, 1393 bp, Neurospora crassa
tcggacggcgagtacgcctccgacgatgagctcaagaggcatggaaagaggacagcggacgggcgcagcaagcaaaccaaggcgtcatgggaagatgttaagcgctcctgggataccgtcttggaaacagcggacagcggcctctccatcgcagagattcgggaggccgagaagcggcgtcgccttctgcgcgacacgacacctcttcagcgtggaattatccgccatctgatgcttgtgctcgacatgagtttcgccatggccgacaaagatctgctaccaaaccgttaccgagtcgtcctaaataacgccattggcttcgtacgcgagtatttcgagcagaatcccatcagtcagctaggcatcgtgggaatgcgcgatggaattgctgtgcgaataagcgacctgagcgggaatccggccgagcacatcgaaaagttgatgcaatggagcgagcaacaagacccccaaggaaatccgagtttacagaatgcacttcaaatgtgccgaggtgctctatagtcagcgctacggcccaccccctccgtgacagaggtcattcgctaaccgcttcatgtttttgtacagtcaaacgccgtcacatgccacgcgcgaaatactgataatctacggtgccctcgtctcaatcgatccgggcgacatacacgacaccatcaacgacctcgtagccgaccgcatccgcgtctcggtcgttggcctcgccggccaagtcgccatctgcagcgagctttgcaagcggacgaacaaccacgacggcaactacagcgtcgccgtagacgaggtgcacctcaaggagctcttcttcgccgccaccactccgcccgtcacccgcacgcccgagcaaaacaccgccagcctgctcatgatgggctttcccagccgcacgcttgctccgaaagaccatgtcagcttctgcgcctgccacgcgaagcccacgcgcgaggggtacacctgtccgcgctgcggaatcaaagtgtgccggctgccgatcgactgtccgatctgcaagctgacgctcatccagagcacgcacttggcgaggtcgtaccatcatctgttcccgctcaaggtgtttgtggaggttccgtggtctcaggcgtataagtcgacggcgtgctactcgtgcctgacaccctttcctgctaggccaagggattcagtggcggcagcgccagctgtgttaggagggagagccggagctaaaggtagcgggaaacaacaggacggcgagcagaaaaatccaaaaccggaactcaagggtgtcagcgaaagcgggcggtatgcttgccaggtatgcggaaatcatttttgcatagactgtgatgtctttgcccacgagactattcataattgtcctgggtgtcagagcgat

SEQ ID NO: 27339 - DNA, 1155 bp, Neurospora crassa
aacttcaatggctatgaccacgtaacatggtgggtgggcaacgccaagcaggctgcctcctactacaacactgtcttcggctttaagactctcgcatatcgcggccttgagaccggcagccggtactttgcttcatacgtcgttggcaacgccgacgtccgctttgtcttcacctcccccattcgctcccagaagtgtcttcccgaggaggagcccatctcggatgcggaccgcaagctcctgcaggagtgccatgaacacctggagaagcacggcgacgccgtcaaggacgtagccttcgaagttgacaatgtggacggcgtcttccacaaggccgttgccgctggcgccgacgttgtccaggagcccaccacgctcaccgacaagatgcacggcagcgtccgcaccgccgtcatccgtacctacggcgacactacgcacaccctgatctcccgggcggactataacggtcccttcctgcccggtttccgtaccgctgccccctcctccgccacggtccagctccccagcgttcccctggcccgcatcgaccactgcgtcggcaaccaagactggaacgagatggtctccgcctgcgccttctacgagcagtgtctctccttccaccgcttctggtcggtagacgactcgcagatctgcaccgagttctcggctctgaactcaatcgtcatggcgtccgagaacaacctggtcaagatgcccatcaacgagcccgcgcccggcaagaagaagtcccagattgaggagtacgtcgtcttcaactcgggcgccggagtgcagcacattgccctgctgacgcccgacatcatctccaccgtcagcgccatgcgcgcccgcggcgtcgagttcattaacgtgccctccacctactatgacaccatccgccagcgcctcaagacggagaagcgtggatgggagctcaaggaggacctggacaccatccagaagctcaacatcttgatcgattacgacgaaggtggttacctgctgcagctgtttaccaagccgttgatggaccgcccgactgttttcatagaaattatccagagaaacaactttgagggcttcggcgcaggtaacttcaagagtctatttgaggcgattgagagagagcaggctgagcgcggcaacttg

SEQ ID NO: 27340 - DNA, 3107 bp, Neurospora crassa
ggtatccgcaactttgtcgtccagtatatcctccaatgttcgagttccgaagagcttctcaaggcccaccgtgtcctgctcaacaagcttaaccttgttctcgtctccgtcctcaagcaagagtggcctcataactggcctaccttcatcaacgagattatctctgcctctcgctcgagcctttcgatctgcgagaacaacatgatcattctgcgactcctctccgaagaggtcttcgactattccgcggagcagatgacgtcgacaaagacacggaacctcaagaccaccatgtgcgccgagttctcgcagattttccagctttgccaggaagttctcaactctgccaaccagcccagccttatcaaggccaccctcgaaaccctgttgcgcttctgcaactggatccctctcggttatatcttcgagacccctcttattgaaacccttcggacgcgtttcttggaggttcccgagttccgaaacattactctccagtgcttgaccgagattggtggtttgcaaatagggggtcctacgggccaacagcccaactatggcgaggccctcatcaagatgttcaccgaggtcctgacgaccatctccaacatcattcctctcagcatggacttgaaggcgacctacccggccagcaactctcgcgaccaggaattcatccagaacttggcgctgttcctttgcaatttctttggcatgcacctgcccgtaagtagctgagatttgtgagctcatgatcgtagtactaatatggtatctagctcatcgaaaacctgccgaaccgtgactttcttacacatggtcactattacctaatcagaatttcgcagattgaagaccgcgaaatcttcaagatctgcctcgactactggctcaagctcgtccaggagctctatgaggagatgcaggccttgcccctttccgatatgaaccctcttcttagcggtggtctgcagaccagcggcgccccgaaccccgctctgctcaacaactaccctctccgcaagcacaagtacaacgagattctttccaacctgcgtgttgtcatgatcgagaagatggtgcgccccgaagaagtcctcattgttgagaacgacgagggcgagattgtccgcgagtttgtcaaggaaaccgacactgtccagctttacaagaccatccgcgagtgtctcgtttatctcacccatttggatgtggtcgacaccgagcagattatgaccgacaagctcgcacgccaagtcgatggatccgaatggtcatggcacaactgcaacgttctctgctgggctattggttctatttctctcgccatgaacgaagagacggagaagaggttccttgttactgttatcaaggatcttcttggactgaccgaaatgaagcggggcaaagataacaaggccgtcgtcgccagtaacatcatgtacattgtcggacagtatccccgtttcctcaaggcgcactggaagttcctcaagacggtcgtcaacaagctgttcgagttcatgcacgagtctcacgagggtgtccaggacatggcctgcgatacttttattaagattgccaagtcttgcagacgccactttgttgcgctccagcctagcgagtctcagcctttcattgaggagatcatcagggaccttggcaagatcacttgcgacttgactcctcaacaggtacatactttctatgaggcttgcggctacatggtagctgctcaaggcaataggcaccagcaggaaaggctgctttctgagctcatgcagattcccaatatggcgtggcaggagattatcaggcaagctagcctcaaccctaacatcctccaggatgcggacaccatcaaggttattggcaacatcatgaagaccaacgtctcggcatgctcatctattggtacctatttcttccctcagatcggcaacctctatagcgacatgcttcagatgtatgccgccaccagtcagctgatttctgaggctgttgctcgcgagggtgagattgctaccaagatgcccaaggtccgcgggctccgaaccatcaagaaggaaattctcaagcttattgagacctatgtcgacaaggctgaggacctccaggccgtgcgggagcagatggtgcctcctctcttggactcggtgcttgttgactacaaccgtaacgttcctggtgctcgtgacgctgaagtcttgagggccatgaccgccatgatcactaagctctcggctttgatggaggaccaggtaccgatcatcatggagaatgtcttcgaatgcacgctggacatgatcaacaagaacttctccgaataccccgaacaccgtgtcgagttcttcaacctcctccgcgctatcaaccttcactgcttccctgcgcttttgaagcttgataaccgtcagttcaagtttgttattgattcgtgcatgtgggctagcaagcacgacaaccgcgacgttgagactgcgggccttaacatgtgcctggagctcgtcaacaacattgctgagaagactgacgttcagacctccaacgctttcttcaaccaattctttgtcagcattctgcaggatgtgttcttcgttctaaccgaccaggaccacaaggctggcttcaagacccagtccatgttgctcatgcgcatgttctactttgtccaccccgccgatggctcgccctcgaggattcagggccccatttaccagcccgatcaggcccagccaggcactagcaacaaggagttcctcaccatgttcgtgggtaatctgctgcagaccgcttttgccaacctcacgccgtaagttttcttccccaccttcggaccttgtaaggtaccgagctaaccaaaagtgcaaaacagtgcccagattacctcgtttgttgagggactcttcacccttaacacccagtacgacaagttccgcctcgcgttgcgtgacttccttatctcccttagagaattcgccggcgacaatgccgagctctacctcctggagaaggagcagcaagagacggcggccaaggcggccgatatcgagaggagatccaaggtcagcggcctgctgaaacccagcgagctcgaggacgatgag

SEQ ID NO: 27341 - DNA, 1387 bp, Neurospora crassa
ttcaaggactatttcaatcagccaacaagcgcgcaaataggcactatggttgcgattctggaaataggtgccctcatctcctcgctcctggtgggcagaattggtgatatcattggccgccgcaagactatcctgtacggatcgtgcatctttttcgtgggcggtgccttgcaaacgatggccactgatatggccatgatgatgactgggcgtattattgctggcttgggtgtcggcatgctctccactatcgttccggtctaccagtccgagatctcgcctcctcataacagaggaaagcttgcttgtattgagttctcgggtaacatcattggttacacaacctctgtctgggtagattacttctgtgggttccttgagggtaacatctcgtggcgtcttccgcttctcatgcaatgtatcatgggcgcgttgctcggactaggaagtctgattatagtggaatcacccaggtaagtacagcctttttttcagtgctcagcttccattgattgctaatcacgatgttagatggctcctggacaatgatcatgacgaggagggcatcgtcgtgattgccaacctgtacggcggtggtgacatccataatcctcgcgccagggatgagttcagagaaatcaagatgggcgtgttgcttgcgcgccaggagggcgaaagaacatacagtgagatgttcaagcgatacagccgtcgcgtcttcatcgctatgtcggctcaagccctggcgcagctcaacggcataaacgtcatctcgtactacgcacccctcgtgttcgagtctgcaggctgggtgggccacgacgccgtgttgatgactggcttcaacggcatcacttacttattgtcgacgattccgccatggtacatcgtcgaccgctggggtcgtcggcatatcctcttgacgggtgctgtggctatggtgctttccctgtccgctatttcgtacttcttgtaccttgatactcattggacaccgtctgcagttgtggttatggtcatgatttacaatgcggcattcggatactcatggggccccattccctggttgtacccgccggagatattgcccttgaagattcgatccaagggtgctagtctttcaacagcgacgaactgggcgttcaacttcttggttggagagatgacgcccattttacaagagttgattcactggaggctgtacttgattcatgccttcttctgcgctgttagttttgtaattggtgagtatctccttacagcgacccctcaaggtatccaactaacggagtttccagtatatttcctttatcccgaaacttgcggtgtccggcttgaggacatggacgccctctttggtgattccaccaacgcatttggcacgccc

SEQ ID NO: 27342 - DNA, 2597 bp, Neurospora crassa
accagctcgtcgtgaaactggagattgaggaggaagacaggcgagaggccatcatcgagaaggaaggcaagaacagcaaaaacctatcgagcaggcgagggctctcagtctcatccgtttacgactcaataaaacggtccaactcgagtcttgcgcgccaaaagaagaaactactggaggactccatcgagcgggtgctcgacctacgacgagaggaggccaaaaaggacgcggtcgaggattcggacgatgcaattgaggcggcggatgaggccgaagcggccaagaggaacaagtcggctgaggcgacggctacagggtttctgaacaagcagattgcgaaggcatggggtttggccgcgccgaagctgcctgcgacgacggcagtgagtggtgaaggtgtggcggtggtggaaaatggtggaggggaggcgggtgccgctggtgaagggggatcgggctcagttccacaaacccccggactcggagcggctgctgtagctccaggatcatctgagagacaggcgaatggagagcctagaggaaagaagagaaaggcggagaagatatcgaaggagaaagaggtcgaccggtcgccgcccacgggcatctccatcaaggacattgccggtgtggacgataccttggacaagcttctacacgaggtgtggttcccgctttgtgcgggtgaggcctgtgccaagatgggataccgttacgacaatggcgtgctcctccacggcccttcgggctgcggcaagaccacgcttgctcacgccgtggctggcagcgttggcgccgccttcattcctgtctctgcgccttccatcgtcggcggcacctcgggcgagtcagaaaagaatatccgtgatgtcttcgatgaagcgatccgtctcgccccgtgcctcatctttatcgacgaaatcgacgccattgctggcaagcgtgagagcgctaataagggcatggaaggccgtatcgtagcggaaatcatgaacggcatggaccgcatcaagcagcagacaccccttggcaagaatgttgtcgttctggccgccaccaaccgtccggactttttggatcccgccatccgtcgccgcttcagcgccgagatcgacatgggcatgcccaacgagcgcgcccgcgagcacattctcaagtccctctctcgcgacctcaacgtggccgacgacgtcaatttcgccgagcttgccaagctaacacccggctacgtcggttccgatctgcagtacgtcgtcaaagccgccgtgtccgaatccttccgtggaagtctcgacgccctgctcgaaaaggcgcgccaactgcgcgctgccgctgcagaagctgccactgccgctatcacctccgactcccccgagggccacgaagagcaacagaaacagattcaaaaggaactcgacgacaccctcaccggcatctcccaaaaacagcgcgactggctcctcctcgaggaccaccgccaagcctcgtggtccgacagctgcatcaccatggcccaattccgcctcgccgtctcccgcgtgcagccggcctccaagcgtgaaggcttcagcacgatacctgacaccacgtgggcgcatgtgggcgctcttgacgaagtccgcaagaagctcgagatgagcatcatcggccccatcaagcggcccgaacttttcaccaaggtgggcattaaaccggccgccggtattttgctctggggtcctccaggctgcggtaagacgctggtcgccaaggccgtagccaacgagtccaaagccaacttcatctccatcaagggtcccgagttgctgaacaagtatgtgggcgaatccgagagagcagtccgccagcttttcgcgcgcgccaagtcctcggccccctgcatcttgttcttcgacgagatggacgccctggtgcccaagcgcgacgactcgctctccgacgccagcgcccgcgtcgtcaacaccctgctcacggagcttgacggtgttggcgaccgcagcggtatctacgtcattggcgctacgaacaggccggacatcattgacgaggcgatcagaagaccgggcagattgggaacgagcatctacgtcggcttgcccagcgcggaggatcgggtggacattctccgaacactctacaggaactcgattgcgagggccaaggcttcccagacggctgctgctgctcctcctcgtcctacgcctactacgacacccgctgtggagggagacgtaatggatatcgatggcggctctggcgctgttctgccaggccaacaaacgccctcggccaccgccgccgctatggacgagaccatgcaggaggcggagaagcagctggagcgtgtcgcgctggatttgcgctgcaccggcttctcgggtgccgatctgggcaacttgatgcaggcggctgcccaggcttgtttggagagggcgtacctgagccagatgtaccagtctagtaaggagagtggtacgccaacggaggaggagaaggtgacggatatggtggctaacccggtcatcactccggaggactgggagaaggcgctgaacgaggtgaagcctagtgtgaaagatccggaaaaatatgtc

SEQ ID NO: 27343 - DNA, 1983 bp, Neurospora crassa
tcgcgcatcaagcaattcttccgcatcaattccggctccaaagaccacaaggaccgcgatgcccacaccacctccagctcccacggcggagcaccacgcgccgacgccaagacgccctccggcttccgtcaatcccgtttcttcagcgtcggccgccttcgcagcaccaccgtcgtgagcgagggcaatccgctcgacgaatccatgagtccgaccgcacacgcgaacccgtattttgcccaccagggccaaccgggcctgcgccatcacaatgacggctcggttccgcccagcccgcccgacacgccctcactcaaggtcgacggccccgaaggctcgcagcagcccacggcggccacaaaagaagagcttgcgaggaaactgaggagagtcgccagtgctcccaacgctcaaggcctgttttcaaagggtcagggcaacggcgaccgccctgccacggccgaactcagcaaggagccgctcgaggagagcaaggattccaacaccgtcggtttcgcagagcaaaagcccaacaacgattcctccacaagtctggctgcgcccgatgccgatggtctcggagcgctgcctcctcccatccgtcagtcgccgctcgccttccgccgaacatacagctccaactccatcaaggtccgcaacgttgaggtcggcccccagagtttcgacaagatcaagttgattggcaagggcgatgtcggcaaggtatatctagtcaaggagaagaagagcgggaggttatatgccatgaagggtacgtcttcgcgtctgttcggtacagtgtctcaccccttactaacaaagcaacacagttctgagcaagaaggaaatgatcaagcgtaacaagatcaagagagccttggccgagcaggaaatcctcgcgacaagcaaccatcccttcatcgtgaccctgtatcattccttccaatccgaggactacctttacctttgcatggaatactgcagcggtggcgagttcttcagagctctacagacacgtcccggcaagtgtatccccgaggacgatgctcgcttctacgccgcagaggtgactgctgcgcttgaatacctgcatcttatgggattcatctaccgggatctcaagccagagagtacgtttccacttttcccacctttcatcatgccgatcatttcgcataactaactgtcgatcatcacagatattctactgcatcagtctggacatatcatgctttcagatttcgatctgtccaagcagtccgacccgggcggcaagccaaccatgattattggcaagaacggcacgagtacgtcgtcgttgccgaccatcgataccaagtcatgcatagcaaacttccgcacaaactcctttgtgggcacagaagagtatatcgcaccggaagtgattaagggcagtgggcatactagtgcagtcgactggtggacgctcggaatccttatctacgaaatgctgtacggtactacccccttcaagggtaagaaccgtaacgcaacgttcgccaacatcctcagggaagatattcccttccctgaccatgccggcgcgccgcaaatatcaaagtgagtctctcatacttgtcaacgctttctactctgactacttgctaaccttgaatcatcagcctttgcaaatcactcattcgcaagttgcttatcaaggacgagaaccgtcgtctaggtgcccgtgctggtgcatccgacattaagactcatcccttcttcaggacgacacaatgggctctgatccgtcatatgaagccgcccattgtcccgaaccaaggtcgcggcattgatacactgaacttccgcaacgtcaaggaaagtgagagcgtggacatcagcgggtccaggcagatgggcctcaaaggggaaccacttgaaagcgggatggtaacaccaggcgagaatgccgttgatccattcgaagagttcaacagcgttacattacatcacgatggggat

SEQ ID NO: 27344 - DNA, 854 bp, Neurospora crassa
cccacggcttccaagctttcagacctcttcagcctcaagggtaaagtcgtcgtcatcaccggtgcttccggtcctcgaggcatgggcatcgaagccgcccgtggctgcgccgagatgggcgcctcagtagccatcacgtacgcctcgcgggccgatggcgctcaaaagaacgttgccgagctggagaaggagtacggaatcaaggccaaggcctacaagctgaacgtggccgactacgcggaatgcgagaagctggtcaaggacgtcattgcggatttcggccagattgatgcttttattgccaagtatgtagacgctctctttccttctctgtgtacccttttctttctctaggaacgcatgctaacgcaaaggaaaacagcgccggcgccacagccaagtcgggtgtcctcgacggctccaaggaggaatgggaccgcgtcatcgaaacggacctcaacggcaccgcctactgcgccaaggcggtcggcccgcacttcaaggagcgcggccgcggctcctttgtcatcacaagttccatttccggccacatcgccaactacccccaggagcagacgtcgtacaatgtcgccaaggccggctgcattcacatggcccggtcgctggccaacgagtggcgcgactttgcccgtgtcaacagcatctcgcccggttacattgacaccggcttgtcggactttgtcgaccagaagacgcaggatttgtggaagagcatgattccactgggcaggaacggcgatgcaaaggagttgaagggcgcctatgtttacttggttagcgatgccagcagctataccaccggtgcggatatcttgattgacggtggatacact

SEQ ID NO: 27345 - DNA, 1876 bp, Neurospora crassa
ctcctcgccctcttacttctctttagcatcgcttactttcttcactcctcctcctcctcctcctcctctcctccatcagcagcacatgctgtctcagagttcgcctggctacaacaccacatgaactcccctttcccctctcaaaggagaaacttagtctccaacacctctttcgactggagctccatcccctacaaatatcccccgccctttcccctccgggtcttacccctaccctctggctttcccatttctttaccacccatccaacaccattttggaccagaatcccgaacagcgcgccatatccgcgaatcccgacgacagcaagtcaagcaagtgttcatcaagaactggaaatcttaccgcgaacgagcatggaaaaaggacgctttgctgcccatttccgggggatataaagatcaattctccggatgggccgctacgctagttgacgcactggatacgctctggatcatggggttacggagtgaattcgacgaggcagtcgcagccgtagccgagatcgattttggagttgtgcaagaaggaagtggaaacagagtgaatacctttgagactaacattcggtacttgggcggacttttaggggcgtatgaccttagtcacagggatatactattgatcaaggcgcgcgaggtgggcgatttactgtttgcggggttcaacactgcaaagagaatgccagtggatttcatagattttgagcgggccaaggagggaaaagaaggggttggaagtggaagagacagtagtgagcgctagtccgggaacactcacgctggaaatgacgaggctggcgcaggtgatgggggacatgcagtattacgatgcggcggcgagggtgatggatgtttttgagcgggggcagaatcgcaccaaaatcccggggttgtggcctgtctatgtgtcgatggcgaggcaggacgtagtgccgacgagcgggaatcagtttggcgtggcggggggtgcggattcgttgtatgagtatttgcccaagatgtatgcgcttacgggggggttggagacgcggtacgaagacatgtcgagggcgttcttggagcggcggatcagaagttgctttttaggccgatggtgccggggaatgaggacgtcttgatgattgggacggcggatgtcatgattaataagaatgggaaggaggaggtggtgctgaatccggagagcgagcatttggggtgttttgtgggaggggtttatggacttggtgggaggttgtttgggaggccggagtgggtggagaaccagggcatcaagatcacaaaggggtgtgtgtacgcttacagggcgatgccgacggggatgatgcccgagaggtataacatggtgccttgtccgtcacgcgatgatgtgagttgttggtggaacgaggacgtgtggaagagggagaagaagaagaggcttgagtggaagcaacatctaccaaaggggttcacgacggcgaaggatccgaggtatatcctgcgaccagaggctattgagagcgtgtttgtcatgtggaggattacaggcagacaggagttccaggaggcggcgtgggatatgtttacggctgtgagcaatgcgacggaaaccgagtttgcgaatgcggccgtgttggatgtgaccaaggccgagtatcctctgccaaaggaggattacatggaggtgagggttctaaccttgacccgatatgacgccgtattcaagcgatgcaatagctgacagtggttcgcagagcttttggttggccgagacactcaagtatttctacttggtcttttcgccgccagatgttatcagtctcgatgatttcgtcttgaacaccgaggcgcatccgtttcgaaggccaaag

SEQ ID NO: 27346 - DNA, 1539 bp, Neurospora crassa
tatgtcgggttggatccgcctgagggggccaagttgttggggattcagtacccgcgtgctgccgtcttgggcgggtgcgcgatgcataacgcgggcgtggcgagcttgccggaagatgatgattggaatcggattgtgaatctgacgggggatgccagctgggaggccgggaagatgagagagtatctgaagaagattgagaggaatgagtatgcggatgctgatgatccttcgcatggacatgatggtgagttttctttgtgacagtctttcgtataatgagatgggaactgacaacggacgacggtaggctggctggcaatctctaactctgatccctcctgggccaaaaacgacagcagtccagccgtcaaaatcatgaagcggctcgccgagctcatcggccaagacccttcgcgagtagccgacttcgccaacaccgacatcctcggcgacttccccaaccgcgacaccatgtcctccttcttcaacctggccacccacgccgacaagaccggcaagcgcttcagtcccaacaactacatccgcgccaccgtcgccgaccccgccaagtaccctctaaccgtgaaactcaacaccctcgccaccaaagtcctcttcaacaccaccggacccaagccccgcgccatcggcgtcgaagcaatgtccgggccctccctctaccgcgccgaccccaagcacattcccggcaccaccgcgcccaaaactcaatactttgccagacgcgaagtaattctctccggcggcgtcttcaacaccccccaactgctcaaactctccggcatcggcccggccaccgagctttccaaattcggcatccccgtgctcgtcgaccttcccggtgtaggcgagcgcttaaccgataactacgaaggttcccttttggggctaggcaaagtccccatcgcaagcggtctcatcaccatcttgttccgaacccccaacgcgcccactcccaaacgaaacatctttgcctggtgcggtgcgttttcctttgaaggattctggccggggttccccacctactacggccccaatcaatattcttgtgcaatggtgcatatcaaaccccgctcgcaagacgggagcgttcggttactgtctgccgatccgcaggataaaccggagattaactttcggttctttgaacatggtggggatgaagatctagccgaacttgtgagtgcggcgaatatgctgagggaaagttggcaggcggcgggggaaccggtcttgccttttgaggaactgcatccttgtccgtcgtcggctgaaaagaagagtaatggaacgacgtgttcggatgggaaacaggccgagtatttcaagacgcaagcgtattcgcatcatgcgacgtcgagttgccagattggtgctgagggggataaaatggcggtgttggatagtaagttccgcgtgaggggggcggagggattgagggttgtggatgcgagtgcgtttccgaatgtgccggggttcttcccgagtgtgccgaccatgatgattagtgtgaaggcg

SEQ ID NO: 27347 - DNA, 3487 bp, Neurospora crassa
cagcccaaacgcgagggcttccacctaaacgtgaatgacgccctaaccccggatcccggcaaggaaggactgttcaaagttgagaataaccccttcgccttcacgccaggccatcttgcaaaactacttaaccccaaaagcctcgatgctttttacgccctcggcggcctggagggcctggagaaagggctccacacaaatcgcaacaccggtctcagcgccgacgagaagcacgtcgatggtcccatcgccttcaaggatgtcgcccccccaggaacgccgcagtacggccagcatggcgacaatgagccatttgcgtcaggcaagcacgatgcatctgtcccggagccgcttcctctcgatcacaaggcagggagtaattacgccgaccgccggcgcgtctacagagaaaaccgattacccgagaagaagagcaagacactcctgcaactagcttggaccacgtacaacgacaaggtgctgatcctgcttaccattgctgctgtcgtctccctggcgcttggcctatatcagacttttggcggcaaacacgaaccaggagaagcaaaagtggaatgggtcgagggcgtggctatcatggtggctatcatcattgtcgtgctagtgggcacgatcaacgactggcagatggaaaggcagttcaaccagctcaacaagaaacacaacgaccgtaccgtcaaggtgatccgctccggaaagtctgttgaaatttcggttttcgacgtcatggtgggcgacgtaatgcatctgttcgcgggggaccttattcccgttgacggcatctttatcagtggccatggtgtcaaatgcgacgaatcctccgccacaggtgaatccgacttgctcaagaagacgcccgccgacgaagtgtttgctgccctgaaagacatcgccgatggaaagcctcccagagaggacatccacaagcttgacccgttcatcatttctggcagcaaagtaaacgagggaaccggcacgttcctcgtgacagccgtaggcgtttactcgagctacggccaaatctccatggccatgcaaaccgagcaggaagataccccgctgcagcagaagctaaatgtgctcgccgactggatcgccaaatttggtggtggcgcagcgctgattctcttcatcgtgttgtttatcaagttctgtgtccagttaccgcacaaccacgattcgccagaccaaaaaggacagacctttctgcgcctcttcatcacctctgtcacggtcgttgttgttgcagtcccagaaggccttcccttggctgttacgctagccctcgcgtttgcaaccactcggatgatgaaggacaacaatcttgtccgcgtactcaaggcctgtgagaccatgggtaacgcgacaaccgtgtgttccgacaagacgggaaccctgactcaaaacaagatgaccgtggttgctaccactcttggcaaaagtctcagctttggtggcacggataaaccgctggaggaacccgactcggacaaagagaagatcaataatggcgcaaacggatcggaggcgccaaatactgtgcccaatgtgcctgtggcaaatttcatcagggaactcagcaagactaccaagaagattctcaaccaagccaatgctgtcaactcgaccgcgtttgagggtgatgaggatggcgagaagacattcattgggtccaagacggaagtcgctttgctcactttctgccgtgatcatctcggcgctgcaccggtagaggaggagcgcaagaatgctgatgttgtccaggtcgttcctttcgattcaaagtacaagttgatggctaccgtcgttaggcttcccaatggcaagtatcgcgcatacgtcaagggtgcttccgagcttctcctcgagagatgtaacacggtcatcgccaacccgagcgaggatgagttgcgtactgccgagcttaccgatgcggatcgcaagatgttcttgcacacgatctcctcatatgctggccaaacccttcgtacgattggttcctcttaccgcgatttcgataactggccgcctccggagcttagtggccacggagaattgacggccgacgaatttgcaaaagtccaccatgacatgacgctcgtagccatttttggcatcaaagatccccttcgcccgcaggtcattgacgccatccaggattgcagacgcgccggcgtgtacgtccgtatggtcaccggcgacaatctcttgactggcaaggcaattgcgaaggaatgcggtatttacaaacccgaagagggcggaatggccatggagggtcctgctttccgaaggctgtccgaagataagctcaaggaagtcgtaccgcacttgcaggttctcgctcgctcgagccctgaagacaagagaatcctcgttcgtactctcaaggaactgggtgagacggtggcggttacgggcgatggaacaaatgacgcgccagctctcaagatggcggatatcggctttgccatgggtattgctgggacggaagttgcaaaagaggctgcatctattattttgatggacgacaactttgcgtctattgtcaagggtattagctggggtcgtgcggtaaatgatgctgtgaagaaattcttgcaggtaagcgatgtgctctgtgtccggagtgaggtagtagctaacaagaggcgtacagttccaacttacggtcaatatcacggccgtagccttgaccttcatctccgccgtttccaacgacgaagaacagtccgtcttaaacgcagttcaacttctctgggttaatctgatcatggacaccttcgcggcccttgctttggcaaccgatcctccgtcacacaccgttctcgaccgcaagccagatcgcaaatctgcgccattaatcacgatcagaatgtggaagacaattatcggacaggccattgcccagctggccatcactctctgcctctactttggcggccgctctctgctcggctacaacatgtctgaccccacggaatccaaacgtcacagcaccttcgtcttcaacacctttgtctggctccagatcttcaacgaactcaacaaccgccgtctcgacaacaagctcaatatctttgagggtatcacgcgcaactatttcttctgggccatcaacgccatcatgattggcggccaagttctcatcatcttcgtcggcggggaagccttcaagattactcgtctgaacggcaaggaatggggcatgtctatcggactcggcgccatctccatcccctggggtgctttgatccgcaaattccccgaccgctgggctgaagccatgatgccgcacgtgcatattcccatccccaagatcttgaagcgcaagaagaaggagggagaggatcaggagaagcagccagtggacaggccgcccctgccgccgggcagggtgcataccggtttgagaggacagagggcgagagtgcatagttcaaggttggggaggagttggtcttag

SEQ ID NO: 27348 - DNA, 2019 bp, Neurospora crassa
aacggtggtctctcgcacaacctcctggctgctcgcgaggccgctgccaaccagttcccaaccagcgccggtgctcagtatgctttctaccaggctcttctcaaggcgaacatgcctgctatcattatcgaaaggtatcagtctggacgtttcgccacgaacgagcaggtagaccagatctaccagcaagcccttgccatgtctaccggtcaaccctacacgcctgcgaacaacaccgtcgataacaatggctatcacccctccggtttcaccgctagccagatccatgccgctggtactgccgctgctgctcagcatactggtggaaacatggccatggtcaagccgatcgctgctggtgccaagacgggtcctctgcatatcgtagttgacgaaagtttcggaagctccgctctcagatgggtcaagtttctcatgtggttcactctcttcacgtatctcagcatggtcgtcatcacaatggttttcgagggcttgagcagcatcaagcgccccggtggcaagcttgaggccagcgaggtcaagcctgagaaccagaaggctcgctttgctgatgtccacggctgtgatgaggccaaggaagagcttcaggaacttatcgactttttgcgcaaccctgagaagtactcgactcttggcggcaagctccccaagggcgtgttgctcgtgggaccccccggtactggtaaaactcttttggctcgtgctgtcgccggcgaagctggcgttcccttcttcaacatgtccggttccgagtttgaagaggtctacgttggcgttggcgcaaagcgtgttcgtgatctctttgccgccgccaaggccaaggctccctcaattgttttcatcgacgaacttgatgctattggtggccggcgtaactccagggacgctacctacgtacgtcagactctcaaccagcttcttaccgagttggacggtttcgagcaaaacagtggtgtaatcatcatcggcgccaccaacttccccgagtcccttgacaaggcgcttacccgccccggccgcttcgatcgcaatgttgttgtctctcttcccgatgtccgcggccgtatggccattctccagcaccacgccaagcgcatcaaggctgctgccgatgtcaacctggaggctattgcttccagaacttctggtctttctggtgccgagctggagaacattgtcaaccaggctgctattcacgccagcaagttgaaggctcaggctgttactcaaaaggatttcgaatgggcaaaggacaaggtcatcatgggtgctgagaagcgtagtatggttatcacagccaaggaaaaggagatgactgcctatcatgaggctggtcacgccctcgtcggatattacgccaaggacagcgcaagctcgctttacaaggtcaccattcttccacgtggccagactcttggccacactgcctacctccctgagatggacaagcactcgtttactgtcagggattacttgggtatgattgaccgtgccatgggcggcaaggtcgctgaggagattgtctatggtaacgagcttgtgactagcggtgttagcgctgtacgttctcccctccccttgttccacttgattagacgagttaactaacatggcattcaggatcttgacatggccaccagaaccgcctggcagatggttgctcagctcggcatgtctgagaagctcggccccgttgagtacctccgcaagtacaaccagctcagctccgagaccagggcgatggttgagtccgaggtgaagagagttctggacgaatcgtacgagcgtgcgcgtaacctgctcacctccaagaggaacgaactcgactacttggccaaggcgctcgtcgagtacgagacactggacaagaaggaagttgagagggtgattcggggagagaagttgaaggatcgcatctcggtgccgccagggcctatggctattcccaagcccagcgacaccctggagccgggcctgcccctaccacccctacct

SEQ ID NO: 27349 - DNA, 1517 bp, Neurospora crassa
ccttcaaacaaaatggaagaacttgaatttcacaacataatcaacgacaccctccgctcatcccccaccacccacaccgtcaccgacccacgcaccgaatcccccctctggccgtgtcccattgcctctcccgccgacttcgaagatgctgtcgcctctgcccaaaccgccttcaaaacatggatgctcacccccctctccgagcgccaagcactcctcacaaagctcgccaccaacctcgaagaccacctcccgcttctctcccagatcctcgctcgcgaatccggcaagtccctgctcctctcggagctcgacgtccgcacttccatcgcccaatgccttcactacgcccaacccgccaacgctttatccgaccacatccaatatgaggatgaaaccgtcaagatcatcgccacgcacgttcccctcggcgtcgtagccgccatctgtccctggaattttcccctgatcctgtccaacatcaaagtcgtttcgtcgctggtcacggggaactgcgtcatcgtcaaaccctcgcccttcacgccctacgccgtcatgaaatggatcgagctggctcgcggcatcttgccacctggtgtcctgcaagttctcaacggcggtgcggatctaggtcagatgatgacgctgcatccgggcatcgcaaaagtaagcttcacgggcactattgccgtaggtaaagcagtcatggcggcctgcgccaagacgctcaaaaaggtcacgctggagttggcagggaataatgcttgtattgtttgtgcggatgccgacttgccaaaagcggtgaagaatgtggctagtggtgcgttctttaatgctgggcaggtgtgtgtggctaccaagagggtgtatgtgcatgagagtgtgtatgaggagtttgtgaggcggttggtggaggaggtcaaggggacttataccgtggtggaggatgcgagtgttcctagtgtgtttgggccagtgagtaataaggtccaatttgagacggtcaagaggatcgtcgaggattgtagagggaaggggtatgagatcgtggccggaggcgaggtgagggagagtgggaatgcggaggggaataaagggttctggttggagccgacgattgttaaggggccgccagacgattcggtgttggttaaggaggaacagtttggtaagtctcatcttttttcttgtcgggtttgatgtgtagtggtttaaacactgactagttatgcgctcttgcaggacccatcctccctgtgatgagctggtccgacgaagacgatgttatcagccgctccaacttagccaatgctgggcttggtgcttccgtttactcctctgacctggctcaagcggaacggattgctcgtcgtctggaagccgggggtgtctggatcaacaaatctgaaaggccacacatgggcgcctacttctccggcttcaaagacagtggttttggcggtgaaatgggcaagcaaggtcttctgtcttactcgtatacccagagcattcatttt

SEQ ID NO: 27350 - DNA, 481 bp, Neurospora crassa
gacggaaagctcgtcactatcgagctctgggacttcccaggtaacattgccaatgagcggaccacccagctagcatccaactttttccaagctgccatcatctgctacagcgtcgaggacgtcaagaatattccgtccatttgcgatacggtatgtttgcaccatggttttcgggatgaaaccgcttaggtgactaacccaatgtcttctccagtggaaacccaaactcgaccgctccctcatcgattgccctcgctttctccttggcctcaagaaagatctccgccctgcctttccgcctctcggcctcagctttctgcctcgaaaggagcctgtcatggccgacatgggtcgcagcgcagcctaccactcccgtgttgccggctatggcgagtgctcggcaaagacgggtgagaacgtcgacgacgcattccgcggcattgtcaactttaccctgagccacatgagaaagaaggagata

SEQ ID NO: 27351 - DNA, 2238 bp, Neurospora crassa
ctcgccgagctgcttcggcaccccgatgatctcgacaagatcaccaccctgaaggccgagttcatgcggaaaaaggcagctgttgactcccaactacgcagtggcctgcgggagcagctcgagacgacacaagccggcatgaacggcctggctgacgggcaaaggacggtgcagcaaatcaaggaggagatgatgaaaatcgacaagatttgttccgagtcgcaagacatgatcaccgactttgctaccatcaacctggtgtcccaagcccaccgcaactttggcgccgtcgagactatgcgccgcaacctcgagactttcagcgagcgcctggacgctatcgacaggatgttaaacgaggacgacgaggaccccgaaaacatgcccaacctactggctattcattacgagttgacgcagctccgtaatatccgagacgatgccatcgagcaaatacagaggggtgacgatccaggcctgcagtctacattagaggattacttctcccgcctggataaatacattgagtggtttgatgtgaatatcaccctcgtcgccatgagtttgatcaacctggttattgccgacaacaacagtctggtcgtacgtttcgcactgataatagaagctgaggaaaagagcgatcagagggttttggccttgcaagaagcgctgaaggatcacaaggaaatggccacacgcttccagagcataaccgacggcgccaagacggtcaggggctataaggacaagtttttgaaggctatcaagacctttgccgaggaccagttcaaagagagcaaggagaagttcttgggtgatccggacatgctcgacaagtccttgaaatggtacttcaacgacttgaacgccgtcaagatcggcatgacgccgcttatgcccaagaagtggaagatattcaagacatgggctactatctaccacggcttgatgcatgactatctcatcgggctcattgacgacccggagaccagctcggcacatactttagccattatcagctggcctgaggcttactatcgcaagatgaccaagttgggaatgaagcaggacgaactaacaccacatgtgatcgacaaccgcgaggcagaactggtgcgcgacttccgcgccctcatcatcaagttcctcgacgaatggattgaccgtatctacaagcaagagtgcaaggactttgtcgaccgcaacgtcgagggtggcaacctcgaccaggacgagtatggatacttccgcaccaagaacctggtcgatctgtggcgcatgctccgcgaacaggtcgatgccgcgggcaactcaaagcgtgccgatgttgtggaaggtgtcatcgacaccatgttccagcgcttacgcacccgccagcagtcctggcagaagatgctcgaggacgaagccgcgcggtacgaggtgcaacccccacaaggccaaccagagctggacggcttccagccactgcaggactggctcgtggcgacagccaacgaccaaatcgcctgcatcgatgacaacgaggacgaaggccggatggcgtacctctccgacttccggcgcaaattcagcacgctcgtgtcgccgcagtacatggaccgggccgagacggagatcacggctctgcgcgacggctacgtcgacctgagcacgtggtgcatgaccaaatttgcccaactggtgttcgcagttgacttccgcaccgtcatgcccgacttcttcaccccccgctggtacacgaccaacgccatggcgcgcatgatcgccaccttcgaggagtacgtgtccgactacaagatggtgctgcaccactcgctcgtcgacatcttcatcgagatctttgccgaggagctgctcattcgctacctgtcatcggtacgcaacaagggcgccaagttccgcaggcaagataacttccaagacaagatctttgacgacctgtcgactgcctttgacttcttcaacaacttgccgaaccccgatgtgggcgatgccatcaaagagacgtggcgcgtgtcggagccgttcttacagttgttgacggtcgataaagaggcggtgccggacgcgtttgcagagttcaagagccagtattgggatttgcagatcagctgggtcgaggcagtgttaaggtccagagacgattttgagagaagtatgttgaatgctgtcaaggctagggccgcccaaatggacgttgtcagagggccggaaactatcatgagcaaggtc

SEQ ID NO: 27352 - DNA, 1483 bp, Neurospora crassa
atggctcccatttccagagaaaccgacttccttgtcattggtggtggcagtggtggcatcgcgactgcccgcgctgctgctggcaagtatggcatcaagtccatggtagtcgagggcaagcgtttgggaggtacatgcgtcaacgttgggtaagtcgcattccaattctgtctttgcgtctgtcttgctcgaaaggtcaagctctaacttcctctcttcctcttgtagctgcgtgcccaaaaaggtcaccttctacgccgctcttgttgccgaaaccattcaccaggccaaggactacggcttcagcgtcgagcaaactgctcccttcgactggcctaccttcaagcaaaagcgcgacgcttatgtcgcccgtctcaacggcatctatgagcgcaacctcgccaacgacaaggtcgagtatgtgcacggctgggccaagctcctgtcccccaactcggttgaggttactcttgatgacggtaccaagtcggtcgtcaacgccaagaagatcctgatcgccgtgggcggcaacccgaccatccctccccatatccccggctcagaatacggcaccaacagcgacggcttcttcgacatcgacaccctccccaagaaggttgcccttgttggcgccggttatatcgctgtcgagtttgctggcatgttgaacgcccttggcgtggagactcatctcttcatccgccacgataccttccttcgtagcttcgatcctatgatccagcaggtgtcggttaaggagtatgagcgcatcggggtcaaggtccacaagaagagccaactcaccagtgtccagaaggatgcggcgggcaagctggccatcaacttcaaagagggtgagggcgagcagtctatttccgacgttgaccatctcatctgggctgttggtcgcacgccggcggtcgagggtctcggcttggacaaggcgggtgtcaagaccaacgaaaagggctacattgaggtggacgagtaccagaacaccagcaccgagaacatctacgccgttggtgatgtgtgcggtcaggttgagttgacccccgtcgccattgctgccggtcgcaagctggccgcccgtctgtttggccccgaggagttcaggacactcaagctgaactatgataatgtgccatccgttgtgttcgcccatcctgaaatcggttccattggccttaccgagcccgaggcggttgccaagtacggcgccgagaacctcaaaatctacaagtctagcttcactgccatgtactacgccatgatgaagcctgaggataaggcaccgaccgcctacaagctcatttgcgccggccccgaggagaaggttgttggtctgcacattatcggccttggcagcggcgagatcctccagggcttcggtgtggccgtcaacatgggcgcgaccaaagccgacttcgacaactgcgtggctattcaccccaccagcgctgaggagttggtgaccctcaag

SEQ ID NO: 27353 - DNA, 759 bp, Neurospora crassa
aagacatcagtcaccagccgccttaacctgcccggccgaattggctggctcaccatggaagcacctggcttcatgaccctggtgtacatgatgcgcaccctccccgcccaacatggcttcaccctcagcgacctgccctggcaaaacaaggtgctcgccggcctctttgtatttcactattcctatcgcgccctcgcctttccttttctgcagcccagcatggcgcccatacacatcgccatctggctctctgcgcttagcttccagattatcaacggaacgttgatcggtgcttggctcgccgcctacggtcccacgagtcacgcggcgtgggacaggcagctctttagctcgttccccacgctgcagtttacttgcggaattgcgctgttttacgtcggtctgatggcgaacttttaccacgatgacgagctgcgggagatcagacgccgggaaaaccgcaggcaggaaaggctggcgaagcagaatgggcaaaaggggcagccggggaagaaggtagggaagcactacgagatccccaaggcgggactgttcaaggtgatgctttacccgcactacttttgcgaatgggttgagtggcttgggttttacatggcggcaggctggggatgtctgccggcgaggtgttttttgctgaatgaggtggcggccatgttgccgagggcggtgaaagggaagcagtggtatatggagaagtttggggaggagaagattagcaagaagtgggcggttattccg

SEQ ID NO: 27354 - DNA, 839 bp, Neurospora crassa
ggtattggccgagcatctgctcaccagtttgcccagaacggggcaaaggcagtctacatctgcgactacgatgattccaatctcgaagagcacaagcgcgagatcgaaacactatattccagcgcgaatgtacacacgcgacagtttgatgccgccgatgaaaaagccatcagcgaggttgtcaaggatgctctggaccggtacggacggctcgatgtcttctttgccaatgccggaattcttggccctcataccaagttctccgacgttgaagctgatgagtttatggagacgatgcgggtcaacgcgctcgggtaggacgcctggttttctttccgtccgaactgccctttcttgtctggttgatctcgtagagcatcgctaaccatgcgtaccatcaaagcccctttcttgccgccaaatacgcggcgccggccatgcaaaaaacatcagcggagaagcaaaagtcctccggcagcattatcatgacagcttcggtagccggtttgcggtccaacgccggtgggacaccatactctgcttcaaaggcagccgtcgtcagcatggcacaaaccattgcctaccaactggtcgggaccaacatccgggtcaacgctctctgccccggcctgatcgagacggctatgacggcgcccgtattcgacagcgcacgagctcggggtaccgaaggtaagattggacagctcaaccctctcaggaggggtggacacgctgacgagattgcgcgtgtggccttgttcctgggaagtgatgagagtagctatgtcaacgcgcaagcatgggcggtggatggtggtctaagttctggccatccttat

SEQ ID NO: 27355 - DNA, 3213 bp, Neurospora crassa
atgcttgccggttacaactgcaccatatttgcttacggccaaacaggcacaggcaagacatataccatgtcaggcgacatgaatcagacttttggcatgcttcccgacaccgcaggcatcatccccagagtcctgcatgctctctttaataagcttgaagtggatgacaaggaacactgcgtgcgatgctcgtttatcgaactttataatgaagagctgcgtgatctgctttcggcagaggacaacacaaagctcaaaatatttgacgacaactcgaaaaagggccatgccacgactattgtgcaaggtatggaggaaagacacattttgagcgcggcagacggcctcagatggcttcaagagggcagtgtgaggcgtcaggtggccgcgacaaagtgcaacgacctcagcagtcgtagtcacaccgtcttcaccattaccgttcatgtcaagcaacaaaccgagaatggggaggattatctaatgggaggaaagctgaatttggttgatctcgctggcagtgagaacattcagcgctctggagccgagaacaaacgtgctgctgaggctggcctcatcaacaagagtctgcttacccttggtcgcgtcatcaacgccttggtcgaccgcagcccccatattccttacagagaatcgaaacttacacgtctactccaagactctttaggtgggcggacaaagacgtgcatcattgcgacaatatccccggccaggagtaacatggaggagacgatatccacccttgattatgcttttagggctaaaaacattcgaaacaaaccgcagatcaacgcgctactcaacaaaaaaacattacttcgcgagtttgcgaccgagatcgagaaactgaaaagcgagctgattgccactcgtcagcgaaacggtgtctatctatcgaacgatgcttacgaagagctgactgtacaaaacgaatcgcggcggatccttacggaagaacaagcggccagaatcgagaccctcgaaacaaaccttcgaaacaagctccaagagctgtatacgatgacatcaacattcatggggcttcgaaaagagcacgaagccacaaaagcacagctagacgagaccaaagatgtgttggaccaaaccgagctggtgctggcagctaccaggaagtcgttggcggaggaggcgcacctccgaagggcgcatcaaacaaccgagcagaagcttgccaaagtgggtgatgagcttatctctaccgtcaagcggaccgtccaagatgtcgaagggctccacgcgaagaacagaagaagatccgacctacatgcgctcaatcgtagcacgtgggccatgtcgcaatcgcaagtcacaggtattactgagcttgttgaaagtcggattgcggagttccgcaaggggcaggaggagcatatctccagcgtatcagagcgaatgcaaagttttgttcaggaggagctcgacaagctgtccacaacccaagccttcctcgatcaaaacttggagcatttcgcagagtctaggacacagctgttggagcagaagcaaaagtccaaggaggagatggacaacgtgctggaagagatcaaggttgttcgggacaccgtgaaacagcgcgttggagaatcgctccaggctattgcctcggcggctgagcggattgcaggtgatgtcctgggcgaactaactactttccacagtcagttacatgcttcgtatagttcgcttgggaaggaatgtaaatccatcttcggggatctgctgcaaacaattagcgcccagaaagccgaagctgaaagacttcggcaagagctcgagggtgctagtcagaccattgttgaatccaacgcaactgtgtcagcccggattcaggaggttttggaggaggagcgaagacaagcggccgaggaaaggcaaaaccttttgctacagatcggctccctcatcaattcgcaagcggagatgcaagagtctcgcctcgccgggaagacagcacttattcgacaagcggttatggattcgaacgcaacgtttgagggcagtatgtccgaatatatggatggcatgaacgcttggaacgagaaggacagcagacttatggaggatgttgtcaagtctcgtgatgtgcttaagaacaagatgaaggacgactgggcggtaagctacctgtcctgtttctcaattgggagactcatttactaatgaaagccgcagactgccgacgagcacagcaactctatacagaataccacaaaatctgtccatgccgagacggttcgtgtagtcgatgctcaactcaaagatctcgatacacagatgcaggatcttgaccaattcgtctctcgcgcccgctccgaaaactccgtgcaccatgaacaacatgtcgtctcgatggagaacctcacctcaacggtcgaaaagtcattcattaacattgcggaccattttggcgagcgcttcgaccgtatccgcgaccttagtggcgaaatggataacgatgcgaagatcctgcgagaatctcttgagccgcttgacgaatccctccgtcagccccttgccgccctccgcgaagacatccagagcaccaagatccgcgagtacgagcctaccggtgacacccccgagaagaagcgctacgaatatccgacggaccttccgcgcactgcgggccatgagacgctcattgcaggcatgcaggacaagccttcgacgacgccgacgacaagcccagctaaacgtgcaacgatgactgcggtatatagtgatatcgtcgtgtcaccttcacgttcaccctccaaagtgccattgtccgtgcctgtttcacccaggaataatcccttcggcacgcccggacccgccacgagcacccgaaataagtcgcatcccatggacccgagtttacgagaagtgaatccgaaccttggtggcgggacatcagtttttggcgagttgtcatccagcacgatgtcaatggcgccgccatctacatcggtgatcggtttccacgccaacaatacggaccacactgaagagagtgcgacgcaagtaccactctttagaagaagtaatcggagacagtcacctcgtgtattagccaagaaaaagataacgggtcatgctggcgggatcatcacggagggcctggaaaacatgccggtgacgacagatgccagtgtaggcattgccgggaacaggaggaagactccacggcta

SEQ ID NO: 27356 - DNA, 1800 bp, Neurospora crassa
gaagcggctacggaggagaagccgcccaagaagcagaagaagcagaaggaggacaggaagaagcaggaagaggaggaaaagaagaaaaagaagaaagacgaagacaaaaagcaaatctacccgcagccgctcaactcgtttggcgagctcaagtacacttacggcattcaccccgtgttggcggacaacatcacgcggcagggattccgggtgccgactgaggtgcagatgggcagcttgccactgcagctgcggccagagatggcgttggagaaggccacagatgtggaagacgtcaaggttgaaaagggaatcgacttcctcggtgttgcgccgacaggcagtggcaagactatcagcttcttgattcccgctatcgatgccatcatcaaaaggagggccgaggattacacccctgaaacagacgagcatgttctgcaggccatcgtggttgcgcctacgagagagctggcaagtcaaattgtcaatgaaggaaggaagttggctatcggaaccggcgtgcgcgtggttctcatgaagaggaccctgcggttggtggcagaatcaaatgagcaggaggagacggagcaggaagccaaggaagaggttcaagacagtgatagcgacagcgaagcagagagcgagcccgaggaggttatgaaaatcgatgaagaagaagaggaagaagaggaaagcgattctgacgccgagaagaaaacggagagcagggccaaaggtgatcagaagttcaagaaggagaggccgatcaccagggtagacattcttgtgacaacccccaagattctcctcaacttcctctgcggaggcgaaaaggagaagggcaagcccaggatcatcaagaagacgctccccaccgtgcaatccctcatccttgacgaggccgatgttctccttgatcccatcttccgcaagcaaaccatgggtatctggcgtgcctgcacccaccccaacctcggcatgacgtgctggtcggccaccatggcctccaacatcgaagctctcctcaccaaacacatcgacaagcgcgccaagcgcacccccgaacagactcccaagcccctgatccgcctcgtcgttggtctcaaagacaccgccgtgcccaacatcacgcacaagctcatctacacggccacagagcccggcaagctgctcgccctgcgccagcttctccaccccgtgtcctcggccgactcgggcccgccgctgcgcccgcccttcctcgtcttcacccagactatcgagcgtgcccaggcgctccacgacgagctcaagtacgacatcccgctcgaggcgggcggctcggcccgcgtggcggtcctgcactcgtcgctccctgactcggtccggtccaagatcatggcccgcttccgcagcggcgaggtgtgggtgctgatcaccacggacgtgctcgcgcgcggcgtcgactttgctggcgtcaacggcgtcgtcaattacgacgtgcccgtgtccgccgcggcgtacgtgcaccgtgccggacgcacgggtcgcgccggtcgcgagggcggtgtggccgtcaccttttacaccaaggacgatatcccctttgtcaagtcggtcgccaacgtgatcgccatgagcgagaagcaggcgggcaaggacatcgacgagaaagataccgtcaaggccgcccagggtagcgtgcaaaagtggctgctggatgcgctgcccaaggtggccaaggaggataagaggaagttgaaggtcaggggggtggagagcaggcggacaggcggaaaggcgacgatcacgactaagagc

SEQ ID NO: 27357 - DNA, 2385 bp, Neurospora crassa
cattccaagcgagaaaagcacaccaaatttggcgaatatattctcggtaatacgattggagagggtgaattcggcaaggtcaaacttgggtggaagcaggaaggcggcgtccaggtacgtaggacaaatgtcttgccgctcataaatatgctgcttactgacttacctatgaccaggtcgccatcaaactcatcaaaaaggacacagtaggcaacaacccatctcgtatggcaaagatcatgcgggaggttgcgattctgaagcaactgacccatccaaacattgttcggttacataagatggaggagtctgacaggcattatggtattgtgctcgagtatgcatcgggaggcgagctgtttgactacatcctcaatcaccggtatttgaaggacaatgccgcccggcgactatttgcccagctcgtgtctggcgtagggtatctgcataagaagggtatcgtgcatcgtgatctgaaactggagaatttgcttctagatcgaaaccgcaacatcatcatcacagattttgggtttgccaataccttcgatcccaaccaggagctttcggaggaggaagagctcaacctttcggatcgcgagtttgtcaagcgcatgggcctcgataaggtcaatgacgctggctggcgaaaaggagatcttatgcagactagctgtggcagtccatgctacgcagctccagaattggtagttagtgactccctctacaccggaaggaaagtagacgtctggagctgcggtgtcatcctggtgagttagcccccccgtcctgccgcctgaactatagctaacgttagttcagtacgccatgcttgctggctatctccctttcgacgacgatccggcgaatcccgaaggcgataacatcaacttgttatacaagtacatcgtcaacacgcctctcacgtttcccgaatatgtcacgccacatgctagggatttattgcggaggatattggtacctaatccgcgaaagcgagcggatctctttgaggtagcccgtcacagctggttgagcgaatattcgcatgttgtcgagttcatcacgtcctccactaccacacctagcgagatccaaaacacgacagtacctgccgaggacgagggagagtctcctcaccttgctcgtagcgcttcggtacgcgaggcgccgaagaagtcaaccgcctcgccggccatcggtggcttggttagcaagcaaggcaccgtggaccccgaggcagaggctgcttacgctaaacagcagcgcgataacaagcgtcggacagtacaggtcgaatatgttgctccgaataccacaactcaaagaggtgatattgcgggacaacagcagccctccagtaacgccaacagaaaccgtaatgagagtcaggcaccagtggaatcctcagacagtcgcccaacgacatcggccaaggataagcagctctcccagggcccctccgcccccaaagacgcctacaacaacaaacccccggtttcctcgagaagaccgccaagttctcagcggaatggtgggaatgctcccactacgggtaacgcagtggctcctcctaggccgagccgtgacggccgtcccaccgccgacaaccagtatctgtcaggggcagcaggtgcaccaacccaaaggcctactactggcgggtccatgcagtcaggaagaccttcgtacgcccaaccagcaccacctgaagttgctgacgctaacgtacacggcagaatccagcaaccttccaaaggatccggcagcagtcactttggcgtacctacaaccacccccgccgagcagcaaccgagcgaaagcgccgattatggcaggcccagcatcagcacgggctctaggtttgacaaggtacgggaagatggtgttgtcaagggccacaaaaggtccagcactatgggcgaaattggcggcaagctctttggccggagcggctcgttgtttggaggtaggaaatccaagcgacagcaggagcttcagcaggctggagagaagaccaagaggtatccccctgttagcatgaacaactcaatgccaggcggtgagaatggctctcggccgtccttggattctaagcgatctcgccggtccttctcgatgggaatggggaagaagtcttctggaggcagtatcactggttccaatggctctcaggagaagtctaataagcggttctctttcatccccccttcgctatccagggccttcggctacaacaaagaggatgaacctccagctctcgattcacaacaggacctgcccattcaggagccctcatccgttgaccaatttctgggccgggaacaaaatgtgagcgcgaccactgttgacgggatgtacactcagcttcaggactcgcaacag

SEQ ID NO: 27358 - DNA, 1440 bp, Neurospora crassa
ctcggctggctcgtgggcacccagtatcccaggggcgagatctcccccgattccaccctccccctcgccaagaccactcccccaagacacgacaccggcaaggccaacctcgaggctgcctgggccgactttgtcaagattgtcggccaagagaacgtcagcactgccgactacgaccttgaggagcactctaactcggactggtcttctcaccagtctgatgcctccactaggcccttctgcatcgtctacccgtcctccaccgaggaggtgtccgagatcatgaaggtgtgccattcccgcgccatccctgtcgttggctacagcggcggcacttcgctcgagggccacttcaccccgacccgcggcggtatctgcgtcgacttccgccgcatgaacaaggttctggctctgcacaaggaggacctcgacgtggttgtccagcccgccgtcggctggcaggatctaaacgaggacctggccaaggataacctcttcttccctcccgacccgggcccgggcgcccagattggcggcatgatcggcaccggctgcagcggcaccaacgcctaccgctacggcaccatgcgcgagtgggtcttgtccctgaccgttgtccttgccgacggcaccgtcatcaagacccgccagcgcccccgcaagtcgtccgccggctacgacttgaccaagctcttcatcgggtccgagggcaccctcggtctcgtcaccgaagccaccctcaagctcaccgtcaagcccgcctccgagtccgtcgccgttgccagcttcaaatccatccgcgaggccgcctcgtgcgtcgcctccgtcgtcgccaatggtgtccccgtcgccgctgtcgagatcctggacgatgaccagatgcgcatcatcaaccaggccggcgtcaccacccgccgttggaaggaggcccccaccatcttcttcaagttcagcggcacccccagcggcgtcaaggagcaggtcgccatcgtccagggtctctccaagcagacgggcggccagtcgttcgagtttgccaggaataacgacgagcaggccgagctctggagcgcgcgcaaggaggctctgtggagcaccttcagcatcaagaagcccggtgaccacctctggactggcgatgtcgccgttcccatgagcaggctccctgacataatcgatctgaccaaggacgacctcaagaagagtgggctcaagagctccattgtcggccacgtcggcgatggcaacttccacatccttctcctttacagcgacgccgagaggaagctggcagaggactgtgtccaccgcatggtgaagcgtgctgtggaaatggagggtactgttactggtgagcacggtgtcggtcttgtcaagcgtgattatctcccccacgagttgggtgagagcaccgttgacactatgagaaaggtaagctta

SEQ ID NO: 27359 - DNA, 4010 bp, Neurospora crassa
atgtccaagctcgagaaaatgtccatcttgggcgtgcgctcctttgggccacgccacccagaggccatcgctttcaacaccccattgaccctcatcgtcggttacaatggctcgggcaagaccaccatcatcgaatgtctcaaatacgctactactggcgagcttccgcccaacagcaaaagcggggctttcatccacgaccctaacgtgagtgccactgtcgactgtccctggctgtatgaagactctggctaaacggtgacatgttgtagctcgttggcgagaaagatgtacaagctcagatcaagctttccttccgctccactgttggtgaatccttcgtcgtgactagaaacgtgcagttggccgtcacgaagacctcaagtaaacaaaagaccctcgaaggaagtctcctgttacgagccaatggcgatcgccaagtattgtctaccagagtagtggatctcaacaagctcgttcccgagaaactgggcgtttcaccagctgtcctagatgcggttatcttttgccatcaggatgagtccctctggcccatgagcccgggggctgacctgaaaaagaggttcgatgaaatctttgaggccaaaaagtacgccaaagtcatcgataatatcaagcttctccgaaagaccaagggcgaagagcttcgactactcaggatgcaagaggctcaagataaggagaacaaggagagggcggacaaggtcgacagagagctgagtaagcttattcgcgagctacaagaggatcgcgacaagtgcaacgaactgcaaaaacaaatcgaggatgaggatgttcgaattaagcaaaaatgggagcaggccaacagtttcctcaagatcgtcaacgagctacagactaaacaggagaaactcgaatacaaaaaggatgccatcgcagagttgcgcgaacgcatcgaggagagcacagagtctgatgaatatcttcgtgacgttctcagccagtacgaacaaactgttaagcgaatgaacagcgaccgagatcagaaggtggcccaatttggcaccctacagacggagctcaagaccgcccgagccaagcataccgctaaggtggaggagcagggaaagcatcagtctgacaaggaaaagtatgaccgccaactcgtttcgcaacgtcagatgatccaagaagcagctgaaaaacacgagattcgtggctacgacggtgacttggatgaccaggagatcaatgcattttacgaacgcatccagaaaatgcttcaagacacaaaacgagacctggaacgtctacaacgcgacaatgccgccgaactggacgcaaaatccgccaccatcacggagctagagagccacaaggcgtcccgcattcgagaccggaagatctcttcacagcgggttgcgacacttcagagagatattaccaaacttcaaggagaactgaacaatctcgatgttgacgaaggcgcggaagcagtactacagaccgagatggaggggctggagtccaagatcaaggcagcgaaagctgacaacagagtgtcagaacttgattcacagatcacaaagctgaacaacgaggtcttgactctagaagctcagggtgcccagctaagtcgggaattggttgaatgcaccaacctagcatccgaacgtgcacaactcgaacttcgtaaaaagcagctcacagaacggaagcgagaactagacattctgaagaacacattcaatcagcagcttaccgatgttgtcggcagaaattggacaccggaaaccattgagtcagattttcaaaaagcccttcgacagctgagtgaccgactatctgagcttagaaagacgaaggattcgacgcagcaagaactgaagcaggttgagtacaagcttaccactgctcgtgagcaacaaatcaagtccgtaaaggaaagggatagctgcaaaaaagacgttctcgaagccctgaagaaggtgccgcgtcaaaataagccggtgacggagtcggtagatgattatccagatgctgtcaaagagatcgagaaattgttgaaggataccgacacggacctggaactcaatatgtatctgaaagaatacttcttaaaagcgaaggttaaggcagaggaaaagcacaaatgctacctctgtgagcaatcgcttggcgacgagaaaaccatgaagcgattgatgaagaggattcaagataagattgatgacaaagatagagacgagctgcttgaggatcaagccttgtacggacgtcaccttggaacactgagaagtgtgcggacgaagcacgaaacatatggacggttgtgtaaggagctgccgtccatggtcgaagaaatcaactcgctcacgcttcagaaggaaagactggttcgacagcttgaagaccaggatggcgctttcaaaattgccgaagagaagcggaatgcggcggatgtgctgagcaagagcgtactgaaaattgcgcagactgtcaaggatattgcggattccgagagacacatcgagagagcacagcagaattcgagcaatcaggtgcgcagtgctgacgagattaacgatgaccaaacaacctgtgcagagcagttaagaattgcccaagccaagttgagcaagtcaaccgccgaacgacaacggttgaaggacctggccgctcagctcgaggttgagaaattggagttgaagcacaaaatcacggaggccgtccagaaattagaacacaagaagcgtctccaggacacgattaagaatcacagagacgagcagagcgaacttcgcaaaaacatgcaagacattgacaaagaggtcgagggcatcgacccagaaatcgccagcgcaagagccgcgctcgaggaatctcggaagcagggccgtgctagagagcagaggatcgcagaggaacgtgatggaatcgccactacggtgagcgagctcaagataatcaaccgcgaaatccaggattatctcgaccgaggaggtcctgccaaccttgcttccaaccagcggaccattgccagcctggagagcaccatcgctgccctcgagaaagagatgaaagacgtcaccattcagatcaacaagctgaacaaggagatcgataatagcgacgccaagaggcgcaacatcgccgacaacctcacataccgcaagaacctgcgcgagcgcgatgctctcgaggaagaaatcgaagagctcgagtcccgcaacgcacaagaggactacgaccgtctcgtcgaggaagcgcactccttcgaattataccgtggcaaactcaacgccgaacgccagcggctcatgggctccatgtccaccaaggacgagcagttccgccggctcgaagaggagtacgagattgagctcaagggggcgcgcgcccggtacaaagagagccacatcaaagttgagacgacgaaagcggccatcgaggacctcgcacagggcaacatggcgctcgaccacgccatcatgcagtaccactcgctcaagatggaggagatcaaccggaccatcgccgacctttggcaaagcacgtaccaaggaaccgacatcgacacgatccagattcggtcctacatggaatcgacggcttcgggcgccaccaatacgcgccgcgtttacaattaccgcgtgtccatgatcaagggcgacacggaaatggacatgcgtgggcggtgcagtgcgggtcaaaaggtgctggcctgcattatcattcgccttgccctggccgagtcgtttggcgctaattgtggcatgattgcgctcgacgagccgacgacgaatctggatagtgacaatatccgcagtctggcggagagtttgcacgcgatcatcaaggcaaggcggtcacagaacaatttccagctgatcgtgatcacgcatgacgaggagttcttgaagcatatgcagtgcagcgatttctgcgatagtttctttagggtaaagagggatgagaatcagaatagtgtcattacgagggagagcattacgaggatttcggagtaa

SEQ ID NO: 27360 - DNA, 708 bp, Neurospora crassa
ggtgaatcggcggttggaaagagctcgatagtcttgcgcttcgtcaaggtacgcccagctcctactcggcgcttgatgggattgaagcgggcaactgacctccatccaggaccagtttgactcgtacagagaatccacgattggcgccgctttcctaacacagaccattgctctcgacgaaaacacaacggtcaagttcgagatctgggataccgccggccaggagcgctacaagtctctagcgcccatgtactacagaaatgccaactgtgcagtagtcgtttacgatatcacacaggcggtatgtggcctttctcgaggtccttgtctctgcccgcgcgacatgagctgacgtaacccccttctaggcatctctggacaaggccaagtcgtgggtcaaggaacttcagcgccaagcaaacgagaatatcattatcgctcttgccggtaacaagttggatctcgtgcaggagcaacccgataagcgtgcgattcagacggccgacgcccaggcatatgcaaaggaggccggccttctcttcttcgagacttctgccaagactgccgagaacgtgcaaaacctgttcaccgagattgcgaagaagctgcccctcgaccaagttggaccgaggcatgctcgcccgggccaacgaccgggtgtcagtctagctcccgagggggccaacacccaggtcggagggccttgtg

SEQ ID NO: 27361 - DNA, 1713 bp, Neurospora crassa
cactcgccgctctctggcctcaccacaagagcgaaactattttcagccaagccaacaacaaacatccaccacttcatcttcagacctccccttcgcacttgccataccacaccctgcaaaatggcctcctcacagcgcacctacgacgacgccctatcccgtctcgcccaactccaatccaaccgcactatcgtcaacctcttcggtagcgacgacagcaacaatgactcccaaagcaagaagcctgccgccaaaaaggacctcaactccctcgcaatccccgaaatgctctcctggctcgcccgcgccggctacacgccctcatcccttgccgccacggggctcaagtgcgtgcacgtagcgggaaccaagggtaaaggatctgtgtcggcgctggtttcttccatcatctcccaatacccccctcctccttcttttcatgacgacggcggtggtggtggtgcccacatcatccaaaaacctgtcgtggtgggaacctacacatcgccgcacgtcctctcggtccgcgaacggatccagctcgacaacgtgcccgtctcccgcgaaaagtttgcgctttacttctttgaagtctgggaccggctgtcggccgccgcccgagcggctcgggatccggttcagtccgaggcagagtatgacgggcccggcacgaaaccgttttactttcggttcttgaccatcctggcctttcacatctttgtccgcgagggggtcaagcaagcggtgattgagtgtgggattggcggggaatacgactcgacgaacttcttgagcccgcagtgcgtgacggcgagcgtggtcacgcagctgggaattgatcacgtggctatgttgggaaatacccttgagaaaattgcgtggaataagagcgggatttttaggaaaggggtcaaagggtttacgaggaggctggatggggaaactcagaaaggagtgatggaggtgttgaggaatagagcgcaggagaaggaagtggagaggctggtagaagtggaggatgagcaggttgagaagtggaagggcgtagagggggccaagttggaagggccatttcaaaagtttaacatggcgttggccgtggcggcggcgagggagcacttgaccagggtgggacacaaattcgcgggggcttttggggaggaaggctggaaattggatgatatcccggctgagtttgagaagggtttgaaggaggctagccttaagggcaggtgcgagtcttttagagaccccaagggcacggagtggtttgttgatggagcgcatacggaggatagcctggcgggtgttggacagtggttttctgggaaggtgaaggagggcgatgtcaacgtcttggtgttcaaccagcaggatagggacccggaggtcttgttgagggctcttcttgcggccgcgcagaagcaaagcgggacaacgacgccggtgttcacctacgcggtgctcacaaggaacgaggaaaaggcgccggtagagggtgagccggagagagatctcgcggtgcagttgcaggggcagaagattattcaggaagctagtgcggagaccgagacctcggtctacaacgcagtagagccggccatggaacaggttcagaagatcgctgagcaggcgcgcaaggacggcaagacgtgtaatgtccttgtaacgggaagcttccaccttcttggtggcgttctcaagacagttgag

SEQ ID NO: 27362 - DNA, 1701 bp, Neurospora crassa
atgcaccatgttttgaggcccatagcttttcgacttgccctcgtctcccctctgaggtcgctcaccatcacccatcatcacctcttcttcacaaaacgcaccatggcatccagcgctagaacatacaatgtgagtcaaccaaccttttaccgctccacagaaccccaaacactcactcaccatatcgtaggacgcaatcgatgcgctcaactccctccagacccccttcgccgtcatcgaagcccggcgcaaagcgggtatccgtcccgatgcgcactcggtaaaggaaatgcgtgcctacctcgcccgcatcggctactcctcccaagatctcgatcgcctcaacatcgtccacgtagccggtaccaagggcaagggcggcacctgtgcctttgtcgactccatcctcacgcgtcatcagcggactcacggtatccctaggcgcatcggtctcttcacctccccccatctgattgctgtccgggaacgcatccgtatcgactccaagcccatctccgaggaactgtttgcccgctacttcttcgaggtctgggatcgtctcgagacatctcagctggctaaggatgaggtggaactgggaagcaagcccatttacgctcgctatcttaccttgatgagttaccacgtctacctgtccgagggcgtcgatgtagccatttacgaaactggcatcgggggtgaatacgatgccaccaacgtagtcgaccgtcccgtggtcagcggtatcagcacccttggtatcgaccacgtctttgtcctgggtgatacggtcgacaagattgcgtggcacaaggcgggtatcatgaagacgggcagccctgcgttcacgattgagcaggttccctccgcaactcaggtgctcaaggatagggcggtggaaaagggcgtggatctcaagatccttgatgttgatcccaggctcaacggcgtcaagatccgtcccgatgcagtcttccagaagaagaacgcaacgctggctatcgcgctcgctgagactgccctcaaaaagttggacccttctttcaagcctggcaccgacagtctatcacccgagtttgtccaaggcctcgaacaggttgtctggcgtggccgatgcgaggtcaaggaggaggatcaggctgtctggcatcttgatggcgcacataccgttgacagcctgaaggtggcggggagatggttcgtcgaggagtgtgtcaagaaggccaagggcggacccaaggtgctcatcttcaaccagcaaggccggtctgaggccgttgacttccttgatgggctttgcaacactgtcaagagtgctgatccggagggaactggctttagccatgtgattttttgcaccaatgtgacatatgcgacgactggctacaaaaaaggtatgttgtcctgggtctttccatgatttgctcaagctaaccttcaatagactttgtcaaccatcaatataaccccaaggacattgaaaacatgacacaacaacgagtcttcgcggagaggtggtcgaccctcgacccctctgcgaatgtcatgcttatccccactattgaggaggccatcaacaaggccaggagcctggtagacaccacggaaggcgaacagaaagtgcaggcactcatcaccggcagccttcaccttgtgggtggcgcgctcggcattttggaaaaagcagatgctctctgaagg

SEQ ID NO: 27363 - DNA, 1032 bp, Neurospora crassa
aacctctccttcgtccttaacaagcccctcgacgtctgcttccaggacaagcccgtccccaagatcaactccccccatgacgtactcgtcgccgtcaactacaccggcatctgcggctccgatgtccactactggctccatggcgctatcggccactttgttgtgaaggaccccatggttctcggccacgagtccgccggtactattgttgccgtcggcgatgccgtcaagactctttccgtcggcgaccgtgtcgccctcgagcccggctacccctgccgccgctgcgtccactgcctttccggccactacaacctctgccccgaaatgcggttcgccgccacccctccttacgacggcaccctgaccggcttctggaccgcccccgccgacttctgctacaagctccccgagaccgtctcgctccaggagggtgccctgatcgagcccctcgctgtcgccgtccacatcaccaagcaggccaagatccagcccggtcagaccgtggtcgttatgggcgccggccccgtcggcctcctctgcgccgccgttgccaaggcctacggcgcctccaaggttgtctcggtcgacattgtcccctccaagctcgagttcgccaagtcgttcgccgccacccacacctacctctcgcagcgcgtgtcgcccgaggagaacgcgcgcaacatcatcgcggccgccgaccttggcgagggtgccgatgccgtcattgacgccagcggcgctgagccctccatccaggcggcactccacgtcgtccgtcagggcggccactacgtccagggcggtatgggcaaggacaacatcaccttccccattatggcgctctgcatcaaggaggtcacggctagcggctcgttccgctacggcagcggtgactacaggctggctattcagcttgttgagcagggcaaggttgatgtcaagaagctcgtcaacggcgttgttcccttcaagaatgccgaggaggctttcaagaaggtcaaggagggtgaggttatcaagatcctcatt

SEQ ID NO: 27364 - DNA, 814 bp, Neurospora crassa
ctatgtactttcagtgcttctggcctcggccgtgcctgcgttcgggacattgtcaagtcgggcggtaatgctgctgtccttgacatgaacgaggaaaccggagccgctctggccaaggaacttgggtcatccatccgcttcttccagtgcgacgtgacggacaccgagagcattgcgtccgtcgtggagtcaaccctggaatggatcaaggagactgggaagcctctcggtggaatcatccccgccgccggggttggaagtccgggtttggtaagtattcctgccaatgtctccgcgttggacttgatctaacactcaccagatgcttgacaagtccctgaacccactttccttgtcgtccatcgactttgtcctctccatcaatctccgtggtgtcctcgatctcgtgcgccagttccttcctgctctcgcttcttccccggcctacggtcctgacggcgagcacggtgttgttattatggttgccagctctgccgcctttgatggtcagatgggtcaggtttcttatgccgccagcaagggcgctgttgcggccatgacgctgcccatggctcgggatctatcccgatttggaatcagagtcgtcaccattgcgccgagcatgtttgactcggctatgacggccatgatgagcgacaaggtgaggacggggctgaagaaggcgatggagtttccttcacgggcgggtcagccagaagagtttgcttccttggccaggcaggcgattgagaatgtcatgttgaacggggtagtcattcggctggacggcgccacgaggatgcccagcaaattg

SEQ ID NO: 27365 - DNA, 2418 bp, Neurospora crassa
gttcgggcagttagctttccagcagccaacgtcgtcctctctgcctcccgagaccacactgttcgactttggcgcaaggcgacaagccagtcgcccttcgacgacactatcgttagccaaggtcacggctacatcaactctctcaccttcatcccacccactggcgaataccccgacggcctggttgtttcaggcggcgctgagcccatcatcgaggtcaagaagccgaatgcgacacctgatatcaatgccgagcgactcctagttggacatggccacaatgtgtgcacactcgacgtctcgcccgacggaaaatggcttgtttctggcagctgggatggcaaagcgatcgtttggaatactgctacttgggagatggcccatgtgctcgtccataacatggacaacagaggtgtctggacagtcctcgcatacgacgcggataccattattaccggtagcgccgataacaacgtacgggtattccgactaaaaggcgctacgggcctcgaaatcgaagcttcacgcaccctcagtaccggtgatgttgtgcgcgcattatgcaagcttccctcaggcctgaaggggcaccccagcggtgctgatttcgccagtgccggtaatgataacgtcatccggctatggaagttgtcaggaaaagaggtgggaaagcttcagggccacgacagcttcatctactcacttgccgccctacccaccggcgaaattgtcagttctggagaagaccgcactctgagaatctggaggggctccgaatgcatccagactattacacaccctgccatctcggtgtggactgtggccgtctgtcccgaaaatggcgacattgtgtccggtgccagcgacaatatggtccgtgtctttacccggagcgctgatcggacagcggacacccaaaccatcgcccagttcgaagagtctgtccgaagctcggcaatcccacagcagcaggtcggctctaatatcaacaaggagaagcttgataccaaggattggatgcaaaccaattccgggaccaaggatggccagatcaagatgattagggaggaggatggcaccattggcgcctaccaatggtccatgggtgagtgcaactagcccgcccttagtctgtgaatcaagctaacatgttacgcaggtcaacaacagtggattcacgtcggaacagtcgtcgattctgctggtagcagtggcaaaaaggtgtcgtacaatggccaagagtacgattacgtctttgacgtggatattgaggatggcaagccaccactgaagctcccttacaacctgtcgcagaatccgtacgacgcggccaccaagttccttggtgataatgaactgccgatctcgtatctcgacaatgtcgccaacttcatcacacagaatactcagggtgccaccctaggacaggccaatgaggccccctcgagcgacccttacggtaccgactctaggtacatacctggccaggacagtcaacctgcgaagcctaaatacttgccgcataccgagttcctcagtttgaccagcggcaaacttgagccggcccttgctagactcaagacgctcaacaccaagcacattcaggccgggaacaagcatatcgcgatgaaccccgataatgttgagattcttgaggagcttgtcaagcagctgcttcagccagcttctgctgccggaaagttggccaacttggacgcatcaaaacccattctcctcacactcgtcactcagtggccgtacgcggacaggctgccagcgctcgatattcttcgttgcctcgccgcctggcctgctgcggcttccatcacagacgaccgctatggcgacatcatcgacattgcggtcaggggagcacttgacgtggaggacactgtaactgcagacggctcactgagcgactttatcgccaacaagcttgacgcaacaaaagcaaatgctaacagcgtcatgatggctcttcgtaccattctcaaccttttcaagcttgacgatggccggaagctcgtagccagcaaggccggtgttattttgtcctttatgggacacattgttggtctcgacggggataagggcgtgattggcgccgagaacaacaatttccagattgccctgacttcggcggccttcaactttgcttgcctattttacagagacaggaagttggatgcgaacttggacgaaattgcgcttctcatcatgattgttgaggcaactgtgcgtaagcagaaggatcctgaagtcctgttccgcgctctaatggcgctcggcatggttctttctattggcccacagccggtagcggaggcgaagaagcagggagttgatgcttggttgactccggtgatcgggcagactcgggagcagcgcctcaaggacgttattcaggagtgtctctcg

SEQ ID NO: 27366 - DNA, 741 bp, Neurospora crassa
tgcggtatcacaacctgccccaccggacaaacctgctgcaacgcctcctgcggcctctgcgtctctccaggcatggcatgcactcaacaactctgcgagcccgccggcgtgcaatgtggccccaacgtttgctccggagatacacctgtctgctgcaataagagctgtggaatctgcaccgctccgcgtggattctgtacgcagcagttttgcgaacgcgggtttacccccagcgagagcaagaggaacgaggaggccgataagatcaagttgggaaaccaaaagtgcggaaaggcgacttgccccgaggggacgagctgctgtaactctagctgtggtatttgtgtgaagcctggtggtgcgtgcacgcagcagttttgcgaacacggttttatctccggcgagagcaagaggaatgaagaggctgatgagatcaagctgggaaaccaaaagtgcggaaaggcgacttgccctgaaggaatgagctgctgtaactctagctgtggcatctgtgtgaagccaggaggtgtgtgcactcagcagttttgcgaacacggttttatttctggcgagagcaagagagaagaggagactgaggagatcaagtcggggaacgaaacttgcgggaaggtgacttgccctgaggggacgagctgctgtaacgctagctgtggaatctgtgtgaagccgggagatgggtgcactaagcagttttgcacctagtgcggatgctcagactgt

SEQ ID NO: 27367 - DNA, 1464 bp, Neurospora crassa
ggaatgattggaaccggcagcatgggcggcatgatgtctcttctgttcgccgagtacggcatccacacgcactactacgacccttccaaaaagaacatcgaagccctccaatcgcacgccaaagaaagcaagcacgaagacaagatcacctaccacgacgatcacaagtctttgtgcgaggctctagaggacggtgataaacccaaggttttcatgttcagcatcccccatggcggccccgccgacgacagcatcgatgccctcgaaccctacctcaagccaggcgacatcatcatggacgcctccaacgagcactggaaggcgaccgagagacgacaggcccgccttgagccaaagggaatccattacattggaatgggcgtctctgggggctaccagtctgctcgccatggtccttccatctccccgggtggcagcaaggaggccctcgacaaagttttccccttcctccagaaaatcgcggccaaagacaacaggggacggccatgcgtggccaagcttggaccgggcggatgcgggcactacgtcaagatgatccacaacggcattgagcacggaatgatgactgccctctgtgaagcctgggccatcatgaacatcggcttgggcatggactacgaagagatcggcaccatctttgagaagtggaacggtgacaagcaaaggccattgagggacaacttcttgattgacattggtgccgatatctgtcggaccaaggatgagaagggcaactatgtgctggccaacgtgcgtgacaaggtcgttcaggatgtagacaactccgagggtacgggaacgtggtcggtccaggagggtaccagactccatgtgccagatcctaccattgccgtctcgcatcttttcagggtagcttcggcagatgcagcgaggagagagacagtcaacaaggcgctggacggaaagggggtgaagcccgctcaaatcgagggtgtcgataaggccaagttcctggaagacttgtacaacgctgtctacgcctccttcctcatgtgcttcatccagggcctgcacgtcctatccaaggcaaacgaggaaaacgactggaagctcgactttgctgatgtactgcagctctggcgcaatggatgcatcattcaaagcgacggagttgccgatttgctcgagactgtgtatcgctcgagggagcatgacaacgatgatctcctaggacaccaaacgattgctggcgagctggcaaagacgtacccgtcgctcaagagggttgtactgaaggctatcgagtttgatctacatgctggagcgctgggtaccagtctcgaatactacaagtactcaggttcgactgagctacccacccaattccaagaggccgagttggactacttcggggctcacatgtttgacctaaaaactgctgagccgggtaagccggtgacgggtaaacaccactttgagtgg

SEQ ID NO: 27368 - DNA, 2650 bp, Neurospora crassa
cagagcaacagtccctacgccgaagtgcgcgccgtggtcgacaataccgatgacccttccacgccgtgctcaaccattcgttcgtggaccattggcatcttgttctctgtcattctcgcctttgtcaaccaggtaggtgccaattttctttttcgagaccccgcatgcttctcatggctgaccatcatcgcagctcttcagtgtacgccagcccagcatttcgatcgaatccaacgttgctcagctccttgcttttcctctcggcaaagcctgggagatgtggatgccgtattacgagttcactctctttggaaccaagcataatctcaatccggggcggttcagcaagaaggaacacatgttgatcgccatcatggcaaacacagccaagtcgctgccctacacgcagtacattgtgtggacccaggtgctgccgcaatactttaaccaaccatatgcgaacagctttgcgtaccagattctaattgcgttgagcaccaacttcatcggctatggccttgctggtgagtgatagtcttccttatgtgagatgccaaagggctcgggtgattgacaatacaaaataggtatcactcgccggttcatcgtgtatccatcttactgcgtctggcccgcatctttggttaccatcgccctcaactcggctctgcaccacgaggagaaccatatagttcctggcccgttcaagaagctgtacagaatgtcgcgcttcaagttcttcatgtgggctttcggcgcaatgttcgtgtacttctggttccccaactatctctttgaagccttgacattcttttcttggatgcagtggattgctcccaacgtaagacagacccatttgcttctgtggcgagaagttaatctaacattggcagaatttgaatctgagcattctcactggattccaaaacggcactggcgtgagtgctccctcccgatttcagcaatgaataccgtcgcagtgtcttgatactgactgtgtgtagatgttcaaccccttccccacatttgactggaacgttttgcttttcgactccgtcgatcctctcgtgagtcttcttgcttccattcctcagagttatactatactaaccaatgccagatggtgcctgctttcaccacgttcaataaaaccttcggcatggcgtttttcggcttcatcatcctaggaatttggtacactaatgtttggaataccggtcacctcccaatcaacagcaaccgtgtgtttgaccactacggtagtctgtacaacgtctcgcgagccattgacgagaagggcatgtttgacgaggcgaagtacatggattacagcgccgcatatctttcagcagccaacgccattgtgtatttcgctttctttgccatctatgcggccaccatcagccatatcatccttttccatcgggccgagatcgccattggcttcaggaatatctggaaaactgtgaagccaaagagatggacaaagagaaatgctgccggagagagtgtcgaggaagaggatgttggatacaaggacgtgcataaccgtttgatggctgtttatcccgaaggtgagaacccattcctgaaaagaggacgagaaaaggttactgacgagaacccaaaacagtttcggaactgtggtacttgggctgcctcgtgattgccatggcacttggctttgctggtgttgccgcctggcccacatatactactgctggtgtcgttccctacggcctgttccttgcaataattttcgtcatccctattggcatcatcaaggccatgacgggtatcgaagtcaccttgaacgtattggccgagtttatcggtggtgcttgggttgagggcaacgccttggccatgaactttttcaagtcctttgggtaagtcgtgtccctctattccctcattgtcaggtctcaagctaactcaccacagatatgtgacctgcgcgcatgccatcagcttcgccaacgacctcaagctcgctcactacatcaagattcctcctcgccacactttcaccgcccagatggtggccacgctcatttccactttcatctgcaccggtgtgctcaacttccaagtcaacattgagaacatttgccagaccaacgcgcccatgcgtttcttctgccccggcatcaacaccttctttactgccgccgtcttgtggggaaccattggtcccgtcaaggtgtttggaattcatggccagtacaagtggctccttctgggcttccccatcggtctctgcattcccgtcatcttttggctcatcatccgcaagttcccgcgcaacaagttcattcgtcagttccaccccgtggccttgttctatggcgcactcaactgggcgccatacagcatgagctactgctggccagcggtgcccattgcgtggttgagctggatctatgtgcgaaaccgatacctggcgttctggtccaagtacaactttgtgttgagcgccgcgtttagcgcgggtatcgcgcttagcggtatcgtgatgctgttctcggtgcagtgggctagagtgagtgtggagtggtggggtaacacccagccgtacaagggctgtgaggataccgcttgcacgatcaagacgttgtccgagggagagaggttctttccctggtgggac

SEQ ID NO: 27369 - DNA, 1424 bp, Neurospora crassa
atgtctctctccaacaagctctccatcgaggacgtcgacctcaagggcaagcgcgtcctcatccgtgtaagtttcttctagcgctagctagctcctgatgtcgctgtgtgattcatataggtggatgggtgggtgaccagacaaaagttctaacatgccacccttctctaggtcgacttcaacgtcccccttgacgccgagaagaaggtcaccaacccccagcgcatcgccggtgccattcccaccatcaagtatgcgctcgaccatggcgccaaggccgttgtcctcatgtctcaccttggccgtcccgacggcaagcccaaccccaagtactccctgaagcccgttgttcctgagctcgagaagctcctcggcaagaaggtcaccttcgcccccgactgcgttggtcccgaggttgaggagatcgtcaacaaggccgacaacggtgaagttattctccttgagaacctccgcttccacattgaggaggagggcaagggcaccgatgccgagggcaacaaggtcaaggccgacaaggccaaggttgaggagttccgcaagaacctcaccaagctcggtgatgtgtacatcagtgagttttccagtcccctcggcttcaagattgggcacagtagctaacaccatattccacagacgatgctttcggcactgcccaccgcgcccactcctccatggtcggcattgacctccccgtcaaggccgccggtttcctcatgaagaaggagctccagtactttgccaaggttctcgagtcgccccagcgccccttcctctccatcctcggcggtgccaaggtttccgacaagatccagctgatcgacaacctgctcgacaaggtcaacaccctcatcgtctgcggtggtatggccttcaccttcaagaagaccctccagaacatgcccatcggcaactcgctcttcgatgaggccggcgccaagattgtccctgaccttgtcaagaaggccgagaagaacaacgtcaagctcgtgctccccgtcgacttcaccattgccgacaagttcgacaaggacgccaacactggctacgccacagacaaggacggcattcccgacggctggatgggtctcgactgcggcgaggagtcggtcaagctcttcacccaggccatcaacgagtcccagaccatcctctggaacggccccgccggtgtcttcgagttcgacaagttcgccaagggcaccaaggccaccctcgacgcttgcgtcaaggctgccgaggaaggccgcaccgtcatcattggcggtggtgacaccgctaccgtcgctgccaagtacggcgttgaggacaagctcagccacgtctccactggcggtggtgcttctcttgagctccttgagggcaaggctctccctggtgttgttgctcttagcgagcgtcagtaa

SEQ ID NO: 27370 - DNA, 1341 bp, Neurospora crassa
atgtctgcccccgcccacaagttcaaggtcgccgacctttccctcgccgccttcggccgcaaggagatcgagctcgctgagaacgagatgcccggtcttatggctactcgcaagaagtatgccgctgaccagcccctcaagggcgcccgcattgctggctgccttcacatgaccatccagactgccgtcctcatcgagaccctcactgctctcggtgccgaggtcacctggtcttcctgcaacatcttctccacccaggaccacgccgccgctgccatcgccgctgccggtgtccccgtcttcgcctggaagggtgagaccgaggaggagtaccagtggtgcttggagcagcagctcattgccttcaaggacaacaagaagctcaacctcatcctcgacgacggtggtgaccttacccacctcgtccacaccaagtaccccgagatgctcgaggactgcttcggtgtctctgaggagaccaccaccggtgtccaccacctttaccgcatgctcaaggagggcaagctccttgtccccgccatcaacgtcaacgactccgtcaccaagtccaagttcgacaacctctacggctgccgtgagtccctcgtcgacggtatcaagcgcgccaccgatgtcatgattgctggcaagatcgctgtcgtcgccggtttcggtgatgtcggcaagggctgcgccatggccctctccggcatgggtgcccgcgtcattgtcactgaggtcgaccccatcaacgccctccaggctgccatggccggctaccaggtcaccaccatggagaaggctgctcctcttggtcagatcttcgtcaccaccaccggctgccgtgacattctcgtcggcaagcacttcgaggtcatgcccaacgacgccattgtctgcaacattggtcacttcgatgtcgagatcgacgtcgcgtggctcaaggccaacgctgcttccgtccagaacatcaagccccaggttgaccgtttcctcatgaagaacggccgccacatcatcctccttgctgagggtcgtcttgtcaaccttggctgcgccactggccactcctctttcgtcatgtcctgctctttcaccaaccaggtccttgctcagatcatgctttacaaggccaacgacgaggctttctccaacaagtacgtcgagttcggcaagtccggcaagctcgagaagaaggtctacgtccttcccaagatcctcgacgaggaggttgctcgtctccacctcgaccactgcaacgtcgagcttacccagctctctgacgtccaggctgagtacctcggcctcgccactgagggtccctacaagagcgaccagtat

SEQ ID NO: 27371 - DNA, 2055 bp, Neurospora crassa
ctgagcacgagagaggccaacctctttcgtaccgtcatccgccactatgaggacaagcagtacaagcgcggcttgaaggccgccgagcagatcctcaagaaaaaccccaggcatggcgacaccatgtccatgaaggctctgatcatgaactcccagggcaagacggaggaggcctttgccctcgccaaggaggctctcaccgtcgacatgaagtcccacatctgctggcacgtctacggtatcctctaccgccagcacaagaacttcgacgaggccatcaaggcctacaagtttgccctcaagctcgagcccgagtcccaacagatccagcgtgacctcgccgtcctccaggtccagatccgcgactaccagggctacgtccagagcaggttcgccatgctcaaggccaagccccatctccgccagaactggaccgcccttgcgattgcctatcagctcgaaggcagcctcgaacaggccgagaacatcctcaccacctacgaaaagtccatgaccaacgttcccctcaagaccgaccaggagcactccgaggctctcctttacaagaacaccattattgccgagcgaggcgatatcaagcgtgcgctcgagcacctcgagtccgactgcaagaactgcctggacaggttggctgttatggaaatgcgggcgcgctacttgggtcagctcaacaggaaagaggaggcggcaaaggcgtggcgggcactgctggacaggaaccccgagcaccccgagtactacaagggtctgattgaggctttggagattgacgagaaggacgaggctgctctcaaggccatctatgacgagtatgctgccaagtaccctcgctcggatgctgccaagaggttgcctctcaacttcctcaccggcgatagcttcaaggctgctgccaagagctatctcaccaacatgttggacaggggtgtgccttcggtgtttgccaacctcaagcacctctactctgaggttgccaagaaggaggccatcctcgcccttgccgaggagtatctgaaggagcataaggggtctgagcaagcgaacggcgacagctccaagggtgtcggtgctgctctttacttcctggcgcaacattacaactaccacctcagccgcgaccttgccaaggccatggagtatgtcgagcaggccatcgagctcgatcccaagaacgttgacttccacatgaccaaggccaggatattcaagcaccagggcgataccgccaaggcctcggaaaccatggaccgtgcccgttcgctcgacaccaaggatcgttacatcaactccaaggccgccaagtaccaactacggaacaacgagaacgagaaggctctcgagaccatgggtcttttcacgagggctgaaactgtcggcggacccctcgctgacttgaccgacatgcagtgcatgtggttcttgactgaagatggtgaggcctggcaacggcgtggcaacaccggcttggctctcaagcgtttcaccaccatccacaacattttcgatatctggcaggaggaccaattcgacttccacagcttctccctccgtaagggtcagatccgtgcctatgtcgacatgatccgctgggaggacagcatccgcgagcaccccttttacttccgtgctgctcttgacgccgtcaagctgtaccttgacatgtttgagaagcagcaggcttctgccaacggcaccaacggcactggcgaggccaccaacggagaggatgccgctgagaagaagaaggccgccaagaaggcccgcaaggaagcccagaaggccgagcgcgaggccgctgagaaggctgctaagcaggatcccaacaaggcgacggccaagaaggacgaggaacctaagaagaaagacgacgatccgaacggcctcaagctcgctgctacgacggatcctttgggtgatgccatgaagttcctcaccaacatcttgcagttcagccccaagaacattgagggccaagttgctggtttcgatgtttacatccgcaggagtaggttttagatgcaacccctgtacttg

SEQ ID NO: 27372 - DNA, 1092 bp, Neurospora crassa
aaataggccgatgaaattatacgaaatgaccctgaagccaaccacgaatatctccccatcgccggtctcgcttccctaaccagcaaagccgccgagctcgttgtcggtgcctctgctcccgccatcactgaggggcgcgtcgcctcgatccagaccatctccggcactggcgcctgccatctcggcggtctcttcctctcgcgcttctacaacccatacggcgacgcttccaagaagcccaccgtctacctcagcaatccaacatgggccaaccacaaccagatcttctccaacgtcggcctccccatcgcccaatacccttacttcgaccagaagaccaagggcctcgacattgacggcatgaagaaggccctctctgacgcccccgagcgctccatcatcctcctccacgcctgcgcccacaaccctaccggcgtcgaccctacgctcgcccagtggcgcgagatcgccgagatcatggccgccaagggccactttcccttcttcgacaccgcctaccagggtttcgcttcgggcgacctcgaccgggacgcctccgccatccggctcttcgtcgagctcggtttcgagctcgtagtcgcccagtccttcgccaagaactttggtctctacgggcaacgcgctggctgcttccacttcatctccgctccttcgcccgacgctgcgtccataaccacccgcgtggcctcgcagctcaccctactccagcgctccgagatttctaacccgcccatctacggcgccaaggtggcttcgatcgtcctcaacgaccccgcgctcttcgccgagtggaaggagaacctgcgtaccatgtcgggccgcatcatcgacatgaggaaagctctgcgggcaaagctcgaggagctgggcaccccgggcccgtggaaccacattaccgaccaaatcggcatgttctcatttaccgggttgaacgagaagcaggtggctaagctcagggaggagttccacatctacatgaccaagaacggccgcatcagcatggccggtctaaataagaagaacgtagattacgttgccagggcggtggacaaggttgtcagggaagtgcaa

SEQ ID NO: 27373 - DNA, 863 bp, Neurospora crassa
ctcgccggccaagtagtcatcatcaccggtgccgcccagggcatcggcgccgaatgtgctagactcttcgctaatgaaggagccaaggttgttgtttctgacatcgacgccgccaaagcccaagctactgtgaataggatcgatgccagcggaggcaaggccatctctgttcccggtgaccttctcaaggacgactacatcgaaaagctggtgaagaaggctgcggagtttggcaatggcaagattcacataatcgtgaacaatgctggtttcacatgggatgccgtcgttcacaaggtagtacaatatctctgatcgggaaaaaggtgctgttgatgctaacacagaaacagatgaccgataagcagtgggagaccatcatcgccctccacggtactgccgccttcaagctcatccgtgaagcagctcccttcttccgcgtcaaggacggcgagccacgcaacatcatcaacatctcttccacctccggtctgcacggcaacgctggccagctcaactacgccatggccaaggccggtgtggttggccttagcaagacgatagccaaggagtggggtccggcttttggtgtcagagcgaacaccattgcctttggacatatcgagactcggttgacggccaacaaggaggctggtgcgtttgtggaggttgatggtcaaaaggttgctttgggtattccacagaagcagaatgcccaaaaggctggagggccggttccctttgcagatatccccctcaggagacccggttcagcaactgaggctgccagtgctgtcttggccattgcctctcccctgagctcgtacatctctgggcagactatcagtgtgacgggcggcagg

SEQ ID NO: 27374 - DNA, 3196 bp, Neurospora crassa
aatggtctctcaacgaaccaggtgccgaagctgcaggagcagtatggcgagaacgagttggacgtaggcaacaccattgcctggtataccatcttcatcagacagctatgcaatgctatggttttggttcgtaccccattccccaagcctccaatgacgggagagctcaatgctgacatctggacgtaaattctaggtcctgattttcgccatggctctgagctttggtgtcaaggattgggttgaggctggagttctcgcggctgtcatcatcctcaatgtcggaatcggattctggcaagaataccgcgccgagaagaagatggacgcccttcgcgccctctcctcccccagtgctagcgtactccgtgatggcaagacttctgtaattccaaagtaagttgccaaaatatccgccgacagaagaactgaacggcccgctgactcataaccgtaccacagcgctcaggtagttcccggtgatatcatccttctcaagatgggtgacaccgtccctgccgatctccgcatcttcgaggccatgaacctgacctgcgatgagtcctcgctgacaggcgaagccgaacctgtcgagaagatcacgaccaatgacattgtggttcccggcaccgagaagccagcactctccgaaggcgatcttggcatcggtgatcgtatcaacatcgcatacgctaccaccatcgttcgtaagggccgtggtcgcggaatcgttattgcaactggcatgaagaccgaagttggtaagattgctgcttccaccaacaagaagcaacgcaaggcaggtaggtcgatgagcaccaagcatggccacctccagccggtcaagggcgctggcttgcgtacgtgggatttcatcggcaagttcctcggtttgaccgaaggcacgccgcttcagatcaagctgtccaagcttgcgtatatcctgttcttttgcgcaatcttcctggccatcatcgtctttgccgtcaacaagttcaacatccccacggaggttattctgtacgccatttcaactggtattgctatcatcccggagtccctggttgctgtcttgaccatgaccatggtcgtggccactgctgttatgagaaaggccaacgtggtggttcgagatctctctgctctcgaggccctcggaggcgtgaccaacatttgctccgacaaaacgggcacgctaacacagggagccatgatcgtcaaaaaggcatggcttcccccgtccagcgtttacaccgtccgcgattccaccaaccccaacaacccaaccgagggcaaagtaactttctctccggatgacaccaaggcgaagaaggaggaaaaggaacgtgactacgaccaggagagaactacccaggccatcaagtttgatgtaccggaaggtgagaaggaaaagccgatgcagcccaaggcatcggagatggatgccgaggtcactcccgacctcaggttgttccttcatgcgaccgcgctctgcaacctcgccacggtccggtatgacgaagaggctgagggctggaagaccaccggagaacccacggaaattgccattcaagttttcgcccaccggtttgaccacggaaagaagtccatcgagggcaagggctggaagcaggttgccgagttccccttcgacagcagcatcaagcgcatgtcagtcgtctacaatgcgcccaaggacaacgagctcgggtattctcccgagaacagcatcgtattcaccaagggtgccgttgagcgtgtcctggatctgtgctcccacattggaaccggcgacgcccagcagcccatgtccgaagaggttagggatcgcattctggaccagatgactgactttgcctcccaaggccaacgtgtccttgccgtggcgtacaagccgtgggatggagagtactctgctccggatgaagcccacaaaggcgatgattccgtccgtgctcaagttgaggacaacctggtactgcttggtctggtcggcatctacgacccgccccgccgtgagacgactggttccatcagcacgtgcgccgaagctggcatcaaggttcacatgctcacgggagaccacccggagacggccaaagccatcgctagggaaatcggcatcattcctcgcaaccttggcgtgctgccggcgggcgtggctgagagtgccgtcatgaaagccactgatttcgacaagctatcagacgaagaaatcgacaacctacaagagctccccctggttattgctcgttgcgcccctgagaccaagacgaaaatgattgaggctttgagacggaggggagccttcatggccatgacgggtgacggtgttaacgatgcgccatcgctcagcagagcggacgttggtattgccatgggatcgggttcggatgttgccaagtctgccgccaaaatcgtgctgactgatgacaagttcaacagtatcgttgctgctattcaggagggtcgccgcatgtttgagaacatccaaaagtttatcctccacttgctgagcagcaacgtcggcgaagtcatcttgctcattgccggtctcgggttccgcgaccaggacggattctccgtcttccccatctcgcctcttgccattctgtggatcaacatggtcacctcttccttcccggccttcggcttgagcaaagagcccgcctctcgggaagtgatgaggaagcccccgcacgaccgcaagaggggtgtgttctcgaaccagattctgtgggacatgatcgtgtacggcattcttatggggacctgcacgctcatgacctttatcattgtcgtctacggcaagtacggcggagatctgggcaaggactgcaaccgcggatacaacgacacgtgcatccctgtgttccgagcccgagccgccgtgttcgccctgctgacctggctgatcctgcttagcgcctgggagttcaagagcatccgccgaagcatgttccgcctcgacccggacaaccacaagaaatttgccgtgtttcacgacctctggtctaacaagtttttgttctgggccgtattgatcggcctcgttagtgttttccccaccgtttacatccccggcctgaacaggaacgtgttcaagcacaccgacatcagctgggagtggggcgttatcattggcatgtccatcgtgtatgtggttggtattgagtgctggaaggccgtcaagcgc

SEQ ID NO: 27375 - DNA, 1918 bp, Neurospora crassa
gaccacgagtacgatgccatcgttgtcggtgccggcggtgccggtctccgtgccgctttcggtctcgccgaggccggcttcaacaccgcctgcatttccaagctcttccccaccagatctcacaccgtcgctgcccagggcggtatcaacgctgcgctcggcaacatgcacgaggatgactggaggtggcacatgtacgacaccgtcaagggctccgactggctcggtgaccaggatgctattcactacatgacccgcgaggctcccgcctccattgtcgagctcgagaactacggctgccccttctcccgtaccgaggacggcaagatgtaagtctctaacccgggaaaccgtgcggtccggagcgcccgaggatgattgcttacagtctacactctctacagctaccagcgtgctttcggtggtcagtccaaggagttcggcaagggtggccaggcctaccgctgctgcgctgctgccgatcgtaccggccacgctcttctccacaccctctacggccagtctctccgccacaacaccaactacttcatcgagtacttcgccgttgacctgatcatgcaggatggcgagtgccgtggtgtcctcgcctacaaccaggaggacggcactctccaccgcttcctcgccaacaacaccgtcctcgccaccggtggatacggacgcgcctacttctcctgcacttccgcccacacctgcaccggtgacggttccgccatggttgcccgtgccggtctccctaaccaggatctcgagttcgtccagttccaccctaccggtatctacggcgccggctgcttgattaccgagggtgctcgtggtgagggtggttacctcctcaactctgagggtgagcgtttcatggagcgttatgcccctaccgccaaggatctcgcctcccgtgatgtcgtttcccgctccatgaccatggagatccgcgagggccgtggtgtcggccctgagaaggaccacatctacctccagctcagccatctccccgccgagattctcgccgagcgtctccccggtatctctgagaccgccggtatcttcgctggtgtcgatgtccgcaagcagcccatccccgtccttcccaccgttcactacaacatgggtggtatccccactcgctacactggtgaggttcttaccgtcgatgagcagggcaacgacaaggttgtccctggtctcttcgcttgcggtgaggctgcttccgtctctgtccacggtgctaaccgccttggtgccaactctcttctcgacttggtcgtcttcggccgtgccgtctcccacaccatccgtgacaagttcactcctggctccaagctgaagcccattgaggccgatgccggttccgagtccatcgaggtcctcgacaagatccgcacttccgacggccccaagagcaccgccgagatccgcctcgccatgcagaagaccatgcagcgcgacgtctccgtcttccgtacccaggagtcccttgatgagggtgttgagaagatcacccaggtcgaccagatgttcgaccaggtcggcatcaaggaccgctccatgatctggaactctgatctcgtcgagacccttgagctccgcaacttgctcacttgcgcgtaagtggcccttgcgatgattttgagaaaaagaattggtgaatatatactgacaaaattgcgaatacagcacccagaccgccgtctccgccgccaaccgcaaggaatctcgtggtgcccacgcccgtgaggattaccccgagcgtgacgacaagaactggatgaagcacaccctctcttggcagaagcagccccacggcaagatcgagctcggttaccgccgtgtcattgacacgacccttgacgagaaggagtgccctcctgttcctcctttcaagcgtgtctactaa

SEQ ID NO: 27376 - DNA, 791 bp, Neurospora crassa
ttcggaaagctcttcgatgggctcttcggcaagaaggagatgagaattctcatggtcggtctcgacgctgccggaaagaccactattctctacaagctcaagctcggtgaggtcgtcacgaccatcccgaccatcggtacgccactcgccatgctcccccccttagtacatattgatggcacagacccactcctcgcgcgagcacgctcactgacatgtttgtccaggcttcaacgtcgaaaccgtcgagtacaagaacattcagttcaccgtctgggatgtcggtggtcaggacaagatcaggcctctgtggagacattacttccagaacacccagggtattattttcgtagtcgacagcaacgatcgcgaccgtgttgtcgaggcccgcgaagaactccagcgcatgctcaacgaggatgagctccgcgacgccctcttgctcgtcttcgccaacaagcaggatcttcctgtaagcgctacccctatctacccgatgcctgccatgttcagcagcaacagcagcagcaacagtcagctaacattgcgtgtttttagaatgccatgaatgctgccgagatcacggataagctcggcctttccagcttgaggcaacgctcttgggtatgtttcgaatttcccttgtctcacatgatgcatgcctttgtgccctaacactaatttttcccttcacgtagtacatccaagccacttgcgctaccaccggtgatggtctgttcgaaggtctcgactggctgtcgactgagttgaagaagaagagcccttaaagt

SEQ ID NO: 27377 - DNA, 3282 bp, Neurospora crassa
tgcggcgcctgcacttcggccgtggaagctggcttcaagggcgtcaatggagttggtagcgtatcggtcagcctggtaatggaacgcgccgtggtcatgcacgaccccgaccagataaccgcggacaaaatcaaacagatcatcgaagaccgagggttcgacgccgaggtgctggccaccgacctcccgacgcctatgatcgccaggcaccccgaacaagacctggaagcttccgatgactccccattaatgatcactactgtcgcaatcgagggcatgacatgcggcgcttgcacatcagcggtcgaaaacgcattcaaggacgtatccggcgtacgacattttagcatttccctactctccgagagagctgttatcgagcatgacccgacactgttgagtgccgatggcatctgcgaagctattgaagaccgcggatttggggcgactgttgttgagagtgtccataagcagcccgagagagaatctgttcccggcgcggcgacatcctcccaaccgtcaaatgcgaccacgacagtagctatcgagggtatgacttgcggcgcctgcacttcagctgtggaacaaggattcaaggatgtgaacggggttctgaaattcaacatcagccttctcgctgagcgagcggttattttgcacgatccaacgttattgccggctgacaagatcgtcgagatcatcgaagatcgtgggtttgatgccaagattctaaccagtacatttgaccagcccagtcagtctgggggtacttcgacagcacaattcaagatctatggaaatattgacgctgccgcggccaacaagctagaagatgcggttcttgcgctgcccggagtcgccagtgccaaactggccattgcgacatccaggctgactgtcacccatttacctaatgttacaggacttcgagctattgtcgagaccgtcgaaggcgctggtttcaatgcccttgtggcagacaatgatgacaataatgcccagctggagtcgctcgccaagacgcgagaaatcaacgaatggaagcaggcgttcagaatctcggctgctttcgctatcccggtcttctttatcagcatgatcttgccaatgttcctgaagttccttgacttcggcaaggtcagactaattccaggtctataccttggagatgtggtctgcttagttctcacgataccggttcagtttggcatcggaaagcgcttctatgtttcggcatggaagtcaataaaacataaatcgccgactatggatgtccttgttgttctcggcacctcgtgtgctttcttcttcagcattgtcgccatggtcgtctcaatattatttcctccgcacacccggccgagcaccatcttcgataccagtaccatgctgatcaccttcatcacctttggccgtttcctcgagaatcgggccaagggtcagacatccaaggcactctcacgcctcatgtccttggctccatcgatggctaccatttatgcagaccccatcgcggcgcaaaaggctgccgagggttgggatcgtaacgcagactcttccgactctcaagagccgcgtgaaggcaatgcagcggatgagaaggtcattcctacagagcttatccaggtcggcgacatcgttctcgttcgtcctggtgataagattcccgcagatggtgttattgttatgggtgagacatatgtcgacgaaagtatggttactggagaagccatgcccgtccagaagaaaaagggaagcctgttgatcggtggcactgtcaacggcgcggggcgagttgactttcgtgtcactcgtgcaggccgggacacccagctcagccagattgtcaagctggtccaagacgctcagacaactcgtgctcccattcaacgcctggcggacactctggctggctacttcgtgccaatgattctgttccttggtatgatgacatttttcacttggatgatcctgagccatgtcctgtccactcccccgaagatcttcttggaggacgcaagtggtggcaagatcatggtgtgcatcaaactttgcatttccgtcattgtattcgcttgtccctgtgctctcggcctcgcaacgcctactgccgtcatggtaggcacaggtgttggtgcggaaaacggcattctggtcaagggtggtgctgctctcgagacgattaccaagatcactcaagtggttctcgacaagactggcaccatcacgtatggaaagatgagcgtcgccaaaaccaacattgttcccgtatggctggataatgactggcgccgtcgtctatggtggactctcgtgggcctggctgaaatgggcagtgaacaccccgtcggcaaagcggtcctcaacgcagccaaaacagagcttggtcttgaggcggaagaaacaatcgatggtaccattggcaactttactgtagccgtgggtcagggcattaccgcagaggttgagccagctacttccctggagaggacgcgttaccgtgtacacgtgggcaacattcgtttcctccgggacaacgacatcgaggtccccgaatccgcaatcaacgccgccgaagaaatcaacgaagccgccgccagctctcgctacaagtccaccccctccaacactccagccggcaccaccaccatcttcattggtatcgacggtaaatacgccggccacctctgtctttctgacaccatcaaagacggtgccgccgccgccatcgccgttctccaccgcatgggcgtaaagactgccatcgtcaccggcgaccaacgcagcaccgctatcgccgtcgcctccgccgtcgggatcgacccggaggacgtctacgccagcgcctcgcccgaccagaaacaagccatcattcaacaactccagtcgcgcggcgccgtcgtcgccatggtcggcgacggcatcaacgactctccagccctcgccaccgcagacgtcggcatcgccatgagttccgggacagacgtagccatggaggctgccgacgtggtgctcatgcggcccaacgacctgatggacatccctgccgcgctgcacctcgcccgcaccatcttccgacgcatcaagatgaacctggcgtgggcatgcatgtataacctgattggcctgccatttgccatgggcatctttttgccgtttgggtaccacctgcatcccatgggcgcgggcgccgctatggcggctagcagtgttagtgttgtggtcagcagcttgttcctcaagttctgggccaggccgaagtggatggataagacgcttaat

SEQ ID NO: 27378 - DNA, 497 bp, Neurospora crassa
agattgcagacggagcttatgcagctaatgacatcgccggcgccgggcgtgtctgccttcccctctgccgacggcaatctcctttcgtggcgggctaccatcgagggacctgaggataccccttatgccggcctcaccttcaagcttagttttgaatttcctgcgaattatccttacgcgccgcctacggtgctgttcagaaccccgatctaccatcccaacgtggacttttctggacgcatctgtctcgacatcctcaaggataagtggactgctgcttacaacactcagaccgtccttctgagcttgcaatccctgcttggagagccgaacaagtaaggacttcacatgctctctcattcaatttctacgagatcagagctaacacccatcacagtgcttccccgctcaacggcgaggcggctgagctttgggacaaggacccgaccttgttcaagaccaaggtcatggaccgtcacagggacattgacgacgac

SEQ ID NO: 27379 - DNA, 654 bp, Neurospora crassa
catccaaacgtgattgagtggttcgctactggcgaagacaggatctggagatggattgccatggagtatgctgaaggaggtgaccttttcgacaagattgaggcagatgttggcctggaggaggatattgctcacctctactttcagcaactgatcagcggcgtcagttttatgcattcaaagggcgttgcccatcgcgacctcaaacccgagaacatcctcctttccgagagcggcatcctgaaaatcgcagactttggtatggccaccatgttcgaatacaagggtgcacgaaaacaaagttcgaccatgtgcgggagcccgccttacatcgctccggaggttttacattgtgcgaggcagagggaacgaagggcaccatcgtccgagcagaccaagtactcggccgatcttgtcgatatctggtcctgcggcgtcattctcttcgtcctcctggtcggcaacaccccctgggatgagcctactcccggtaactgggagttcaaagaatatgtccgcacaagcggccggagcaccgacccgctctggcaacgggtgccctctgacgccctctcgctcctccggggcatgatgaacatcgaagccaacaaacgcttctccttcacccagatccgccaacacccctggtacacg

SEQ ID NO: 27380 - DNA, 7896 bp, Neurospora crassa
atgacgagaaatgacggcggctcccgctacagctccatcgacagcgcacaatccagcatcacggcgaagccatttcccttgacgccgaccagcagcctgggcagctcgatgacacggccgctgtccccgtcgctgcaagcgggcagcagtagcagcaatggcggccacaatgtatctcggtccgcctcacagggtgcgcgcaggcctgcgccgacgcgtttgaagacggatgacggcacccaatttgcgaggtgagttgaagcgagcgacgcagtctgttgtttcctgggggcttcgtggttctcgagcggttctgtgatacggatacctacccagtcttgcttgcacagtcctgtcctgtcaccgcaactatccggaaaccccgttcttctttgccgtcccttctcttacaagtcaagcctgttcttgccctattttcctgcagttcaaactaacgggtgcatgcgtcggccgcccatctacagcaggtcatcgagagatttcgagtcgtcgcagtcccagtcgcagccgtcgcatacgcagacgcggtcgcactcactgtcacaggccacgcttcaatcatgttcgcagccgcagttgtcattgaattcccagcagtctcaatccccttctcagtaccactcgcagcagacgccgacacagcaacaaccacagcaacaagtatcgcccacggggggctcgcgcctgacccagtcgcccactacaccatccaatgcgtctatccgcgaacacagaatgagcgagctggggggatatcgtcgtgaaatggcggccatgttggacaccacaggcggcgcattgagccgaacgtcatcgcacagtcagcagcagccgcagcagccgcagcaacaacaacaacagcagcagcagcagcagggtcacgctgcaggatcagtttcgggtaccttcagcaacctcagccagtacgcaccgtatctggggggaaacaacggcggcgggatgtccatgggcagcttcctcaatgactctacggataatctgtcggtaatatcgcagctatcgccgggcatccggccgatgacggcacggccttcgcaggcgtcggcaggcagcatggagtttccggattcggcgtactacgacgatgagcggcggccgtcgattgcttcaatcacgacgacggcgagcagccaagggtcgcggacttccaagacccggggcgggctacagaagctccagcagttttttggcgatcgggacgattggcctggccgagattcgtcggaaattagcctgccccagccgagtcactcgggccccatgtccacagggaaggaacaccgatcacactcttacagcctaccaggcagcggtcgctcgcaccgggaccgcaactactccaatgccaccgatcaccatccctccacctttggctccgtctcgactgtcggcgggcgagatagggatgcctcgcccgtgccctcgaggccgcgaaccccagtgcctgcgcccgaagttgtgccgtttctgtaccaagaagccgacgtacgtatagcctcgctctctctttctctctttctctatttttgttttcttttgtaatttactgttttcgatcttcccttccccctcttcgctctccccctccccccctcttccctcccctctctcgtaaagtgttgtggtggtagcttggtaagagatacaggagcagtagtatcactaaaggtaccctacgctacttatacctactagctactaccctcgcttcgaccccatttccacacctcgccaaatcttatctctggccttctctttcctatctccaccccgagctatcccttttgggaatcgcgaattggatgagtagcagtgggatcaacattggcaatggccgccggccgtctcattctttgctccaaacgcaaccctcgtttgacgcttcctgcaacatgtcggcggtgagatgatccctcctgccatcttccgtcttcaagttcacaacaaccacattaacaaggagcccaaggcaatggctgcggaatcttttacacaacaatgacaacgacagcctgccagtgaggtgtcgttgttgccctgctccaatcccgagaaacccgctctttgctgctatcctccagtctggactcctcctgcctgccgtgcctaccaatccgtattatacaaattgcacgagtgatctctgtcgccgtaactgaccattgcatgaaacacaggacatcgctcgctatggcgaagcacccgttcgaacaagtctcactggccccgatcgcgatcgttacatcgacagctcccagaacccaccaaagacctcgtcttccgcccggtcaggtcactccatcgtgcacctaccgggacatcataaacacaacaagagtaacgaggatccaagggctttgaagccatcgcttagcagggaggattcggcagccagtttcgctagggattttcgcaacggttccagctctatgatgggcacccgatctcgcgcacagagtccagcgcccagttggacagggacgtcgcggggactcaaagccaacagtatttccgacggaacatcatctccagctccatcgcacaaaaagggcatattgggtcgcttccgccggcacaacaaagacaaggaagatggctccagccttcggagtggctcaaaccacactcttgtacaccgcccgtcgagacaagaccttacccgcgccgccgaatccacctacccagcatccgtctacgtttcggaccctagcgagcagcgagaggtccctgtccgccctggctatgtgcgccagacgacggcgccggggttcaccacgaaactctttacctctaagaaatcgagctcggccaaacagccccaagatgacatggacgaggacattgggcccactgacatgcacatgggaggtggaaccgtctatcatctcgatacgaaccttaatgatatggagggaattttgaccaagcctcaacccatgacccccttggacaacagcatatcaatgcgacgcgaatcagaaaagatgattgtcccgatcacgacagatccggagggcgcatgggctgccccggacagttgggcagtgcgcgacaacaaaaagtctctcgcccctcaggtaaatgaagacttgtgctcacgtcaacctagcgaggaaaaggagaagaaaagcaattattacattcgtgtctttaggtcagatagcacctggactacgctcaccctgcccttgactgcgacagctgaggatgttatcatgggtgtggcgaaaaagacttatctccctccgggtgctcaggacagctactctctccttatcaagaagcacgatttgttcagggtcttgaatagcgccgaacaacccttgagaatccaaaaacgactctttcagcagataggttatcaagaaaaggatggcattgacgaaatcggtcgcgaagataacagttacatttgtcgatgggtcttcctcaaggagaaggaagccgacatgcatttgctctcacctgacatcaacttcaggaaccagaagctcaatcatgttgacctgtctgggcgcaacctaataaccataccggtaccattatatcgcaaggcagcagagattgtatcccttaatctgtccagaaatctgtccttagatgtccccagagactttatacaagcttgcactgctcttcgggacatcaagtacaacaacaacgaggcgcaggccttgcccaagagcttcgccacggccagcaagcttacctatctagatgtgtcaaacaatcgcctccaggatctggatcatagcgaactgagcaagctaacaggcctgctcaagctgaacctcgccaacaactgtttgcgcagtctaccccctacgcttggagcctacaagtcgctgcgaacacttaatatatcttccaacttcctcgacgtcttcccgtccttcatctgcgagctggaaaccatcgtcgacctcgacctcagcttcaattcaatcaacaaccttcccgataacttgatgaagttgagaaaccttgagaagttcgtgatcactaacaaccgactgtctgggcctatatccgagagcgtgagggacctagtcagccttcgggagttggacatcagatacaaccagatcagtaccatcgacgtcctttctgacctacctcggttggagatcttatccgccgatcacaaccagatatccaaattcagtgggtcctttgaaagacttcgaagcttgaaactcaactcgaatccgattgtcaagtttgaagtcaaagcacctgttcctaccctcaagatcctcaacctgtccaatgcgcagttagcgagcatcgacgaatcaatcgacaacctaatgaaccttgagaggttgatactcgactctaattacttcgtctccctgccaaaccaaattggtaacctcaagaaacttgaccacctcagcatggcaaacaaccacctcggagagcttcctcccgaaatcggctgcctgacggagctccgaacgttagacgtccacggaaacaacatgcgcaaacttccgaacgagatttggtgggcgaacaagctcgaacacctcaatgcatcctccaacatcttgacagagttccccaagcctgcctcgcgtgcgccacaagcgccaggagaagctagcccatctccaggtgcatatcccttcccgaacgccaacaagaacggactcctttcgcggacacctagtatggacgaccttaatggggatgcgtcgcgacgccctagccaggcttccagcacactcctcggcgttgctgtgtcacccgtgccatcaggacccgacaataggaagagctccatggtgtcgctgtatgggaaaggagggcgcaagacctccgtcgtatcacgaagtacaacgcagagcagcactggagtaataaccccgagtaacggccctaggaaagactccagtctgtcttaccgattcacccacacgttttcgggatctctgaagaacctctatcttgcggacaaccagctagatgacgacgtcttcgaggagctcaagcacctccctgaacttcgagtactgaacctttcctgcaacgatttgagcgacatgccccaaggaacgatcaggtcctggcctcagctcgtggagctgtacctttctggcaacgaacttactagtttacctgcagaggacttcctagaggagcactgcctcttacagactcttcacatcaacggcaacaagtttatcaacctacccgcagaaatatcgagggccaagaaacttcaggttctggattgtagtagcaataatctgaagtacaacgtcaccaacgtgccctacgattggaattggaatttcaaccgcgatttgcggtacttgaacctttctggcaacaagcgattggagatcaagaacaattaccgtcagccacaaagctatagagacgatgattttgctgacaccgacttttcgaagctgacgaatcttcgtgtgcttgggttgatggaagtaactcatactttacccaacatccctgaccaaacggaagaccgccgtgtcagaacctccgaaatgaaggccggtgcatatctaccgtacggcatggcggacacgctgggcaaaaacgagcacttgtctcttttcgaccttgtcgtacctcgcttgggttctgtggaaaccgatacgctcgtggccttgtttgatggcaaagagctcagcactggtggctccaagattgccaaatttctctatgaagagtttagcagactgttcatactggagcttgagaaggtcaaggggaagccgaacgagaatccggcggatgccctgaggcgtactttcttgtcggtcaacaagcttctcatgagcctctctaacagcgcagacgaaagggggcttgactcgcaccctagcaggaattacgcccatacggtcctgaccaaggaagaccttaattccggctgtgtagctaccgttgcttatttgagcgagctgaagctctacgtcgccaacgttggcgatgttcaaggcatgctcatccaagccaacggttccttcaagatgctaaccaaaaagcatgacccggcggacccagttgagcgcagtcgcattcgaaatgctggaggctgggtttcgcgtaacggacgattaaacgatgttctcaatgtgtctcgtgcgtttggttatactgagctattaccagcagtgcaggcagcacccgacatcaccgagcacaccattgacgacaaagatgagacagtgctcattgccagcaaagagttatgggagcatcttcggccagagctcatcgtggatgtggcgcgtgagtgtcgcagcgatttgatgaaggcgtctcaaaagcttcgcgacctcgcgatagcctatgggtcaaccaacaagctcttgatcatgatgattggcgttgcaaacctaaagcaacggcaagcgcagcaattcaagggacagcttaatgctactttctcgatgccgcaagatgatcctagtcatgtgccaccgagcgggaacaagaggaggaaggtgagggccgaaggacccctggactctaatctcatgcgccttaacgcggaagtcccgcctcctacaggccagctgtccatcgtgttcaccgacatcaaaaactccacgcaattatgggaaaactatcccgaagccatgaggttggcgatcaagcttcacaatgaggtgatgcggcgacagctcaggatgattggtggcttcgaagtcaagacggaaggagacgcatttatggtttctttccccacggccacgtctgccttgttgtggtgctttgccgtgcaaatgaaactgctaacagtggattggccccctgaagtactgagtaacagcagctgccagcccatttatgaccgaaacaataacctcattaccagaggtctctcagtccggatgggtgctcattggggtgagccactagctgagcgagatccggtcacaagacgaatggactattatggacccatggtcaacaaggctagtcgtatctccgctgtcgctgatggagggcagattaccgcatcgtcggatttcattacggagattcatcgatgccttgagacctataaggagtcggttgatgttgacgaggactctttggaggacgatgctactgcaaaggccatccgagctgagctacgggcattgagcagtcaagggttcgaagtcaaggacatgggcgagaagaagctcaaaggccttgagaaccctgaactcgtatactcggtatatcctcatgcgcttgtgggcagaacggaacaacaccatgcccatacagaaagcacgcagaaccaggccgcattgcagccctatggcgctcttgcaacgcctaagccggcgactatggatcccgacagcgagatacagttcgagccggagacgatctgggcgttgtggcgtgttgcgctacgccttgaaatgttgtgcagtacgctcgaggagcctaacgcccgcggacttcaggcaccagagaccgagctattggagcgcatgaagcaaagggctggagaggttacggaccactttcttctaaacttcatggaacatcaaatcagccggatcgaggtatgttgagcccaaacaaaaacctttgtgcgacgaatcaagagactaaagttcctatttacagacatgcatcacttcgctcgctgttcgccacatagcaatcggcagcggaccaatcaccaagctgaatgatcttcgggcgccgatgaacgatgttctcagcactctgaaggaacaaatggacgagctcgcgcggtacaaggccaaatacgggtctttggaccaagctgagaccgatgatgccacagacaacaactcaagcggcgacgtcgacacgctagatggaagtgatacagagcaagaataatca

SEQ ID NO: 27381 - DNA, 1774 bp, Neurospora crassa
ggaaacagctactgcaattcgatccttcaagcgttatactattcggaacctttccgagagaatgtcgttaactacccgccttcaaataacacgtcagaaggcaatacgagcaaggtcaaagtctcgatacggccaccggtacaagtcaacggaaatgcggcgacgcccggcaagcaattgcccaaaccgcggcaagggttcactcctggaccaataccgatgccaataacgcaaccgatacgacccgaagacaggcctgatgccccagaatacaagaaaaagcaggccatgattaaaggacccgtgttggagttgacccaggaaaatccagatgcgtacggcatggaggaatgcacgttcaccgggctcaaggatatttttactgctctgattcaaagcaactccaggaccggtgtcatcagcccacagcgctttctggatatcttcaagcgcgacaatgaaatgttccgcaattctatgcaccaagacgcacacgaattttacggccttgtattgaacgatgttatctcgaatgtggaggcatatgctaggcgtatgcaggagagcaggaaggagattggaacgacatcgtctccattgaaccaacaatcgtcatctccaagccttacgaggagcttgatggcatccaacctcaggacgccagagacaagctgggtgcacgacatttttgaaggcgtcctagtttccgaaaccaggtgcttgacttgcgagacggtgtcacaacgagacgaaacgtttttggatctctcaatcgatctggaagagcattcttcggtaacgtcatgcctacggaaattttccgcagaggagatgctttgcgagaggaacaagtttcactgcgatcgttgtggcggcttgcaagaggccgaaaagaggatgaagattaagaagctaccaaaggttttggcgttgcatctgaagaggttcaagtataccgaggactacagccgactccaaaagctgtttcatcgtgtcgtctacccatattatcttcgcatgttcaatacgacggacgatgctgaagacccggacaggatttacgagttatacgcagttattgtccatattggaggtaacgcctaccacggacactacgtgtcaattatcaagaccaaggatcggggctgggttttgttcgatgacgaaatggtcgagcccgttgacaagaatttcgtggcgaacttctttggtgacaagccaggcatggcttgcgcctacgtactattctaccaggaagtcacctttgagaagatgagggaagagttggatgccgaaggactagaagagatgaggttagccacccaagcagccgacctggcagccggtgcggaacaaacgaacgggaccggaaatgactccttaacaaaggtcaacagtcagccgacagtaccggtcgaagaccttgacccatcggtaagccttgctcacgcccaaacagctccaggcggaattgccagtatcttacaatcttcaacgccgacccagacccccggacccgagcctttctcccatcctctagttgcggcaccacctccggcccctgccgtcataacgaaggcggacgaggcggccacggttccgcccaaatccaaggatgaacttaccaaggagaaaaaggaacagaaagcccaagagaaagcacaggaaaaggcccgaaaagccgccgagaaagaggcagcaaggctcgcagaaaaggagcgtctcgagaaggtcgcaaagaagcgcggagtacagcaaaaagagcaggagcagc

SEQ ID NO: 27382 - DNA, 810 bp, Neurospora crassa
gactacggcaacgaggttgagtgcggccagggtgtagcccgcgccatcaaggagggcatcgtcaagcgcgaggagctcttcatcgtctccaagctctggaacaccttccacgacggcgaccgcgtcgagcccatcgtccgcaagcagcttgccgactggggtctcgagtacttcgatctctacctgatccacttccccgtcgccctcgagtacgtcgacccctcggtccgctaccctcccggctggcactttgatggcaagagcgagatccgcccctcaaaggccaccatccaagagacctggacggccatggagtcgctcgtcgagaagggtctctccaagagcattggcgtctccaacttccaggcccagctcctgtacgacctcctgcgctacgccaaggtccgccccgccactctccagatcgagcaccacccctacctcgtccagcagaacctcctcaaccttgccaaggctgagggcatcgccgtgaccgcctactcctccttcggccctgcttctttccgcgagttcaacatggagcacgcccagaagctccagcctctcctcgaggaccccaccatcaaggctattggtgacaagtacaacaaggatcctgcccaggtcctcctccgttgggccacccagcgcggcctggccatcatccccaagtctagccgcgaggccaccatgaagtccaacctcaactctcttgatttcgatctctccgaggaggacatcaagaccatctctggtttcgaccgcggcatccgcttcaaccagcccaccaacgtaagtttgatacttcct

SEQ ID NO: 27383 - DNA, 885 bp, Neurospora crassa
gatctcctcgacaacgagcccctcgataccgatgagatcatttgcacccactcccgcattcagtccatctcagcattgcgtcttgagcgcttcaaacaagttgcccgcatttgccttcgccaaaacctgatccaagatatcgaaggcctcgccgctgtcgccgagaccctccaagatcttgatctttatgacaacctgatttcgcacatcggccgcgggctgactgacctcacgaatctgaccagtctggatctaagcttcaacaagataaagcacatcaagcacatcaatcacctgaccaacctgacagatctcttctttgtttccaacaaaatcagccgcatcgaagggttagaaggactcgacaagctgcgcaacctcgagcttgggtcgaatcgcattcgcgaattgcagaacctcgactcgctcaagaacctcgaagagctatgggtggccaagaacaagatcaccgaactcaccggccttggcggccttcctaagctgcgtctgctcagcatccagtccaatcggattcgcgacctgtcccccttgcgcgaggtaccccagcttgaggaactgtacatttcgcacaacgcgctcgaatcgctcgaagggttggagaacaacaccaagctgcgggtgttggacatttccaacaacaagatcgccagcctgaagggcatcggtcccctcgaggagttggaggagttgtgggcgagctataacatggtcggcgacttcgccgaggtggagcgagaactgaaggacaagaagaacctgacgacggtgtattttgaggggaacccgttacagctcagagcgccggcattgtataggaacaaggtccggttggcgctgccgcaggtgcagcagattgatgctagt

SEQ ID NO: 27384 - DNA, 923 bp, Neurospora crassa
cccgcagataccatcaaggtccgcatgcagctctccaagcgcggccgcgtgcccggccaagccaagcgtggcttcatccgcaccggtgtcgagattgtcaagaaggagacggcgctcggtctttacaagggtctcggtgccgttctgacgggtatcgtccccaagatggccatccgtttcacctcgttcgagtggtacaagcagctcctggccgacaagcagactggtgttgtctcgggtcaggccaccttcttcgccggcttggctgccggtgtcaccgaggccgttgccgttgtcactcccatggaggtcatcaagattcgtctgcaggcgcagcaccactccatggctgatcctttggacgttcccaagtaccgcaacgccgcgcatgcgctctacactgtcgtgaaggaggagggttttggtgcgctttaccgcggtgtttccctgactgcgctccgccagggttccaaccaggccgtcaacttcactgcctacagctacttcaagaagtggctctatgattaccagcccgaatatgtcggccagaacctgccctcttaccaaaccactcttattggtctcgtttctggtgctatgggtcctctctcgaacgctcctatcgataccatcaagaccagactccagaagagcgttgctcagcccggcgagacggcattccagagaattaccaagatttctgctgagatgttcaagtgagtaaccttccattccctttccctttcagcatctcaattaccgtgaaggggcaggttgctgatgcaaatgcgacaaacaggcaagaagggttccacgccttctacaagggcatcaccccccgcatcatgcgtgtcgcgcccggtcaggccgtcacatttactgtctacgagttccttaagcagaagctcgagcggagcggtcct

SEQ ID NO: 27385 - DNA, 6905 bp, Neurospora crassa
tcgtatgccgccaagcacaacctggccccccatttcattggcggcaacaggcttgagaatgcccctccctccaaggtcaaggactttgtggcctcccacgatggtcacactgtcatcaccaacgtacgtttcctcgctctcccggcagtccaacgcacattccgctaacatttgcttgttttccaggtccttattgccaacaacggtattgctgccgtcaaggagattcgctcagtaaggaaatgggcttacgaaacattcggcgacgagcgcgccatcaagttcaccgttatggccacccccgaagatctgcaggccaacgccgactacatcaggatggccgatcactatgttgaagtccccggcggcacaaataaccacaactatgccaacgtcgagctgatcgtggatattgccgagcgtatggatgtccacgccgtgtgggctggttggtgcgtagacaagagtcctgcctctggggttgatggtatgaaaatactgactgttcgaataggggtcacgcctccgaaaaccccaagctccccgagtcccttgcggcttcccccaagaagattgtcttcattggtcctccgggttctgccatgcgctcccttggtgacaagatttcctcgacaattgttgcccagcacgccgacgttccctgtatcccttggtctggtaccggtgttagcgaggtcaaggtcgacgacaatggcattgttacggttcccgatgacgtttacctcaagggctgcgtcagctcgtggcaggagggtctggaaaaggccagggaaattggtttcccagtaatgatcaaggcctccgaaggtggtggtggcaagggtatccgcaaggtcctcaacgaggacaacttcgagtcgctctacaacgctgccgctagcgaaattcccggctcacccatttttatcatgaagctcgccgacagcgccaggcatttggaggttcagcttcttgctgatcagtacggcaacaacatctcccttttcggcagagattgctcggtccagcgcagacatcaaaagattatcgaagaggcccccgtcaccatcgccaagcccatgaccttcaaggccatggaggaggctgctgtccgtcttggtcgtctcgtcggttacgtctcggccggtaccgtcgagtacctctactcccacgccgatgacaagttctacttcctcgagttgaacccccgtctgcaggtcgagcatcctaccactgaaatggtcagtggtgtcaaccttccggctgctcagctccaggttgccatgggtattcccctccaccgcatccgcgacatcagactgctctacggcgtcgaccccaggactgccagcgagatcgacttcgagttcaagaaccccgagtccgagaagacccagcgcaggcctacccccaagggccacaccactgcctgccgtatcacctccgaggatcccggtgagggtttcaagccatccaacggtgtgttgcacgatctcaacttccgttcgagctccaacgtctggggttacttctccgtcggttctgccggtggtattcacagtttctccgactcgcagttcggtcacatctttgcctatggcgagaaccgtgccgcctcccgaaagcacatggtcgttgccctcaaggaattgagcatccgcggtgacttccgtaccaccgtcgagtacctcatcaagcttttggagactgaggccttcgaggagaacaccatcactaccggctggctcgatgagcttatttccaagaagctcactgctgagcgtcccgaccccattctggccgttgtttgcggtgccgtcaccaaggcccacattgcgagcgaaggctgcatgaccgagtaccgtgctggccttgagaagggtcaggtcccctccaaggacatcctcaagactgtcttccccgtcgactttatctacgagggttaccgctacaagttcaccgtcaccaggtcgagcgccgatagctaccatctcttcatcaacggctccaagtgcactgtcggcgttcgtgctctgagcgatggtggactcctcatccttctcaacggccgcagtcacaacgtttactggaaggaagaggtcgctgctacccgcatgtcggtcgatagcaagacctgtctgctggagcaggagaacgatcccacccagttgcgcaccccctctcccggtaagctcgtcaagtacaccgtcgagaacggcgaacacgtcagcgccggccagaccttcgctgaggtcgaggtcatgaagatgtacatgcctctcattgcccaggaggatggtatcgtccagcttatcaagcagcccggcgctactctcgaggccggtgacattcttggtatcctcgctctcgatgatcccagccgtgtcaagcaggcccagcctttcctcggccagcttcccgagtttggtgcccctgttgttgtcggcagcaagcccgctcagagattccgccttctctatgacactcttcagaacatcctcatgggctacgacaaccagatcatcatgcagcagaccctgaaggatctgattgaagttcttcgtgaccccaagctcccttacagcgagttcaccgctcaattctcagcccttcatgcccgtatgcctcagaagctcgacgcccaacttactcaggtcctcgaaaaggcctcttcgcgttcggccgagttccctgcccgcaatctcggcaaggtcttccagaagttcctggacgagaacgttgcctccaaggttgacgctgagctgctgaagaccaccttggcccctctcaccaccgtcatcgaccagtactctgagggccagaaggtccatgagctcaatgtcattcgcgatcttcttacttcttacgtcgaggtcgagcgtctcttttctggccgtcgtctgcaggacgaggaggttattctcaagctgcgtgatgagaacaaggaggacatcaagaaggtcacccagactgttctctctcacagcagggttgcggccaagaactcgctcattctcgcgattctggacgagtaccgccccaacaagcccaacgttggcaacgtcagcaagtaccttcgtcccgtccttcgcaagcttgccgagctcgagtctcgtcagactgccaaggtttccctcaaggctcgtgagatcttgatccagtgcgctttgccctctctcgaggagagaaccgctcagatggagcacattcttcgctcctctgtcgtcgagtctcgctacggtgagactggctgggatcaccgtgagcctagcttggacatcatcaaggaggttgtggactccaagtacactgtctttgatgtcctgacccttttctttgcccacgaggatccttgggtgtccctcgctgcccttgaggtctatgtgcgccgcgcctaccgcgcttacgttttgaagaagattgagtaccacaccgatgagaccgagactccttccttcttgtcctgggatttctctctgcgcaagcttggccactccgagttcggcctgcccatccagtccgctgccccctccaccccgggtacacctgtggacagcaccttcaagcgcatcagctctatcagcgatatgtcctacctttcccacaagactcaggatgagcctacccgcaagggtgtgatcattccctgcaagttcttggatgatgcggatgagctcctcagtagggctcttgagaagctccccgtgctcggagcccgcaagagaaacagcgtgattcccgatctcaacgagaagcgcagacctcctcttcagcgcctggagaccttcgacgagctctccgctgtcgtcaacgttgccgtccgtgatgccgagggtcgcagcgacgaggagattcttaaggagattcttcctcttgtgcaccaacacagggaggacctgtttgcccgccgggtccgccgcatcacattcgtctgtggtcgcaacgatggctcctaccctggctacttcactttccgtggccctgagtacgttgaggacgatagcatccgtcacagcgagcctgctcttgcgttccagctcgagctcggacgtctgtccaagttcaagatcaagcctgtcttcaccgagaacaagaacattcatgtgtacgaggcgattggcaagggtgtcgagaccgacaagcgctacttcactcgcgctgtcattcgtcctggccgtctgagggacgagattcctactgccgaatacctcatctcggaggccgatcgcgtcatcaacgacattttcgatgctcttgagattatcggcaataacaattccgatctcaaccacatgttcctgaacttcactccggtcttccagcttcagcccgaggaagttgagcactccctccagggcttccttgaccgcttcggccctcgtggctggcgcctccgtgttgcccaggttgagattcgcatcatctgcactgaccctgctactggcatgccctacccgttgcgtgttatcatcaccaacacctccggctatgtcatccaggtcgagctctacgccgagcgcaagtcggagaagggcgagtgggtgttccactccatcggtggcaccaccaagatcggctccatgcacttgctgccggtcaacacgccgtaccccaccaagaactggctccagcctaagcgttacaaggctcacctcatgggcacccagtacgtctatgacttccctgagctcttccgccaggctatccagaacagctgggtcaaggctgtccggatggactcgtctcttgccgacaagcagccccctgttggcgagtgcattgagttcagcgagctcgtgcttgatgaccacgacaacttgatcgaggtctcgcgtgagcctggcaccaacacttgcggcatggttggatggctcatccgtgcgagaacccccgagtaccccaacggtcgcaagttcgttgtcgtcgccaacgacatcaccttcaacatcggctcgttcggtcccaaggaggacaacttcttcttcaagtgcactgagcttgcccgtaagctgggtattcctcgcatctacctgtccgccaactcgggtgcccgcttgggtctcgctaccgagcttatgcctcacttcagcgttgcctggaacgaccccagcaagcccgaggctggcttcaagtacctctacctcgacgatgcgggcaagaagcgctttgagaacactgtcatcaccgaggagattaccgaaggagacgagaagcgccacaagattgtcacgatcgttggtgctgaggatggtctcggtgttgagtgcttgcgtggctctggtctcattgccggtgccaccagcagggcctacaacgatatctttacctgcacgctcgtcacctgccgctccgttggtattggtgcttaccttgtccgtcttggtcagcgtgctgttcagattgagggccagcccatcattctcactggtgcccctgccctcaacaacgtcttgggtcgccaggtctacacctccaacctgcagcttggtggtacccagatcatgtaccgcaacggtgtctcccatttgaccgccaacgatgactttgctggtgtctccaagatcgtcgagtggatgtcgtttgttcctgacaagcgcaataaccctgtgcctatcagcgtcagtgtcgacacttgggatcgtgacgttgtctacaccccgcctcagaagcagccttacgacgtcaggtggatgatcggtggcaaggaggacgagaacggctaccagcctggtctcttcgacaaggactccttcgtcgagactcttggtggatgggccaggactgtcgtcgttggtcgcgctcgccttggcggtatccccatgggtgtcatcgctgtcgagacccgctctgttgagaacatcactcctgccgatcccgccaaccctgactcgatcgagcaggtggccaacgaggctggtggtgtctggtaccccaactccgccttcaagaccgcccaggccattaacgacttcaacaatggcgagcagcttccgctcatgatccttgccaactggcgtggtttctctggtggtcagcgcgacatgtacaacgaggttctcaagtacggttctttcatcgtcgacgccctcgtcaagttcgagcagcctgtcttcatctacattcctcccttcggcgagcttcgtggtggctcgtgggtcgtcgtcgatcccaccatcaaccctgtcgccatggagatgtatgctgatgtggatgctcgcggtggtgttttggagcctgagggtatcattggtatcaagtaccgcaaggacaagcagcttgagactatggcccgccttgaccccgtctatgccgacctcaagaggcagagcgccgatgccagcctccccaaggaggagtctgatgcgatcaagcagaagatgactgagcgcgagcagcagcttctgcccgtttatgctcagatcagcgtgcagttcgctgatctccacgatcgcgctggtcgcatgaaggccaagggtgtcattcgcgaggttcttgagtggcagaacgcccgccgcttcttctactggcgtgtgcgcagaagactcaacgaggagtacattctccgtcgcatcatctcggctactactcctggcggtgccccaagcaaggctctcactgccagctcgaccaaggagcgcgctcgccacctccagcttctccaggcctggagcggcattgagaagttcgacaccgccgaccgcgaggttgccgtctggtacgaggagaaccgccacctggtccagactaagatcgatgccctcaaggccgaggcgatcaccacggagatgcgcgacctcatccgcgctgcctccaagggctctgatgacgctgcctggaagggtgtccgtgatatcctgagcgttatgccggttgaggagagagagaaggtcgtcaagtaccttact

SEQ ID NO: 27386 - DNA, 954 bp, Neurospora crassa
ggcggtcccaaccacgtgcgcaccggtttccgattctggcgagaccccggcgcctttgcccagtattcggcttcggcaggcgacgacaaagtggtgattcctggtgccaccggccgtttcttgggtgtctgggcttgcatggtccaggccacctttgcctacctcggtactgagctcgtcggcgtcgcgttcggcgagacccccaacccccgcaagaacgtccctcgcgccgtcagccagacactcatgcgtattgtcttcttttaccttggtggcatcctcgtcttgggcatggctgtcaagtacactgaccccctgctcggcgctgtcaagaagaccagcggtctggcttcccccttcgtcatcgcggccaagaacgctggtatcaacaagctcgacgacgcggtcaacggactgttgctcatctttaccgtgtcggctgccaactcggatatctaccttgcctcgcgtaccctttgggccttggccaaggacggacaggcgccgggcatcatgaacaagaccaacaagcgcggtgtgccggttccggccgtcatcctgtcctccttgttcattcttcttggatacatgaacgccagcaagggatcatcgaccgtatttggctactttgtgtcgctcgttacggtctttggggccctgaactgggttgccattcttgtttcttacctcttcatgatccgggcgatgaaggtgcagggcgttcctcgcgaggtcatgccgtacaggaatatcttgctgccgtggggcgccccgattgcgctgttcctgaccatcctcattatcattttcaacggatttggcgcgttcttcccgcacttccaggtggacaagttcttgacgagttacattggtattccggtgttcttgatcaacattgggtggtggaaggtgttcaagaagaccaagagggtgaggccggaggatgcggacttg

SEQ ID NO: 27387 - DNA, 2220 bp, Neurospora crassa
gttcatgtgccggcttcgttcaaggttgtttctggtgaggttgagaatccagcttcaagtccatcttcgcccaagatcgcagccgaagagatggacattccgcgctcaccttcgcctgtggataacctggatgttaccgagcttcaacatcagcattcaactcagatcattccaccccacactcaacgctccgtgttgcctacagcccaaacccaggccgttcccgaagagattcagcttcctgcttcgccattggaacagttcacgcctgaggaggttgaactgccacgttcatcttcaccagtggaggcgaaattggatatcgtcgagatgcagcatgaacactcggctcagatccttcccctgtacgttcagcgtgctgattcaacttggggtgaggttgatcctgaggacgttgatcttccgactgggcctctaaaagagattatgcccgcggaggctgagctcccgggatcgccatcgcctgtcgaagatgaattggatggcgccaagcttcaagccgctcacgaagaagttgagctccaagcttctgagcctacctcgcccaagatcacaccggaagaaattgaggttccacgctcgccgtcgcctttcgatgagtccaagatcactgagcttcagcatctgcattcggcccagatcattcccaggaatatccactatgcgacttcctcttccggctcgccaaagatcattccagaggaagttgaactgcctgcttcgcctgtggaggaagtggacgttgatgaacttcagcgattccactctagccagatcatttctccgcatattgagcgctccgcttcgccaactattgaggaggttgttcctgaggaggttgaacttccagtttcgcctgtggaacaagtggacattgagcagctgcaacatttgcactcgcgccagatcattcctccgcatattcagcatcccgcctcgccttctcctaacgctgaacttctggcctcacccaaggttactcctgaagaggtagaactcccggcttcgcctgaacttgtccctcaagatatcgagcttccagcttcgccaatcgacgaggctgaacaagctgaacttcccattcttactaaagaatccgaggccagcgttgatcaacaaatcgatgacttggaggaggaggaggatgctaggagtgccgctcttgaactcccatcctctcctgaagtcaagcatgaagttcagcctgaagagatggaattgcctctttcgcctgttttgaagcctgaggaggttgatcttcctgcttctcctgaggttgttcctgaagaagtcgaactgccggtttccccggtggatgatttggctgatgtgcagcaccttcctcaacccgacgatgtgccagaggaagctgttcaggagaatgtcaatcttgagattccgtcttcacctgtaattgcacccgaagaagtcgaactcccactttctcccaagacagcccctgaagaggtagatgttcccgcttctcctgtggttgaggtcgaagaacagcctgcaaccgtctctgagccgtctgaacggagcatcaatcttgaagccgacattgccccacaagaagagatcgagcccccgttctctcctgtcgcaaagcccgaggatatccagcttcctgcctcccctgaagtcatccctgaagatgtggaactgcccctttctcctatcgttgagttggaacatcagcttcccattgagcctgtcaattttgagctcccatcttcgcccaagcttaagcccgaggaccttgagctaccttcttcgcctgagatcattcctgaagacgtagagcttcccgcttctcccgtggttgagttggcagatgaacagctgccagtcgagcctgagcaatctgcgcaggccattgaagtttccgaagaggataccaaactcccgtctacgccaatcgtcaagcctgaggacttggaacttcctgcttctcctgaggtgctggctcaagatgtggaacttccgccttcgcctgtcaccttatccgaagatgtggaacttccgccttctccgatggttgacttggaacatgagcagctctcagttgagcctgtcgatctttccgacgttcaagagcagcaagtcgaagagcaacttgacaagcacactgcacccgaaagttcgcccgtccttctacctaaagaagtggagcttccgacttcccctgcgacgaaatcc

SEQ ID NO: 27388 - DNA, 1374 bp, Neurospora crassa
tgggcgcccgactcgtggagatccaagcccatcaagcaatgccccgagtaccccgacaaggctgctcttgaaaaggccaccaacgagctcaagacgctcccgcccatcgtcctccccaacgagatcatccgtcttcgagaacaccttcgcgatgttgcccaaggcaaggccttcctccttcagggtggcgactgcgccgagctctttagctactgccagcaagacgtgatcgagtccaagatcaagcttcttctccagatgtcgcttgtcctcctctggggcgccgacaagcccgttgtgcgcatcggtcgcatggccggccagtacgcgaagcctcgctcctcgcctgtcgagaccatcaacggcaaggaagtgccctccttccgtggcgacatcctcaacggcttccaccccgacgagcgtgagctggatcctaaccgtctcgtgcgcgcctaccagtactcgtcagccacgctcaactacatccgcggcgccatcggttccggcatcgccgacctccacggtcccctcgactggggcctcggccacgtgcgcgacccggcgctcaaatccaagtaccaggaaaccgtcgaccgcatccaggaaatgttgcgcttcatgcacaccatcggcgccgaccaaaacgagaagctgtcgactgtcgagctcttcacctcgcacgagggtctccttctcgagtacgaggaaccgctcacccgcctgctcaaccacccttcggtccgctcctaccctcccgactctaccacgccccccaagaaagaatactacaacacgtcggctcacttcttgtggatcggcgaccgcacgcgccaaatcgaccacgcgcacgtcgaatacttccgcggcatcgccaaccccattggtgtcaagattggtccctcgacacctacttcggacttgctgcctatgctgcgcactctaaaccccaaccgcgaacccggcaaggttacgctcattacgcgctacggcgccgacaaggtggcctctctcctgcctgcgcacatccgcaccgtcgaaagctcggagtacgcccgcaccgtggtctggcagtgcgatcccatgcacggcaacacacaatcggttagcggcggcatcaagacgcgcaagttcagcgacatcttctcggagcttcagcagacactacgcatccacaaggaagagaagtcgtacctgggcggcatgcatctggaattgacgggtgacgcggtgacggagtgcttgggaggcggtgcaggactggatgaggatgacttgagtactaactatacgagcttctgcgatccgcggttgaacgagaagcaggcgctggagttggccttcttggtggcggatcattataggcaggagaggaag

SEQ ID NO: 27389 - DNA, 1766 bp, Neurospora crassa
acggcaaacacgggtctggcccgagagctcaaggggagacacttgcagatgattgccattgggggttcagttggtatgtcttgtacaacaccttacctgaagacatgactgaccaacatcaggttccggtttgttcgtggcctcgggcaagtgtctctacctaggaggtccggcctcgctcatcattgcatatggctttgtgggtgtcatgctttggtgtactattcaagctcttggagaactggccgttgctttccccgttgccggttccttctcgtcatactctacaagattccttgatccagcatgggggtttgccatggggtggaagtaagacactgacccctgaactttgatgatatatcgaacccgactaacctcacccccagttatgccctccagtggttgacagtcctgccactcgaactcatagcagcttccatcaccatcggctactggaacgaccaactcaacaaagccatcttcatcaccatcttcctagcaaccgtcatcatcatcaacctcttcggcgtcaaaggctacggtgaagccgaattcgtcttttccattgtcaaaatcgccgccgtcaccggtttcatgtacgtacatccccttcctttatcctctccaaaactctccctaacgataccagcatcctcgccgcagtcatcaacatcggcggcttcgacgacccccaaggcaacaccggctacattggcgggcggtactggaccaaccccggcgcttttcaccacggtttcaaaggtctctgctccgtctttgtctctgccgccttcgcctttacaggtaccgagctggtcgggctcgccgccgctgagaccgccaacccgcgtaaatccctgccgacagccatcaaacaagtcttttggcgcatcaccctcttctacattgtctctctcaccctcgtcggcctcatcgtcccttacaaccacgagcgcctcctgggaaacatccagcactactccgtctccgacgcctcgtactcgcccttcgttatagccatcgagtcggcctccatccaagtgctgccgggaattatgaacgccgtcatcctcatcgccgtactcagcgtaggcaactccgccgtcttcggtagttcccgcaccttagcagccctggccgaccagcgtcaagcgccccaaatcctcgcctacgtcgaccgcaagggtcgacccctcttcgccatcctttttgctgccctcgtcggcctgatcggctacctagccgacctgaaatttcaatccgacgtgctaaactggctgctcgccgtctcgggcctttcgtccatcttcacctggggctccatctgcctctgccacatccgctttcgccgcgcctgggcccgtcgcggccggtccctcacccaattatcctttacagcacaggcaggcatcacggggtcgtacgtcggcctttttctcaatgtctttgtgctgattgcccaattctggattgcggcgttcccgattgtcacgtttacagataaccagtcggcggctaccgcgtcgccgagtaaagtggcgcagagtttctttttgcagtatctgtgtgtgccgattgtggtggcgttttacttggtgtataagttgtggtttaggaccaagattgtgaggagtgatgagatggatttggacacgggacggaggagggatgtgaatttgcctgtgttggtgatgagggagaaggaggaggtagaagggtggccggggtggaagagggtttatcggtttttttgttgaccgttt

SEQ ID NO: 27390 - DNA, 1624 bp, Neurospora crassa
agctcggataccaaggcgaggagtaaggcggattggttgaagaggagggagagggttgttgaggctatggagctgagctgggatgcttatgagagatatgcctggggtatgtttctgaagaagggttggtgttgtgattatcggttaaggctaacttgtgtgactaggttatgacgagtttcaccccgtgtccaagacgggccgcaatatggcccccaagggtttgggttggatcattatcgattcgttagacaccttgatgatcatgaacttgacctcgcgggttactcatgctcgcgagtggatctccaagtcgttgacctgggaccaggatcaagatgtcaacacctttgagacgaccatccgcatgatgggcggtcttttgtcggcttactacctcagcaccgagtacccgaacctagcgcccatctccgatgacgatgtgggcgcccccggcgaggacctctacctcgaaaaggcccgcgacctcgccgaccgcctcatgtccgccttcgacacgccctctggcattccctacgcgagcgtcaacctcggtaaattccagggcctgccctcgcacgccgacatgggtgcctcttccaccgccgaagccaccaccctccagctcgaattcaagtacctcgccaacctaacaggcgaaaaggacttttgggaccgctccgaaaaggtcatgaaagtgatagacgacaaccaagcccccgatggcctcgtgcccatcttcatccagcccagcaccggccactttcatacccaaaacatccggctcggctcgcgcggcgattcctactacgaatacctgatcaagcagtacctgcaaacccacaaggccgaacccatctaccaagacatgtggaacgacgctctccagggcatccgcaagcacctagtcacctacactgagaacagcgggttcaccattgtcggcgaacgtccctcgggtctcgagggcaacttgtctcccaagatggaccacctcgtctgcttcctcccgggaaccattgcgctcgccgccaccgaaggcctctcggagcgcgaagcccgcaagaagcccggcttctggaacaagcagcgtgaggccgacatgaagcttgcccgcgagctgatgcagacgtgctggggcatgtaccggtacatggcgacgggcctcgccgcggaaatcacctactttaagatcccctcggaccccttgccagagtcctcctcgcacaccagcccaccagattccattttcgatgaccccgccggccctgatgcgacctggcgcaaggactatgaagtccatcaaatggacgcgcataacctccaacggcccgaaacggtcgagtccctcttctacatgtaccgcatcacgggcgacgtcaagtaccgcgagtgggggtgggacatgttcaagtcgtttgtcaactacactgctgtcgaagatggcggcggatttacgagcttgtcgaatgcaaatgtcataccgcctgtgatcaaggataacatggagagcttctggatggcggagacgctcaagtacttttatttgttgttcagtccggaggatctgttgccgctggacaaggtcgtgttcaataccgaggcgcacccgttgccggtcttt

SEQ ID NO: 27391 - DNA, 1748 bp, Neurospora crassa
gccctcttgccgtaaagcgaacaagacgctctctccgaatccacccagagatccaccatgagcccgaccacatccaagcagagaaggagaaggccgcctcaccacccaagccaactgccgacgaggacgttgagaaccacaaggaaaaccgcaagcccacaggagacgaggacgaggacagaaaggaggccgaaacaccagccaagtcacttctcagaaggcgcaaatcagtcatcgccagcccgccaaagacagctcccgtcacaccttccacaccacgacactacgatgtctttgcaagagtaccagtcaccactccgcgccatcgcgtcatgtccgttggcaagctctccaggcgcatgacaccaagcacgcccatgacacccgccgcttctcagacagtctaccatcaagctcgccaactcttttctcgaagcgccgatcctggagagctcattggacgcgacgacgagcgcgagaagctcaacactttcctggattgctgcaccactgcccatcccagcggctgcctctacgtcagcggacctcctggaaccggaaagagcgccatcgtcaacaaggtcaccgacaagttcgcatccgagacatcaacagtgcgcaaggcttacatcaactgcatgagcatcaagtcgtccaaggatctctacgtcacccttctcgaccagctagtcagcaaagatgaagacaaggaggaactctcaaccgaaagcgacgtggtggcagctctccaaaagctcatcctgcccaggaaaaagacccaggacgtcttcctcgtggtgttggacgaaatcgaccacatcctcaccctcgaccctgaaagtctctacagcctcttcgaatggtcactcgaaaagaagaactcgcgcctcgccctgatcggcattgccaacgcgctcgacctcaccgaccgtttcctgccgcgcctcaagtcgcgcaacctcaagcctgagcttctgcccatccttccatacacggcgcctcaggtcaagaacatcatcatcacacgtctcaagagcctgcttcctggtggaacacccaaggaccccaactacatacccttcttccacccagccgccatcgagctctgctcgcgcaaagtctccagccaaaccggcgacctgcgccgcgccttcgagatctgccgccgcgccatcgacctggtcgagtcggagacccgtctgaagcacgaaaacgaagtcaaggagcagatgctacaaatgtctccctccaagaagcgcgtcctaggcgaaaacaccaacctctcctcggctcctgcgccttcctctctcttccggagcatctccactggacccagcgccagcgtctcggcctctttactcaaatctctgcaagccttgacgcccgccaccgctccgcgcgtcagcatcgccgacctcagcaaagtcacagccgcagcattcagcaacggcaccactcagcgtctcaagacgctcaacctccagcagaaagccgctctgtgcgctctggtcgccatcgagaaacgtaaccgcgccgcgcagtcggaggctcttaactctgcttcagccagttttgcatccactaccggcactccgtcgaggaaacaagaggcgccaattgccccgacagtcaagactctctttgaagcttacaccaagctctgcaaacaggactcgctgcttcatccgctttcgtcatctgagtttcgcgaggtggtgtcttccttggaaactctcagtttgatcacg

SEQ ID NO: 27392 - DNA, 1169 bp, Neurospora crassa
ggcgagaccgttgagcgtccccctatctgggtgatgcgccagggtgagatgtcctcacttacacatttttactctcacatctaacgcagcacctctcatcctcacagccggccgctacctccccgagtaccatgaagccaaaggcgggcgtgacttctttgaagtctgccgcaaccccgagatcgcctcgaccctgaccctccagcccattgagcgctacgccggcctgatcgacgccgccatcatcttctccgacatcctcgtcatcccccaggccatgggcatgacggtcgagatggtcgacaagaagggcccccacttccccaaccctctgcgctcgcccagcgacggccagtacgccgagctcatgaagcgcgacgtcgacgtagccaaggagctggactatgtctacaaggccatcaccctcacccgcaagaagctcgacggccgtgtccccctgttcggattcaccggtgccccgtggacgctgctgtgctacatggttgagggcggcggtaccaagctgttcaaggaggtcaagacgtggatttacaagtatcccgaagagaccaaggccttgttgcagaagatctcggagttgtgcgtggagtatttggctctgcaggtcaaggctggcgctcaggtaatgaccctcctcttatctgggtatatcactttggccattcagtactaacgacatccagatcgtccaagtctttgactcctgggccggcgagctctccccctcctccttcaagaccttctcccagccctacctgacctacatcgccaagcacctgccgctccgcctcaaggagatgggtctcgagcccgtccccatggttgtcttccccaagggcgcgtggtatgccctcgacgccgcctgcgacatgggctacaacgtcgtcggcctggactggctgcacgaccccgccgaggccgtcaaggttgttggcgacaggcccatggtcctccagggtaacgctgaccctggtgtcctttacggatcccatgaggccatcaccaaggtcgtcgaggagatggtgcagggctttgattggcatggcagacacaagggctggattgtcaacttgggccatggcattacgccgtttgtcaacccggatgacctcaagttcttctttgaggagattcaccggttgactaag

SEQ ID NO: 27393 - DNA, 689 bp, Neurospora crassa
cgcaatcatgtcgtgatcaaggtcggcatggtcggtgatgcgcagattggcaagacaagcttgatggtcaaatacgtcgaaggcagttgggacgaggactacatccagactctgggcgtcaacttcatggaaaagaccatcagcatccgcaacaccgagatcaccttcagcatctgggatcttggcggtcaacgcgagttcgtcaatatgttgccgctcgtgtgcaacgatgctgtagccatcctcttcatgttcgacttgacccgcaagagcacgttgaacagcatcaaggaatggtaccgccaggggcgaggattcaacaagacggccattcccgtccttgtaggcacaaagtacgatcactttgtgaacctttcgcgggaggagcaggaggaaatctccaaccaggtaggatccgtcatttgtgcgtatacggcaaagttcctgcttgctgacgttacttttccaggcacggcgattcgccaaggccatgcgtgcggcattgatctttagcagcaccagtcacagcatcaatgtccagaaggtacgtcacactttgtttgccgcaactggtgcatggtctgactgtttcgcagatcttcaagatcgtactatccaaagccttcgatctaaaatgcacaattcctgaaattagcaacgttggcgagccacttctcttgtaccagtcg

SEQ ID NO: 27394 - DNA, 393 bp, Neurospora crassa
gagctaaggaagtacacccgcgagcacgagtggatcgagctctccgacgacaagaagactggttacgttggcatcagctcctacgccgccaaggccctcggcgacgtcgtcttcgtcgagctccccgaggagggcaaggaggtccacgctggcgatgcccttggcgccgtcgagtccgtcaagtctgccgccgacatcaacgcccccgtcagctgcaaggtcattgctagcaacttgaccctcgaggagagcccttcgaccatcaacaaggttcccgaggaccactctgccagcggcggttgggtcgccaaggtccaggttaccgaccagggcattgccgatctcgagaagctcatggacgaggaggcctacaaggagttcactgccgccgag

SEQ ID NO: 27395 - DNA, 963 bp, Neurospora crassa
gaaacagtccacatcggcacccgccgctcggccctcgccctccgacaagtcgacctcgtcattgccgccctccagcctcaccaccccaacgtccactttcaagtgcacgccctcgccaccctcggcgacaagaaccaaacggcctctctgccctccctcggcaagggcctctggaccaacgagctcgaagccaagctgttcaacaaggaagtcgactttatcgtgcactgcctcaaggacatgcccaccaccctgcccgagggcggtaaaatcggcgtggtgacggagcgcgaggatccgcgggacgtggtggtgatgaagaagaagtgggccgagcaagggaagtacaagtctctggctgacctgcccgagggcgccatcgtgggtacttcgtcggtgcgccgcgcggcccagctgcgcagacggtaccccggcttggtgttcaaggacgtacgcggcaatatcgagacgagaatgagaaagtgcgacgaggaggattatgactgcatcatcctggccgcggcggggttgttgaggatgggctacgacgagcggattgcgcagtggttggattcgacgacggaagggggaggcatgttgcatgcggtcggacagggcgcgctggccatggagatcagggagggcgatgagaagacgctggagatcatcaagcccttgtgtcatgagaagaccatggtggcgacgtttgcggagcgcgccgtcatgaggaccttggagggcgggtgcagtgtgccgattggtgttgagaccaagtgggtgggcgaggatcagttgcagttgaaggtgacggtggtcagcttggatggaaaggagagtgtggatgggcagagcgtcgaggtaatcaagacgattgaggaagccgaggccatgggtcagaagctggcggaggatctggctaagaggggcgcgcagaagattctggactttgtcaaccagggtcgt

SEQ ID NO: 27396 - DNA, 1427 bp, Neurospora crassa
ggagagttgatcggccttctcatcaatggatatgtatcagaacgtttcggttatcggtacaccgttatcggctgcttgatgctcatttgcgcgtggacttccctgttctttacggcgcagaatgtccagacgttgttggctgctgagattctttgcggcatcgtaagtttcactcacctccctcaaagtaatgcacatgattggtttactgatgaacttccagccatggggcgtcttccaaactctcaccatcacctacgcctccgaagtctgccccgtcgccatgcgcggctaccttaccacctacgtcaacttctgctggggcgtgggccaggaaatcgccatcggagtcatcatgtccatgctcaagcgcgacgacgaatgggcctaccggatcccctacgccctgcaatggatgtggcccgtacctctggccttgggaatcttcttcgcacccgaatcgccttggtggctcgtccgcaagggtcgtctggatgacgccaagaagtctctcctccgtctgaccagcgtgaaccgcgaaaccgatttcaatgcggacgagaccgtcgccatgatggttcacaccaccgccctggaggagaagacgacgcagggagcgaccttttgggattgcttcaagggccatgatctcaggagaacggagattgtgtgcatggtgtgggcgattcagaatctgagtggaaactcgttctcgaattactcgacgtatttcctcaagcaggccggcctggacgatgatgacgcctatgcgtttgctctcgggcagtacgctatcaacatggcgggcgtgtttggcgcgtggttcttgatgagccgcggcattggacggagagctctttacctgtatgggttgtgcggtctattctgcatgctctttgtgctgggtttccttggtcttgttcccgaagcgcacaacagggaggcttcgattgcgactggcagtatcatgttgggctgggctttggtgtaccagttgacagtcggaacggtctgctactcgcttgtcagtgaaatctcgacgagaagactgcagatcaagaccattgctcttggtcgtgtgctttagtaagttcctcagacccaggagcccttctgagctcatgcataggtactaacaatgcacagcattattgtcggcatcgtcactgccgtcctcacaccctacatgctcaaccccggcgcctgggactggtccaactttaccggtttcttctgggtaagtcaccttgcccctttcccctggctgcaaagctaacgcatcccaggccggcatctgcttcctctgcatcatctacgtctacttccgcgtccccgagcccaccggccgcacctttgccgagctcgacctcctcttctcaaagggcatcagcgcgcgcaagttcgctgagaccaaggtggatgtattc

SEQ ID NO: 27397 - DNA, 722 bp, Neurospora crassa
ctggatcgctatttccggcatatcggctattcgccgaaggatgccgaagacgacctcggcaggcttgccatgttgcagctacgccacatggcccgcgttccatttgagagtctgacattgcattactcccaacaccaccgattgtcactggacctggaggacctttttgaaaagattgtggacaaggggaggggaggctactgcatggaggtcaatacgttcttcggagccgtcttgcgcagtctgggttacacactcattaacgtaggaggaagagtgaaggcaggcgatggagagtacaaaggatggtttgtggtacccgaccggaggcctatgcccatctaaagtcagcatcgtgcactaacgggattcccaggaatcacatggtcaacatcgtgaccatcaacaacacacgttatctggttgatgtaggatttggctcccatggctcggttaatccagtgcctctggagcacaacaacgtcttcactacagtctcaccagcacgaggtgtactcgaatacaaaagcctctcccaacacaccgaccctaccaaccaaaggatatgggtatactcaacccaggaaaacccgtctgcgccctggaaggaaatgtactgttttgccgccgacacagagttcttcccggccgattttgaggtcatgaacctatcaactatgaccagccctcaaagcttctttgtgcagaccgtcatgtgcatg

SEQ ID NO: 27398 - DNA, 2136 bp, Neurospora crassa
atgtctgcgaagagcatcctcgaggccgacggcaaggccatcctcaactaccacctcacccgtgcccccgtcatcaagcccagcacgctaccaaacccgaccaagcacaaccctcctcccagacttgcttccctccacttcgccgaggatgccgatgtgaacggtgttctcagccaggctgaggtcacctacccttggctcctccaggagggcgcccgcttcgtcgccaagcccgatcagttgatcaagcgccgtggcaagagcggtctccttgctctcaacaagacctgggctgaggccaaggcctggattgctgagcgcgccggtaagcctcagaaggtcgagcacacagagggcgtccttcgccagttccttgttgagccgttcgtgccccatcctcaggaaaccgagtattatattaacgtaagtcgtcccattgctggattggccaaggtcatccacaaatgaactgcacgctaacgtgaaacagatcaactccgttcgtgatgtaagtgttgtcgccttttccagtcgtcttggcaattcgtcgaatcatcagaaaggtcccacatgcaagtgcatccgaatgaaggtgtcgccaagcccaagaggtccgatgtccgcatcccgattcaagtcgaaacaaattcgtgaggcagcgggcctcagttttcatatactttggaaaaagagaaaaagaagatttaggggggaggttgagaaaattggggatgagaagcacattttgagtcgtgtgcatgacttgtgttgcccctgccagtctacggacgaacggaggctaaacccaattcatgtggagcgggacacacccaccgccccctttgcgatcctcaccaccacaaccccccctcaacccctacccaaaccccatcacaacacgtggttccccaaaagaattgccaaacttaaaataaagttgcggaagctaactgcacatcatgtagggtgactggattctcttctaccacgagggtggtgttgatgtcggtgacgtcgatgcaaaggccgagaagatcctgatccccgtcgacctttcacaatacccttccaacgaggagcttgcgagcacactgctcaagcatgttcccaagggcattcacaatgtccttgttgacttcagtaagttttacctgtcaaatcaagcttaaccggccagtcttggcggtgccctgtcaggcgtcgagaacccacactcttcatcctgataaccatccggggttggcggatgcatgactcgatcattagtactaacagcctctcacagttgcccgtctctatgccgtctatgtggactgccagttcacctacctcgagatcaaccccttggttgtgattcccaacgaggatgccacctctgccgaggttcacttcctcgatcttgctgctaagctcgaccaaacggccgacttcgagtgcggcaacaagtgggctattgcccgctctcccgccgccttgggcattgttgctcagagctctaacaccggtgtcaacatcgatgccggcccgcccattgagttccccgctcccttcggccgtgagctctccaaggaggaggcttacattgctgagcttgatgccaagactggtgcctcgctcaagcttactgtcctgaaccccaatggccgtatctggactctcgtcgctggtggtggtgcctccgtggtttacgccgatgccattgcctcggctggttttgctgatgagcttgccaactacggtgagtactctggtgctcccaccgagtctcagacctaccactacgctcgcactgttctcgacctcatgctccgtgctcctgtctctgagaagggtaaggtccttttcatcggtggtggtattgccaacttcaccaacgttgctagcactttcaagggtgtcatcaaggctcttagggagtatggcaaggccctcatcgagcacaacactcagatctgggtccgtcgtgccggtcccaactaccaggagggtctcaagaacctcaaggctgcgacacaagagctcggactcaatgccaagatctttggccccgagatgcacgtcagtggtatcgtgcctctggcattggtccctggcaagtgggaggagagcggtgcggtggagttccaagcttaaaag

SEQ ID NO: 27399 - DNA, 1631 bp, Neurospora crassa
ccacaacgctttcagcggtcaatggtgcaagtccaaggagagaccggagtagccatcgattcaccacagggccgcaagttgttcgtgtttgaccgggtttttggtcccgaggtcgaccaggagggcgtatgggagtatcttagcgactgtgtaaatgctttcacacagggttacaatgtctcgcttctcgcctacggccagtcgggcgccggcaagtcatacacgatgggtactgcaggccccgatgtgcaggaagacctagaggccatgggtaagtgcacctggcaccggcctctgagacatgcaggtgccctccccaccaagaagcttgcgtgctaactgcacatgcaggagtgatcccccgggccgctatcgccctgttcgaaaagctggacggctcaagtccaaagtcccaaggcgcggcttcgaaacggagttccatgtcccagctgcgtgccccttcgagagttgccatgcttcagccctccaacatcgacaaggattggaaactgactgcgacttacgtcgagatttacaacgaaaccctgcgagatcttctaattccagagcacattccgcagcatgagcgcggcaccgtcaccatccgtgaggatgtcaaggggaacatcatccttaccggcttgcagcaagtcgaggtcaattcggtggacgatctgatgaatgttttagcccagggttcagcactccgccagaccgatgcgacagccatcaatgcccgatcttcaagatcccatgccgtcttcagccttaacctggtacgaaaaggagccaagggtcccacggcgcccacagatagacgcatgtcgatgccgctcgaggccatgtccggtacggaagccatggtcaccaccgatagcaagatgcatttcgtcgatttggccggtagcgaacgtctcaagaataccggtgcccaaggcgagcgtgccaaggagggtatttcgattaatgccggtctggccgccctaggcaaggttatatcgcagctttcgtcacggcaaccaggagcgcatgtgtcataccgagattcgaagctcacacgcttgcttcaagattctttgggtggaaatgccattacgtacatgattgcttgcgttacccaggccgaattccaccttagcgaaacactcaacacggtacaatatgcccagagagcgcgagccattcaaagcaagccgaggatacaacaggtagacgagggcgacaaacaggccattatcgagcgtttgaaggccgaggttgcgttcctgcgtgagcaaattcggagctcggaaaggggcgggggtgacagacgtagcatgttgcttgctcctggggagaggtccgagcggcagaatgaacgggaggcagagctccagaaccagctactggacgccagggaaaactataccacgctatcccagcgacatgcgaagctgatttccgagatggccaaggcgcgggaaaatgagtttgctgagaatcagcatctcgaggaaagcttgggtgaaagcgccaccgaacgtctaaatcgctcaaacagtttcgcccaggccgtcgagcaggtcgttcttgaatacgagaaaacaatccaatcgctcgagcagtcccttgccagcacgcgggccaccctc

SEQ ID NO: 27400 - DNA, 1962 bp, Neurospora crassa
ttgcgccagactttgaggagtaccagaagctgtacaagcagtccatcaccgagcccaacgtgttctgggctgagcgcgcccgcgagcttctgtcgtggagcaaggatttccagacggtccacagcggctccctcgccaacggtgacaacgcctggttcgtagagggcgagctcaacgcctcgtacaactgcgtcgacagacacgcccacaaggaccccaacagagtcgccatcatctacgaggccgacgagcccggtcagggaaggaatgtcacctatggcgagctcctcagggaggtctccaagctcgcccatgtcctcaccaacttgggtgttcgcaagggagacaccgtcgccatctaccttcccatgattcccgaggccatcgttgccatgcttgcttgcaccagaattggcgccatccactccgtcgtttttgccggcttctcctccgactccctccgcgaccgtgtcgtcgatgcccagtccaaggttgtcatcaccaccgatgagggcaagcgcggtggcaagctgattggcaccaagaagatcgtcgacgaggctctccagcagtgccccgatgttcgcaacgtgctcgtctacaagcgcaccggcgccgacatcagcatgacccccggccgtgatctctggtggcacgaggaggttgagaagtaccctgcttactacacccctgtggccatggcctcggaggatcctctcttccttctctacacctctggctccactggcaagcccaagggagttgcccactctaccggtggttacctgctcggtgctgccatgaccggcaagtacgttttcgacatccatgacggcgacaggtatttctgcggtggtgacgtcggctggattaccggtcacacctatgtcctctacgccccgctcttgctcggtgtctctaccgtcgttttcgagggtacccccgcctaccccaacttctcccgctactgggacatcattgaggagcacaaggtcactcagttctacgttgctcccactgccctgcgcctgctgaagcgcgccggtgaccatcacgttcgcaacgagatgaagcacctccgtgttctcggctctgtcggtgagcccatcgccgccgaggtctggaagtggtactatgatgttgtcggcaagggccgcgcccagatttgcgacacctactggcagaccgagactggctccaacgtcatcactccccttgccggcgttacccccaccaagcccggttccgcttctttccccttcttcggtatcgagcccgcgcttgtcgaccccgttaccggcgaggagatccacggcaacgacgttgagggtgtcttggccttcaagcagccctggcccagcatggctcgcaccgtctggggtgcccataagcgctacatggagacctacctccatgtgtacaagggctactacttcacgggcgacggtgctgcccgcgatcacgagggcttctactggatccgcggccgtgtcgacgacgtcgtcaacgttagtggccaccgtctcagcactgccgagattgaggctgctctgattgagcatcactccattgccgaggctgctgttgttggtgttgccgacgagctcactggccaggccgtcaacgccttcgttgccgtcaaggagggtacccagatcaacgatgctctccgcaaggagttcgtcctccaggtccgccgcagcatcgggcccttcgctgctcccaaggccatctacatcgttcctgatcttcccaagactcgctctggcaagatcatgcgccgcattctgaggaagattgttgccggcgaggaagatcagcttggtgatatcactactgtaagttccagtctaccaaccgaacaactgcatgcaagatactaacagctggaaatagctcagcgatcccagcgtcgttgccaagatcatcgatgtcgtccacgcgcagcgccagtaaagaaat

SEQ ID NO: 27401 - DNA, 1528 bp, Neurospora crassa
gacacaggcgtaataagcgccacccttgtctctatcggtacctccctctcgcaccggcccctgacctcgctcgacaaatccgtcatcacctcatgcacctccctcttcgccctgctcgcgctacccttcgcctccgcgctcgccgacgaccggggccgcaagcgcgttgtcctcttcgccgacaccctcttcatcatcggcgccctctgccaggccgccagccggaccgtcgaggtcatggtaattgggcggtcggttgtcggcatagccatcggcgccgccagcttcgtgacgccgctgtacattgccgagctggcgcctgcgacgcaccgcggccggttggtgacgatgaacattgtgtttatcacgcttgggcaggtggttgcgtacgtggtaggctggatctttgggacgtatggtagtccggagacgacggggtggagatggatggtcgggttgggcgcggtgccggcggtttgtcaggtggtcatcttgttgtggatgccggagagcccgaggtggttggtgaaggacggaaggtcgcaagaggcaagagcggtgattgctaagattgccgcgggggatgatgcgcaggatccgtcgacgaggagggaagtggatgctgtgttgaagagcatcgagattgaggtgagagaggaggctacggctatgagactgggtggcgccggggccgggtatgcaaatgggaatgcagtgaatgcgtggatggaggctatgcgggaactgatcagggtgaggaggaacagacgggcattggcaattgcttgtctcctccagggtcttcagcagctgtgcggatttgtgagtaacccgggctgcgaccgtgacactgtaccgccttattgatgggccacttgtgctaacaatttttttttttttttttttttttctttagaactcgctcatgtacttctcggccacgatattcacgatggtggggttttcagagccgactttgacctcgctagtcgttgcagtcaccaactttgccttcaccttagttgccctggtgttgatcgaccgggtgggaaggagacgcattctactctggtctcttccctttatgattgcaggtctggtgcttgccggctatggcttttcgttcatcgagctcccgaattcagagaccagctcgccctcgacaacgggaggtcagggcggggccgtcattattttggcgagcatcatgatttatgtggctggctatgccatcggactgggcaatgtgccctggatgcagagcgagctcttctcactgagtgttcggtcagtgggcagtggtgttgcaacagcgaccaactggagcgccaactttgtgattggactgacgttccttccgctgatggaggccttgtcgccgtcttggacgtttgtcctgtacgcagtgatctgcgcggttgggtatggcctgatttggacggtataccctgaaaccgcagggctgagcttggaagatgcggcgacccttctagaagcggatgactggggggtgcggtaagggttgcat

SEQ ID NO: 27402 - DNA, 4839 bp, Neurospora crassa
cggtcacgcaatcctaggaacaatccgctcaagggcaagtcgttggggatattttcccctgacaatccactgcgcttgtggctttgcgatttgttggtcaacccatgggctgagccactcattctcatcttaatcgttcttcaagccgtcctcctagctgttgaggctgcgccagatgtgctggctgatggaaacggtcggcctgagcgttggggtagcaccaggatagactgggccatatttgtcctgtttgtcatctttactatcgaactcatagcgagaattattgtgtctggcttcatcatcaacgcccccgaatacgaagaagccaagaacaaacggcgcttccgtgaaaggctggccgaacagtatcgggttatattccgaccgcagcgtcagagatcggttcgtcaaacccggcaagagcccttcgagcctgctccgttcacgagatcctttaccatggcccacagtcaaattcaaacgctcgaggatcaacagcgacgtcacctggctcgccgcgcctttctccgccatggctttaataggttagacttcgtagccgttgtctccttctggatatccttcgtattaggcgtcactggtcttgagagcaagcaccatatgtacgtcttccgcatgctaagctgcttgcgcatcattcgattactcgcccttacaaagggaaatctgatcatcttacgaagtctgaagaaggccgcgccgttgctcgtccgagtttccttcttgatgggtttcttctggcttctctttgccatcattggcgtgcagagctttaagtcaagtctgagtcgtcaatgtctttggatagatcccgatgatcccaccaacttccaagcagcttatacgccggatatgaccttttgtggagggcatattgacaacgtgacgggtgaaaccatgccctgggtttatagtcacgaaaaggaatccctaattgatttgaagaacggaacttcgcgtgccaagggcttcatctgcccgagaggttcaatatgcatccggcaagaaaaccccttcaatggaacggtcaatttcgacgatatcggccattctttggagctcgtgtttgtcatcatgagcgccaacacctggtcggacttgatgtatcacactatccgctcagatttcctcccgtcggccctcttctatggtgctggcattcttataatgttgctctggatgaccaacttgttgattgccgtcatcacgtcgtcgtttcaggtcatccgagaagagtccaaggctagcgcttttactgcggatgaacctcctggcatgacttcatctcgagttgatgataccatgcgtaggccgacattgctgcaaagaatatataacaggacaaaacctttgtggatcttgatcatcgcttttggacttttggcacagtctctccgcagcgccaggatgaagtcagaccgagagcgtttcgtcaatatagcagagcctgtggtcactcttctgctcgatgtcgaaatcatcatccgcttggctgcagacatccgaggttttcaccgtaggaaacggaaccttgtcgacttggggcttgctgtagccacctcaatcatcctcgtccctcctatacggaattctggccaagtttacaattggcttaccgcgttccaaatcctgcgagtttaccgtttagtcatggttattcccatgacaaggaaattaatccggcttgtgctcggaaacgtcactggtatcggtaatctaatgtcgtttgtcttcctcatcacttttctgatggccatcttcgcagcgcaattattccgtggcgaactaccgagagaagatgatggtggagaggaaattagaatcccgttcaacaccatttataattccttcttagggatgtatcaagttatgtcgactgagaactggaccgacatcctctacagcgtcactgccagcactcaccacctgcacactgcttggattggcgccatttttctcgtcggctggttcattctcgcttattttatcttgatcaacatgttcattgccgtcatccaagaaaattttgatgttggagaggatgtcaagcgtcttgaacaggttaaggcattcctccagcgcaaggaactaggacattcttcttcgagcaacctggcattatccaaagttttcaattttggccggtcaagaaaacagagggatccgctcgactatggccctgctatgatggagatgcttctgaaagaggccgtggtacacgacttccttgacgacgatatggaccctctccagcaaagctctcccgatggtcagccaacttcccatctgggtagtagtgcagccatgcaacatgacggtgtcactcccggggtactctcctctttttggggaaaactcgtgtcagtgtttactagccgtgaacccaaccctttctattcgaacgtcaatttgcacgggctgggtgagaatctcgatccacgaactatggccgcccaggcgatgaatgccacgagacgccgccagaggcaacagagagagtatttgatgcgccaccccaactacaacaattccctgttcattttcaaacccagaaatcccatacgacgtctttgtcaaagtctggtcggccctggtcggggaactgagcgcttcgagggggcgcagcccaataaatatgcatggtacaccttctcgactctgatttatgcagccatcgtgatcatggtggtgcttgcttgcattactacacccttgtaccaaaaggaatacttcgaaaagtatggcgagaatgcgtttgactggttccgctgggtagacacggggtttgccattgtcttcacccttgaagctctcatcaaggttatagcagacggctttctttggacaccaaatgcatacttccgcagcacctggggtgtgattgatgccattgtgctcataactctttggatcaacgtcatcactctatttacccgaaacggagccgtgtctagagctgtgggtgccttcaaagcattaagggccctgcgcctgctcaacatcagcgaaagtgcgatggacactttccactcgctcctcatcgtgggtgggtggaagatcttgagcgctgctttcgtttctatatccctccttattccctttgctatttatggggtcaaccttttccacggtaaactgcttgcatgcaacgacagctcggagggaatagtcagcctggatgactgctttggtgaatggaacagcaccccttacaacaacaattggcccgttcttgctccgagatcagtagcgaacccatacttcagctttgacgattttggctcgtctctcttcattcttttccagattgtgagccaagagggctgggttgacgtgtcttttgctcttcaagccattaccggtaggggtttgcagccgcagtcgggggctccctacagcggccaaggaaatgcgttgttcttggtcgtcttcaacctattggcgacagtctttgtgttgacgctctttatctctgtgttcatgaggaactatactgaacaaacaggtgttgctttcctgactgccgagcaaagatcctggctcgagctgcggaagcttctccgccaaatctcgccgtccaaaagctcatatgacgagagtaagaacaagtggaagatatggtgccataaacgtgccattgagaagcgagggaaatggtatatggccatcaccagcgttctggtcttgcatcttatactccttctctccgagttctacagcgagccagattggtggacaaacaccagggacgctttgttcttactcttcacactcatctacatcgccaacatcgtgattcggattgtggggcttggctggagccgctttcgcaagagttcttgggacatgttctccctcatcactgttactggtgcattcgccacgacgatccttttcatgacgaacacgaagctggacacgtacattcaattacacaagttctttctggtggcgatcgtcctaatgctcattccccgcaatgatgcgcttgatcaactgttcaagacagctgccgccagtctgacaactatcggaagcctgttggccacatggctcgttttctttctggtgtttgcgattgcacttacacagacatttagtctcacccgtttcggaaatagcactgattactatgtcaatctccgtacggtgccgaatgccctgatcctactcttccggttcagttgcggagagggctggaatcaggttatggaagactttgctaagatcaaaccgccgctttgtgtggagagcaccaatttctctgacagcgattgcggcagcaccgcatgggcgcgtgctcttttcatcgcgtggaacatcatcagcatgtacatttttgttaacttgtttgtttcgctgatttacgaaagtttttcgtacgtataccagcggacaagcggacttgccatggtggatcgggacgagctccggcgcttcaaggaagcatggcgcagtgttgacccttcagggactggatttatcagcaaggaggctttcccgcgcctcttgggtgaactgtcgggcgtgttcgagatgcgcatttatgaaagccatgactcggtgcgccagatcctcgaagatgttcgtggtgaagacacgtcaagcatcagacatgcctcgatcattagtaccacgcagtttcaaactagcttggatctcaaaaagttaaacgaacggatatcacaaattgatgtcgctaaggtgcgcgaacgcagacggcggttcaacatcttcttcgaggaggtgatggtgtctgcggatccagaaagaggcatttcctttaccactgttcttatgattctggcacattat

SEQ ID NO: 27403 - DNA, 1539 bp, Neurospora crassa
accctgcagcggacgaggaacccgcgttcactcgcgaacgaaaatgacgagaacagtacagcaaccacgacacgtatgacgagggccaaggcggccactctccatgtcgacgaattgtccatgcccgcgaaaaccatgcagaccaaaaagacgacgatttcgacaaccaccgccgccactgccgctcgcactgtcggtaagcggaatgcactgggcgacgtcagcaatgtcaccaaggttgaagttgcgggaacgaagaaagcgattgcgaagcccggcctagtttcgaaggcggcccagccgagtggcatccagaagaagaccacaactgctacgagccgtactgcgactactgcccgccgtgcgttatccaacaaagagcccaacaagacggtcggccccagtgctggtgctggcaccattcccgccaagcgcaagcctcctccgtccacatccaagctcgcccctatcaaggaatcagcacctgttgaaaatgaaccggcccgcaagaagatccacgtcgaagagcccgagaagaagaaggtttccaggactgaggccaaggagaacgatgctccctccaaggctgtgaagccgatggccgagccccccgctcccgtcgtccgcgatgtcgtccctgttcagtcagtgtatccgccaggtgttaaggaccttgacactgaagacctcgaggatcctcttatggttgccgagtatgcgacggaaattttcgagtacctccgcgacctcgagtgcaaatcagtgccgaaccctcagtacatgagccaccaggacgacctcgagtggaagactcgtggcattctcatcgactggctcattgaagttcatactcggtttcatctgctgcccgagacgctgttccttgccgttaacatcatcgatcgttttttgagcgaaaaggtcgtccagctcgatcgtcttcagctcgtgggtatcactgcaatgtttgttgcctccaagtacgaggaggtcctctccccccatattgccaactttcgccacgttgcagatgacggctttactgaagctgagatcctcagtgctgagcgtttcattctatcgaccctcaactacgaccttagctaccccaaccctatgaactttctccgccgcatctccaaggcagacaactacgatattcaatcccgtacccttggcaagtacctgatggagatcagcttgctggaccatcgcttcatgccttaccgtcccagccatgtcgctgctgctgctatgtacttggcacgattgatccttggccgcggagaatgggtaagttatacagatggatttataatactcgccatatcatcctgtggctaatactcataataacaggacaagactatcgcctactatgctggctataccgaggaggagatcgagcctgtattccatctcatggttgactatctggcccgtcccgttattcatgaagcattcttcaagaagtatggcagcaagaagttcctcaaaggtatgtcaaacaaccggccttgcttgtctcgtaatcttatt

SEQ ID NO: 27404 - DNA, 1056 bp, Neurospora crassa
atgagaacctacaagccgcacacgcccggtatccgtcacttgaagcgcccgatcaacgaccacctgtggaagggccggccgtatcttcctcttacctttcccaagaagggtcaatctaagggtggccgtaatcacagtggtcgcgtcaccgtcagacatcgcggtggtggtcacaagcgaagaatccgcatggtcgactttgaacgatggatccccggtccgcacacagtcctgcgcattgagtacgatcccggtcgcagcgcgcacattgcgctggtgaaggaagaggccacagggaggaagagctatattgttgcggcggatggtatgagggctggagacgttgtgcagagctaccggtccggtcttccccaggacctgctcgattctatgggtggtgtcgttgatcctggtattctggctgcgaggacatgctggagaggcaactgcttgcctgtgtccatgattccggttggaacccagatctattgcgttggctcccgtccggatggcaaggctgttttctgccgcagtgccggaacatatgcaaccattatttccaaagaggaggagacccgtgaggatggtacaaaggttatgacgggcaagttcgtcaacgtaagactgcagagcggagaaatcagaagggtcagcaaggacgcttgcgccaccgttggtattgccagcaacattatgcatcactacagacaactgggcaaggccggtagaagccgttggctcaacattaggcctactgtgagaggtttggcgatgaacgcaagtgagtagactcccagaacaatccgtttgtcaagcgagcaaaaccaactaacggcctggtagatgaccatcctcacggtggtggtcgtggtaagtcgaagggtaataggcaccctgtttctccttggggtacacctgtaagtcatgcccctttatttccttccttcctctgaacagacgccttaccctctttttctgtaggccaaaggtggttacaagactcgcagaaagtccaacgtcaacaagtgggtggttaccccccgggtccgcaacatg

SEQ ID NO: 27405 - DNA, 715 bp, Neurospora crassa
tttatttcctcgcgaggcaatgagtacttttgcgaaattgacgaggactacatcactgataggttcaatctaactggtctcaacactgaggtccagtactaccaatatgctctcgatctcatcaccgatgtcttcgacctcgactgcgatgacgacatgcgggaaacaatagagaagtctgctaggcacctgtacggtcttgtccatgctcgatacattgtcacaacgcggggtcttcaaaaaatggtcagtaatcaactctcagcattccatcttcatccagcgtctcctcgtcttcatccgtgactaacgcacttcccaccaacagttcgaaaagtacaaaaaagccgactttggcaagtgcccgcgcgtcatgtgttcctcgcaccctctgctgcccatgggtctctcggacgtgcccaactccaagccggtgaagctgtactgcgcgcgttgcgaggatatttacaaccccaagtcgtcgcgccacgccgccattgacggcgcctacttcggcacctcgttccacaacatcttctttcaggtatacccgaccctggtgcccgccaagagcgtcgagcgctacattccgcgctgctacggcttcaaggtgcacgccgctgccgctctggtgcgctggcagaacagccagcgggacgagatgcgtaggcggctgaggaagctcgaggtcgagagcgggttcaaggacgccgag

SEQ ID NO: 27406 - DNA, 1032 bp, Neurospora crassa
tctgataagtacaacttcaaaggcaaaatcgggcagggcgccttcgctacggtgtatatggttaccgacaaaatgaatggacgtccgtatgcggccaaagagctcgaaaaacggaggttcatgaaaaatggagtgcttgacctaaaggtcgagaatgagatgaagatcatgcaacgagtatcacatgtaagtcactatatcatccaaaggccagagttgatacattacttgcatcaacccgactcaacacggctaacgtgttacctacagccgaacatcgttcagttcaaggagcacctggatcctgatgataaacacctttacataatcatggagtttgtcggtgtcggtgacggtgatttgggaaagtatatcggcacaaacggtcccttttccgaaccagataccaagacgatagcgaggcagttggtggacgcccttgcgtatctgcatgatatgaacattactcaccgcgatgttaagcccgacaacatcctcattcaatcccggttcccgctagttgtcaagctctcagattttgggctttctaaaatgatcgatcacgatgcaacatttcttaggacgttctgcggtaccttgctctactgtgcgcccgaagtttatgcagagttcgaagagtacgatgaactttgcgagcgaaagacgcgtcgcagttacccgcgtcaacctcgccggagccagagatacgatcacaacgtcgatatctggtccttgggcggtgttctgtacttcgccttgaccacccagccaccgttccctgcccgaaatggtgtcggtcatactgagttcctgcaccagattatgacaacttttcccgacttcgaccagctcatcaaggcggatccccctgtttcactcgagtgccgcgatttcttgaagcaaatgctcagtcgaagacccgaacatcgaccaacggcaaagatgttgctgagccatgaatggatccgcactccccactattctccaaatgtcgcaccgtcttgctcacaaaatggcggagtagacgaactg

SEQ ID NO: 27407 - DNA, 1195 bp, Neurospora crassa
atgtcgaacaacgaggagtacgatgagtctgccaacatggaggacgacagcgggataccaaacccaggcgccccaacaccactttctgctctagaggtacggatcactttctttgatggatccatccggattgcaaacaaccaactgacttgcctagggtgttgccggacttaccaagcgagacattcagctgattgttgatggaggcttcaacaccgttgaatctgttgcctataccccccggagggtactggagcagatcaaaggtatttcggagcaaaaggcagggaaaatcctggcagaaggtcagtagccagcatttgacattcctagaggttccattttgggagtgcatgattactgacactatcatcaagcctctaaacttgtgcctatgggttttactactgcgacggagatgcaccagcgccgcagcgaactgatttccatcacgacaggctccaaaaatctggatacactattggctggtggtatcgagaccggcagtgtcaccgaaatctttggagagttcagaacaggaaagtcgcagatctgccatactcttgcggtaacatgccagctcccatttgacatggggggtggtgagggaaaatgtctctacatcgacactgaaggtaccttccggcctgtgcgtctcctagcagtggccaaccgatacggtctctcaggcgaagaagttcttgacaacgttgcgtacgcaagagcctacaattcggaccatcagctgcagctcttgaaccaggccgcagccatgatgtgcgagacccgcttcagtctgttgattgtcgactccgcgacctcgctctacagaacggacttcttgggtcgtggcgaactcagttcccgccaaacccatctcgcaaagtttatgcgcacactccagcgccttgccgacgagtttggtattgcggtggtgatcaccaatcaggtcgtggcgcaggttgatggtggtccgtctgccatgtttaatccagaccccaaaaaaccaattggtggcaacatcattgcgcacgccagtactactcgcatcagcctgaagaagggtcgcggagagaccagaatcgcaaagatctacgacagcccatgtttaccagagagcgactgcttgtttgccatcaacgaggacggcattggtgatcctagcccgaaggatatggagaagatgaatcagtag

SEQ ID NO: 27408 - DNA, 1195 bp, Neurospora crassa; identical to SEQ ID NO: 27407

SEQ ID NO: 27409 - DNA, 447 bp, Neurospora crassa
accggccagctctccgaacgagaactctccgcggcgctcgtcaacggggactggactgcctttgatccgcacaccgtccgcatgatgatccgcatgttcgacagcgaccgcagcggtaccatcgggtttgaggagttttgcgggctctggtccttcttggcctcgtggcggacgctgttcgatcgtttcgacatggacaagtctggcaacatcagcttggacgagttcaacaacgcactggtggcgtttcgctaccggcttagcccgcgctttgtcgagcttctctttcgcacgtacgacaagcgcggcgacggcgtcatgagcttcgatctctttgtgcaggcttgcatcagcctgaagcgcatgacggatgtgttcaagaagtacgatgatgatcgcgatgggtacatcacgctgagctttgaggacttcttgacggaaattctg

SEQ ID NO: 27410 - DNA, 2742 bp, Neurospora crassa
ctcgatcgggactggtacggcggtgacgatgaccttggcggccacacgtttggcgatgacagccacaatcccttcggcgatgagggcgcatgggcagcccaggagagggaggcggccctggcggagaagaaaattgggcagatggcgcgcggtatgagcgtccggcagattcagaaacaaaaggatgccgacgcctgggagacaaaccggatgctcacctcaggcgtggcgcaaaggagagacttgggacaggactttgaggatgaccaggaaggcaccagagtgcatcttctagtgcacgacttacgacctccttttctggatggacgaaccatcttcacaaagcagttggatccggtccccgctgtgcgagattctcaaagcgatatggctatcttcgctcgaaaaggaagcaaggtggtcagggaaaggaggacacaacgggagcgccaaagacaggcgcaggaggctaccaaggtggcaggaactgcactaggcaacctgatgggagtcaaggaggaagataccgacagcgccttgcctatcgctgtggaggaggaggccggcaaaagcaaaaacatgaacaagttcagtgaacacatgaaggagaacgagggtgccagcaatttcagccaaagcaagtccctcaaggaacaacgcgaatttcttcctgcctttgctgtacgggaggacctgctgcgtgtgatccgtgacaatcaggttgtcattgtgattggagaaacaggctctggtaagacgacacagctcacccagtttctctacgaggacggctacggcaagacgggcatgatcggttgcacccagcccaggagagtcgcggccatgagtgtagcgaagcgtgttgctgaggagatggaggtgaaacttggcagcacggtaggctacgccatccgcttcgaggattgcacgagcaaggatacggtcatcaagtacatgacggatggtgttcttctacgagaatcgctgaatgaaccagacctggaccgctactcatgcgttatcatggacgaagctcacgaaagagccctcaacactgatgtcttgatgggcttgtttaagaaaatccttcaaagacgccgcgacttgaagctgattgtcacgtctgcgacgatgaatgcaaagcggttttcagacttctatggtggtgcacccgagtttaccattcccggaagaaccttccctgtcgacatcatgttccatcggtcacctgtcgaagattacgtggaccaggctgtgcagcaagttctggcgattcacgtaggaaaaccagcaggcgatatcctcgttttcatgaccggccaggaagatattgaggtgacctgcgaactcatccgcgagcggctcgatgccctcaacgacccaccgaaactcagtatccttcccatctacagtcagatgcccgcagacttgcaggccaagattttcgacagggctgctccgggtgtccgaaaggtcatcgtggccacgaatatcgcggaaaccagtttgacggtggatggtatcatgtacgtggttgatgcaggctattcaaagctcaaggtatacaatccacgaatgggtatggatacccttcaaattacgcctatttcgcaagcaaacgccatgcagcgcgctggtcgtgcgggtcgcactgggcctggccaagcatatcatctcttcaccgagaaggccttcaaagaggagatgtacatgcaaaccattccggagattcagagaacgaatcttagcaataccgttctactcctcaagtcactcggtgttaaagacctccttgatttcgactttatggatccaccacctcaggataccatcagtacatctctcttcgatttgtgggcgttgggagcactggacaacctaggtgagctcaccgacttggggcggaagatgaatgcgttcccgatggacccaccccttgcaaaactgctcatcacctcggaggagtatgggtgcagcgaggaaatggtcaccatcgtttcgatgctttccgttcccaacgtattctaccggcccaaagaacgacaagaggagtcagatgcggctcgcgagaagttctttgtaccagaatcagaccacttgacctatctgcacgtttacacacaatggaaggccaacgggtataacgacggttggtgcgtgcgacactttttgcattccaagtctctccgtcgtgccaaggaagtccgcgagcagctcctggacatcatgaagatgcagaatatgaagatgacgagttgtggcaccgactgggatgttattcgcaagtgcatttgctctggctactatcaccaggcagcaaaggtcaagggcattggggagtatatcaacttgaggaccagtgtcaccgtccaattgcatccgacaagtgcgctttatggactgggcttcttgccagactacgtggtgtaccacgagctgatcctcacaagtaaagagtacatgtcgacggtgacctcggtagacccccactggttggcggatctcggtggtgtattttattcggtcaaggagaaaggatattcggcgcgggagaagaggatcacagagacggagttcaacaggagaatggagattgaggcgcggatggcagcggacaagaagcggcaagaggatcagctgcacgaagaagagcttcagcttgagaagaaggcggccccgtccaaggacaagaaggtggttaaagcgggtgccgtggtgaagccagtcaggaaacgtgctgga

SEQ ID NO: 27411 - DNA, 1064 bp, Neurospora crassa
atcttgctccgcgcctacggcaacggcaccgacttgatcatcgaccgccaccgcgaaacccagaaccacgagctgctcatgcgatacggcctcgctcccgaactgctcgcccgcttcgagaacggcatgatgtaccgcttcgttcagggctccatgacccaccccgaggatctgcgcaagcccgtcatctacaaggccgtggccaagaggcttgcccagtggcacgccgtggtaccttgcatcactgctcgcacgggacacagccgcagaaactccaagaacaccgacttcattgtaccgtctgaagcccttggtgatgccgagtttcagcaaatcattgacagtgtcgcgcctggaaagcccccgccgaacgtctggacggtcatgcagaagtggatttttgccctgccaacagatacggaagcgcaaagagagcgtcaggcccagttgcagaaggagcttaccaggactgttgccgagctgagccagcggccaggcttgggtaccaatggggtgagtactgccttctatctgtttcccgcgttttcggcatgacgggggataattttgctgatcacctcacacaacagctcgtgtttgcacactgcgatctcctcagcggcaacgtcatcgtccttcccaaaccccagcagacacccgccgacgacagcaacggcgtcaccgccaaagacacgaccatcgacgtgaccttcatcgattatgaatacgcgaccccctcaccagccgcctttgatattgccaaccactttgccgaatggggtggcttcgactgcgacttcagcgtccttcccacgcgcgtccagcgtcgcgagttcatcaccgcgtacatccgcgcctactatgcttaccaaggcaagaagaacggaaccacggccgattataatgaagcagctgaggtcgatcgcctactaaacgaggtggacgtcttccggggcctgcctggattctactggggcatctgggcgctgattcaggcgaccatctcccagatcgactttgactacgcctcctatgcagaaacaagactgggcgagtactgggcc

SEQ ID NO: 27412 - DNA, 1554 bp, Neurospora crassa
agagcgtttcatgccacgagagacctcaaagtcattaagccggtcctccttgccgatattggagagggtacgtccagagccagtggtcctcggtccatcttctccatagcttcgcgctaacggcttttgctaggtatcgtcgagtgcgaagtcatccaatggttcgtcgaacctggcgcccgagtcgaggagttctcgcagctgtgtgaagtccagagtgacaaggcttctgttgaaattaccagtcgctttgccggtgtagtcaaaaaactctactacgaagcgggcgaaatggccaaggtgggaaagccctttgttgatatcgacattgaggccggtccggagagcaaggaggtggaagcttggactccgcctggacctgtttcgaccctggaagggcagcaggcaatcaagggggaggctatctcgacatctacaccacaagctgttgcccctgaacttaaacagtcatttatcgaggcaccgtgggcacgacaaacgccaacaacatcctcgcacgcgccagtgacgaagcagacgggcaagcacgcgtcgttggcaactccagccgttaggcacttggcgagggagctgagcgtagacatcactcagatacctgggacaggcaaggatggacgggtgctcaaggaggatgtctacaagtttttacaagctagggactctgcgccaacactctacccatctgctgctacgccaacctcgccaggcgggaccgctgctgctgctgctgctgctgctaccgccgcgagcgcgttctcctccccagacgccacgatacccggccctcaaaaggaaactccggtgcctctcacaaggacgcaggaaatgatgttcaagtccatgacgcggtcactaaccatcccacatttcctctatgccgacgaagtcgatttcacccccctggtcgagttgcgcacgcgcctcaaccgggtcctctccaagtctggccttcccgagggccaggtcagcaaactgtcttatctccccttcatcatcaaggccgttagcatggctctttacaagtaccccgtcctcaatgctcgtgtcgagctcgatagcaacagcaatggcaagccatctctcgtcatgcgcagccagcacaacattggtgtcgcaatggacacaccttccggcttgctcgtgcccgtcatcaagaacgtcggaagcctcaacatcctgagcattgccgccgagctggcccgcttacagtctctagccgtggccggcaagctgtcgccccaggacatgtctggcggtacgatcaccgtcagcaacattggtagcatcggaggcacgtacctgtccccggtgatagtagatcgggaggtggccattctcggcatcggtcgcatgcgtactgtcccggcattctcgacggtgccaggggaggaagacaagattttgcgaagacagatctgcaacttcagttggagtgcggaccaccgcgtgattgacggggcgactatggctagggcggcggacgtggtgaggacgattgttgaggagcctgatgttatggttatgcacctcagg

SEQ ID NO: 27413 - DNA, 584 bp, Neurospora crassa
cagcatatctggctagtcaccggacctgctggatgcggcaagagtaccgtggcaagatacctagcggaatctctacattggccttatattgaaggtgacgaggtacgtgatgatgcccttccctctatggtgttatcccaactaacaaagtcaaaaagtttcacccaccagccaatatcgaaaagatgagcgccggtatcccccttaccgatgcggaccgctgggattggctcacagctctgcgcgaggcatcaattcgagctcttgatcagggcaatagcggcgtagttttgacgtgctctgcgctgaagcgcaagtaccgtgatgtcatcagagtggccccctatttcaccccgaatcttcaccttcactttatctacctcgatgcgtccgaggagatcctccttcaaagagtccttgctcgccaaaaccattacatgggtgccaacatggtccacagccagtttgaggctctcgagccaccaacgcctgccgagacggacgtgatccgcattgacgtgagccgtcctgccgacatggttatggcagatgccctgaaccaggttcttcatacaattgatgga

SEQ ID NO: 27414 - DNA, 2598 bp, Neurospora crassa
aaaacgacagctaaacggaagattgacatgggagatgaagaaatcatcaagcgcaagcttgtcaaactccctgacctggccctcgagaatgctgacgataccccatacgcggacgacgacgtggcggaagacgcggagaaagatttcgacgtactccttgccggcaccgaggaggaccgcgctgaagcccaacggttgctgcgcgagcggcgtgaggagcaaattcagaaagagagcatggctatggaaatcgacagtgccccttctaatatcgaggttgcaaccgagcctgtggcgcaaaatccgacagcgatggatgtagacgacgaagtcgacccactcgatgccttcatggctggacttgagcagacagcctctggcgaggagtcgcactctaaagccgatacgctgaccgaaaagaagaacggcaatattccgcctgaggcctacttcagtgatgatgactacggctatgaggcagatgggaccgaccccacttccattctcgccatggcttccaaaaagaagaagaaggatatccccacgatcgactacagcaagctcgacctgaatcctattcggaagaacttctgggttgagccgtatgagttaagtcacatgagcgaagaagaactggctgagttgcgattggagcttgatggcatcaaagtgtccgggaagaacatccccaagcccgttcagaagtggtctcagtgcggcctcacccgtcctattctcgataccattgagagccttgggtttgaaaagcctacgccgattcagatgcaagctctgcctgtcatcatgtcagggcgtgacgtgattggcgttgcaaagacgggatctggtaagacaatggcttttgccctgccgatgctccgccatgtcaaagatcaagaccccgttaccggcgacgatggtgccattgcgcttatcatgaccccgaccagagaactctgtacgcaaatttactcggacttgcaaccgtttgcaaaggctctgaagcttcgcgttgtcgctgcttatggtggaaacgccatcaaggaccagatcgccgagttgaagcgcggtgctgagatcattgtagccacaccaggtcgtctaatcgatcttcttgcggccaatggaggacgtgtaacaaacctcaagcgtgctacttatctagtccttgacgaggctgatcgaatgttcgacatgggctttgaaccccaggtcatgaaaatcttcaacaacgtccgcccagatcgccagaccatcctcttttctgcaaccatgcccaggattatcgacgcgttaaccaagaaggtcctgcgcgaccctgtcgagattactgtgggtgggcgcagtgtcgtagcacccgagatcacacagatcgttgaggtcatggacgagggtaagaagttcaaccgtctgctagaactccttggagagctttatgcggacgacgacgatgtccgttccttgatctttgtggagaggcaagaaaaggctgacgatctattacgcgaactcttacggcgcggctacggttgcatgtctatccatggaggtaaagaccaagaggaccgaaactcgaccatatctgatttcaagaagggtgtgtgccccatcctcattgcaacctcgattgcggcccgtggcctggatgtcaagcagttaaagctcgtcatcaactacgatgcccctaatcacttggaagactacgtccaccgcgctgggcgtactggacgcgctggtaacacgggtacggcagtcacctttataaccgaagagcaggagaattgcgcatctggcattgccaaagcgttggagcagagtggccagcccgttccagaccggctgaatgaaatgcgcaaagcatggaaggagaaggttaaggctggtaaagccaaggatgccagtgggtttggcggcaaaggccttgagaagctcgataaagaccgtgaggccgctcgcatgcgtgaacgcaagacccacaaggcggaaggcgaagaggacgatgtcaaagaagacgctcctgcagaagatggcgagaagaaggacaagaccaaggttgccatccagtccgctgtatctgccattgtgtcacgcgatgcctccaaggcggagaccgaggacaagcacgccatccctgcgggtgccgtcaaggccgggcatcacgcaagcagcggcaagagcggaggggctctcgacaaggcggcgtccgccatcagcgagatcaacgcacgtctcgcccgggccggtcagctccggcctggccagcccattgacaacaagggtcccgacgcgggcgcgttccacgcaactctcgagatcaacgacttcccccagaaggctcgttgggctgtcaccaaccgcaccaacgttgccaagatcctcgaagccacgggaacgtcgatcaccacaaagggcaactactatgctcctggaaaggagccaggtccgggtcaagaaccaaagctgtacattctcattgagggtgataccgaagttgtcgttggcaacgcgctgtcggagcttactcgtctgcttagagagggcacgatggcggcggcggatgctgagagccgtgctcctgctagcggtaggtatacgatt

SEQ ID NO: 27415 - DNA, 1156 bp, Neurospora crassa
cttggctccgtcatggtgattggcggctgtggcttcctcggtcaccacgttgtccgcgtgctcctccgcgactacatctgctccgtttccgtcatcgacctacgctgcacgcggaaccggcgacccgagtcggatggcgtccaatacttcgaggccgacatcacagaccccgccaggctcgaaaccatcttcaaccaggtcaagccccaggtcgtcatccacaccgcgtcgcctgccgcccagtccaacgacagcgtctctcatgcgctgttcaagaaggtcaacgtcgacggcaccgccgccatcatcaaggcgtgtcagcagacgggcgttaccgccctcgtctacaccagttccgccagtgtgatgagtgataacaagtccgacctcatcaatgcggacgaacgttggcccgtcatccgtggagcccagcagagcgagtactattcggagacaaaggtaccctcctacttcccctctctcccatatcccccaagagtgatgcatcccaaaactaacctccccctccctccaggccgccgccgaagaactggtcctccaggccaaccgttccgctgccgccccttccctgctcacctgctccatccgtccctcaggcatcatgggcgaaggcgacaccatgacgctgtaccacctaatcaaactgtaccagaacggcaagacctcggttcaagtcggcgacaacgataacctcttcgacttcacctacgtcgagaacgtagcgcacggtcacttgttggccgccgtcgccctcctccaaacctccaagctcaagatcgccccactagaccatgagcgcgtcgatggcgaggccttcatcattaccaacgactcgcccgtgtacttttgggatttctgccgggctgtgtggaacgctgcgggatctccccatgggactgagcacgtgtgggttttgccgcgcgatgttggtattgtgctgggctttttgtcggaagtcttctttgggatcattcgcaagccgccgacgtttaataggcagcgcatcatttatagctgcatgacgaggtactacgatatttccaaggctaagaagcggttgggatataagccgctggtgccattggatgaggcggtgaagaggtcggttaagtggacgctggagcagcagaagggg

SEQ ID NO: 27416 - DNA, 384 bp, Neurospora crassa
gaagacggcaatcccttcgtctggctagtgacatacttcggtaaacccatgacgaacctggacggtggcctgttccgaatcaggctttgcttcagtgcacggtttcccgaggagcaacctcgggcaaggttcgaaaccaagatctttcatcatcgtattgccgcggacggcacaccctgctactttgcgccgcagaaccgccgtgaggatgtcaggacgcacctcgaagccatcattgatgctcttgaagaggagagtcccccttatgatccgcgaactctagtcaaccccgaggcgttcaagttgttctggggctcagccgatgaccgaaagatgtacaatcggcgtcttcgccggtctgttcaacagtcaatggagtaagat

SEQ ID NO: 27417 - DNA, 1113 bp, Neurospora crassa
cgtccaaagaccctcagtgatgtcacagcccaagatcacaccattaccgtcctccaaagaacattacaggcttccaacgtttgtcaaacctgcttatttccccttcgtgtctctctcaagtcaaatttggacagccactgacctgtgtcgtcaaccctccagctcccacacatgctcttctacggccctccaggaacgggcaagacctcgaccatccttgctctcgccaaggagctctacggccccgaactcatcaagtcccgcgtcctagagctcaacgcctccgatgagcgtggtatctccatcgtccgcgaaaaggtcaaagactttgctcgcatgcagcttaccaatccctccgcggcttacaaggcgcgctacccatgtccgcccttcaagcttatcatcctcgacgaggccgacagcatgacgcaagacgcccagagcgcactgcgccgcactatggagacgtattcgaagatcacccgcttctgtcttatatgtaactacgtcactcgcattatcgatccgttggcgagtcgttgcagcaagtttcggttcaagagcctcgaccaggggaacgccaagaagaggctggaggagattgctcagctcgagggtgtcgggctagaagagggagctgtcgatgcgctgatcaagtgcagcgagggcgatttgagaaaggcgattacgtatttgcagagtgcggcaaggctagttggtgccgtggcagccacagctaaagacggggagcaaaaagaaaccgaaggcgacgacgagatggaagtggacgccaaattggttacggtcaaggtcgtggaggatatcgctggtgttatcccggacgataccattcagaggttactcgaagcgatgcggccccgcgctggggtggatacgtaccctgcggttgccaaggtggtcgaggaaatggtggcggatggttggagcgctgggcagaccatgacgcagctctaccaggcggtggttttcgacgagatgatcccggatgtgcagaagaacaagattgttatggtgttctcggaggtggataagaggctggtggacggcgcagacgaacatctgtccgtactcgacctggcgctacggatatcg

SEQ ID NO: 27418 - DNA, 3508 bp, Neurospora crassa
aggtggctctctgcctccgctgccgcggctgctgccagccagcccgcccccgacgcgaaggcttatatccagagcggcgttgtcaagccccgcgaccatgtcgacgtcaagaaggtgcttgtcatcggctccggtggtcttgccattggccaggccggcgagtttgactactccggtacgtctaatgtcttgtcgactcagtgaaaccagacacaaaacaaacaaacaaataaacaaacaaacagcagtgctgactctactctacccatccaggttctcaggcgctcaaggcccttaaggaggccggcgttgcttccgtgttgatcaaccccaacatcgctaccatccagaccaaccattccctcgccgatgaggtctactacctccccgtcacccccgagtatgtcgagtatgtcatccagagggagaagcccgatggtatcttcctgtccttcggtggtcagaccgctctcaacttgggtgtccagatgcagaagcttggcctcttcgagaagtacggtgtcaaggttctcggtaccagtgtcaggacactggagctttctgaggacagagatctcttcgccaaggcccttgaggagatcaacatccccattgccaagtccttcgctgtgaacaccgtcgacgaggccctcgacgctgccaacaagattggctaccctatcatcgtccgcgctgcctacgcccttggtggtctcggttccggtttcgccaacaacgaggaggagctccgcaacatggctgctcgctccctcaccctctccccccagatcttggtcgagaagtctctcaagggctggaaggaagttgagtacgaggtcgttcgtgatgccaacaacaactgcattactgtgtgcaatatggagaacttcgaccctctcggtatccacactggtgactctatcgttgttgctccttcccagaccctcagcgacgaggagtatcacatgctccgttccgctgccatcaagatcgtccgtcacttgggcgtcgttggtgaatgcaacgtccagtacgctcttcagcccgatggcttggactaccgtgtcattgaggtcaacgcccgtctctcccgctcgtctgccctcgcctccaaggctaccggctaccccctggcttacactgccgccaagatcggtctcggccacagccttcccgagctccccaacgctgtcaccaagaccaccaccgccaacttcgagccttctcttgactacatcgttaccaagattcccaggtgggatctgtccaagttccagcacgttaagcgcgatatcggctctgccatgaagtcagttggtgaagttatggctatcggccgtaccttcgaggagtctttccagaaggctatccgccaggttgacccccgcttcgtcggtttccagggtgacaagttcgaggatctcgatttcgagctccagaaccctactgaccgccgttggttggctgtcggtcaggccatgctccatgagaactactccgttgacagggtccacgagctctccaagatcgacaagtggttcctctacaagctccagaacatcgtcgactgccagaaggagatgcaacagcttggcagcctcgaggccctcaagaaggagcacatcctcaaggccaagaagctcggtttctccgataagcagatcgccatggccgtcaacagcaccgaggatcttgtccgcgctgccagaaaggggttcggtattaggccctgggttaagaagattgatactctggccgccgagttccctgccgacaccaactacctctacaccacttacaacgcctcttcccacgacgtcaccttcgaggacaagggtactgtcattctcggcagcggtgtctaccgtatcggttcctcggtcgagttcgattggtgcgctgtcagcgccactcaggccctgagggctatgggcgagaagactgtcatgattaactacaaccccgagacctactcgaccgatttcgataccgctgataagctttacttcgaggagcttagctacgagcgtgtcatggatatctacgagctcgagagcgcctctggtgttgtcgtctctgtcggtggtcagcttcctcagaacattgccctccgtctccaggaaactggaaaggcccgcgttctcggcactgatccccgcgatatcgaccgtgccgaggacagacaaaagttctctgagatcctcgacagcattggcgttgatcagcccgcctggaaggagctcacctccgtcgaggaggctgagaagtttgctgaggaggttggttaccccgtccttgtccgtccctcgtacgtcctctccggtgctgccatgaccgtcatccgcagcaaggaggatctcaaggataagcttgaggctgctgccaacgtctctcccgagcaccccgttgttatcaccaagttcattgagggcgcccaagagatcgatgttgatggtgttgcctctgagggtaaccttatcctccacgccgtctctgagcacgtcgagcaggctggtgttcactcgggtgatgccaccctcgtcctccctcccgccaaccttgaccagaccaccatggaccgcgtcaaggagatcgcccagaaggtcgccaaggcctggaggatcactggtcccttcaacatgcagatcatcaaggctgaggatcccgagggtggccttccggctctcaaggtcatcgagtgcaacctccgtgcctctcgttcgttccccttcgtctccaaggtccttggcgtcaacttcatcgacgctgctaccaaggcccttgttggtaagaacgtccctgagcccactgatctcatggctgtcaagcgtgactacctcgccaccaaggttccccagttctcctggacccgtcttgctggtgccgaccccttcctcggcgtcgagatggcctctaccggtgagatggcctgcttcggcaaggatctcgtcgatgcctactgggcctctctccagtccgccatgaacttccgcgttcccgagcccggcgagggtcttcttttcggtggtgacctcagcaagagctggttgaccaccattgtcgactacctcagccctctcggctacaagctctacgccgccgataacgaggtcaagcagttcctcgagtcctctgccaagaccaagatcgatgtcgaggtcattgccttccctaccaatgacaagcgtgcccttcgtgaggtcttcgccaagaacaacatccgtggtgtcttcaaccttgcccaggcccgtggcaagaccgtctttgatgtcgactacgttatgcgtcgcaacgccgtcgacttcggtgttcctctcttcatggagccccaggtaagcttcaccactgacctttccatccacggtgaccgaaaactaacgtttccttcttcccctagaccgctatgcttttcgctcagtgcatggccgagaagttgccccgccccgagggtatcccctctgaggtccgcaggtggtccgagttcattggcggcaagcctctgtagatg

SEQ ID NO: 27419 - DNA, 1277 bp, Neurospora crassa
ttattggactcgccctcgcggccgccgtttccggtgtcgtcgcccagcctcacaaccaccacggtcaccaccacgccaagaagcacgctcacgccggtattgataagcgcgccgatggtactgtcgtggtcactgaggtcgttcagggccccactgtcgtcgagtatgtcctagacggcaagaaggtcgatgccaatgaggcggagaagggcatcaaggagggtgattatgtcgtccttggctcatccaagccttcgttcgtcgcccccccgcccgttgtctcgacctcgaaggctagcatccctggcggtgccctgtttctcgagctgactagctcgatgtccacgtctacgtctacgtccacgtctacctcatcgtccaccacttcgagcatcccgaccacctcctcgagccccattcccagctcgacctccagcgagccccccgctgccacctcgtcggcggcttctgagaacctctctggcggtggacttgacagcgagttccccagcggtaagatcagatgcgatcatttccccagcgattacggcgccctcggcgttgactggctcaacttgtctggatggaccactcttgccaaggttggcaagctcatgaagggcgtggccatcaacaactacgagcagccaatcagcggcccatgccagccgggcatgctgtgctcgtatgcctgccctccgggctaccagaagactcagtggcctgaggactcccaaggtgccactggtcaatctatcggtggtctctactgcaacaacgacggcttccttgagctcacgcgtgcgagccaccctaccctttgcgagcagggtgccggcggtgtttatgtcaagaacatgctccccaagagcgctgccatctgccgtaccgactatcccggcaacgaggccatggtcattcctctcgagaccaaccccggcggccagtaccctctcaccaaccctgtgtcttcttcctactacaagtggaagggccagtccaccaccgctcagtactatgtcaacaacatgggcattcctgtcgacgatgcttgcacctggaattccaagtcctgccccgactgcgccggtaactgggcgcctgtcaacgttggtgttggcaagagtgacgatggcgttacttatatctccatcttccccaacgcccccactaccaacgccatcctcaacttcgacatggagatccagggtgatatttctggcgagtgctggctcaagaacggcaaatactctggcagcaatggctgcacggtatgt

SEQ ID NO: 27420 - DNA, 1323 bp, Neurospora crassa
atggccaccaacggtgttaacggtgcgaagcactacaacgagggaaccttcctcttcaccgtaagtctgcgccgacactctgtatatgcccatggccgaaccattcgctgatccgacctgtacagtccgagtccgtcggtgagggtcaccccgacaagatcgccgatcaggtttccgatgccattctcgatgcctgcttggccgaggaccctctctccaaggtcgcttgcgagaccgccaccaagactggtatgatcatggtcttcggtgagatcaccaccaaggccaagctcgactaccagaaggttgtccgcaacgccatcaaggacatcggctacgatgactcctctaagggcttcgactacaagacctgcaacctcctcgttgccattgaggagcagtctcccgatatcgctcagggtcttcaccttgacgaccgtctcgagaacctcggtgccggtgaccagggtatcatgttcggctatgccaccgacgagacccccgagctcttccctttgactctccttttcgcccacaagctcaacgccgccatgtccgctgcccgccgtgacggctccctcccctggctccgccccgacaccaagactcaggtcactatcgagtacaagcacgacaacggtgccgtcgttcccctccgcgtcgacaccgtcgtcgtctccgctcagcacgctcccgagatcaccactgaggagctccgcaaggagatccttgagaagatcatcaagaccaccatccccgccaagtatctcgatgagaagaccgtctaccacgtaagtacaaaaccggtcaatttaacatactttggcggtatcactgacacgttaattcctactacagatccagccttccggtctcttcgtcatcggtggtccccagggtgatgccggtcttactggccgtaagatcatcgtcgacacctacggtggctggggtgcccacggtggtggcgccttctccggcaaggacttctccaaggttgatcgttccgctgcctacgtcggccgctggatcgccaagtctctcgttgccgctggtcttgcccgccgtgccctcgttcagctctcctacgctatcggtgtcgctgagcccctctccatctacgtcgatacctacggcacctctgacaagacctctgaggagctcgtccagatcatccgcaacaacttcgatctccgccccggtgtcattgtcaaggagctcgatcttgccaagcccatctacctccagaccgccaagaacggccactttggtaccaaccagtccttcagctgggagaagcccaaggctctcaagttctaaatt

SEQ ID NO: 27421 - DNA, 1692 bp, Neurospora crassa
gactcgccttgcggtcctcttccagaccgtcgtgcatatatcgatcctgagcaacctgatacgaactacctcgacctcagcagctaccgactcttggccaagcgcgtcgccttgggcttacaacaagctggtctgaaagaaggcgacagagtgctcctcttctctggcaacaacatcttcttcccttctatcttccttggcatcttgatggccggaggcatcttcacaggtgccaatcccagttttgtggctcgagagctggcataccagcttcgcgacagtgaagccagcttcctcgtcacggcacagggctctcttgagacagcttttcaggcagctaaagaggctggcctgccgagggatcgcatttttgttctcggcggagatactcctgcagcacaagaagtagtgctatcttccaatcctggaccagggctgaagggccgggttgcgggagctaggcactggacagaactccttcagggaaatgccaaagaagccgagagttggagctggaaagagccaaaggatccgcagaccacgacatgctgtctcaactacagcagtgggaccactggagttcccaagggcgttgagatcagtcattattgctatgtcgcaaacggagttcaggttatccacctcaacaacctcaaccccgactgggaggaaaggcaaaagcgagcgcgtgccctctgcttcctgccgctttaccatgcctatggccagacatactttgtcgcgaacatgccgcgggccggcatccccatctacatcatgccgagcttcgatttcgttaagatgctcgagtatgttcagcgctatcggattacctcactgacctgcgtgccaccaattgtggtcgcgttggccaagtctcctcttaccaaaaaatacgatctttcaagtgtcgagggattgggttctggagccgctccgttggcaaaagaggtctcggacgaagcggagaagctgttcaatgggaaatttcgtcttcgccagggctggggcatgacggaaacgacatgtacttgtatgtcatgggatcctctcaataaggaacccagctcaggcgtgggcgagatgatgcccaactgctctggaaagctgatgtcactagacggaaaagtcgagatcaccaaggcaggggaaagaggcgagttctgggtcacaggccctaatttgatgcgcggttattggcgaaagcctgaagcgacagcggaaaccgttgtcgtcgacgcagatggcactcgctggctcaagacgggcgatattgcctacttcgatgcatacaagcctggaggtattgttcacatcgtcgacaggttgaaggagttgatcaaggtgaagggtaaccaggtggcgcctgctgaacttgaagggctgttgctcgagcatcctgaagtagccgatgccgcggtgatcggtgtgacgatcaacggcgaggaagttcctcgagcctacatcgttcgccagaatcccaagtcaaagattactggacaggagattgccggctggatggccggcaaggtgactcggtacaaacagctaaagggcggcgtcgtttttacggacaacattccgaagaacccggtaagttctgattatatcttttgatgttgcacgtacctaggcgctaatgcgtaactcgtacagtctggcaagattctgcgtaggcagctgcgtgatcgc

SEQ ID NO: 27422 - DNA, 822 bp, Neurospora crassa
gtcggccaccccttcgacaccatcaaagtgcgcctccaaaccagcgacgccacccgcttctccggcccgctccaatgccttacccaaaccatccgcaacgaaggtatcctgggtctctacaagggcgccagcccgccactggtcggctggatgttcatggacagtgttatgctcggctctttgactgtctatcgccgccttttgcgcgacaacctgttcaacccgccctggcaccccttgcacgaccccgccaaacccttgccttcgcatggccacgggttggcgggtattctggcgggcatgacggtcagcttcattgcagcgcccgtggaacacgtgaaagccagactgcagatccagtacgcggcgcgtaaggaggagaggatgtataagggccccattgactgcctcaaaaaggtgtacacgcaccacggtatcaggggcgtgtatcacggcttgggagcgacgatattgtttcgcagcttcttcttcttttggtggggcacgtatgatgtgttcagcaggtggatgaagcagtacacgcagatgagcacaccggctatcaatttctgggcgggcgggctgagcgcgcaagtgttttggctgactagttacccgagcgatgttgtgaagcaacggttcatgacggataatcttggaggagggctcggtgatggcgtcaggaggttcccgaggtggagggacgccgcggtggcggtttacagggagaatggtgcgaagggatactggcgcgggtttttgccttgcttcttaagggcattcccggcgaatgcgatggcactgttggtgtttgagggcgtc

SEQ ID NO: 27423 - DNA, 1302 bp, Neurospora crassa
cagaccatcacttgcaaggctgccatcgcctggggcgccggccaggagctcagttatgaggacgttgaggtggctccgcccaaggcccacgaggtcagaattcagatcaagcacaccggtgtctgccacacgggtgagttcgctcgcactccaagaaccttgatggctcgctcggttgggcttccgtgcagttcgcagtcgcattaaccaaagacatggtgtgatatgcagacgcctacaccctctcgggcaaggatcccgagggcgccttccccgtcatcctcggacacgagggtgccggtatcgtcgagtccgtcggcgagggcgtcaccaacgtgaagcccggcgaccacgtcatcgctctctacacccccgagtgcaaggagtgcaagttctgcaagtccggcaagaccaacctttgcggcaagattcgcgccacccagggcaggggtgtgatgcccgacggcacctcccgcttccgcgcccgtggtcaggacatcctccacttcatgggcacctccaccttcagccagtacaccgttgtcgccgacatttcggtcgtcgctgtgaacccggaggcccccatggaccgcacctgcctgctcggctgcggtatcaccaccggctacggcgccgccaccatcacggccaacgtcgagaagggcagtactgttgccatcttcggcgccggctgcgtcggcctcagcgtcatccagggtgctgttgccaacggcgcctccaagatcatcgctgtcgatgtcaaccccagcaaggaggagtggtctcgcaagttcggcgccactgacttcgtcaacccgagcaccctccccgagggccagtctgttgtcgacaagttgatcgagctgaccgacggtggttgcgactacacctttgactgcacaggcaacgttaaggtcatgcgtgctgctctcgaggcttgccacaagggttggggtcagagcatcatcatcggtgttgctgctgccggccaggagatttccaccaggcgtaagttcttctatccgtcaactcgttcccctgctagccattatatgctcaacaatgctaacgtacgttcatcctatagcgttcatgctggtcaccggccgcgtctggaggggttccgccttcggtggcgtcaagggccgctctcagctgcccggtcttgtcgaagactatctcaacggcaagatcaaggttgacgagttgatcacgcaccgcaagaagctggccgagatcaacaacgcctttgaggtcatgcatcagggcgactgtgttcgtgcggtcgtcgatatgtcgtag

SEQ ID NO: 27424 - DNA, 2810 bp, Neurospora crassa
agataaacaagaggctgacccgcttatgtcacagacgattttcaagctcgtagttcggacgagttgagcttaaccaagggtgaccgcgtggaactgattgaacgcgatgacgaattcggtgacggctggttcttgggaaagcatttggcaaatggcaacagtggtcttttcccagaaggtatacacaccccctcctatgtataagccacagaagagctgcatggcaaacagctctttcgtgcccgcgctgtaactgacttcgccctacagtctatacgcgtcctgcacccaagccccattccagcagcccgtctctccaaaaacctgttctcgcgccgctggccgaaatcgttaacgagcaaacggcaaattccacttattcttacggcaacttcaacaagattgggaaatcggccgatgaaaccttaccgttaagctccttcaagccagcttcagcacccgacggccctgcacattcgtttctcagcagtagtttgccaatagggggtattggacgccccggcgctgacagccacgtcctacacgagactctgaatgtgatcgacgaacatattacggatttgaactcgccgcaaagcaacggagctcttcgaaacactggcgattctggtagcgaatacagctcgcacataggcaaccgtgtctcatacattcaaggcgaagaaacggatgaggaggaagaaggaaaccatacacgaagcgaggtcgaatcctggtctgccgatcaagttgccgagtacttgtttacggtaggagtggagaagcaccactgtgaggtgttccgtgaccaggagatcaccggagaggtcattctcgggatggatcaaacatcgctatttatcaaagcctttgatctggggtctgtgggaagacggctaaaaacttggcagaagatcaaaaacctacaggatgaggtcaacggagaagggccaggctcgcgcgtactcagccagtcgtatgggagcgaggtcgggtctgatgcacaagggaagatgcgcagcaggacgaacaccctcacagggtcgactccacggtactcatccaacaccagccaatctctgtcagtccagacaaagcgctcgtcggaaacccccaaaatggaccctgtccagcccgtgtctccagtctcacctctgatggagagcccaaatcgtatgttccacgaaaggagaccctccgctgcagacatcagagacttgcaccactcccgtcgccattcctcgactgatttccgtctcgcaggagcatccccggccacccctaaagtctcaggtggaacgttgcacggaacagaggtgccccacaagaagcaaccgtctttcgaccgaaactggacgctgggcagtgcaagcaactctaaccatcccgagtcctcggccgggcaacaagataatgtggctgttcaggagcctgagatccaggattcggcagtagacttggatcgaggctacttgtcaggaaccgatgccgatcctcggcagcggaacgtgctgaagaagcgtgagagcaaggcccctgctctcgcggaatcgccaaagacgagctacacggaagagcagcgtgtgcggagcgccacaactctttctcgacagtcacggttaggcagcattgattcctcccgtgaagcagttggcatcttgcctgctgcacagaaatactacgggctggttaggcgcacagcttccacggctaccatggagtcagctcgtctctccatcgaacgcaaccaccctacggttaccaaactcgagggatcgccggagcaaagcaggtcctctcccagatcggctctcaaacgcctgagccaagtcaaccacccggactttaatatggccggcatgctaaagaacggcttcggcgggctacgagccgcctcagacgcgatcacgggtaccgaacgagcaaaagtggcgtcaccagtggacacgccgtccaaagactcgtctatctattcgcccacacgcaccggctcaaccacgccctcggccggccgaagtttggatctcgaccaggagactgccaagagtttgagcaccgtggcaaccgcggcctctgccgcgaaacaagcagcaaaccggaagaagaccaagaaggagacaagtgcttatacgcgtggtttacaaaagatcggcccacgagaatcgatcaaggatgcggactacagtggatggatgaagaagaggagtgccaacctgatgaccacatggaagccgcgactctttgtcctgaagggtagacgcttggcttactattattctgaagacgaccaagaggagaaaggcttaattgacatttccttccatcgggtacttccggcggacaatgagcgcttgactggcttccatgcgacgcttatgggggctagtacctccccagcaatcccggctggaagccatgtccagacgctcgcagacgcggatgcagagcgggatccaacggaagagggggatcagatgttcatcttcaagcttgttccaccacgagccggtctctcgcgagcagtgaacttcacaaagcctacagtacactactttgcagtacccaacatcaagcagggtcgcctgtggatggcagctctcatgaaggcgactattgatcgcgatgatacccaagcagtcacgacgacataccagcagaaaactatctcgctcaccaaggcgcgccagatgcttcacagaccaccagcattgatgaatttggtggaggccagtgaagacaatgctggtgacgacaaaagggggcccgcaaaggagcaaaatggcctaggtattagctacaacgaggcggac

SEQ ID NO: 27425 - DNA, 1403 bp, Neurospora crassa
ctaaacatttacgaacgcggcgaaattgtggattacaaggacgtctacttctgcggtactcagaatgcggccaaggtcgttggtaacgttcaatcggaccttcccaactttgggtacgatgatgagcgaggagactactcgattattatcggcgatcatcttgcatacagatatgaaatcattgatgttcttggaaagggtagcttcgggcaggttgttcgatgcatcgatcataagactggcgtccttgtggccgtcaaaatcatccgaaacaagaagcggttccaccagcaggctcttgtggaagtcaatatcctgcagaagcttcgcgaatgggtaagtttcttgtcgaagattcatcctaaccttacttctttgttcgctaacaagtaaatttccaggaccccaagaataagcacagcatggtgaatttcacccacagcttctatttccgtgggcatctctgcatttccaccgaattacttgatatgaatctttacgagtttatcaagtccaacgctttccggggcttctctctcaagttgattcggcggttcactaaacaaatgctcagctcactgcttctgctcaagcagcacaaggttattcattgcgacttgaagccagaaaacatccttctgcgacaccctctacactcggagatcaaggtcattgattttggttccagctgtttcgaaaacgagaaggtttatacttacattcagtcacgcttttaccgatcccccgaggttatcctgggtatgacctatggccttcccattgatatgtggtcgctgggctgcattctggcggaactcttcactggagttcccattttccctggcgagaacgagcaggaacagctggcatgcatcatggaagtattcgggcctccggagaagcacctcattgaaaagtcaacacgcaagaaactcttcttcgatagctctggcaagccgcgtcttaccgtctcctcgaagggccgccgccgccgcccctcttccaagaccttgcagcaggttctcaagtgcgatgatcaaccattcttggatttcattgctcgatgcctcaggtgggatccggatagaagaatgaagcccgaagaagccgtacgacatgagttcatcaccggacaaaagactccgccctcgtcttccatgccagtgccacgccttgcatcgacgcgggaatcatccccaagcaagcgtgtacagaatctgaacggaggacctcgcccgctgccggagccgccggccgccgctgtcaccaccagaacctcactacggtcaggagttgtcagttctggtatgcctcagggtcctttaaaacccactcttgctagtggtatgttgccttcctcccgtaaggtctctggcgtgacggcttcggctagtggggcaacg

SEQ ID NO: 27426 - DNA, 1307 bp, Neurospora crassa
atcaccaccatctctcccaccacgggggaacccatcatcactcgcaatggcatttcagaggaggaactcgtccaactgcccgagactgccttcaaggccttccaaggatggcgcactaccaagttggaggacagacagatcatcgtcaagaaggccttgaagttgctggccgagaagcaggatgaacttgcagaggaactcaccgtccagatgggccgccccattgcttatactgccaaggaggttgccactgccatcaagcgctcagagtatctgctcaagatcagcaacgatgctctgaaggacaccgatggcgaggaggagaagggattcaagaggttcatccgaaaggtgcctgttggtcctgttctcatcatctttgcttggaacgtaagtggtgtccatcatgttgttttgacactccatccgtcacctctaactttgcgcagtacccctatcttattctcgtcaacgccttgattcccgctttattgtctggaaattcggtcattctcaagccctcgcctcagacacccacaattgtcgagcaggtggccaaggtgttttccgaggctgggttgcccgacggagtcatccagtacttccactcgggttcgccgacagtgattgaaacaattgtgcgaaaccccaagattgccaacatttgctttaccggctcggttgctggtggcctggccgtccagaaggccgcgtccgatcgcatcgtcaacgtcggcctcgagctgggtggcaaggatcctgcatatgttcgcggtgatgtcgatattgcctgggctgccgaagagattgtcgacggcgcagttttcaactcgggtcaaagctgctgctcgattgagcgagtgtacgttgacgagaagattcacgacgagtttattgcggccgtccagaacgttcttaagggatacaagcttggagatccgttggataaagggacgcatctcggcccagtcatctcggcgcgctccaaggagaccatccaggcacacatcaaggacgcgctcgacaagggcgccaagaatgcgacacccgagaatgagacattcagcattctgccagacaaaggtaactttgtcgcaccgacattgctgaccggcgtggatcacaccatgaccgttatgaaggacgagacttttggtcccgtcattccagtcatgaaggtcaagagcgatgccgaggcaattcagttgatgaacgacagcgaatttggcctcactgccagtatttggaccaaggacacggccaagggatacgaactcgccgaggaagtagaggcagggacagttttc

SEQ ID NO: 27427 - DNA, 1206 bp, Neurospora crassa
gccgtctcggctcccggcaaggtcctccttgcaggtggatatctagtcctcgaccgcaactacaccggcctcgtctttggtctcagcgcccgcatcaacgtcatctcccgggacatccaggccagccccggggttcatattaacgagatcattgtcaggagccctcagttcctgaaagccgaatggcgctacggctaccacctggccgatgaagacggcggcatcaagacgatccagctacagggaggcgcttctgcctcggccaagggcaaccccttcgtcgagactacgctcaactatgcgctcacctacatcacccgccgcgccgcctacgggactacgcaaactttgaagcccgtcaccctcaccatcctcgccgataacgactattacagctcgcccaccaacaacagcaacgccgccgccggaaaaggcagcggtggcagtcgcttcgccgcctactccaccaccctggaagacgcgcacaagacgggcctcggctcctctgccgccctcgtcaccgccctgaccgcctccctgctttctcactacctagacccttccctcttcgacctcgccaccgacgagggcaagcgcatcctgcacaatctcgcgcaagcagctcactgcgccgcgcagggtaaagtcggcagcgggtttgatgtggctgccgccgtctacgggtccagccactaccgccgcttttcgccttccattttgtcgtctctgcccgaggcgggcaagcctggtttttccgccaagctgttcagcgttgtgaatggtaaggatgctgagtctcaatgggacaccgaggtggtgaaagatgctgtaagcctgcccaagggcgtggcggtgcgcatgtgcgatgtcgactgcggcagccagacggtcggcatggtcaagcaggtgcttgcgtggcgggcggcccagcccaaggaggccaaggagctctgggatgagttacagcgcaggaacgagaaattggccagcgtgttgaaggagggcaagacggaggagatcaggccggcggtgcacgctattcgcgagctggtgaggaagatgggcacggaaagcggggtaccgatcgagccggatagtcagaaggagttgttggatgcgctggaggaaggggtggaaggtgtctatgggggtgtggtaccgggtgcgggaggctatgatgccctggcgttgctggtaagggatgat

SEQ ID NO: 27428 - DNA, 556 bp, Neurospora crassa
caatagatccccaccgtgttcgagaattacgttaccgactgccgagtagatggcaagtcggttcaactagcgctatgggacacagccggacaagaagactatgagcgattacgaccactagcatactcaaaggcgcatgtcattctaatagggttttctgtcgacacgccagattctttggacaacgttaaacacaaggtgggtggttcgagcgacacatcgtctcagcaaatcatcaaatcagactactaattaggacatttcacagtgggttactgaggccaatgaaagatgtcccaatgttcccatcattttggtgggtctcaagaaggatctcaggggagatcctgttgccatcgaagaaatgcgaaagcgatcccaacgattcgtgatggaggacgaaggccagaggatagcaaaggagattggcgctcgaaagtatctcgaatgttccagtcttaccggagaaggtgttgacgacgtattcgaggcagccacgcgagcggcgctgctaacgtttgagaagaaggaaggaagcgggtgctgtgtgattcta

SEQ ID NO: 27429 - DNA, 3800 bp, Neurospora crassa
atgctaacgacctacaacagtcacgccctacacaacgccgtgcgcagatcgtaagtggatcaagatgagctctcgtcgttacgcctctcctaactgagtaaacagatcgactcagatgaagaagatgaaccatccgaatcggatgccacaccggtgtctagaaagcctgcgaagagacgtcgggttgaacgctcgttgcctggtaagttttcatccgtcatactcctcggcattttgtttcactgctgacttgtcgtgatttccagcttccaagcgtggcactcctgctcgccaaccctcaatcgatgattccgactcggacacatatggaggcgccaaagcccgcagcttccaaagaaaggtccgcaggcaacaagaacaggaccctgccttggcttttagcgaaaagagatggtctagccgtcgggccgcccaggtctcagccggtgcctaccaagaaagtgacgccgaagaagatgaagaggacgactccgagcttacccccaactactggtctgccaatgtcgaggataactcgccatacatcgagaaaatcctcggtcatcgtcctaaggagggtgtcgaggtcacggtggattctacgcgacacgactttgaatacttcatcaagtggcagggacaatcatatccccacaacacctgggaaactacggaaactgtcgcaggcttccgaggctttcgccgcctcgaaaactattacaagaaggttgttgagtacgaactggagatgcaattcggtggcgacgatatcagtccggagcagaaagagcagtggtacctggatagagaacgtgagcaagaggccctcgaagactacacaaaggtcgagcgcgttgtggctgtcagagacggtgatgagggcaccgagtattacatcaagtggaagggcctgcaatacgacgagtgcacctgggaagccgagtctctcgtggccgaacttgctcaggacaagattaaccagttcctcgaccgatgcaaccggtcatggcagtctgaccgcaagcaaactaaccccgatacccggtcgaggatgaccaaactggagaagcagcctgactatatcaagggcggcgagcttcgcgagttccaaatgaaaggccttaacttccttgctctcaactgggtaaggggcaacaacgtcatcttagccgatgaaatgggtctgggaaagactgtccaaagcgtctcgttcctcagctggttacggaatgaacgcggccaggaaggaccgttccttgtcgtcgctcctcttagcgtcatccccgcttggtgcgatacatttaatcattgggctccggatctcaattacgtcgtttacctgggcccggaggcagctcggtccaacattcgagattacgaactttttgtggatggtaacccaaagaagaccaagttcaatgtcttagtcacttcctatgactacatcttggccgatgcggatcatctcaagaacatcaaatggcaagttctcgctgttgacgaggcccaccgtctcaagaaccgagagtcacagctctacatcaagctcaacaacttcggcgttccttgcaaggtcctcattaccggcacacccattcagaacaatctggccgaactctcagccctcctcgacttccttaaccccggaaaggtcgtcattgatgaggagcttgaagcgttgtctaccgcagataacaaaggtcccactgatgaagaacaggatgaggctaggcgtatcaggacccaagagaagctccgcgagttgcatcagtcaatcgctcctttcattttgcgtcgcaccaaggagacggtcgagtcggacctcccccccaaaaccgaaaagatcatccgagttgagttgtctgacgtgcaacttgactactacaagaacattctcacacgcaactatgctgccctcagcgacgcgagcaacggccacaagcaatcgttgctcaacatcatgatggagctgaagaaagtcagtaaccacccgtacatgttccagggtgccgaggagcgtgtcctcaacggcagcacacgccgtgaagaccagatcaagggtctcattacaagtagcggcaagatgatgcttcttgatcagctgctggcaaaacttaggaaggacggacatcgtgttctgatcttcagtcagatggtcaagatgctagacattttgggtgactatctccgtgttcgcggatatcaattccagcgactcgacggtaccattcctgccggcccaagacgtatggcgatcaatcattttaacgccgagggcagcgatgatttctgcttccttttgtctacccgcgccggtggccttggaatcaatcttatgacggctgatactgtcatcatctatgactcggactggaatccccaggccgatcttcaggcaatggctcgagctcaccgtatcggccagaaaagacctgttaatgtctaccgcctcgtggccaagcagactattgaagaggaagttgtaaagcgagcccgcaacaagctcttcttggagtatcttaccattcaggccggtgtgacagatgaaggcaaggctctcaaagagcagttcaaggagcgcggcctcaagatggacgaggctaagaccgctgaggatatctcgatgatcctcaagatgcgttcccagaacctgttcgaacaatctagcaaccagcagaagctggagcagctcgatatcgatgctatcctcgagaatgccgaagttaccaaaactgatgtcgatgacaagatcaacctgagcagtggtggtatcgactgggataactggatgcaggtcaccgatgtcaaagttgacgatctcgcccttgactgggatcagatcattccagccgagcagcttgctgccatcaaggctgaggaaaatagaaagaaggaagaggagtacttggcaaaaacgatagaggagaatgctcctagaaaagctgcgttgaaaggctccaaaaagagcgcagagaacgatcgagctgagcgtctggcaaagaagcgacaacgcgagagggaagagcaggaagagctcgaagagcaacgtgcattgctttctgatcccaaacgccccctcaatgagaaagaaacccgaaaccttatcagggccttcttcaggtacggttccttggacgaccgcgaagaagaggttgtccaggatgcccgccttagtgatagagatcgggactttctgaagtctattatcgaggaccttgtcgttatcagtcgccgcgctgtagatgcgaacaacgagagacttcgcgaagaagaagccagggctggcaagccactggcgaagaaggataagaaggctgtacttgtcgattttggcgaggtgcggaaagtcaacgcagagactgtcgtggagcgaccccctcagctcaaactcctgcgtcgcgtcctccgggagcacgcagacattctcagtttcaggcttcccgaagcttccaaggctgccgcatatacttgcgactggggtgcacgcgaggatgccatgctgcttattggaatcgacaggtacggatttggtgcgtggacgcaaatcagggacgatcctgagttgcagatgcacgacaagttcttcctggaggagcatcgtgtcgacaaacgggaagaacgaaagaagacggaggctgtagggattcaatcccctggtgctgttcatttggtccgaaggtccgagtatctcctgtctgttctgttggccaagcactctaatgatgctgccgctaagaaggcagtggagaaccaccatcggagcaagaagcttctcacgaacaacggccatcgacgcggtg

SEQ ID NO: 27430 - DNA, 2949 bp, Neurospora crassa
gcaaccatggcgagcttaaagagatccttcgagtccgatccgtttgcccagaacatttcgagcaaagtctacgtgcgttcgacgaagagtggcaaggtgcagaagattgtgcgcgaggtttacctgcgtcaagatatcccttgttcttccaagctctgcaatgcctgcctcaagattgcgcccagagatgccgccaaccgtccgattccttttgtactctcagagaagcccgccggcaccagcgtcttcacacagggccattacatcgtccccgacaccaacgctttcctcagcgccatggacctcttcgagcagagctctgcattctacgatgtaatcgtcctacaagttgttctcgaagaagtccgagcccgctcactgccgctgtacaaccgactcgtcagcttgaccaagagcgaagacaagcgattctacgtcttcttcaacgaattccgcctcgagacctacgtcacccgcgaagagaacgagtccgtcaacgaccgcaacgaccgcgccgtacgcaaagccgtcaagtggtacaacgaacatctttccaagacgtccaagaaggcacctgccgtggttatgctgagtaatgatcgggataacctgcgaaaggccaaggaggatgatatcccggcctactctctggctaactatgtcagccagctcaaggatggcgagcagcttctggatatgattccagaattggaggagcgcgatgcgctaattgaaaagaaacccggacagtttctataccccgaacactatacactgtccaagatgaacacgggcgtcaagaatggcttgcttcaccagggcatcttcaacgtctcgccttacaactacctggaaggctccatcagagttcctgcgttccccaaggcgctactaatattgggcagagaaaacatcaaccgtgccgttgacggtgacttggttgtggtggaagttctgccaaaggaccaatggaagcagccgtcaacccaggtcattgaggaggaggctgtcaccatgaacgagaatccaacggaagagggatccgacctgatttcagagaaggagcgcaaggtgctacaagaagaggccaagcggacgttggccaaaaccaccgaaggtcatgctctgccaaccgcaaaggtggtcggtgtaatcaaacggaactggcgtcaatatgtcggccatatcgaccagtcttcagtcagttcatcggcagcgcagggacggaagcaagacagtgtctttgtcatcccgatggacaagaagattcccaagatccgcctgcgtaccaggcaggtcgccgagcttctaggaaagagaattctcgtcacgattgatgcttgggacagaacatctcgccacccgaccggtcactttgtccggtctcttggtgagctcgaaacgaaggctgctgagaccgaggcgttgttgcttgagtacgatgtgcagtataggcccttccccaagactgtccttgactgccttcctaaggagggtcacgattggaaggtacctgcaagtatggacgacccgggatggagagacagacaagaccttcgcgaccttctcatctgcagtatcgatcctatcggctgccaagatattgacgatgcgctccacgctcgcgctctccccaatggcaactttgaggtcggtgtgcacattgctgacgtgtcccacttcgtgaagcccaacaatgccatggataccgaagccagcatccgtggcacaacggtctacctggtcgacaagcgtattgacatgttgcccatgcttttgggtactgatctgtgctcgctcaagccctacgtcgagcgttatgctttctctgtcatctgggagatgaattccaacgccgacattgtcggatcgagattcaccaagtcggtcatcaaatctcgtgaggcctttagctacgaacaagcacagctgcgcatcgacgatgcttcgcaacaagacgagctcacaaacagcatccggacactacttgagctttccaagaagctgaagcagaagaggttggacgccggtgccctcagtctctcctcccccgagatcaaggtccacatggagtccgagacttccgatcccatcgacgtcaagaccaaggagcacctccctaccatgtctctcgtcgaagagttcatgcttctcgcgaacaccagcgtggccgccaagatctacgaagccttcccgcaaaccgccatcctgcgtcggcacgcggccccacccaagaccaacttcgacgagctcgccaaccagctgcgcgtcaagaagggtctcgacctttccgtcgagtcctcgcgcgccctcgccgatagcctcgacctgtgcgtcgaccccaaggaacccttcttcaacacgctcatccgcatcatggctacgcgctgcatgatgtcggccgagtacttttgctcgggcacccaatcctacccggagttccgccactacggcttggcctctgagatctacacgcacttcacgtcgcccatccgccgctacgccgatttagttgcccatcggcagctcgccgccgcgattgagtacgaggccgtccacccggccgtccgctcccgtggccgccttgaggccgtgtgcaagaacatcaacgtgcgccaccgcaatgcccagttggccggccgtgccagcattgcttattatgtcggccaggccctgcgcggcaaggctacggaggaggacggcttcgtcatgaagatctttagcaatggctttgttgtgctcgtgccgaagttcggtatcgagagcttgatccgtctgcgtgacctggcggagccggagccggcggcgacgtatgatgccgagacgtacacgctgaccacatcgggaagcagggaggttaaggtggagttgttccagaaggtcagggtgagggtgacggatcagaaggatgagacgacggggaagaggggggtgaagatggagcttgtt

SEQ ID NO: 27431 - DNA, 2958 bp, Neurospora crassa
agtcgatatgtcgagagtcattctggctcggtgccttctctggtgcccgggtccctgaccagctccctgcccctggccaatggatcgagcagtcgccgcggtgctagctcagagacgtatgccaatgggactccgtcacgaccacagcgcccaaccgcccctgccaggacgccttccaacacttatcagccctacaaccagcgcaggcccccacaaggtcagccttcgtcctatatggcgaataatccccacgcccgtgatggctccagaccacgccccttggccggcacttcaaccttcagagcccaggagagagaatatgtgcgcagattacgacaacaggactacaacaacgactactttgacgcttacggctccggcgagcagtacgattccgattccgaaggcgagacgccatcttccgagggcgcgttcgacagctacgatgatgcgcatatcatgttcgccagtaacgaggatatccagattaccgaggaagacctgagagatcccgagagccgcgagagactagaatggcacggcatgctggaggctgtgctcaccggtgatgttgtgcggcaagagaagaaacgtctcattggctccaatgatgaggcctttggaaagtcagctcacaatgtagagctgtggcttgggattcgggcaaggctatgtggtcgacacctgccagtccagaaacgggtcgtcgaagatgcccgtgcagcgctggaccgttccattaacgacattatcaactttgcgattgctggagagagcgaggcaggaaagccgccatttgaacaggttcgcgatgtggttaacaaaatcgaaagaatcgagagcctctacccgtccagtagggaactcatgaccgccctcaagcctggtgtttattcggcctatcaggagacctgcgacgcagtgatatcatggtacaacgtcaatgagatgatcaacacagagctgtcgatcttgaaaaagtgggtcggcaacgatgctctcgacttctcccgcaccaaggaaaaatcacccagcgggaatggtctcagcgatgaatcatctttcctggatcgtctcatgaaggaggagggtctcaagtcactgcacgaagacaaaggctccgaaccgaaaagcctaaagaagaagagcagactcgacggcatctctcgtgtcatcaccaaggccaaggacacacttattcaaaatgccgaaggtttccagaagcgccatctcccgccttacatcgaggagctgctcaccctcatcagtttcccttcacgcctcattgaggagatcatcaagatgcggctggcttatgctaagaagatgaaggactcggcacaacaaaaccccatgatgcaggatcaaatgatctcgcagttccaggttcttctcaagctcgccatcaagattaagcgcgagtacatggaaatcgctcgaccggagcccggttgggacttgcccccatgtattgatgaggatttcgaccgtgtcatcctggaggcgctcaagtactacttcaaactgttgaactggaagctcagcggcaacaagaacaccttcaaggaggccgaactgctattccaagagtggggttttggaaacgaaatcgggcgttacttggcacacggcgatgtggaagtcgcggaacagttcagttctctaacctacaaagcctggaaccgactgagccaaacttttgaaaaggaggttcaacgaaggccaaaagaaagcgtgcctgagatgaccaagcgatataaacagatcctagactccgttcgggttcggcagcgaatgctgcagcgtttctctagaatgttgaacgacaactatgaaaatgcatgcgattacacaatcgcatttgagcagcctcaaatgctccaccaactgtacgaccgcctgatagagacgggccatttccaggtttatagtgccagtcctgaacacaaagacatactcatcattgcctccccgacacttcataaccgcgacgatgagatccaagtgctgatgggcactttcacatatgaggccgctattgaggacccatcggatccctaccttctcatcattaaagccgaagatccacctcagtggctcgggcccgtccacactctcagagtccgcaatgagcccctggacatcaagttggggcacatgcgactcattgccggcggctgccaacccagactattgaatgcgcgcaaggcctttgtcgacaggatcgatatgcaggtcgacccagtggtagagcagaggtcaaacctgcaaaaggtcaacttcaggctcatggagattcgcaaggttgccttcaagctctcgaacgctttcatggacagtgtggaagccatccgacgacaaacacgaggtctcaattgccaagaactaatccagacatgcttcatctttgcaaccgagttcggccagcggtctttgctgtacatggacaacaatcgacgcacaatgaataacctgaaactcaccaagcttgctttggactgggtaagcttcatctgtgacgactgcatctcttcagaccggaaaaccttccgctgggccgtgcaggccctggagtttgccatgggcatgacgcgtggaagacacattctcggcctcggagaagacgagtatgcaagattgagagccaaggttgccgggtgcatggcgcttctgatatctcatttcgacatcatgggtgccagatccagcgtggccgcccaggcggagaagaagcgcttggagggactcgtcaaccagatcaagcgtctgaacaaaggtcaaatgttggatgacaacgaagcagccaagtactaccaagaacatcgcctcgaagagttggcaaaagtcgacaactacagaaaggagatcctactgcaacaatctgccatgggtagagtcttggaggcttctaacgaggtggatcggtcgcttgcatggctctcctccacagcgaccaac

SEQ ID NO: 27432 - DNA, 1656 bp, Neurospora crassa
caacactatgccaaaggctcagaatcacgacacaagctcacggaagcttatacggcgctttcaaagaatcttcctgtcgacgttcccattaacatccgcggaaggacggtaagcgtgtgcccaaagatgtccattcatccgaagccgtccgctaaccatcgcccataaacgcagcttagcaaagcagacaccaagtaccaggtgaaccccgccgatcaccaacagaaaatagccaattatgccgtggcaacccccgaaatggtcaacctggctatcaatgccgccctgaacgcaaagccggcatgggaaagcttgcccttcgctgacagagcggcagtcttcctcaaggccgccgatctgattagcaccaagtatcgctacgagttgatggccgcaacaatgttgggccaaggcaagaacgcctggcaggccgaaatcgatgccgctgctgagctctgtgactttctccgcttcaacgtccaatatgcggagcaactatacgctcagcaaccggcacataactcccccggtgtctggaaccgtgtcgagtacaggccacttgagggctttgtctatgccgtcaccccgttcaacttcactgccattgcgggcaaccttccaggcgtggcagcactgctgggcaatgttgtggtctggaagccgagcgattccgcgatcctcagcaactaccttctgtacaaggtccttctcgaagcgggactcccgcccgatgtcattcagttcatccccggcgatcctgagttggtgacaaaggaagtgctcgcgcacaaggactttgcggctctacactacacaggcagcactgccgtcttccgtaagctctatggccagattggcgctggcgttgctgagggtaggtatcgatcatatcctcgcattgttggcgaaaccggtggcaagaacttccacctggttcacaagtctgccgatctacgaaacgctgttgtccagacggtccgcggtgcattcgaataccagggccagaagtgcagcgccacttcccgactgtacgttgccaagtcgatttggccagatttccaggagcttctcgtccaagaaacggagaagttgaaagttggcccacctcatgatcatggaaacttcatgggcccggtcattcatgccgcctctttcaagaagctgagcacggctattgacgagggcaaaaaagacccagacctccagctaattgcaggaggagaatacgacagctcggttggttactacgtcaagccaaccatctttgtgtccaagacgccagaccataaactcttttcgacggagctgttcggacccgtcttgacggtctacgtctatgatgactacgtagacagcactacctctatctacgacatcatcgacggagctacggaatatgggctgacgggctcaatctttgcaagtgaccggagcgttatccggttcgcagaggagaaactccgcaactcggcaggaaacttctacattaactgcaagagtacgggtgctgttgtaggccagcagccatttggtggcagccgagcgagcgggaccaatgacaaggccggcagcatcaacctcctgagtcggtttgttagcatgagaagcatcaaggaggaatttaactcgacgaccacggtgacatatcccagcaat

SEQ ID NO: 27433 - DNA, 1449 bp, Neurospora crassa
catgtccgcacctacgccgatcaggtcatcaaagtcccccaaatggccgagtccatcagtgagggtaccttgaagcagtggaacaagaaggttggcgactatgtcgagcaggacgaagagatcgcgaccatcgagaccgacaaggtgtgtacgacgcttccttagtcccgtgccggtgtcggagcctagaccgcttggagcacatgctgtctgcccccctgtcctgcctctttctacggtcatagctcgccagcggcacatatatttgctttctaactgcttctgccactgggttctagatcgatgttgccgtcaacgctcccgaggccggtaccattaaggagttcctcgtcaatgaggaggacactgtcacagtcggccaggacatcgtccggttagagcttggtggtgcgcccaaagagggcggtgccgaaaagccggccgcgtccgagagcaaggaggctgctcccaaggacagcgctcctgctcctgagaaggctccggagcctaagaaggagaccaagcccgccgctgctcctgctcctacgcccgccaagaaggaaactcctgcccccaaacaggagagtactcctgcgaaggaggccccggctgcattgggcaatcgcgaggagcgcagagtaagtaaacggctcctgagcaaacggagtggtgaatcggtcaaactaacaccctccaggtcaagatgaaccgcatgcgcctccgcatcgccgagcgtctcaagcagtcccagaacacggctgcctcgcttaccacattcaacgaagttgacatgtcgggcctgatggatttccgcaagcagtacaaggacgagatccttaagaagaccggtgtcaagctcggcttcatgagtgccttttcccgcgcatgtgtcttggccatgcgcgatatcccggccgtaaatgcctcgattgagggtcccaatggcggtgacaccattgtctatcgggactatgttgacatcagtgtcgctgtggccaccgagaagggtcttgtcactcccgtagtccgcaatgttgaagccatggacctcgttggcattgagaagtccatcgctgatatgggcaaaaaggtacggcttcccgcgcctatggagtgcttatattaccttactaactgttatcgcaggctcgtgatggtaagctcaccattgaggacatggccggtggcactttcaccattagcaacggaggcgtttttggctccttaatgggtaccccgatcatcaatcttcctcagagcgcagttttgggtctccatgctatcaaggagcgacctgttgctgttaatggaaaggttgaaattcgccccatgatgtacttggctctcacctacgaccacaggctgcttgatggcagggaggctgtccagtttctggttaaggtgaaggagtacattgaggaccccaggaagatgcttctttaggttgtt

SEQ ID NO: 27434 - DNA, 1721 bp, Neurospora crassa
caaaaatggcgttgcagtgcggtagagctcaaggacaacaccgtcatcgttgtccttggcgcctctggcgatctcgctaagaagaagaccgtgagttcctgcttaccattgggctacttcatatggcaatcggctgacgtgcaactagtatcccgcgctcttcggactggtgtgtatgccctcttctcggtcgcctccgattgaggagctaatgttattgctgtagtaccgcaaccaatttttgcccaaggacatccggattgtgggctatgccagaactaaaatggaccacgacgagtacatccgccgcatcaagtcgtacatcaagactcccacgaaggagagcgagcagcagcttgaggagttctgctccatctgcacatacgtttccggccagtacgatcgcgacgactccttcctgcagctcaacaagcatttggaggaactggagcaaggaaggaaagagaacaaccgactcttctacatggctctgcctcccagcgttttcaccattgtttcacagcatctcaagaagtgttgctacccctccaggggcgttgcccgtgttattgtaagtcactaatcgtatccgttgttactcagcccttgtctaacactgcaacaataggtcgagaaaccctttggcaaggacttggcaagctctcgagaactgcagaagtctcttgagcccgactggaaggaagaggagatcttccgtatcgaccattatctaggcaaggagatggtgaagaacattctcattctgcgtttcggcaactccttccttggcgctacctggaacaggcatcacatcgacaacgtccaaattacattcaaggaacccttcggcaccgagggccgtggtggctacttcgacgagttcggcatcatccgcgatgtgatgcagaaccatctgttgcaggtccttacgttgcttgccatggaacgccccatctctttctccgctgaagatatccgtgatgagaaggtgcgggtcctccgcgccattccggcaatcgagcccaagaatgtcatcattggacagtacggcaagtcgcttgacggaagcaagcctgcttacaaggaagacgatacggtccccaaggattcccgctgccccactttctgtgcgctagttgcgtacatcaagaacgagcgttgggatggtgtacctttcatcatgaaggcaggcaaggccttgaacgagcagaagaccgagatccgcgtgcagttcaaggacgtcacatcgggcattttcaaggacattcctcgcaacgaactcgttatgcgcattcagcccaacgaaagtgtctacatcaagatgaactctaagcttcccggcctgagcatgcagactgttgtcaccgagcttgacctcacctacaggagacgcttctccgacctcaagatccccgaagcttacgagtcccttattctcgactgcttgaagggtgaccattccaactttgtccgtgacgatgagctcgatgccagctggagaatctttacccctttgctccactatctcgatgataataaggaaatcatcccgatggagtatccttatggtatgtgatcaccaagatgttctatggaatgatactcagtactaacatcgtctaggttctcgcggcccggctgttttggatgactttacggcttcgtacgggtacaaattcagcgatgctgcgggctaccagtggcccacaacctccgccatg

SEQ ID NO: 27435 - DNA, 1431 bp, Neurospora crassa
ctgcttgcagtctcactcgttgccctcctcgagccagtatccgcgatatggccggcaccgcagagcttcaccaagggcaactcaagtctgtacttgcatccgaagatcaacgttacctataatggagaacctgtaaggcgcccgacttcctcctcctcttcctcctctttctttctctcttcatccaacaacgtgggcggatctgctggtccgggctatgagggcctgttcactaaaacaccagcgcaacaacagctcgtctacaaagaagactatttcgcctcaagcctgagcagcaaagagatcgtccatgccggcgtctcgcgcgcactgggctccatcttctccaggaacatcgtcccctggatgctccagccccgcggaaagctgtctgaattcgagcccgacctctacaagggtcagaactggatcaagtcgctcgagatcgatcagacggccaaagatgccaaaaccgccttcaaacccgcactggccggcgaggtcagcgaagcgtacagcctcacccttagcgtcgagggcgacgtcaagctgacggctgactcttatatcggcgtgctgcacggcctcgagacgttcacgcagctcttctaccagcactcgaccggcacatcgtggtacacgccgtacgcgcccgttgagatcaaggacgagcccaagtacccgcaccgcggcatcctgctcgacgttgcgcgcacattcatgcccgtaaagaacatcctccggaccattgatggtatggccaccagcaagctcaaccggctgcacgtgcacgtcaccgattcgcaatcatggccgcttcagatcatctccatgcctgaggtggccgagaagggcgcctaccattcgagccagacgtactcgcccgccgacatcgacctcattcagaagtacggtgccctccggggcgtgcaggtgtactttgagatcgacatgccgggccacatcgggtccttgtcgctctcgcacccggaccttattgtcgcatatgaccagtggccgtatcagtggtactgcgtcgagcctccttgcggcgccttcaagctcaacgacaccaaggtcgacgactttctcggaaagctgtgggacgatctgctgccccgcgttgcgccgtactcggcctacttccacactggcggggacgagctgaacaggaacgactcaatgttggacgatggcatcaagtcgaatgatactgaggtgctgcgcccgctgctccagaggttcgtcgataagcagcacgagcgcatcaggaaggagggcctgacgcccctcacttgggaggagattccgatcgagtggaatgtcaatcttggcaaggatgtcgtggtgcagacgtggcttggtcagtcttcggtcaagaacttgaccagcagaggccacaaggtgattgatagcaattacaacttttgg

SEQ ID NO: 27436 - DNA, 1484 bp, Neurospora crassa
tggcaacagatgttcagaagcattggtgggtacactggcgaggttaggcttgttggtcatcgaatcatctttacctcggagccggaaaacatgaaggccattctagccacccagtttgaagactacggcaagggcgaaggtttccatcaggagtggaaggatttcttgggtgacagcatcttcacgaccgatggcgatctttggcatgccagccgtcaactaatccgcccccaattcatcaagaaccgtgttagtgacttgcaatgttttgagaatcatatgcaaatgcttttccgcacaatcgccaatggaggagccctaaatggtgaggatcagatggtcgatatggaagctggtaatggaaagccggtcgatatcagcgatctcttctttcgttacacgttggatgccgccaccgatttcctccttggcaaagatatcaagtcgttgaggtttgtcctacccaatgcctctttccctatatgttagaatgctgacagaaaacagcacccctgtacaaccttttgccgacgcgttccaggaggtacaacgagtacagatcgtcatcgccagagccggacctctcaaccgttttgtgccgaaaaagaccttttgggaaggattgaaagtcatcgacgagactatcaacttctacattgatcgcgcccttcgacttgatgaggaggagctcgcgagcaagtccaagggagacgagggctacacttttctccatgcccttgctggtttcaccaaaaaccgccaagtgttgcacgaccagctgatggccgttctccttgccggacgtgatacaacagcttgcaccctctcatgggcaatttacgagctcgcccgccatcccgaagctgtggcgaagctacgcgccgagatcctctccgttgtcggacctgaccgcgctcccacatatgacgatctcaagagcatgaagtaccttcagaatgtcatgaacgagactctgcggctgtaccccgtagttcctttcaagcaagttcccgaaacctctttctcaacaagatcattgtttcctaacttttttcattgtgtacagtgtacggatggccctcaaggacactactctcccccgtggcggtggtcctgatggctctcagccaatcgttattctcaaggatacacccgtcggttatagccctcttgccatgcagcgccgacccgatctgtaccctcccgtcagcgagaaattcccagatgttgagatgttctctccagaccgctggttccactggcagcctaagccgtggcagtatatcccgttcaacggaggcccgcgtatctgcatcggccagcaattcgcccttaccgagatgggatatgtgctgacgcgactgttccagcgatacgaccgggtggtgagctacatggatgaaattgatggaggcaagccgaggatgaagactgatattgtcttgatgcctggcgatggagtcaaggtcgcgttctttgaggcg

SEQ ID NO: 27437 - DNA, 2875 bp, Neurospora crassa
aaggccgatgatcgtgccatggacgctgctgattccaaggttcacatggctcccgttggtgtctccatccgtaatggccccgtcgaccaggacaggatggacgtcgactcctcagtaagcggtcaggctaagcgcaaatcgcggacatccattgatcagtccatcaactataaggatgactccagtgatgacgaagcacccttggtaagtttcccagtctttgcagcttggtatccttgcttggtctgtggctgaccaggacaggcgaaacgttcaaaaacacaacataagcaaccagactccgatagcgacgacgagccgattgcgaaaaaaaatggcgcgagattgcctccctccgccaagaatacggatatggacgtagattctgatgacgacgaacctctcggaaagatcgccgcgaagaaggccaatatcgagaaggaagccgccaaggaagccaagagtattcgtgctggtaccaaggccaagaagcctgctgctaagaaggccgtcaaggatgaatcctccgatgacgaaccccttgcgaaacccaccaagcgacaggtcaacggcacagctgcgaagaagacgaatggtgtgaagaaggaagagtctgactcggatgtgcccatcgctaagcgggcgaagaaggcacctgccgcgaagcctgctgcaaagcctgctgcaaagccggctgcaaaggctgccacgaaggccgccccgaagggcaaggttgccgctgtcaagaagtccgtcaaggaggaatcgaaggacatcaccgatgaggacgatgaggaagaggagtataagtggtgggaggagtcggcaaagaaggaagatgacagtatcaagtggaccaccttggagcacaacggcgtcatcttccccgaggattaccagcgtttgcccaaggacgtcaaactgctctacgatggaacgccggtcgaactcgatatcgaggccgaggaagctgcgacctttttcggcttcatgcttaactcgacggtgaatgttgagaacccaactttccagaagaacttcttcagggacttcaaggagatcctagatcggacaggtggcgccaaggacaagaatggcaaaaaggttgacatcaaggaattcgaaaaactcgacttctcccagttgtgggcttacaaagatgctcaaacgaaggctaagaatgcccggtcgtcagcagagaagaaggccgagaaagccgaaagggacaagagggacgccccctatctatattgcaagtgggatgggcgaaaagaaaaggttggtaaccccagagtggaaattccaggacttttccgtggtcgcggtgatcaccccaagaccgggtgtatcaagaagcgtgttttgccagagcaaattaccatcaacatcggcaaagaggccaaggtcccagagccgccagctggccacaagtggaaggccgttcaacatgacaacaaggcaacttggctcgcgatgtggcaagagaacatcaacggacactacaagtatgtgatgttggcagcaaacagtactgtgaagggcaaggccgatttcaagaagttcgaaaaggcccgtgagctcaagaaatacattgatcgcatccgtgccgattataccaaggacctcaagagcgaggtcatggctgacaggcaacgcgcaacggccatgtacctcattgacaagttcgctctcagagccggtaacgaaaaggataccgagaacgaggccgagactgtcggttgctgctctctcaagtacgagcacgtcaccctcagggaacccaacactgtcattttcgacttcttgggcaaggacagtattcgtttctacaacgagttcacggtcgatcgccaggtcttcaagaacctcaaaatgttcaagaagcctcccaaggaggacggagatgacatctttgacagactgacggtaggtttaatcttacccactttacaatatttggaggtttgctaacgcgctgtgcagacaacccaactcaacaagcacttgtcgagctacatgcctgggctcacggcaaaggttttccgtacttacaacgcatcgtacaccatgtccaagctgctgcaggagctcaaggtgacgaatgccacggtacatgaaaaggtcaagctctacaatgactgcaaccgccaagttgctattctttgcaaccataagcgtactgtcggtgctagccatgagcagcaaatgaagaaacttgtcgagcagatcaagggtttgcgataccagaaatggcggacaaagatgatgatgctcgaccttgatcccaagctcaagaagaagaagggtgctgcctactttgagcttgatgaggacttgacagaggagtgggtcaagtctcatcaggagttcctcgttgaggaccagaaggccaagatcaacaagaagttcgaaaaggacaatgagaagcggatagctgatggcgagaagcctctgcctgccagcgagctcaaggagcgactcaaggcggcatccgagctagaagccaagttcaagaaggagaacaagaccaagaaggtcgaggctgaaggcaagggtccttctgtcgagaagctggaggcagctcttgagaagcttgatcaacgtatcaagaacctggagctccagtccgcggatcgtgaaggaaacaaagaggttgctcttggcacttccaaaattgtaagttggatgggcttcccatcaacatgcatagtaggatgctaactttctaccacagaactacattgatccccgtcttaccgtcgtcttctcggccaagtttaatgtgcctatcgagaagttcttctccaagacgttgcgcgaaaagttcaagtgggctatcgagtctgtcggaaacgactcgacgtgggagttctga

SEQ ID NO: 27438 - DNA, 955 bp, Neurospora crassa
ttcgcgactctccgtgaaatcgagacccgcctcaagtcgattcgcaacatcgagaagatcaccaacaccatgaagattgttgcctcgaccaagctcaaccgcgcccagcgtgccatgaccgagtcccgcggctacggtgccaccagcaacgaggtcttcacctcggccgagactaagcctctcgaggctgagggcaagaagaagctcgtcgtcgtctgctcctccgacaagggtctctgcggtggtgtccactccggtcttgcgcgcttcatccgtcgccgcgccgccaccgagcctgagttcgacatcgtcatcatcggcgagaaggccaaggcccagctctcccgtaccaacgccaaggacatcgtcctcaacttctccggtgttggcaaggacatccccaccttcgtcgaggcctctgccatcgccgaccagatcacccagctcaagggcgactactcttccgttgagattgtctacaacaagttcatcaacgccaccagctacgagcccaccgtcattgaggcattttctgaggatgccatcctcgcttcccgtacgtcctgtcggccaccgtgatgcccgtcgaggttcagtcagctgactaagttatatccagccaacttttccgcttttgaggttgatgaagaggtccttggcaacctccgcgagtacgccctcgccaactccctctactgggctctctgcgagggtcacgcctgcgagatttctgcccgtcgcaacgccatggacgtgagttctcctcccgtcccatgccacctctttgaagtcgacagcggacaggctgctgacgtgaattctcttaccccttatccagaacgcttccaagaacgccggcgagatgatcagcaagtaccagattctcttcaaccgtactcgccaggccgtcattaccggcgagttggtcgaaattatcactggtgccaccgcttcg

SEQ ID NO: 27439 - DNA, 1368 bp, Neurospora crassa
aggtccaagtactcctttggtcgaacgctaggtgctggtacctatggtatcgtcagggaggccagcggccctaccggcagggttgctgtcaagattatattgaagaaaaatgtcaagggcaacgaacagatggttcttgacgagctagagatgcttcagcgcctcaagcaccctcacattgtgaagtttgtcgactggttcgagtctagggtgtgtaggattgctacgggcttagggtggctacgccgagactaacttcgcttcctctaggacaaatactatatcgttactcagcttgcgacgggaggcgagctcttcgacaggatctgcgagcaaggaaaattcacagaaaaagatgcttcccagaccatcaagcaagtcttgggtgccgtcaactacctccacgagaacaacgtcgtccatcggggttagtggcgtccttacttgtccatttcctagacacccgatctaaccctcacttcgcagatctcaaacctgagaacctcctataccttacccgggatgccgattcggatctagttctggctgactttggtatcgccaaaatgctggataataaggacgaagttctcaccactatggccggctcgttcggttatgcggcgcccgaagttatgctcaagcagggtcacggcaagcctgtcgacatgtggtcaatgggtgtcataacgtataccctcctctgcggctactcgccattccgctccgaaaaccttcaggacctcatcgacgaatgcagcagcggcagcgttgtcttccatgaacgctactggaaggacgttagcaacgacgccaaggacttcattctgaggcttttgcagcccaagccagaaaaccggtggacaagccaggtaagactcagtcatgttatgttgtgctgatctgacgttctcaaatacggctactaacacgcttgccccgatcaattagcaagctctggctcacccctggctgcgcggcgattccgcaaccaaccacaacttgctgcctgagatcaaagcgtaccttaccaaggcccgcctcagacgcggcatcgagatggtcaagcttgcgaaccgcatcgaggcgctcaagatgcaggaggacgacccggagaacaccgatatgcctggcgacgccacacttgccgccgaccaggcccagtcccgccaccgtgctctatctttggcgagcaccaagggcggatcctcagatgccgagaacgccaccgcgcccgccgaaaagcggacactctccaagactatcaagacggccatcttccgcgaggtcgttttggccaaggttcgcgagatgaaagaggcggaggaggccaacaagctaaaggaagaagcggagacgaaggcgaag

SEQ ID NO: 27440 - DNA, 1789 bp, Neurospora crassa
tctggcctggatgtcaacctggctatgattcctcctaatcacaagttcctagacccccggcttctcgaggcggaagccattggcctccttgacagaatgctcggtggtctccaggacaacagcaggtacgtaagggctgcttttccacgtctataactagctaaccgctggtgcccttgtcgtgtacagtgatgctctgattgtagatgccactctcaacactttgtccattctcatccgcactcgtcctgccacctccagccgtattacaaatgccgtcctcaacttcaaccctctgaaactggccaactctcccatgacccccaagaacaaagttctcgtcaagtcaatgacgaagacaacccagatgctcttgaagcatctgtttgtgaggtaagaaatgtccagttaccgcttatgcttctcttgctaactagggcaagggattctcataatccgatagcgccacgcctcaatcaacaatacgagagacttcagcgttctcgtttggacatttttgatgaggcgaaccgcaagcgggctcttcctgagcaggctgctgcaggttatggtgatgtgaagaggcagaagactgaaggagtcgcaccgcagcctccacttcgcattcaaccacttgcaccagggccacatactctggctgaagtgttcagtctcactaacaatacaggcttgcagggcttcgatgtgactgtagtacctacctcgttaactgctagaattaatgtcaggacgctggcgtcactagaccaagggcagctggatatggccatcaatgtaaggctccggcagtttcttgataggggtaactatgctaatactgccatagggagttcgtgaccgattgattgctttgtatgctgcagcacctgccgcagcaccagtcccggtaccggtcataggaacagcgacggcgcaacaagcttcggttaatgccgagacggttgccttgggggttgaggaagatgacgacgcctacgaacccgacttctacgctgcggaggatactgaacaaatactgaacaagctcgataacgcgcctccggaggaatcacctgagcagaacgccaagcctgattctgcgttagctctcggcccgttcaggctcccgcctccgcctgttctcaatccggatactgctgtcaaggtcagccagatcactgctatgcgcatatttgggcctctctcaggtctcgaggacccccttgttcgcaagcccaaggccggcctcaaccgattggccgccaactcccatgaccgcgactcatggcttacactgataacgcgccttgcaacccgcagcaccataggcctaggggacggtgtcaagagcgaggctgacgctaccagtagcgctcttggtcgcccacagatgagcctgggcaacctcattcgcgaaatgcttttcaactacgttctcgaagactggcggcgccgtatcgaggttgccgtggcatggtgttgcgaggagtggtacaacgaccgactaacaattcttaataaactcgatggaccgctgaattacgagcggtgcgcgttgcgtctcatggacggcttcctcagttatatcacggctcaagacaaggttctcacccggttcctgtcggagatcccccaactcagcaaagagcttctcggtcgcctcaagggtctttgtagcgatccgactacggtgcagctcgctatgaccagtctgctttatctggtgatgatgaagccaccagcgagggagctagctctggacacggtgtatgagatttgggttgaatgt

SEQ ID NO: 27441 - DNA, 1829 bp, Neurospora crassa
caggttgttcacattcacttgggccaggccggtacccagcttggtaacagcgcctgggagctgtaagtgctcaacacaccgctatgcttttttttttctttttttttttttggcgtgaccttctctaacacatctgctcttctagctatctccttgagcacggtcttactcaagatggtcgtaaggaccccgactctaccgttgccggtgagggcggttcctatgataccttcttcactgagtccagcaacggcaaatatgttcctcgatccctcttcgtcgatcttgacccttccccgatcgacgagatccgcaccggcccttaccgtcagcttttccaccctgagctcttgatcagcggcaaggaggatgctgccaacaactacgcccgtggtcactatactgtcggcaaggagatggccgagaacgtccttgatcgcatccgcaagatcaccggtaggttatcttctgtacgtctagggcgggtaatatgtttctaaccgggtatggacagacaactgccactctcttcagggtttcctcgtcttccactccttcggtggtggtaccggttccggtttcggtgctctcgtcctcgagcgcctcgcccaggactacgccaagaagtgcaagctagagttagtcctttcctctcttcccccaatggtgccaataggccatctttacggatgacttggtcttgttcaaaacgttgggatcttgactttcaagccttgttgggtctttcgaagatggtgcctgaactctcttaatgttcggccatccaggcggaaaaaagagaacctgttgggagactcagccgcgtttggaacaagaccgatttgccccagcgctttcgggagatcacttttgctcacagtatcctcggtcaggttctccgtttaccctgcccctcgtgtcgccacggccgtcgttgagccctacaacgccgtcctcgctacccacagcaccctcgaacacagtgacgttaccttccttgtcgacaacgaggctgtgtatgacatttgccgaagaaacctcgatattcctcgtcccagctacgagcacttgaaccgcctgattgcccaggtcgtttcttccatcacctcgtccctccgtttcgatggtgctcttaacgtcgatctcaacgagttccagaccaacttggttcctttccctcgtgtccactatcctcttatctcttacgctcctgttatttcggctaccaagagtgctcatgagagcttcaagacctctgagcttaccctccagtgtaagtggaacttgagcgttttgatcagccgtagcattgcgatcccagacactgacatattttgtgaataggcttcgagcccaacaaccagatggtcgtctgcgacccccgtaacggcaagtacatggctgtcgctcttctgtaccgtggcgatgttgttcctcgtgacacttccgctgcggttgctgcgctcaaagccaagtcctccttcaacctcgttgagtggtgccccactggtttcaagatcggcatcaaccaccagaagcccatgtccgtccccactgcctcgcccgctgatggtggtcttgcttccgtcgaccgctccgtctccatgttgtccaacaccaccgccattgccgaggcttggtcgcgtcttgaccacaagttcgaccttatgtacagcaagcgcgccttcgtccactggtacgtcggtgagggtatggaggaaggcgagttcagcgaggcccgtgaggatcttgcttcgctcgagaaggattacgaggaggtcgctggcgactacaacgatgtcgatgtcgatgctgagtactaagcggtt

SEQ ID NO: 27442 - DNA, 802 bp, Neurospora crassa
tacgactacctcttcaagctcctcctcatcggtgactccggtgtcggaaagtcttgcttgctccttcgttttgccgacgatacctacaccgagtcctatatctccaccatcggtgtcgactttgtacgtcctgctatcctgcctgcgcaacacatgcgttcgacccccatcaacatgctgaccgtttggctagaaaattcgcactatcgagcttgatggcaagaccgtgaagctccagatcgtaagcaaccccccggcactcctggacactttggaaatccaaattcgctgacccagtcgcttattcagtgggataccgctggccaagaacgtttccgtaccatcacctcttcctactaccgtggcgcccacggcatctgcgttgtctacgatgtcacggatatggactctttcaacaacgtgaagcaatggcttcaggagattgaccgttacgccaccgagggcgtcaacaagctcctcgtcggcaacaagagcgatatgaccgacaagaaggttgttgagtacacagtcgccaaggtacacagccacccctaaccctcgtgtctaagccacatacttacacatcaaccaacaggagttcgccgacagcctgggcattcccttcctcgagacctccgccaagaacgctagcaacgtcgagcaggctttccttaccatggcccgccagatcaaggagcgcatgggcagctccatcgccaccaacaacacgaaagccagcgtcaacgtctcccccggccacggcgtctccaacaactcttccggcggctgctgctaaagcgtc

SEQ ID NO: 27443 - DNA, 2704 bp, Neurospora crassa
atgaccaccctcatcgcatcccgaccacggtcacgacccgcccatcccccgggagcaacatactgcgcctacacccccgatggcaccagactggtgacggtcgggtccaacaacaccaccagactctacaagacgggctatgaaggcgagcccacgaatatcgacgactgccaggaacagaaccttgcccttgccaccagcaacaactactttgtggccggctccgaagacggtaccgtcagcttgtactccctcgacactaatgccttcgaccgtttccttctgcgaacctctctcccagtccgcgatgtcgccatatccccagaccaccagtggtgcgctgttgccagcgacgagcttacagtgaggctggttggagtgcacgacaacacccagctccgtaccctcaaagaacacggaaagccgacaaaacacttgaccttcgatcccaagggcagcttgctcgcgctatcatgtaccgacggcgtcatatacatatactctttgactgccgaacacccagagctgattcgcaaggtggatggtgtcattggcaggctagagacagagtccgaagcctcgtcaagggcggtctggcaccccgatggtcgcgcctttgccgcacccactcctacacgagacattcaggttatttccaagaacgactgggaaaagcagcgggtctttaagagcggtcacgacggagatatcacggccctgtcttggtcgcccaacggtgccctgctcgcctcggctggcaaggacaagaagcttctgatctggtcaacgaaagaccagagtgtcatcgcaagatacgaatatcccaatgttaccgatatctgctggcatcccaccaaaaaccttgcttcattcacaacctccgacggagagctttacattagccccgacttcgtcccggagcagttcgcctctcttctcaggctacccaagcagcccgccccctttatccacgaccctctcaccgaactatccaacaacacccgccgcttagaagtcagtggtcctaagcccgacgctcgcccacgcagagactccgtggacgccgatctcgatgacctcctggacgaaaactacggcgacgacgacgatttcgtggtggacgatgacggcgcaggatacaccctcaacgcgggccgcaaacgcccagccgaagacgatgcgatctacgagagtcacactgccaagcgtggcaactttgtccaaccgcaacaccatccctccttccaacctggatcgacgccatggcgcggcaaccggaaatatctctgcttgaacctgatcggctttgtctggaccgttgaccaagactctcacaataccgtaaccgtcgagttttacgaccacgagttccacagagacttccactttaccgataccttcctctacgataaggcctgcttgaacgacaagggcagccttttttcgtgcccacccaaagaggatggctccccagctgtggtcttttaccgcccccatgagacctggacgcaaagaaatgattggcgcatacagctgcccaagggtgaggcggtgctggccatgtcgctgagtgattcatatattaccgtgacaacgacgggcaactatgtgaggatatacacccttttcggcattcccgtgagggtgtacagacccaagagcacaccgatggttacgtgcgctagttggagggactacgtcctgactatggggaacgggcctgtgggtgcggacggtatgtcgcgcttgctgtataccattgagaacatcaagcgggatgaagtttgtcagaacgaagacaccgtcgcccttcctgaaggcgcgacagtgaagagcgtcttcttttctgacaatggcgtacgtcttcgtccctctctccctcttcccttgtatcttacccatccactaacatccggtccaggacccctgcatttacgactcaaccggcaccctcctcacgctccttcactggcgccgtccatcccgggccgtatgggtgcccctcctcgacacccgtctcctcccgcgtctcgcctccggccgcaaaaaggaatcctatttccccatcgctgtcgccgaccacaaatttcactgcatcatcctcaagggtggcgaccaatacccctacttccctcgccccttgctttccgaattcgactttgccgtacccctcacctccgcgaagcccaagaagcaatccaagaaaaagaagacacgtagtggcgacgattctatggacgttgacggtgaagacgaggaggacaacgatttctctgcatcagaagccgacgactctgattccgaaaacaacgccgatcccctaacaaccaaggaatcccttcccttaacccaatccttccttctctcatccctgcgcgccgcgcagctctcggacatgctcgaaagctcccggtccacggcctcgcagcgcgccgcgctggctaggctggagcttgatatcgacaagactctgctgcagctgctggcgattgagtgccgcgagggtgaggatagggggatgagggcactggaggtggtgaaacttatgaaagacaggacggggcggatgattgaggcggcgggtaaggtcgcggaaaggtatggaaggagaatattaggggagaagatcagagaggtgggtgagaggagggtggccggggaggacgagagtgaaggggaggaggaggaggatccttttgcttag

SEQ ID NO: 27444 - DNA, 1730 bp, Neurospora crassa
cctagaatccgctacaacaccgttggtggtgtcaacggccctctcgtcatcctcgacaatgttggtcaaccaccacttctctccgccgccatgggcatgtctaacaacggccgcaggtcaaattccctagatacaacgaaatcgtcacattgaccctccccgatggaacgcaacgctccggtcaggttttggaggcgcgaggtgtgtttccctctcgccatatctcttgtgcttctctctgatcaacagctgacagccatgatgctctacaggaaaccgcgccgtcgtccaggtagataaccgcgacacaagttggcagacacgcgaacaatgcgctgatatcatgaacaggtcttcgagggtacttccggcatcgatgtgaagaaggtgaggcagatatccacacgggactagcgaacaagaaactgaccaggaacaacagaccaaagtcgagttcaccggcgaaagcttgaagcttggtgtatcagaggacatgttgggccgtatctttgatggttccggcagggcgatcgacaagggtcccaaggtgttggccgaggaatatctcgacatcaacggcagtcctattaacccctacgccagagtaagtaccttggttgctgaattgccaaggccggggacattgtgctgacaagacataggaataccctcaagaaatgatctcgacgggtatctctgccatcgacaccatgaactccatcgctcgtggtcaaaagattcccatcttctcggccgccggtctgcctcacaatgaaattgctgcccagatttgccgacaggccggtctcgtccagcgccaaggtattacgaataagggtgtgcacgatggtcacgaagagaacttttcgattgtctttggtgccatgggtgtcaacttggaaaccgcccgtttcttcacgcgcgatttcgaggagaacggcagtttgggccgcaccaccctcttcctcaaccttgccaacgacccgaccatcgagcgtatcatcaccccccgtctcgccctcacgacggccgagtactacgcctaccagctcgagaagcacgtcctggtcatccttaccgatctctcgtcatactgcgatgctcttcgtgaggtctcggctgctcgcgaagaagtacccggtcgtcgtggtttcccgggttacatgtacacagatttgtcgaccatttacgagcgtgccggtcgtgtggctggccgcaacggttctatcacgcaaattcccattctcacaatgcccaacgacgatattacccatcccattcccgatttgacgggctacattaccgagggtcagattttcgtcgaccgaggtctccacaaccgtggtatctaccctcccatcaacgtgctgccctctctctcgcgtctgatgaagtcggccattggtgagggcatgacccgcaaggatcacggtgatgtgtcgaaccagctgtacgccaagtacgccattggtcgtgatgccgcggccatgaaggctgtggttggtgaggaggccctgtcgaacgaggacaagctttctctcgagttcttggacaagtttgagcgctcgttcattgcccagggtccttacgagtctcgcaccatctttgagtctctggatcttgcgtggagcttgctccggatctaccgcaaggacatgctcaaccgtatccccaagaagatcatcgacgagttctactcgaggtctgcggctgaccgcaagggcaagggc

SEQ ID NO: 27445 - DNA, 729 bp, Neurospora crassa
caggtcgactccgcctctgcctaccgcaacgaagctggttgcggcgctgccatcctccgctccaccattccccgctccgaaatcttcttcacctccaaagtcggccccaaacacatttcgtacaacgccgcgaaacgtatcatctccgaatcccttgccaaaacgggcctagggtatatagacctcatgcttctgcatgctccctacggcgggtctgtacacagaaagggtgcctggctagcgctcgtcgaagctgttgaagaagggaagatccgctctattggtgtttccaactacggtgttcaccacctcgacgaactggagcagcatatcaaggagctggaacaggaacggggcgggtctggcaagggcggagtgttgagtgtagggcagtgggaggttcatccttggtgtcctcgccaagatattgtcgagtggtgtcgcaaacgcaacgttgtcgtcgaagcgtatgcgcccatcgtaaggggggagaggttcggtgagcccaggctgaagagcctggctgagaagtatggaaagaccgaggcgcaagtgcttgtgagatggagtctccagaaggggtacgtgccgctgccgaagagtgtgaaggcggagaggatcaaggagaacgcggatgtatatgactttgatcttagcgaggaggaggtgaaggcgctggagacggatgagtacagtccggtgtgttgggacccgacgacgagtgagctg

SEQ ID NO: 27446 - DNA, 2936 bp, Neurospora crassa
cgctacgtcggcgcatttggtgttgagggatgggctaccagaagcgggacaggcctcctcagacacggtgacagcgtcaagattgagcgccaaaagatccaaccacctaccgttgcaagaaaagggcagaccaagcctggcaccccgcagtccataccacgagtcagcgcggcagctgccaaacgtgtcgatgtcatagtccgcttcaacgacgccagtggcagggaactcggccgtctagccaaagacacagccaactgggtgtcaacgctaatagaccagaacatctgcagattcgaaggcatctgtgtttacgcgcccgagcgtctacgaacgaacgagaccgtcttcttgcagctcaagtgctacatgctacggtctgccttcttggggagaaccctccaactagccgacaatagggctgccgggttccacgagaaagacgagacaacagaagagaaggacctgcgactgagacaagtggcgcttgtcagactgtttcaagagatcaacattgttccgtctcgaggcaacgccgctgccgccaaggacgccaggaaagaccttcttgaagcagcagattcggccgagaagaaggcgatggacaaggccaaggctggggaccacaacactaacggattagcttctccccccgaagaggccgaagagggccaggagctcgaacaagaccaactcgacgcgctgtacaagaaggcccaatccttcgactttagcacccccgaggctgaaccagctaataccttcgccatgaccttgcgtccctaccagaagcagtcgctgtactggatgctggccaaggagaagaaccagcgaacagaagaccgtgaaacatccatgcatcccctatgggaagagtacgtgtggccgaccaaggaccatgacgataaggacctacctgtggttcctgaccaaccttgcttctacgtcaacccatactctggcgatctgtcactggacttccccaaacaagagcagcattgtcttggtggaatcttggcagacgagatgggacttggtgggtttgccttttacatttttcttttctctttgacctgatatccagctcacagtcatgtatcacaggcaaaaccatccagatgctttccctgatccattctcaccgatccgaagtagccatcaaggcgcgggaggctggccctacctcggtcaacaacctcccacgcctaccaacagtctctggacagaagacgacaattgacgctccgtgcacaacccttgtggttgcccccatgtccttgctggcgcaatggcaaagcgaagctgagaatgcttccaaggagggcacgttcaagaccatgatgtactacggggcggaaaagaatgtcgatctggtgaccatgtgctgcgaagccaacgcggccaacgctccagatgtgatcatcaccagctatggagtcgtcctctccgagtttacccaactcgccaccaagaatggagacagactcagcagccgcgggcttttctccctcaacttcttccgtgtcattctggacgaagcacataatatcaagaaccgccaagctaagacctcccgcgcatgctacgaaattgccgccgaacaccgctgggtcctcaccggaacccccattgtcaatcgcctcgaagacctcttcagcctggtccgtttcctacgcgttgagccatggaacaatttttccttctggcggaccttcatcaccgtcccctttgagtccaagaactttgtccgcgccttagacgtcgtccaaaccgtcctcgaaccgctcgtcatgcgccgcaccaaagacatgaagaccccggatggccagttccttgttccgcttccgcccaaacacatcgagatcgtcgacatcgaactctccgagcctgaaagggcagtctacgactacgtcttcaaccgcgccaagcgaacgctctttgacaatatgcaggccggcaccgtcatgaaggcgtttacctccatttttgcacagatcttgcggctccggcagtcctgctgtcaccctgtgcttgttcgcaaccaggagatcctcgctgatgaggaggaagccaatatggccgctgacgttgcggcgggtttggcagacgatatggatctccaaactctgatcgagcgcttcaccgccaccacagacgacgcctccaaaaccaacaacaacttcggcgctcacgttcttagacagatccgtgacgaagcagtcaacgaatgccccatctgcgccgaagaaccaatgatcgaccaggccgtgacaggatgctggcattctgcgtgcaagaaatgtctgctcgactatatcaaacatcaaaccgaccgtaacgaggtcccgcggtgtttccaatgtcgcgagcacatcaacatccgcgacatcttcgaagtcatccgccacgatgatgacctggagacatcctctaccccaggggcaagtcccgagccgcgcatctccctacaacgcgtgggcgccaatgactccagcgccaaaatcgtcgctctaatctcacacctccgcaccttgcgtcaagagcaccccaaaatgaagtccctcgtaatttcccaattcacatcctttctctcgctgatatcctccgccctcacacgtcacaagatctcttttcttcggctggatgggtccatgtcccagaaggcccgcgccgctgttcttaccgagtttcaatccaccaacaagttttgcgttttgcttctcagtctcaaagcgggtggtgtcgggttgaacctgaccagtgccaagagggtctacatgatggacccgtggtggtcctttgcggtggaggcgcaggcgattgatcgtgtgcatcgcatggggcaagaggatgaggtgagggtttatcgatttatagtgaaacagagtgtggaaatgaggatgttgcgggtgcaggagaggaaaaagtttatgtga

SEQ ID NO: 27447 - DNA, 1723 bp, Neurospora crassa
ttggacgaaggacacggcgaatccgtcttcgacatcggcttcgagaaccatggcgagagcctaaagttgaccaaggaggattgggaggtggcatacaagaggttatcgcaggccgcagcccagattgatgctgactgccagctgctactaaccaagaatttgggcggcgatctcgacggtaccccaacccgcgatggcgacgtgagcggcaaggtgatgatccgtcgacgcccgtccgcagccgaggaggttatcgaaacgcgaatagcagtcgtgggcaatgtcgacgctggcaaatcctcgatgctgggtgttctggtcaagggcgacttggacgacggtcgcggtcgcgcacgcgtgaatcttttccgacacaagcacgagattgagaccggtcgtacgtcttccgtcggcatggaaatcatgggcttcgactcgcacggtcagaccattctttccgacacccccggtcgcaagctctcgtgggaggaaataggcaagcgcagtgcaaaagtaatcacttttaccgatcttgctgggcatgaacggtatctaaggacgaccgtcttcggcttgttgtcatcgtcgccaaattactgcctgctaatggtagcggccaacaacgggctaataggcatgtccaaagagcatcttggtattgctttggcgctgaacgtgccaataatggtggtcattaccaagatcgacatctgcccgcctaacatcctggaacagaccatcacccagatcacccgcatcttgaagtctcctggtgcgaggaagatccccattttcatcaagaaccatgaggaatgcatcaacacggccactcagttcgtctcccagcgcatctgccccatcttccaggtcagcaatgtaacaggcgagaacttgagcttggtccgttcgttcctcaacatcttgccgcaccatggacggtacgacgccgacgcgcctttcgagtttcatgtcaatgacacttttagcgtcccccacgtcggcacggtcgtctcgggaatcgtcaagtcgggggtcatccatgcgggtgatgaggtttacctggggccggatggcttgggcaagttcacgaccacggccatcaggtcgattgagcggaagaggataggcgtcccggcggcgagcgcgggacagtcagccagcttcgcgttgaagagggtcaagagaaaggacgttcgtaagggaatggtggtgctctccaagactgaaagtggaccgccgaaggtgtatcgggagttcattgctgaaggtaagtaaacacagcgcttccttttgtctttactttcctctgccccttggtgccattcaaaaaattctgtatgtatcctaacgtgcactagtcctcatcctctcccacgcaaccaccatcaaaaccaaataccaggccatgcttcatgtcggccccgtctcccagacatgcgccatcatcgacgttgatcgtccgtttatcaggaccggcgatcgggctaccgtcgcgtttcggtttgtccagagacccgaatacctagtcccgggagacagacttctcttcagagaaggcagaaccaaggggttgggtatcgtcaagagtgtggggtatgatcctgaacggccgttgggcggggttaatgtaggtgaagggggtgataaggtggctgcgggcgttgaagatgtcaaacatgagggtggcggtaacgaggtgaaggttggtgcttagtgacctggc

SEQ ID NO: 27448 - DNA, 908 bp, Neurospora crassa
atatgcctgctgattgcccacccggacgatgaggccatgttctttgcgccgaccgtgctggcgctcacgaggccggagacgggcaaccatatcaagattctgtgtttgagcagcggtaagtgctcctattccgtccatccgacctttgcccatctttttctgccttcccaccaacaattgctaaccagccccgaacaacaggcgatgccgaaggcctcggtcccacgcgcaagcgcgaactcgccacttccggcacttacctcggcctccgctccccctccgacgtctttgtgatcgactcgccctttttccccgatagcatgactacatcctgggaccccgagcgcatttcccacttgctagcctcggctttcgctcccgaactcaaagagaccaccaacatcgcttctgccagcgcctcgcgatcatccaagaacaagggaggtgctggaaaggcggaagtgaaggccacaatcgacaccatcatcactttcgacaagcacggaatctcgggacatccaaatcacatttccctctaccatggcgctaggttgtttgtgagtcagttgttggctgctacggccgggaagaacaaggaaaaggggcaggggcaggtggatctttacacacttcccacgctctctctgccgcgcaaatatagcgggatcctggacgcccttcctacactgttggaatgggcatggtcagcgggtatcacgaaaaaggacaaacacgaaaggccgggcggcttggtgtttatgaacaaccttattcctggcgagggatgggcgagtgtggacaaggcgtgggcggccatgaccaaggcacatgtgagccagatgaggtggttcaggtatgggtggattggcctgagtaggtatatgtatgtgaatagtttgttcagggag

SEQ ID NO: 27449 - DNA, 1293 bp, Neurospora crassa
cccgacatcaagaccatccgcgacgccatccccgaccactgcttccgcccgcgcgtctggatctccatggcctacttcatccgcgacttcgccatggcctttggcctcggctacctcgcctggcagtacatccccctgatcgcctccaccccgctccgctacggcgcctgggctctgtacggctacctccagggtctcgtctgcacgggcatctggattctggcgcacgagtgcggccacggcgccttctcgaggcacacgtggttcaacaacgtcatggggtggattggccactccttcctcttggtcccttacttcagctggaagttcagccaccatcgccaccatcgcttcaccggccacatggagaaggacatggcgtttgtgcctgccaccgaggctgatcgcaaccagaggaagctggccaacttgtacatggacaaggagacggccgagatgtttgaggatgtgcccattgtccagctcgtcaagctcatcgcccaccagctggccggctggcagatgtacctcctcttcaacgtctccgccggtaagggcagcaagcagtgggagactggcaagggcggcatgggctggttgagggttagccactttgagccttcctctgctgtgttccgcaactccgaggccatctacattgccctgtccgatcttggtctcatgatcatgggctatatcctctaccaggccgcgcaggttgttggctggcagatggtaggtctgctgtacttccagcagtacttctgggttcaccattggttgggtaagttgtctctcgcccatttcgcctctgtctggtggttcttgtgatctttgtggaattagcgcactaactctcgctccctctcaaaacagtcgccatcacttacctccaccacacccacgaggaagtccaccactttgacgccgactcgtggaccttcgtcaagggcgctctcgccaccgtcgaccgcgattttggcttcattggcaagcacctcttccacaacattatcgaccaccacgtcgtccaccacttgttcccgtaagtcttcagatcagatatccctgctattttctcatttaaaaccatcccctcaatgtccctcgctaacgccccaaatcctgcacagtcgcatccccttctactacgccgaagaagccaccaactcgatccgccccatgctcggccccctctaccaccgcgacgaccgctccttcatgggccagctgtggtacaacttcacccactgcaagtgggtcgttccggacccccaggtccccggcgcgctt

SEQ ID NO: 27450 - DNA, 1783 bp, Neurospora crassa
gtaatgcgccgtcgccacgatgattgggtaaacgctacacatatcctcaaggctgccggcttcgacaagcccgcccgaacgagaatcctggagcgcgaggtacaaaaagacacccacgagaagattcaaggcggatatgggagataccagggtgcgaaactcatgtcaaggtctctgtgaacatcccgcccattgctaattatccctctcgccaggcacctggatccccctcgaacaggccgaagccctcgctcgccgcaataacatctacgaacggctaaaacccatcttcgagttccaaccgggcaacgagagccctcctcctgcacctagacacgccagcaagccaaaggcccccaaggtcaagcctgctgttccgacatggggcagtaagtcggcaaagaacgccaacccccctcagcctggcaccttcttaccacccggtcgcaaaggtcttcctgcacaagccccagactacaacgatgccgatacgcacatgcacgacgacgatacacccgacaaccttactgtggcctcggcctcctacatggccgaggacgaccgctacgatcattcacacttctcgaccgggcacaggaaacggaagcgagacgagttgatagaggatatgacggaacagcagcatgcagtctacggtgacgaactactcgactactttttgctctctagaaacgagcagccggccgtgcgacccgaccctcctcccaatttcaagcccgactggcccatcgataacgagcgtcacacctgtcttcattgggcctctgccatgggcgatgttgatgtgatgaggcagttgaagaagtttggagctagcttggacgcacaaaacgtacgaggagagacaccgtttatgcgagcggtcaactttaccaactgcttcgagaaacagacctttccgcaggttatgaaggagcttttttccaccatcgattgccgggatttgtcaggttgcacagtcatacatcacgctgctgtcatgaagattgggcgtgtcaacagccagtcgtgctcgcggtactacctcgacatcatcctcaataggttgcaggagacacaccaccccgagttcgtacaacagcttctagacgcccaggacaacgatggtaacacggctgtccatctcgccgccatgcgcgatgcccgaaaatgcatcagggccctcctcggccgtggcgccagcaccgacatcccgaacaagcaaggcatacgtgccgaagagctgataaaagagctcaatgcttccatctccaaatcccgctccaaccttccgcaacgatcctccagcccgttcgcccccgatacccaacgtcatgatgccttccacgaagccatctccgagtccatggtcacgagccgcaagaactcacagccgaactacagcagcgacgcggccaacacggtgcaaaatcgcatcacgcccttggtcctccagaagctcaaggaccttaccgctacgtatgacagtgagttcaaggagaaagacgacgccgagaaggaagcccggcgcatcctcaacaagacccagtccgagctcaaagccctcaccgcctccatcgacgactacaactcccgcctcgacacggacgacgtagccgccaagacggccgcggagatggccacggcgcgacataaggtgttggcgttcgtgacgcaccagaaccgcatatccgtgcaggaggccgtgaagcaagagttggccgcactggaccgtgcaaatgcagtcacgaacggcacctcgaccaaatcaaagtcatcttct

SEQ ID NO: 27451 - DNA, 679 bp, Neurospora crassa
atgcctttcccctacaagaccgtcctcatcaccggcgccacctccggcatcggcctcgcgctcgccgagcgcatgatcaacagcggtgtctttgtcatcgccgtcggccgccgcaaggaccgtctcgacgctctcgtcaagcagcacggttccgacaaggtggccgctgagccctttgacatttctgacctttccgcccttcccaactgggtcaagcagtatgttcccattcccattccttccctcccctcttatccccctactaacatctaccagcatcacaaccacctaccccaccctggactccatcctcctcaacgccggcctgcaaaagaccctcttgttcaccaaccccaccgccatcgacctcgccgcccacaccaccgaactcaccaccaactatctttctcccctgaacatgatcgccctcttcatgccacacttgatctccctcgcccccaaccccacctccatcatcgtcgtcacctccggtctttcggtaatccccctcccgcgctgcgccaactactctgcctccaaagccgccgcccactcgcttgtgtggtccctgcgcgcacaacttaccggcccagaggcagagcacaccaagcacatcaaggtggtggaaatcatgccccccgcggtcaagacggagttgcacacgattcagccggacttg

SEQ ID NO: 27452 - DNA, 810 bp, Neurospora crassa
gcccgcctccggcccagcgtcgtcccccgcgtccttcccgcgctgagcaccgttgccagcccccgctactcgtccggtgtcccctccgaggaccccaagaccaaggcccagtccatcatcgactcccttcccggcagcaacctcatgtccaagaccgccatcctctcctccgccgccggtctttccatctacgccctctccaacgagtactatgtcgtgaacgaggagaccgtcgtcgccttctgcttgctctccgtctggggtggtctcatcaagttcggtggtcccctctacaagaagtgggctgatgagcagagcgacaagatcaagaacatcttgaactctgcccgcgccgaccacactcaggccgtcaagacccgcatcggcgacgttaagcagatgtctggtgttatcgacattaccaagaccctcttcgccgtttccaaggtaggcgctaccaggatggggattgggatacatgggatgcagatggtgcagcaggtggaaggatgacacgattgggaagaatgatgttgaggaaacaaggggaaagacagaggctgacatggcttctaggaaaccgccaagcttgaggctgaggcctatgagctcgagcagcgcaccgctctcgccgctgaggccaagactgtcctcgactcctgggttcgctacgagtcgcaggtcaagcagcgccagcagaaggagctcgcccagactgttatcgccaaggttcagaaggagctcgagaaccccaaggtcctcaagcagatcctcgagcagtccgttgctgacgttgagagtatgttttct

SEQ ID NO: 27453 - DNA, 1262 bp, Neurospora crassa
ctgtcgatggcttctctttcggttcacgccgacgactacatcaacaaccaccaggccgttgcgcctcccatgcacgtgtccaccacctttcgctatgccgagaacccagacgacttgaaaccatgggagaacctcaacgtatgcctcctgctttcactcctcaccttctcgtcaaacattgaaaaagatcctcaatctcagaatctcactaacacgcaacaaaaacacagcccaatgccccctatgactcccacatctactcccgcgactcggcccccaactccacgcgtctcgaggccatcctaacctccctcctgggtgcccccgccctcacctacgcctctggcctctctgccttccacgccatgatcgtcttcctgaaccccaagcgcgtcgccatcgggggcggctaccacggctgccacggcattcttaaactcatgaagaagctgaacggactggaaaagctcgaactcgagtccgacgccgacctcgccaaactccaaccgggcgacgttatccacgtcgagacgcccctcaatcccactggcgaagcccgcgacctagcttattaccggcgcaaagccgacgagctgggttgctacttgaccgtggacgccaccttcgctcccccgcccctgcaggacccgttccagttgggcgtggacattgtcatgcacagcggcaccaagtactttggcggacacagcgacatgttgtgtggcgtgctggcgttccggccggacaaggctcaggaatggctaccggcgctgttggaggagaggctgtacttgggcgcagtactggggagcttggagggctggctgggggtgcgcagcctacggacatttgagctgcggatcaagaggcaggcggagagcgcgcagaagctggtggattggttggtggaggagaaggcgaaggagggcagcctggtgagcgagtttgtgacgaggatccagcatgcttcacagcagcccgaggctaaggaggagggcagctggctgcggaagcagatgcctggtggattcggaccggtgttttccatatacctcaagtcggagcagcaggctaagaggttgcctagcaagctgcacttgttccaccatgctactagcttgggcggcgttgagagcttgatcgagtggcgtgccatgagcgacttggatattgacaagaggctgttgcgtataagcgttggcgtcgagagctgggatgaccttagggacgatcttattcagggccttgaggcgttgaagaag

SEQ ID NO: 27454 - DNA, 4510 bp, Neurospora crassa
gaggacttctcgggcaaaaagtatgtctggcttaaggatccccaggcagcctttgtcaagggatgggtcgtcgaagagctcccagagaacaagctgttggtccagtgcgatgatggaagcgtaagcatagcctctctatgatatgtgctcaaggcgcaatgttcaaccaactgactaactcgcctgatagcaacgggaggtggatgccgaaacggtcgacaaagtcaacccggccaagttcgacaaggctaatgacatggccgaactgacccatctgaacgaggcctcagtcgtccacaacctgcatacgagataccagtccgacctcatatacacatactccgggctcttcttggttgctgtcaacccatattgtcctctccccatctataccaacgagtacatcaacatgtacaaggggagaaacagggaggacaacaagccccacatcttcgccatggccgacgaagctttccgcaaccttgttgatgagcacgagaaccagagtatcttggtcaccggcgagtcaggtgctggcaagacggaaaatacaaagaaagtcatccaatacctggccgctgtggcgcacccagacccttcgggcaggactagaggttctcagcattcgaatctgtcggcgcaaatcctcagggccaacccgatcctagaagcctttggtaacgctcagacagtgcgaaataacaactcctcgagattcggcaagttcattagaatcgagttctccagcaatggctcaatcgcgggtgctttcatagactggtacctccttgagaaatctcgagtggtccatgttaatgccaacgagcgcaactaccacatcttctaccagctgctcaagggcgcagatcggaagcttaagcaagagcttctgctggatagcatggatgtaaaggatttcacttatacacgggatggtcatgacaccattacaggcgtgtctgataaggaggaatgggattcgctcattgaagccttcttggtgatgggtttctctgacgaagagcaggtcgcaatcctccgaacgattgcggccgtcctccacctgggtaatatcaccgtggtcaaggagagcagatcggccgatcaagcgcggcttaaccctgatgccaaggcgattgccggaagggcttgcaagcttctcggcgtacctttggaacccttcctccagggtttgctgcatcccagggtcaaggctggtcgggaatgggtcgaaaaggtgcaaaccccagagcaggttcgtttggccatagacgctcttgccaagggtatctacgagcgaggtttcggcgatcttgtagcgagaatcaaccgccagctcgataggaccagcatgggtcttgacgacacgcgcttcatcggtgttcttgatattgctggcttcgagattttcgagaccaatagctttgaacagctctgcatcaactacaccaacgaaaagcttcagcagttcttcaaccaccacatgttcgttctcgaacaggaagaatatgccagggaacaaatcgagtggaagttcatcgacttcggaagagacttgcagcccaccatcgacttgatcgagctaccaaatccgattggtattttctcttgcctcgacgaggactgcgtaatgcccaaggccaccgacaagactttcactgagaagctgaactccttgtgggacaaaaagtcgcaaaagtatcggccttctaggcttggacaaggcttcatcttgactcattatgctgccgaggtcgagtactcgacagaagggtggctggagaagaacaaagatccactcaacgacaacatcacacgtctcctggccgcttccaccgataagtacatggccaacctgttttccgattgtgctgatcaagatgatgaagctggagctatgcgtagccgcgtgaagaagggacttttccgaactgttgcgcagagacacaaagagcagttgtccagtttgatgacacaactgtattctactcacccgcactttgtgcgttgcattattcccaaccacaagaagaagccaaagcaattccagagccttcttgtcttggaccagcttcgttgcaatggtgtgttggagggtattcgtatcgctcgaactggtttccccaacaggttgccgtttgccgagtttagacagcgttatgaagttctttgcccgaacatgcccaaagggtatgtcgagggtcaggcagccgcaaggattatgctcgacaggttcggcctcgacaagtcactgtaccgtgtcggcttaaccaaggtctttttccgcgcgggtgtgcttgccgaattggaagagaagcgcgatgccatcatcaccgaaatcatggccaagtttcaatctctggcgcgtggctacattaagaggaggattgcctacaagcgcctttacagggcagaggcaaccagggtcatacagagaaacttccaagtctacctagagctgagcgagaatccatggtggcagctcatggtccgcatgaagcctcttctcggcgccacaagaactgcaacagaggtcaaaaagagggatgaaatgattcgtcagcttagtgaccggatgaagcaggaagccatggatcgacagaggctggaggaggagcgtcgcaatgttcatgccgagatgctgcgaatccaacaaaccctcgagagcgagcgtgctttggcgcttgacaaagaggaaatcttcaagagactgcagctacgtgaagccgagcttgaagacaaactggcgggcgctttggacgaccaagagcgcatggaagagcaaatggacggtctccttgaagccaagaagcgtgctgaagtcgacgtagagaagtatcggacacagcttgaacaagccgctaccattattggaaggttggaagatgagaaatctgaacttgcaaaccggattgcggatttggaacgtcaaattgtcgaaatctcacagaagcagtctgagcgcagtgaacaggaaacggcactggaaaacgagcttaagatgctacagagtcaactctccctgaaggatcgcaaagtcaaggacctagaaagcaagctgctcaaaatcgatcaggatagcgatgtcaaacttctggccaccgagaaagaacttcagattgccaagagcaaaaatgagcagctgactacagaaaacacccagttccagcagcagcttacacaactctcgaagacgtcaaccagttatgaggacctaattcgtaaaaaagaaagcgagcttgcgattctccgctcagaaaacaagcaactggcaacggagagacggagcattgatgatcaaacaaagatgcttgcttccgaaagggagaaggccgccgaaagactccgggaagtccaggctgaattgactgccatgaagtcgcaacaagctcagctgatgagggaggccgaggatgccaagaagcttctccaagctcgtctctcggaagacgctcaggcagaccaaaaccgccaagtgcttgaggcacagatcaaggatctcaaggatgagttgtataacgctcagatggaacttagcagggaacgtcagtctcgtgatgatgtccagttgcttggtgaacacaagtatcagaccctcaaggacgagtacaatcaccttaatgagtccaagattacaatcgagaaggagctctatgcccagcaggatacgctccggcgcgcggttgagactcgtacaacgcttgaacaggagcgggacgatgcccgcgaagaaatccgccgtcttcgtagtgccatgacccaggccgaggaagcacggcgtgaggccgaagtgctcggagagcgagcagcaaccaaaatcgcgcgagaacgcgaagagagtctgctcaaagacctcgacgcggcaaacgacaaacttaagtggtacgagtccgaatgcgccaagttaaactaccaagttgaggacctcaacaaggtgattatcgagtcgggcgagtttggtctcaaaaacgatcaggcaaaggaacgacttgagcgggaactcaataccgtgaggagccgactggccgcttctgagaacgacaaccgcgcccttctcaacaagttgcaacaaaagggcctcgagattgcaaggtccgcatcaagagccggtgaagcatctcgagctcaactcgtccaggtacagcgcgaaaaaactagagtggaggaacaaaataccaaactcaacaagcaactgggagattctcaggtcactgtcgccggcttggaaaagaaggtggagaaattgcaactcacaatcgaagacctgaaccacgaacttgcaagggaaacacaagccagccgcaatgccgaaaagctatcgtcgaatgttacagttcagctagcagaggcgaataggaccattgagtctgagcggcagttgcgtacccaagcccaaggtacagtccgcactctccagtcaaccttggatgcgcgtgataaggagctgattgagcttcgggctcaactcctgagcgcgctgaagacggtcgatcccgacacagacgacact

SEQ ID NO: 27455 - DNA, 1903 bp, Neurospora crassa
gagcgtaccgcgtcgggtgaagaagacgcatacctcgacgaaagcccacagcttcggcgggtgcagaagcttgaaaaggccaacaaccgacttcacgaactccttgatgattcctccaagaaagtgtcggctttggagaaggctcttcgcaccggtgagctgtcgcttcgtgacatccagaccaggtctcatgaagaaatcctcgacttgcttaatagccaggaggactcgcgacggtcactcttgcacagccacaaggatgcggttgcagagctgacggaactcaaagagcactatgacaaggtacgacacgagcgtgccaagcttgaagtcgatctccgcgacgccaggtcggatctccaagagatgtcgctcgccagggatcaggaggctgcaagccggagccaactactccaagagtttgcggacctccagattcgcctggatgctgaggcgtccaagctggctgacgtaacagcaagccttaacctctataaaggtcgggcggatgagtacttcagcaaacttgaacaggcagagattgccgttctcaaggccaaccgggcggaggcgttcgctagagcgcaagccaaggaagcggaggacagctgtgcggagatgatgtcggagaggaagcgtctggatacaatgattgaggatctgcaacactcgaaccaaaggttggaagagaagattgaagacatgtcgacggaccttgccgccgttactcaggccaagaagaggcttcagcacgagctcgaagattaccgcaaccagcgtgctaacgacattgaggataaggaatcgagcatggagcagatgcgcaagaagtaccaggccgagtttgcgacactggccaacgagctcgatcgggcccgcgaggagaagctacgcaagcagtcggagattacgagactccgggaagagctggacgagcttcggtccaagtgggatgacgaggtcctcaacagctcgacgtggtctaaggagaaggcgcggctggaggcgactctctcggacgtggtggcctctcgcgacgaagctgtcagcgcccacaacgaggctcaaagcaagattgtcacgctccttggccaggtacggtcgctccgctcgtctcttgacgagatcacggctgagcgcgacgccctattccgtgagaagaggagcatcgaggcaaggcttgaagaggccaaggctggtctcgatgagctggccaacagcgagagcccgtcgctgcgcaacgcggcgcacatggacagggagatcctagagctcaagtctagccttgctcaacaggaagacatcgctgcggctgccgtcgagaagatgcggcgcgccgaggcgcttgctgccgaagtccagaaggacattgctgctgagcgcgagaacaatgccgatttgcagaagcaaaaggttactctcgagaagaactttaacgagctgcagatgaaactcattgatcttgagaccaagggctattccactgccagccacgacatcaaattcttgcacagccgcatcaaggaggtaagtttatacggagtagtccttgctttcttagcatcaacagctaactcatcatcaccagcttgaatcccagctcgaagagcaagaaaacgagcgcagcaaatcccagcgttccgtccgcaacgtcgaccgcatcgttaaagacctgcagtcccagatcgaccgcaaggacaagcagaacacgcaactccaagaagacgtgacgcgcatgcgtgacaaggttgacaagttgctcaagaccattgacgagctgcaatcctcggaatcggccaatgagctgtcagcccgtcgcgcggagcgtgagctgcgcgaggaaaaagaaaaggccctgaggctggagcgcgagctcgaagggtggaaaaacctccgcatggag

SEQ ID NO: 27456 - DNA, 1854 bp, Neurospora crassa
ggcgcaggagcaggcggtatcgccgtcgcggcccgtctggccaaagccggagtagacgtcacagttctcgaaaagaacgacttcacaggaggccgctgcagtctcatccacacaaaagctggctaccgcttcgaccaaggtccctcactcctcctcctaccgggtctcttccgcgagacctttgaagatttaggcaccactctcgagcaggaagatgtcgagctcctccaatgtttccccaactacaacatctggttctccgacggcaagcgcttctcgcccaccaccgacaacgccaccatgaaggtcgagatcgaaaagtgggaaggccccgacggcttccgccgctacctctcgtggctcgccgagggccaccaacactacgagaccagcttgcgacacgttctgcaccgcaacttcaagtccatcctcgagctggcggacccccgccttgtcgtcacgttgctcatggctcttcaccccttcgagagcatctggcaccgcgccgggcgttacttcaagacggatcgcatgcagcgcgtctttacttttgcgaccatgtacatgggcatgagcccgttcgatgcgccggcgacgtacagtctgcttcaatactcggagttggccgagggtatctggtatccccgcggaggcttccacaaggtgttggacgctttggtcaaaattggagagaggatgggcgtcaagtacagactcaacacgggcgtgtcccaggttctcacggacggaggcaagaacggaaagaagccaaaggctacgggtgtccagcttgagaacggcgaggtgctgaacgccgatctggtggtggttaacgccgacttggtatatacgtacaacaacctcctgccgaaggagatcgggggcatcaagaagtatgcgaacaaactcaacaaccgcaaggcgtcgtgcagttctatttctttttactggagtttgtcgggtatggccaaagagttggagacgcacaatatctttttggcggaggagtacaaggagtcctttgacgctatctttgagaggcaggccctgcctgatgatcccagcttcgtaagttttaccctcattttggtttttttcctctccctctctctctctctctccctctaatagtcgtccgaccatcctccaactaacttcacctcacctcttgaacagtacatccacgtcccctcccgcgttgacccctcggccgcccctcccgaccgcgacgccgtcatcgccctcgtccccgttggccaccttctccaaaacggccaaccagagctcgactggcctactctcgtctccaaagcccgtgccggcgttctggccaccatccaagcccgtaccggcctgtccctgtccccccttatcaccgaagaaatcgtcaacaccccttacacctgggagaccaagttcaacctcagcaagggcgccatcctcggtttggcccacgacttcttcaacgtgctggccttccgcccgcgcaccaaagcccaaggcatggataacgcctactttgtcggcgctagcacccatccgggaaccggcgtgccgattgtccttgcaggtgccaagatcactgccgagcagattcttgaggagacgtttcctaagaacacaaaggtgccgtggacgacgaacgaggagaggaacagtgagcggatgaggaaggagatggatgagaagattacggaggaggggattattatgaggagtaacagcagtaagccgggcaggagggggagtgatgcttttgagggcgccatggaggtggttaatctcttgtcgcagagggcgttccctttgttggtggcgttgatgggggtgctgtatttcttgctatttgtgagg

SEQ ID NO: 27457 - DNA, 1116 bp, Neurospora crassa
ggtgtcttgggctgcactggctccgtcggtcagcgcttcatcctgttgctccagaatcatcctgttctgaagctcgtcgccgtcggcgcctcctcccgctccgctggcaagaagtaccgcgatgccgtccgctggaagcaatccacccccatctctgccgagttcggtgacctagtcgtccgcgactgcaaggccagcgaattcgccgactgcgacatcgtcttcagcggtctcgacagcgatgttgccggcgacgtcgagaaggagttccaacacgccaacattgccgtcttctccaatgcaaagaactacagacgcgaccccctcgtgcccctcgtcgtcccgaccgtcaacctcaaccatctcgacctgatcccccaccagcgcaagaccctcggcctcgagaagggcttcctggtatgcaacagcaactgcgccgtcattggcctcgtcgccccctttgccgccctccaggcgcgctttggcaagatcgataccgtatccgtcgtcaccatgcaggctgtctcgggcgctggataccccggcgtcagcagtatggacatcattgacaatgtcgtgcccttcatttcgggcgaggaggacaagctggaaaccgaggcccagaagatcctgggttctctcaacgccgacgccactgcctttgaggaccagaagcagctccgggtgtcggcagcctgcaaccgtgttcctgtcttggacggccacaccgcctgcgtgtcgctgcgcttcgcccagcgcccgcccccgtccgccgaggaggtcaaggaggccatgcgcagctatgtttctgatgctcagaagctgggatgcccctcggcccccgagccccccatcaaggtctttgacgaggcagacaggccccagccccgtcttgaccgtgatctctgcaagggatacactgtcagcgttggccgcgttagagaggacgagagtggtatcttcgatatcaagtttgttgccctgagccacaacagtaagtcgccctatgcctcgaacgcctcttcctgttcgcgctaacacctctcggtagctgttattggagctgctggttcctccatccttaacgctgaggctgccatatttaagggcctcatc

SEQ ID NO: 27458 - DNA, 2672 bp, Neurospora crassa
atgtactccgcttgcgctgttgccctccgggccggagcccgtcgcgttgttcgccgggttcctaagagcgctcgtgctctcccccgcgctgccgccgctcgccgtcagatctctaccacggccgctcgctcgaccgatcttactacccggggcatgatcgtccagaccctgtcctcggtcgggtcaaagcgcgaggtccagcagtacctctctctcttcacctcggtctcctcccagcgtttcgccgttatcaaggtcggcggcgctatcttgaccgactatctcgacgagctttgcgccgctctcaagttcctctacactgtcggtctctaccccgtcattgtccatggcgctggtccccagctcaacaggctcctcgaggatgctggtgttgagccccagttcgaggagggtatccgtgtgaccgatgccaagaccctccgtgttgcccgcgacctcttcctccaggagaacctcaagctcgtcaacaagctcgaggagatgggtgtccatgcccagccccttaccactggcatgtttcgcgccgactacctgaacaaggagaagtggggtcttgtcggcaaggtcaccggcgttaacaagcaggctatcgagactgccattagcaacggttatctccctatcctcacctctatggctgagaccgatgacggccagattcttaatgtcaacgctgatgtcgccgctgctgagctcgcccgtgcacttgagcccctcaaggttgtctacctttccgagaagggtggtctcttcgatgctggcggacagaagatctccgccatcaacctcgacgaggagtacgagcacctcatgtcccaggcctgggtcaagtatggcacccgtctcaagatcaaggagatcaaggagctcctcgacactcttccccgtaccaccagcgtcgccatcatccatcctgaggaacttcagaaggagcttttcaccgactccggcgccggtacccttatccgccgtggcagcaagctccaggcctccaccagcctttctgagttcaaggacctcgaggctctcaaatctgtcctgatccgcgaccgtgagggccccgatgccaaggagaccgttgaaaagtacctcgacttcctcaaggagaaccccttcaaggcctacttcgacagctccatgaacgccctcgccatcgtccttcccgccagcgagggtcgtcaggccacccttgccactcttactattaccaagtctggctggttgaccaacattgctgacaacatcttcactgccctcaagaaggagcacccctccctcgtctggactgtgaaggaggatgacgagaacctcggctggttctttgacaaggccgacggtagcatcacccgccagggtgatgtcatgttctggtatggcattgagaacggcgatgagattgtcaagctcatgaaggatttcaccgagaacggccgcgccatgcttggtaactccaacctcgagtctcgtcttcgtcaggctgccagcaagcccgctgcccagcaggttcgcggctactccactcttgctcgccgccctgcccttcccaagttcagcatctctaaccgcaggggctacctaacccagaccaaccccaacccccctgtcggcaagcaaaatgcctctatggaccgtcccgctcgcgttgccctcatcggtgctcgtggttacacgggccaggagctgatccgcctcatcgactctcatcccaacatggagcttcaccatgtctcctctcgtgagcttgctggcaagaaactcgaaggctacaacaagcaggaggttatctatgagaacctcagccctgaggatgtccgtgatatggagaagcgtggcgagattgactgctgggttatggctctgcccaacggtgtctgcaagcccttcgttgaggccgtctgggagggtcgcaaggcttccggccacaagagcgttattatcgatctttctgctgattaccgctttgacaacaagtggacctacggtctccctgagcttgtccagcgcagcaacatcatccaggctactcagattgccaaccccggctgctacgctactgccgcccagctcggtatttctcccttggttcctcacctcggtggtatgccccacgtcttcggtgtctctggctactctggtgctggcaccaagccttctcccaagaacgatgtcgagaatctcaccaacaacatcatcccctacagcttgactggccacatccacgagcgtgaggttagctcccagctcggtgccgagattgccttcatgccccatgtcgctgtctggttccgcggtatccaccacaccatctccattcccctcaacaagagcatgacttcccgcgacatccgtcagctgtaccaggaccgctatgccggcgagaagctcgtcaaggttgttggcgaggctccttccgttaagaacattggtggtaagcacggtgttgaaattggtggtttcgaggttgacaagtccggccgccgcgtcgtcatctgcgctaccattgacaacctcctcaagggtgccgctacccagtgcctgcgtaagttttctatactctccagtctcgcagagtgcctctgctaaccacattaacagagaacatgaaccttgcccttggctacgctgagtacgagggtattcccaccatgtaa

SEQ ID NO: 27459 - DNA, 1575 bp, Neurospora crassa
gttgtcggtcagttcgactattcggacgaagatgtcaataagggcgtcgtagagttccttcgtcaaatgggtaggtggtcccatcgccgtagacaaatgccgcaacaagctctgacaaattgaggattgcagccgaaggtctcgagaaggatggcgctagcatgagccagattcccacatatgtcaccgccgtccccaatggcactgaaaaggttggttatacactgctgacaagtacctgcaccgatggctaacctcctctgatggtagggtctttacatggctgtcgatctcggtggcaccaacttccgcgtttgctcaatccagctcaacggcgacaccacctttcgtctgacgtacaccaaggtcgctatccccagagagctcatggttgccaagaccgccgaggagctgttcgctttcttggcgaagcaggtcgaaatcttcctcaggacacatcatggagagcacttcgaggcacatatccgcagacgcatgaccatgagctcccccgagggcttcaaggacgagaacgtcttccgtctcggcttcacattcagtttccccgtccaacaattgggtatcaataagggtacgctcattcgctggaccaagggtttcgatatcccagacgccgttggaaaggacgtttgtgccctcctgcaaacggagattgacaagctccatctccccgtcaaggtcgctgctctcgtcaacgacactgttggcactttgatggctcgttcctactcttcccctggcaagagcggtgctattctcggtgctatcttcggtactggcaccaacggagcttatgtcgagaagctttccaacatcaagaagcccctagccggcgagtacgataaatctaccggagagatggtcatcaacactgagtggggttcgtttgacaaccagctcaaggtccttcctaacacaccatgggatgtccagctcgacctggccacccccaaccccggtattcagatgtacgagaagcgtgtctcgggcatgtacctcggcgagatcttgcgattgacggtcattgatctgcttaagaacccagacgttgctctcttcaaggacgataactcgagctacaatgactggaagtcaactaccaacattgccgaacactcccccatctacaagcagtggggtcttgatacctcggtcctctctgtcgctgccgctgacagtacccccgagttgtcgatcctccgtcaggagctcgaggccaacctccacatttatgccccctctttggaggacgctcaggctttcaaggccattgctggtgctatcggtcgtcgtgctgctcgtctttcggctgttgctattgctgccattgttttgcagaccggcaaactcaacgaccccgagcaggatgagcctatcgacattggtgttgacggaagcttggtcgagcactatccctacttccgtgacatgatctacgaggctctccgtgtcatcaaaggcattggtgaggagggtgccaagcggatccgtatcggtattgccaaggatggatccggtgttggtgccgcgttgattgctctcgtcgccgcccgc

SEQ ID NO: 27460 - DNA, 801 bp, Neurospora crassa
tcaggcaaggtcatggcgatgaaagagatcagactcgagctggatgaatccaagttttccactattctcaaggaactcgtaattctccacgagtgcgcttcgccctacatcattgatttctacggcgccttttaccaagaaggcgcggtatatatgtgcatcgagtacatggatggcggcagtatagacaagctatatgccggaggtatccccgaaaatgtcttgcgcaagattacatatgcaacgatcatgggcctcaagtgtctaaaagaagatcacaacatcatccatcgcgatgtcaagcccaccaatattctggtcaacacgaatggacaagtcaagatctgcgattttggcgtttcgggaaatctcgttgccagtatagcaaagaccaacattggctgccagagttacatggcaccagaacgcatcagcggtggtggcatgtcagctgcgggcggcgcggctgccgggacctacagcgtacaaagcgatatttggagtttgggtctcaccattatcgagtgtgccatgggtcgatacccatacccgcctgaggtttctagcacaatcttcagtcaactcagtgtaggtcttctttctgcttccctatcctcatccctgaagcgtacacacaagctaacagaatgaacaatccaggccatcgttgagggcgaccctcccggcctcccaagtgagggctactccggcacagcacaggactttgtcaagtcctgtctcaacaagatccctgccaagcgccacacctacccgatgttgctgatgcacccatggatcaag

SEQ ID NO: 27461 - DNA, 1926 bp, Neurospora crassa
gtaactcccatttcatccgttctcattgcgaaccgtggtgagatagctctccgcgttgctcgaacggcggcgtctatgggcatccgcaccacgaccctctacactgatatcgatgccgcttcccaacatgccaagtgcaccccctatgccctctccctcggcgctccctcggcctacctcgatgggccacgcattgttgagctcgcaaagcaacatggcatccaggctctccacccgggttacggtttcctgagcgagaaccctgcctttgccaaggcctgcgaggaggccggtattgtctttgtcggtcctcccgccaaggccatgaccgacatgggcgacaaggcccgcagcaaggagatcatgaacgcctccggcgtgccatgcgtccctggctaccatggctccgagcagtctgtcgagcagctcaaggccaaggccgccgacatcaaataccccgtcttgctcaagagcgtcaagggaggtggcggtaagggtatgcgtattgtgcgcaacgcggacgagttcgaggcccagctgaagagcgcaagggctgaggcacgcgctagctttggtgaaggtggtgaggtgatgctcgtggagaagtacattgtgcggcccaggcacgtcgaggtccagatcttcgctgatcgtcatggtaactgcgtggcccttggcgagcgcgattgtagtgtccaaaggagacatcagaagatcctcgaggagagccctgcacccttgttggacgatgtaacacggaaagatctatgggacaaggcaaggaaggctgcccttgctgtggactacgtgggcgccggcaccgtcgagttcatcttggacaaggacaccaacgagttctactttatggaaatgaacactcgcctccaggtagagcatcccgtcagtgagatggtcacgggtaccgaccttgtcgagtggcagtttagggttgctgccggcgagaagcttcccttgacccagggcgaaatcgaagccaggattctggaaagaggtgccgccatcgaggccaggatatacgctgagaacccggagaagggcttcttccctgactcaggcactctggtacatctctcaaaacctcaaacaaacgaagacgtccgcattgacgccggcttcgtggaaggtgacaccgtttctgaggcctacgacgggatgatcgccaagcttatcgtccggggcaaggatagagagacggccatccgcaagctcgaactggccttgcgcgaatacgaagttgtcgggctgagcacaaacattgagttcctcaagagactctgtaacagccaagcctttatcgaaggtgatgtcgagaccgggttcatcgacaagtggaagacagaactgtttgaagccaagcctacctccaatgatgtgttcgcccaagcggcccttggtctcctaggcacccagacacaaaatgtccctgctgcacatggtcaggccctcggcttcggcgaagccactacccagaactcgcgcaagttcgcgttccgtgtccaagacgatgccagtaccgaggaaggcaagatcgtcgaggttgaagttgcgcagctgaacaacaagctgttcaccgtgtccgtccgcaaggagggcgatgacaagccgcaagtgtttgagaatattgtgtccaagtcaacttctacaacggccccgacctcatcagcgaagaagaccaagctgactacgtacttccctcttgcgagggtcgacacaacattggtccaggaccctgcggataacgagaagttgacggtcttccagcttggtcacaagactcagctcagactcgtcagcccagtgtggtttgataaggcgctgggcttgaaggaagttgcggctagcgtggtggcgccgatgccttgcaagattttgaggaatgaagttgaagagggtcagccggtggag

SEQ ID NO: 27462 - DNA, 771 bp, Neurospora crassa
ggcgatggtgcctgcggaaaaacctcactgctcaacgttttcacaagagggtatgtttgcgattgaaccgccattgcctcgcaatctaagaattcacgctcaacctcccgtccagctatttccccactgtatacgagccgacagtcttcgagaactatgtgcacggtacgtttgcagagaaagtgaccgaagcgtcctccaatgcgatactaatgttgactcagacattttcgtcgacaatgtccatattgaactgtcattgtgggataccgccggccaggaagaatttgacaggctacgaagtctatcatacggtaggttcttcgcattccccggtagccgctaaccatgttatgtgcgtgacgtctgacttgcggtgtactagatgacaccgacttaatcatgctttgctactctgtcgacagcaaggactcgctcgaaaacgtcgaaagcaaatggcaaggcgagattgctgaaaactgcccgggcgtcaagattgtcttggtcgcgttgaagtgcgacctgcgcgaggcgaccgaggacgaagaggatggcggagccaacgaggacggtgctcaacgtgagaagaagccaatgatcagctacgaccagggcctggaagtggctcgccggatcaaggcccttcgatatctcgaatgctccgccatgcgaaaccggggagtcaacgaagccttcaccgaagcagcgcgtgtcgctttgtcagtgaagaaggaccgggaggagtcgaagtgcgtggtcatgtaagacggc

SEQ ID NO: 27463 - DNA, 1787 bp, Neurospora crassa
cctaccatactacccttcttacggcacaagactgtcgggaacatgttcacctcatcatcggttccaatccgctggcggcatcccgagtcgcccagtcactcagcgtgggcgcaaaacccattttaattgctccggtagagtcggatatgacaccaacagcagcggactcacaacagaatcaaaagcgggagctacaccacaacctggccaactacatctcttctggagccctaacgcacctggatcggccttttgcggacgaggacctcactacgctcggtcggtctgaggtggacaatgtcgtggacgccgtttttgtgacacaacacgaccaattgctggccgagcggatatcagccctgtgcaagcgcaagcgcattcctgtcaacgtgcttgacaacccggcgctgtgttctttcagcctcctgagcgtacacgtcgacggcccgctgcagatcggcgtgacaaccaatggccgtggctgcaagctggccagtaggattaggagagaggtggcttctgcgctacccaagggattaggagccgcgtgtgctcgacttggagacgtgaggaggaggatcatcaccgaggacgcagaggccaggactgctgcagggagcgccatcgctgccgcggtaaacgaaggcgtcgacgactccatcgaccagtcggcaacgtttaacaaacttgtcaccgagctagacgtgcaggccgaggcggcgaagacgcgccgcatgcggtggttggcacaggtgtgcgagtattggcccctgaagaagctggtggaaatcaccgatgatgatgtggagagcatcctccaggcatatcccggattcagcagcgacaactcctcggcatcaccacaacctgttctcccgggtgctgtcagtgagggtggcagcagcagcaccaccaccaccagcagcagcagtaatggccgtattggacgcatcttcctcgccggcagcggtcccggccacccggatcttctcacgcgggccacatacaaggccatccaatcagccgacctgattctcgccgacaagttggttccctccggtgttttggatatgatcccgcgccggacgcccgtttcaattgcccgcaaatttcccggtaacgccgatcgcgcgcaggaagagctgctcgagcaggctttggaaggtgttcgtgcgggcaagacggtgttgcggctcaagcagggcgatcccttcatttacgggcgcggcggcgaggaggtggccttcttccgggagcacgggctcggcgatcgtgtcgtggtgttgccgggcatcacaagcagcttgagcgcgccgctgtttgcgggtattcctgccacccagcgtgatgtgtcagaccaggtgcttatctgcactggaacgggaaagaagggcaagccgccggcgccgcccgagtacgtcggcagtcgtacggtcgtgttcttgatggctctgcatcgtattggaggactggtcaaggagttgacaacgcgtctcggggaggccgatggggtcgcggaggttcaagagggcgagaagcaacgggcactgtggccgcttgacaccccgtgtgcggttattgaaagagccacttgcccagatcagcgggttatgcggacaacgctccgatacgttgagcaggctatcgaacaggagggtagtcgcccaccggggcttttggttgtcggccgcgcctgcgaggctctttacacgccaaagcaggaggggcaaccttgggtggtggaggatggtcagttcaaagatcttgatttcgaggattctctgggc

SEQ ID NO: 27464 - DNA, 1860 bp, Neurospora crassa
tcgtagccaccattgcttcacgacaccattcctcaacacttcgcttccgtcgtctcccaacatggtgaccgtcctgcagtgatagcgcgatcgccaacggctatccccgatgccttcccgaatctcgcgcccgaccagcttcccgaagctctagaaacggcccatacatatgaggaacttgatcgggtatccaaccgtcttgcgcattccctacggtcgcttggcgtaaagaaaggcgatagagtggccgttagcttgggaaactgcgcagaatacgctgccatcacttacgccgtcttcaagctcggtgccattcttgtgcctttgaatccgggattcaacgccaagcaggtatctgctgccctgaatcacctcaacgttgagcttctgatcattggcgctattacggatctggcctacaaaccgtgccgtggacggagcaacctcccgcttcttcgggacattgttcctgatatagagtcgggcaggatcgaagcccctcatgtgccatcactacgaacagtagttgtcctcgacaacaccccttctcaccctgcttcggaatttccaccgctatcgtcatgccggtcactcatccccttctcgattctgatggatggctccggcgcacctgtaacacccgattcaccactctgtccttcagagactatcaacatccaattcacctccggcacgacctcacacccaaaggccgccatgctcactcacaccggcattctcaacaacggcgcgctcatcgccaaccgcatgggtctcgagcccaccgacagcatggtcgttcctcctccgctcttccactgttttgggtgcattctaggttacatggccacagcaaccactggcgccgccatcctctttccaagtccagccttcgatccactagcctctcttcgcatggccgccgaccacaaggctaccggtctctacggcgtggccaccatgtttgtggccatgctcgagctcatcggggcgcagtcacatctctccgatccgctcataccactcaaggacatcgaggactttcccaaccacctgcgcaagggtattgcggctggcagctccgttcccgagagtctgatgcgcaggctctacgcaaagattggtctgcaggacttggtgatctgctacggcatgacggagaccagccccgtgagcctcatgacagcgccctcagacccgttcgagaagcgcaccgcttccgtcggcaaggcgatgccacacaccaaagttaagatcgtcgaccccctggacaggacgcgaatcttgcccattggcgaacgcggcgagcttgcttcggcaggatatttggtcatgaagggctactggggcgacccagagcagacagcagaagtcatgattaccgagcctgacaacgacggaagcggctcgagcacgacatggatgtatacaggcgacgaggccagcatggactcggacggctacgtggagatcacgggccgcatcaaggatctgatcatccgcggcggtgagaacatccacccactcgagatcgagaactgtctgttccagcatccgttgattgccgaggccagcgtcgtcggcgtggcggacgagaagctgggtgagagcgtgggcgctttcattattgttcacaaagacgtcgagcctgtcgagggcgaaggtgggggaggggatgtgctctcgctggagagcacggcgaagggacgtagtgaggggaagaagacactgacgagacgtgagatcagggagtgggttgctaagcatctgtctcagcatatggtgcctaagcacgtgttctgggtggatgaatatccgaagacggcgagtgggaagatacagaagttcaagttgagggat

SEQ ID NO: 27465 - DNA, 882 bp, Neurospora crassa
gccgatgtcgagacagccaagcatgcatcaaccactgctgtgacggacaagagctcctcgggcgccaacgccgctcaacaaaacccccagggccaacgaccgatccaagacatgtcacgaatgacactgtacgaaaagctcgcgtatcagtttccctacgatgtcgaatccaagttccccgcctacatttggcagacgtggaagtggacaccagcacacggcgaattcaacttccgcgatcaggaggccacatggacacagcaacaccctgggttcattcacgaagttatcaccgacaaggtcgccgtacatcttatccgtctgctttacgcatccgtccccgaggtggtggaggcatacaatgcgcttcccttgccggtgctcaaggccgacttcttccgctatttgattttgctggcgaggggcggcatctactcggacatcgacacgtatgcgattcggagtgccgtcgagtggattcccgattcagttcccaaggacgccattggtttggtgatcggcatcgaggctgatccagataggccggattggaaggagtggtacagccggaggatccagttctgtcagtggacgatccagagcaagccaggtcatccggtgctgcgggaagtcgtttcacgcatcacgaatgtgacgctggcgatgaagagaaacgggacactgagaggcgtggttgacaagaatgtcatcgagttcaccgggcctgctctctggaccgacgtcatctttgagtatttcaacgaccagcgttatttcgacatgacacactcggccggatccatcgactggaagaactttacgggcatggaggcctcgaagcgggtgggagacgtggtcgttctccccatcacaagcttctct

SEQ ID NO: 27466 - DNA, 7641 bp, Neurospora crassa
aatgacccgttcgcggatttcgcaagcttgcagcttaaggctcagaacacccttagtcttctcaagcttgccgtccaagagaccccggatgtgctgaagcagacgaccgatgggaatgagttcttgttacgcggcccagaacctttgtggctatggttccagcctaggttacttgctcttctgggccgttccaagctgcttggtatcacgtctgcgattgaggacttcttccactttactctgcaaaccgttgctgaacgtgtgcccctctgggaccttggcccaggcttgcttcagtatttccaagcaagcttgcacggtaagcatcagcgacaagccgcaactggttatgcagtaatcgctaatgttaatgtaaatcgccagccatactcgagcatttccaatcgaacccgctcgccgatatgaatgcacggaactctaatctcgacatccagcttccgccggacacgtttcttcgagccctggacctcgatgacccagatacaccatccaagttcttctacaagatccgggattccgaacatgctatccgccacgccatcagcctttttcacattctgaagtccaccatcctacctgtgggggctgctgaacccccactgctgtaccgcggaaacattgcttggttgatggatgtgtttcagccgcttttctctgctttggttcactggtcgccacaattgaagataagtctagcgccctatgttcagacagctattgacctagcagaagccgcagacgacacactgcgcccaaaagcgatatccgcgcttgcgttgatatgcggcgaggtatttgacagatccgcgcaatatcttggcgaagacgagtttgggctggctacgagaaaggcactctccttggctttgctccatcttgtcaaggaagcagatagtcacaggtctttgatgcagctgttcgaatcccgagtcgtcatccccgccgtcagtttcgctacagctagcctccccaactcggatctatgggttggtgcatcagaaatgtcacatttggtttaattggtgctgacatccaatttagagatcagccattctcctccagcaggtagtgtctgctgagacttctttttcccaagttcctgaagagctcagttccagtaaattcgttgacgtcacccttcgtcagcaagtcggactgttgggcctcgatcctgttgtcgaggatggggaaccggcccctaaacgaaggaagctggtggagcaccaagcattatcagccgacattgtcgaagaaatatgccgtgttgctaacctgccaatctctgaagacatctgctctttggaagatagcctaatgtgagttggccgagtagaaggcaggccgtacttctttttttactaacgataatagtgatgcctttcccaagctgacaatacttcgacaatgccgagtcattgagctcatttcctttgtcccgtgcgctacggataataccctgggactcgaagaaggccgtttggggtctttggctctttcttcggcatctttagaatgttcccattgctccatattcggatattcagcttttacgcaggcatgtgatgatgccgttacaaagaccactgcctacaagatcctggagaagcttgttaagagcccgggtttccgtgactctagacgccctcgtgtgtacgcgatagtgcgtttacaacgcatgttgcggcataccgtccttcctgagttccgtgatctggagcagtcgatacttggacagtggtgtgtgcagtcgctacgcagctctatacgagagcttcgtattggtgctggtcgcgcacttgccgtcctgttagacccagatgttcccgattttgtccgtcctatcgccagagggaaccaaaatattgtcctcgacattctcaagttaatcaccgatgaggatgctcttcatttgcacgaaacatgcatactagcttggggtcaagcaggaagggttgtatctgtcgaccacctaaacctgattttgatcaagctcgttgagtacctgggatacaacaattcggtcgtgtcttctatggcagttaacgaaattctcaacatcgcaacgtatcgcggaataacgcccttgcagctatttgcgccatactgggagaacatggcggttctcgtagtcaaggacttggtttcggcaccgcagaccacgaggttggttgcggagactttgcagctcagcatcgaagaactcctttgtctgttacaaaaacacgctcttccatggttggtattggcgaagaacctaggtgtcatcgagaaaattgccgaagcccggggtgagaagtcaacatcgcaaccgtgcattgacagcgccaacttcccctcgatcattgctcttctcttgatccaggatgtcccggacgttgaagagcatgcaatggaattgctctgcgtaatctcccccaaattcaaggaaccaaaccccggtgagcttaattccgatgagaaaagaccggtatctgtacgcgatcgactcgccgagatcctgagagttgaaccattgggggtattattcgagcttttcaaggccagtggcggggctgacgagagaaaaaaggcactggtacgttacgttcactgatatatagaaaccagaggctgacaatgcgcagatacgcaaaggtatcagtatcttggcaactcggagttcacctttaacagaaaagggagccgagccacctcacatcatcgagcgcttcttggaaaaatatacacttgggttggtatcgcgactcagtgaacgaataacagatatcgacgttcctatcccagatagacgacgatgccttagagcaatggaagaaatgatcagagtttgtcgatcatcggtgacaactgctcgttcacaggtatgctgctctggatcagtgactccggcctggaaacacctatactcaccgcactcctctcatagatatcggcatgtttactgtctgcactaggatgcgacgagctgcggtctgatgccttctcgtgttggtcggtcatgatcatgaacatggacgagatggatgtgccaaatttgcttgacaccacgctctgggtgatcacacatcactggacatgctttgacgacagtaccaagcaacaggctcaaggagtcctcgacgccctttccaagacgaatggtcatgatcttgtcaaggcaacggcctcgatgacgacgtttaatcatctccctgatttggctgaacaccgcaagcgtctgggtcttctgtcgcagtcaggattaactcgtcaagatctttttcgcacattttgccgacgactgagacacgaccatccgggcgtcattgaacaagctttgaccgaactccttgagttattgcggcaacatcaagactatatccaggcatccgctcttgctgaacaacccaaatcgttcattccaggacttacgcgctccgttcttgattgcgcagccaaatacaatggttggcagcctgggatcatgcgcctctgtgccgagtgcatgggtatcattgggtgccttgactcgaaccgcatggagagcaatcgagaacagaaacggtttgtcgtcagtcaaaatttcatggatttcagagagacagcggacttcgtgtgtttcatgttggagaatgtcctcgtcaaggctttcctttcaactacagacacgaagttcctgagcttcctttcgtatgcgatgcaagagctcctggccaaaacgggcatcaaactcgcttaccaaagtcagggacagggccaacatgagacattatacaagagatggcggagcttcaacgacataaccaaagagattttaacgccatttttgacatccgaattcatcgtttcgtctggaatgattgggctggacaccaattaccctattttccacccccagaaatcatacgagacttggctgaaaacgtttgttcttgatcttcttcgcaatccacagaaccctaacagcgcgattctctttccacctctctgtcgacttatcaaggtccatgatccttgtgtgagcgagtttctgttaccctacgtggtgctacacgccgtcatcgggagcgagggcccctcccagacaccagatgagagccaaatgctcgtggcggaagaggggtcgaccagggccgaggcccacgaaaagaagacaagcggttcggaatggaggaagaaggtaatgtctgagcttaagactattttggaatatcaaccgccggaaaccgccacgcattccgagaaagaggaagtcaagctttgctacgaggtatgtacattttctcatgactgtgtattacttaaactgactaaagtaggccgtgttccgcattcttgactacttcaaaaactggctacacatcaaaaagtcccagtcagcaaccaaagagaaagatgcgaggtggtgtccattggttgaggaggtgctttcttccctcgatcctgaactagttgctcgacgagcgattgactgtgggcaatatgctcgcgctcttttgttcctagagcctcacattgaaagtcgcagagacgaggctataggtgacgaagcaactcgtctcatgcgatcggtacatgatatatacacgcagatcgacgatcccgatgggctagatggcatatccgcgtgcatgaaagatctcgggtttaaggagcaggctctcagtcatcgtaaagcgggccgatggactgctgcgcagacctggtatgagatacagctggctgaatcgccggacgatgttaatcttcagctcgacctcttgacctgtctcgaggaatcaggccagtacggtgagtgacatttgttatctttaggttgatggtacatacggagctgacattgcgtccagacaatcttctgagttttgctgaaggaattgacaaaacaccaagcagtctgagcaaagtgatgcctttcgttctcgaagcgtcgtgggcgacgggcaggtggcaaataatggagaagtatctacgatcgtacaccgagggcgacgtaaccgatgtcttcaacatcggtatcgctgatgcactgctctgtctcaaggaaggagatggagaacggtttcaagaacttttgcaggcaatgcgggacaaggtggctagttccatggcactttcagcgacatcatcgttcagaacctgtcatgacgtgatgctgaagtgtcacgttctggaggatcttgagatgattgccaatgcggagccagtcgagggtgaaggccatgcgcctcttgtgaaggctctagaacgtcgcttggaggtactcggggcatatgtcagcgacaagcagtacgtgcttggagtcaggagagcagcaatggaactgatgaggtatgtatcttgtttgatctctgaactcattgagctcatttctgataaatcactaggacgaaattcggagacgaagagatatcgtcatcatggcttgccaccgctcgcttggccaggaaatctggttcgactcatcagtctttcaacgcagtgctacgtgcgcagcagcttggtgatagttctgcagtcatagagtacgcaaaattgttctacaaggacggccagcatcgcaaggcgatccagctattgcaacgcgccattgacgacgaccttttcaacgatggtatgatggcaatagataccccaacatctagcaagagtcaacagtctcatcgcaatctactgaaagccagagcccacttgctccttgctaagtggctcgattcaaccggccaaacccacgccggcgctttacgctccaagtttcaagaggcggccaaaacccacccgcaatgggagaaggggcactactaccttgggcgtcactacaagaaggttttggagtccgagaaggcgctcagcccagatgatcaaagtgacgcctatttgaccggagagaccgccaagttggttatagagaattatctgcgctcactcaactttgggaccaagtatgttcaccagaccttgccacgaattctcgacctatggctcgaactcgggactcaagtcgacgctccgtcactgggcatggtgaccttgtccgcagagctacaatcacgtcggaggaccattctccatgagctttataagcatttcaacaggcatctacctaaaatgccagcttacattttttacacggctttgccgcaaattgtggctagaatagctcatccgaaccaagatgtattcagagtcctggagcaaatgattatcaaggtggtggaagcacacccccgacaggctatctggagtctcttctccttcatgaccgggcgtacgaacggtgctcgacgacacagagggcaaaaggttttggacgacctcagagccatcgcgaaaagagtcgatgagacaggctacgacctgaaacagttgctcaaaatgggcgagaagcttgccgagcagctccttctggcatgcaacaaaggtgacttccagagcaacaggacagtaaaagcaagtattacgagggacttgaacttcaaccacaaatgcacgccgtgtccgctggtggtgccgatagaaacgtgcctcaccgcgacattgccgacgttaacggacaacaccaggaagcacaaggcgttttccggggacgtcatcacgatcgatagattccttgatgatgtactggtgctgggatctctggcgaagccgcgcaaactgacggcacgaggatccaatggacagctttacggtctcttgatcaaaccgaaggacgatctccgcaccgaccaacgtctcatggagttcaacggattgatcaaccggtcgttaaagcgcgataccgaatctagcaaacggcagctgtacatcaggacatacgccgtcacgccattgaatgaggagtgcggcatcatcgaatgggttgatggtctgaaaaccctccgcgatatccttctgggcatctacaagacgcgaaacatcacacccaactacgggcaaattgcagaactgatgaagcaggcgtgcacgtccgacgacaatctccatctctggtccagatccgtgctcggcatgttccccgacgtgctaccagaatggttcatctcacagttccccgacccatcagcctggttcgccgctcgcttgcgatacacgcgctcctgcgccgtcatgtccatggtaggcaccatcctcggcctcggcgaccggcacggcgagaacgtgctgctggaggaaggaaacggcggcgtcttccacgtcgacttcaactgcttgttcgacaagggcttgacttttgcccagccggaaaaggtgcccttccgactgacgcataacatgattgcggccatgggtatctaccgctacgagggccccttccgaaactgcagcgagctgacgctcaaggtgctgaggcaacaggaggaaacgctgatgacgattctggaggcgttcatccatgacccgacgctggatctacagaggaccaagaagcggactcatgatgtggtcaagctgaatccgacaagcgtggtggagagtatcaagcgaaaagtcagggggctgttgccgcatgagaagatcccgttgggcgtggagggtcaggtggaagagctcattaagcaggctacggatccgaaaaacttggctgctatgtatattggttggtgcccgtttttgtagtctgattagcgtatctatagagaa

SEQ ID NO: 27467 - DNA, 2423 bp, Neurospora crassa
gcacccatcaagatggcgcccagaaagaaaatcgccatcatgacctcgggcggcgattcccccggcatgaacgctgtggtacgctcgtgcgtccgcatggccatccacatgggctgcgacgcctactgcgtctacgaaggctacgagggtctggttagaggtggtgacttcataaagcagatggactggtttgatgtgcgcggctggctctcggaaggcggcaccttgatcggtaccgctcgctgcatggctttctacgagcgcgctggtcgccttactgccgccaagaacatgattctcaacggcatcgatgccctcattatctgcggaggagacggctctcttaccggtgccgacaggttccgtgccgagtggccttcgctgttggaagagctggtctctactggcgagctgacggccgagcaaattcaggcttacaagcacctcaacatcgttggtatcgtcggttctatcgacaacgatctgtctggtacagacgccaccgttggctgctattcggctttggcaagaatttgcttgtgtatcgatatgattgaggctaccgcctcttcccattcccgtgccttcgtcgttgaagtcatgggcagacactgcggttggctggctttgatggcagctgttgcgacaggcgcagatttcctctttattcccgagaaacctagggaggacaactggagagaggaaatgcgtagcgttatccagcaggtacgttttccatgttcagcctgggctacagtgccaccgaataagcaatggctaacaaacggaaacaacagcaccgcaggcttggaaagcgcaagaccatcgtcctcatcgctgagggtgctctcgacaagtttggtaacaagatcacccccgaagaagtaagagatcttctcgccgacaagaatggcctcgccctcgatacccgcatcactaccctcggccacgttcaacgcggtggtactgccgtcgcatatgacagaatgctcgcgactcttcagggtgttgaggccgtcaaggctgtcttggaagccactcccgagaccaagacttgcttcattgccattaccgaaaacaagattgtcaggaagcccctgatggaggcggtactggataccaagcaagtcgccaaggcgattgaaagccaggattttgacggagccatggctcttcgtgatgccgagttttcggagcagtacaagtcgttcatgatgacaactgcaggccagatcgatcacgagacattgctgcctgaaaaggaggtgagtgatgatcatgctatttgcgcttcatctggttgagttgagctaacctccattcagcgcatgaaaatcggctttatcaacgtcggtgcccccgctggaggtatgaatgccgccgtccgcgctggtgtgtcgtactgcttgtctcgtggtcacgaacccattgcgatccacaacggctttgcaggcttcgcgcgccatcatgccgattcgccgggctcagtgcggccctttgactggcttgaggttgatggctgggctagcaagggcggttccgaaatcggcaccaaccgtgagctcccgagcgagtctggcatggagaccatcgccaacctcatcgagcagtaccagtttgacgccctgttcctcatcggtggcttcgaggctttccacgccgtctcgcagttgcgcaaggccagagagcagtacccctctctgtgcatccccatgacgctgctcccagcgaccatctccaacaacgttcccggcactgagtactctcttggttccgatacttgccttaacgagcttgtcgactattgcgacaagatcaagcagtccgcgtctgccactcgcagacgtgtctttgtcattgagacacagggtggccgttcgggttacatcgcaactctcgccggtctcggtgttggtgcctcggccgtttaccttcctgaagaaggtcttagcttggaaatgctcagcgaagacgtccgtcacttgaaggaggtgttcgctcaggacaagggacagagcagagccggtcgcttgatcctgatcaatgagaaggcctccaaggtttacaatgccaagctcatcgccgacattctccgcgacgaggcccacggtcgttttgaaagtcgtgagggtattcccggtcacatgcagcagggtggtgttccctcgggcatggaccgttgccgtgctgttcgtttggccatcaagtgcattcagcagcttgagaagtatggacgcaacgtgcacaaccgcgtcaagatggatcccatgagcgctagcgtcatcggtatcaagggagcgagtgttatctttacgccggtccagaagttggaggaggaggagaccgactggcccaacagacgccccaaggctgccttctggcttagtatgaaggagattgttgacatccttggaggccgtcct

SEQ ID NO: 27468 - DNA, 2199 bp, Neurospora crassa
agagaggacgagatcagtaagctgctatccaacatccggccagatgaggatataccaccggaggaacgcggagacacaccaccagatttgaagtaccccctctatccacaccagcagttggcactcaagtggatgactgatatggaagggggccacaaccggggtggaattcttgccgatgatatgggcctggggaaaacgatctcgacgttggcactcatggctagccgcagagctccggagggtgaagtggtaaccaacctaattgttgggcccgtggctttgatcaagcaatgggaacttgagatccaaaacaagatgaaagaggaccgccgcatgaaggtctatctctatcacggcgggtcaaaaaagaagccttggacggaactccagaagtacgacgttgtcctaaccacgtatggtaccctgactgctcaattcaagaaacaccatcattatctcgagaaaaataccgagagcctgaatgggttggatgagcaagctgagaagcgatatcggcttgagtgcccgatgcttcatcctagcaccaaatttttccgcgtcattttagacgaagcccaatgcgtcaagaacgccaatacaatgcagtctcgagctgtccgccaggttcgagcgacttaccgatggtgtctgactggaacgcccatgatgaacagtgtttcggagctttcctctctgctgcgtttcctgcaaattaaacctttctgtgacgagaagaaattcaaagaagccttcgcatctttggaccacaagtacaccggacgcgacgttgaaaagagcacggccatgaaacaattacaggctttgttgaaagccataatgctgaggcgcatgaagaccacggtgatagatggcaatcccattctgaacctgcctccgaagtcgctgtacactgagcacgttgagttctccgaaggcgagcttgaattctacaagaacctgcaagaaaagtcccaggtcatctacggcagatatgtgagaaataacacagtgggcaagaattactcaaacattctcgtccttctcttgcgactcagacaagcctgctgtcacccgcatctcaccgactttgaggctaaccccaagaatcatctggccgaagctacaatgattgagctggcgaagaccctggagcctgtcgtcattgacaggctcaagcaaatcaaggcattcgaatgccctatatgctacgatgcggtcatagaccctaccatcctacttccctgcggtcatgatatttgcgcggactgcttttcctcgttgactgaccaatccgctatgaacggaatccgaaacggacaggacggagcgaatgtcgccaaatgtccggtttgccgtggccccgctgaccatacaagggtgaccaactacacgtctttccaggctgctcatatgcctgaagccctggagaagttggacaacgatgatgcagattctcttgtcggtgatggatcagacacgtcggatgggtcgctgggtagtctcagtggggagaagaagcgtaaagcaaagagcgaagggaaacgtcctacaaaggttaagccggaagagaaggaggactggaagccgaccgtttttgaccaactgcgcaaagaagcaaacgccagcagaaaccaggacgcacgagatcgcctactccagtacacttgggaccattggcaagactcggccaaagtaagtcgagtgaccgaactggttgatcagtttcagcagttcaacgagaagaccatcattttttcgcagtggacgtctcatctcgatctcattgagtgctctctcaagttcaaactcaacatcaagtaccgtcgctatacaggtaatatgtccagatcccaacgcgacaatgccatccaggcgtttgtcgaagatcctgacgtcaaggtattactggtctctctcaaagccggaaatgcgggcctcaatttgactgttgcttcgcgcgtcattgtttgtgatcccttttggaatccgttcattgaggaccaggccgtcgacagagcctatcgaatcggccaacaacgggaggttcacgtttacaagattttggttcaagaaaccattgaggatcgcatcatcgagttgcagaacctgaagcgaaacattgttgagacggcgcttgatgagaccgagggtaagcagctcgcaaggctatccatcgacgacctcaactaccttttc

SEQ ID NO: 27469 - DNA, 2245 bp, Neurospora crassa
caaaaggccaaggaggccctcaccagtgcccccagcagcaagaaggtggacgatctcaagaacgagttcaaggagaccgataagagtgcccgcctcaccaccgactatggtgtcaagcagaccacggccgacgactggctgaggatcgtcagcgacgacaagattggtccttcgttgctcgaggacccctttgcccgtgaaagggtacgtatcccatcctactaacacttttctgcccgtatcgcggctaacaacattctttcagatcatgcgcttcgaccacgagagaatcccagagcgagtagtccacgcccgtggcagcggtgcctttggcaagttcaaggtctacgagagcgcctccgacctcacaatggcccctgtccttaccgatacttcgcgcgagactcccgtctttgtgcgcttctctaccgttctcggcagtcgaggcagtgccgacacggtccgtgatgtccgtggtttcgccgtcaagttctacacagaggagggcaactgggatctggtcggcaacaatatccccgtcttcttcatccaggatgccatcaagttccccgatgtcatccacgctggcaagcccgagccccacaacgaggtgccccaggcccagagcgcccacaacaacttttgggatttccagttcaaccacaccgaggccactcacatgttcacctgggccatgagtgatcgcgccattccccgttccctccgcatgatgcagggtttcggtgtcaacacctacactctcatcaacgcccagggcaagcgtcactttgtcaagttccactggactcccgagctcggtgtccactccctcgtttgggatgaggccttgaagctggctggtcaggatcccgatttccaccgcaaggatctttgggaggctatcgagaacggtgcctaccccaagtggaagtttggtatccaggctattgccgaggaggacgagcacaagttcgactttgacatcctcgatgccaccaagatctggcccgaggacctcgttcccgtccgttacattggtgagatggagcttaaccgcaacccggacgagttcttcccccagaccgagcagatcgccttctgcaccagccacgtcgtcaacggtattggcttctcggacgaccctcttctccagggccgtaacttttcctactttgacacccagatctcccgtcttggtgtcaacttccaggagctgcccatcaaccgccctgtgtgccctgtcatgaactttaaccgtgatggtgccatgcgccacaccatctcccgcggcaccgtcaactactaccccaaccgtttcgacgcctgccctcccgcctccctcaaggaaggcggttacctcgagtacgcccagaaggtcgccggtatcaaggcccgcgcccgcagcgccaagtttaaggagcacttcagccaggcccagctcttctacaactcgatgtcgccaattgagaagcagcacatgatcaacgcttttggcttcgagctcgaccactgcgaggatcctgttgtctacggccgcatggttcagcgtctggccgacatcgatcttggtcttgctcagaccattgccgaaatggttggcggcgaggctcccactaccaccaaccaccctaaccacggcaggaagaccatcaacctcagccagaccgagttcccgcctgcgaccccaaccatcaagtcccgccgtgttgccatcatcatcgccgatggctacgataacgtcgcttatgacgctgcctatgccgctatttctgccaaccaggccatccctcttgttatcggcccccgccgttccaaggtcactgctgccaatggctcgaccgtccagccccaccaccacctcgagggcttccgttcgaccatggtggacgccatcttcatccccggcggcgccaaggctgctgagacgctctccaagaacggccgtgctctgcactggatccgtgaggcgtttggtcatctcaaggccattggtgctaccggcgaggcggttgacctcgttgccaaggcgattgctctgcctcaggtcacagtcagcagcgaggcggaggttcatgaaagctatggtgttgtgacgctcaagaaggttaagcctgagagcttcacagatgccgtcaagattgccaagggcgctgctgggttcttgggagagttcttctatgccattgcccagcacaggaattgggacagagagttggatggcttgcactccatgattgcgtactaa

SEQ ID NO: 27470 - DNA, 1461 bp, Neurospora crassa
aaatacccggccaagcgacatgctcaacgcgtggccgactacatccgcaacaagatgcccggcgcttccggcgtcctctacctcgaaggccgcgccaccaagctgctcgaggacaacgatgaggccgagcccttccgccagcgccgctacttctactacctgaccggttgcccgctcgccgactgccactacatgtacgacctggatgccgacaagtccacgctcttcatcccgcccatcgaccccgactcggtcatctggtccggcctgccggtttctgtcgatgaggccaagcagcgctgggacgttgacgacgtcaagtacaccagcgatgtcaacgccactctcgcccacgtcggcagcagcaagcccaagggctcttccgtcttcgccctcgcgaaccaggtctcggacaaggtcaccttcctcgaattcgacaacaagaacttctccatcctcaaggaagccatcgaagtcacgcgcgttgtcaaggacgagtacgagctggccatcatggccaaggccaacgagatcagctctgacggacacaagatggtcatgcaaaaggtcaagcacgtccagaatgagcgcgagttggaggctgttttcctggggcactgcatcgccaagggcgcccgcaaccaggcctaccacagtatcgtggccagcggtcgcgcggctgccacgctgcattacgtccccaacaacgccgacatggctggcaagctcaatcttctgctggatgcgggaggcgagtgggactgctatgcctcggacattacccgcactttccccattaatggcaagttcaccaaggagagcagggagatttacgatattgtgctcaagatgcaaaacgagtgcatcgctgcgctgaaggagggtgtgctctgggatgacgttcacctccttgcgcacaagattgccatcgacggccttctccagatcggcattctccagggcgacaaggatgagattctcgagagcaggacgagcgttgctttcttccctcacggtctgggtcactacctgggcatggacacccacgataccggcggcaaccccaactatgccgacaaggacaccatgttccgctacctccgcgtccgcggtcgtctcccagctggcagcgtgatcaccgtggagcccggtatctatttctgcaactttatcattgagccgttcttgaaggacccaaagcacagcaagtacatcaatgctgatgtgctggagaagtactgggatgttggtggtgtgaggtatgtcgactgtgatttgttcgcgtgtatggtatggaaagggcgaatgctaattttgtcgttgttatgcagaatcgaggacaacctggtcatcaccaaggacggcacgtacaacctcacgacagcacccaaggaccccgaggagatggagaagatcattcagcagagctgagacaaggctggacatggagaatacgtgcta

SEQ ID NO: 27471 - DNA, 882 bp, Neurospora crassa
attggggcctggccatggggcgacaagagcacctggcactacaaggaggaagagtttccagcgatcgaggctgcctggcgccagctctacgacgccggcatcaactttatcgacacggcccaggcgtacggcagcggcgagtccgagaggctcgtgggcaagctggtcaagggtctgcctcgggatagttatgtgatccagaccaaatggctcgggacggcgctggacgccaagaactatgtgcacgccagcgacgcgccgtacaagacgctcaagtccagcctggagcggttggggctcgagtacgtcgacatctatctcgtgcacggcccgacgcacccgcagagcgtcaagacggtggccgaaggactggccaagtgcgtcaacgaggggctggccaaggccgtgggcgtggccaactacggcaacgacaaggtgctcgagatgaaggcggcgctggccgagcacggcatcccgctggcgacgaaccaggtcgagtacagcatcttgcgcaggtaccccgagatccacggtgagatcaagatgtgtctcgacaacggcatggtcttccagtcgtactcgtctctggcccaaggcaggctgacgggcaagtacacggtcgagcacccgccgcccaagacgtacaggttctcgagctatccgatggaggaaatcaaggagacgctggctgtgttggagaagatcgccaaggccaggggcaaagccatggccagcgtggcgctgaactataacattagcaagggggcattgcctcttgttggtattcgcaacccggagcaggcgaggcaggcgattgatgcgctgggttggaggttgaccgagcaagagattattgagctggaccgggtgagtgtggagggg

SEQ ID NO: 27472 - DNA, 1008 bp, Neurospora crassa
tccgcaaccacccagtccccgccaaccatcaccggcaacaacctcctcctcaaaatcacccatgcggcactcaaccccgtcgacttgcacatcctccgcttatttccgcactggcttcccttccgtcgaaaccccacgcctggattcgacttttgcgggcgagttgtcggcgccggacccgatgtggacaccaacgagttcacagtgggcgacgtagtctgtggagctctgggagcaggggacgtcttttggggcaaaggttcgctggccgagtacctcctcgtctcctcctcgctggtagccaaaaagccaaagacatggggaggactcaacggggggaatgaggtgagtggggaagaagcagtggggttgtttggcatcgcgggacaaacggctgttctcatggcgcagaccgctggtgtctcgtcagatgcggactggaaggggaagcgatgcctggttaatggcgccagtggcggcgtggggagtatcctcacgcagattctcaaaggaaagggggcagaagtatgggggactacaggttctgcggaaggcgaggagttggtgacgcagtgcggaggaaaggtggttaattacaaggatcatcaccccgtcactgctcacttggccgagctgtttggggaggataagttggatttcatctttgattgcgcaggaagccaggatatgttttctcaatcgccggggtatttgaagaaggaggggaagtttatcagtattgctgggggaccatcgcagggtgttgttccctatgtcaagaataagttgaggcccgtgtggttgggtaggacgccgagggagtttgagttgttgttgttgatccccggaaagaaaactgtgagggaggtggggaggttggtggaggaggggtttattgaaaggggcttggtggatggtggggtttgggagatggaggagttggtgaaggcttatgagaggctgggcagtgggagggcgaagggaaaggttgttatcagggttggggag

SEQ ID NO: 27473 - DNA, 1557 bp, Neurospora crassa
atggccgggaagcaaaaccaagctgccccaaagaaggcggttgcgccgcgccagcagcactacgagtttggcggcccgtaagtcaaccaaaaacagaacccctgactccatctcgttcgtgtccagaccacgccccgctaacaagcttgacaacgatcaaacagcatcggcgcctttggcatcacctttggcctccccattctcgtccacgtcttcaaccttttctgcaacgacatctcgggctgccccgcgccctcgctcctccaccccaagtctctcgacctcgcccagctcaagcgcgaaatcggctggcctgacaatggcgtcttcggcctcttctcgtggtccgccacgctgtggactttgggctactacgctctctcgctcgttcaataccgctttctccccggccaccacgtcgagggaaccgagttgagcaccggcggccggctcaagtacaagctgaacgctttcaactcggccatgtgcaccttggccatcctggctgccggcaccatcgctcagggcgccgagttccccgtttggactttcatttccgacaactttgcccagatcatcagcgccaatatcctcttcgcttttgccctcgccatcttcgtctacgttcgcagctttgacgtgaagccgggcaacaaggacatgcgccagctagcagcaggcggtgtcaccggctccctcatctacgatttctacattggtcgcgagctcaatcctcgcatcactctgcccctcatcggccaagtagacatcaaggaattcatggaaatgcgccctggtcttctgggctggatcattctgaactgcgccttcatcgccaagcaataccgcctttacggttacgtcaccgattcaattctcttcatcactgccatccaggctttctatgtctttgacggaatctacatggagccggccgtcttgactacgatggatatcactaccgacggcttcgggttcatgctgagtttcggagatgtcgtttgggtgcccttcatgtactcgactcagactcgctacctttccgtccatcctcagcagctgggcgctttcggactgattgctgttggtgctgtcctggctgctggttatagcatcttccgcctgtccaactcgcagaagaacaactttcgcacgaaccccgaggatcctagtgttaagcaccttacctacctccagaccaagactggatcgcgactcattacctcgggatggtggggcatcgctcgccacatcaattatctcggtgactggcttcagagctggccctattctctcccgaccggcattgctggctaccagatcttgagcgccggcagcaacgcccctggtgcaattaccatgcttgacgggcgcgaggttgtccagggcgaggcgagaggctggggtatcgttttcacttacttttacatcttgtactttgctattctcttgatccaccgcgacctcagagatgacgagaagtgctccaagaagtatggtgacgattgggaaaagtacaagaagcttgtcaagtggagaattgtccctggcatctac

SEQ ID NO: 27474 - DNA, 1336 bp, Neurospora crassa
atattaacccgagtgactcgacagggctacaccgtcgtctgcttcctcgccaatgtcggccaggaggagaactgggatgaggtccgcgccaaggccaagaagctcggtgctgaggagatggtgatcctcgacctccagcaggagttcgttgaccagatcgtcttccgtgccatccagtgcaatgccatctatgaggaccgctacctcctcggcacctccctcgcccgccccatcattgcccgtgcccaggtccgcgttgccgagcaatacaactgcgagttcgtctcccacggctgcactggcaagggcaacgaccaggtccgcttcgagcttgccttcaagtatgctgattccctcctcttgagcctcatccgacgcacaaacactgacgtgacaccagggcctgcaaccccgagatcaaggtcattgctccctggagacttcccgagttctgtgctcgcttccagggtcgtcaggatctcctgaagtacgccgccgacaagaacatccccgtctcctcgacccccaaggccccttggtccatggatgacaaccttgtccactgcagctacgaggctggcattcttgaggaccccaaccacactccccccaaggagctctggacccgcactgttgacccccaggacgcccccaacactccccaggagttcaccatcgtctttgagaagggtatccccgtcaaggtcattgtcgatggcaaggagaccactggctctgttgagctcttcaagctcctcaacaagattggtcacgaccacggtgttggccgtgtcgatatcgttgagaaccgcttcatcggtctcaagtcccgtggctgctacgatactcccggcctcaccattgctcgccttgcccatcttgatcttggttcgtgttcctcgtgtctgacctggtctgggtgaattgactgctaatatgggttctacagagggtcttgttatggactctagggtccgtgagctccgtgatcagttcgtcaccatctcctggtctcgtcagctgtacaacggcatgtacttcagccctgagcgcgagttgtaagttgtttcctaccccaaactgaaaacagatgagcaatcaccaaccgtcattcccctacagcgtcgagaactccatcatcttctcccagcagaatgttactggtgaggtccgcatgatggcctacaagggtaacgcctacgtcctcggccgcaagtccgatgccagcaacctctactccgaggccgatgcctccatggactccctcgagggcttctcccccatggacaccaccggtttcattgagattaacgccatccgtctcaagaagtacggt

SEQ ID NO: 27475 - DNA, 2142 bp, Neurospora crassa
cccccaggcggtacccatcgcatgaacctcgggggtgaggacgagaaaccagcattggaacaatacggtatcgacttaacagcaaaagcacgagagggaaagctcgatccggtcatcggcagagcggcggaaatccagagaaccatccaaatcctgtcacggagaacgaagaacaacccggtgctcattggatgcgccggtgtcggcaagacagccattcttgaaggccttgcgctggagattgtgaagggcgcggtgcctgaaagtatcaagaacaggagagtcatcagtctcgatctcggatctcttattgcaggagccaagtttaggggtgattttgaggagcggctgaagaaggtcctgggcgaagtgcaagaagccaacggagaggttatcctgttcatcgatgagctccatactctccttggcctcggaaaggccgaaggctccattgatgcgtcgaacctcttgaagccagctctttctagaggtgagcttcagtgctgtggtgcaaccaccatgactgaataccgtcagatcgagaaggatgttgctctcgctcgccggttccagcccatcatcgtcagcgagccgacagtggaggataccattagtattctgcgcggtatcaaggagaagtatgaagttcaccatggcgtccgtatcactgacggagcactggttgctgccgctacctattccaaccgttacatcaccgaccgtttccttcccgataaggccatcgacttgatggacgaagccgccagctcgcttcgcctacagcaagaaagcaagcccgacgatatccagcgcttggaccagaagatcatgaccattcagattgagctggaaagtttacgaaaggagaaggacgttgccagcgtcgagcgccgcgagaagctcgaggctgacctgaagaagtatcaagatgaagtcgccgtactgacggaaaggtggctgaaggaaaaggccgaaatcgacagcatcaagcaaacccaggcagagctcgacagagcccgcattgagttggagcaagcacagcgaaccggaaactttgccagggcctcggaattgagatttggcgtcattccaaacctggaaaagaagctacccaaggacggcgaaagacctacccgtgatctctctctcatccatgactcggtcaccgctgacgacattgccaacgtcgtctccaggatcactggcattcccatctccaagttgtccagcggccacacggagagactgattcacatggaagacatcctccgcgagtctgtccgcggtcaagacgaggccctgaaggcggttgccgacgcagtgcgaatgcaaagagccggcttgagcggcgagaaccgcccactggcctcctttttcttcctcggacccaccggcgtcggcaagacagagctgtgcaagaagctcgcaggcttcctcttctcgaccgagaccgccgttgttcgctttgacatgagcgagttccaagaaaagcacaccatctcgcgcctgatcggtgctccctccggctacgtcggctacgaagacgccggccagctgaccgaggccgtccgccgcaagccctacgccgtcatccttctcgacgagttcgaaaaggcgcacagagacatctcggccctgctccttcaggtcctcgatgagggctacctgaccgacgcccagggccacaaggttgacttcaagaacaccatcatcgtgctcacctccaacctcggtgccgacatcctggttggagccaaccccatggtcccctacaaggagacggaagacggtgacatccacccagacgtcaagcaggccgtcatggacgtcgtcgcatcccagtacccgcccgagttccttaaccgcatcgactcctttatcatcttcaagcgtctcgctatggaggcgctcagggacattgttgacatccgcctgaaggagctccaggagcgactcaacgatcgccgcatcaccctcgacgttcccgaagaggtccgccagtggctggctgagaggggatatgatcccaagtttggcgcgaggccgctcaacaggctcatcaccaccgagattggaaatgggcttgcggataagatcattcgtggacagatcaagtcgggcgataaggcggtggtggaaatc

SEQ ID NO: 27476 - DNA, 1218 bp, Neurospora crassa
gataatgtttttacgacccacgacgacaattcaaaagtctacgaccacagtgccaagcgcttggtcagacgagttatggagggatatcacggcacagtctttgcatacggtatgacgggtacaggaaagacattttcgatgcagggcaccgcctcttcgccaggtgtgataccgttggctataaccgacatcttctcatacattcgcgaaacgccgtcgagagagttcctgctccgggtcagctacctggagatctacaacgagaggatccacgatttactgagtatggcaacggggggcaacggtcctggcgccccggcacaagaggagatcaagctgcgtgaagacagcaagcggggtgtttatgcgacgcctctcaaggaagaaatcgtccagagtccgacgcagctcctgcgtgtgattgcacgaggtgatcaagctcgccgggtcgcaagtacgcagttcaacgccaggagttcacgcagtcacgcagtcgttcagattgtggtggagagtagggagcgtgtgcccgcgggagatagctcgggggggagcaagcgacagggtctgctgccaggtggcgtgcgagtttcgaccttgagcttgatcgatttggcggggtcagaaaaggcggctgacacaaaggagagacgtcaagagggttcacacatcaacaagagtttgttgacccttggaacggtcatcgccaagctttccgagaacaaggacaaggacgacaaacatttaccttaccgcgacagcaaactgacacgattattgcaaggtgcgctgtcaggaaactcgcttgtgagcattctttgcactattcagtgcggcgctggcggaagtaccgcaggaagcactcacatcaacgagacacttaacacactgaaatttgcgtctcgagcgaaaaatagcattgtcagccgcgccaaacgtgctgacgaagctctcggagccggaggtgatggcaatgctagggtcttgctggaacgctatcggatggagatcgctgaactgcgaaaggaattagaaaagcaggcaaaggccaacagtcaaaaggaagcagacgaggagatggagcgtgatgcgaaggaagaactggcacgagagctggaaatggagcaacgccacgaagaacaaatgctggaaatgcagctggctcgaaccgccttgaaggagaggatcgaccatttgaaccggctcattctcagctca

SEQ ID NO: 27477 - DNA, 1128 bp, Neurospora crassa
tatcaagactcattggctaatgcctgcggaatgaacgtcaacactcgaattttgcagtttaaaccagctcctcccgagtcctccaaacccatcgatctccgccagcaatacaatcgccctttgaaggccgccaactcgtccgcacaattccgacgccgcgtcgctacagctcctgagcgtgtccttgatgctcctggtttgattgacgactactaccttaacctcttggactggagctcgggaaaccaggtcgccattggcctggaacggaacgtctatgtctggtcggccgatgaggggtctgtcaactgcctgctggaaacttctcctgatacgtacgtgagcagcgtcaagtggtcaggtgatggagcatacgtgggcgtgggactcggcaccggtgaggtccagatctgggatgttgccgaaggcatcaagattcgcagcatgtttggtcatgacagtcgagttggtgttatgggctggagcaagcatcttctatcgacaggtgcacgaagcggtttggtgttcaaccatgatgtccgtatcgccgagcacaaggtggctgaactggtttcgcatacatcggaggtttgcggcctcgagtggcggtctgatggcgcccagcttgctaccggcggaaacgacaatcttgtatcgatttgggatgcccggtcccttgctgttccaaagttcaccaagaccaaccataaagctgccgtcaaggctctcgcctggtgcccctggaacatcaatctgttggccactggtggaggtgcctacgatcgtcacatccatttctggaacaccacttccggtgcacgcgtcaacagcatcgacacgggctcccaggttaccagtctccgatggagccctcgctatcgcgaaattgtgagctccagcggttaccccgataattcgctcagcatctggagttaccctactctggtccgcaatgttgagattcctgctcatgagagccgagtcctccacagctgtcttagtcccgatggacaaatgctcgccacagctggtaagtgaagtctgtgtgaaaatagctgatttgaagctcatactgaccgggattactagccgccgacgaaagtttgaagttctggaagatctttgaga

SEQ ID NO: 27478 - DNA, 981 bp, Neurospora crassa
ctcgaccccctcggcttcgaagacgaaatgtgccccgtctgcaaatcgcgcaagtacctcaaccccgacatcgtcttcgtcttcaaccccgaatgctaccactccatgtgtctcaactgtgccaaccgactcttcaacgacggacccaatcaatgtccgcacgccggctgcaacaaaacgctccgtcgcaagggcttccgctcggcttttttcggcgacttggccgtcgagcgcgaggtcgacatccgccgtcgcgtggcggcggtgttcaaccaagtcgaggacgactttgagacgctccaggattataataattacttgcagatggtggaagatttgacgtttgaacttgtcaatgggacggatgagaggagacggcaggcggaggcgcaattgcaggcatgggaggcggagcatagggcggatattgaacggaataagaaggcggggagggaggcggatgagatttcaagagtgaggctggcagccgaaagggatgctgtcaggcagaggaggattgaggctatcaaggaggcggaggcggagaaaagagagagggtgaggagtcgcgaaatggagctggataacctggccaagggaaccactgctatgacagcggagccggcgacgaaggtacagctaaagaggcgtgggcaggtgaatcgggttgctgaaacagcttccaaccctgccatcgcaacaacgggaatgggcacgggcgcgtcggaggttgagcgtttgtccatccgcggcttgaaggagaagccgaaggcgccggcgccacagggcccgtacgacccctttggaggcatggacttcgcgcctagtcggtacaagctacatggaggcttgagtcacccgcttatggagaagtaccggttggacagacagcacgttgctggtgggtacagctttgacgactttgcggcgcgcgccttgtatgaagcgtttgctgggttgggtgtgtttgttgaggatgag

SEQ ID NO: 27479 - DNA, 3229 bp, Neurospora crassa
cttgcggctcttgtccctcaatggacatctgctcaacatgtatctgtggttgcaacgtcatctggacctggtgtgttgagcgggacggtggcaggggattcccctatgttcactttcccagcttcggctgacatcggaccaaatgtcttaccgaacattttcgacccgcaagcagttaatgttcaaagcgtctgtccaggatatacagctgctaatgcacaaaagacggagaagggactcacggctgacttgacccttgctggccctccctgcaatgtctatggcaacgacatcgagcacctgaagcttaccattgagtttcaggcggacaatcggatcaatgtccagattcaacctcgctatactggccccggtaatgaaacctggttcatacttcctgaggtgctcgtgccacgaccagaggccgagcctgatgcgaatgccgctagaagcaagctggaaatctcgtggtcgaatgagcccaccttctccttcacagtgaagcgtaaggagactggagatgtcttgttcacgaccgagggccgtgtccttgtttatgaggatcagttcatcgagttcggctcctctttacccgagaattacaacctgtatggtctcggcgaagttatgcatggctttagactggggaacaatctgacacgtaagtctctttacttaacatgaatgtgcatcgtggattgcatctgactaacaccatctccaggcacgctgttcgctgcggatgtgggcgacaacctcgatgccaacatctacggcaaccacccgatctatctcgacaccagatacttcaccaaggacgagtctggaaaattaagctacgtttccgacccagcagacaagaatgccaaatatgtttcgtatacaaacggtgtcttccttcgaaatgctcatgcacaggaagtgctccttcgacccgaaggtatcacctggaggactctcggcggaagcatcgatttgtacttctttgagggaccttttgctcaggatatcatcaagtcttatcagctcagtaccgttggtcttcctgcaatgcagcagtattggactcttggctttcaccaatgtcgctggggatactcgaactggactgttgtgaaggatgtcgttgacaatttccgcaagtttggcatcccgttggagacaatctggagtgagtgaacccaagtccttcagcatcagaatcttccccatccatgcttttactgacttttttaagccgacattgattacatgaagggctatcgtgactttgaaaacgaccctgatcagttcagctacgaggaaggcgccaggttcctcgaggagcttcacaagaatcaccagcactacgtgccgattgtcgactcggccatctatgttccaaatcctgacaagccagaagatgattacgaaccttaccaccgtggactcgaagctgatgctttcatcatgaacccagacggttcgctctatatcggtgcagtgtggcctggctacaccgtgtttccggactggattggtgccgccctcaacggtacaggtaccgtcggctggtggacggacgagtttgttaggtactataagaaggtcgcttttgatggcatctggattgacatgagcgaggttgcttctttctgcatcggaagctgtggcacgggcaacctgacgctcaatccggttcatccaccatggggtcttcccggtgagccaggcgctcttgtgctcgattaccccgaaggttttgaaaaaaccaacgcgagtgaggcatcctctgcaacgtcggtttacaaaacgcagaacccagaccccacgactacagccagcaccactagcactacttcttacctcaggacgacaccgactcctggagtgcgcaatatcaactatccaccatatgtcatcaacaacttccacggcgacattggtactcacgccctgagccccaatggtacccaccatggcggcacagtcgactatgacttccacaacttgttcggccatcagatcctccacgcaacctaccaggcacttctcaaagtctttgagggcaagcgtccttttatcatcggccgcagcacctttgcgggttctggcaaatgggccggtcactggggtggtgataactattccctatgggcgtttctgtactttagcattccccaggccctatccttctccatcttcggtttccccatgttcggcgtagatacctgcggcttcaatggcaacacggaccacgagctgtgctcacgatggatgcagctcagcgcctttttcccattctaccgcaaccacaacgtccgtggcgccatcagccaggagccctacgtgtggagctctgtgatcgatgcgtccaagaaggcgatgaggattcgatacctcctgctcccgtacatgtacacacttatggcccaggccagcctgtctggagatacggtcatgcgcgcactctcgtgggagttcccgcaagagccgtggttggcggatgcggatcgccagttcatgttgggcagcgcggtgatggtgacaccatgtcttgttcaaggggccaatacagtggacggcgtgtttcctggagttggcgatgggaccatctggtatgattggtatacatacaaggccgccagtgagggtgttcagcctggggagaatgtaacgatcgatgcacctctgggacacattccggtttttctacggggtggccatgtcattccagtgcaagagccgggcatgactacgacggagagcagacaaaatgagtggagtgtcatcgttgctcttgatggtgcgggtaaggcgaatggtacgttgtatctggatgatggtgagagtttggagccgggtgagaatgtgaagtgggttgatgtgagtcttcttccgttctttctatttttcttctcttttccgtgagtgttcagtcggtcgattgccactcgctcctctcgcgacaaggtcgaaagtgctaaccgggtttggctgtttctagttcacggttgagaagaactcatttcgagtgacacctcagggcaagtaccttgaccgaaactcactggccaacgtcacgatcctgggagtggccgaggcacctctgggagtggctattaatagtcatctgctcggatcagcttcttggtcctacgactccgaggggaagttcctttcggtaaccgagctgcaggacaacttcaaggaaggggcgtgggcatccaactggacgctgtcgtggaac

SEQ ID NO: 27480 - DNA, 2037 bp, Neurospora crassa
atggcgatcttcgccatgggctggcagaagcccgacaatgtcgctggctcatctgccccagcgattatggtcggcctgtttgtcgccacaggcggcttactccttggctatgacactgggtaagcctctcttctgaatgcactcgggcgcggcgagcacgtcgatgcgacggatagcatatgccatggggcatgcaatggcatctgcgatggatactggcttgatgctgcgttgtcgcagaccagacgaccaggccctcgagataacaccaaactaaagtgctaactatgcacctctggcttgtagaaccatcaacggcattcttgccatgaaatcgttcaaagaccacttttcaaccggctacatcgacggcaacggacagcctggcatatacccaaaggagagtgcgttaatcgttgccatgctcagcgccggaaccgccatcggagccttactcgctgcgcctctcggagatcactatggacgtcgccggtcccttattggcgccatcggaattttcgtaataggcgccatcctgcaggtttgtgcatataacatcgatctgttggtggcaggaaggtgtgtacttttacccctaggctttgcttggcgcattcctgaactaacgtggacaatatcaggacggttgccggtgttggtatcggcattgtctcagtgcttgtccccttatatcagtctgagatggcacccaagtggattcgaggaacactggtgtgcacctaccaactctccatcaccatggggcttcttgccgctgccgtggtcaacatcctcacatacaaattgaagacagctgctgcctaccgggtaccaataggacttcagctaacctgggcctgcgtcttggccctgggcttgaccgtgttacccgaaactcctcgttacctcatcaaacgtggagacaagaacgccgctgcgctttctctcagtcggctgcgtcgactggacattactcaccctgccttggtcgaggagcttgccgaaatcgaagcaaaccatcaatacgagatggcactgggtcccgactcttacaaggacattctctttggcgaacctcaccttggccgtcgcacgtttacaggttgctgtctgcagatgctacaacagcttaccggcgtgaactttatcatgtactatggaaccaccttttttaataacgctggcgttggaaaccccttcaagatctctctcatcatgcaagtcatcaacacagcatcgaccatacccggattgttcgtagtcgaatcatggggccggcgtcggctcttgatggtgggcgccataggcatggccatctgtcagctgctgatcgctgccttcgcgacggccagcggctccaacaacctatcagcacagaacaaggtcctcattacctttgttgcgatatacatcttcttctttgctgcatcatggggcccagttgtatgggtcgtcacctccgagatttatccgctcaaggttagagccaaatccatgtcgataactacggcttcaaattggttcctcaattttggcatcgcctacggcaccccgtatatgcaaacgaacagtgcagcgagcgacgaaagctcgatagatctcggctctaaagtgtttttcgtatggggcgcgttttgcatagtagcggtcggctttgtatggtgtatggtttacgagactagcaagatcagtctcgaacaaattgatgagatgtacgagagagttgaccatgcgtggcacagcaggcgcttcgaacctagttggagtttccaggagatgcgagaccttggcttctccgatggcggcataccgccaacgcagcagctgcagcagcagccgcagcagccgcagcagcaacaacaacaacaccaccaacaacaacaacaccaactacaagttgacctacagcaatcgcagtcacgcactagcaactccagcacgtctcaaaccgacacgggcgggagcaataacaccggggcgtcacaagacgataaacttgtggcatccttgggcaacatcgatctcagctattgactt

SEQ ID NO: 27481 - DNA, 1014 bp, Neurospora crassa
gtctttatcctcagtgtcggtcaggctcctgcccgccagtgcgccctgaaggccggtctctcgaacaaggtggttgccaccaccgtcaacaaggtgtgcgcttccggcatgaaggccatcatccttggcgcccagaccatcatgactggcaatgcagacatcgttgtcgctggcggcaccgagagcatgtccaacgtcccccactatatgcagaacctccgcactggtgtcaagtacggcgacggcggccttgtcgacggtatccagtccgacggtctccgtgatgcatatggcaaggagctcatgggtgttcaggccgagctctgcgccaaggaccatgaactgagccgtgaggcccaggacgagtatgccatcaactcgtaccagaaggcccaggccgccaccgaggctggtctgttcaaggagattgcacctatcgaggtcccgggtggccgcggcaagcctgccatcaagattgaccgcgatgaggaggtcaagaacctcaacatcgagaagctcaagtccgcccgtaccgtcttccaggccaaggacggtaccgtcactgctcccaacgcctcccccatcaacgatggcgccgctgccgttgttcttgtctccgaggctaagctcaaggagcttggtatcaagcccatcgccaagatccttggctggggcgatgctgctcacgagcctgagcgcttcacaactgccccggctcttgccattcccaaggccatcaagcatgccggtatcaaggaggaggacgttgacttctacgagatcaatgaggctttctctgttgttgcccttgccaacatgaaaatccttggcctcgagcccgagaaggtcaacgtctatggtggctccgttgccatcggccaccctcttggctgctccggtgctcgtgttgtcactaccctcacctccgtcttggctgagaagaaggccaggattggctgcgctggtatctgcaacggtggcggtggtgcttctgccatcgttatcgaaaacttg

SEQ ID NO: 27482 - DNA, 753 bp, Neurospora crassa
acgaaagcaggtgtgaccgtgggaaagctgcgagccaatcccaacaaggacattgcccgtattgccagcgagatcgtcaacaagtggaggaagctcgtcgaagctgcgaaggaggcgaagaagaagagccaggccgccgcggcctccggtgccagctccccagcacccaatgcatccccggcgcccgcatcatccgcgtacaacaagccctacactggtgacgtcgagaagcgccattttaagacagacaaggtcgacatcaaccgaacctcgagccagacgcgcaacaacaccatcggtgtgctctacaacggcctcgcttaccgaagaactgagtcgattgaggaagtcgtcaagcgtgctgtcgaagtcgagaatgccctcttcaaagcttgcaagggcgaaaaccaggagtaccggagtaagggtcgcaccctctttaccagcctgaagcgcaaggacaacgctgcgttgggacgacgagtgatgtcgggcgagctgccggtcgaacgccttgtcgtcttgtcggacaaggagttggcctcggaggaacagcgcgctagggatgaagagctggagaaggagaacatgaagaaggcccaggtacccatggcggagaagtcgatcagtgatgctctgaagtgcggaaagtgcggacagaggaaggtgtcgtacagccaggcgcaaacacggtcggctgatgagcctatgacgaccttctgcgagtgcacagtttgcggaaaccgctggaag

SEQ ID NO: 27483 - DNA, 2874 bp, Neurospora crassa
atcaacaacagcttcggcccgggtggtaacgatggtctgactgaaatgctggggaacctccagtcgggaggcgagatcgatcaacgaggcaaggcagacgatgccatcgactttgaggacatcgacttgagcgacgaggacgagctacccaacgacgaaccgagcacttccggcaccagtggcgagctgccaagcctcatcgacgacgccggcactaatgatgacgacgacctctttggtggcgacccctcatcgcccatggacacagctcacgatggcctgagatcctctcccccgccgctcgacgtccatgacgatgttgatgccaaaaaacgtccggatgctgccgccggggagtcccttgaagacctccggaacctcaacttcgacaatgacgaagagccgcatgcgacaaatcaagatcccgacattcctccgccagcggaaaacttcatcgacgccgtcaagcaactattccccggttttgaggaaaacgccatcctgcattggaacgaactattgaagcccaagaatgccacatggatctcaaaaaagccccccaaagctcccaagcccttgataccatcaaaactcagtctggagttggatgccgatcaggaaaagcagttccggattccgggccctgccactggctccgtttggcagaggattaaggaagcggaagcgagaggtctgttctgtctcgaagagccagagcctttggaacaaaccgatctggaagtattcagcttggacgacgaaacggattcggagaggataggtggatataccctccaggacatagctacgatatgtcaggactgggaacagatgattttcttgggcgacagtcttgcggctgccatcgagccgggaccgcagccgaaacctgacaacatgctcattaaggatgagcctgatgaagaggcggactgggatgccatgttcctcgatgagcctgctcaaaagcggagaaagatcgaaattcctaaaggtcttcctcctattgctcacttcacggctccaaatttggacgaattcgagcaggtcacttcgaaattgggcaagcgtgtcatccttgacatgaacgacccttatttgctgatagacgacgtcgaatctgagcggtcatctaagcggcgaaagacccaacataaaacggtccgcttggcgaatgggaaagctgggcgggaccttatacagcggttcaatttctcctctgacgctgcttacgacgcgttgaaggagaacagccagaatagggttcgggccacgttggctactatccctgtcgagcacagtttgcctgcgcagagactgtcttggccttactaccgcgtcaagctcgcggccagtgaccctcatagttatcaccggcctcagctccaccctaagaaggatctgcagtatctcatcaggttcgacaagcctgccattatcaagcgcaagactctcaagggtaaacgcgtcagcgaggtatttaagagtactcatgacctctccctcaacgacaactcgaccgctatccttttcgagtactgcgaggaaattcccaccgttctctccaactttggcatgggacagaaaatcattaattacttccgtcgagctaaaggcgctgatagcagacctgagaagcgtgagcttggcgagacttgtatattgatgccagaagatcgctcacccttcgccatcttcggtcacgtccaccctggcgaggtcgtgcctactcttcacaaccacatgttccgcgcccctattttcaagcataacccgaggaatacagacttcctgattggtcgtagcagtaccggccaaaaaggctcaacttggtacatcagaaatatcgatcatctttacgttgtcggccaaaccctgccctccatggaagtcccagggccccattccagacgtgttacaaacattgccaagaatcgtctcaagatggtctcgtatcgcctacttcgcaagagcgagcatgttaccctccatgatattactaagcatgtagctgagtccaacgagtctcagaatcgtcaaaagttgaaggagttcctgcgctttagaaaggaaacaaaagattgggcgctgcccgaaggcgaagagctaatggccgaaccggccattcgatctcttgttaggccggaagaggtctgcctattggacgccatgcaagtgggcttgcacgagatcgagaagggtggttatgatgctaccgattccctcaaggacgatgacattggggttgatgtgaacgatgagctctctccagatgctcttgccaacaagatggcgccttggaagactaccaaggcatttcttgacgccagtcatggcaaggctatgcttgcagttcatggcgccggcgacccgacgggcaagggactgggcatcagtttcctgaggacgtccatgaaaggcggctatcttgagcagctccaaggaccaatggccacatcagcagatgccatagagaggcagcgcaaagcgaacggtgggcacatgtacaacgtcaagaaccaggacacactctacaccgaggctcttaccgatatctggaaccgccagcgggagagtctcttggattcccaagagcacgatgatgaagatgtgcttgggcaagaggatgaagacgagcgtttcaacgtacagggcagccaattcgcgcaaacccctgtggtccaggacggttttagtcagattagccagagcgccaccagtgctattaaccggaagaagctcgtgatcacaagagaggtgagggatgaaaatggccaaacacggactgtgacagaggtcgtaagggaccctgctgtcattgctcagtacgtcaagaggcgtcgccaagagcaaaagtccgagattgagtaggtt

SEQ ID NO: 27484 - DNA, 1347 bp, Neurospora crassa
gatgaggtatccgcgcttgttctcgatccgggctactgcaacactcgcgccggctatgctggcgaggaaatgcccaagcaagttctcccttctttttacggccacatcaatgggcgtgacgtattcggcgacgagtatatcgtgccaaaaccgggcttcgaagtgcgcaactacatgaaccgcgacagcgttgtcgaagattgggatgctgccaccaggatgtgggaacatgttctcgtcaagcgtttgcagcccgagcgatcaacacctcccagcaaaaagggtatcaacattagtgacgatggcgatgtgcccatggaagacgatggaaacaacaacgaggatgctacggacgcgctggagaagccactggccgagaaccctcttcttatgaccgaagcgccgtggaactcgcccaaggcgcgcgagaaggccatcgaaatcagcatggagacttggggcgtgcccgcattctggcttagcaagacacctgtgctcgcagcatttgcggccggaaaggccacggctctggtaatagacgtgggcggtgccaacacgagtgtcacggccatccacgacggcatggtcctcaagcgatcgattcaaaggtctccggtgggcggtgtttggctgagcagccagatctgcaagatgtgggacggtagtgagcccaaggtcgacgttgtgccgcggttcatggtcgagagtaagaagcccgtggaggccggtgcgcctgccgaagccaacctgcgaaagtttaacttcgacatccacccgtccttccgcgcttacgaggaagagcgtgttctcaccgagttcaaggagtctgttgtcgaggtgtggcgtggtccccagcggttcacgacccccggaaacgaagatgctgtccgtacacaacccggccgggtcttcgagatgcccgacggcagcaatcagatgtggcgtgagcagcgcttcaaggtgtcggagggcatgtgggacgagacggctgcctataacagcactgacgaggaaggacgtgttactaaggctcagacgatcccggctctcatcaaggcggccctcgagggtgttgatgttgatctccgccccaacatcctcggcaacgttgttgtcacgggtagtacaagcttgttgaacggtttcaacgaccgtctcaaccacgagctcgcgcaaatgtaccccggtgtgaagatcaagatccatgcggcgggtttgacgaccgagagacgcttcggtgcttggatcggaggaagcattctcgccagtctcggaaccttccaccaaatgtggatttcgcgaaaggaatatgatgagaacggcgcgggcattgtcgagaagcgctgc

SEQ ID NO: 27485 - DNA, 1857 bp, Neurospora crassa
atggcttcccggagactagctctcaacctggcgcagggcgtgaaggcccgcgctgggggtgttatcaaccctttccgcagaggtcttgctactcctcacagcggcaccggcatcaagacccagaccaccaccctcaagaatggcttgaccgtgaggacgcccgccctcccctcccccggcttccgagcccgcccccgagcccgcctccggcccgactgtctccctccccgactgctgctccggaccccaagccacctccagacttgtcctaacgtcaattgctatcacaggttgcttcccagtactctccctacgcccagacctccacggttggcatgtggatcgatgccggttccagggccgagaccgacgagaccaatggcaccgcccacttcctcgagcaccttgccttcaaggtacgcccccgaattcacgagtcacgagtcctctccccgggctgtggttagctttgatatggcgcgttgggttgttggatcggtagattgtatgagagggcatctggttaattcgacgacgacacgcagggaacgacgaagcgcactcagcaacagttggagctcgagattgagaacatgggcgctcacctcaacgcctacacctcggttcgtctgatcttgtcgtccggcgcatccgccgcccgctaacccgcgagcacagcgcgagaacactgtctactttgccaaggctctcaacgaggacgtccccaagtgcgtcgacattctccaggacattcttcagaactccaagcttgaggagtccgccatcgagcgcgagcgcgacgttattcttcgcgagtcggaggaggttgagaagcagctcgaggaggtcgtcttcgaccacctccacgctaccgcctaccagcaccagcccctcggccgcaccatcctcggtccccgtgagaacatccgtgacatcacccgtaccgagctcgtgaactacatcaagaacaactacaccgccgaccgcatggttctcgttggcgccggtggcgtcccccacgagcagctcgtcgagatggccgacaagtacttctccaagctccctgctaccgcccctgttagcagcgcttccatcctctccaagaagaagcccgacttcatcggctctgatatccgtatccgcgacgataccatccccaccgccaacattgctattgccgttgagggtgtcagctggtccgacgacgactacttcactggcctcgttactcaggccatcgttggcaactacgacaaggctcttggcaatgctccccaccagggcagcaagctcagcggctttgttcacaagcacgacctcgctaccagcttcatgagcttctctaccagctatagcgacactgggtaagaacgcccctgtttggtttcgcaccttttttttattcatctcttatcatcatttttctctttctgacgtacaactactgacatggcaaactatagtctctggggtatctaccttgtcactgacaagctcgaccgcgttgacgaccttgtccacttctccctccgcgagtggacccgtctctgctccaacgtcagcgaggctgaggttgagcgcgcgaaggctcagctcaaggcctccatcctcctctcccttgacggcaccaccgccgttgctgaggatattggtcgccagatcgtcaccaccggccgccgcatgagccccgccgagattgagcgcatcattgatgccgtctccgccaaggacgttatggatttcgccaacaagaagatttgggatcaggacattgctatcagcgcggtcggcagcatcgagggcctgttcgactatgcccgtatcaggggtgatatgagcaggaacgctttttaagcg

SEQ ID NO: 27486 - DNA, 2028 bp, Neurospora crassa
aaggagattctgtctggaattcaaggcatggctcatccgggcgaggtcactgctatcatgggagcttcaggggcaggaaagaccacattcttggatatccttgcccggaagaataaacgcggccaggtgtcaggagatttctacattaatggtgaaaaggttagcgatccggagtacaagaacgccgtcggctttgttgatcaggaggacaccatgctgccaaccttgaccgtacacgaaaccattctcaacagcgcccttcttcgcctaccgaaagacatgacacgcgccgcaaaggaacaaagagtgattgaggtcgagaagcagttaggcatctaccatatccgggactcccttattggttcggaagaaggcaaaggacgtggcatttctggtggagaaaagcgcagagttggcatcgcatgcgagctagtcaccagtccttcgattctgttcctcgatgagcccaccagtggtcttgacgcttacaatgcttacaatgttgtcgaatgcctcgttactctggcgaagacttacaagagaaccgtcattttcaccatccatcaaccaagatccaatattgtcgcgctgttcgaccggcttattttgttggcacaaggcaagaccgtgtattctggaccgctgcaccaatgccaagagtatttcgaccaaattggctacacttgcccgcctggattcaacatcgccgattatctggttgatttgaccatgcacgccggatcaacttcttcttacgatgatggtacgctgtcagtggatggggttagtgtgggaccaagcagtactagagctgtcaagtcaatcgccagcgtgtctggagttagcatcggtgatgacagcttagttgaatcatcctcttcccgccctaggaacaagcgtcgtgactcagtcagacgtagacaggagcgggagctctacaccaggcgcaagcaagccgtcgatactgctgcctcctcggatgctggagacgagattgggggctacaaattgcaaaagcagccacccgttactcctttgcggagcacaaacgatgacctccacgatctccctcctcttgctgctactggcaccgatcttgacgtcctgattgagtcatatatccattccgacattgctgccagtactcatgaagaaattcaccaggcaatcgcagctgcggtaaacagcaatggtcaaaattccaacggttatgttgcagatggtaacatctacacgggtacaatgggcaaaggctatgctcgtgtgggcttgttccgacagttcgttattctgtctcagcggacttggaagaacctgtaccgaaacccgatgttgatgttgactcattacgcgattgcaattctcttggctgtctttgccggctacttgttttacggcttgaccttggacattgcaggcttccagaacaggcttggcctcttcttcttcgtcctcgccttgttcggtttcagcactctcacaagcttgggtgtgttctctcaagagagactgctgtttgtacgcgagagagcgaatggctattattcacctatcacctatttcgccgccaaagtcctgttcgacattgttcccctgaggatcattccacccatcctgcttggcgcaatcatctacccgatgactggtctcgtcgctgactaccagcggtttttcgtctttatcctggtcttggtcctcttcaacctggccgccgccgctatctgcctgttcatcggcatcctttgtaaggatggaggtgtagccaacctgattggcagcttggttatgctcttcagtcttctcttcgcgggtctattgctcaaccacaacgccattccggctgcggcactctggcttcagtggctctccatcttccattacggcttcgaggcactgattgtcaacgaggttactcagctcactcttgttgaccacaagtacggtctcgatatcacggttcccggcgccaccatcttgaccactttcggtttcgacaactcagcaatgtggagggatatcatgaaccta

SEQ ID NO: 27487 - DNA, 1679 bp, Neurospora crassa
gggactctcgataaccttcctaaggatctccgcaatgagatcgagcacctcgagcgcctctttaccgtcgatggcgccaagctcaaggaagttaccaaccacttcgtccatgagctcgagaaaggtgattactccacgaactgcaaagatactacatgtccatagctagaagagatgctgactgcttcttttgtgcacaggccttagcgtccagggagggagcattgtgcgttttagcatccaccgagcaacacagatacaaaaacgaacctcgctgacgagaggattactgtagcccatgaaccctacctgggttatgtccttccccgacggcaacgaaaccggtacttatctggctttggacatgggtggtacaaacctacgtgtctgccaagtcactttgaccgaaacaaagtccgaattcgacatcatccagtccaagtaccgcatgcccgaggagctcaagacgggcgacgccgaggagctgtgggagtacattgccgactgcctcatgcaattcattgaaacgcaccacggagacccaaccaagctcgatgcgcttccactcggttttactttctcctatccggcgacacagaactatatcgacgagggcattctgcaacgctggacgaagggcttcgatatcgctggcgtagagggccataatgttgtccccatgtttgaggctgccctccagcgccgggtaggttgtgttcttcagctctctctgatcagctgctaatgttatttttgtctctagggagtgcctatcaagctgacggcgttgatcaacgacactacaggcaccctgattgcctcggcatacactgatcctaagatgagaattggatgcatttttggcacaggttgcaatgctgcgtacatggagaactgtggctcgattcccaagctcgctcatatgaatctcccaccggatatgccaatggccatcaactgcgaatggggagcttttgacaacgagcataaggtcttgcctcgtactccttacgatgtcattattgacaaggattcgccgcgtcccggtcagcagtccttcgagaagatggtcgcagggttgtatctgggtgaaatcttccgcctggttttggttgacctccatgacaaccaggagatcaagatcttccctggccaggatatcgccaagcttcggaaagcttatagtcttgactcgtccttcctttccctcattgaagagtgagtataacctctctgcaagacttagagactggcaactaacgaacacttgcagggatccgttcgagaacctttccgaaacctttgagctgtttcagaccaagctggggcttacacccaccggccccgaattggagctgattcgtcgcaccgccgagctaatcggtacccgcgccgctcgcctctccgcctgcggcgttgctgccatcagcaagaagaaaggatataagcagtgccacgttggtgctgatggatccgttttcaacaagtatcccaacttcaaggctcgtggcgcgcaagcactccgtgagatcctggactggcctgagaaggcggaccccaaggaagatgatccgattgagattctcgccgccgaggacggaagcggtgttggtgctgctttgatcgctgccctgacgatgcaacggatcaagcaaggaaatatgcacggtatcctgcac

SEQ ID NO: 27488 - DNA, 2881 bp, Neurospora crassa
agctcgcctttgcgccagcagacagagacccagagcgatgctgaccgaactcctcgcgcaaacggacggagccagttaattgggggtatggctgtcaaccaaaaaaaaaaaaaaaaggactacactgaatgctgaccacactccgcagactcctctcccatccgctatgcctccagttctagcccgggccgtcagcttactcaacagtccgatcttcgtagcgaaagcagtcagctcttcgtcagctcgcaaaggtccgttgccggtcgatcccgtcgaggcgacatcaacggggaccctcttcgtactcccgcccagattccccgccgaatcatcctcgacgacgccggtcgtgtgatccgcgatgcccctggctccgatgccaactcgtttgtcaccaataaccccaatacctctgaggcagatgcccttggtggacaaagccaaggtcttgtttggggtacaacaatttctcttgacgattcgttctccgcgttcaaggactttctcaggaacttcaccaggaaataccggatgtgggcagatggcgcggacgaggccgagactattggccatccggatgcggattcgaagccatattgggaggcactggagaatatgctgctgcttggtaccaacaagctgtatctggatctccgcgacctcaagtcctacccgcgcaccttgaagttatggcatcaggcccaacactatcctaccgaaatcatcccggtcatggatcaatgcgtacatgactgtatgatggagttggcgcaaaaggaaatggccagccaaagagcatcccaaaactctaggaccgctccaggtgcctcacaaagctcggagccgaacttcccaagctctgaaaggagcgaggaaccgcccaccccgcggcctgcccaaacagcggcgcccacaattgaggaccaagtcagccagatggcgtatgtggttcgcccgtggggtcttgacaagatcaccaacctccgtgacctcaacccatctgacatggacaagcttgtgtccatcaagggtcttgtcatcagaaccacgccggtcatccccgacatgaaggatgcatttttcaagtgcagtgtttgtggtcattctataaccgttcagttagatcgtggcaagattcgtgagcctacagagtgtcctcgggctcgctgcgcctccaagaactcaatgcagatcatccacaacagatgtgctttcgaagacaagcaagtcatcaagctgcaagaaactccggataacgtgcctgctggtcagacaccccactcggtatccgtttgcgtctataacgagcttgtggacttttgcaaggccggtgacagagttgagctcactggtatctttaaagtcacccccgttcgtgtcaacccgcgcatgaggacggtcaagagcgtgcacaagacatatgttgatgttgtccatgtacaaaaggtcgaccgcaagaggatgggttctgatccctcgaccctcgaccttgccgaggaggaggaagcccatgctaatggccagagcatggacgaagtccgaaaggtctctcctgatgaggaagagaggatcaaggaaactgccgctcgaccggatatctacgatctcctttcacgttctttggctccatcaatttacgagatggatgatgtgaagaagggtattcttcttcaactgttcggaggcacgaacaagacctttgagaagggtggaagccccaaataccgtggagacatcaacgttctcctctgtggtgacccatccacttccaagtcccagcttctctcctatgttcacagaatcgccccaagaggtgtgtacacgagtggtaaaggttcttctgccgtaggtcttaccgcctatgttacccgcgatcccgagtcccgccaactcgttctagagtccggtgctctcgtcttatccgacggcggtgtctgttgtatcgacgagttcgacaagatgaacgaatcgacccgctccgttcttcacgaagtcatggaacaacagaccgtgtccgtcgccaaggccggcatcatcaccactctcaatgcccgaacatcaatcctggcgtctgccaaccccattggtagtagatacaaccctgatctatcagtgccgcaaaatattgacctcccgccaacccttctatcccgtttcgatctggtctacctcatcctcgatcgtgttgatgagaagaatgatcagcgtctggcccgccatttgctctccatgtatctcgaagacaagcccgagagtgcccagcaggccaacgacgtccttgtgagtttttccccgtctgtcaatccacacgaagatgaaccccaaactaaccaactccccctcaaaaaaacagcccgtcgagtttctaacctcctacatctcctacgcccgctcgcacatccacccggccctcacgcccgaagccggtcgcgagctcgtcgatgcctacgtcgagatgcgcaagctgggccaagacgtgcgcgccgccgagaagcgcattacggccaccacacgtcagctcgagtccatgattcgcttagccgaggcgcacgcaaagatgcgtttatctcaaaccgtcacgcgcgacgacgtccgcgaggccgtgcgcctcatcaagtcggcgctcaagaccgccgccaccgacagccagggccgcatcgacatgagcttgttgacagagggcacgagcgcggcggagcgccagcgcaaggccgacatgaaggatgcggttatccgcctgctggatgagatgaccagcggcggacaggtagttaggtactcggaggtggcgagacggttgggcgagggggcgggtgtgcaggttgagccggctgagtttgcggaggttatgagggctctggagatggagggcgctgtt

SEQ ID NO: 27489 - DNA, 819 bp, Neurospora crassa
tatcagctagaggagctcatcggcaaaggcagctttggccgcgtatacaaagcgacggataacaagtccaatgctgttgtggctgtcaagattattgacatcgaggagagcgacagggagaatcctaggctggcagacacgtatagcgagtttatgaaggagaccagtgccctcaagttactcagtaacagcggcgcaaagaacatcaatctcattctcgatgtactgcccgttggacagtccatgtggctgatcaccgagtactgtgctggcggaagcgtggctactctgatgaagcctaccgcacccgggggcttgcaggagaagtggatcattcccatcctacgagaagtcgcagaggccatattctgggtacacaaagaaggaatcatccaccgtgacatcaagtgcgccaacgtacttgtgacggagacgggcgccgtacagctctgtgactttggtgtggctggtatcgtggagaccaaattcgacaaaaggtcgacttttattgggacgcctcattggatggcaccagaactctttgaacctacaccgtcttacagcacaccagttgatatatgggcgtttggatctatggtatacgagattgcatccggacttcctcccaatgtcatgtcggggttcaacatccctcagcttggcaattatatcaagtcccatgcgcctcgtctagaaggagaccagtactcagacaacctcaaggacttggtggctttctgtctggtcgaagaccctgcaaaacgaccgacgattgagcaagtccagcggcacccttacatattcaacacgagctctgaa

SEQ ID NO: 27490 - DNA, 2370 bp, Neurospora crassa
ttcatagtgtcgggagcgctggtcgccacttgggtcatcggcctgatcttcttcgtctcgtccaaggcctacaagccatcctcctccttcgcgcatgacccccaagcaacagtcacgcacggcagtggaaagaaggtcaccctagaccaagtcttaaacaatgaatggcgtgccaagagccattccatcagctggatcgctggtgtaaacggagaagatggccttcttctagagaaggagggcgcaaataaagactaccttgtggtcgaagatgtgcgagctcagaacccttcctccgttgaagcctccaaaagcaagaccctgatcaaagacaaattgtttgaatttgccaacaaaacatactggcctactgtcaccgttccaagccgggacttgaagaaagtcttgcttgcgaccgacgttcagaacaattggcgccactcatactacgctgtctactggatctttgacgttgagactcagcaagctgagcctctggttccctacgatgccgatgctcgtctccagctggcgtcatggagccccaccagtgatgccattgtctacacccgggataacaacatgtttcttcgcaaactcgacagcgataagattgtgcaaatcaccagggacggcagtgcagacgttttcaacggtgtccccgactgggtctacgaggaagaggtgttggcaagtggtgttgcgacctggtggtccgaggacggcaattatgttgcctttttgcggaccaacgaaacaggcgtccccgagtatcccatccagtactttgtgtctaggcccagtggtgaggagcccaaaccgggagaggagaactaccccgaggtcagacaaatcaagtatccaaaggccggtgcacacaaccccattgtcgacctcaagttctatgatgtcaaacgtggcgatgtcttctctgttgatatatcaggccgttttgccgacgacgatcgccttatcaccgaggtcatctgggccggaaagcaggtcttgatcaaggagacgaacagagtgagtgatgtgatgcgcgtcgtgctggttgacgtgggatcgcgcaccggaaaggcagtcagaaccgttgatgtcaacgacatcgacggtggctggtttgagatctcccacaagaccaagttcatcccggccgatcctgccaacggtcgtcctgatgatggctatgtggacactatcattcacaacaatggtgatcatctagcatacttcacgccgttggacaatccaaaccccatcatgctcacctctggggactacgaagttgtcgatgcgccatctgccgttgacctgcaaaggaacctggtctactttgtttctacgaaagaatcctcgatccagcgtcatgtctaccaggtcaagctgaccggagaagatatgacaccggtgacggacacttccaaggagggttactacgccatctcattctcgaccggtgccggatacgccttggtgtcctaccagggcccaaacatcccctggcaaaaggtcatcagcacccctagcaaccccgacaagtacgagcacgtcgtggaggagaacaaagatctcgccgaagccgccaagaagcacgaacttcctatcaatatctatggcaccatcaacgttgacggcgtagaacttaactacatcgagagacgtccgccacattttgacaagaacaagaagtatcccgtgctgttccagcagtacagcggtcctgtctcccagaccgtcaagaaaacctttgctgttgacttccaatcgtttgtggctgctggtctcggttatatctgcgttacggttgacgggcgtggaacaggcttcatcggccgtaagaaccgtgtcattatccggggcaacctcggtacctgggaatctcacgatcaaatcgctgccgcgaagcactgggctcagaaggattacatagacgaagaccgtcttgctatatggggctggagctacggcggctacatgacgctcaagaccctcgagcaggatgcgggacagaccttcaagtacggcatggccgtcgcccccgtcaccgactggcgcttctacgacagcatctacacggagcggtacatgcgcaccccccagacgaatcccgagggctacgaatcagccgccgtcaccaacgttactgccctttcgcagaacgtacgctttctcttgatgcacggcgtggccgacgataacgttcacatgcagaactctttgacgctcttggacgcgctcgatcagcggagcgttgagaactatgatgttcaggtttttccggatagtgatcatggcatttatttccataatgctaaccggatcgtgtttgatagtgagtacttcaatgtgttgttatggccgagtcga

SEQ ID NO: 27491 - DNA, 1890 bp, Neurospora crassa
cgtgtcgtctcgtatagtgatggtatcgcccgtgttcacggcatggccaacgttcaggctgaggagcttgtcgagtatgttccagtccctaacctaacggatgctccttcgccccaaatctgaccctttatccccaggttcgcctccggcgtcaagggtatgtgcatgaacctcgaggccggccaggtcggtgttgtgcttttcggttccgatcgtcttgtcaaggagggcgagactgtcaagcgtaccggtgaaattgtcgatgtccccgtcggccccgagcttctcggccgtgtcatcgatgccctcggtaaccccatcgatggcaagggccccatcaactgcaaggagaagcgtcgtgcccagctcaaggcccccggcattcttccccgtcagtccgtcaaccagcccgtccagaccggtctcaagtccgtcgacgccatggttcccattggtcgtggtcagcgtgagttgatcattggtgatcgtcagaccggcaagactgccgtggctctcgatgccattctcaaccagaagcgctggaacagcggttccgacgaggacaagaagctttactgcgtctacgttgccgtcggtcagaagcgttccaccgtcgctcagctcgtcaagacccttgaggagaacgacgccatgaagtactccatcgtcgtcgctgccaccgcctccgaggccgctcctctccagtacctcgctcctttcactggtgtaagtggctgccggatcttgtcccctccaattatcagcagaccccttcagttgccgctcgaacacctccagattttcgtttgacgccttgtctatatatgggaggatgtcttccaaataactggaaaccccttccattcatcatcatacccttcccagatatatgcacgaccccttcaacacttttgcacctccctgttgaatttctccaccgatctctcaaacaccatcagaccccatcacacctcttctcggattcctgccccccggcccgttcgaaaccaatcagaccagactggctaaccagaagcttctaaacacaggcgtgtgtcggtgaatacttcagagacaacggcaagcactcccttgtcatctttgacgatcttaccaagcaggccgttgcctaccgtcagatgtcccttcttctccgtcgtccccccggtcgtgaggcttaccccggtgatgtcttctacctccactctcgtcttctcgagcgtgccgccaagatgaacaagacccacggcggtggttccatgactgcccttcccgtcattgagacccagggtggtgatgtgtccgcttacattcccaccaacgtcatttccatcactgatggtcagatcttcttggagtctgagctcttctacaagggtgtccgtcccgccatcaacgtcggtctttccgtctctcgtgtcggctccgctgcccagctcaaggccatgaagcaagtcgctggttcgctcaagctcttcttggcccagtaccgtgaggtcgctgccttcgcccagttcggttccgatcttgatgctgctaccaagcagaccctcaaccgtggtgagcgtgtaagtgcaaacaggctgaactccccatgtcttggtgcagagctgacgagtctatctacagttgaccgagctcctcaagcagaagcagtactcccctatggccgtcaacgagatggttccccttatcttcgccggtgtcaacggtttcctcgactccgtccccgttgccaagatcctccagtgggaggctgacttcctcgcccacctcaagaccaacgagcctgagatcatggccaccatcgacaaggagggtgccattagcaaggacctcgaggctaagctccgtgatgttatccagaccttcaccaagagcttcctcggt

SEQ ID NO: 27492 - DNA, 4161 bp, Neurospora crassa
gaggccgatgaggcgtacgtcattggcaagcgtggacaatacacccccgttggtgcttatctcgcctccgacgagatcgttaagattgccgtcgaacacggcgcccagatgatccatcccggtaggatagaaccgttcacctgaaggccttgatgtcgcttttactgatcctcccataggttatggtttcctctctgagaacgctgatttcgctcgcaaggttgagaaggccggtcttatcgtgagttgcccagaccacgcctagctagagcgcggggttcatgtgattcgcccaatgaggagtgcatgagcactaacctgttctctttagtttatcggcccttcgcccgaagtgatcgacgctcttggtgacaaggtctctgctcgcaagcttgccattgccgccggtgtccccgtcgtccctggtactgagggtgctgtcgacaccttcgaggccgtcaaggacttcaccgacaagtacggtttccctatcatcatcaaggctgcctatggcggaggtggtcgtggtatgcgtgtcgtccgcgaggaggcttccctgagggagtccttcgagcgcgccacctctgaggccaagagtgcctttggcaacggcaccgttttcgtcgagcgcttcctcgacaagcccaagcacatcgaggtccagcttcttggtgacaaccacggcaacattgtccacctgtacgagcgtgactgctccgtccagcgccgccaccagaaggtcgtcgagattgcccccgctaaggaccttcccaccgagactcgcgatgctatcttggccgatgccgtcaagctcgccaagtcggtcaactaccgcaatgccggtaccgctgagttccttgtcgaccagcagaaccgctactacttcattgagatcaacccccgtatccaggtcgagcacaccattactgaggagatcaccgggatcgacattgtcgccgcccagatccagatcgccgctggtgctactcttgagcagcttggtctcacccaagaccgcatcactacccgtggtttcgcgatccagtgccgtatcaccactgaggatcccgccaagaacttccagcccgatactggcaagattgaagtctaccgcagcgctggtggtaacggtgtccgtctcgacggcggtaacggctttgctggtgccgtcattactcgtaagtgatttcccctttccccattcatgcctcaaagacctttcccaaaaaccccaagaccccaaatgcatcgcttgatgagttttcaactctccatgggacattcctgttatctctcgacgcatacttgcatcaatcagatgcatcgcgataccagaggaatggcatcaactgctctcctcaggccttttgacatcagctcgaggcttttttgcaacaagaaactgcatgcaaatttgagaagaatacctcaatttccggcggcctgttgcttcacattgaagcatttgtttcgtggtaaacaaatggcaggtgcttggacccactagtgtggggctggtccaaaagacccacaaattattaggggggtggaccgtgcgtcatgtgcagcctcaactcatcaacatatattcaccctcgccgtcgtcaactcaaatcatcacatctatcaatcaccacccttatccgtcactaccaatcatcaatcacgacccctctcaagatgatgtcactaacattaaggaatcacagcgttctacgacaggtaagtcgttacgcaatccttagcggatcccgacctccatgaccaccgtctatctgtcgatacttgtactaaccttccttcaatcacaagtatgttagtaaaggtgagctgtagaggttccacctatgaaattgctagaagaaaggtactgcgtgccctgatcgaattccgtattcgcggcgtcaagaccaacattccatttttggcttctctcctcacacacccgaccttcatcgagggcaactgctggactaccttcatcgatgatacgccctcgctcttcgatctcgttgggagccagaaccgtgctcagaagctccttgcttatctgggcgatgtcgccgtcaacggcagtagcatcaagggtcagattggtgagcccaagttcaagggtgatatcatcattcccgagctccacgatgcttctggcaagaaaatcgatgttagtcagccttgcaccaagggctggcgccagatcatcctcgagcagggccccaaggccttcgccaaggctgtccgcaactacaagggctgccttctcatggacaccacctggcgtgatgcccaccagtctctcctcgccacccgtgtgcgtaccgtcgatctgttgaacatcgccaaggagaccagccatgctctccacaacctctactccttggagtgctggggtggcgccaccttcgatgtcgccatgcgtttcctctatgaggatccttgggacagactccgcaagatgcgcaagcttgtgcccaacattcccttccagatgctcctccgtggcgctaacggtgttgcctacgcttccctgcccgacaacgccattgagcacttcgtcgagcatgccaagaagaacggtgtcgatatcttccgtgtcttcgatgccctcaacgacatccaccagctcgaggttggtattaaggctgtccagaaggcaggcggtgtgtgcgagggtaccgtttgctacagcggtgacatgcttaaccccaaaaagaagtacaaccttgagtactaccttaagctcgttgacgagcttgtcgctctcgacatcgatgtccttggcatcaaggatatggctggtgttctcaagccccacgctgctaccctcctcattggcagcatccgcgagaagtaccccgacctccccatccacgtccacactcacgactccgcgggtactggtgtcgcctccatggttgcttgtgccatggctggtgctgatgccgtggatgctgccactgacagcttatctggcatgacctctcagcccagcatcaacgccatcattgcttcgcttgatggcactgacaaggacactggtctcgacgtccaccatgtccgtgctcttgacacctactggtctcagctccgtctcctctactcgcccttcgaggctcatctcactggccccgaccccgaggtttacgagcacgagattcctggcggtcagctcaccaacatgatgttccaggcttctcagcttggcctcggctctcagtggcttgagactaagaaggcctacgaggaggccaacgaccttctcggtgacattgtcaaggtcactcctacctccaaggtcgttggtgacttggctcaattcatggtttccaacaagctgtccaaggatgatgtcttggcccgcgctggcgagctcgacttccccggctccgttcttgagttcctcgagggtatgatgggtcagccctacggcggtttccctgagcctttccgtaccaaggcactccgtggccgtcgcaagctcgacgctcgccccggtctcttcctcgagcccgtcgacttcgccaaggtccgcaaggagctcgctcgtaagttcggcagcgtcaccgagtgcgatgttgccagctacgtcatgtaccctaaggtctttgaggactataagaagttcgtggccaagttcggtgatctctccgtccttcccaccaagtacttcctgtccaggcccgagatcggcgaggaattccacgtcgagctcgagaagggcaaggtcctcattctcaagctccttgctgtcggtcctctctctgagaacaccggccagcgtgaggtgttctacgagatgaacggtgaggtccgccaggttaccgtcgacgacaagaaggcgtcggtcgagaacgtgagcaggcccaaggccgatcctaccgattccagccaggtcggcgcccccatggccggtgttctcgttgagctccgcgtccacgacggtactgaggtcaagaagggcgaccccatcgccgttctcagcgcgatgaagatggtacgttgtccactacacccctttacgcagatgactcaatactaattcgtatcctataggaaatggtcatctccgctcctcacaacggtgttgtctcttcccttgccgtccgcgagggtgactccgtcgatggctctgacctcgtctgccgtatcgtcaagcccggc

SEQ ID NO: 27493 - DNA, 729 bp, Neurospora crassa
tatgagaaggccgtcgcgcatgccattggcatgaaggccggcgacaaggttctcgacttgggatgtggccgagggcgcgtggctgctcatatggccagcatgaccggcgctacagttaccggtctcaacatcgaccctaaccaggtcgcccaggcacaagagttcaacaacctgaagggattcaagaacacttttgtacaacaagacatgaacacgctaccactacccttcgccgacaactcctttgactgcttctaccagatccaagcactgtcattgtgcaaggatctcccaacgctcttccgtgaagtctaccgcgttctcaagccgggcgccaaggtctcgctcctcgactgggttagcctgccaggctacgaccccagcaacccggaacaccttgcgctcatgaggcgcgtaaagcccctaatcggcgccgttggcacgccaacgcccaagagcttcgagaaggccctcgaggatgctggcttcgtcgtcacgaaatccgagaacgcgagcatcgacggcttgcaggcacctctgattgatcgggttgacatctacttccgcaccatgcgccagatcattctgggcttggtgaagatcaaggtcctaccccagcacttcaagacattgatcaacaggttatgcctggatgggcaggcgtttgtgaagatggacaggatgcgtctcatttcgacaagttactggattgttgcggagaagcccctc

SEQ ID NO: 27494 - DNA, 2295 bp, Neurospora crassa
gaccagagcgagttcgagccatgctgggcccttttgcgcgacgccatgaccgatattcacctacagaacgccggccgtctgtccttcgaacaactataccgagcttcatacaagattgtgcttcggaagaagggcgccctactctacgagagggttagagactttgagcaggagtggttccgagatcacatcatgccgaacatcgccgccctgatcaccaagaacctgatcaacatatcgctgcttcagcacccggggtcgagttcacatgagcgcagggagatgggcgaaaagttcctgcgcggaatacgagactcatggacggatcacaataggtctatgaacatgattgcggatgtgctcatgtatctcgaccgtgtctataccctagagacgaagcagccctctctgtttgccgttacaattggtctcttccggaacaatgtcctccggagccacattggcgccgccgcagaagacatcgagcaagactttgtcgtctttgacattctctgcgccgtcatattggacctgatcaacatggagcgcgacggcgatatcatcaaccgaaacctagtgcgcaaaataactgcgatgcttgagagcttatacgagacagatgacgagatcgaaaaccatcggctttacctaacccttttcgaacctcggtatctcgaggcaagcaccgagttttaccgtaaagagtgtgagaagctggtccaggaagcaaattgcagcacgtggctccgccatgcccaacggcgactaaacgaggagcgcgagcgatgtggtactaccctatcaattatgacgaccgacaaaatcgcgagtgttgtggagaaggagctcatcgaggcaaagctcgatgtctttctggccatggaggggagcggcctgaagcccatgatcgacaatgatcgcttggacgacctttcgatcctgtaccaactcatatccagagtggacagtacgaaatcggcgctaaaggttattctacaacgtagagtgcgggagcttggactggagattgagaaggcgctcaagaacacagacttttccgtcgctggtgcagctgctggggatggtgaggatgctggcgaagcggcagagaaggccaaaccccagaccttgaatccggctcagcagcaaaccgctgccgctatcaagtgggtggacgacgtattgcagcttaaggacaagttcgacagaatattgtccgattgcttctgcgatgatctcctgctacagtccgctatcacacgaagcttctccgacttcatcaactctttcaatcgcagttctgaatatgtttctctattcattgatgacaacctcaaacgcggcatcaagaccaagacggaagccgaagtagacgctgtcttggataaagccatcgttcttctcagatatcttacagatcgagacatgttcgaaaggtattaccagaaacatctggccaagcggctactgcatgggaagtctgaaatccataccgagaaggagatggtatcccgtatgaagtcagaaatgggcaatcatttcacatccaagtttgaaggcatgttcaaggacatggagttgtccaaggacctaaccgacaactaccgtgaccatatcgccagtttaggtgatgccgactataagatggttgacctcaacatcaacgtcctgaccaccaacaactggccacccgaggtaatgggtggtggtacgtcgaagggagaaggggcgaaactggattgcttctatccacccgaaatcaagcggctccaggagagcttttacaagtactacctgaaggacaggagcggccgtgttcttacatgggttagctcggcgggcaatgcggacatcaagtgtgtgttccccaaggttccgggcaaggagactggacctttgagcaaggaaaggcggtatgagctaaacgtctcgacgtatggcatgattgtgcttatgctgttcaacgatctcgtggacggcgaaagtttgagcttcgacgagatccaagccaagacgaacattccggcaccagagctcatgcggacactggcttcactttcgagtgttcccaagtgcagggtactgctaaaggaaccggccacaaagaacgtcaaaaataccgacaagttctcttacaacgcacagtttgtgagtaaggctatcaggatcaaagctcccgttataagcagcatttccaaggtcgagggagacgaggagcgaaaggagacggaaaggaagaatgatcagacgcgcgctcatgttatcgatgcggcggttgtcagaattatgaagtca

SEQ ID NO: 27495 - DNA, 1057 bp, Neurospora crassa
acttccataggaacaggctacgatcttgccaactccattttctcccccgatggtcgcaactttcaagtcgaatatgccatgaaggcagttgagaatggcagcacctcgatcggcatccgctgcaaggacggcatcgtgttggcggcggagaaggttatcacatccaagctgctcaagcaaggcgccaacaagcgcattgcgacagtcgacaggcatttgggcattgtacgtatacgtagatttatttctttttctatttgtttgggcaggtttcatccacgagctccgaccgtctgcggggcagctggagccaggttcaccaccctcctccgccatcgcatgaacgaaccataccccgaccttcactaccttttgatctagctcgacgattactaaccacaaactgcgaatccgtctttgataggtatactccggcatgatccccgacggtaggcacttcgtggaccgcgcccgcgacgaggcgcgcggctggcgcgacaactacaagacgcccatctcgacaaaagacctagccggccgcatgggcggttacatgcaagcctacacgctctaccaatctgtgcgacctttcggcatcacggccatcatcggcggctacgacagcgaactcgatacgcccgtggaaggcgaggtcggcagcggccccagcgtcggcgccggcggcaaggtggagggcaagaagcacggtggtccgttcctgtacatggtggagccctcgggcctctactggggatactacggcgccgcgacgggcaagggcaggcaagcggccaaggcggagctcgagaagctggacctcagtagcgacggcgagtcgagtctgacgctggagcaggccgtcaaggaggcagcgcgcatcatctacgttgcccacgacgacaacaaggacaaggagttcgagctcgagatgacctggatcagcggggcggacggtcccacgaagggccgtcaccaagaggtgcccgaggctttgcggaaggaggcggagaagtatgcggagcgcatgactgcgaaggacatcgaggaggaagaggaa

SEQ ID NO: 27496 - DNA, 1608 bp, Neurospora crassa
gtcgtcctcatccagcttcccaactcacttgcttttgcgcccgtgctgctgggaacgctggccgccggactcaccgcaacgctggtttcacccgcccttacgagcgatgaaatcgcttggatcctccaaaactctcggccgcgagccatcatcacggcgaaagcctgtctcggcgccatgcgcgaggcactggagaagcaggagccgcgagaccgagccttctttgacgccgtgcccatcttcatctttgacgcagccaaggaccactacccttctgtatcgtcatcgtcaccgcctacctctgtcggcagcggcagcagcagcagcagtaagaagacgaacaaaacccaggactggaaggtccttctgcgctcttcccgagcaacagtggtcccctcctccttccttccctcttccgcctcccccgctcgcacagccgtcattctctggtcctccggcacctccggccgatccaagggcgtcctcctctctcaccacgcgctcaacttctccggcgcgcacatgtggcacgacgcagccgactaccactctcttgcaaaggtccggcagcagcgttggctcggctacgtacccttctaccatgtcttcggtctctgtaacatcgttttgctcgccatcatgacaggcagcaccgtgtacgtgatgccgtccttcagtctcgatggcatgctcgccgccatcccgaagaggaagatcacgtacctgcacatggcgccgcccattgccgtgatgttggccaaggctcctgtagtcgaaaaatacgccaagcgcgacccgaagacaggtaagaacggcttcagctccatcgtggcagccgtcacgggcggcgctcccctcggacacgaggtggtcgtggaggtgtacaagcggtgcgggttcagagtcaggctcggttacggactgagcgagacgtgcagcacctcgctgcagcgcggcacgagcgagaaggagatggtggagcaggcgggcgagacgggcgtgccgcattggggcgtcgaggtcatgattgctgatatggatgtgcccgctccggggctagtggacgggaaaaccaaggcggcgaggataggacaggaaggggagattttgatacggtcgccgacgctacttagcgcgtatctgcccgtgggcatgttcaggacccctaagggtcaggagccggatatgtcggtcacgagggaggcgctgacggttgatgggtggttccgcacgggcgacgtgggcaccatcagtgcgcaggggaggctgcggatcacggaccggctgaaggagctgatcaaggtgcgcgcataccaggttgcgccggcggagctggaggccgtgttgtgcagcagcccgtcggtggcggatgcgggcgtggtgggcgtgtatgacgagtcggaggcgacggagtggccgagagcatatgtggttccgcacaagccggaggcgctggagaataagacggagctagaaaaactggcgcatgaactcagggttttggtggaaaagaggacaaccaagtacaagtggcttatgggaggcgtggtgtttgtgaagcagatccccaaaagccctagtgggaaaatcttgaggaggatcttgaag

SEQ ID NO: 27497 - DNA, 1332 bp, Neurospora crassa
gtctcgcgacgaggctacgctaccgccgaacccgatctcaagacagtgctcaaggaggccattcccgaaaagcgcgagctcttcaagaaggtcaaggcccatgggaacaaggtgctgggcgaggtcaaggtcgagaacacaatcggtggcatgcgtggcctcaaggccatgatttgggagggctccgtactcgatgccaacgagggtattcgcttccatggccgcaccatcaaggactgccagaaggagcttcccaagggcaagaatggcaccgagatgctgcccgaggccatgttctggcttctcttgaccggcaaagtcccctccaccaaccaggtccgccagttctcgcgggagctcgccgagcaggctgccctgcccgactttgtcaacaagctcctcgacggcttccccaaagacctccaccccatgacccagttcgccattgctgtctcggccctcaatcatacctccaaatttgccaaggcctacgagcagggcctgaacaaggctgactactgggagcctacctttgatgactgcatttccttgctcggcaagctccctaccattgccgccaagatctaccagaactcgtacaagggcggcggtgctctccccgccgaggtcgacctcgagcaggattgggcttacaactttgctgccatgctgggcaagcccggtaaagagaacgagaacttccaggatcttctgaggttgtaccttgcccttcacggtgaccacgagggcggcaacgtctctgcacacaccacccacctagtcggcagtgctctgagcgaccccttcctcgcctacagcgccggtctccagggtctcgccggccctctccacggtcttgccgcccaggaggtgctccgatggatccttcagatgaaggaggccatcccctcttcctacacggacgaagacgtgcgcagctacctctggaacacactcaactcgggccgcgtcgtgcccggctacggccacgctgtgctccgcaagcccgatccccgtttcgaggcccttatggactacgcggcctcccgccctaagattgcggccgaccccgtcttccagctcgtgctcaaaaatagccagattgctcccgaggttctcaagcagcacggcaagaccaagaacccctaccccaacgtggactcgtcctcgggcgtcctgttccaccactacggcttccacgaaaccctctactacaccgccaccttcggcgtctcgcgtggtctgggcccgctcgcacagctcatctgggatagagctctgggtctgccgattgagcgacccaagtccatcaacctcgagggtatcctcaag

SEQ ID NO: 27498 - DNA, 591 bp, Neurospora crassa
gacgtctccaaagaagaccaagtagaaaagatggtctcgcacctcgactcctggggcggcctcgacatcatcttcaacaacgccggcatcatgcacagccaggatgacgacgccgtcgccacccccgagtccatctgggacctaacacacaatatcaacgtcaagggagtctggttcgggtgcaagcacgccgtcctgtccctgcgcaagcacaaaaagaccaagggcagtatcatcaacactgcctccgtcgtcgcgcttgtcggctctgccaccccccagctggcttacacggcctccaagggcgctgtcttagccatgacgcgcgagttggctatggtgcatgcccgcgaagggttcagattcaacagtttgtgtccggctcccctcaacacgccgttgttgcaggactggctgggtgacgataaggcgaagagactacggagggagattcattttccgactgggaggtttggagaggcggtggagcaggcgcaggcggtggtgtttttggcaagtgatgaagctagttttgttaacggacatgatatggtggttgatggcggcatgacgaaggcgtatgttacaccc

SEQ ID NO: 27499 - DNA, 1121 bp, Neurospora crassa
gacatccccaaggagcagtgggcgcaggttactgagaaggatggcggtatgttgctctcttctctttcttatcccgttcatggaactttgactatgtgccttactaacaccaatacgcagtaatcacctacaaaaaaatccctgttcccacccccggccacgacgaagtcctcgttaacattaaatactcgggcgtctgccacaccgacctgcacgcgctcgacaacgactggcccctgccgcgcaagacccctgtgatcggtggtcacgaaggcgccggcgtagtagtccaaaagggcgagctggtgaccaacgtcgacatcggcgacaaggtcggcgtcaagtggctcatgtctacctgcttccactgcaccttctgccagcaagccctagaatcgctgtgcccgaaggcgcagctctcaggttacaccaaggacggcacctttcagcagtactgcgttgcgaacgccgcacacttggcccggttcccgccgcagaccgatttatccgccgttgcgcccatcatgtgcgccggtttgacagtgtacaagggtctgaaggaatccgacacacggccgggccagtacgtggcgattgtgggtgctggaggtgggctgggcacaattggcatacagtacgcccacgcgatggggctgaacgtgatcgccattgatggcggtaaggaaaagggcgaggcgtgcaagaagttgggcgcgtcgatgtatatcgatttcaaggagtccaaggacctggtggctgatgtgaagaaggccacgcacgatggactgggaccacagggcgtggtcttgctggcgccgcaggaacagccgttccagcaggccacaggctatgtgcggtcgcacggcaccgtggtctgcatcggcatgccggcgggcgccaaggtgagcatgccggtgtttgatacagtggtcaggatgatcaaggtcaaagggtcgtatgtgggcaacagggaggatacggccgaggccttggatttcttcttgaggggtaaggtccatgcgccgtataaggttattgggctcagtcagcttcagagcgttttcgacgagatgagggcgaatagggttattggaagatatgtgatggatatgagcaagtga

SEQ ID NO: 27500 - DNA, 1094 bp, Neurospora crassa
cgagtcgaggatcctacggtgcgagtggcggttgtctaactatctatactacagagcttgagctggacgaggaagggacgcgtatcgcccttaccatcgtcgacacccccggcttcggtgaccagatcgacaatgaagccagcttctccgagattgttggctatctcgaaaggcagtacgatgacattcttgcggaggagtcgcgcatcaagcgtaacccccgcttcagggacaaccgtgtccacgccatgctctacttcatcaccccgaccggccatgggtaggtttcacttcctctgttacacatcctgacacatcttgaatcgcaactaacatgtgctataagtctccgtgagctggacatcgagcttatgaagcgccttgcgccccgagtcaacgtcattcccgtgatcggccgcgctgatacgctcaccccagctgagcttgccgagtccaagaagctagtgatggaggatatcgagcattaccgtatccccgtctacaacttcccttacgatatcgaggaggatgatgaggataccgtagaggagaacgccgaactcaggggtctcatgccgttcgctattgtcggctcggaagatatcatcgagattggaggacgcaaggtccgcgctcgccaatacccatggggtgttgttgaggtcgacaacccgcgccattccgacttcttggctatccgttcggccttgttgcactcgcatctcgccgatctgaaggagatcacccacgatttcctatacgaaaactaccgtaccgagaagctcagcaagagcgttgagggtggtgctggagtgtaagtgttaccctgaagcttccgattgcaaccacgtagcggagtagagtactaacgttgatatagtgactcctcaatgaaccctgaggatctcgcatcccaatccgtccgactcaaggaggagcagctgcgtcgtgaggaggagaagcttcgtgagattgaggttaaggtccaacgcgagatcaacgagaagcgccaggagctcctcgcccgcgaatctcagcttcgtgagatcgaagcccgcatgcaacgcgaagcggcggctgctgcccaagcaggg

SEQ ID NO: 27501 - DNA, 1514 bp, Neurospora crassa
atgcgcggcaccctcatcttttcgggcagctcgtgcccggccctcaccggcaaagtatgcgagaacctgggcatgacgccagctgatgctgagctcacccagttttccaatggagagacgagcgtgcgcatcctcaccagcgtccgcgagaaggatgtctttgtcgttcagtcgggcagccccaagatcaacgacaccatcatggagctgctcatcatgatctctgcttgcaagggaggctctgccagcaagatcactggtatgtctgccgctcaacagcaatccatccagtgtgaaggctgaccaggcccccccttctagccgtcctgccatacttcccctacagtcgccagtccaagaagaagtcgcaccgcggagccatcactgcgagaatgcttgccaatctgcttggcgttgctggtgttaagcacatcatcacggtcgatttgcacgcttcccagatgcagggcttcttcaagtgccccgtcgacaacctccatgccgagcctctcattgcccgctggatcaggcaaaacgtccccgactggaaagaggctgtcgtcgtgtccaagaacgccggtggcaccaagcgcgtcacgtcgcttgccgacgctctcaagctgaacttcggcatggtcaccaccgacaagaagagaggcaatggcaacatgactggcagcatgcttctcaaccccattgatgctgtcttggaccccatcggcgagcaggtcaacgaggcagttgagcatgaggagccctcagtcagcaacattacccagcctattgcaggcactacaagccccgcgcgccgtcccaacggatcgtccatgcacagcgccaagtctttgccgtctcgcctgcgttcttcgacctcggctttggacggtgttgacgaggaaggcgaggacggcgtcgagtacaatgaccagcgtgcgcacgaggtcactcaggctcgtcttgtccaaggccacatcgttccggatgactttgagtcgccggccgtctctgcagccaccagtgtcgctggagatgacccgatgaccatgtcgcacgcttcgtcgtttttcgctcctcagcaccacgccgcccttggtggctcgggtgatgcagctgaaagttcggatgaggaagaggagatcctgaaggaccccaaggtggagcacatggtcacccttgtcggagacgtcaagaaccgcaccgtctttattgttgacgacatgatcgacaagcctggttcttggatcgctgctgccgagacggtggtcaagcgcggtctggccaagaaggtctactgcattgccacccatgccgtctttggtgctgactgcctggagcagttgcaggattgtgactgcattgatcacattctcgtgacaaacagctaccccattccggaggagaaggctcgcaacgccagcaaactgaccgtacttgacttgtcgtatctccttgcggaagcaattcgtcggaaccactatggcgagtcgatctcgcctttgttccagcacataatg

SEQ ID NO: 27502 - DNA, 1376 bp, Neurospora crassa
gttctgatcggcgtcttcgtggcctttggcggtcttctttttggctatgacaccggcaccatcagcggcgtcattgccatgaaatattggaacgagcgtttctccactggctacatcgatgctgatgggaggccggccattagcccgtcccaatcttccctcattgtgtctatcctttcggctggtaccttcttcggtgctttggcttctcccttgctggcggataagattggtcggcgatggggtatcatcatatcctcttgggtcttcaactttggcgtgtccatgcaagtaatttctgtcgccattcctctgtttgtagccgggagattctttgccggccttggagttggcctgctttcggctcttggtgagtgatgcatccttttttttcttttccataaagtcatggccgtggtatgctaactccgcgcccttcatagtcccgctctatcaatccgagaccgcccccaaatggatccgtggaatgatcgtaggcgtatatcaacttgcaatcaccatcggcatccttttcgccgccatagtcaataatggcactcatgaacgggaggacaccggctcgtacagaattcccattgctctccagtggctcttctcgctcactctcatcattggcatgcacttccttcccgaaactcccaggtattgcatcaagcgaggcgacatgacccgtgccacccgagccctggccagaatccgctgcctgtcgcccaatgatcccgccatccttgcggagatggaagagatccgtgcaaactaccaatatgaactgtcactcggtaacagcagctacctggactgcttccgtaagggcatgttgaagaggatgctcacaggcatggtacttcaaatcctgcagcaacttaccggttcgtcttttcatctcccatgttctccttgctgttccaccatgaccgttttctaacttgaagaattatacaggcgtcaacttcattttttactacggtactcaattcttcgagaactcgggcatctcgaattccttcttgattagtatgatcctagccacagtcaacgttctctcgacggtccccgctgtcttcatgttcgacaagttcggtcgccgccctttactcttgtggggtggtgtagccatgcacatatgccactttatcgtcgctacactcggtacatcgacaacgagtcagactgccaccggggtcattatcgtgctcaacgttgctgctcaaaaagcatcaatcacttttgtgtgcttgttcattgccttcttcgccgcaacatggggtcccttggcgtgggtggtaactgcagaattgtacccactgaagcatcggtcgcagatgttgagcattagcacagctacaaacgtgagt

SEQ ID NO: 27503 - DNA, 2829 bp, Neurospora crassa
accgttgagatcgccgaggatgtcgacggcggcactacccaacgacgcgtgtcgagtcatgacccagaaaagatccagtcgagcgccggcacaacccacaagttcagcgaacagatcccacatgagatgctcgaagaactggctcccaacggggagagcgactacatctgcgaaaaggtcgacaacatgagcgaggatgaggccatcgccatcgttcaggaatccgtgaggttccatgccgacgactggaacttcccctcggaaatgcgagagcgtatgaagcgcctgctcgaaggccccaaagcgtatggggagttttacgaccgggacctgcgaatcgatgccactctgatgcgctactcgtctccttatcccggggtttgcgcggtccaagagttgaaagatgacccgactgtgccgattgagactatcagggcatacttcctaggcgtggcgtgggcggtcattggaaccttcatgtcgaccttttttaacagcagatttccgtctataggtttgttgcatattgtttctagaactcactgttctttcaagatttgatcactgggactgactgtttctcgcaggtcttagtgggtcggtcatccagatcttgttatttccatgtgccaagttcctggaatgggtgctccccgattggggcataacggtctggggtgttcgtcactcgctcaacccgggaccgtggacgttcaaggagcagatgttttccacgatttgctacaatattgccatctacaccaccaactcatatggaatggtacgttttcggtatggtgattgggatgatgtatactgacttgctggacagattttggtgcaaaggctggacggctactacgggctgaaatttgtcaactttggataccaactgatgttaacgctttttgtccaactcatgggcatgggatttgccggatatctacggaggttcagtgtttacccggtcaaggcgctatggccgacaatccttcccacaatcgccatgaaccgagctctgacaagacccgaaccgaaagaaaacatttacggatggaccatttcccgttaccgcttcttttatatatgtaccctgactatggctatatactactggtttccaggctatctgttcactgcgctttcaacgttcaactggatgacatggatagccccagattccgttgtcctctcccttttgaccggctcaatcacaggtttgggattgttcaaccccatcactacgtttgactggaacgttgccacgagctcgtatgccgcactatcccagcctttcttcgccacttgcaccatgtactttggtggtattctcggcggtctcatcattctgggcatatactacaagaacatgaactatacagcttttctgcccatcaactccagctcagcctttgccaacgatgggacgccgtatcaggtccagaaggtggtggtcaacaaccaactggaccaaaccaagtaccagaactattcaccaccattttactcggctggatatatcctgactgttggggcgaacttttgcttctatccagtgtaggtcaacccttttcacaacacccattgtcttgatctgatcagtgcttcactcttagctactttttctacatcatggtcaaccaatggaagactattggccaagcctatgttgatttctaccatgggttgcgttacggaaagggcaactatgagaacgcaatggatatccacagcagacttatggctcagtaccccgaggttccggattggtggttcctcatcatcctggtgggcgccattgtcgtatccgtcctctttctcaagatttatccgctcgataccccgatctggctcgtgtttctcgtgattgggatcaacctagtgtttgccgtgccgttatcgttcctctcggcaacgactggcacgaacctcggtctgggtgcattgatccaggtgattaccggattcttgctacctggcaataccaacgcctttctgtttgcgcagacactagggtcctgggctctcgcggggtatggtgacaacatggtccaagacctgaagatgggacactatgtgcgaattccgcctagagccgtgtttcgaagtcaaatcgggaccatcatcattaccgtctttgtcgcagtcgggacccaagactttatcatgaccaacgtcaaggggctttgcacccccaaccagccttcccgctttacctgcgccaacgacgggaaccccctctacgccagctctctcatgtggggccttctcgggtcggaccgcatgttcaactccctttacccgctgttcaagtggtgcttcctcatcggaacttgcatcgccctggtcttcctctttggacagacctacggcccccgctacctccccggcgtcaaagaccagctccgccagcgtctctctcgccggatgttctccctgctggaccgcacattgttcccttttgtggcgtccctcctctggctgaaccctatcctcgtcatccagggcgtgcagcactgggcgccgagtaacatgagttacaagacgcccgggttcattttgtcgtacgtgtttatgtactggatgccgaagcaccggttggcgtggtgggaaaagtacaattacgtcttgtcggcggccttgacggctggggtggcggtcagcgggctgattatcttttttgcggtcgggtataatccgaagaagctggagtggtgggggaacacggtgagtggggcgggggtggacgggagagggacgggcgtcttggagattccgaaggatagagggtattttgggccggagaaggggacgtttccttagagtgga

SEQ ID NO: 27504 - DNA, 1347 bp, Neurospora crassa
ctcgcaggcggcctcgaccccctcatggtccagtacaacgaatccatccacttcgaccgtgccctcttcgcccaggacatcaccggcagcattgcctttgcgcgtgccaacgccaaggccggcatcatcacacaggacgaattcaacaagctagagcagggtctcctggctgtcaagaaggagtgggaggacggtaccttcaagattgtccccggtgtcgacgaggatatccacactgccaatgagcgtcgtctcggcgagatcatcggaaaggatgttgctggcaagcttcacaccggccgctctcgtaacgaacaggttgctaccgatatgcgcatgtggctccgcgacgagcttcgcaagatcgagaagcaccttcaggacttcctcaatgtcactgctgcccgcgccgagcaggagattgatgtcatcatgcccggatacacccacttgcagcgcgctcagcccgtccgctggagtcactggatgctctcctacggcttcgcttttgctagcgacctcgagcgtctgcgcgaggttatcaagcgcgtcaaccgcagtgctcttggttgcggtgcgctcgccggtaaccccttcggcattgatcgtgagatgatgtccaaggagcttggcttcgatggcctcctctggaactccatgggcgctgtcgccgaccgtgactttgttgccgagaccctccagtggggttccatgttgatgcagcacatctctcgctggtccgaggatctcatcatctactctactagcgaattcggcttcgtcaggctggcggatgcctactccaccggcagctccctcatgccccagaagaagaaccccgacagtctcgagctgctcaggggtaaggccggaagggctttcggtcacatggctggcttcatgatgacccagaagggcattcccagcacttacaacaaggatcttcaggagagctgggagcccatgctcgaccacgtcaagacggtttctgacagcatccaaattgcaaacggtgtcctggctaccctcagcatccagcccgagaagatgaaggagtcccttgaccccttcatgctcgccaccgaccttgccgactacctggttcgcaagggtgttccgttccgcgagactcaccacatctctggccgctgcgttgccctctcggagcagaccggtattcccatggacaagctttcatatgagcagctcaagggtatcgatgcccgcttcgaggaggatatctccaaggtgttcgactatgagaagagcgttgagatgcgctctgccaagggtggcaccagcaaggcttgcgtccaggagcaaatccaggttctcaagtctatgatt

SEQ ID NO: 27505 - DNA, 1077 bp, Neurospora crassa
gtcaaccgcgcccgcttaatcgaagaaaacaagatcacgcacatcctatctgtcatcaactacaccctccctgccgaccccgcgtttcgcaatgtccaacatcttagcatcgacattgacgacgtggaggaggccgatattttggttcacttccccaagatggtccgctttatcgagcgcgggttgtacggtgacgaagcagcttcgatagcattcggaggggataatgcgccagtagtagtacctacacccgcgagcgcgagtgcaaagatcaacggcgacgacgagacagcgcacgacgccgatgccataaccgccgcgccacccatcaccaccaccaccataacatcacaacaacaacaaacaaaacccggcgccgtcctagtccactgcgccatgggcaaatctcgctccgtctccgccatcgtcgcctacctcctctggaaacacccgcaccgcttcgggcggtccgacccttctacgcccgcgcgccgcgccgtcacgcaggccatcaactgggtacgacagacccgacccattgccgagcccaacgacgggttcatggagcagctagagctatggtggaccatgggctgtcccctcgagtcaggagacgacgcggtcgagaaccaccctgcctaccagcggtggctgtacaagcgcgaggtggaggacgcgacaaggattggccgggtgccagactggatccggttcgaggatgaggaggcagctaagcttgcttctgagaacaacaacaaagaggcggaggcgggtggtggtgcggcgtcgctaagtctaagatgcaaaaagtgtcgaagaacactggcgacgaagccgtttattgtcccgcaccaccaggggaaaggaaacaaagaaagggactgcggacattactttgtcgaggccctgtcgtggatgcgcccgacgctggagcagggcgagctggagggcagactaacgtgtccgaaccaaaagtgtctggcgtccgtggggaggtacacatggcaagggtttagatgtagctgtggcgactggatcgcgccggcgttctcgctgcagaagagcaaagtggatgag

SEQ ID NO: 27506 - DNA, 1547 bp, Neurospora crassa
acaaaaggcggcgcgctatttggcttcgatatttcttccatgtcagctatcatctcgactcagccgtacctctgccagttcaaccagctcggccacaacgaaaagggcttgtgcctcggtcctaccaacgatgttcagggtggtatcacagccgccatgcctggtggttcgtggctcggcgctctctgctctggttttgtctccgatactttcggccgcaaacgctccattcagataggttccgtgatttggtacgtggtctccgcatcgactacctcacgagaaccaaacaactaaccctttcttgcaggattattggttccgtcatcgtctgcgcgtctgtcaacattcctatgttggttgtcggtcgcatcatcaacggattttcggtcggaatatgctctgcccaagtccctgtctacatttccgagatcgcccttccatcgaagcgcggtcgccttgtcggtttccagcaatgggctatcacctggggcattctgatcatgttctttatctgctatggctgctcgttcatgaagggaacggccgccttcagagttccttggggtcttcaggccatccctgccgccctcctctttctcggccttgtcttcctccccgagtcgccccgctggctttgcaagaaggacagatgggacgaggcaaaggatgtgcttaccttggttcacggaaaaggaaatcccaactccccgtgggtgcaccgtgagatgcaagagattcgcgagatggtcgagttcgagcgcgccaatgctgatgtcagctacttcgaactgttcaagcccaacatgatcaaccggacctcgattggcgtttttactcagatatggtctcagttgaccggtatgaatgtgatggtatgtcttcctatcattcttgctccatgtttcacaaaagttatcgctgaccaccaacagatgtactacataacctacgtcttcacaatggccggtcttgccgatggaagcgagaatgctgtccttctccctagcggtatccagttcgtcattaacgtcgtcatgacgataccggctcttctttggatggatcgctggggtcgccgtccgaccctgctggttggtgcattcttcatgtgcctctggctctgtgtcaatgccggcttgtttgctgtttattcacgacctgcccgccctggcgagttcacttccccggccgagtccatggctatcactggcgctccagccaaagccgtcattgcttcaacttatctctttgtcgcatctttcgcacccacttggggtcctgtttcgtggacctatcccccggagctttacccgcttcgtctccgcggaaaagccgttgccctctgcacttcagccaactgggctttcaactttgcccttgcctacttcgttcctcctgcttttgctaacattacctggaaaacctacgtcatcttcgctacgttctgcgcggccatgttcatccacgtctttttcatgttccccgagaccgccaacaagcctcttgaggaagtcgaggagatctttgacgataccaagcctgga

SEQ ID NO: 27507 - DNA, 3492 bp, Neurospora crassa
atggggacagagatcgaacttgacgtcgagggccagacggagcctcctatatgtggcttcaagagtccaacaacgtccaaaacaaccacacggtccccgaccttgactacgctcaacaccgggaccatcatcggagaagaatgtgaataccgggccaacgacaacgccaccattactactgctgctaccggaatcggacccggcgatctcccgtccttcactcctgaagcggcccacaccctttcggtgccggacgtctgtgcttttctcagaaccgaccctgagtaattccccttcgatgccctaaagcagaaatgcactacactcaaaagtttggtcacttatttagtcttgtagaaatggaatcgacaacgatgaagctgcccgtcgtctgcagcaccatggccccaacaaggttgagggtgccaagggtttatccctttggacgattctcttaagacaggtctccaacagcttgactcttgtcctcgttattaccatggtattgtcctttgccatcagtgaccacatcgaaggcggtgtcattgctgcggtcattcttctcaacatcatagtcgggtaagactggaccatgtgaattcatgtccttgttgcccccttgttagccgagatgctaaccacagcctcgcccattagctttctccaggactatcgcgccgagcaaaccatccaggctttgtacgccctctcggcgcctacctgcaaagtcacccggtccggtgtcacttctaccataaaagccgagacacttgtgcctggcgacatcgtccgcctcggcgtcggcgatgtggtccccgccgacctccgtctcgccaccagcatcaacctctctaccgacgaggccctgctaactggcgaatcccttcccgtcagcaagcatgctgagctagtaatggcccgggatcgtgatgtccctctcggcgaccgttccaacatggtttactcagccagcaccattactcgcggacgcgccacgggcatcgttgtctcgacgggcatgggcactgaggtaggcaagattgcgggcctgttgcgcgacagtaacggcgggcgtaacaagaagcgcgtcgacaaagaagaaatgggaaccctccgctcgctgaccgtccgcgcccgaaacggcatgcgcgtcctcctcggcctcgacggtacgccgctgcaggtcacgctgagcaagtttgctttgctattgtttgctctggccatcttattggccatcatcgttttctccgtcagcaagtttgacgtcacggatgaggtactcatctacggcatctgcgtcgccgtagccgtcatcccggagtcactcatcgccgtgctgaccatcgctactgcgcttggcacccgtgccatggcccgtggaaacgtggtaatccgcaagctggccgcgctcgaggcggtcggcggagtgacaaatatctgctcagacaaaacgggaacgctgacgcagggcaagatggtgaccaagaaggtctggcttgcgaatggcactgaggtcgaagtcctagggacgacgcatccttttgattctaccagcgggtcggtcagtattggggaggaagtctttagcctcgctgatcatggcatgaaagatcctgaagaggccatcggcgaaaagggggagaatctcaaggagtttctggagagcattgctctttgcaacaacgcggttgtcacgaaggccgaggaagcaggcacttattcggctatcggtgagccaaccgagattgcgttgcagacctttgcaatgcggtttggtatgggaaagtcgagtgtgttggctattgttgatggacagtcacaacagcagctgctcttcgagttccctttcgattcatcctgcaagaggatgacggtcgtttacacaagcacagagagcagcggcgctggtgatagttacgcttataccaaaggcgcgctcgaggctctgttgcctttacttgacgcttccgacgagcagaaggttgagatcgtggcaaaggcggaagccctagctgcccaaggtctgcgtgtgctttgtgttgctaagcgatccgtcaatggagccctcttccaggctggggatgacgtctctgctagtcccgaaagggagaaagcttcggcgtcgattgtccccgaaagatcaagcgttgaaatgcatttgacctttcttggtttggctggtatatatgaccctccccgtctcgagtccgctgcagcggttcagaagtgtcaagcagctggcatcacggttcatatggtaacaggtgaccacgtcaagactgcaacggccattgcctgcgagattggtattctccgctcggacagattacagaatgggaccgaggtgatggtggccagcgcttttgacagtctctcggatgctgaaattgatgccttggaaagtctgcccttggtgcttgcgagatgcagcccaacgaccaaggtcagaatggtggaagccatgcataggagaaaggccttttgcgtcatgactggcgacggcgtcaacgactcgcccgccctgaagaagtcagacgtgggcatcgccatgggactaagcggcagtgatgttgccaaagaagcggcagatatggttctcactgacgacaacttcgcttccatcgttaccgccattgaagagggaagaaggttgtttgataacattcagaaggcacgtatttgaccaagcaagcggacggaaaaggtcatgactaacaagagaaactctagttcctcctccacctcctgatctccaacatcgcccaagttatcctcctcctcatcggtctctccttcaaagacaatgatggtatctccgtcttccccctctcacccctcgaaatcctctgggccaatctcgtcacctcctccttcctcgccctcggcctcggtctcgaagatgcccagccggacgtgatgcaacgccctccgcacgacctgcaagttggcatcttcacgcgagagctgattgtcgacaaattcgtctacggcacagccatgggcggtctctgtctggcggccttcaccagcgtggcatacggcatgtcgggtgccgacggactcggcgagggttgcaatgaggactggacgtctgagtgtggcgtggcattcagggcgcgagcgacgactttcgctacgctgacttttctgttgctggtcacggcatgggaggcgaagcacttcacccggtcgctgttcaacatgcatcccgagaagtactcgggcccactgtccgtttcaaagacggtgtggcaaaacaagttcctgtttggcgcggtgtcggctggatttgtgatctgctttccagtcatctacatccccgttattaaccatgtggtgttcaaacataatgccattacgtgggagtggggtgttgttatggcttgtgtggttgtttatgtggccatcatcgagggttggaaggctttcaagaggcgaactttgaaggcgaagatggtgactggggttggtggagagggtgtgtaagaa

SEQ ID NO: 27508 - DNA, 1107 bp, Neurospora crassa
aggtactggggcaagcgcgacaccaagctcaacctccccaccaacagctctctctccgtcactctctcccaggccgatctccgcaccctcaccaccgcctcctgttcggcctcgtaccccgaaggcgactcccttcttctcaatggcgagccctctgatgtgtctggcgctcgcccccaggcctgcttccgtgagctgcgcgcccgtcgtgccgccctcgaggctgccgacccctcgctccccaagctctccaccatgcctctgcgcatcgtctccgagaacaacttccctaccgctgccggtctcgcctcgtccgctgctggcttcgctgcctttgtgagggctatcgccaacctctacgagcttcctgcctccccctcggagctgagcttgatcgcccgccagggctccggctccgcctgccgcagtctgtttggcggttatgttgcctggcgcatgggtgaggctgctgatggcagcgattccatggccgaccaggttgccgaggcctcgcactggcccgagatgcgcgccctgatcctcgtcgcgtctgccgccaagaagggtgtcagctcgacctcgggcatgcagcagacggttgccacctcgagtctcttcaaggagcgcatcacgtcggtcgttcccaaaaacatggagattatggagaaggcgattgccgagcgcgactttgccgcgtttgctgaggtcaccatgcgcgattccaactccttccacgctacctgcgctgacacctatcctcccatcttctacatgaacgacgtttcgcgcgccgccattcgcgctgtcgaggccatcaacgcggctgctggccggtccgttgccgcttacactttcgatgccggcccgaacgccgtcatttactatctcgagcaggataccgaggccgttgttggcaacctctacagcgtccttagcaaggtggatggctggaaggcgtccgccgttgagggcctcaaggccaacgcgtcctttgacgagagtgttgtcggcttgctcaagaacggcgtcagccgtgtgatcatgaccagtgtcggcgagggtccggttgcgacacaggagtacctggtggctgaggatggcactccg

SEQ ID NO: 27509 - DNA, 693 bp, Neurospora crassa
cttcctacctcgcaacaacaacaacaatcatcatcatcatcatcctggtcctcatggctccccttcatgtcttcttcttccggctccacaacaaccggtgccgccgccgccgccggtgctactccccagcttaacctcggcgaacaccgcgaaatctcctccatcccccgcgccgccaccacgggtccctccgcctgcccctccaacgccgagcaagaaacgggcgccgacacctccaccggcaactgggtctacccctcggaaaagcaattctacgaggccatgaagcgcaagggccacgacggcgccagcgcggccgacatgaagacggtcgtgcccatccacaacgccgtcaacgagcgcgcgtgggccgagatcctgcggtgggagaagccctttaccggcgaagcatgtggatgcgccgagggccccaagctgcagagcttcatgggcgagagcaagcggatgacgcccaaggcgaggctgaacaccttgttgggatacacggcgccgtttgatcggcatgattggattgtggatcgctgtggcacgagggtggactatgtgattgacttttatgcggggaggaataacgatagggccggggcggggaagctgaacttttatctggatgtgagacccaagttgaacacgtgggagggggtgaagatgagggcgttgaggtttgtgggg

SEQ ID NO: 27510 - DNA, 3637 bp, Neurospora crassa
aggcagtcgagtatcctgggcttcttctccaaagctgcctcctcggggactcccacgaacgcgggcgccaataccaatgccaatgccaatgccaatgccactatcggggcttccagtccagcttctgatgcgacagccacgcctcgcgctggccaaaaggaaaagtcaccagaatgcctgaaggaatccacaaaatccaactcgattcttccgcccaggcggcggaaaagactcgacgaaacgccagtccctagtagtgacgccgttctacccccgagctcccaggaaaacccaggcactgcctattccaaggatgatgacaccaggaccatcatgatgcccagtagccccatcaggcgcaaggcgagttatcagctctctgttctagacctccatctaagctaacccatcgcgacttcaggcgaaagcggttatcaactatgccgagtcgtcagacgacgacggcgacgatgtctttctctcgttttccgggagacccaaaagctctcgtccatcacgctctcgatcacgaccccaagtcctagacgaggacgacgaagacgatgctttcgaaatagacgacaatgcaatcaacgaggaagaagacgatgatatggcggactttgtcgtggacgatgacgaatccgatcaagggccctcaaagtcaaagaagagaaaacgaccggcagcacgcccgagcgccccacgcaaaaagtccgccgtatcttctccacccagccctcgaagatcgtcaaggcaagaggagtatgaccaagatgaggagatgatggatgatgttcccagaacctcaacagccctgaaatggaagtatgatccggacaacattgaaccaaccgaacctcgatcggccgctcctcgttccgcacaaacaccatcagccaccaagccaaagacaaaggcacacacaagagagcctgaagagagatacccgtggttggccgatatccaagatgcaaacaggaatcgaccaggacatcccgattacgatcctggctctgtctatgtgcccccatctgcctggagacagttttcgccgtttgagacgcagtattgggagatcaagaagaacctatgggacacggtggtcttcttcaaaaagggaaagttctatgaactctacgagaacgacgccaccatcggacatcagctctttgacctcaagctcactgaccgtgtcaacatgcgcatggttggcgttcccgaaagttcgctagacatgtgggtcaaccaatttgtggccaaagggtacaaggttgcccgggtcgaccaaatggagtctgcgctgggcaaagagatgcgggaacgtgacaccaaggccaagaaggcggacaagatcatccgccgcgagcttacttgcatccttacgggcggcaccttggtggacggtagcatgcttcaagacgacaatgccgtctactgtgcagccatcaaagagtccgtcgtggatgataagcctgcgtttggcatagcctttgtggacgctgctactggacagttcttcatctcagagtttgaggacgatgtcgacctgaccaagtttgagacctttgtagcccagacctccccacgggaattgatcttggagaaatcgcatctgtctaccaaggctttgcggattctcaagaacaacacgagtcccaccaccatttggaactatctcaagccgggaaccgagttttgggacgctgacgtcgcgaggcgcgaacttgactgtagcggttactttgtgtctggcgaaggccaggaggaggtctggcctgcgaagctcaaggaggctcgcgacaaagacctcttgatgtccgcactcggtgctctgactcagtatctgcgcatgctcaagttagagcgtaacttgctctcccagggcaactttgcctggtacaaccctattcatcggaacggcacacttattcttgacggccagtctcttatcaacttggaaatctttgccaatacagccaatggcggccccgaaggaaccttattccatctgctgaacaggtgcataactcccttcggaaagcgactcttcaggcaatgggtctgccaccctctctgcaacatacagaagctcaacgagagactggatgccgtcgacatgctcaatgacgaccacagccttcgggagcaattttcgtctcagatgagcaaaatgccggacttggagcggttgatatcccggatccatgctggggcttgccgacccgaggactttgtcaaggtcttggaaggattcgaacagatcgaccgtactatggaactcctagagtcctatggtggtggcaatgggctggttgatcgcctcattgcttcaatgcctgacctcaaggaacccttaggatactggaagaccgccttcgaccggaagagagcccgtgatgacaagcttctgattcctgagccaggtatagaagaagactttgaccgcagccaagcagaactggaccggatcaaaggagagttgcaggagctgcttgaaaggcaaaagactgctctacgatgcaaaaccgcaaagttcaccgacgtcggcaaggaggtctaccagatcgaagtccccaaaacagtcaaggttcctcccaagtggcgccaaatgtctgcaacatcggcggtcaagcggtactatttcaaggagcttgaggacctcgttcgtgagctccaggaagcggaagagacacattctcagatcgtcaaggaagtcgcctcgagattcttcaagcgcttcgacctcgattacgagacatggttgcaggcaattcgcatcatttcacaactagattgtctcatcagtctggccaaagcttcgtcggcgcttggtcagccttgctgccgcccagtgtttgtgaacgacgagcggaccgttgtcgagttcaacgaactacgccacccctgcatgctcaacaccgttgacgacttcatcccgaatgacatcaagctgggtggtgatgaggcgaacattaaccttcttaccggcgcaaacgctgctggcaagtccacgattcttcgaatggtaagtgcctgccttggccgtggaggcatccacctcttctaatgctcttcatctgctaacgccttccgtgcgcagtcctgcattgccgtgatcatggcccagattggttgttatgtcccggctgtgtccgcccgtctgacccccgtcgaccggatcatgtcccgtctgggcgcaaacgacaatatctttgctgcgcaatccacgttcttcgtcgagctgtcagagacaaagaagatcctgtcagaggccacaccccgttcactcgttattcttgatgagctcggacgtggtacatcgtcatacgatggtgtcgcagttgcccaggcagttctgcaccatgtcgcatcacacattggttgcgtcggtttcttcgccacgcattatcacagtcttgctaccgagttcgagaatcatcccgagatccgtgctaggagaatgcagattgcagtggacgaggagaacaagagaataacattcctgtacaagctcgaagacggcgttgcagagggctcctttggcatgcattgcgcagccatgtgtggtattcccgacaaggtgatccgaagatccgaggtcgctgcgaaggagtgggagcatacgagccggctg

SEQ ID NO: 27511 - DNA, 1605 bp, Neurospora crassa
gcatatcagtcgacacgatgggcatcacaacgatccaagaatatcccccaaaggactgggcggatcttgtccactatgctaggcctgtccagacaaagctggatcatccttgcgttatcggcgataatcattatggatgtttcgaaaactgtcttgaaggactcgaagaaggaagagcattcactggcaaagccgacctacgcaagccgcaaagagatgcttgacgctgcgaacgagattgctcagatactaggacaagacgccgtcacctccgatgcccatgttctcgaacaccacggccattcggactggtcgacgtccaactcacctgggcgtgccgttgccgtagtttacccacgcaccactgaccacgtatctgctatcgctcagatatgcaatgctcgtaatctccccatggttccctttggcgcaggttccagtgtcgagggcaacttctcccagccctattccggcatctgcatcgacttcacctacatggatagagtcatcgccttccacccagaagacatggatgtcgtcgttcaacctggcgttaactgggttgacctcaataatcagatcgcccatacagggctcttcgtacctttggatccctcgcccactgccacagttggtggaatggtctcaaccaattgttccggcaccaacgccatgcgctacggaactatgaaagactgggtgctcaatctgactgtcgttctcccggatggccgcgttatcaagacacgtcggcgtcctcgtaagacctcggctggctataacctgacttctctgtttgtcggcgccgaaggtactctgggaatagtaaccgaggtcaccctgaagctcgctcccatcccaaaagaaaccagcgtcgccgttgttgctttccccaccatccactctgccgcagcagcagcttccaagctgattcgctccgggatccagctcgctgctttggagctcatggacgacgagcagatgaaattgctcaatgcgcacggaagcgacgcagttcgtaagcgtgtatgggacgagaaacctaccttgttcctcaagttcagcgggactaccaaggacgccatcaagagcgatgtgtcccgcgtaggcgacatcctcaaacccttgacagacagcaagttccactttgcaaagacgaaacaggatgagctggacctctggtccgcgcgcaaggaagccctttttaccatggtaaacactcggcccaagggcaccgagatttggtcaacagacgtggccgtacccatatcacggctggcggaaagcatcgaaatctcgaagcgggaatgcggatctctaggcttgtttgcgagcgtggttggtcatgtaggagatggaaactttcacgtctccatgatgtacgacccaacaaatgcgcagcagaagcaggctgtcgccaaatgcgtcaaaaacatgatgacccgggcgctagagatggagggtactgtaagcggggagcatgcgattggtattgggaagaaggagtgcttggtggacgaactcggagaggagacgattgggctcatgaggcagctcaaggcttcggttgatcccaaatgggtcatgaacccgggaaaggtgttt

SEQ ID NO: 27512 - DNA, 3873 bp, Neurospora crassa
acatggaccgactacctcctcctcctcatcggcaccatctccgccctggcagccggcgtgcccttcccgctcatgggcatcgtcttcggccaactggtcgatgacatgaacggcgccacgtgcgcggtcgagcaacacgacaccaaccccttccgctacgagcacgacatcaacgacaaggtgctcatcattgtctacatcgccattgccgccttctgcctcatctacatttacgttctctcgtggagtctcatcagccaacgtctcgccgcccgcctcaggaacaagtatgtctctgccctgctgcgccagccgcccgccttcttcgacactcgtgccgcgggtggagaggttagcacccggttgcatggcgacatggcggcgctgcaggctggtacgtcggagaaggtgggcgtgttgctggctagtatcagcttcttcatcactgcctacgtcgtggcttttatcaagcaggccaagttggctggtatcttgatttccatgatcccggcttatctcgccatgggtctggtgggcggtgcttacttccaaaagtacatgatcaaggccgccggcgccattgccagcgcttcgtccattgcttccgaggctctcaagaacgtcattgtggtccaggctttcggtgccgcgcccagactggaggccaagttcgctgatcacatggctacggctcgggatgctggtatcaagagaggcatgtcggctgccgtccaggctggtctgctctacttcatcgcctacgccggtaatgcgctggctttctgggagggttcgcgcatggtggcggatgccatggctggcaagggcagcgagactatcggtcagatctacaccgtcatcttcatcttggtcgatgcttgcgtcgtccttggtaacatttctcccctgctgccccttttgggtggtgcgcaggctgctttcgacagactgatgaaggacatcgacgagccttcccctatcgacggcacttccgacaagggcgtcgtccttccctttgagactcgcggcgagatccgcttcgagaatgtctccttctcctaccccagccgccctgatcagctggtcttgaagaacgtcgacttgaccttccctgctggcaagcacactgctattgttggtcttagtggcagtggcaagtccacggtggcggccatgatcagccgtctccaggatcccaactctggcagaatcaccatggacggctacgatctcaaggagctcaatgttcgcagcctgcgctcgttcatcagcttggtccaacaagaaccctccttgctcgaccggtctatcctcgaaaacattgctctcggccttatcaactctcccaaacccgaacaccagcgcctcaaggacatcctccacagccacgagctggccgacttggccaagaaggggaaggactccatcgaccccaccatcgtcagctccttcggtcccctcgtccaagagatcatcaacctcatccagcacgccgccactgaggccgacgccgctggtttcatcgaacgtctcgagaagggctacggcacctatgctggtccctctggttccatggtcagtggtggtcaacgccagcgtgtcgctctcgccagagctttgatccgtgatcccaagattcttctccttgatgaagccacttccgccttggactctgcctctgagcgccgcatccaggaagccgtcgaccgtgctgccaagagcagaaccgtcatctctatcgcccatcgtctgtccaccattcgcaacgccgacaagatcgtcgtcatggaagccggcaaggtcatcgaagaaggatcctacgacgagctcatggccaaggaggacggtgctttcgccaagatggccaacctccagactctcggtactgctcacaaggccgaggccggctcttctgtctctggcgagtccatcgagtcttcctcttccgctactggaacctctgtcgagaagccctctgcccctgaagtcgctgtgacacctgcccctcctcccgctgtcgccgaggccgcggctcctagtggagacgagattgccggcctcgacaccaaccgtcccctgagcagcgttgtacgctccctcggccgcttcctccgtcccagtctcggctggctcgtgattgccatctttgcggccgtgattgtcggtggtaccttctccggctccggcgtgctcttcggcttcaccatcagctctctcaacccttgcagcggcagcatggacaaggttctctactacggcaagttcttcggtggcttcctctttatgcttgcctgcatcgagttcttcgccaactttgcggcctggtcgtgcttcgctctcatcgccgagaagctcctctacgccatgcgcgtgctgtcgttccgctctctaatggagcagggcgtgcagtggcaccagtccgagggccgcagcccatcctcgctgttgaccatcatcaccaaggacagcgcttcagttggtgccttttctggctccaccatcggcactgtcttctccatctgcgttaacttcatcgccgccatcatcttgtctcacatcttcgcctggaagatcgccatcgtctgcctctccatcgtgcccatcctcctcggcactggcctgatgcagctccgcatgcttgcccgttacgaggagcgccacgccgaggccttcaacaaagccacctccgtggccgtcgaagccgtgcagaccatcaagaccgtggccgccctctcgctcgagcacgaggtgctcggctcctaccagcgcctgctcaagaacaaccgcgacgaaatggtcaaggcggctgcctttaccaacatctggctggcgctcgccaactcgatctccttcctcgtctacgcttttgcctactggtggggttcgcagcgtattatgcacggcgagtactcgcagcgggacttcttcatcgtgttggtcgccatgttggtctccgcacagctctggggccaaatgttttctttggcgcccgagttctctcgtgcccgtctcgccatctcccgcattctgggcgtcatcggcctaggctccaacgaccacgtgcacgactcctcttcccccgcttcaaagactaccgaccccgaagccactggcgaatcctccgcctcccgcctctccccccaaaagaagtccggcgtacaaatcaccttctccgacgtctccttcgcctacccctctcgcccggatcaccccgtcctcgactccgtctccttcaccatccaacccggccaattcgtcggactcgtcggcccttcaggagccggcaaatccaccatcatgaacctcgtccaacgcctctactcccctacttcgggatccatcaccatcgacggtgttgacatctcctctactcaatcatccaacaccttccgcgactccattgcactcgtcccgcaagaacccgccctcttcgacggttccgtcaaattcaacgtcggactcggcgcgcgaccgggacacgaggcttcggacgccgaaattgaagaagcgtgccgtcttgcttccatccacgacgtcatcgcttcgttgccggaggggtacgagacggaatgtggcgcttcggcgtccaggttgagtggtggacagaggcaaaggctggcgattgcgagagcgctggtcaggaagccgagactgttgttgttggatgagagtaccagtgctctggatgccgctagtgaggcggcgttgcaggaggggttggagaaggtggcgagggatacgaccgtgttggcgatcacgcatagattgcatacggtgcagaaggcggatgtgatttttgtggtggagggcggcaaggttgtagatagggggacgcatagtgagttgatggcgaggagggagagctatcgggtg

SEQ ID NO: 27513 - DNA, 1089 bp, Neurospora crassa
gtcgagaagtaccgccccgtatccctctccgatgtgtctggccaacaagacattctcgcaaccatcaacaagtttgtcgacacgaaccgactcccccatctcctattctacggtccccccggtaccggaaaaacatcgaccgttctcgccctggcccgacaaatctatggcgccgccaacatgcgccagatggtgctcgagttgaacgcttccgatgaccgtggtatcgacgttgtgcgcgagcaaatcaagacctttgcctccaccaagcagatcttctccctcggctcctcctcttcgcgctcggggctggctggtttcaagcttattattctcgacgaggccgatgctatgacgtccacagcgcagatggccctccgtcgcatcatggaaaagtacacggccaacactcgcttctgcatcattgccaactactcccacaagctcagcccagccctcctgtcgagatgcacacggttccgtttcagccctctaaaagaaaaagatattcgtgtcttggtggacaaggtcattgacgaggaaaacgtcaagattctgccagatgctaccgatgcgctggtgcggttgagcaagggtgatatgcgtcgggcactaaacgtgctccaggcttgccacgcgtcaagtaagtggtggtgtcctcgtctcgccttctgttgcgggcctcaagctaacccaggtcaaccaggcacaccactccaaccaaagaacgcccccaagatcgccgaaaaggacattgtacgggaaaccatcaccattcgaaccatctacgactgcgttgccgccccaccacccgacgccatcaaaaagattctcagcacacttttgagcacgagcgacgtcacaacctgtctgtcgactatcaacaccctcaaggttgcacaaggtttggcccttgccgacattatcaccgctctgtcggaagagatcgtcaagctggaagtcaagccgcaggtcatgatcacatggcttgatgaacttgccaagattgagcatcgggtagcgagcggagccggagaggtgatccagactggtgcggtagtgggtgcgatacggaatggtgtagaactg

SEQ ID NO: 27514 - DNA, 2173 bp, Neurospora crassa
acgcgcaaaggtgtcccctgtcgcagatcaggccagcgccaagaacgaggccaagagggaggacaagatggacgttgacagtaagcctgccgcgtcatctgcatctacctcggtccacgacaggagcgaacccaagtcgcttgcggatgactcgattaaccacttgcccatctcggactacatgaatcgccagatccgtcaggtgctggctggcgtcaagaagaccaaagcgggttatcacttccgtctccccgtgtcggagctctggccgggcctgtggaatgaatactcggccaaggttaaggaccctaccgacattcagaccatggagaagcggctccgcgggaacttggctaagtaccacaccctaggagacttcaagcgcgacttggagaagctggtgcaaaactccatcgcctttaacggtgagtaccacgacgtcactgccgcggctcggtcgtgtcgagatactatcttggctcgacttggtggctgcccagcatttgagccgtcgaggccggagaaaaaggactttgcgaagcagcacccgacccgtcatgcggaaccgagagccgcttcccacctctcttctccgtcggcgcctctcccccagcgcccccaacagccccgcgttaacaccgctgctgtgcccgctccctcctcatcaaagtccatcgagtctcctgcctttgccatccctgccaacaacaatggcatgcccctcattcgccgcgactcgaccaagcccgatagccgggccaagcgccccgtcaagccgacccattccaaggacctcgtctatgacacaaagcgcaagaagaagctcatccccgaactccgtttctgcgaagaggtgctcactgaactccgcaagcagagatactatgagttcaacgaggccttccagaagccggttgaccctgttgcccttaacatcccgacttaccacaagatcatcaagaagccgatggacttgtcgacgatgcagagcaagcttaacgcgggcgactacgccagcgccaaggagtttgagcgggactttgacctgatcatcaagaactgcaggctgtttaacggcgagcagcacatcgtatatgagcaggctctgcgactgcaaagcctttaccgccgtgaaatgtctaagaaagatgagtggctggctaagcatgcgcctgctcctgcgccccatctttcctcgaacactagtcctagattgaaggatgagtcggactgggaggagcctgaatcggagggcgagccggaggtggatgaggaacttaagggggcccagcagcgattggcaagctacatgaagcggttggaggaagaacagaagaagatcaacgacatcatgctcgagatgaatccgaatatggcggacgtcgagattgcacagtctgtcgtggccatgctgcaaaagcagatcatcactgagaggtccaagattgcttccatgcagccgaccaagaaggccgcgcctgcaaagtcgcatcatgctaacaagccttcggttagcaagcctaagaaggccatgccggccggcggcagctctcaccacgctggtggccatgttgctaagaaggctagcgtgagccattcgagcatgggcggtcacggaggtggtatgggaggtatgcctaagaaagcggccgctaggaagcccgcaccgaagcgcaagatgggcacggtcgagaaggaagttattgcagccggtattgccgagctggaaggcgcacaacttgagcgggctattgagattatcaagagcgacacgggcacgggtgaaaacgactcgggtgaactggagctggacattgatcaactctcccaagaggccctcactcagctgtacgacctcgccatcaaggcgttcccccacctgcaaagggaaaaggaacgtaccatggccgctcaggcgcctgctccgccacctgctgcacaacggtccaaacccgtgcagaagactaagaagaataagcccatgagcaagatggagcaggagcgtagactgcagcagttgaacgagctgcgcgcccaggccggccgccaaggctccggtagtcaagagcctctggagtcgatcgagggtacgggaaggacttctgctgaacctgctccgcagcaccatcgcgaggaggacagcgaggatgaggagagctccgaggaggagtaa

SEQ ID NO: 27515 - DNA, 1113 bp, Neurospora crassa
aacagctaaccgatccggacaggtgtcggtgcctaccgcgatgacaagggcaagccttacgtcctcccctccgtccgcaaggccgaggacaaggtcatccactcccgcatgaacaaggagtacgcaggcatcactggtgtccccgagttcaccaaggccgccgccgttctcgcctacggcaaggacagctccgccctggaccgtcttgtcatcacccagtccatctcgggtaccggtgccctccgcattggtggtgaattcctcaaccgcttcttccccggagccaagaagatctacatccccaccccttcgtgggccaaccacggcgccgtcttccgcgactccggtctcgaggtcgcccagtatgcctactacgacaagaacaccatcggcctcgactttgagggtctgatccgcgacctcaaggctgcccccaacagctccatcttcctcttccacgcctgcgcccacaaccccaccggtgtcgaccccacccccgagcagtggaaggagatcgaggccgtcgtcaaggacaagggccactactccttcttcgacatggcctaccagggtttcgcttccggcgacatccacaaggacgcttttgctgttcgctactttgtcgagcagggccacaacatctgccttgcccagtccttcgccaagaacatgggtctctacggcgagcgtgttggtgccttctccattgtctgtgccgacgccgacgagaagaagcgcgttgactcgcaggtcaagattctggtccgccctctctactccaacccccccattcacggtgcccgcatcgccgccgagatcctcaacacccccgagctctacgagcagtggcttaccgaggtcaaggagatggctgaccgcatcatcaagatgcgcgccctcctcaaggagaacctcgagaagctcggcagcaagcacgactggagccacatcaccagccagatcggcatgtttgcctacaccggtctgacccccgagcagatggagaagctggccaaggagcacagcgtgtatgccaccaaggacggccgtatctctgtcgctggtatcactagcgagaacgttggccgtctcgccgaggccattttcaaggtc

SEQ ID NO: 27516 - DNA, 1362 bp, Neurospora crassa
ctcgaccccaaagccgagacggccctcctgcacaagctcgactcggtcttcgtccccatcatcatgctcgtctacctctcctgcttcctcgaccgctccaacatcggcaacgtcaaagtcgccggcatgcccgaggacatccacgccacgcccgcccaattctccacggccgtctccatcttctacgccacctacgtcgcctttgaagcgccctgggcgatcctgctcaagcggctgacgccccgcgtgacgctgaccactctatgtgtggtatggagtctgacgaccattttctcggggttcatcaccaacattggcggactttacgcggcccgtctagtcttgggggcgtgcgaaggtggtttgttcccgggcttgaatctttatttgaccatggtgtataagcgggaggaacaagcgcggcgcgtgtcgtacctgtttgtgtgcacggcgattgccggggcgtttggggggctgttggcctacttgattctcaagatggacggggtgggcgggcaggccgggtggcggtgggtgtacatcatcgaaggcatcttcagcgtcctgattggcgcactggtgtggttcgcgctgccgaatgaccctaccgaggcgtatttcctcaatgaagaggagaagcggatgatgagggtgcgggcgaggcagagggcgcagtacatgggcagcgaggacttctcctgggaggagatccggatcgccctcaaggataccaagttgtggctgagcggcgcgatccagttctgtcaggatatcttgctgtttgggtttagcacgttcttgccgagcatcatccagagcatgggccacaccagcattgaggcgcagtacttgaccattcccgtgtacatcacgggcgggctgttcttcatgggcttggcgttcttgtcggataagattgcggtccggggcccgctggtggcgtttgccaatatctttggcatcttggggtacattttgattatctgcccgacgagcaacggggtcaagttctttgggacgttcctttgcgccgcggcggtgtacagtggccccgggctgaacttgacgtggcttaatgtcaatgtggccccgcattatcgaagggcggcggcgattgggtttcagcagaccatggccaacacggcgggcattgtggccgggcagatttatcgggagaagccgtacttgctgggcaacgcgttctcgctcgcggcgttggtcgtgtccgagtttctgattgctggcttgtggttgtatatccggtcgtgtaacaggaagaaggagaggatcagtaagggggagattgaggatactaggaaggtcaggacgggcgatggggcgctggactttaagtatcatctg

SEQ ID NO: 27517 - DNA, 1646 bp, Neurospora crassa
gtttcctacaccagcctatccgcctttatccaacccagctccaagccagctctcagtacgcccgacctaagcacagctctcacccatggctccctccgggactttaccaacaacttcgctctccccagcaaggctcttgacgtgccacaaaggggtcaacttaccaagcccattgtttgtattgctctccccaatggccctgtcctcgctgcagtttgtctagccgtagcaaatacatgcactgcttcaccagtcaactgcgataaggctgttggggctgaacagtttcgcgctgatgtacggcagacgggtgcttcagtcatcttgacctccgcaaaggatgcggagcggctgggacttacgggcccttcatcatggacggccctggaaggactgacagtgttgctggttgagagtgacctcgctcaacgtggccaacctacacaaatttccatcagagacttgaccggacaactagtcacgccccaagtagctggctgctcccagccagcgccaaatgggacagacgatgtagccatcatcttgttcaccagcggtacttcaggtaccaagaagcttgttccaattaccatccagaacatagttgctggcgtagcctttgtcatcgactcatgggggttgacgccggatgatgtctgtctcaacatgatgcctttgtttcacattggcggcttggttagaaacatcttctcgcccatattctcgggtgggtctgttatctgctgttcggcctttgatccgaccctcttctgggatgttatgcaggaccatggggcaacatggtactatgcttcgccgtcgatgcatcagatgattctagatcaagcggaggaccgccccgaagcgctggctaagagcagagtccgattggtttgtaatgccgctggtggactgctacccgccttggctgtcaagctaaaagagacatttaatggggcaattgtgttgccgagctatggaatgactgagtgagtgcctcgtttgtgcttgtctggactttcacactgacccatgacagatgcatgcccatctcaactccaccaacaaactacaaacttgacaagcccggcacttccggcgtcgccgtcggtcctgaacttgccattctcgactggaacaacatccgccagccctccgacaccgtgggtcgtatctgtgtccgcggggagcccgtcttccctggctatctcactgcagagggtcagtacgacagcagcaccttcactccagatgggtggtttgataccggtgatcttggccgcctctcctcggacggctacctcttcatcactggtcgcagcaaggaagtcatcaaccgtggtggcgagattatctcacccttcgagattgaaaacgccatcattgctgccgcacaggaccccaagtcaccaatcttcaaccgggttttgcaagccctttctttctctgtccgtcacgatgtccttcaagaagttgttggtgttgtactagtcacgcctcctggcgctcagcgtgttgataccaggcaactccatcaagccctgaaacagtcgttgcagcaggtaaagtggcctggcctgattgtctacatggaggacgtgcccaagagcaacaacaaggtactacgcatcaagttggcagaccgc

SEQ ID NO: 27518 - DNA, 1140 bp, Neurospora crassa
aagttcgaaggctggctcggctttgacaagagctctgcccatggcaacatgcagtggggcgagttcgagcccaagccctgggaggagaccgatattgatatcaagatcgagtgctgcggcgtctgcggttccgacattcacactctgaggagcggttgggtatgtttgttgtttgcctgctgttttaaaatatcagtttgtcaagttcttgatgctaacaattccttacagggccctaccaactacccttgctgcgtcggtcacgaggttgtcggtaccgtcgtccgtgctggttccaaggttgagggcggcatcaaggtcggcgaccgtgttggtgttggtgctcagagcgatgcctgccgcaaccgcaccgacaagcactgcaagatctgcgccgacggcaactacaactactgccgcgtccaccacgttggtacctacaacggtgtctacatgaacggcggcaagtcttacggcggttacgctacctaccagcgtgtcccctctttcttcgccgtcaagattcccgagtcgatgccctcttctcacgccgcccccatgctttgcgccggtgtcaccacctacgctcccctcaagttccacggtgtcggccccggcaagcgcgtcggtgtcatcggtctcggtggtctcggccactttggtgtgatgtgggccaaggccctcggcgccgatgaggtcgttgtcatctcccgcagctccagcaagaaggcggatgccatggccatgggtgctaccggcttcatcgccactggcgaggaccccgagtggctcaacaagaacaggtcgtctctcgacatcattctctgcaccgcctcctccgccgatatgcccttcaacgactacctcttccttctcgacctcgatggtgtcttcatccaggtcggcgcccccgacgatgatctcccccgcatcaagcagatggccctcatcttcaaccgcatcaagctcaccggttccctcatcggctcgcccgacgatatccgcgagatgttccagctcgcggttgacaagaaggtccagccctggatcagcgagatccccatgaaggaggccaacaaggccattgtcgacttcgaggacggcaagcccaggtaccgtttcgtcctcaagaacgaggac

SEQ ID NO: 27519 - DNA, 2620 bp, Neurospora crassa
cgcgtccccatcctggccaactttgaggagtggatgaagatggccaccgacaacaagatcaatgccgccaactcgtggaactttgcgctgatcgactacttccatgatatgtcgctactcaaggaaggagacggtgtcaatttccaaaaggccagttgcacgctggacgggtgtgtcaagatttataccagcagagtcgacagtgttgcgacggaaaccggaaagctgctcagtggtttggccgacagtcgcgacagcaagaagagggataggggcgagggcgaggacggcggcgatgacgatgaggaggaggacgaggtggacgagaatggcaacgtactaaagaagcgtagaaagaaggttggttgctcggctcactgctacgggcgggttgcatgatactgacaattgcagacccaacgatcctccgaagccaccctggcaccctctttcgcttccctgcagctcaaaaagttcgaactcgaattctcagtagatccgctcttcaaaaaggcatcagcagacttcgatgagggaggcgctaagggtctcctcttgaaccatctgatgatcgattcgcagggtcgcatcgtctttgacagcagcgacgacgccatcgacactctcgactcacgcaaccaaaaagccgccgaggagaacgaccaagatgccgacccggacgccatggatattgatgcgatggaaatcgacggccaaaccgaaaagacccagacccggacccaacaacaagaagaagaggaggaggacgatgtggagatcgacattgccagtcttggtgctaggttctttcccgatcttggacgactagacgagatggatgtgtgcccatcgctcaagacttttatcctcggagacccctccggatccctcgatattcccttcctcagagcgcccgaggactggcgccaggagcaagatagagccaagacccctggcctcggcaacaaatccggcttcattattgatgacgagaacccgctcggtttcgatgacgatgatgcgctgggcgcattcgacctgggaggagacgttgacgtagccttcggtgagggtggagaagcctgggcccgcgaagccgccatcgagccacaaatgatgcgggtctttgacgccggtctagacataggagagggcgaaggtggtgacgatggtgatggagtagacggcgacctcgaaatgatcgatcaagacaagggcgatttcggcatggttaacatgacgaacgcccaaaagacggaccggctgcacgaggacattctcagctacttcgaccaagccctatcaaagaactggaccagcgccgagcactggcgcattcgcaagatcaaagatgtcaacaaaccccaaacgggagaaccacaacgccagcgcaaggagaaacaggctttcgagatcgacttcttcacccccgtggatcgcacccttcacgacgtcctgcacacccaagccaccaccaactcggccatttcgctgcccaagaaggactggaagtccaagtcgcgcaacctgctgccggacgacaagcacttcagctccaagcagctgctcaacctcttcctcaagcccaaggcccgtctcggccgcaagcagcgcgcctttggccgttccaatgccgacaaccaaaacccagaccaagtccccgagggcaccatggacgaggccttctgggcccaacaaaaagcgccgctgaaccagggcccatcatcgcaagacgaccatctaccgcagggtgactacgacgccaacttcttccaggatgacggtctgccgtttgccaacggcggagacgacgatgacgacgaagacatggacgaggaagtctttgctgacgcacgggatcacttctcgcctggccccggtggcacgcaaggggatggcgctgccgggaaagaaggaacagcaggactgacgatggacgtgggcatgacgggcgcgtttaacgggctgacggttacgaacccggccgatttggcgtttggcacgatgctggtcacgcaatcacgaagagtcaggcccgagtatgtgcagtatgcgagacgggccaagaaggtggatgtcaggaggctgaaggaggaactttggcgggggatggggatggacatgttgaatggcgcacgttttttttttttttttttttttttttttttttcctctcttcttttctcctccctgtttttcttttctttttttttttttctttttgtttcatcctctttttatttctcccagttactaacaacacgaacaacagataccaacaacaacaacaacaacaacaacaaaccccgaagactccctcctctccccacccccaacgacgaccccatccgcccaaccaccgagctcctcagtagaacctcccaaagaaggggaagaagaacagcaagaaaaaccaacgctcaagttcacagaagtcatgaactcgctgcaaaaagtctacccgaaacaagccatggacgacatctccaccagttactgcttcatttgcttgttgcatcttgccaacgaaaaagggttggtgattgagaagagcgaggagttgacggagctctacataaagaaggacgcgaatgctgttgttgaggagggtggtgagtga

SEQ ID NO: 27520 - DNA, 913 bp, Neurospora crassa
cctgtcgccttcacgaactgacaatcaccacagctgtcatggatcatcatcctgtttggatccatctttggctttagggaccaaaatgacggatcgaatggggctcccgtcattgtttggccaacctacagctggttcaccctcgtcttcaacttcttcctcattctcggcattttcatcgtcatcgcctcggacagcgctcagacctaccatgtcgccatcgttggctacctggccgtcgggctggtcggctccacgtcgtcgatcaacaacctgatttacagtggcgttgcgtccatggaggcgacagcggctgggtatatcttgttgtccatggtgacggtatgcggttccccgctaacttcccccagctggctgaccccatttgctaacgtcccgccagatcatctggatattctactttggctccgccccatcggctgttccccgtgcctacatcgactcctttgcgctgaccaaggaatccaccctccctgcgcatcacatgagccgccaaaccatgaaccacaacggtctctcctctcccaatgcttacggctcctacaacatgcgccctgaaacctcggcctcgggcctccagcctccgcaaatgtacacgggtcagctcaacgggctcgaaaaccccgctcgccagtcgcagattccccagggtttctcgtccaacaacatccccaagccgcaaggagaaggggagatcgttccgccgacggagtacccgtacagggccaaggcgatattcagctatgaggccaacccggacgatgccaacgagattagtttctccaagcatgaggtgctggagattagcgacgtgagcgggcggtggtggcaggcacggaaggagaatggagaaacgggtattgcgccgagcaattacttgattttgctatga

SEQ ID NO: 27521 - DNA, 276 bp, Neurospora crassa
tttactctggacgacgtgcgcaagcacaacagcaaggacgatgtctggatggtcattcacaacaaaggtgacttgctctttcccttatttccacagatggtgacccctttgctgaccttctcagtctacaacgtcacaacatacctcgaagaccatcccggtggctccatcattcttcgtgaggtcgccggtacggatgcgaccgagcagtttgtggaaatcggacactctgtcgaggccaccgatatcctagaagagctctacgttggtgatttg

SEQ ID NO: 27522 - DNA, 786 bp, Neurospora crassa
gaggcccagaaagagttcacccatttcccccgcagccgtccggccaagaaggagcgcaaggtggccatcctcaagatccccaccaactccacctcgggtcctgccgtcaagcctcccgtcaaggtgatggacccggccgactggcgcaagttcaaactggtgcgcaaggtgttggtgtctcccaacgtctaccacctcgtcttcgccctcccccaccccaccgacgtcctcggtcttcccaccggccagcacgtcgcccttcgcgcgctcatcgacggcaaatcggtctcgcgttcgtacacccccgtctccaacaactcggacctcggccgcgtcgagctgctcatcaaggtctacgaccagggcctcatgaccaagcacctcgagcgcatggaaatcggcgaccagatcgagatgcgcgggcccaagggcgccatgcagtacgtgcccaacagttacgccaaggagattggcatgattgccggcggcacgggtatcacgcccatgtaccagctcatccgcgccatctgcgaggacgagagcgacaagaccaagatctcgctgctgtacgccaacaacaccgaggcggatatcctgctgagggaggagctcgacgggttcgtcaaggcgttcccggacaagctgtcggtgcagtacgtcctcggccaggcggacgagaactggacgggccttagggggttcgtgacggccgatatgatcaaggatttcttacctcctgcggcggataccaccaagatgttgctttgcggacctcctcctatggtg

SEQ ID NO: 27523 - DNA, 776 bp, Neurospora crassa
cgccccgtcaccatcctgggcggtggtgtcctcggccgccgcatagcctgctccttcgtcgccggcggtttcaatgtgcacatccgggatccctctcctcaagcgcgtgaggacgccctcaagtacattgacgagaacaaggaattctacaccaccttctgccccaacggcgagcccgctccgtacggcacctacacggcgtcggcagacatcgagacggcggtgaaggacgcatggctcgtcatcgaggcggtgccggagaagatcgagctcaagattgatacctttgggcagctggacaagtacgcgcccaaggactgtatcctgggatccaactcgagcagtttcaggagcgggttgatgctggacctggtcagcgacgagaggagaaagatggtgtgcaatgtgcactacacaatgccgccgatggtgaggacggtggagttgatgacggatgggtatacccatcaagagatctttccgttcttgagcgacgtgctcaggctgtgcggcatgctcccagcgacggcaaggaaagagtctactgggtgagtaaagtcatccccgatgatgcacttggacttctcaagcacatggcaccactgacacttgccagcttcatcttcaaccgcatttgggctgcggtcaagcgcgaagtcctcaccaccctcgccgagggagtctcggacgccgccgaaattgacgccctctgggctcacatgttccagacctccgtcgtcccctgtcaaatgatggaccgcgttggccttgacacc

SEQ ID NO: 27524 - DNA, 912 bp, Neurospora crassa
ttcaacgtcgatggctgggcctgtctcgtcacgggcggcggcaccggcatcggtctgatgaacgcccaagcgcttgctgccaacggcgctcgcgtgtacattaccgggcggcggtatggggttcttgtgaatgcggccaaggaacatagtcccaaggagggaaatggcaagattattccgtgagtccagtcgcttcctctcctcgcagacttgccaaggaaaaaaacacccccctaacaaatccatgtgtctagcatcggcccctgcgacgtcaccaacaaagagtcacttgaatccctcgtccacaagttctcgtcgctcgaaccgcatctcaacctgcttgtctgcaacgccggcatctcgggccccaaagccgacccgtccgtctcctcgtcggccaaggacattgcccacgaactctggaccaaggaaaacttttccgactggtcgtccgtcttcaccaccaacgtttcgtccgtctattttactaccatcgccttcttgccgctgctccaagcctgcagtgccgcccaccccgagggccacaaccacatggcgggcaacgtgatcgtcatcagctccatgtcgggcatcatgcgcaacgcgcagaaacattttgcctataatgcgtccaagggggcgacggtgcacttgaccaagctgatgtcgaccgagtttgagaagacgggtgtgcgggtgaactcgattgcgcccgggtatttcccgagcgagatgacgacgggggacagcgatgagaagaataagagcgagttgtcggatgacaaggtcaagggacacggacacaaggtgccggcgcagagggcggggcatgatgaggagatggccatggcggtgctgttcttggccaaggaccgctatgtcaacgggagtgtgatttgtgtggatggcggt

SEQ ID NO: 27525 - DNA, 4885 bp, Neurospora crassa
gaggaggcctaccggcgaagcgctgccaacacggttcccaacgaactccaccaccgggcaagtcgtgacgatgatgagaagcccgacgagacaaacccagaactcagcacctcgtcgatatcccaccatggcgatggcgatggcgacggcgcctggggagagcgcgatgtcggcgggcctgtcgacagggaggctgccatgcaggaattccaagagctgcaactaggtctttcacgcttgagcagggagagatcgacagcatcaagaccatcttcacgcccggcttcgagggcctctcgcgcctctcgcgccaccagtggagggagaccagatggcctgttcaagcgcctgtcagttgccgtgagcaacgccatgggcgatggcaaaccccaggaccaggaggattccgacgacgaaggcgataacggagacgtttcgtccagcgagcgtaacagcggcgacgactttcacctcgagcagttcatgcgtgatggccatctcgagaagcgcaacgaagccggcgagtccaccaaaaaggtcggcgtcgtcttcaagaacctcaccgtcaagggcgtcagcaccggcgccacctttgtccgaacccttcccgaagccatcctgggcacctttggccctgatctctaccgcattatcggcaactacatccccgcattgcgcttcggccgccagcccgagcttcgcacgcttctccacaacttcactggtgtcgtccgccatggagagatcatgctcgtccttggtcgtccaggcagcggctgcagcaccttcctcaaggtggccgccaacaaccgcggagattacgctgctgtcgagggtgaagtccactacggtggtatctccgccgaagaagtagccaaaaagtaccgcggcgaagtcgtgtacaatggcgaagacgacatccatctgcccaccctcaccgtcgagcaaacactcaagttctccctctacaacaagaccaagaagcgcctgcgcggcgacatggagcttatcatcaccgctctgctcaagatgttcgccatgtcgcatacccgccacaccatcgtcggtgacgcctacgttcgcggcgtgtcaggcggtgagcgcaagcgtgtctctatccaggagtcgctggccaccaagtcgtctgtcgtctgttgggataactctacccgtggtctcgatgcttcttcggccctcgactatgcccgctccctgcgcatcatgactgacgtcagtgaccgcaccaccatcaccacgctgtaccaagccggcgagggtatctacgagctgatggacaaggtccttgtcattgacgagggcaggatgctctaccagggtccggcgtccaaagccagacagtactttatcgatctcggtttccacgcgccgcctcgccaaaccacccccgactttttgacctccatctgtgaccccaactctcgccagttccgtcccggctggaaagaccgctgccccaaaacggctgaagaactcgaaaaggctttcctcgccagcgaagcttaccaagacgtcctcgccgacgttcgcgactacgaagcctacctccaagaaaccaaccacgccgacacccatgccttcaaggagtctgtcgtgtcgcaaaagtcccgccgtgtctccaaagagtccaactacaccgtctctttcttcaagcaagtcgccgcctgcacgcgccgcgaggcctggctggcttggggcgacaagcaggaactgcggaccaagttcttcatcatcattggctgcgctctggtagtcagctctctgttctacgattcccccttggatacttcgggcgctttcatgagaggcggtaccaccttctacagcatcatcttcctcggctggctccagatgggagagctgatgaaggctgttagtggaagagcggtggtggaaaggcacaaggcgtatgctttttaccgaccatcggctgttaatctcgctcgcgccatcctcgatttccccttgctgctcatccaggtcatcgtcttcagcttgattgtctacttcatgacggggctggaccgcgacccgggcaagttcttcacctacgtcctcttgatcttcacgaccacgtactgtctgaccgccctgtatcgcatgtttgccgctctaagtcccaccatcgacgacgcagtgcggtttgccgggctggctctcaacctgatcgtcatgttctgtggctacgtcatagccaagcccgttatgctcggccagaagatctggttcggctggttgtactatgtcagtcctgtcggctactcgttcgaggccgtcttgaccaatgacttccacggaaggcagatgcagtgctcgccgggtatgttggtgccccagggccctggcgtccagcagcagaatcagggatgtacgctgccgggtggtatgccaggggatgacacggtgaacggtgatgcttatctcgcccagcagttccagtacacgaggggacacttgtggaggaactgggccgtcatcattgccttctctgtactctatctgctggttaccgtgttggcgactgagaagctgtcctttgttggcggtggcggcggcgcgctggtgttcaagaagacttccaaggccaaaaagaacttgactctcggcaaccaaggccagcacgacgaagaaaagggcagctcgagaggctcctctacagacgacatcggcaagaaaacccctcaaggcccatctcgcaaggagatggatggcactatcgaaaagtcccagaaggtcttcacctgggagaatgtcacgtacaccgtccccacgccccaaggccccaagcgcttgttgaataacgtcactggctacgtcaaaccaggcgtcatggtcgcgttgatgggtgcctcgggagccggcaagacgacccttctcaacacgttgtctcagcgccaaaccgttggtgtcgtcactggcgatatgctcgttgacagcaagcccctcggaaccgaatttcagcgcagcaccggctttgtcgagcaaatggacctgcacgatgagtccaccaccatccgtgaagccctcgaattctcggccctcttgcgccaatcccgcgacactccccgggccgaaaagcttgcatacgtggatagcatcatcaacctccttgagctggaagagatccaagacgccatcattgcttccctaggagtcgagcagaagaagcggttgaccattggtgttgagctggccgccaagccttcgctcttgctgttccttgacgagcccaccagtggcttggattcgcagtcggccatgtccatcgtccgcttcctgagaaagttgtgtgcggctgggcaggccatcatttgcaccatccatcagcccagttccgatctgatccaggagtttgacaagatcctggccctgaaccctggcggcaatgtcttctactttggtcccgttggcgaaaacggctcttcggtcgtcaactactttgccgctcggggtgtcgagtgtccgccgggcaagaacgtggccgagttcctcctcgagaccgccgcgaagccgcacaaacgaaagggtgaggacgggaagagcaggaggattgtttgggcgacggagtggaaggagagtgaagagtaccgtcaagtccttaccgagatcagccagatcaagaaagcccgggccttggccaaccaactcaccctcgccaacgaccaagctcagcctgtccagcacgagttcgcagcgcccattcccacgcaggcctggctccttaccaagcgcatgttcatccgccaatggcgcgacccctcgtacctctacggccgtcttttcatctgcttgatcatgggcatcttcaacggcttcacctactggaagatttcgtctccacactattcccgcccgctctccctcaccgacctccaaaacaccctcttcacggccttcctgatcatcatgatccccagcaccgtcctcaacgccgtcctgcccaagttctacatgtcccgctctctttgggaagcgcgcgagcacccgtcccgcatctacggctgggtggcctattgcacggctgagattctctcggagatccctggctcggtcgtggctggcaccatttactttttggcatggtatctccctaccggcttgccccgcggtgctggctccaccgagtcagagtcagcagtctacgtctggctgatgagcgtcgccttcatggtcttcattgctagctggggccagtggatttgcgcttttgctccctctttcaccgtcatcaccaacgtgttgccgttcttccttgtcatcttttcgctgttcaacggcgtcgtggtgccgtgggcacagatgaacgttgcgtggaagtggtggttgtactacatcaacccggcgacgtactggatcggcggcaacatggctgccgtcctgagaggacagactgtccactgcactaataacgagatggctgtgttccgcccgccggtgggagagtcgtgccagagctttgcgggcacttggctgtctgatgtgggcaaggggtacttgacgacaataggagttggtaatgatggcgggtttgagtgtgggtattgtccgtatgcggacggggaggagtacctggccagtctgaatgtgaagtcgagccagatgtggaggaactttggtatctttgcggcgttttgtgtctctaactgggcgtgagtattcccttttttcccttggcaattgttgaaacagaagtgctaacaaagtgatgaacaggctcgtttacttcttcatctacactgtcagagtcaaagggtggtcattcggtttcggctttgtgacaagcgttgtgggggcggtgattagcactgtgaaggagagtgtggagggtctgtttgggaagaaggaggagaaggaagaaaagaagtga

SEQ ID NO: 27526 - DNA, 3350 bp, Neurospora crassa
gctcagaagaagcgcaaggcctctcccgatgtcgaaatggccgatggagctgccgctgccgctcccgtcgcgaatgccgccgccgccgtcactcacccgcaagctcaagccgcccccgcgccgcaaaaagacaacattgacaacaacgacaacaacaacaacaacaccaccaccagcgccgtccagcccacgattcccaacggtgatgccgccgccgctgccgacgatgttcagtcgccacagagcccccatggcctgggcgacaacaagcgcaggaagaagacggacgaggccgagcccatcatgaccgacgccttccaaacggcagagtcccgagaggttaccggcgcgcagggtttcgcgcccaccgagggcgagtccatcgttctctcccacaacattcagcatcaggtcgccctgcctcccgatttggactacgagtatatccccttgtctgaacacaagccccccgccgagcccgcgcgaacatactctttcaagctcgatcccttccaggccctgtccgtcgcctccattgagcgcgaagagagtgtcctggtgtccgcgcatacctctgctggtaagacggtcgttgccgaatatgccattgctcagtgcctcaagaagaaccagagggtcatctacacgagtcccatcaaggctctttccaaccaaaagtacagagatttccaggccgagtttggcgacgtcggtctcatgactggtgacgttaccattaatcccacagccagctgtctcgtcatgaccaccgagattttgcgctccatgttgtaccgtggttccgaaatcatgcgcgaagttgcctgggtcgtctttgatgaaattcattatatgcgcgacaagatcagaggtgtcgtctgggaagagaccatcatcttgctccccgacaaggtcagatacgtcttcctctccgccaccattcccaatgctttccagttcgccgaatggatcgccaagatccatcgtcaagcctgccacgtcgtctacactgatttccgtcccacgcccttacaaaactacttcttccccgctggtggcaagggtatcctcctcattgtcgacgaaaagggcaatttcaaggagaacaacttcaaccaagcaatggccatgatcgaagagaagaagggcaccgattccaacgactggagtgccaaacaaaagggcaagggaaaaaacaaaaagacgaacaagggcggagaggctgctgatgagaaggcggatatcgcaaagatcatcaaaatgattctcaaaaagaacttccagcctgtcatcgtcttcaacttcagcaaaagggagtgcgagcagatggccttggccagttcttctatgaagttcaacgccccagatgaggaaaacatggtcaacaaggtttttgaaaacgctcttgcttcgctgtccgaggacgacaagaacctcccccagatctccaacatccttccccttttgcgcaagggtatcggtgtgcatcactccggcttgttgcccatcctcaaggagaccatcgagattctgttccaggagggtcttatcaaggtccttttcgccacagaaaccttctctattggtctgaacatgcctgccagaaccgttgtctttacccaggtcaccaagtgggatggtcagcaacgccgccctcttacttcctccgagtacatccagatggctggcagagctggtcgtcgtggtctcgatgaccgcggtatcgttatcatgatggttgatgacaagcttgagcccgagacggccagagctatcgttgtcggaaatcaggataagctcaactctgccttccatctcggctacaacatggtcctcaacctgctccgtattgaggccatttcccccgagtacatgctggagaggtgtttcttccaattccagaacgctgcgagcgtaccgcagctcgagcgtgagctcatcagcctgcaacaagaaagggacgccatcatcattcctgacgagagcattgtcaaggattattacggtgtgcgtcaacaactcgaagagtacaacaaggatatggtttttgtcattcagcacccccaaaactgtcttggctttttccaggagggccgtcttattcacatcaagagcccaagtggagtagactatggttggggtgttttgatcaaacacatccagcgacaaaccccgaagaatggccagccaccttatccagagcaagagtcatacgttttggacgttctgttgaaggtatctggcgatttcaaccctaagacccgtggggaggggccgatgcctgagggcattatgcctgccggaaaggatagcaagaatgccaggtgggaggttgtcccctgccttctgaactgtctcagggcccttggccagctgcgtgttttcttgcccaagaggctagagagcgccgacgagaaggatggcgtgggcaaagccgttgacgagatcagccgtcgcttccctgacggcatccctattttggatcctatggagaacatgggcattaacgatgacagctttaagaagctgctccgcaagattgaggtcctcgagtcgcgtttggtggccaaccctcttcacaactctcctctcctagttgaactgtggaatcagtacagcctgaagatgcaacttggcgagcagatcaaggaaaagaagaaggccattgcccgggcccacagcgttgcgcagcttgacgagctcaagtctcgcaagcgtgtccttcgcagactgggcttcatcaacgatgccgaggttgtccagatgaaggcccgtgtcgcgtgcgagatctcctcaacggagggtcatgagcttcttcttgccgagctgctcttcaaccgcttcttcaacgagctgagccctgagatttgcgcctgcattctcagctgcttcatcttcgacgagaagatcgaaacacaggcgctcaaggaggagctggctaagcccttccgtgagattcaggcccaggccaggatcatcgccaaggtcagcgcggaaagtaagctggatgtcaatgaggacgagtacgttcagagtctcaagtggcagcttatggagactgtcctagcttgggctcaaggaaggccgttctccgagatttggtatgtctgcctgtcaacccccaatcccccccccccctgaatcatgtttgctaaccaatttgtaacagcaaaatgaccaacgtctacgaaggctcgctcatccgtctcttccgtcgtctcgaggagcttctccgccaaatggccgaggccgcccgcgtcatgggcagcgaagagctcaaggataaattcgagctcagcttgtctaagatcagacgtgacattgtttctttcaacagtctgtatctgtaa

SEQ ID NO: 27527 - DNA, 1248 bp, Neurospora crassa
tacgtcctcggcgtgggcatgaccaagttcatcaaacccagaggtaaagtggactataccgagcttggttttgaggctggtgtcaaggccatgctcgatgcgcagatttcctatgacgatgttgagcagggtatcgcctgttactgctacggcgactcgacatgtggtcagcgcgtcttctaccagttcggcatgactcagatccccatctacaacgtcaacaacaactgctcgactggctcgacaggtctggccatgggccgtaatttcatctcgagtggggcggccgattgtgtattggtggtgggcttcgaaaagatgcaggctggtagtttgcagagccatttcaacgacagagagaaccctctcggaacgacatataagatgatggccaccaccaggggagttaccaaggcacctggtgccgctcagatgtttggtaatgccggccgagagtatatggagaagtaggccaaatctcatataatatcagtgtaatgttacagaaaaaggcataatgactgacctcattccttctctcataggtacggcgccaagcccgaggactttgccgagatcgctcgtattaatcacgcccactccgtcaacaacccatactcgcagttccaggacgtatacacccttgaccagattatgcagtcacccaaggtccacgagccattgacgaagcttcagtgctgcccaacttctgatggtggcgcggcagcagtcttggtttcacaggagttcctggacgcccgccctcacctcaaggaccaagccatcctcattgccggtcaatgcctggccactgatgcgcccagcctgttctcaaagagcgccattgacttgatgggttgggacatgacccagcacgctgcgcgtgttgccatgaaggaggccggtgtcaagcccagtgacttcgctgtatgcgaacttcacgactgcttcagtgccaacgagatgatcttgattgacgctctgggtttctccgagcccggcaaggcgcacgagtttgtgcgcgccggtaatatcacatatggtggcaaggtcgtcgtcaaccccagtggaggtctcatctccaagggccaccctctaggcgccactggtattgctcagtgcgccgagttggtatggcacctccgaggatgggccaacaaccgcaatgtgcctcacaccaaatacgcgctccagcacaaccttggacttggtggtgccgctgttgtcaccgtctacaagcgcgccgac

SEQ ID NO: 27528 - DNA, 4287 bp, Neurospora crassa
atgtttgacgagctgaccttcaaacctgcctgcgatgatcgacttattgttaggtattcgccaaataccggtgccgtgactgccgctacgccgcctcgtctggttgcagagatcacctcgccctcctttctggattatgacctcgtgtctgacttcttcctcacgtatcgacagtttctcgattctcacgacttgctttccatgctgttcgcgcgccttcgatgggctttggcaagagagggtgacttggggacggtggtgcgtgttcgtacttttgtagccctccgacactggattctcaactacttcatggacgatttcgtggtcgactacgacttgcgcgtttctttctgtaacctcttgaacgatgtggtcgacgagtgggctgaggtatccaaggcgcacaagatagagatgaagactctacctgagctcaagaagtgctggaggagaatctgttcgcaattctgggatgggcctgacttcgacgcttccttggcagccgatattcccatcaccccaggaggtatcgcaggccatcgtgacccaaacttgactcccagcttctgggtcaaatacgacaaaggtccgccccagttggacgagctaaatgtcccgacgacccctcgcggaccaacgagcttctacgctgagatcgcgaaggctggacatatcgactccattattgtgggtgaaaggccagggactcccgaaaacccagagatcgatgaacctcagaggaatcaggcctcgccaaccagcgtcacaagcgtcgaggttgtatcgtgctcattcccgattaagagttcgcgacatacgcaagtagcatccaaccgtccgttgactgctcacccagcggaccccagctccgtatacaataccaccgaaggcatagcgactactcctcgctcccttacaggcaaacgtgtccgacctcagcactcttcgcacaagcggaacaacagcttgagtgattctcttcatgatcacgccactttgacggaaagggttttgtacaaaaatgccgagttccttttgacgctgccatatgcgggaagccttatccaaggtaacatctttccgcctgggcaagcctttgttgaggtacgtccaaatagtgccatgggcgacccttccggccagaccactgtctttcaaccggtagaggtgcggaaggataagttcatagggtcggccatgtccagccatggaatgaagaagctgcttggaagcgtccggcgcgcgttgagccacaagacgtcaacacatccatccaatcaaacaatgttggccaacatctcgcccatcgggccagagggcgcaacaacgaaccggcctccagggacagcagtcgtaccgcaatcaaaagctcgccagaacggagtccgaccacctgtgcgtattgatctgctcggcgctggagtcgcggaggactttaagaaagcgatacgcgaagatgctgctgtggaagccgaaaaactcgaatacgctgttcctccggcaactggaaacgaagaagccaaaagtcacgggaacgcgatggaatattcggctgcacacatggacacggcgtttaaccttcgcagtgttgaagatgtacaacataggagcgatatggggatatcatctggcagcgactcgattgtcattgtcgatggtaccacccttcaacctgtaatgtccggagcgttgccagctgccagttcatcggcatcattttcgcattcgttcatcccaatcactgcggatccaacgccaccaaatacgccgccagatctacaacagggaacaccaagaacgtcttcatacatcctgggccaacaagtccttcgcaactcggtctcgaccaatcaggcgtcgccgattatacttgactctactcctagagaaggggaagacctcccatcagacgatttcggtcagccatctattgatcatgtcatgcaagactttgatcagaccccccggagcgggctgcatgggcacttcagaaatctttcaagcagatcacagcattcaacttggtcggcaaggcatggacgattcgcgtcatatactagcgatattatgccacagccaaccgttaggagcttcgatgctacgacatattcggaggagtccgtggctgatgactcgtcccaagtcctcattccgcagccgcttcgaattctaagaaggaggccaggaggtgaccttcgtgctgtgaccaatgttggcgatctggatcatccaccgctgagaacatcccgctcggtcggatccctgacaacgtacactgactcgttcgcaagttcgttcatacgaagtccagcccatcaagactccagtagcttcgtggatgttaacaatcggccagaaatgttttctctcggagcactcgctgagcaaaacccgaaaaaacgtcatctgtccctcttcagcactcattcatcgaagccggtgatgcgcccatcattcgaggctgaggcgatcaaattggcgcagattcctgacgatgaagaggatggcggtgtcgaggccgcacttctcaagttggaaggaaaatacgaaagaaagtcaactattcgcttgtccatggacctacctaaattcaaggccgaacagaataccaatccccttccgacgcagcctgaggaggtcacaggagaggagaggatggaacaacgacacatacgcgctgccgggaagaatatctatatgccaccttcacctacgacacctgcaccaatggatatagctgacagctatctggacgtcactccccgtcagcaccggattaccaatgccgaatccttcatttctgctacttccagggactcctacaattcgagccctctgctggagcaggaaatgatggataattatggtgtcaaccaggataccctgcaatcatggaccgatcgttccatcctgcagcctccttcctctgatgagcagagtgtacaaagctcccaacacccttctatagcttcgtttgactttgtggagaaagcggacagcatggagcccgtcaaggttgacgacgcaatacccactgcagagccagaacagtctttcctgacattggaaagtgaagatgacacagacctgtcttcggaaatgtctgcagaaccattcgatgcgagtgttgacgactacggagtcattaccccttcggccgttggtgttgccatctcgacagagcccgcacattccctggctgaaaatcaattcggccccaacccgccctccccacccacaatcatgattcaagcacttcagatgcttccggatatggccaaaggttccgcatcccagcagcagggaggatggcacacgaagcctttgccaccaacgcccgatactactccgaccacaacagctgctccttatggccagtatcaacattcctttcccgtacagccaactgcttcgaagggcacgcctcgtgataaacgccagcttgatgtaccctcgcccttgcccgaagctagcgatgttaccgaagcgtccgatagcagactctcggcccatttgcctttcattctggcattcgacagcgagatcttagctcagcagtttacactgatcgagaaagatgcgctgaacgaaatcgactggagagaactgattgacatgaggtggaagaatgctgagcagaagggctgtgacgcgcgcagctgggtttcatttttgagggatacggatgcgcatggcgtcgaggttgtgattgcccgtttcaatatcatggtgaaatgggccatttccgagattgtcctaactcgcgacatcgaggaaagggctcgttgcatcatcaagctcatccacatcgcagcacattgtcgacgcttccgcaactttgcaaccatggcacagttgaccattgcgctgatgagcaatgagattggccgtctaaacaagacatgggcgatggttccctccagcgaccagcgaacaatgcaagagttggagacgttgatgtcgcctacgaggaatttttataacctgcgcaaagagatggagggcggtgattcgaagacggctgatgagggatgtattccctttgtgggaatttacacacacgacctcctcttcaacgcccagcgaccgagcgagattgcgagctctcccaccactgcacctttggtgaactttgagcgttgcaggatcgcggccggggtggtcaagacgctgctgaggcttctcgaagcgagcaaccggtactctttccagcctattgagggcattactgagcgctgcttgtggatgggcgctttggatgatgacgagattcgaaggctgggtgag

SEQ ID NO: 27529 - DNA, 1810 bp, Neurospora crassa
caatggattcttgactacctctcctccatgggctttacccagccgactcccgttcaaaagtcatgccttgagctcttccgtggaaataaagatgttgtcgtcgaggccgtaacaggcagtggaaagacacttgcctttttgattccggtagttgaggtaagccggatctcttgctgtctaccagctcaggatgatcatatgctaaccgattctgcaacagaaactcctgcgcggcgaagaaccagccaagcgaaaccatgtccaaggcattatcatctcgcccacccgcgaacttgcaacccagatttacaatgtcctcgtttccctcgtcaagtttcacgaaccctccgctgaagccatttcccacgccaaaagcgacgagaagcgcccaacagcaacccagcctgtcgttgtcccccaactacttgtcggaggcaccaccaaggctgctgaggatctcggtacattccttcgtctttccccgaatctcctaattggcactcccggccgtcttgccgaactcttgtcgagcgcatacgtcaaggctcccgcgtctacatttgaggttctcattatggatgaggccgatcgccttctcgatatgggtttcgcgaacgagctcaaccgcattctcggatatcttccgaagcagcgccgtactggtcttttcagtgcttcgctcagtgacgccgttgaaaggctgattacagttggtctattgtacccacacaagatcaccgtcagagtgaagagtctgaaggacggtggcataattcaagagaggaaaacaccaatgtctctacagatgagctaccttgttaccccagccagccagaaaatgccagcaattgtccagctcctcgaaaagctcgagcccaggccccagcgatccatcatcttcttctcttcatgcatggccgtcaagtacttcagccgcattctcggcgccgtcctgcccgccggtttttccgtcacctccctgcacggcaaactcgaacctaaagtccgcgaaaagaactatgagcgtttcgtcaacaccacctcgcccatggtcctcctcaccaccgatcttgccgcccgcggtcttgatatcccccaagtcgacctcgttatccagcacgacccgcccacggacaccaaggttttcattcaccgctgcggtcgtgccggccgtgccggtcgtcggggtctcgccgtcgttctgctccagccgggtcgcgaggaaggctacgtacagcttcttgaagtccgtcaaactcccatcacgcccctggagaagcccgccatttccgtcacccctgatgaagtcgagcgcgtctccgccgccttccgatcgcaagccctcgccgaccgcgagatcttccagatggcccagctcgctttcgtttcctggacgcgctcctacatcgaacaccaagcttcttccatcttccgcatcgccgacctcgactggctcgacctagccaagggctacggccttctcgagctgcccaagatgcccgaagtccgcgaagccaagatcgaccgctctctgggtctgggcatcaacacggaagaaattcctttcaaggacaaggtgcgcgagaaaaagcgtcaggaagagctggccaagtggaaggaggagaaggcaaagcgggcacaggaagagaatacgggcgacaagcgcaagaagaacgaggcgtggagcggcaaggcggaacaggaggagacgaaactgcagaggcgcgagaagaagaggagaaagagggaggccaagaaattcagcgagatgacggagaaagagaaggaggagcatctcaagctggagcag

SEQ ID NO: 27530 - DNA, 2572 bp, Neurospora crassa
caaaccccacaaggaggagctggtctccccggtcgtcccgtccaacaagcagccggaggcggatacggcggcggcgcaacaccaaccaactacggcagcccaggtggtcgcgctccctctcagccccaatactctggcagcggcgctggaggatatggaggtgcgccatctgaaaagagctatggcggcggcggtggcggtggttacggcggacagcccgctcctggcggatacccttctcagccagccggtcgcggtgtcccccttcggctcgcaaaggtggatgacaagacgttgcagagtctctacatctttggcaacatgtgagttccctgcgctacccatggtcagtctatccaatccaaagttgttaacctcgtactttagttgcgccgtatcgcccaatgatttccccccgaaccacgatggcaccgatctatacatccgcttgacaggaagacagctacgaggagattacgtggtgacggcacgccccacccccggcttccgtccgggtcacatcagcttgtcagacccccagcgaacatggtgcggagttggcatgatggacgagttgatgggagaggtctacgatccctttgcccgtggaggcgacgcctacattggctccatggatgttgagatcggatttgcgtcaaccaaccgaatcgtcgataccccctatgaccaggatgagctggccaaagtgttcctcaagactttccagaaccaggtctttgctcctggtcagaggttcctgcttgacgtcaagaacatccctttggctgtcatggtcaagacggtcactctggttgacctgaccatgctgggatcgggcgaggctcccacacgcagtgaccctggagcacgcggtattctcaccaaccaggccagcattggcttctacaaggatgccaggtcacccatcaagctcaagggctccaacaagcgcccagcggccaacgccatcatcgccccagacttcaagttcgagaatatgggcattggtggtctggataccgagttctccaccatcttccgtcgtgcctttgcctctcgtatcttccctcccggactcatcgagaaacttggcatcatgcacgtcaagggtatgctgctgtatggtcctcccggtaccggaaagaccctgattgccagacagatcggcaagatgctcaacgccagggaacccaaggtcatcaacggtcctgaagtgctgaacaagtacgttggtcagtctgaagagaacatccgtaagctcttcgccgatgccgagaaggagtacaaggagaagggagacgagtccggcttgcacattatcatcttcgatgagttggatgctgtgtgcaagcagagaggttcgggtgctggtggtggtaccggcgtcggagacagtgttgtcaaccagctgctctccaagcttgacggtgtcgaccagctcaacaacatcctccttatcggaatgaccaaccgtaaggacatgatcgacgatgccctgcttcgtcctggtcgtctcgaggttcaaatcgagatctcgcttcccgacgagcatggccgtggccagattctcaagatccacacctccaagatgaaggagaacaaggtcatggctgacgacgttgacctcgctgagcttgccactcttacaaagaacttttctggtgccgagttgagcggtctcgtcaaatccgctacctcgtacgccttctcccgacacatcaaagtcggcaccatggctggcgtttcagaggacgtggccaacatgaaggtcaaccgccaggatttcctcaacgccctcgacgaagtcaagcccgccttcggcgccgacgagtccgagcttgagaagcacctggcttacggcgtcatccactattccaagagtatcacgtcgatcctggaagacggtctgctctacgtcaataacgtgcgcaagctcgagcgcctcaagcacatgaccgtcctccttcacggcccttcggcctctggaaagacggctttggccgcccatatcgccatgaagtccgacttccccttcatcaagttcatcacccccaccgacatggtcggcttccgcgacgaggtggccaagaaggattacatgcacaagatcttcaccgacgcctacaagtccccgctctccctcctcattattgacaacatcgagcgcattatcgaatggaaccccgtcggcccgcgcctgtccaacaccatcctccaggccctcgtcacccttttggttactcctccacctaagggccaccgtctcttgattctcgccacgacttcgcagcgtaccgtcatggaacagttggacgtcactgagtcgtttgactaccagattgccgttcccgctgtgaacaacctccaggagttgggcgcagtgttgaacgaggtgggagcgtttggtggcgaccaggcggctgtcagtgaggtgttgaataccctacgcgagtataccgggtcggatagcgtgggtgtgggtgtcaggacgatcctgacgattgcggagagcgcggacacgagtcctgatccgaagggatggttcgtggagaagatggccgggttgattgct

SEQ ID NO: 27531 - DNA, 1204 bp, Neurospora crassa
aacagctacattgagggtatcgtccgtggatacaggaacagcctgttgacgagcaccaactataccaacatgacgcaatgcgagtcgattgatggtgagcctctctctcccatctccatccccgacccatttcacctccatccacatcgccctaacaacattgcccacagaccttaaactccaactcggacctgcatacggcgacttcctcgcctctctcccgcccaagccttcgacctccgctctcgctgccaagaccaccgacaagctggtctccgagttccgctatgtccgcgccaacgcggccggctccctggccaagttcatggactacctcacctacggctacatgatcgacaacgtcgccctgctcatcacgggcacccttcacgagcgcgacacgcgcgagctgctcgagcgctgccacccgctcggctggttcgagaccatgcccgtcctctgcgtggccaccaacattgaggagctgtacaacagcgtcatgatcgagaccccactggccccgtactttaagagcagcctgtcgctccaggacctggacgagctcaacatcgagattgtgcgcaacacgctttacaagaactacctcgaggacttttaccacttcgtcaacacccaccccgatatggccgggaccccgactgccgaggtgatgtcggagttgctggagtttgaggcggataggcgggctatcaacatcactcttaactcgttcggcaccgagctgtccaaggcggaccgtaagaagctctatcctaactttgggcagctgtacccggaggggacgctcatgttgtcgcgggcagatgactttgagggtgtgaggctcgctgttgagggtgtggctgattacaagtcgttcttcgatgctgctggcctcggaggcggtcccagcggtcccggtaacatgggcggtggcggaactgagggcaagagtctggaggacatgttctaccagaaggagatggagatctccaagatggcgttcacgaggcagttcacctatgccatagtgtatgcgtgggtcaagttgagagagcaggtgagattagggttcccctgtgttgttcgttgagcatctgttgactaatgtgacatttaggaaatccgcaatatcacttggatcgccgagtgcatagcgcagaaccagaaggagaggatcaacaactacatcagcgttttctaa

SEQ ID NO: 27532 - DNA, 648 bp, Neurospora crassa
aagaaggtggtggtcgtgggcgatggcggttgcggaaagacatgtctcctgatcagttatagtcagggatacttcccagaggtatgacgtcccacccctacaaaggtatcgcttgggttggcgctaaccgtgattaatttcgcaaacagaaatatgtcccaaccgtctttgagaactacatcacctacccaacgcatccaccgaccggtaagaccgtcgagctcgccctgtgggataccgccggccaagaggaatacgaccgcttgcgaccgctttcatacccagaaaccgaccttatttttgtctgcttcgccattgactgccccaactccctcgagaatgtcatggacaaggtgagtcttcataccgtcttttacccttcctttcacctacgctcatgctaacacaccttcccagtggtaccccgaagtcctccacttctgtccgtatacaccccttatcctcgtcggcctcaagtccgacctccgcaataagaagacgtgcatcgacatgctcaagacacaaggtctcacccccgtcaccaccgaacaaggactcgccgtcgctaagaagatgggcgctcagtacatggagtgctcatcaaaggagatgaagggtgtagaggagatttttgagcaggccatcctc

SEQ ID NO: 27533 - DNA, 1498 bp, Neurospora crassa
ttcataaacaacgagttcgtcgagggtgtcgacaagaagaccttcgaggtcatcaaccccgccaccgaggaggtcatctgctccgtccacgaggccaccgagaaggatgtcgatatcgctgtcgccgctgcccgcaaggctttcgagggtgtctggcgcgacgtcactccccagcagcgtggcatctacctcctcaagctcgccgacctgctcgagaagaacctcgacctccttgccgctgtcgagtctctcgacaatggcaagtccatcaccatggcccgtggcgatgtgggcgccgtcgttggcactatccgctactacggcggttgggccgacaagatcgagggcaagaccattgatatctcccccgactccttccactacaccaggcaagagcctctcggtgtttgcggtcagatcatcccctggaacttccctctcctcatgcttgcctggaaggtcggccccgccctggccaccggtaacactatcgtcatgaagaccgctgaacagacgcctctctctgctctcgtctttgctcagttcgtcaaggaggccggtttccctcctggcgttctcaacatcatctccggtttcggcagaattgctggtgccgccatggcctcccacatggacattgacaaggttgccttcaccggctctaccatggtcggccgccaaatcatgaaggctgccgccgagtccaacctgaagaaggttaccctcgagcttggtggcaagtcccccaacattatcttcaacgacgccgatatcgaccaggccattgattgggtcaacttcggtatctacttcaaccacggccagacctgctgcgctggttctcgtgtatacgtccaggagggtatctatgacaagtttgtggcggccttcaagcagcgcgcccagcagaacaaggtcggcgaccccttccacgacgagaccttccagggcccccaggtcagccagctccagtacgaccgcatcatgggttacatcaaggccggtaaggaggagggtgctaccgtcgagactggtggtgagcgccacggtgacaagggctacttcatccagcccaccattttcaccaacgtccgtcacgacatgaagatcatgaaggaggaaattttcggccccgtctgcgccgtcgccaagttctccaccgaggaggaggttatcaagctcggcaacgactccaactacggccttgctgctgccgtccacaccaaggacctcaacactgccatccgcgtcagcaaccaccttagggctggtaccgtctgggtcaacacctgtaagtatacctgctttgtattggaaggagtaacgtttcatcgtgctaaccaaaatttgttccaacagacaacgctcttcaccaccagcttcccttcggcggttacaaggagtccggtatcggtcgcgagctcggcgaggctgctctggccaactacacccagtgcaagtctgttgctatcaagctcaactagacaatccaagtgta

SEQ ID NO: 27534 - DNA, 1430 bp, Neurospora crassa
atgtccacgattccaaagccgggtccggctaatcttcgtcccggagccggtctagatgagtggctggaggaggcgaaacaatgtcattaccttcctgagcctgtcatgaagcagctctgcgaaattgtcaaggaagttcttatggaaggtacttgagcaccaactactagtcaggattacacatgcccgcgcgcgcgcgcgcgttcgcatcccgtgttcccaaggcgcgcacgacaagggaacttgtccagctgacttgtgtccccacgtcatcagaatcgaacatccagcctgttgttacgccagtcaccatctgcggtgatattcacggccaattctacgatctcctcgaactctttcgcgttgctggtggcatgcccggtgagacaaacgtccaggcgcccaagaccgcaacaaccgtcatcacatccgaggacatcgagcccccaacggaaatcacagatcccaacctcaagaagaagatcaagagcagtacagacagtgaggctggggctggaagcgagaaggaatccccaagtgaagagaccccccaatccagcgccaacacgggctctcaatcggccgatactcgcttcgtcttcctcggagatttcgtggatagagggtacttcagtttagagacatttacccttctcatgtgtctcaaggcaaagtacgaaggccccccgttctagttctggttcggttcacgctgctgacacttttcgcccaacagatacccagatcgcattgttctagtgcgcggtaatcacgagtcccgacaaatcacccaggtctacggtttctacgaggagtgccagcaaaagtacggcaacgcctctgtctggaaggcttgctgccaagtgtttgactttcttgttcttgccgccattgtcgacggtaccgttctctgcgtccacggcggtctcagtcccgagatccgcacgattgaccagatccgcgtcgttgcgcgtgctcaggagattccgcacgagggtgctttctgcgatcttgtgtggagtgacccagaagacgtcgatacatgggctgtcagtccacgtggcgctggttggctgttcggagacaaggtcgcgacagagttcaaccacgtcaacggtttgacaaccattgcaagagcgcatcagctggtaaatgagggttacaaggtgggtcatcactttttgttgctctccacagttatgagaaggaatgccagctaacctgcgtttctcatctagttccactttgccgaaaagtcggtcgtaaccgtatggtcggcacccaactactgttaccgttgcggtaacgtcgcatccatcatgacggtggaccgcgaccaaaacacaaagttcagcatcttctcggccgtgccagacgatcaacggcatatccccgcaggccgaagggggctgggtgactacttcctatga

SEQ ID NO: 27535 - DNA, 2875 bp, Neurospora crassa
atggcgccgaaacaggacacgccgttccgctcggcggacatgagcatggtccagctctacatctccaacgaaatcggccgcgaagtctgcaatgccctgggcgagctggggcttgtccacttcagagacgtaatgccacccgagtcccttccctgcctgtacagcatcacgagaacccaccagcaacgtcaacaaacaataacatcaacatcagccagtcactaacaatatgtgccgctatagctcaactcggaactcagtgctttccagagagcatttacccaagacattagacgcctcgacaatgtcgaacgccaactgcgtatgtcccctcttctcgaagccaccacttggcatcctggctaactggcgtgtgccaaggctacttccactcccagatggaaaaggctgggatccctctccgcaaattcgaccccgacgtagacatcctcaccccgcccaccaccaccgagatcgacgaactcgccgagcgtgcccagaccctggagcagcgcgtctcttctcttaacgagagctacgaaacattgaagaagcgcgaggtcgagctgacggaatggagatgggtcctgcgcgaggctggcggcttctttgaccgcgcccacggcaacgtcgaggagattagggcgtccaccgacaacgatgacgcccctctgctgcaggatgtcgagcagcacaacacggccgccgatgtcgagcgttccttttctggcatgaacattggtttcgtcgccggcgtcatcggcagagaccgcgtcgatgcctttgagcgcatcctctggcgtaccctccgcggtaacctttacatgaaccaggccgagattcccgagcctttgatcgatcccaccatcaacgagcccgttctcaagaacgtcttcgtcatctttgcccacggcaaggagattctcgccaagatccgccgcatttccgaatccatgggcgccgaggtgtacaatgtcgatgagcacagcgatctgcgccgcgatcaggtccacgaggtcaacgctagacttgaagatgtccaaaacgtccttcgcaacacccagcagacgctcgaggctgagcttgcacagatctcccagtcactttcggcttggatgattaccatcagcaaggagaaggctgtttacaacaccctcaacctcttctcatacgaccgggcccgccggactttgattgccgagggttggtgtcctaccaacgacctgccgctcatcaggtctactctgcaggatgtcaacaaccgggctggtctttcggtcccgtccattatcaacgagatccggaccaacaagacccctcctacgtatctcaagaccaacaagtttaccgaggctttccagaccatcgtcaacgcctacggtactgctacctaccaggaagtcaaccctgccattccggtcattgtcactttccccttcctctttgctgtcatgttcggtgactttggtcatgccctcatcatgctttgcgccgcccttgccatgatctactgggagaagcccttgaagaaggtcacgtttgagctcttcgccatggtcttctacggtcgttacattgtgttggtcatggctgttttctctgtctacaccggtcttatctacaatgatgtattctccaagtccatgaccctctttgacagtcagtggaagtgggttgtaccggaaaactttaaggaagggatgacggttaaggccgtgctccgcgaacccaacggttaccgctatccctttggtctcgattggcgttggcacgggaccgagaacgagttgctcttcatcaacagttacaagatgaagatggctatcattctgggttgggcgcacatgacgtactcgctgtgcttctcatacattaacgcccgccacttcaagaggccgatcgatatctggggtaactttgtcccgggtatgatcttcttccagtctatctttggctatctcgtcctctgcattatctacaagtggtccgtcgactggtttggcaccggtaggcagccgcctggactcttgaacatgttgatctacatgttcttgcagcctggtacgcttgacggtggggtcgaactctaccctggccaggctacagttcaggttattctcctgttgctggctgtcatccaggttcctatcctactcttcctcaagccgttctatcttcgctgggagaacaaccgggcgcgcgccaagggctatcgcggtattggcgagcggtctcgtgttagtgccctggacgaagatgatgaggaggaccctagcaacggtgacgactatgagggcgcggccatgcttacccacgatgagcatggtgatggtgaacatgaggagtttgagtttggtgaagtgatgattcaccaggttattcataccattggtgagttttcttttttccgttcgtccgggatctgtcaaagatgacgtgctaacaacaggacagaattctgcctcaactcggtctcgcacacggcttcctacctccgtctctgggctctttcgctggcgcatcagcagctttcggctgtgctctggtccatgaccatggcgaaggcgctggaatccaagggtcttggcggtgccatcttccttgtggttgcgtttgccatgttctttgtcctcagtgtcatcattttgattatcatggagggtgtctctgctatggtaagtgttccgttgctaatgtgaatgtatgggaagtcatttgctaacgaagattaaaacgatagcttcactcgttgcgtctcgcgtgggtcgagtccttctccaagtttgccgagtttggcggatggccgttcacgccgttctcgttcaagcaacagcttgaagagtcggaggagctcaaggagtacataggttgatga

SEQ ID NO: 27536 - DNA, 381 bp, Neurospora crassa
gtagcccaactcctctacggccacggcgacctcaagaaccccctgcccgaaaccgtgcgcgtgctcgacgagctcatcaccgacttcatccagggcgtcggcttcgaagccacgcgcgccgcccaccacgccggccgacaaaaagtcaagtttgaagatttcgagtttgccatgcgccggaacccgcggttcatgggcaagatccaggaggtgtttgagaagaaaaaagagatcgaggcggcgcgcaagaatttcaacattgaggatcagttgatgaaggatgcggataaggaggagaaggagaaggaaaagaaggggggtagtgctgacaaaggagacaaggagaagggggagaaaggggagaaagagaaagaaaaggga

SEQ ID NO: 27537 - DNA, 1881 bp, Neurospora crassa
atgtccgacatagaaaaagggtcagcgggctcccacgacaaggagacccgcgtcgacgcggccactcttcccgcctatgaggccggcagcgtcgccgaggcgcaacaggaggacttcatgacgcgcaacggtctcaacctcgcctccttcaagccccgccggttccacacgggcgacggcaccgagatcgagcgcaccatgaagtcccgccacctgcacatgatcgccattggcggctccatcggcgccggtttctttgtcgggtccggcaaggcgctgcacaacggcgggccggcgtcgctgctgattgatttcgccatcatcggcgtcatgatgttcaacgtcgtgtacgccctgggtgagctggctgtcatgtttcctgttaccggtggcttctacacctactcgactcgctttatcgatccgtcttggggtttcgccatgggttggaactatgttttccagtgggcgattgtcttgcctctggaacttaccgtttgcgggtttacggtcgggtactggaatcaggacataagtgttggtacgtaaacatactcattttggtccgtttataacaagaaagatactgaccgtaaaaacagccgtctggatcaccatcttcctcgtcgccatcatcatcatcaacgtcttcggcaccctcggctacgccgaagaggaattctgggcttcggcattcaagctcggcgccaccattgtcttcctcatcatctgcctcgtcatggtcctcggcggcggtcccaaaggcagccgctacgaccactacaccggtgccgccctgtggtactcccccggcgccttcgccaacggctttagggggttctgctcctgcttcgtcactgcggcttttgccttttcgggcaccgaactcgtcggtctcgctgctgccgaggccaaaaaccccgtcaagtcccttcccggcgccatcaagcaagtcttttggcgcatcaccctcttttacatcctcggtctcttcttcgtcggcttgctcatcccctatgacgacgagaacctgttgggcgctaacccgttcatcaacgtcaacgcctccccctttgtgctggtgggcaagtacgcgaacctgacgggcttcgactcgttcatgaatgtggttattctggtgtcggtcctctcgctcggtgtctcgtgcgtctatggtggctcgcgcaccttgactgccctcgctcagcaggggtacgcgcccaagatctttacgtacgttgatcgttccaaccgcccgctgttctcggtcctgctcattattgcgtttggccccctggcgtatgtcaacttggcggctgctggtccgaccgtgttcgattggttgctttcgctttccgggctggcggcgctgttcacgtggggatcgatttgcttgagccatattcgctttcgcaaggcgtgggcgctcaagggacatagtgtggaggagatcccgttccgggctgcgggcggtgtgtggggatcgtggctggggttggtgttggttgttttggtgttgattgctcaggtatgtgcctttttttttttttttttttttttctgtcgctcgcttcgctcgatttatatctcgtgacaaggtgctaacaagtgcatcaacagttctacgtagccatctgcccacccggcggcggcttcaacacggtcgagggcttcttcgtgcagtacctcgccttgcccgtcgtcatcgtcttctggatcggtggattcatctggaagcgcacgagctggctccgcgttgatcagatcgatgttgacacgggccgtcgcgaacatgattgggagtcgattaatgcgtaccaagctgagttggctgctatgcctgcttggaagaggtggttccataagttgtttgtctgaaag

SEQ ID NO: 27538 - DNA, 1130 bp, Neurospora crassa
atgtcgaccatgggccctgccaccgtccaccccgagacccacgtcggtttcgacagcatcacctcccagattgagcgcaagctgctcaagcgcggcttccagttcaatgtcatctgcgttggtacgtctacctctccattctctgccatcaacctatgcccacgcaactaacaccgcttccacccaggccaaaccggcctcggcaagtcgaccctcatcaacaccatcttcgcttcccacctcatcgactccaagggccgcctccaacccgacgagaccgtccgctccaccaccgagatccagtccgtctcccacatcatcgaggagaatggcgtccgtctccgcctcaacattgtcgacacccccggctacggcgacatgatcaacaacgaccgctgctgggatcccattgtcaagtacatcaaggaccagcactctgcctacctccgcaaggagctcactgcccagcgtgagcgctacatccaggacacccgcatccactgctgcctcttcttcatccagccctcgggccactcgctcaagcccatcgacattgtcgtcctcaagaagctgtcggatgtcgtcaacgtggtgcccgtgattgccaagtcggactcccttacgctggaagaacgccaggccttcaaggagcgcatcaaggaggagtttgccttccacaacctcaagatgtacccctacgacaacgacgagcttgacgaggaggagcgctccctgaaccagcaaatcaaggtgggcttttgtacttgccccagaaagtaacaatagctaacgtgacacagagcctcattcccttcgctgttgttggttccgaaaagagcatcgtggtcaacggcaagcaggtccgcggtcgccagaaccgctggggcgtgatcaacgtggaggacgagaaccactgcgaattcatctacctccgaaacttcctcctccgcacccacctccaggacctcatcgagaccacatcccagatccactacgaaaccttccgtgccaagcagctattggccctcaaggaaagcagtgcgcagggacacagcagcaggccaatcagcccggctgcggatcgcgagatgagccgcaactctcaacgcatgaccatgaacggctactag

SEQ ID NO: 27539 - DNA, 3516 bp, Neurospora crassa
atgaccaagacggagcctgataaggctgctgctggcgaccatgtctctggccaaagcaacaaacccctttcccgacctgcccacgccttgacccatcaagatctcgcccacgagattggagccgaccccctctccggtctcacccccgacgaagccaagcgtcggcttgaggaatatgggaaaaacgaactgggcgaggctgaaggtgtccagcccatcaagatcatcattgctcagattgccaatgccatgacgttggtatgttttcctttcccttcttcttcttcttctttgttccttttccttttctgtgacagcaactgacaacaaacaggtcctcatcctggccatggccgtctcctttggtattaaatcctggatcgaaggcggtgtcgttgccttcgtcatcggcctcaacgtcgtcgtcggtttcttccaagagtactctgccgaaaaaaccatggacagtctacgctctctttcctctcccaccgccaccgtcgtccgcggcggcgaggccatggtcgtcccctctggtgaaattgtccccggtgatctagttgaagtcaaaatgggcgatactctgccggctgatatcaggtaacctgttgaccattctctccactacccgcctttgcaatggctgatcaggttcttctttggataaacaggttgatcgaagccaaaaactttgaaaccgacgaagctctcctaaccggcgaatcccttcccgttcgcaagacggttgagtctactttcgacgacaccaccggccctggcgaccgtctcaacgtcgcctactcctcctccaccgtcaccaagggaagagcaaagggtatcgtttttgctaccggcacgtttaccgaaatcggcgccatcgcctctgctctcaacaagaaagactccaaggtccgtcccgtcaagcgcaagcccaatggccacgctggtccccatcgttatctggaggcgtacactttgactcttggagacgccctcggtcggtttttgggtgtcaacgtcggcactccgctgcagaggaagctgtcgaagctggctatgttgctctttggcatcgcggttatctgcgccatcatcgtcttgggagcgaacaagttcaacacccgtcaggaagttatcatttacgccgtggccacaggcctgtcgatgattccggcgagtttggtggtggtgttgacaatcaccatggcggctggcaccaagaggatggtggaacggaacgtcattgtgcgcaacctcaagtctttggaagccctgggcgccgtgacggacatttgctcggacaagactggcacgcttactcaaggaaaaatggtagcgagaggtgcttggatcccgggaatgggcacttataccgtcgaactgggtgatgagccggtgaatcctaccaagggcgacatccgctttgcgaagcagatgccgtcggaggttgatttcaagtcgaccaacgctgaaaagagctctaccggccctgttacggcccctggagagctcttgacatccagcaccacccgtctccaagacttcctctccgtctgctcccttgccaaccttgccaccgtcttctccaaggaatccgaagaaacgcccggcaccgaacaatggcacgcgcgcggcgacccgaccgaaatcgccatccaggtgtttgcttcccgcttcgactttaaccgtctccgtcttgtctccggttccaatcccgaatggcaagaagtcgccgaattcccgttcgattcggacgttaagcgcatgtcggtgatcatgaagaatacgcagacgcaagaacactgggccttcaccaagggcgctgtggaaagggttattggtgcttgcgtcaactactttgactctgacggtcccgacgcggaggctaagcccgtaactgacgagttccgcgccgatatcctgaagaacatggaatcttttgcctctctcggtctacgcgtcctggccctcgcctcccgccgtcttccctccgacggcaccacctggaacgaagaaacgtcccgctccctcatcgaatccgagctcaccttccgcggcctgatcgggctctacgaccctccccgcccctcgtccgcctcggccgtccaccaatgccacgaagccggtatttcggtccatatgctcactggtgaccacccagagaccgccaaggccatcgccatcgaagtaggcatcctgccccctctctcttccatgtcccgcgtctctgcagctgtcgcccacgcaatggtcatgaccgcctcgcagttcgatgccttgtccgatgacgaagttgacgctttgcccgttctcccactcgtcatcgcgcgctgcgctccctctaccaaagtccgcatgatcgaagccttgcatcgccgtggtcgcttctgcgccatgacgggcgacggcgtcaacgactctccttccctccgtcgcgccgacgtcggtatcgccatgggtctttccggttcggacgtagccaaagacgcctcggacattgttctgacagacgacaactttgcctccatcgtcgccgccattgaagaaggccgtcgcattttcgacaacatccagaaattcgtcctgcacgtcttggcggagaacatcgctcaggcaggcaccctgctcatcggactggcattcaaggacgcctcgggcctttccgtctttcccctggctcccgtggaaatcgtctggatcatcatgatcacctccggtctacccgacatgggcctcggtttcgagcgcgccgttcccgacatcatggcgcgtcccccgcaatctctaaagacaggaatctttactttggaattcatcatcgacatgatcttttacggactgtggatcacggcgctatgtctggcctcgtttgtgttgcgggtctacgcctggggcgacggcgacttgggcagcggctgcaacgagcattactcggactcctgcgagaccgtgtttcgcgcgcgcgccaccactttcgcgtgcttgacgtggtttgccctcttcctggcttgggagctcgtcgatatgcgccgctccttcttccggatgcagcctggctccaagaagtactttacgcaatggatggtggacgtgtggcgcaacaagttcttgttttgggcgatcgtcggcggattcgtcacgctgtttcctacgctgtatatccccgtgattaatcatgccgtgttcaagcacacgggcatctcgtgggagtggggtattgtgtttgttgcggcgggactgttctttggtggtgttgaggggtggaagtgggctaaaagggttttcctcaggagacgcgcgaggaggggagctgccaagagcggtggaggagcaggaggacagggcaaattgtggaaggatatggatgtggaggaaaagatttttggagagtattttgggtcgcctgcttctacggatgaggtttcgcttcaggatactcatactcgtgggcatgaaaagaagaatgatgagggagccacgggccagcgccaggagaaccagggacgggattgacta

SEQ ID NO: 27540 - DNA, 2520 bp, Neurospora crassa
caactccaacaggatctaaaaccccgccggggacagtcggcgcttttcgattcgttttcgtacctctcgtctgatgacgccccatggaatcacacggttgtcgcctggactggcgagattgaggaggtcaagtccgcccagcacgccggcaaggcgcctgctaccacggtcggccaaccctcgctcaaccccctttcccgccccgtgcccatcgatggcagcgtcactcctccggcccaccccacggcagacggcctctggatccccaaggaagacatgcacttgctggagcacgacctgtcgcacaaccgcaagatcaagactgtcccagtctggctcgccgacgacatcgagggccatgacgatggcatcaggctgaaggaccaggcccgctggagacgctacgccgagcactccctctacacgcttttccactacaagcagaacgagcccgccgatggccgcgccgaaagaatccagtgggctgactactaccgcatgaaccaaaagttcgccaacaagattctcgaaaactacaagcccggcgacattgtcattgtgcatgactacaacctgatgcttctgcctagcatgttgcgccagcgggctccccacatgtacattgcctttttcctgcattcgcccttccccagttccgagttcttgcgctgccttcccaggagaaaggaagtcctggagggcgtcttgggctccaacctggtcggcttccagagctacagctactcgcgccattttgctagctgctgtacccgcgtccttggcttcccctccgatactaccggcgtcgaggcctacggcacgcgtgttgaagtcggcgtcttccccattggtatcgacgctatcaaggtcgctgccgctgcgtggaagccgtccgccactgcaaagttcgagggactgaagaagatgtacgccggcaagaagctcattgtcggccgtgataagttggatagcgtccgtggcgttccccagaagctcatggcttttgagcgcttcctcgagctctaccctgagtggagggaaaaggtcgttctcatccaggttacctcgcccactaacattgaggaggaaaaggaggattccgagaacaagatctccagccgtgtcaacgagcttgtcatgaagatcaatggcatgtacggctcgcttggcgacactcctgtgcagcattacccccagtacatttcgcaagatgagtactttgctctgctccgtgctgccgatattggcctcatcacctcggtcagagacggcatgaacacgacctcgatggagtacattatctgccagcgtgacaatgctggcccgctcattctctccgagttcagcggtaccgctggctcgctgaaggatgccatccacatcaacccctgggatcttaccgatgtcgccaagcagattaacaatgctctcaccatgtcgcaagagcgccgccaaagtatcgagaagagcttgcttgagcacgtcaccaacaagaacgtccagttctggatcaccggtctcctacgtcgtctgattagtgtcctcgctaacagaaaagacatcatcgccactcccctgctcgatcgcgccaccatgctccgcaagtaccgggcggccaacaagcgtttgttcatgttcgactacgacggcactctcacacccattgtcagggaacctagtgccgccatcccgtcggagcgcgttatcaacagcctcaaggctctggcggccgatccccgcaacgccgtctggatcatttccggccgcgaccaggagttccttcagcagcaccttggccacattaccgagttgggcttcagcgcagagcatggtagtttcatgcggcacccgggctcgacggagtgggagaacctggccgagaagtttgatatgggctggcaggccgaggttctggaagtcttccagaagtacaccgacaagactccaggttagttctttgattctcctttccttactgaaaaaaaaaaaaaaaaaaaaacaacggctaacatgaatttgctaggctccttcattgaacgcaagcgctgtgctctcacctggcactaccgcctcgccgatcccgagcagggtctccacatggctcgcgactgccaaaaggagctcgagaccaccgtcggccgtaagtgggacgtcgaggttatggcgggcaaggccaaccttgaggtgcgtcccacgttcatcaataagggcgagatcgcgaagcgcctcgtcacggagtacaatgccgagctcaaggctcttgctgccaagtcttcggggtcgccagacaaggttgcttccgagaagctcgagtttgtgctctgcatgggtgatgatttcaccgatgaggacatgttccgcagcctgaacgtgctatccggacctggcgaagacgccgagatcaagcccgagaactgcttcactgtcacggtcggcgcaagcaccaaggttacactggctaggtggcacttgttggaacctgaggatgtaattgaatgcgtggccctccttgctggcgtt

SEQ ID NO: 27541 - DNA, 996 bp, Neurospora crassa
ctccccatcatctccctcgcccctctcttctccccttcctcttccctttcctctcgcctagaggtcgcaaagcaaatccgccaagccgccacgaccaacggtttcttctacatcacctcccatggcatccctccctccataatccaagaagcccaagaatccgcttttcaattcttccgctcccccgtctcggaaaaagaaaaagccagcatgcacaactccctttacaaatacggctggaaaccacctcgtacgcagcgcctcaacccattcgagagcgtcgaccaccgcgagtccttctcgtggagatatgatccccggtacgatccgagtgtcaagaacgtagaagaggagataccggacgaggtaaaggcgatgatcaagcatgaccccgacgattacccgtggagtgccgtccctccggagttcaaggccgcagtcattcggtatttccaggcggtcttgcatttggggagggtgctccagcgggcgtttgcactgagtttggggctggaggagacggcgtttgatgagaagagtcggtggccggatttgggcatggctgttaattattatccgccgttgtctgcctctggaaaagaggagggaaagggagacgagaccaaggtgtccattgggtcgcatacggatttccagctgtttaccattttggggcaggacgaggtgggcgggttgcaggtcttgtcgagatcggggcagtggttgaatgcaaagcctatcccaggcacgtttgtggtcaactttggggattatatgcagcggattaccaacgacaagtatgtcagtacggtgcatcgggtgcagaattacagtgggaaggagaggttgagcatggctttcttctttgggtttaatttgaatgagacttgtgaggtgttggacagctgtgtggaagaaggagaggagccgaaatatgaggctgttagttgttgggagtggacgcagaggagggtcaggatgatgcacgatgttaag

SEQ ID NO: 27542 - DNA, 180 bp, Neurospora crassa
aagggggagaagaagacgagtctgtttgtagcgcatcggttgaggacgatttatgactcggatttgattattgtgttgaaggaagggagggtggcggagcaagggacgcatagggagttgatggagaggaatggcgtgtatgcgcagttgtggagggcgcaggagatgttgatgacggag

SEQ ID NO: 27543 - DNA, 1578 bp, Neurospora crassa
atcatgaaggaaatgtccaaatacctgtggcccaagggcagctggggcgacaaggcgcgagtactgctagctatcggcttgctggttggtggcaaggtgctcaacgtccaggtgcccttttacttccgcgagattgtcgactcgctcaacattgacttttctacaacgggcgggtccgtcacggccgtggcgggcgccatgattctgggttatggtgcggctagggtaggcgccgtggtttcgcaggaactgaggaatgccgtctttgcgtcggtggcgcaaaaggccattcgcaaggttgccaggaacacttttgagcatctgttgaatctggatctgagcttccatctgtccaagcagacgggtggtttgaccagggctatcgaccgtggtaccaagggcatcagtttcctcttgaccagcatggtgtttcacattgtccctaccgccctggagatcagcatggtgtgcggtattttgacctacaactttggctggcagtatgccgctcttacggccctgaccatggtcagctacacggccttcaccattctcacgacagcctggcgcacaaagttccgtcgtcaagccaacgcggcagacaacaaggcatcgaccatcgccgtcgactccctcatcaactacgaggccgtcaagtacttcaacaacgaagcctacgaggtcggccgctacgacaaggccctcgcccaatacgagaagaacagcatcaaggtcgccacttcgctcgccttcctcaactcgggccaaaacatcatcttctcctccgccttgacggtcatgatgtacatgggcgcccacggcgtcgccaccggccagctcaccgtcggcgacctggtcttgatcaaccagctggtcttccagctttccgtcccgctcaacttcctcggttccgtctaccgcgagttgcgccagtccctcctcgacatggaaaccctcttcaacctgcaaaaagtcaacgtgaccatcaaggagcaacccaacgccaagcccctcaccctcacccgcggcggcgaaatcgagttcaaggacgtcacctttggctaccaccccgagtcgcccatcctgcgcgatctgagtctcaccatccccgccggcaagaaggtcgccatcgtcgggccctccgggtgcggcaagtccacccttctccgtctcctctttaggttctacgacccccaaaagggcgccatctacattgacggccaagacatccgctccgtcaccttggagtctctccgtagagccatcggcgtcgtcccgcaggacacgcccctcttcaacgacacagtcgagcacaacatccgctacggcaacctatccgccacacccgaacaagtcatcgaagccgccaaggccgcgcacatccacgagaaaatcatttcctggcgagacgggtacaacaccaaggtgggcgagcgtggactaatgatttccggcggcgagaaacaacgactggctgtttcgcgtctcatcttgaaggacccaccgctgctgttctttgacgaggcgacgagtgcgctggatacgcatacggagcaggcgctgatggagaatatcaat

SEQ ID NO: 27544 - DNA, 1459 bp, Neurospora crassa
gcgctgctgtagcgtcgcacaatcaccacaatgtcgactcccattccacgaccaccgggaatcccagtgctgggaaacgtcttcgacattacacctagcaacacatggtggtccctcaaggcactggctgagaaatatggtgagtcccgcagccaaagacgtccatggatacaccagctaacatgattcaggcgagatcttccaggtcaagatcctcggcaagaccatcgtcttcgttgccagcgccgccctcgccgaagagatctgtgacgagcaacgcttccagaaatatgtaggcggtcctatcgtcgagatccgcgccacagtccacgactccctctttacagccttccaccacgaacaaagctggggaattcatcaccgaatcatcgctcccctcctcacccctcaagccgtctcaggctacaccgacgacatcaacctctgcgcgaccgaggtcattcaaaaatgggcatccctcggtgacagcaacgtcctcgagcctctcgtcgacctcaacctcctcaacctcgaagccacgtctctcaccctcttcagccaaaagctcaattgcatccaagccggtggccaccccgtcatccaggccatggaagatgccgtctccgaagccatcatgcgccccacgcgccccggactcgtcaactggctcctctactcctccaagttcaagaaagccaccaagacattgcgcacctgggccgccgacaccgtcaaataccgtcaagaaaaccccacagacaagcacgacatgctttgggcctttatgaacgcaaaagaccccgaaaccggcaagggtctctccgagtccgaaatccttgacgaaattgtcaccatgcccatcggctccgccaccgctccctgcgccgtgaccgccaccatctattacctcctgcagaaccccgaagtcgtcaccaaagcccgcgaagaactcgatcgcgtcatcggtaccggccctctgaaggacgaacacctctcccaacttcactacattgaaggcatcacccgcgaaaccctccgcctatcctgtgccgccccaggcttcaacatcgagcccatcccccgccagaacaaggccgacaagtcccccctcctcctccaaggaggcaagtaccaagtcgcgcacgaccagaaactcatcatcgtgctagccggcgtcaaccgcgacccagccgtgtttgaggactccttggctttcaagccggagaggatgatgggcgaggaatttgatcgcttgcccaagggcgtgaagaagtggtacggtaatggcaagcgggaatgtatcggcaaggagtgggccaacaatttcttgaagattgttacggcgaggctgatacatgagatcgactttgaggtggcggatgagggctatgagtttaggcaggatggctggttccagattaggccggttgcgttcaaggtgagggtcaagccgagagtg

SEQ ID NO: 27545 - DNA, 2515 bp, Neurospora crassa
caatccttctccatgagccagtcatcccagtcagtctacagacagtacacggatccccccaaccggctacacaacgaccatgccgtacctaccatctactctgtgagcctattctcctcctcccccatcttccatactctctccactgtgctccgactgacagctacaggccacgtactcgggcgtcggcgtctacgaaatggaggtcaacaatgttgccgtcatgcgccgacaaaaggacggctgggtcaatgccacacagatcctcaaggtcgcaaacatcgataagggacgccgtaccaagattctcgaaaaggaaatccagattggcgaacacgaaaaagtccagggcggctacgggaaatatcaaggaacttggattccattcgaacggggtctcgaagtctgccgccaatatggcgtcgaggagctgctgtccaaactcttgacacacaacaggggacaggaaggcgagactggaaacgtggacacccccaccaaggagcaggccatggctgcacagaggaagcgcatgtacaacgcgagctcgcaagagaatcgcggtattggctccaccggcaccttcttcaagaacatctcctcgacggcctcaaccgcagtggctgccatcagcaaggctcgcttcgattcccctgcgcctagaaaccgcagcggtcccagcagggcccccagcttcaaccgccagtcctcgatgcaggatgtggccgatttcccaaactcgcaacaaagccttgtttcgaccgaatacgcaacccagacacagaacgccgactcgggcttcgggtctcaaactacgcaacccttggctggtgacggcctcgaacaaccccctaggaagcggcaaagagttctcacccccgccaggagctttggcggccagactccgggccaccagcctctcgacccattcaatgctggaaatattgccaacggagactctggctctcccacggagcccagcaactctttcaactacgatcaagtcactgctaatgatggcgatgcctcgtatgcccttggcccgttgcggccgttgccctatgagaataacgccgacgcggaagccaagcgcggtatgctgatgggcctctttatggatgccaacggccccgaggaggccatccaggctgccctttgcaatgtgtctccccaggagctggactcccccatcgacacccagagtcacacggcccttcattgggctgccaccctctctcgcatgccgcttctgcgagcgctcatccacgcaggcgcaaacccctggcgtgtcaatgcttgtggagagactgcccttatgcgtgcctgcaccgtcaccaactccatggagaacaacacgtttcccgagcttcttgatctccttggttgcactcttgacgtgaccgacgacaagggccgcaccgttttgcatcacattgccgtcaccagtgcggtcaaaggccgtcattatgctagccgatactacctcgagagccttctagaatgggtggtccggcaaggcagtgctccaagcagccaagagaacggcatcggcgataggaaaggacgtcgaatgggtatcgcccggtttatgagcgagatcgtcaacgctcaggataatagtggtgacacggcgcttaacgttgctgcacgcgtcggtaaccgcagcatcatttcccagcttctggaggtgggcgcggatcccacaattcccaaccgagccaatttgaagccgctggattttggcatcgggattgccgacgccgagaccaacgatgatccagcccaagaaaagactggggctacgacgggcagtggccataagagccgtgagaccagtgacgaggttgtccgctgtaagttcttttttctgattttctatccttcttgctccattgctaacgtaaagccagccatcactcacctcattggtgaatccgcgtccattttccagaatgagctgaaaaagaaacaagaatcgattgacaccctccattctcaactccgcgtcacttcctcgcaagtcggtgacgcccgccgcaccctcgagtccctacaagaaaagctcaaagcccagcaactggccaagcagaagattgtcaacttcaaccgggcatgtgaagaggaagagcagatcctcattgaactcgaacagcgtcacggtcggctggatgtcgcttcggccaacgcctgggaaatggaactcgagtcggcactggaaattgtcaagacgcagtcccccaagggactggacccagacagccgacctagcctaccgagcgcggcagtgctaagagctagaatcaaggcactacgggcgaggtcgagcaaaacgcgacaggcggtggcggccttgcaggcacagagcaaggagaaagagctcaagtaccggcgactggtcagcctctgcaccaggaggcccgaaatcgaggttgaagccctgctggatacactgacgagggcggtcgaaagtgaaaagcctgaattggagattgcgagggtcaggaggttcttgggc

SEQ ID NO: 27546 - DNA, 2779 bp, Neurospora crassa
aggatcgcaattagagagcagcttgcggcccttgtcatctttgccgtcctcctctccctcgccattgtctccatccccgtatggatctttgtcaacaactttgtcattggcgtcaagacggatggcctggccttgtctgcctctctcaaggcctctcgcatctcttccgaaatcgatctgatccagacggcatgcaccaccatctccacacgactcttgcttcagcaagcctttgaggatttctataccaacgaatactatggcaatcaaactgcggacgtctgggagcaggctctcgaggatctggccagcgcgctttccaccagcaacgtgtcgggtctattgcaggccagattgtattctcgcaataccaccggtgatccacgtggccttctcaacattaccggccaagatgccctggacgaccctgtctatcttccttacagatccccaactggagccgacatcaaactcggcgatcccgactatggcttcccccctatgctctacccaaacatcacatacgagaacaagaacctgccgagcccatacaaggccaacaccgttcaattctctgccaacatattccctggcgtctcgttgagcaatggcagcgaaggcaacggcattctcttgggaccgcttgtggtcaacgagtcgtacgcgcttgtctccatcacggttcctgttcgagagaatcaatctagcaggttcattctcggctacatgactgtgattgccagcgcgagacagctcgtccaggtccagaggtccaacgagggcctgggcgagactggcgttgctctgttcatcggcccagtcaacccgtggaaccatttcaactccaaaatgcctgccagcaaccaaacatggtctccgccccgtgatgagtttgcgaggaccaaccaggttcacttcctcctaccgcctgccccccaacccggccaagaagaccgccacagcgaccacagcttcgagtccggtgcctatgatgcccccttcgatccggcgacgtaccaggcggtgctcgatctttttgtggagaaaaacaatcagaccaacaacgccacgagcaagatctcgaccaagaatgagcagggcaagaaggtggcgattggcgctgcccggccacaaacctcactggttacctgggcggtgattgtagaacaggacaagcgagaggcgacggaaccgatccgtacgctgaggaacatactcttgggttgcgtgtttggtaccgcagggcttgtcctactgctcaccattccgtgtgctcacctgagcgttatgccgattcgccggctgaaggaggccaccgagaaatcgattgcaccaccgggttacgaagatttgtccgattccgactatgatgaagagaaccctagttcgggcggcaccacgtcgggaaggtccgagaagagctggctcaaaagtttgaagaggaggatgcgcaagtcgaagagggcgagattgagagctgcagctgcacaggatgcgcatcgccatgctttcaagattcccgccaaggtggaggataggaagcattacattactgacgagctgaccgagcttacacaaaccttcaacgagatgtcggatgagctgctgaagcagtatacttcgttagacgagaaggtggctgaacgaacgagagaactcgaaatcagcaagaaggccgccgaagctgccaacgaaagcaagacgctgtttatcgccaacatttcccacgaattgaagacacccttgaatggaatcatgggcatgtgtgcagtcttgatggaggaagacgatgttcttcgcatcaagcagtcgctcaagacgatttacaaatctggtaagcattcccgccccctatgtatcccctcggcttttcatcaaactaaccgtgatgataggcgaccttctgttgcatttactcgaggatctcctcagtttctccaaaaatcaaatcggtcaacaagtcagcctggaagagagagagttcaggcttggtgagataagatcccaaatgctggctatctttgacaagcagatccgcgagaacaagatcaccttcaccgttagctttgtcggcaccgacatcctcgagagcagtcccgagcgacgcagcggcatcgacaagcggcttcccgcccttgggcctcccggtgtaggccgtcttaaggacatgtgtctctggggcgaccagcaccgtatcctccaagtcatcatcaacttggttagcaacagcctaaaattcactccggcaggtgggagagtcgagttgaggatacgctgcgtcggcgagatggaacaaacccataaccaaagcaggtcttcgtcgttatccaagaactcgcatcgtccaggtcggtctcgccataggctaggctcgggatcaagggactcgcaatcttccaagggagcgccgcactcgccgaatctgaaccagagtagtggtactgcgctttccatcaaccccatggaccccaagtcgcctcatgtgcacatcagggaacgatcaccaacccctccgccaccgaatgccaagacgtttatgttcgagttcgaggtggaagataccggtccgggtattgcggagcatatgcagcaaaagatcttcgagccttttgttcagggcgatctgggtctgagcaaaaaatttggtggtaccggtttgggtctcagtatctgctcccagttagccaccatcatgggaggcacgattgggctcaagagtactgttggtgtcggaacgacgtttacgatgcggataccgttgaaatatgtcagggatcgg

SEQ ID NO: 27547 - DNA, 1168 bp, Neurospora crassa
aaaccgcaatagaggaagcgtacccgactacgcttaaacaaacagacatcatggccgacccatttgccccgcgctccatgaagcgcaagaacgtcaaaggtcttgccttggctcctgccgctcccaagcccccgccgacggccgagaccttttacaaggataaagacgacgacaacaatgcccagctagagatcggcatcgagttcaacctggacctcaggcccgaagatctggacctcatcaaagagttgggagctggaaacggaggcacagtcagcaaagtcaggcatatcccgacaaatacagttatggctcgcaaggtatgttggacaagccaaggtttccaagcttcgccgttgtaagctccgctaacaaagcatcgatgggcaggttatccatgttgaggccaagaaggagatgcgcaagcgtatcgttcgcgagcttcagatcatgcacggctgccattccgaatacattgtcaccttctatggcgccttccttaacgagcacaacgatgtgatcatgtgcatggagtacatggatgttgggtatgttgcctcttggaccgcatgttctttgcgcagtggagactgactgaccttggttgtgtagctcgctcgaccgtatctcccgtgtcttcggtccagtccgcgttgatgtcctcggaaagattgctgaagctacccttggcggtctcacgtacctctactccaaacaccacatcatgcacagagacatcaagccctccaacatcctcgtcaactcaaagggccacatcaagctttgcgatttcggtgtttccggagagctagttaactctgtcgccgacacctttgtgggtacatccacatacatggctcccgaaagaatccagggcgacaagtacacagtcaagtctgatgtgtggagtttcggcttgactgtcatggagttggcgattggcaagttcccgttcgccagtgatcaacttggggatgatgctgaaaatgctcccgccggtattctcgaccttctccaacaaattgttcacgagccagcaccgaagctacccaagagcgatgctttcccacaaatccttgaggatatgatccagaagtgtctttacaaggaacccgagaggcggccgacgcctcaagagctctttgtaagttgttctttttactttgct

SEQ ID NO: 27548 - DNA, 1289 bp, Neurospora crassa
tcggcaactggcggggatgagcggctcatctacggcgtgtcggccatgcagggctggcgtatcagcatggaggatgcgcacacgacagtcctcgacctactagccaacaaccccaaggaggccaaggaccacagtcaaaagctctccttcttcggcgtttttgacggccacggcggcgacaaggtagcattattcgcgggcgccaacatccacgacatcattgcgaagcaggacacatttaagaccggcaactacgagcaggccctcaaggacggctttttggcaactgaccgggcaattctaaatggtacgatattgagaaccccagattgtgttttcttggcagcttgtgtgctgtgtggtgcggtgcggtgcgatgctgtgccgcatacggtgcgaaacgggaacgaaggaaactaatattcgcctccccttatgttgcagatcccaaatacgaggaggaggtttctgggtgcaccgcatgcgtcggtcttattaccgatgaaaaaatctttgtggtgagttataatcgaacgaaaaaaacaacccccgctcgtgaactgctcgccctaacctcaagtgtctataggccaacgctggcgattcgagatccgtactgggcgtaaagggccgcgcgaaacctttgtctttcgaccacaagccccagaatgaaggtatgcagctacgcgcgcttgctggttcttcggatgacaaggttccgagctaaccggtgcatgtttgtggttctctaggcgagaaggctcgtatcactgctgctggcggtttcgtcgactttggtcgcgtgaacggaaatttggctctctcgagagctattggcgattttgagttcaagaagagcgccgagctggcacccgagcagcagatcgttaccgcataccccgatgttatggtccacgacttggccgacgatgacgagttcctcgtacttgcttgcgacggtaagagaaggcttgaacctgtatagaaccgcgcggtcagctaacacaggttctctgctaggtatctgggattgccagtcttcccaagcggttgtcgagttcgtcaggcgaggcattgccgccaagcaggatttggacaagatctgtgaaaacatgatggacaactgcctggcctccaactcggagacgggcggcgttggttgcgacaacatgaccatgatcattgttggtttcctcaggggacggactaaggaggagtggtatgaggaaattgccaagcgcgtcgccaacggtgacggtccttgcgctcctcccgaatatggtagggaa

SEQ ID NO: 27549 - DNA, 2333 bp, Neurospora crassa
atcctgcccatcatccttccgccggcgacactacgaccgctcgccttccgaacgtttaccaagaaacacagcctaacacttacatcaactgccctacaagagctcgcaacctttatcggtagacactgtggctcaggatggagggaagaaggcctggccgaaaaggtgctagaagaggtagcaaggagttggaagaaccgcaatggcggcgtcatcgtggaaggcaacagccccgagctcaaggacattctcaagaccctcgagggaaacatgagcggaggaaagatcctgaccgggccacgaagcttgagcagacaaaacagtctcttgctagagcccgaccaagacgaacaacatgcgcatagtcgactcggacttcggcccgtgccatcattaacccgggaggacagcaacgccagctttggcatgtctgggttggagttcacagaagagccggaagacgattcggtgagagatgttaggaggtggctgaaggttatacatgctttcgatcaaccacggttgatgtataatgttggaaagaagcattttgagaggtatggtcccttattatttattaccctctttacataggttacacagctaacctttgtagggatccttccaaaccctccctactaccagccgcctctcacaaaaccgatgccttccgcaaccgctacaacgttattcatcagcgcatccttcgcaacgaagcctttcaatcctcctccgtccaaggctccagcttgcgccaacgaaccaacgccaacggcctctcctcccacaagattaccccaatcgccaacctgctcggccgccatggcagcaaccacatgctgctgggcatgcttgttgtccttcccactggctctcttgccatcagcgacctgacgggcaccattactctcgacctctctcacgctgtcgccatccctgaagattctgcctggtttacgccgggaatgattgttctcatcgacggcgtctacgaagaggaggaggaaaccatgaccatgggcaacggtctcagtggtagcagcggtgtgggcggtaccatcggcggccggttccaaggtttcttcatcggccagccaccatgcgaaaagcgccgcgttacgctcggggttagtgggcccgacggcaccggcgctgatcataccattggcggcggattcggctggatcgacttcctgggcgtaggtagcgagagggcagtcgggtccaaaatgcgcaagttggagcacagaattcttcggcaaccagcgctgttggaggatggcaggccgtcgaggggtagggcagtgattattggcgaactaaacctagatcagccgaggagtttgcaggcactgagaaaaatcttgggtctctatgctagtgatcctgaagggtgtacacccatgacgtttgtgctggcgggtaacttcacgcagcatgctgtcatggcgaggggcgggagtggggggagtattgagtacaaggagtttttcgatgcgttggcatcgacactggcggatttccctagtctgctcacgacggctacctttgtttttgtgccaggtgacaacgacgggtgggtgtctgccttctcaggtggtgcggcaactcctttgccgaggaaacccgtcccagatctgtttacttcccgcatcaggagggtattcgcagcagcgaatgctgaagccgggctagccaaccctggcaaagaaacagaaaaggatgcaggcaagaggagaggcggcgaagctgtctggacaaccaacccaagtaggataacccttttcgggcctagtcacgaaatggttcttttccgagatgacatctccgcccggttacgacgagcttctgtccgtcttaagaacacgagcaaagcctccgtcgagccggaacccccaaccaatggtaacgacgactcggcaatggataaccaatgtccaccctcctccctccccgacgcccccgatgctgacgacgaagacatggccgacacaaccatgaccgacgccatggatgtcgattctgcccctgcccctaaccaaaagactaccatgcctcctccatcttccataccctacgacgtcctcgccgcccgcaagctagtgaaaaccattctcgaccaaggctatctcgctcctttccggcaagctatccgcccggtacattgggactatacttccgccatgtacctctacccgctgccgacggccatggtactggtggatactaccgctccgccgttttgcgtgacgtatgaggggtgccacgtgatgaatccggggagcatattagtgccggggaggaagggggcggcacggtgggttgagtatgag

SEQ ID NO: 27550 - DNA, 2366 bp, Neurospora crassa
ctatcttctatacccgtccccggacccaaagtcaagcctaagaagacacggggatctccttcaccacgatactcaacgtcgggtaaagagcaagagaaggaaagggctgtttcgggtctgagcaggcgcctgcaggacttgtcgatctgtgatgagaaggagaacatccccagcgggagtcaagtgacgcctcgaaagacttcgcagcccgcctcccaagcgtcttagtcggatgctaaggcggagcctgctagaagacccagacgaagaaccgaaggagccgtacccgcacgacgcaagtcctctctccaacagtcgacaacggcgtacccggagacccctaaagcaaagtcaagattggaagacccccgtgcggctatggagcgtttcgaggtcattctcaactctgccgtcgtctccgctcacagaactgcctcgacccgaaaatccgtttcacctgtcaagctttcttttctcaccaaggattctaataacaccgcattcacaggcattgacgtcgacgagcggctcaacgaggttgatgcggaatggaaggtgatgaaggaggctttcagcatatctttgcaagacaagaaggccatggaaacggccgttcagatggcaaagaatcaaggtacgtggcagcaagtatacaaacacgccaggctgactgacacctactagtggacacacttgaggcggaacgacaaaaactgaacgagagaaacgaactgctgcagaaggagatggatgcgttgcgacaacagttccaacaactgaccctcacactggaaagacagaagatggaccatgaatatcaacttcagaacaagtcaagagagcatgaacatgaagtccaagaattacagagaaagttgaaacaggaaagcgaacgactgcaacgaatcaaccgcgaggaaaaggacgcttttgagaggcaatgtcgggcagatctggagggtgaaaaggcaaaggcggcaaaggaggtccaagacttgcggctgaagcttggggcagaacagcaggatatcaacaaatcgctcttggagaaagaacgagaactacggcaactgcaatctcaactggacgatctgcggtcagaactgagccaagagcaaaaaaacaaaagggcgttgcaggaacagatcaatgagatggcgacaacaaatgggaaactggaagcccggaaccaaggacttcgggcgcagattgacttccttgaatctgatagcaagcaacagtcggattcgtttgcacagatggaggcacggcttcgggaggccctggaaatcgcggagaacgccaaacagaagctcatcaaggaggagacggagaggcggatattgttcaacaagtaccaggagctcaaaggcaatatccgggtcatgtgcagagtccgtcctgcactcggcaaatccgaaggcagcgaggccaagattatgttccccgacgccaaaacgtcgtccgcacagattgaagtgaccgggctcgaggaaaagagtagctttggaaacatcaaccgcaaggtgctccccttcgaattcgaccgagtctttgctccgtcagtccacaacgaggaaatcttcgacgagatctctcagctggtacagagcgctttggacggctacaacgtgtgtatcttttgctacggccaaaccggttctggcaagacgtacactatgtcgtctccagatggcatgatcccgcgagccacccacatgatatacgataccataacgaaacttagggagaagtcgtggacgtacaccatggagggtagtttcgtcgaggtatacaacgaagagttgaacgacctgctcgacggcagcagcaacaacagcaagaagaaactcgagatccgccacgacgatgtccgcaagcagacaacggtactcaactgcaagaccgttgcccttgactcggccgacaaggtggagatgatgctcaagcaggcgcaaaacaaccgcagcgtggccgccaccaaagccaacgagcggtcctcgcgctcccactccgtcttcatcctcaagcttgtgggcgagaactcggtcacgaatgagcggtgcgagggtacgctgaacttggtcgacctggcgggttctgagcggctgaagcactcgcaggccgaaggggagagaatgagggagacgcagagcatcaacaagagcttggcgtgcttgggagatgttattgaggcgctgggcagagggtcgtcacacgtgccgtacaggaactcaaagttgacgcatctgctgcagtactcgctgggaggcaactcgaagacgttgatgttcgttatggtgagcccgttggaggcgcacttaaaggagacgattaccagcttgaggtttgctaccaaggtaagt

SEQ ID NO: 27551 - DNA, 1264 bp, Neurospora crassa
agtcgcaataagcgatccggcgatggcgcatcaggcttcggccccagtaccggcaacctccacgaatacggtcaacacggtcagcaattacaccctaatatcaacgccgtcatggccgacgcacccctccgcgacaagatgcgcaccgagcagcgcatcggtgcctataacattgtcaagacgctcggcgaaggcagcttcggaaaggtcaagctggctgtccatcgcatgaccggccagcaggtcgctctcaagatcatcgcccgcaagaagctcatcagccgcgacatgcaaggtcgcgtagagcgcgagattgagtatcttcaattgctaaggcatccccatatcatcaagctgtaaggcacccctcgacgcccatgcgcagcagacgttggctctggtcctttacgtacacgttggctaacccggcgcgcataccaggtacaccgttatcaaaacaccaaccgagatcatcatggtgctagagtatgccggcggcgaattgttcgattacattgttcaacatggaaagatgaaggaggacgaagcccgccgcttctttcagcagatgctatgcgccgtcgaatactgtcatcgtcacaagatcgttcatcgcgacctaaagcccgaaaacctcttgctggacgataatctcaatgtcaaaattgccgattttggtcttagcaatatcatgaccgacggtaatttcctcaagaccagctgcggctctcccaattacgcggctcccgaggtcattggcggcaagctttacgcaggacccgaagtcgatgtctggagttgcggtgtcattctttacgtcctactcgtcgggcgcctccctttcgacgacgagcatatccccagtctttttgccaaaattgcgcgtggaagctacatggtgccgacctggatgagtcccggcgcggcgtcactaatcaagaagatgttggttgtcaaccctgttcaacgtgccacaattgacgaaatccgccaggacccgtggttcctcaaggatctgccggcttaccttcaccctcctgttgaggagttcctcaatactggcgtggaccccaacaaggccatcaaggttagcgacattgcgccaaatgcccctccgcaggaacaggagaagttgcataatgaggtcacggagaagatcagtaaaaccatgggctacggcaagagagatgtcgaagaggccttggaggccgatgaaccctcggccatcaaagatgcctacatgatcgtgcgtgagaacaagctg

SEQ ID NO: 27552 - DNA, 1471 bp, Neurospora crassa
ttcggctttgatatctcctccatgtccgccatcgtcgtgaccgaccaatacctcacctacttcaacaacccccatgatatcatccaaggagccatcggctctgcccttgctgctggctccgtcgtcggttccgccatcgccggtcctctttccgacaagatcggtcgtcgtgactccatctttttcgcctgcttcttctggctcattggtacctccgtccaggttgcctgcaagaactatggccagctcatcgccggccgtgtgctcaacggctttaccgtcggcatcacttcctcccaggttcccgtgtaccttgccgagatcgccaaggcagagaagcgtggttccttggtcatcatccagcaactcgccatcgagtttggtatcttgatcatgtactttatcggctacggctgtgcgtcgatcgagggccctgcttcgttccggaccgcttggggcattcagtttatcccttgctttttcctcatggtcggtcttcccttcttgcctaggtcgcccagatggctggccaaggtcggtagggaccaggaggccattgctgtcctggctaacatccaggctgatggcaacgttgatgacccgagagtcgttgctgagtgggaggagattgtcaccgttatgaacgccgagcgtgaggccggtaagggatggaggaagtttgtcaagaacggcatgtggaagcgaaccatggctggcatgactgtacaggcttggcaggtacgttcttctctgttttcccctatttcctgtcccaacattatcaccaacaagtgcactaacatcctctctctttttctctcaacagcaactcgccggcgccaacgtaatcgtctactacctaacctacatcgcccaaatggccggactcacaggcaacgtcgccatggtaacctcgggcatccaatacgccgttttcatcatcttcaccggcgtcatgtggctcttcatcgacaagaccggtcgtcgcacccttttagtttacggcgccttgggaatggccttctgccactttgtcgtcggcggcgtcatgggcgcgcaccacgacaacgttccggacggcgtcggcggcaacgccaacattgtcattagcgtgcacaagggcgcgcccgccaacacggtcatcctgttctcgtacctgctcattgtcgtctacgccttgacgctcgctcccgtctgctggatctacgccgccgaggtctggtcgttgggcactcgcgctacgggcatgtccatggctgccatgtccaactgggtgttcaactttgcgctgggcatgttcacgccgccggcgtttgtcaatattacgtggaagctgtttatcattttcggggtgctttgcgtcacggcggcggtctggttctggttgttttacccggagacgtgtggtaagacgctggaggagattgagatcctgtttggtgatcagggtcctaagccgtggaagacgaag

SEQ ID NO: 27553 - DNA, 1710 bp, Neurospora crassa
atggtagcccaacaacaaggaaagttcacggtgggcgactacctcgccgagcgtcttgctcaggtcggcgtccgccaccactttgtcgtccccggcgactacaacctcatcctcctcgacaagctacaagctcacccggatctcaaagaggttggttgcgccaacgagctcaactgctctcttgccgccgaaggctatgcccgtgccaacggcatctccgcctgcgttgtcacttacagcgttggtgccctctcggccttcaacggcaccggcagtgcctacgcagagaacctccccttggtcctcatcagcggctcgcccaacaccaacgaccccagtcaatatcacatccttcaccataccctcggccacccggactacacctaccagtatgagatggccaagaagattacctgctgcgctgtggccattccccgcgccatcgatgcaccccgcctgatcgaccgtgccctccgcgccgccatccttgcccggaagccctgctacatcgagatccccaccaacctcgccggagctacctgcgtgcgccccggccccatcagcgccatcaccgaccccatcaccagcgacaagagcgctcttgaggccgccgccaagtgcgctgccgagtatctcgacggcaagctcaagcccgtcatcctggttggccccaaagctggccgtgccggttccgagaaagagctcatcgagttcgccgaggccatgggctgtgctgttgccctgcaacctgccgccaagggcatgttccccgaagaccacaagcagttcgtcggcatcttctggggacaagttagctccgatgccgcagacgccatggtgcactgggccgacgccatgatttgcgtcggcgccgtctttaacgactacagcacggtcggatggactgccgtgcccaacatcccgctcatgaccgtcgatatggatcatgtcaccttccccggcgcacacttcagccgcgtccggatgtgcgaattcctcagccacctggccacccaggtcaccttcaacgactccaccatgatcgagtacaagcgcctcaagcccgaccccccgcacgtgcacacggccgaacgcgaggagccgctctcgcgcaaggagatctcgcgacaggtgcaggagatgttgacagacaagaccagcctgttcgtcgacacgggcgactcgtggttcaacggcatccagctgaagcttcctcctggcgccaagttcgagatcgagatgcaatggggccacatcggctggtcgatccctgcggcctttggctacgccttgcgccaccctgacaggcacaccattgtgctggtcggcgacggatctttccaggtgacggcccaggaggtgtcgcagatggtgcgcttcaaggtacccatcaccatcatgctcatcaacaaccgcggctacacgatcgaggtcgagatccacgacggttcctacaacaagatcaagaactgggactacgccatgttggtggaggccttcaacagcaccgacggccacgcaaagggcctgctggccaacacggccggcgagctcgctgacgctatcaaggtggctgagagccacaaggagggtcctacgctgatcgagtgcacgattgatcaggatgactgcagtaaggagctcatcacctggggtcattacgtggctgctgcgaatgcgaggcctccccgcaacatgtcggtgcaggag

SEQ ID NO: 27554 - DNA, 1498 bp, Neurospora crassa
tcgggaaacggttatacagcatcaaacattcttcgaggtaccggatccgtgggcctatccatgatcttctgggctctcggcttcttgacgtcggttgcgaatctctcggtgtatctcgaatatgcggcatacttcccgaatcgatcggggtctgaggtggtgtacctggaacaggcgtacccaagaccgagatggctgttcccgacggcgtttgcgtttcagtcggtggcgttgtcgtttagtagcagtaatgctatcggtaagtgatttgcttgttccatctccgaagctttcagggaaaaaaatggttggactgactaatgcgaacaacgcgcagtccttgcacagtacttgttcagaataaacggccactctccaacagcttgggaactcaaaggcgtagctgtagccgggtacaccgtcgccgctttgtgtacgtctctttccactcttacgtctatgccactctctcattgctaactcactcccttttatttttcagtcgtgtccttccacacccgcctctcctacctcttcgccaacggcatcggcatcatcaaagtcctcaccctcatcttcatttccataaccggcctggttgtgctaggcgggcatgtctccaccactcggatccccgacccccgtatcaacttccgcgacgccttttccggtcaagcaacgccctatggtgtcaccaatgcgctgtacaaaatcatcttctcgtacgccgggtttgaaaatgcctttaacgtcgtcaacgaggtgaagagccccgtgaagcagatcagaaggaacggatttgtcgcgctgctcatcgtcgcagttctgtacatcttggcgaatgtggcgtactttgccgccgtgccaaaggatgagctggtgcagagccagcagattgcggcgagcctgttctttaccaaggtgtttgggtcgagtggtgcggtgagagggctgaatttcctgattgccttgagctcgtttgggaatctgattgctgtgttgattgggtcgtcgaggttgattagggagtgcgggaggtgagtctcgaggaatctgattaccggtcatgtttatggtaattgctgacacatgttctttcggtgatgacaggcaaggcgtgctccccttcccacggttttgggcttctacccgcccctttggcactccgcttggaccgtacttcgtcaaatgggcgctgaccatcctcatgattttggcgcctcccgctggtgacgccttcaacttcattaccgatctccaagtcctgccttcggccttctttcagttgatcatgggaataggtctgtacgtcgtccggtaccgacggtctcggctcaaccttccccgccctgagttcaaagcctgggaccttgtagtcgtgttcaacatcttggtgcagctgtacctaatcgtcatgccgtggtatccacccgcgggaggagcgtacgcgggagatgtcagcttttggtacgggacctatgtggtcacgggtatcgga

SEQ ID NO: 27555 - DNA, 1053 bp, Neurospora crassa
gtcgttgtagacactggattaactgctcttgtccttcctcgtaacaactgcaccaactgcggcaaacactcgctctttaacccatccaaatccacatcatttttgccccaacctgcactttttcgtcctattgagtacggcactggtgcagacactatcccactcaatcaaaccggccgagcagaatgcgaagtcgtcaccgacactgtttcgatacagggtctttctgcccccaaacaggagttcttgctttgtcatagctacggcgagactctgtcttcccaacttgccgacggaatcctcggcattggtcctgctgacatctcgacttgggacgaaagcgggaactatacctatctcccctttctccccaacctcgttagtgaggggcagctttcaaacaggattgttggtcttgccctcgggtatggtggccagaaccagcaacagcgcggtcctgaagcctccatcggcggcgtcgacgatgcgcgctatcatggccgtatcaagaacgtcagtgtcgatgaaatgctcaccactctctcgggtgtgtttacactagatgtacaagctgcctacgtcggctccggaaataacaagcgagtatggcccaactcaaccaacggcaacaagccactcgtgccgggggttgcttacatcgactcaggaaccgcctacatgctggctcctgaccaacaagcagccgagaatctctactcgggcatttccaaggacatcgtccccctcaatgataggggatcatggggtgcgagttgtgctacgctggatgaagtggcgacggacatcacgttcactatcgggacgaagaccagaggcgaggtgattgaagtgactataccgaagagtgcattcaacctgggtgagtatcctggcagaaagggggtctgtcaggcggcgttttctcattgggatcctcccttggttgagcccattgagggccgtcgggtgtggttgtttggaagccctttaatcaaggcttattacacgggttggaatgctaagagtagcacgcttggttgggctgagaaagtt

SEQ ID NO: 27556 - DNA, 3217 bp, Neurospora crassa
cggagcttggaggattgggaagtggaagactttgtgcttctggcgaccgttgacggagatctgtatgccaccgaccgtgttcgtggcgaggtgcgctggcacttcaaggccgaccaccccatggtggaaactcggcacttccgaacctctcgctctcccgtcgatgaggacttccacgagatggatcactggatctggatagtggagcccacacgagacggcgagatatacatctggagaccgagcgactcgggtccccagctgaccaaaatgaccatgaccatgaaacagctggtcgaaacctacagcggcctccatatgaacgggatcgtttacacgggcgagaagaggaccaacatggtgactctcaacgccgcgaccggcgccatgatcaagaacttgggccccagaggtgtcaacatcaacaaggtcgagtccgagcgatgtcttagagaatacgcccttggaaacagcatcaccagcgagtgcagcaacagagaaaccatcaccctcggccgtaccgaatacattgttggtgtgtatcgcaccgacggcagccccattgcatccctcaagtattccgagtgggcccccaatgtgttggacggcgacctgggccagcaacattcagctacaccagacaagcgctatatcactggcaaaccagacggaaccttctttggctttggccttgatcgggagaatggtgaccggccgctcttctcccaccagctcacttcccctgttgctcgcgtctttgatgtcctgcgtcgccagtggaatccgaccggcagcagcgacaccgacttgatcatccttccccagcctcttttccctgttaatcccgcaatttcacgccttcgcagcgcaaaggttttcgtcaaccatactgaggagggtagctggtatgctctttcgggaacccagtatcccctcatcctccatgccccacctgcccccatccacaagttttggccgctggaaagtttgaacgaggacaaattgtccgaagcactcgtcggcactcatgatctgcctgactggcgaatccccaaggaaatcaaccgcctagtgccacttttggatgcgcctcctcctcccgccggagacgccgttattactggtaaccccacggttccttcgtcagcaggggcactgcccggcctaccagcaccggatactgctacggcactgcctgtgcaagcctctgactttttcctcaacccctttactcttctggttggaatcgtgattgtcattgccgtgtggacaagggcctggatacctcagtcatccaagaaaggctactccttggaagggttcctggattttatgagaacgctcgggaggaaggttgtggacctcacgcgcttcaggattcacgttgttcgtacagagccgacaccaaccgtgactgatatcacgcctcgcttggaggcggctaaggaggaaagcagtaagcccgatgcctccttggcagactcgtccgccggggattctggctcagatgaagggctggcaaagaaggaagtgacgtttgccgaccttcctaaatcatctgagacgccaccgcccgttgataccactgacgctcctgctgaagttgtcaagccgaagaggaaggctcacagaggtcgccgcggcggtatcaagcaccgaaagggtcctagaaatgagaacacccagtcccgtgatgacgaaccccctgagcccactgtggacgaagtcgtcaaaaaggctcaagagattggccaacagccaaagttggagccagacgtcataaccattccaaacggtgtcgataatgtttctggtcctattctgaagatgggcagtctggaggtcaaccaggagcaacagctcggcataggaagcaacggtaccatcgttttcgccggaaagtgggatggacgtgatgttgccgtgaagcgcatgctggtccaattcaatgagattgccagccaggaaaccaagttgctgagagagagtgacgatcatccgaacggtgagtggtatcagcatgtgaacttgatcggtcatgtcacccttactaactgtcgcagtcatccgttattttgctcaacaacagtctgccggattcctatacattgctctcgaactttgccaggcgtccctcgcagatgtcatccagcggcccagtatgttccgtgaacttgctcaggcgggtgagcgcgacatgccgggagttttgtaccaggtcgccaaggggttgagccatctgcacagtcttcggatcgttcatcgtgacctcaagccccagaacatccttgtcaacatgggtaaagatggtcgcccgcgcattctcgtttctgactttggcctttgcaagaagctggaaggtggacagtcgtcgtttggcgctactaccgcccacgcggctggtacaacaggctggcgtgccccggaactgttgcttgacgacgatggaggccccggaccaggtgccacgatgacttttaccgaccctggttccagcatgcacagtgcttccggtacaggttctggagttgtgggagctggtgtcaatgtgcgccgcgtcacccgagcgatcgacatcttttctcttggtttggtcttcttctatgtcctcaccaagggacatcacccctttgaccttggtgatcggtatatgcgcgagtcgaacattcgcaaaggcaaatatgacttgcaactccttgaagtcctcggcgactacgctcatgatgccaaagatctcattgagagcatgctgaacagcaaccccaagaaacggcccactgcgatcggcgtcatggctcatcccttcttctggagtcctaggaagcgcctcaatttcctttgcgacgtctcggatcactttgaaaaggaacctcgtgatcctccttcgccagcacttgcgttgctagaggaccagagctcttgcgtgattaccaacggtgatttcctcaagaccttgcccagggagtttgttgaatcactgggcaaacagcgcaagtatacaggcaatcgtatgcttgatctcctgcgggcgctacgcaacaagaagaaccactacgaggaccttactccccagcttaggaagatggtcgggccgttgccggaaggatacctcggtttctttacgactcgctttcccaaccttttgatcaaatgctgggaagtgattgcggatcttgagctggaggaatcggatcgattcaaggagtactatgaacca

SEQ ID NO: 27557 - DNA, 1724 bp, Neurospora crassa
tcgtttagccccacccagatcttcgaggagggcaccacagaagagaagggagagaatgcccgtctcagcgccttcgtcggcgccattgctgttggcgacctcgtcaagagcacccttggtcccaagggcatggacaagatcctccagtctgcgtatgcttgttcaccaaaccccccgcctacatgcttgacacgccgccgtcatgtgctgaccgcaccatcacaacatccagctcgaccggtgagattctagtaacaaacgacggtgctactatcctcaagtctatcgctctcgacaacgccgctgccaaggtcctcgtaaacatctccaaggtccaggacgacgaagtcggtgatggcaccacctcggttgccgtccttgccgccgagctcttgcgcgaggccgagaagcttgtcgacaagaagatccaccctcagactatcatcgagggttaccggatagctagccaggctgcgctcaaggccctcgaggactctgccgttgaccacagcagcaaccccgaggcgttcaggaaagaccttgtcgccatcgcgcgcacgacactcagctccaagattcttgcccaagacagagaccactttgccgagctcgcgaccgaggccattctgcgcctgaagggttccgccgaccttagccacatccagatcatcaagaagtccggtggcaagctcagcgaatcatatctcgacgatggctttattctcgacaagaagatcggtgtcaatcagcccaagcgcctcgagaaggccaagatccttattgccaacacatcgatggataccgacaaggtcaagatctttggtgcgcgcgtcaaggtcaactctaccagcaagctcgccgagcttgagaaggccgagaaggagaagatgaaggccaaggttgagaagatcaaggcgcacggcattaactgcttcatcaacaggcagttgatttacaactggcccgagcagctgttcaccgatgccggcatcatgtcgatcgagcatgccgatttcgatggcattgagcgccttgctctcgttaccggcggtgaaatcgcttctaccttcgaccacccggagcaggtcaagcttggatatgccgacttgattgaggagattattattggcgaggatacccttatcagattctccggcacggctgccggccaggcttgcactgtcgttctccgcggtgctaccgatcagttgcttgacgaagccgagagaagtttgcacgacgctcttgccgttctttcacagaccgttaaggagtccaggacaacactgggtggtggatgcgctgagatggttatggccaaggctgttgagggtgctgctactcgggttgagggcaagaaacagaccgctgtgtctgccttcgccactgctctcaggcaactgcctaccatcctggctgacaacgctggtctcgattctggcgaccttgttgcccgtttgcgcaaggctatctatgacggtctgaccacctatggtttggatctcatgacaccaggcggcggtattgccgatatgagagacttgggtgttattgagagttacaagctcaagaaggctgttgtttcttcggccagtgaagccgctgaggtatgtaacccctatttcaatgctgaatacggctttgagcatgctaaccatcgtgaatagttgcttttgcgtgtggacgacataataagagcggcccccaggaggcgggagaggcac

SEQ ID NO: 27558 - DNA, 1239 bp, Neurospora crassa
aaggccgagttcggcaagctgctcgacacgtatggcaacgagttcgaggtccccgacttcaccatcaaggacatccgcgatgccatccccgcccactgctttgagcgttcggctcttcacagcttggcgcacgtcgtccgcgacatcatttacctcaccgtcactttttacgtctggaacaagtatgtcactcccgagtacatccccatgaaggctgcccgtgtcgtcctctggggtctgtacaccttcatgcagggccttttcggcaccggtctctgggttcttgcccatgagtgcggtcaccaggctttctccccgtccaggttgatcaacgacaccgtcggctgggtcctccactctgcccttctcgtcccctacttctcgtggaagttctcccacagcaagcaccacaaggccaccggcaacatcgagcgtgacatggtcttcgttcctcggacccgcgagcagtttgcgtctcgcatcggccgtttcgtccatgagatttccgagttgaccgaggagacccccatctacaccttgatccaccttatcggtcagcagctcatcggctggcccaactacctcatgaccaacgtcaccggccacaacttccacgagaggcagcgcgagggtcgtggcaagggcaagaagaacggctggttcactggtgtcaaccacttcaaccccagctctcccctctatgaggagcgtgaggccccctggatcatcgtctccgacatcggtatcgctatcgccgccaccgccctcatctacctcggcaacaccttcggctggtccaacatgttcgtctggtacttccttccctacctctgggtcaaccactggcttgttgccatcacctacctccagcacaccgacccctcgctcccccactacacccctgatcagtggaactttgtccgtggtgccgccgcgactattgaccgcgagttcggcttcatcggccgtcacctcctccacggcattatcgagacccacgttctccaccactacgtcagcaccattcccttttaccacgccgacgaggcctccgaggccatcaagaaggtcatgggccgtcactaccgcgctgacgtccaagatggccccatcggtttcatcaaggccatgtggaaggctgctcgttggtgccagtgggttgagcctaccgagggcgctgagggtaagggcaagggcgtcttgttctaccgcaaccagaacggtctcggtgtcaagcct

SEQ ID NO: 27559 - DNA, 1463 bp, Neurospora crassa
gcactgcgatccatctcgtcgatccggaaacgcctgacgcccgacatcctcgcacaagtcgtctcagaaaccttctccgcgtcctcacccaatactcaagttgccgagcacctgctgctcgctgtcgaccggccaaatgtgactctcggcagcagctcagacatggagatcgactcgggatccaagtcgccagcgaagaacggtggcaagaaggaccccaaggaggtgattcctgagatcgacatcttcctaggcattctggcgcaggtccacctctacgacaccaaacagttccagcgcggattcgccctgtcgcgtttcctatccgagcgtatccagtccctcaaccgccgcacattagacagcctttcggccaaggtgtacttttacttctcgctctttgccgagcagctcgctcccctcccgccttccccccagtcgccgattgtgtcgatccgcccgatcctcctcgccgctctccgaaccgccgtgctacgaaaggatatcgacacccaggcttccgtcattgtcctcctgctccggaactacctcctcacgtcgcatatctcccaggccgatctgctggtgcagcatacccagttccccgagaacgctgccaacaaccaggtcgcgcgtttcctgtactacctcggccgtgtccgggctattcagctacggtacaccgaggcccatgagcatctcactgcggcgacacggaaggctccctcgagcgcctgcgcacttggcttcagccagacggccaccaagctcctgctcgtcgtagagctcctcatgggcgacatccccgaccgcgccatcttccgtcaactgaccatggaggccactctccacccgtacttcctgctcgtccgcgccgtgcgcgtcggcaacctcgaggacttcgagaccaccatcgcccagcatgccgacaccttccgccgcgacggcacctatagcttgattttgcgtctgcgccaaaacgtcatcaagacgggcatccgcatgatgagtttgagctacagccgcatttcgctccgcgacatttgcatccgcttgcacctcggcagcgaggagagtgccgagtacattgtggccaaggcgatcagggacggcgtcatcgaggccacgctcgacagggagcgcggcttcatgaagagtaaggaggtgggcgacgtgtatgccaccagcgaaccggccgaggcgttccatgaccgtatccgcgcctgcttggctctgcatgatgagagtgtcaaggtatgtttcttttttttctttctccccctttcaaattccagaagttatgatagatttgttgctcacaaattctttctttgcaggccatgcgtttccccatgaaccagcaccgtctcgagctgaagaatgcccaggaagcacgagagcgcgagcgtgatttggccaaggagatacaggagggcgatctggatgaggatgatctcggtggt

SEQ ID NO: 27560 - DNA, 2793 bp, Neurospora crassa
atttaggtcgacgacgaacatggcttcattcgcttctacaagtccctgccccaacttggcgaagaggccatcaggattttcgacagaggcgactggtacacagctcacggcgacgatgccaccttcattgcccgaaccgtctacaagacaacatccgtcattcgccagctaggtcgaagcgaccataccggccttccatcagttaccatgaccgtgaccgtattccggcagttcctgcgtgaagctctgttcaagctagggaagcgaatcgagatttgggccagtcccagtggccgcatgaactggaaggtcgtcaagcaggcttctccgggaaacctgcaggacgtggaggatgaactaggtggccagttcgagggagcgcccgtcatcctggcggtcaaaatctcagcaaaggcttcggaagccagaacagtgggagtgtgctttgccgatgccagtgtgcgggaactgggagtcagcgagttcctcgacaatgatctatactccaacttcgaagcgttgctcattcaactaggcgtcaaggagtgtatcgtcacacaggacaagggcgagaaggaaaaggacccagagttggccaagttgaggcagatcatcgacaactgcggtgttgccatagcagagaggtctgcgggcgagttcggcaccaaggacattgagcaagatttgtcacggctattgaaggatgagcgcgctgccagcttgctcccacaaaccgacttgaaactcgccatgggatctgcctcggccctgatcaagtacctaggcatactgcatgatccgtccaattttggccagtatcaactgtaccagcatgacttggcccagttcatgaagctggatgcggcagcattgaaggctctcaacctcatgcctggtgctagagatggcgcaaagaacatgagtctgtatgggttattgaaccactgtaagactcctgtgggaagcagactactgtcccaatggctcaagcagcccctgatgaatgccgaggaaattgagaagcgccagcaactggttgaggcctttgccaatgacaccgagctacgacagtcaatgcaggaggaacatcttcgatccatccctgacttatatcggctgtccaagcggttccagcgtggtaaagcaacactagaggacgttgtgagggcatatcaagtggttatacgcctgcccggctttattggaaccctcgaaggcgtgatggatgaagcctaccgcgacccgcttgatgaggtctacaccaacaaactccgcgagctctcagacagcctcgttaagctgcaggaaatggtcgagaccacagttgaccttgacgccctggacaatcacgagtttattatcaagcccgagttcgacgatagcctacgcatcatccgcaagaagctcgaccggcttcgcacagacatggacaacgagttcgccgaagccgccgaggacctcggccaggagcgcgagaaaaagatcttcctcgaaaaccacaaggttcacggctggtgcatgcgtctgacccgcaccgaggctggctgcatccgcaacaactcacgctaccttgagtgctcaacccagaagaacggtgtctacttcaccaccaagaccctccaagctctccgccgcgagttcgaccagctctcccagaactacaaccgcacccagagcagtctcgtcaatgaagtcgtcggcgtggccgcctcatactgccctgtcctcgagcggctcgccgccgttctcgcccacctcgacgtcatcgtctcctttgcgcactgctccgtccacgctcccatctcctatgtccggcccaagatccaccctcgcggaaccggccgcaccgtcctcaccgaagcccgccacccgtgtatggaagtccaagacgacgtaaccttcatcaccaacgacgtcaccctcacgcgcgaggactcgtccttcctcatcatcaccggccccaacatgggcggcaagtcgacatacatccgacagattggtgtgatcgcgctcatggcgcaaataggctgcttcgtgccctgctcatcagcagaactaaccattttcgacagcattctcgcccgcgtcggcgcgtccgactcgcagctcaagggcgtgtcgacctttatggccgagatgctggagacggccaacattctcaagtcggccacggccgagagcctgatcatcatcgacgagctcggccgcggcacatcgacgtacgacggctttggtctcgcctgggccatctcggagcacatcgtcaaggagattggctgcttcgcactgttcgccacccatttccacgagttgaccgcgctggcggaccagtatcctaacgtcaagaacctgcacgttacggcgcacatcagcggcactgacactgacaccgatgtaatcaccgacgaagacgaaaaggcaaagaagaagcgcgaggtaaccctcctatacaaagtcgaacccggcatctgcgaccagagcttcggtatccacgtcgccgagctggttcggttcccagacaaggtggtgcgcatggctaagcgcaaggcagacgagctggaggactttaccagcaagcatgaggaggaaaacggggggggtctaggtgtccagtacagcaagcaggacgtggaggagggtagtgcgctgttgaaagacgtactggtgaaatggaaggatgaggtgaagagtgggcggatgagtaaagaggagatggtggcgaggttgaaggagttggtacagaaggatgagaggttgttggggaatccgttctttaagagtgttcaggctttg

SEQ ID NO: 27561 - DNA, 1311 bp, Neurospora crassa
gcctcagatcccgaagtcatgcgcacattctaccagcgcctcttcccatggcgatacctgttccagtggcttaaccacagcccaacacccaccaacgatttcggccatcgtgaattcgcctttacgttgcagaacgacgcatacctacgataccaatccttcaccacctcggatctgtgagtttgtctatccggttcccttccagctatccatcttactaacccgaccaacctgaacagactccgtaaagatgtcctccgcctcatgccctcgcgtttcgaaattggtcccgtctacacagccaacccccgcgatcgcaaaacgctacggaactcgtcagctttccggcccctgtccaaggaactctgcttcgatatcgatctgacagactacgatgacatccgtacttgctgcgacaaagccaacatatgccaaaagtgctggcaattcatcaccatggccatcaaggtcgtcgacacggctctgcgcgaggactttggcttcaagcacatcatgtgggtatactcgggtcgtcgcggtgctcacgcatgggtatgcgacaagagtgcgcgggcgctagacgaccagaagcgacgcgccatcgccggctacctcgaagtcatccggggcggcgcgcaaagcggcaagaaagtcaacctccgccggccgctgcacccgcacttggtccgctccctcgacatcctcaagcagcattttcagtcggacgtgcttgaggcccaagacccctggcgcaccgaggaccagcaagagaagctcctcgcccttttaccttcggatcagaagcaactcgtgtccgccctgcgcaacaagtgggcttcatcgcccgaccggccgtccaccctgaaatgggccgacatcgacagcgtggccaagacgtccactgccaaaaactttgacaccaagtccctcctggacgccaagcaggatattgtgctcgagtacacgtacccgcgccttgatatcgaagtgtccaagaaactcaatcatttgctcaagtctccctttgtcgtgcacccgggcacagggagggtgtgtgtgccgattgatgtgaagaggggattagagagttttgatccgctgggggtgccgacggtgcagagtctgattagggagattgacgagtggaagaagccagaaccaaaagaagggcgccaggagcaggaggtggagaagcatgtggtggattgggagaagacgagtctgaagggctatattgagtttttcagaagcttcgtgattgggttgatgaaggatgagagggaggttaaggtgaagagggaacgagaggag

SEQ ID NO: 27562 - DNA, 937 bp, Neurospora crassa
gttggaaactataccctcggacgactaattggcaaaggatccttcggcaaggtctacttggccacccacaaacttaccaatggctccaaggtgtgttgcgctggcggcctctttctgttccttccgagacactcgggctaattcgtccttcaatctttctcttcggtcgcatatataggtcgtgctcaagtcagccaacaaggatgacaccaacctcgctcgcgaaatccatcatcatcgccagttcgtccacccgcacatcgcccgactatacgaggtggtcgtaacggagaacttggtatggatggtgctagaatactgtccaggtacgaaaaaacaaataccttaaccacctttccatctcgtatgcgccctctctaaagttacattgacgtgtttcacaggcgacgagttgtacaattacctccttcaacatggcaagctaccggtcgataaggtgcagaggatctttgcgcaactggtgggcgccgtgtgctacgtccatcggcaatcttgtgtccatcgagatctgaaactggaaaacatcctcctcgacaaacacgagaacgtcaagctatgcgactttggtttcacacgcgaatatgagggcagtgccaagtatctgcagacgttttgcggtaccatctgttactcggctccggaaatgctaaagggcgaaaagtatgcgggcgaaaaggtggatgtttggagtttgggggttattctctttgcccttctctgcggcgagcttccctttgacgatgatgacgagcaagttacccggcgaaagattcttggcgaagaaccagtttaccccgatacccttccggaagatgcgctctctcttctaaagacactactatccaaacgaccgctgatacgaccgtccctacccgatatcctcgcccaccccttcctcgccgaatatgcgccacag

SEQ ID NO: 27563 - DNA, 1612 bp, Neurospora crassa
atagtcgtgattgatggctggggtattccctccgaggagtcccccaagaacggcgatgccattgccgccgccgagacccctgtgatggacgagctgtccaagagcgccaccggtttcagtgagcttgaggcttcctcccttgccgtcggtcttcccgagggtctcatgggcaactccgaagtcggacatctcaacattggcgccggccgtgtcgtctggcaggacgttgtccgtatcgaccagactatcaagaagggagagctcagccagaacgaggtcatcaaggccacctttgagagggcgaagaacggcaacggccgtctccacctctgcggtctcgtctcccacggcggtgttgtaagtgatcaatgtccacggaacagcagatgattgttggtagtctgcacaattgctgacagttctcttcccatagcactccaagcagacacatctctatgccctgctcaaggctgctaaggaggccggcgtccccaaggtcttcattcacttctttggcgatggccgcgacaccgaccccaagtccggcgctggctacatgcaggagctcctcgacaccatcaaggaaattggcattggtgagcttgccaccgttgtcggtcgctactatgccatggaccgcgataagagatgggagcgtgtcgaggttgccctcaagggcatgatcctcggcgagggtgaggagagcaccgaccccgtcaagaccatcaaggagcgctacgagaagggcgagaacgacgagttcctcaagcccatcgtcgttggtggcgatgagcgccgcatcaaggaggacgataccgtcttcttcttcaactaccgctccgaccgtgtccgccagatcactcagctcatgggtggtgttgaccgctcgcccctgcccgacttccccttccccaacatcaagctcgtcaccatgacccagtacaagctcgactatcccttcgatgttgcctttaagccccagcaaatggacaacgtgctcgccgagtggctcggcaagcagggtgtcaagcaggtccacattgccgagaccgagaagtacgcccacgtcaccttcttcttcaacggtggtgtcgagaaggtgttccctctcgagacccgtgatgagagccaggatctcgttccctccaacaagagcgtcgcgacttacgacaaggctcctgagatgagcgccgatggtgttgctaaccaggtcgtcaagcgtctcggtgagcaggagttccccttcgtcatgaacaactttgctcctcctgacatggttggccacaccggtgtctacgaggctgccattgttggttgcgctgctaccgacaaggccattggcaagattctcgagggctgcaagaaggagggttacatcctcttcatcacctcggaccacggtaacgctgaggagatgaagttccctgacggcaagcccaagacctctcacaccaccaacaaggtgcccttcatcatggccaacgcccctgagggctggagcctcaagaaggagggtggtgtccttggtgatgttgctcccacgatccttgcggctatgggtctcccccagcccgcggagatgactggccagaaccttcttgtcaaggcctaa

SEQ ID NO: 27564 - DNA, 1399 bp, Neurospora crassa
atgggcgacgtccttgtcgagaccccggccagtgtgacccagcctcaaaagaagtccgccccttcggcgatccccaacatcgagaccttcgagggcgtgtcaacagagggcggcgatgactacattaccttgaagaagcttcagaggcagctagaatacatcaagctgcaggaggaatacatcaaggatgagcagaggtatggtcacagaagctccacgcgctgagagcttgatgaggaggggctgacaacatggtatctggcaggagcttgaagcgtgagcttgtacgtgcccaggaggaaatcaagaggattcaaagtgtccccttggtgattggacagttcatggaagctatcgatcaaaagtatggccgcccaatgcaaccccccgtcttcaaaactggcccagactaacccttcctctcagcacgggtatcgttcaatccagtactggctcaaactacgtcgtccgtatcctttcgactctcgatcgcgagctcctcaagccctcatcctccgtagcgctccaccgtcactctaatgccgtcgtcgatattttgccgcccgaggctgactcctcgattgctatgctcggtgccgacgagaagcccgacgttacatatgccgatgttggagggttggatatgcagaagcaggaaattcgggaagccgttgagctgcccctaacacactttgatctttacaagcagatcggcattgaccccccgcgcggtgtccttctctacggtcctcccggtaccggcaagacaatgttggtcaaggcggtcgcaaactcgacgacagcgaactttatccgcgtcgtcggttccgagttcgtacaaaagtatctcggtgagggtcctcgcatggtgcgcgacgtcttccgcatggctcgtgagaacgcgcccgccatcatcttcatcgacgaaattgatgccattgcgaccaagcgtttcgacgcgcagacgggtgccgatcgtgaggtgcaaagaattctgctcgaattgctcaaccagatggacggtttcgaccagaccgccaacgtcaaggtgatcatggccaccaaccgtgccgacaccctcgatcccgccctgctgcgtcccggtcgtcttgatcgcaagatcgagtttcccaacctgcgcgatcgccgcgagcgccgtctcatcttcaccacgattgctggcaagatgagcttggcccctgaggtcgaccttgacagcttgattgtccgcaacgatcctctcagcggtgccgtcatcgctgccattatgcaggaggccggtctgcgcgcagtacggaagaacaggtacaacatcatccaggctgatttggaggacgcctacagcagccaagtgaagggtacgagcgacgagaacaagtttgatttctacaagtaaacc

SEQ ID NO: 27565 - DNA, 816 bp, Neurospora crassa
ggccaacccttcgacatagtcaaagtccgcctccaaacctccacccaatactcctccgccctcaccgccgccgcctccatctacaagcacgaaggcgcgctcgccttctacaaaggcaccctgaccccgctcctgggcatcggcgcctgcgtctccatccaattcggcgccttccactcggcccgccgcttcctcgagcaacgccgcgccgccaccgacaagtccttcatcccgggcgtctccaacctcgggtacggcgagtactacgcggccggcgcctttgcgggcgtcgccaactcggtcatctcgggccccattgagcacgtgcgcatccgcctgcaggcccagccgcacggcgcggggaggttgtattccggcccttgggactgcgtgcgcaagctcagccagcaggcgggcggcgtgctgccggggttgtaccggggcgaggtggtgacggtgttgcgggaggcgcaagcgtacggcctgtggtttttggcgtttgagtggttgatgaatgcggatgcggccaggaacaagattgaccgcaaggagatcccgagttacaagattgctttgtacggtggactggcgggcgaggcgctttggttgggcagttacccgttggatgtggtcaagagtaagatgcagacggacgggtttggggcagggcaaaagtataagagcatgagggattgttttgcgcagacgttcagggctgagggcatgagaggattctggaagggtattgggccgacgctgttgagggccatgccggttagtgcgggaacgtttgcggtggtggagatgaccatgagg

SEQ ID NO: 27566 - DNA, 1320 bp, Neurospora crassa
atgaagggtgctttgttgacggcagctatgctgcttggctcggctcaggccggagtgcacacgatgaagctcaagaaggttccacttgcggagcagcttgtaagtgttgactgtttaccttgatggctactatggacacttgttgatgatgttggttatcaggagtcggttcccatcgacgtgcaggtgcagcacctcggacagaagtacactggtctcaggaccgagtcccatacccaggccatgttcaaggccaccgatgctcaggtttccggcaaccacccggttcccatcaccaactttatgaacgctcagtgtaagcatcacacccttctttgatcactcggtgtatgttggcgtgggcacagtaactaacgtctggtagacttctccgagatcaccatcggaacgccaccccagaccttcaaggtagttctggataccggcagctccaacctttgggttccctcttcccagtgcggctccatcgcctgctatctgcacaacaagtacgagtcttccgagtcgtcgacatacaagaagaacggaacgagcttcaagattgagtacggctctggtagtctcagcggcttcgtctctcaggacagaatgacgattggtgacattaccatcaatgaccagcttttcgccgaagctaccagcgagcccggcctggctttcgcctttggtcgctttgatggcatcctcggcctcggttacgaccggattgccgtgaatggcatcacccctcccttctacaagatggttgagcaaaagctcgttgatgagcccgtcttctccttctacctcgccgaccaggatggcgagtccgaggttgtgtttggcggtgtcaacaaggacaggtacactggcaagatcactactattcctcttcgccgcaaggcctactgggaggtggactttgatgctatcggttatggcaaggactttgcggaactcgagggccacggtgttatccttgacaccggcacctctcttatcgctctccccagccagctcgctgagatgctgaacgctcagatcggtgccaagaagagctggaacggtcagttcaccatcgactgcggcaagaagtcgagccttgaggatgtaaccttcacgcttgctggctacaacttcaccctcggtcccgaggactacattctggaggcttctggcagctgcctgtcgaccttcatgggtatggatatgcccgccccagttggtcccttggccatccttggagatgctttcctccgcaagtactactcaatctacgacctcggcgccgatactgtcggcatcgccaccgccaagcgc

SEQ ID NO: 27567 - DNA, 1457 bp, Neurospora crassa
atgagtgccgccaacggtcgacaacccgaagtgcagccgtgtcgatacaaagttggcaagactttgggcgccggttcatactcggtcgttaaggaatgcgtacacatagacaccggtcgctactatgcggccaaggtgatcaacaagcgcctgatggccggccgggaacacatggtacgccgcccattccttccatcatccaaagccatgtgcgatccgttaccttatcctaaccagcagactataggttcgcaatgaaatcgccgtgctcaagaaggtgtccatgggccaccagaacatcctgaccctggtcgactacttcgagaccatgaacaacctctacctcgtcactgacctcgccctcggcggcgagctcttcgatcgcatctgtcgcaaaggctcttactacgaatccgacgccgccgacctcatccgcgccaccctgtccgccgtcgcctacctgcatgaccacggcatcgtccaccgcgacctcaagcccgagaacctccttttccgtacgcccgaggacaatgccgacttgctgatcgccgactttggtcttagccggatcatggatgaggagcaattccatgtcctaaccaccacctgcggcacacccggctacatggccccagagatcttcaaaaagaccggccacggcaaacccgtcgacatctgggccttgggagtaatcacttactttctgctgtgcggctacacccccttcgaccgcgactcggactttgaggagatgcaggccatcctcaatgccgattactccttcaccccactcgagtactggcgcggcgtctcggacaacgccaaggactttattcgcaggtgcttgaccattgacccggccaagcgcatgaccgcccacgaggcgctgcagcaccccttcgttgctggctgggcccgcggaaccgatggtgcggaggccgataagggcgctaacctgctgccgaccgtcaagaagaactttaatgcgagaaggacgctgcatgcggctatcgatacagtacgtgctattaacaagctgcgtgagggccagttcatgaacggcgggaggagccgtgagcccgcgaagaaagcggcagcgggtgcgggtgcggtgcccccagcggcaggaggtggaggaggaggcccaggagtggatgacggattggcggtagcgctcggcccaacgctcgggaaggaggcaagcatggtgtcaacggcgagcagcaatgtcaccaaggacagcggctacgcaacacagccggaaggggagggaggctctagggacggagacgatgttcttatgaaggatgcgtcggtgccagcgccaacatcatcatcgccagcgccggtgcatgggaacacacagaatgcacagcatgcgggagtgccgagtatcctacggccgggcagtatcgagaataaggttgtcgagactggtaaaggcttgtggaatggga

SEQ ID NO: 27568 - DNA, 1185 bp, Neurospora crassa
tactacaacgagactcacgccgccctccgtgccgagatccgcgagtgggtcgagaccgccattgacccctatgtcaccgagtgggatgagaagaaggaggttcctgctgagatctacaaggagatgggcaagcgcggctacctcgccggtctgctgggcaccaagtaccagagcaactatgtcgagaaccccatcaagtccgtccccgccgagaaatgggatctcttccacgagatgctcgtaaccgacgagctctctcgtaccggctccggtggtttcgtctggaacgtcattggcggcttcggcattggctgccctcccctcgtcaagttcggcaagaagccccttgtcgatcgcattctacctggcatcctcaacggtgacaagcgcatctgccttgccatcaccgagcccgacgccggttccgacgttgccaacctcacctgcgaggccaagcttaccgaggacggcaagcactacatcgtcaacggcgagaagaagtggatcaccaacggtatctggtccgactacttcaccacagccgtgcgcactggtggccccggcatgaacggcgtctctctcctgctcattgagcgcgacttccccggcgtgtccacccgccgcatggactgccagggtgtctggtcctcgggcaccacctacatcacctttgaggacgtcaaggtccctgtcgagaacctgatcggcaaggagaaccagggcttccgcgtcatcatgaccaacttcaaccacgagcgcatcggcatcatcatccagtgcctgcgcttctcgcgtgtctgctacgaggagtcggtcaagtacgccaacaagcgccgcacctttggcaagaagctgatcgagcaccccgtcatccgcctcaagctcgcccacatggctcggcaaatcgaggcctcgtacaactggctcgagaacctcatctaccagtgcgagaagatgggcgagaccgaggccatgctccgtctcggcggcgccatcgcctccctcaaggcccaggccaccgtcacctttgagttctgtgcccgcgaggcctcccagatcttcggcggtctatcctactcccgcggcggccagggcggcaaggtcgagaggctgtaccgtgatgtcagggcttatgccatccctggtggctcagaggagattatgcttgatcttagcataaggcag

SEQ ID NO: 27569 - DNA, 1143 bp, Neurospora crassa
agctccatgagcatctacagcttcctaatcgccgtccgctccgatggccaacaactaatgaacgaggccggcgaaaccacgtcgcatctaatgggcatgttctaccgcaccctacgaatggtcgacaacggcatcaagccgctttatgtattcgacggcgcgccgcccaaactcaagtccggggagctagccaagcggttccagcgcaagcaggaagccaccgaagggctggaggaggccaaagaaaccggcacggccgaggacgtggagaagttcagtcggagaacggtccgcgtcacacgcgagcataatgccgagtgccagaagttgttgaagttgatgggcatcccctacattgtggcgcccaccgaggcggaggcgcaatgcgcagtgctggcgcgggcgggcaaggtgtatgcggctgccagcgaggatatggatacgctgtgcttcaacgcgccgattttgcttaggcatttgacgtttagcgagcagaggaaggagccgattcaggaaatccatttggagaaggtgttggaggggttgggtatggagaggaagcaagtatgttttccccccctgccttttgtttcttcgggctatcaaaaaaatactgcgatatgctgacagcaccctcttttacagttcatcgacctctgcattctccttggctgcgactacctcgaccccatccccaaagtcggacccagcacagcgctcaagctgatccgcgagcacggcacactggagaaggtggtggaatggatgaaggcggaccccaagggccgctaccaaatcccagaggactggccgtttgaggacgcgcgcacgctcttcttcgagccggacgtgcggcccgccgacgacccgctgtgcgactttaagtgggataagcccgacatcgaggggctcatccagttcctggttcatgagaaggggttttcggaggaccgtgtccgcagcgcgggcacaaagctggagaagaacatgaagacttcacaacaggcgagaatcgagggtttcttcaagatactgcccaagacggaggaggagaagaaggcgcataagcgcaaactggaggagcaggcggagcagaagaggaagaaggtcaaggaggagaaaaaggaaaaggcgaagcttaag

SEQ ID NO: 27570 - DNA, 485 bp, Neurospora crassa
ggatcgaaccgcgtggcatcttgctcgcgaacaggcatactgacatgctcgattgaatagttccactggcaagcgaccattatgggccctgccgactccccctacaccggcggcgttttcttcctcaacattcagttccctaccgactatccttttaagcctcccaaagtcagctttaccaccagaatctaccaccccaacatcaactcgaacggcagcatctgcctcgacattctgagggatcagtggagtccggcgttgacgatctccaagggtatgtttctctgtgtccatgctcttctagctagcgcccatatggtccttcggctgctgacaagtgtgcagttctgctctccatctgctcgatgttgacggatcccaaccctgacgacccgcttgtgcccgagattgcgcacgtgtacaagacagaccgcgccaggtacgaggcgacggctcgcgagtggacccggaagtatgctatctag

SEQ ID NO: 27571 - DNA, 1173 bp, Neurospora crassa
gcctttgcctctgccacctccaacgctccctcctttaactgggaagaccctctcaaccacaagtctctcttgaccgaggatgagattgccatcggtgagaccgccgagcgttactgccaggaacagcttttcccccgcgtgctacaggcctatcgcgatgagcactacgaccccaagattctcgaggagatgggcgatttgggcctgctgggcgctaccatcgaaggctatggctgcgccggcgtctcctccgtggccagcggtctgatcacccgcgccgtcgagcgcgtcgacagcggttaccgcagcggcatgtccgtccagtcctcgctcgtcatgggccccatcaacgacttcggcaccgcggagcaaaaggagcgtttcctgccgggcatggccaagggcaagatcatcggtgcctttggcctgactgagcccaaccacggctccgatccgggctccatggagaccgtcgcccgtccccaccctaccaaggagggcgtctatctgcttagcggctccaagacctggatcaccaactcgcccatcgccgacgtcctggtcgtctgggccaagcttcaggagacgggcaagatccgtggcttcctggttgagcggtccgcctgcccaccaggtacgctcgaaaccccccagatcaagaacaagacgggtctgcgggcctccatcacgggcatgatccagctagacaactgcccagtgcccaaggaaaacatgttccccgaaatcgaagggctcaagggccccttcacgtgcctcaacagcgcccgcttcggtattgccttcggcatgatgggcgcgctcgaggactgcctggctcgggcccgcacctacgccctcgagcgcaagcagttcaagggcaacccgctggccaagtaccagctcgtgcagaagaagctggccgaggcggccaccgacgtcgcctacggtaccctggctgccatccaggtcggccgcctcaaggacgagggcaaggccacgcccgagatgatcagcatgatcaagcgccagaactgtgatcgcaccctgtaccacgcccgcacgctgcaggagatctttggtggtaatgctgtgtcagatgagtaccatattggccgtgttgttgccaacttgtatgtaacgcagacatatgagggccagagtgatattcacagt

SEQ ID NO: 27572 - DNA, 1185 bp, Neurospora crassa
gaccctctccgtcttgtcgccggcgagatgaagttcctaacaggcaacatccgcaagctcctgggctctggccacccctcgctcgaccgcgccgccaagtactacacacaggccgagggcaagcatgtgcgcccattaatcgtccttctcatgtctcgcgccaccgctttgtgccccaaggctcctcaaaggcaacaatcgactctccaggcctcggccgccattgatacctcgatctcgcctctcaacatcctctccgacttcaacccttctgacgccactcccgtctccattcccgcagataccgacatcctcccttcccagcgacgacttgccgagatcaccgagctgatccataccgcctcgcttcttcacgacgatgtcatcgatcactccgagtcccgccgcggcgctccctccgccaacctcgaattcggaaacaagatggccgtcctggctggtgacttccttcttggcagagcctccgtcgcccttgcccgcctccgccacgccgaagtcgtcgagcttcttgctaccgtcattgccaaccttgtcgagggcgagttcatgcagctcaagaacacggctcgcgacgaaaagaaccccaaatggtccgaggagactctcacctactacctccaaaagacctacctcaagaccgcttccctgatcagcaagagctgtcgcgcgtctgcgctgctgggcggcgctgatgcggcgacggtggatgctgcctacttgtatggcaagaacctcggcttggccttccagctggtcgacgacatgctggactacactcgcagtgagaaagagttgggcaagcctgccggtgctgatcttgagctgggcctggcgactgcccctctactgtttgcctggaagacgatgccggagcttggtccgttggttggcaggaaatttgagaaggagggtgatgctgctagggtatgtttctcctgctctgctagctgttcgatctctctctcacacacacactcacacaaatgctaacatcgttatgaacaggcaagagagttggttctccagagtaacggcatcgagcagacccgtgctctcgcccaggattacgccgaaaaggccatcgaggccatcagcgggttcccagacagtgaagccaaggatggcctaatagaaatggccgtcaagacgctaaagcgcaacaag

SEQ ID NO: 27573 - DNA, 2714 bp, Neurospora crassa
cgcgacatcctccccgacaacttcaagcccatccactatgatctcgagatccgtgatcttgacttcacctcgtggtcctacaagggcaccgtaaggtacgcttgagattcccatctccccgagtcccttcgtttggcgccatctgacttgcgacaacaactcccaggatcgacggcaagctcgtcaagcccaccaaggacattgtcctcaacaccctcgagatcaagctcctcaacgccaagttgacggccggcccgcaatcatgggagtcgacccagtttgccgaggacacaaaggcccagcgctccaccatctccttcgccgaggagctccccgtcgccgacaatgtctccctgaccctcgacttcaccggtgagctcaatcacgacatggccggtttctaccgctcccagtacaagcccgctgctcctgcggccgccagtgtcccccgcgacgacgagttccactacatgctcagcacccagttcgagtcctgcgatgctcgccgcgccttcccctgcttcgacgagcccaacctcaaggccaccttcgatttcgccattgagatccccgacgaccaggtcgccctctccaacatgcccgtcaaggagaccaagcccgccggccccaacaagaagctcgtctccttcgagcgcagccctgtcatgagcacctacctcctggcctgggctgttggcgactttgagtacgtcgaggcctttaccgaccgcgagtacaatggcaagaagctccccgtccgtgtctacactacccgcggcctcaaggagcagggcaggtgggcccttgagcacgcccccaagatcatcgactacttttcggagcagttcgagatcgactacccgctccccaagagcgatatcttggctgtccacgagttcacccacggtgccatggagaactggggtctcgtcacgtaccgcatgaccgctattctgttcgatgagaagctttccgaggccaggttccgcaaccgtattgcctatgtcgttgcccacgaactcgcccatcagtggtttggtaaccttgtcaccatggactggtgggatgagctctggctgaacgagggtttcgctacctgggctggttggctggcaaccgatcacctccaccctgactgggaggtgtggccgcagttcatcaacgagggcatggaccaggctttcctccttgactccgtccgcgcctcacaccccatccaggtcgaggttcgcgacgctctcgatgtgaatcagattttcgacaagatcagctacctcaagggttgctccatgattcgcatgttggcctcccatcttggtatcaagactttcctcaagggtatcgctctctaccttcagcgccacgcttacggcaatgccaagaccgaggcgctctggaatgccttgagcgaggcttctggtgtcgatgtcaacaccatcatgcgtccctggattgaggaaattggtttccctgtagttagtgttaccgagggcaaggatcagatctctgtcaagcaggctcgtttcctgtctaccggcgatgtcaagcctgaggatgacaagaccacttggtgggttcctctgtccctcaggggtaagattggttcgcaggatattgagccactgtctctccagaccaaggagactaccattgacggcgtcagccaagacttttaccagctcaatgccaacgccactggcttctaccgcgtcaactaccccgagtctcgtctcaagactctgggtactcagctcgctcatctcactaccgaggacaagatcttcatcactggttccgcggccgatcttgcgtttgctggcaactccaccactgccgctctgctgtctttcgtccagggtctaaagaacgagacccactaccgtgttcttagccaggctttggactcggtcaatactctcaagtctatctttggcgacgacgaggaggtcaagaagggtcttgagaagttcactctcgagcttattgacaaggctctcaaggaggtcggctgggagcctaagcagggcgagaactacaacattcctctccttcgcaagcgcctccttcttactgcggtggccaactcgcacgaggaggtgattaatgaggccttcaggcgctggaacgaatggcgcgccaaccctaccggtgctcccatccctgcggatctccgtcttcctgtctaccgagctgccctcaagaaggaccccgccaacgccgttgctgccatcaaggaggagtggtttaccacccccgccatcgacggcaaggaggtctgcctccaggccctcggtcaggtcaccgacgagaccctcattgaggacgtcctccttcccttcctctttgactctgcgcctcccgctcatcccagagactcggtgcccggcgctgacatgcacattctgtctggcaacatggccgggaaccgcatcgctcgccccctcctctgggcctacctccgcgacaactgggacaagttcaacgccaagcttggcggtaaccccattcttgtcgaccgcatggtcaacgtcagcttgcccaagtttgcggatctcgagacgctcaaggagatcgaggacttctttagcaaggtcagcaccaagggcttcgacaggacgttggagcaggtcaaggataagatcaggggacgggcggcgtacaagatgagggatgccgaggttgttaagagctggttgaaggctaatgggtactgc

SEQ ID NO: 27574 - DNA, 883 bp, Neurospora crassa
ctccaagacaaagtcatcctcatctccggcggcgggcggggcgtcggcctcactcaagccgaggccgtcctcgaagccggcgcgcgtgtgcacgtcgtcgacattctgcccgacccttccaccgatcccgactctcccttttccgccgttgccaagcgcgccaccgaggaactggggtccagcattacttatcaccgtgtggacgtgcgtaatcagcaggcgctgaacgaagttgtgcaggggattgccaagaaggagggcaggatggatgggttgattgctgcggcggggatccagcaggagacgagcgcgctcgagtatagcagggaggatgcggacaagatgatgagcgtgaatgtcacgggggtgttcatgacggcgcaggcggtggcgagggtcatggtggaaaatgggtggccggggagtatggtgctgattgggagcatgagtgggacggtggctaatcgggggttgatttgcccgtgagttttgtgttcttttgcgtgcttgcttgcttccttctctcttttcccccttcccacctcaaagtttcaaccagactgatccccctcccgaaaaaaaaagcgcctacaatgcctccaaagccgccgtcctccagcttggccgcaacctcgcctcggaatggggcgagcatggcatccgcgtcaacacgctttcgccgggctacatcgtgaccgccatgacggccggcctcttcgaagcttttcccgagcgcaggaccgcttggcccgatgccaacatgctcaaaaggctaagttacccggaggagtaccgcggcgcggcgatcttcttgctcagtgatgcgagcagcttcatgacgggcgcggatctgaggattgatggtgggcattgtgcttggtaa

SEQ ID NO: 27575 - DNA, 5273 bp, Neurospora crassa
cactcgagtgcgcccttgcggaccatcaaggaaatccagtttggtctgctgtcgcccgaggagatcaagggcatgagtgtggcccacatcgtctacccagagaccatggacgagaccaggacaaaaccccgcgacggcggtctcaacgaccctctcctgggctccgtagatcgtcagttcaagtgcaagacgtgcggcgagaacatgtccgagtgccccggccatttcggtcacatcgagctggcccgacccgtctaccatccgggcttcatcaagcgggtgaagaagatgttggagattgtctgccacaactgcagcaaggttcttgctgacagagttcgtgcaacctatccttcagggtagtcttgatttgcggacgctaacctctcttctgtagaatgacaaagagttcgcggccgccatgaggatccgcgatcccaaggtccgcttcaaccgagtatgggctgtgtgcaagaaaaagaggagatgtgaaaacgaggtagtcaagaagagcgacgatgacgagttcaaccctcttgccgacgccaagggcgagctccccggccacggcggctgcggcaacgatcaccccaccgtccgccagcaggccctcaccctctatgcccagttcgataccaaggacgaggagggcgtcaagagcaaggagaagaagatcatcacccccgagatggcactcaacattttgcacaacatgaccgagtctgacatgatcgacatcggcatcaacatctctcaagctcggcctgagtggatgatcatcactgttctgcctgttccgccccctccagtccgccccagtatttccatggacggtaccggcaccggtatgcggaacgaagatgatttgacctacaagctcggcgatatcattcgagcaaacggcaacgttcgccaggccatccaggagggttctccggctcacattatcaacgatttcgagaacctcctccagtaccacgttgctacctacatggacaacgatattgctggtcaaccacaagctctgcaaaagagcggtcgtcccgtcaaggccattcgtgcccgtctcaagggcaaggagggtcgtctgcgtggtaacttgatgggcaagcgtgtcgatttctctgcccgtacagtcatcacaggcgatgccaacatctcgctggatgaagtcggtgtgccccgtagcatcgcgcgtacgcttacctatcccgagactgtgacgccctacaatattggcaaactcacccaatacgtccagaacggccctaacgagcatccgggtgccaagtacgttatccgctcagatggcagccgtgtcgatctacgccatcagaggcggacaggtccgctacagctggaatatggctggaaggttgagcgccatctcatcgacggtgattacatcatcttcaaccgtcagccctctttgcacaaggaatccatgatgggtcatcgtgtcaaggtcatgccctactcgaccttcagacttaacctttctgtcacatctccttacaacgccgatttcgacggtgatgaaatgaaccttcacgttcctcaaaccgaagaaactcgtgctgaagtcaaggagctttgcatggttcctctcaacatcgtctcgccgcagcgtaacggtccgctcatgggtatcgtgcaggacactttggctggtgcttacaagctttgtcgtcgtgacgtcttccttaccaaggaggaggtcatgaacattatgctctgggtccccgagtgggacggcatcattcctgtccctgcaatcctcaagcctcgtcctcgctggactggtaagcaaatcattagcatggttgttcccaagatcataaacctcaagaacatcgacgaggatgatggtgagtgccctcttaaggacaagggcattttgatccaacaaggtgaggtgattttcggcttgatgacgaagaagattgtgggtgctgctagtggcggtatcgtccatctctgctacaacgagctgggtcctagcggtgctatggatttcctcaacggctgccagagagtcgtcaactactggctccttcacaatggtcacagcattggtattggtgacactattcccgacgccgcgaccatcgccaaggtccagacgcacattgacgatgccaaggcagaagtcaagcagctcacagatatggccaccaacaatcagcttgagccattgcccggtatgaacatccgtgagaccttcgaaaacaaggtctccaaggctctcaacacggcccgtgacaaggccggtactaccactgagagcagtttgaaggatatcaacaacgccgtaaccatggctctgtctggttccaagggttcctccatcaacatttcccagatgactgccttggtcggtcagcagattgtcgaaggcaagcgtattcctttcggcttcaagtaccgcacactgccacatttcacaaaggatgattactcgcccgaagcccgtggtttcgtcgagaactcgtaccttcgtggtcttactccttcagagtttttcttccacgccatggctggtagagaaggtttgatcgataccgctgtcaagacagccgaaactggttacattcagcgtcgtttggtcaaggcccttgaagattcggctgcgcagtacgatggtactgttcgcaactcgctgggtgatatcatccagttcgtctacggtgaagatggtctcgacggtattgccatcgagaaccagcctgtcgaccacttcacgatatccaacaaggctttcgacaagcgttatcgtctcgatgtcatggacgaggaggtttcctcgggcgagcttgaggcgctggaatacggaaaggagcttgctagtgaccccactgttcaggagcttcttgaccaggagtacgaacagctttcggtcgatcgccacatgcttcgcgagatccagcgcacaaaaggcaacaatgacacgaagatgcagctcccgcttaacatcattcgtattattgatactgccaagaagctgttcaaggtcgatgagaccgctcgcagtgaccttacccccaaggatgtcattcctgcagttaaggccatgcttgatcgcatgatcgttgtcagaggagacgatcctatctccaaggaggcagactacaacgccacgatcctgttcaaggcccagcttcggtctcgcttggcgttcaagcgtcttgctgtccaagataggatcaacaaattggccttcaaccacatcctcggcgagctcgagaaccgttggtcgaggtcgatggtttctccgggtgaaatggttggtgtgttggctgcccagtctatcggtgaacccgccacccagatgacactcaacactttccatttcgccggtgtgtcctccaagaacgtcacccttggtgtgccgcgtctcaaggaaattcttaacgttgcttcgaacatcaagactccttccatgatggtctatctcgactccaaggcagcgacccaggaggaggccaagaagatgcgcagtgctgtcgagcacacgagtcttcgctccgttacggctgtcactgaaatctactatgatcccgatatcacatcgaccaacatccccgaggattacgatttggtcgagtcttacttcctcattcccgatcagagcggcgacgagccagatccgattgagaaccagtcccgttggcttctgagaatcactctcgatcgtcagaagatgctcgataagggtctccgcgttgaggacgttgctcaccgcatcaaggaggtttacaagaaggatgttgcggttgtcttctccgacaacaacgctgaagagatggtcatccgtatccgtgttatcaaggcggacgatgacaaggacgaagatggtaataagatcatcgaggacgatgtgatgctcaagcgtcttgagaagcatctcctggacggctgcacacttcgtggtgtcgagggcattgagcgtgccttcttgaacaagggtgttaagctgatcgaggccaaggatggttccatgaagcactccaaggtggacgatgagtgccaagagtggtaccttgatacacaaggtacctctcttcgtgaggtcttgactgtcgagggtgttgataccaagcgcaccactaccaacgacttgtggcaggttgtcgatgtcttcggtatcgagggagctcgtgctgctctgatgcacgagttgacggctgtgctggctttcgacggttcgtacgtcaaccatcgtcacttggcgcttctttgcgatgtgatgacatacaggggcagtatcgccgccgtcacacgtcacggtatcaaccgcgctgatactggtgcgctcatgcgttgctctttcgaggagactgtcgaaattctcctggaagctgccgccgtcggtgagcttgatgactgccgtggtatctcggagaacgttatgttaggccagatggctcccatgggtactggtgcctttgacgttttcctcgatcccaagatgttggagaccgtcatctctgacaactctcgcatgggtctcatgccgggcatgaccgtgaagggcagtcagctggatggcgcggctacgccttatgatacaggcttccccgatggccgacagtgggttccttggaagttattcgcctaccatgggcaacttctctcctatccagggcgctggatcggacagcccgacgaacaacggctttggcaccgactacggtggcgttggcggatacggttctggtacttcctactcttcggctactagccctcgtgccaccagccccttcacacccacgtcaccgttcagctatggcgggtactcgccatcgtcgcccgcggctggctactcgcccagctcacctctcctcgactctgctggtcgttttgcttccagcccacaattcagtccctcgtcgccgtcgttctcgccaacttcgccgatgctgcgccctggaagcccgaccagcccgagctacagccctacctccccgagttactcgccggcatcgccagctgccgccaggtactcgcccacctcccccgcccaacaattctctccgacgtcgccctcatactcccccacgagtccgagctacagcccggcctcgcccgctttccaggctacctcgccaagctactctccggcgtcgcctacctggtcgccaacctcgccggacgcttactcgcccacgagcccgtcgttccagcggtcgcctggtcagcagctgtcccctactagcccaacgggttactcgccgacgtcgccgcagtactcgccgcggacgccgggacgtaat

SEQ ID NO: 27576 - DNA, 1219 bp, Neurospora crassa
atgaatttactacttgcggaagattatcttctccaagattaccccgaacacatcaccaacacaattcgttccggccactctacatgcgtgcgcttcaaccggacgggcgacttcctcgcctcggggagggtagatggcactgtcgtaatctgggatcttgagaccatgggggttgcacgaaagcttcgaggacactctaagaacatcacctcgctaagttggtcacggtgtggtcggtacttgctgtctgcgtgtcaaggctggaaggcaattctttgggatctacaagatgggagcaaatattgcgaagtgcgattccgcgcacccgtttatggggccgaattacaccccatgcatcagtatgttattcgtcgtgagctcgatagttccactgcactgtaacagggattgatctaatcattgcaatgatagtcaccagtttgctgccgcgttattcgaagaacagccgatgctcgtcgacgttaaagagtccgcccaaggcgccaaccccgtcgaagtacgacatatccttccttcggtcgagaaacgatccgacgacggtgccgacaccccgaccaaggagaagcacgccaaagaagatgcgaggcacatgacgacagccattgtatacaccgcgacaggcgaacatctcctcgccggcacgaccaaaggccgacttaatatcatcgatgcgacgacacacaaaatcatctactcggaaaagattgcaggcggcgtaataactacattacggcttacagaatcaggcaaggagttgttggtgaatgctcaagatagaacaatcaggacattcaaggtgccagatctgacatcggcagacctggaccccgacacaatccagattccgctcgagcacaagtttcaggacttggtcaaccgtttatcatggaaccacgctgcgttcagttcgactggagagtacgtcgcagcttcgacgtttaataaccacgagctatacatctgggagcgcggccatggcagtttggtgcgcatgctggagggtccgaaggaggaacagggtgttatagaatggcatccccacaagcccttgctggcagcgtgcggtctcgaaacagggaggataaacatctggtcggtcacaagtccacaacgatggtcggccctggcgccggatttcgtcgaagttgaggaaaacgtcgagtacattgagaaggaggacgaattcgatatacatccg

SEQ ID NO: 27577 - DNA, 1560 bp, Neurospora crassa
tatttagtaactctactcgcatgtctggctgccaagtctattgccgtacccttgtctcctgctttcccagctccggagctccagtacatcctgaaccatagcgaagccctgctgcttctctcgtccgccaagtttaccaataaggcacaggaagtgctaaagacggaattggactctaagccaactctcctcgagcttaccaagttccaaggaggaagccagcatgagcaggtcactctggactccaagtccggaccgggagaagcgggcatgatgctctacacctccgggaccacgaaccggcctgtaggaaacctctcagatccctcttttcaacaccaagaagttggcaactgacactcgatacagaaaggcgtactcattccccagtccgtcatgacggcccaagcccgctccctcatccacgcttgggaatacacccccgccgaccacctccttcacgtgctaccgctgcaccacatccacggcaccatcaacgccattttcacccctctcttcgccggcagctccatcgagttcatgttccctttcaaccccgacgccgtctggaagcgttttgccgctcccttcctccccgacacctcggacaagaagaagatcaccttcttcaccgtcgtccccaccgtctactcccgcctcctaactacccacaagaacctccctggcgacctccaaaccgccactcgcaaggccattgctcccagcaatcttcgcctcgccatctccggctccgccgccctccctaccccgatcaagaaggcctggcacgagctttcctccggcaacgtcctccttgagcgctacggtatgaccgaagtaggcatggccctgtcatgcggcctcgaaaccgccgaccgcgtggacggttcagtcggctggcctcttcccggcgtcgaagcccgcctggtcgatatcgaaaacaacaccattattgagcccggtcaggaacgggatcccgagacgggccgtgagcgggccggtgagattcaattgcgcggacccagtattttcagggaatactggcgcaaccccgaagcaacggcgaaggagttcgtcacagacgaaaaggacgttgcgggcagtaaggggcgttggttcaagacgggcgacgtagccgtcaggaggccggcgcccgagggcgcaggcaagagcgacctcaagagccagaaggactgggcgaggggggacatgtactttatccttggccgtaagagcgcggatatcatcaagagcggcggcgaaaaggtgtcggcgctggaggtggagagggagatgctcagcctgcctcaggtggccgagtgcgctgttctagcagttcccagtgggaagtggggacagaaggttggcgccgttgtgattttggataaggagcatgtgcccgagggcagatggaccccgttggagatgaggagggcgttgaaggatcggttggcggcatataagatcccccaggtgttgaagattgtggataagatcccgcggaacgcgatggggaagattaacaagaagaatctggtcaaggaggtgtttgcggatgag

SEQ ID NO: 27578 - DNA, 3778 bp, Neurospora crassa
ggtatcacaaagcgatcaaaggacaaggccgcgcgggccgagcgctctgctggcggagacaagtccagctcggccaagcccaagaaggccactttcgacaccaccaagaagaaggagatcggtgtatcagacctgacactactcagcaaggtctccaacgaggccatcaacgagaacttgaagaagcgcttcgagggacgcgagatctacacatacatcggccatgtcttggtgtccgtcaacccctttcgcgacctgggcatctacaccgaccaggtcctcgagagctacaagggcaagaaccgtctggagatgccccctcacgtcttcgccattgccgaatcggcctactacaacatgaaggcctacagcgagaaccagtgcgtcatcatctcgggcgagtccggagccggcaagaccgaggcggccaagcgcatcatgcagtacatcgccaacgtgtctggcggcgggtcgggggatatccagcagatcaaggacatggtgctcgcgacaaaccctctgcttgaatccttcggtaacgccaagacgctgcgaaataacaattcgtcccgcttcggcaagtacctccagattcacttcaacgctcagggcgaacccatcggtgccgacatcaccaactacctccttgagaagagccgtgtcgtcggccagatcgccaacgagcgtaacttccacatcttttaccaattcacaaaaggagcttcccagcagtaccgcgaaatgtacggcatccagaaacccgaaacatacctctataccagcaaggccaagtgcttcgatgtcgacggtatcgatgatttggccgagtaccaggatacccttaatgccatgaagattatcggtctctcgcagcaggaacaggataacatcttccgaatgctgtcggctattctttgggcaggaaacctggtgtttaaggagggtgatgatggatatgccgccgtatcagatcagtctgtggttgatttcttggcataccttctcgaggttgatcccgctcagctggtccacgccctcacgatccgtatcttgaccccaagacccggtgaggttatcgagtctcccgccaacgttccccaggctaccgcgacaagagatgccctggcaatggccatttactacaacttgtttgactggattgtggagcgcatcaacctgtcgctcaaggctcgccaagctacgacgaactcaattggtatccttgatatttacggtttcgaaattttcgaaaagaacagctttgaacagctctgtatcaactacgtgaacgaaaagctccagcaaatcttcatccaattgacactgaaggccgagcaggatgagtacgcgagggaacagatcaagtggacgcccatcaagtactttgacaacaagattgtgtgcgacttgattgagtctaccaggccccctggtattttctctgctatgaaggatgccaccaagactgcccacgctgatccggcggcttccgaccgcaccttcatgcagagcatcaacggcatgtcgaacccccatcttacgccccgtcagggtgcctttattgtcaagcattacgccggtgatgtgacgtacagtgtggacggtatcacggacaagaacaaggatttgcttctcaagggtgtccagaatctcttccaggccagccagaaccagttcgttcatactctgttcccccagcaggtcgacttggacaaccgcaggcagcccccttctgccggtgacagaatcagaacttccgcgaatgctttagtcgatactctgatgaaatgccagccttcgtatatccgtactatcaaacccaacgagaacaagtcgccaacagagtacaatgagcccaatgttcttcatcaggtcaagtatctcggtcttcaagaaaacgttcgcattcgccgcgccggtttcgcataccgtcagtcgttcgagaagtttgtcgatcgcttcttcctactctcgcctgccacatcatacgctggtgagtatacctggacgggctcttacgaagcggctacaaagcaaatcctcaaggacacaagtatcccgcaggaggagtggcaattaggtgtgaccaaggccttcatcaagtcgcccgagactttgttcgctcttgagcatatgagagacaggtactggcataacatggcgacgcgcattcagcgcatgtggcgtgcatatcttgcatacagggcagaggctgccatccgtatccagcgtatctggaggaagaaacgcgttggtgccgagtacctgcagctccgtgaagaaggccataaggtgttgggaggccgcaaggagcgcaggagaatgtctattcttggttcccgtcggttcttgggtgactaccttggcatcaatgctaccaccggtcctggtgctcagattcgcaatgccatcggcattggtagcaacgagaaggcagtcttctcttgccgcggtgagcttcttgagcacaagtttggtcgttccagcaagcctagtcctagaatcctggtcgtgaccaacagcaagttctacatcgtcgcccaggttctcaatcagggtcacgttcagatcatggcagagaaggcattcccattggcttctatcaagttcattggggcgtctaccgccagagacgactggttctccctgggtgttgggtcacagcaagagcccgatcccctactcaactgcgtgctcaagaccgagatgttcacgcagatgaagagggtcatgcccggaagcttcaatctgaagattggcgacgccattgagtacgccaagaaacccggcaagatgcagttggtcaaggtgttgaaggatgcgccaacctcgcaggacttctacaagagcagtactgttcatactcagcctggcgagcctcccaactctgtgtccaggccccaacccaaggccaagcctgttcctccaaggcctattaccaagggcaagcttatcaagcctggcggtcctggtggaagaccagcgagaaatgccaacccgaaccgcacggctcagccccggcccggcggtggtccttctatcgctgcctctaaccctcttgcttcttctgccgctgcggcttctagcaggcctgttcccgctcaccctggggcagccgctacaccagccgctgccaagtcccttcccagtcatacgaggcagcagtccagcacctcgaccgtgcgccctccgccgccccctcctccagcgccggctgctaagcctaagatcatggccaaggtcctgtatgactttgctggcacaagagagaacgagctctccatcaaggctggagatatgattgagattgtccagaaagagaacaatggtatgtttccgcccctccctagccatttatcttcttcttgaaaatatagaaatcctgacaatgattttcacaggctggtggctagccaagacccccgaaggtcaagcctgggttcctgccgcatacgtagaagagcaagcccccgcacctcctgtcgtcgctccccgtcctcctcctcctcctccccccgctgccaacggtggcggtcgtgtagctcctcagccgcccgccaagcgaccagtcgctggccgtaagcccgcgcccgcgcccgccgtggcctcgctgcagaatagggattcgggcatgagcttgaacggagcgaacggatcaggaagcgatgcgagtaggagcagcaccccgacgccgagcatagcgggcagtttggcggatgccttgaaggcaaggaagcaggcgatggcgaagagggatgatgatgaggatgactggtag

SEQ ID NO: 27579 - DNA, 707 bp, Neurospora crassa
cttccgaagcggattgtcaaagagaccgaaaggctgatggcggagccgtacgtacataccatcctcatcccgagaagcaaacagtctagaccaaagtcctaacttctccttcctgatcgcagtgtcccgggtattagtgctgttccccacgaagacaaccttcgctatttcgacgtcgagatccacggcccttcgcaatcgccatatgagggttggtcttccttgaaccccacggctgccgttacattcatctcttaccttccgtgcgccatgagaacataccacatgatcgctaacaggagaaccaaacacccacacaggtggtgtcttcaagctcgaactcttccttcccgatgactatcccatgacccctcccaagatccgcttccttaccaagatctaccaccccaacgtcgacaagctgggtcgcatctgcctcgacgtcctcaagagtgagtagtcccgagaaagaaaagccgcgatagttggatacgccagttccgaaaagctaacacacgataccaaacccgacagacaactggtcccccgccctccaaatccgcaccatcctcctctccatccaagccctcctaggcgcccccaaccccgacgacccgctcgcccccgacgtggccaagacctggaaggagaaccccagcgttgccgtcgccaccgcccgggaatggacacagcagtacgccttgcca

SEQ ID NO: 27580 - DNA, 1215 bp, Neurospora crassa
atgtctccctccctcgtcgataaccacgcagcggcttatatagctgctccctcgtccgcaaaggcaccaatgatccaaaaaccaggcaacactttcggcatgtcttccccaatcgagtccaagtttctctcccagccaagggacctcggcattgttgccgtaggcttctccggcggccaggtatgtgatgctctttatttttttctttttttctgacgcgtttggcatccattgacacgaccaaaattctagtgcaagcctggtgtcgacgccgccccctccgccctcatcgagtccggccttctcacccagctccgcgaagagcttggctacaggctgcacggcgatgacgaggtgcacctctacactgacctcgttcccaaggaggacccgcctcaccgcaacatgaagaacccgcgcgccgtctccaacgtgaccaagcgcattgctgagcaggtccactcgcacgccaaggagggtcgcctggtcctcactctcggtggtgaccacagcattgccattggcaccattgccggctcggccaaggccatcaaggagcgcctgggacgcgagattgccgtgatctgggtcgatgcccacgccgacatcaatacccccgagaccagcggcagcggcaacatccacggcatgcccgtcagcttcctcacaggcttggcgagcgaggacaaggaggagttctttggctggctgaagcccgaccacctcctcagtgtcaagaagctggtctacattggcctccgcgatgtcgacccgggtgagaagcgcatcctcagggagaacggaatcaaggcgttcagcatgcacgacattgacaagtaagcctagtccccgatgaatgacatgagtatacccggagcatcttgctaatcattacccctttcgtatcaggcacggcatcggtcgcgtcatggagatggccctcggccacatcggcaacgacacccctatccacctttcgttcgacgtcgatgcgctcgatcccatgtgggctccctccacgggaaccccggtccgtggcggtctcactctccgcgagggcgacttcatctgcgagtgtgtgcacgaaacgggaagccttgtcgctgtcgatcttgtcgaggtcaaccctaccttggcggctcccaacgacgttggcgcacacgagactgttcgcgctggttgctccttggtcaggtgcgctctcggcgaaagcct

SEQ ID NO: 27581 - DNA, 801 bp, Neurospora crassa
ctcgccggccagcgcgttctcatcctcggcggcacctctggcattggcttcgccgtttccgaggcctctctcgaggccggtctgctcgtgaccgtctcctcttcatccgcccccaagctctccacagccttggaccgtctccgctcctcccccgcctacgtgccctcctccacctctgtagccgagggcggcgtcccccgcctcaccggcttcacctgcgacctctcgaacccttccaccgtcgaggccaacctcacgcaactgctcgaccaagccaccttggaaggccggcacaagttcgaccatgtcgtcttcaccgcgggcgacgcgctggccttgacgcccatcgggcagatcactcccgagggttacgcgagggcctccgccgtgcgcttcacggcgcccctgatcctgtccaagcttttgtctacggaaaagtacttcaaccactcggtctacagcagcatcaccttcacgagcggcaccaactcggagaaacccgcgcctgggtggagcgtggtagcgggcgtgtgcggcgcgatcgagggactagcgagagggctggcggtggacttgaagcctacgagggtcaatctggtcagccccggcgcggtgaagacggagttgttcagtgcgtttggtgaaggggagcagttggagcagctgctggatggcttcaagaagcagacgctgacggggacggtgggcacgcccgaggacgtggcggaggcgtatatctatctcatgagggaccgctatgttacggggaggtgcttgggcacggatggagggaggcttttg

SEQ ID NO: 27582 - DNA, 2415 bp, Neurospora crassa
atggtacactttcacctaaaccccagcctgtgggcagttcttctggctttcacatccctacaaccatgttctgccgacaagcgcgttgatctcattgtccggcccgatggcggaaatgtttcctcgccgattatgtatggactcatgcacgaggtactttttaccatcctttgcctcttgaccgagcgggtgtaaagatagtctcgctcacaaacactacaggacatcaataactccggcgatggcggcatctacgccgagctcatccgtaaccgcgcttttcagtccggcgacgagtcccgttacccagtcactctcgacggctggtcggccgtcaatggtgccaaactcagcctgaagaagctttctcagccgctctctgccgctctcccttactccatgaacgtagcggttccatcatcttcgaacaagacggttggctttgccaatgccgggtattggggaatggatgtcaaagtccaaaagtacactgggtcgttctacgtcaagggcgcttaccagggaaaatccttcacagcttcgctccagagtgctctgactggcgaagtgtttgggaccaccaaggtacctgtccagaaggctggcaacgattgggtaaaatatgacttcaacttggttcctgagaaggctgcacccaacagcaacaacacgtttgcgattacatttgacgctgcagtaagctacctaccacgacatcatgatcgtgatacaagggagcagtagacgctgacaaacacaatacagggcgttcgtggtggttcactagactttaaccttatcagtttgttcccgccgacatacaagaacaggccaaatgggctaagggtcgatatcatggaggctttggccgcactcaagccggtaaggtgttgttcaatacccacttttacctcgaacatgatctaacatcgaagacagaaattccttcgcttccctggcggcaacatgctcgagggcaacaccctcccaacttggtggaagtggaacgaaacgatcggggatctcaagaaccgtcccggccgagctggcgtctggggatatcctctgagtgctggactgggtttggttgaatacatgcaatggtgcgaggacctcaacttggagccaagtcagttttcaccctcctctattgtcaaaccctgcaaacccctaacaatctagtccagttctcgccgtttggagtggccttgctctcgacggaggcgagctccctgaatctcgcattgatgaggccgtccaaagcgcactcgatgagcttgaattcctcaccggcgacgcttccacacactggggtggcattcgcgcctccattctcggccacacgcgcccctggaagatccgatacgtggagattggtaacgaggattggctaggcggcggctctacgggctttgagaattacaagaagtatcggttccccgcctttttcaaggcattccaggagaagtacccagagatccagctcatcgcctcgccgtcagtcttcgatggcatgactattcccaagccggctggcggagattatcacccgtacttgacaccagataacatggtgtcgagtttcaacaagtttgatagtctgacgagggataacttgaccttgataggtatgttctactacatcttggaaccctaggacattagacgtgatactgactttttatccaggcgaggcagcatcaacacaccccaacggcggtatcggttggagtggcaatcttatgcctttcccttggtggggaggcagtgtcggcgaagccatcttcctgctcggactggagcgcaatggtgataaagtcatcggcgccacttatgctcctggtcttcgcaacctcaaccgctggcagtgggccatgacgcagattcagcatgctgctgatccagccttgaccacgctgtcaaccagctactatgtctggaaggcaggtccatcatcttttttttttttttttttttttttttttttccctgtacagatagatgtatgactgacaatgattctcatatcagctcctgggtaccactgccataaccaagacgcttcccgtcaccgccacgaccggtggtatcggaccgctctactacgtcgctggaaagacagaaaggggaagcagcgtgttcaaggccgctgtctacaactctaccgagccagttgcagtctctgtccagttcgcgggacttggtgaaaaagtaaaacagccgcacaagaaaacagcgaccgctacactgacggtcctgacgggcccgaccaatccgtacgagtacaatgatccgtggaagcataacaacgtggtgaaggagaccaagaccaagttgaatgcgaaggagggagggatcttttctttcactctcccgcaactgagtgttgctgttttggagacggatggtgaatga

SEQ ID NO: 27583 - DNA, 1325 bp, Neurospora crassa
acccatatcggtccatggcagttgggcaagaccctcggcaaaggtgcctctgcccgcgttcgccttgcgcgccatcgcaccacccaccagctggttgccatcaagatcgtagccaagagcactgcccacgttacgcaagctacgagtatggcgaacctggaccgagtcgactatcgcaagccaagcataagcaccgacggggtccgccgaatgcccctcgctatcgagagagaggttgcgatcctgaagctcattcagcatccgaacatcatcaagctacatgacatctgggagaacagacaggatatgtaagacaagcattgctatacccgcttcttggtgattggctcggctaacatctggtccagctatcttgtcaccgagtacgtcgaaaagggtgacctgtttgacttcatcaactggaacggcagcctcaacgaagaggaagcgattttctactatcggcaaatcatgagcgctctagagtactgccatagcttcaacatttgccatcgggacctgaagcccgaaaacatcttgctcaaggcagatggccaaatcaagattgccgattttggcatggcagccctgcaccaggagccaacccatcacctcaaaaccgcttgcggcagtcctcattatgctgcccccgagctgctgaagcatcaaccctacaagggctcagccgtggacatctgggccatgggagttattttgtttgccatgttggctggccgtctccccttcgatgacagtgacatggacgcgatgcttcaaagggccagaaaaggctattacaaaatgccaagcgagctctctcgagaggctaaagaccttatccggaaaatcttggtcgtcaacccactacaacgcattaccatgaagcagatgtggaagcatcccctcatcaagaagtatgactatgtcgacgattatcagcagagcgatggtcaaccgcaggacgtcttgaggaacgcagacattggccccatcccggagaaggaagtcgatccccagattctcagacagctcaaggccatgtggcatgcctattcagaggcccaaatcaaggagaaacttggtcaaaccaagtaagtctatgcctctttcatccaatctctacccacccctcatgctaaccttgcgcaacagaccaaacgaccagaaggtgttttattggcttctctaccggcatagacatgcacaactcgagaactataacaacgacattcccatttcgaagagcgatttccaccacttgaagccccctaactggggcaagcgcatctcgacctgcgaattcacacagtcctctagaaacggtc

SEQ ID NO: 27584 - DNA, 3301 bp, Neurospora crassa
ggtgccattgtccgtgtcaaactcaaggatttcgtcacctacaacgaggccgagttttttcttggtccgagtttgaacatggtcattgggcccaacggcaccggaaagagctcgcttgtctgtgctatttgcttgggattaggctttccatccagtgtattgggccgcgccactgccgtcggagagtttgtaaagcacggaaaggacgaagctaggatcgaggtggaacttcaagggaaacccggagaggacaactacgtcgtcggtctgctcatcattcgagagaccaacaaaacaaggttcaccatcaaccgtgagcaagcgactcacaaggaagtgcgccaactgatgaagtcgctacgcatccaaatcgacaatctttgtcaattcttgccccaggaaaaggtggccgagtttgctggcctcactccggtcgagttgctcgaaaagactttgcaagccaccgcaccggaagaaatgattgcgtggcaaagcgaactgaaagaccactacagggtccaagcagaagcccagcgcagtgccgacgagagcggcgaggagatcaagagattggaggagcgccaagcagctctgcagactgatgtcgagcggcttcgggaaaaggaacagtacgaggccgccattgccaaactcaaaaagctgaagcttgtggtcgcctataacgaggcccgtgaacaatttcacgttgagaaaaggaagaagaaggaagcagaacgacgtctgaaccaactccagcgagactctgctccatccttggaggcggttaataagaagcaggaatacgtggagggggttaaagccgctgtcgaaaccaggacagccaggctaagagacgccgaaaaagatgctgacaatgccgccagaggaatcgaggcggctgagagcaaagtcaggaacctcgctggtcaacttgaagcggaacaaggcgcatttgctgctagaagacaggaacttggcaagatccgtaagaagatcaccgagttggaagccaagcacaaacagaaccctagggattttgatccagccgaatggaacaggcggattgtaagtaatcctttcctgacggcgttcgagtgaccttgtcaccatgctgacacctaacagcgagagcaagagcatgtgattcgcgataaggaacaggaaatcgctgaagtgaatgatcaagtgacgacgttaaaaactcaagggagagaaataaataggacaatccgagcggcggaggagaagatagcggctctcgattctcaccagggtcagttactcagccagctgcaacaggctaacagggacgctgcccagatctgggaatggctccaggagaaccagaacgtttttgagaaggaggtctttggacccccgatgctgacctgctccgtcaaggatcctcgttattccaacctgattcaagcctttctgcaggagagtgatttcttgtgctttacgtcacagaccagaaaggatcacaagacgctcagtgaccaagtcatcaacaaaatgggactttccgccactttgcgatgctgcgaagccgacgtcgactccttcaggcggcctacgtcgcaggccgaactcaacgcgtttggtcttgacaggttcatcattgactgtcttgaaggtccaagcccagtactggccatgttgtgctccgagaaaaagcttcacagtacggcagttggacttgctgatatttcggaagaacaataccacaagatcactttggacggccgcatacgctttttcgctgccggaaagcaatcctacatgagcaaccgccgtgtagaatacggccccaatgccgtatcaactcgcgttatgcaggtccgtccgggcaagttctggacagacaagccggtggatgactccgtgaagagggagatggagcgtctgagagatagagcccgcttcgaacgcgaggaattgaaacagacacatgatgagttggtagggcgtatggatgtactgcgcaacgagataataacaatcaaggataaactcgtacgttacccggcttttaatttcatggttccaatccactgacacgcacaaacaggagcaaatacgagccgagaaaaacgagctacaaagggaacacagcatttggcaagctctccctgacaaaatcggtaggttttcgttgacccgaactagccatgcgtcttgctaacatgacttttagaatccgagaagaggtccgagcaggataagaggcaggagctcatcgaaactcaggcccaactggccgatctcgagaagcagcacgatcgcgccgttctcaaaacggccgaagccgttttacagcatcaagcgaaactttcaggcatccgagaggcgtatcaggcccttcaggaagcaaaggtgcttctcatcgaagcccagtctgactttgaagtgttgaaggagaggaacgccgagattatcaagaacctggaagacgagaaaagagccctgactgaaatctcagggcaaattgccgagatccgtcagcgggccaccgaggcaaaggcagctgccgaagaagccctcagcgaggaggagaggagtgggggggaattttctgctctggcgaaggctacgactctagaacaagttgagagtgatcttagggcgcaggagactttggcggacggcattgaggccaataacccacatgcgctcaaggagtaccaggactgggcccagaagatcgaacgcgaacaagcgaaccatgagcgccgcgcagcccagctagccgacgtaaacgccaagatcgaaaccatcaggagtcagtgggagcctaggctggatgaacttgtcagcaggatcaacgatgcgttctcgtacaactttgaacagatcagctgcgcgggagaagttggcgtccacaaggacgaggatttcgagaaatgggccattgaaatcaaggtccgattccggtacgtttccccttcttcccctttccttctccctcccgaccactaacccctttccacccaacagagcaggcgaagccctccaacgacttgaccaacaccgccaatccggcggcgagcgcgcagtctcaaccatcttctacctcatgtccctccagtcgatggcccaagcccccttccgtgtcgtcgacgaaatcaaccaaggcatggacccccgcaacgagcgcatggtgcacgaacgcatggtcgagattgcctgcggcgaacgtacgtcgcagtacttcctgatcacgcccaagctgctgtctgggctgaggtatgacaggcgcatgagggtccatacgatcatctctggcgagcatgtcgacccc

SEQ ID NO: 27585 - DNA, 1797 bp, Neurospora crassa
gacgatacctttgaggacctcacaggcaatggcagtgctgttagtgtcgtccacaagcaggtggacaagaacttgccgaagccttaccctgtgcccacttccaggagaaaggaaagggatcagaaccaggagaacacaccaccagtcgtaacccgcgatccccgcgacccccgcgaccctgccactgagccaacataccagcgcagccatgctgccctctcccgacaggaactttaccaggcaagagagcgcgcctcacccacggtcaagagatttaacacgtcgaggggcctcactcccgaggagcgcgagctgctaaacaaacccaatgtcaagcgactggtcaacgtgacccagctgtgtaaggatcatgtcatcatgttgctctttgctggtgctaattgttgatagacttccttgactactactttgacctgctcacctatgtcggacaacgacaaaaccgtctgaatgccttcaaggccgagttcccgccaccacccgagaccgacgaggagacgtacaagcagatgtggcacaagtacgctggtcgggaacgtgctaatctccgcaagcgacgagtgagactgcgccagggcgacttccaaatccttacccaggtcggtcaaggtggatacggacaggtctttttggcccagaagaaagacaccaaggaggtttgcgcgctcaaggtgatgagcaagaagttgctgttcaagctggacgaggtgcgacatgtgctgacggagcgagacatcttgacaaccgccaagagcgattggctggtacgcttgctgtactccttccaagatgacaagaacatttatcttgccatggagtacgtcccgggaggcgacttccgcaccctgttgaacaatactggcgtgctctcaaaccggcacgctcgcttctacattgccgagatgttttgcgcagtcgatgcgcttcatcagctgggttacattcatcgcgatctcaagccggagaacttcctagtcgactcgaccggccacgtcaagctcaccgattttggcctggcggctggtttccttgcccctgccaagatcgagtcgatgaggattcgcttggagaaggcatctgagacctcggtgccgtttggcaagccgatggaccagcgaaccgttgccgagagaagagagggctaccggaccatgcgtgatcgggataccaactacgccaagtcgattgttggatctccagactacatggccccggaggtgctgaggggcgaggagtacgactatactgtcgattactggagtctgggctgcatgctgtttgaggctctgacaggtttcccgccttttgccggatctaccgcagacgagacttggcgcaatctcaagcactggaaggaggttctcaagcgtccggtctgggaagatcccaactacttcctcagcaaccggacatggagcttcatcacgacgtaagtatagtgtgacaagaaaaaaagatatggagcgtagatgctaaccagcgtatagttgcatcaactcccgatcgcggcgcttcaacaacattaaggatatttatgcccaccattactttgccgaggtcgactgggccattctgcgcgagactaaggctccgttcgtgcccgagctggactcggaaactgatgccggctactttgacgacttcagcaacgaggctgacatggccaagtacaaggaggtgcatgagaagcagcaagcgcttgagggtctggccgagcgtggcgaggagatgaacaagagcttgtttgtcggattcaccttccgtcatcgcaagccg

SEQ ID NO: 27586 - DNA, 1137 bp, Neurospora crassa
gttcagcagacatgtatcccccaggccatgcttggtggtgatatcatctgccaagccaagtccggtctcggtaagacggctgtcttcgtccttaccactcttcagcaagttgagcccgtcgccggcgagtgctctgtcctcgtcatgtgccacactcgtgagctcgctttccagatccgcaacgagtacaaccgcttcagcaagtacatgcccgacatcaagaccggcgtcttctacggtggtactcccatccagaaggatgccgaggttctcaagaacaaggagacccatccccacatcatcgtcggtactcccggtcgtctcaacgccctggtgcgcgacaagcacctccgtctcggaagcgtccgcatgttcgttctcgatgagtgcgacaagatgctcgaccagatcggtaagttcccgttgtagtcaacagccgaccgatggtcactaacccccaaatagacatgcgccgcgacgttcaggagattttccgcgccactccccagcagaagcaggtcatgatgttctccgctaccctgtcggacgagatcaagcctatctgccgcaagttcatgcagaaccctaccgagcactacgttgacgaagacaccaaattgacccttcacggtcttcagcaatactacattcctcttgaggagcgcgagaagaaccgcaagctcaacgagcttctcgacgagctgcagttcaaccaggtcatcatcttcgtcaagagcactctccgtgctaccgagctggacaagcttttgcgcgagtgtaacttcccttcgatcgctgtccactccggtgtgagccaggaggagcggtacgtacacctgtcccgacatcattgtgtgggcgcctactgactctccttgtagtatccgtcgttacaaggaattcaaggaattcaacaagcgtatctgcgtcgccactgacgtctttggtcgtggtatcgatatcgaacgcatcaacctcgccatcaactacgatctccccgccgatgccgactcttacctccatcgtgtcggtcgtgctggtcgtttcggtaccaagggtcttgccatctccttcgttaccactgaccaggacaaggaggtcctcaaggctattgagaagcgcttcgaggttgctctt

SEQ ID NO: 27587 - DNA, 1673 bp, Neurospora crassa
gaagagggtgacattggccctgagctcccggagttggaggaccaactctttggtcccgtcgagcagcgcggccgcaggggaatcgacttctccgccatcgccgagctccagctggtccaagagggacctactcgagttgagcctatcgactctttcagagctgctggcctgcacccggccatgctccgcaacgtcgagcttgcgggctacgatgtgccaaccccgatccaacgttactgtgtccccgcgattagccagggccatgatgtcattgccattgcgcagactggtgagttcatcttcagatgcccctgtgatgagcatccttgacactgacaaatctctaggttctggcaagacagcggcttatatgatccccatcatcaacaagctgatgggcaaggcaaagaagttggcggcccctcgtcccaaccctgtcacctatcagcccggaatcgaccagccctgcagagctgagcctttggttgtcgtcgtctgccccagccgtgagctggcggttcagattttcaacgaggccagaaagttctgctatcgctccatgctgcgcccttgcgtcatctacggcggcggcccgatgagggagcagatggaacagattgcgaagggctgcgacattctcgtcgcatctcctggccgtcttattgatttcatggatcgcccggacatcctgtcgttgcgccgtgtccgctacatggtgattgacgaggcagatgagatgcttcatgacgactggaaggacgagctcgaccagattctctctggtggtggtaagttgactctacacagcatcttcctgcttccccaaactgtttggtgagctcaggctaatactttttccctccacagatcaggaagagggaaacatcaagtacatgctcttctcggccactttccctaaggctgctcgtgaccttgccacgacccacttggccgacaatcatgtgcgccttcgcgttggacgcgctggaagcacccactccaacatcaagcaggatgttatttgggtcgaaccctatttgaagaagcaggcctgtcttgacctgctcaacacggtgccccccggtcgcaccattatctttgtcaatagcaagcgcgctgctgacgaactcgatgactttctgttcaacaagggagtcccctgtgtcagtatgcacagcgacagaactcagagggagcgcgaggctgccatgcgcgccttccgtgccggaagatcgcctgtgctgatcaccaccgccgtcactgctcgcggtatcgatgtgcgcaacgttctgcatgtcatcaacttcgacctcccctccaccatgtatggtggtattgaggagtatgttcaccgcattggtcgtaccggtcgtatcggccatagaggtcttgccacttccttttacactgagcgtgacgaagatctcgcttctgttctcactcgcaccctcctcgagaccggccaggaagttccggacttcctccagcagtacattcccgaggacacacagaatcttcacttcgaggccgattccgactttgaggaggatgttggcggcggcggcgatgatgctgacggtgacgacgctggtggcggctggggtggtggtggtggcgccgatgatgcgggcgacaatgccggcggcgatggttggggtgctggtaactaatgc

SEQ ID NO: 27588 - DNA, 438 bp, Neurospora crassa
cacccaaaagccaacgtcgagaaaatgtcccgcggcgaacccctgaccgacgccgacagagcaggctggctgcaagccctcgccgagcacgaaaccgccaaaccacccacctcctcgtctccccatctcgtcatcacctgctcggctttgaagcggcactaccgcgacattctccgtttggggtctgaacacgccggcgatttgcgaattcgcttcatctttttgcaggcccccgaggaggtgctgacagaaagagcacacaaccgaaagggacactttgcaaaggagaatttggtgcatagccagtttacgattttggagatgccggatccgacaaagccaaaggaggaagggggagagccggatgtgctggttgtgaatgtgggggagaaggagaagggggtggaggaggtggtgagggaggtggtggggagggtg

SEQ ID NO: 27589 - DNA, 1395 bp, Neurospora crassa
gcctcctcgcacctcatcaactatggcaccaccttcctccctgatctgatcgtatctgcgtcccacctctcgctctttaccgctccctctcccggttcctcttccccctatggccgagcaataacagactggacctccggccagatgtcttctctcctcgggcactcccatccagaaatcgtttccgtcatcagctcccatgcttcctccctcgaccacctcttctccggcatgctctcgccgcccgtgctgaacctagccaagcgcttgacaagtgtcctgccagatggactggatagagccatgttcttgtccacggggggagagtcgaacgaggccgcgatcaagatggccaagacgtataccgggaagttcgaggtcgtagggttgggagcgagctggcatggggttactgcgcaggcgaatagtgtgcagtaccatgctggacggagggtcgggtggccgttgatgccaggaggattgatgttgccgagtccgaatgcttatcggtgtcatcaggggttcaggaagagggaagaaaagggcttgaagggagatggagcaagcggtggagaggaagaatcgaaaaagggtgatgcagatgaaaaggaaaatggaaagaaaaatcaaggagaaaacgaagaagaatgggaatacgattgggaagcggaaatgctttacggctggcgactgattgaccaacagtcatgcgggtctctggcagccgtcatcgttgagcccatccagtcctcaggcggcatgcatgtactcccgcatgggtatctccgcaggctcaaaactgaatgtgagaaacgtggcatgttgctcatcgttgacgaggcccagactggaattggtcgcacgggagaaatggtcgccatcaatcacgacggtgtggttccggacatcttgactttgtccaagactctgggcaacggattgccgttgtcagcggtcgtgactagtcatgccatcgccgacgtttgtgcggaaagggacttcctcttctataccacgcatgtgaacgaccctttgcctgccgccgtgggggataaggtgctggagattgtcgttcgggatgacttggtctcgcacgctcgacggatgggggagatcctgcactccgggctcaaccagctcaaaaagcggtatgcgtgtatcggcgatgttcgaggtcgagggttgatggccggggtggagattgtcgaggatcgaagaaaagggaaagaacccgggctggaactggccaagaggatcggagatcgcgcgtatgaacttgggctctggtgtaatctgagcactcaccccagctttggggggaccttcaggattgcaccgcctatcactataagcgagaaagaagtcagggagggactggcagtgttggaggaggcg

SEQ ID NO: 27590 - DNA, 1692 bp, Neurospora crassa
cgcctccgctcctacttccgtcccggcaccacctccaaccccctcgagcgccgcctcctcctcaaaatcgacttcttcatcctcaccttctgctgcctctcctacttcctcaactacctcgaccgcaccgccctctccaacgcctacgtctcgggcatgaaagaatccctttcctttcgtggcaaccaactcaaccaaatcaacacgtgcttcaccatcggctacgtcctcggccaaatcccctccaacttatctctccactacattgccccgcgcatcttttttcccgggatgatggtcctctgggccggtctgaccatggtcactgccgccgctcgacaccccggcgacataatggccattcgctttttccaggggattgccgagtccacgacctttgtcggcacgcattatatcctcggaagctggtacacggagcaagagctggggaagcgatccggggtgtttactgcgagtggactggcagggacgatgattggtgggtttgtgcagagtgggattcatgggagtatggatggcctgagggggttgagtgggtggcggtggttgttcgttattgatgggatcatcacgttgcctgtggcgatatatgggttttgtctgtttcccgatacgcccaagacgacgagggcgccgtacttgagtgtgcaggaacgggagttggcgatacgcaggatggagaagaagaggcagggtgagccagcggagatgggcaggtcgtcgtcgggggatacgcttgttgtcgaggctgaaacatctgtctcgaaacccgacatccaaccacgtcccgaaccagaaccaaagccatcaccttcttctgctacagatcaccatctaacaacccacccctcctccaccacatccacatccacatccaacaatccccaagaaacaacagcacacgccgcggcaaaaaccgaatcctctctcacaaaaacccaccctttttccctccccttcctccgctcccttttttcctcctatcactgcccctccttcatcttcctctggatcctcgccggcgaaaccgagtccttttcctccaacgccctcttatctctctacttgaaatcccacccgtccaattcttcctccccttccccctcttcttccccttcagttcccaacaatccagctcccacagccccgcgatacactgtgtcgcagttaaacacctacccaacaggcgtcccagccgtcgggatcctctccaccctcttcttcgccttcatcaccgacctctaccccaatcatcggtcaatagtaggctacttcatcggcatcatcggggtccttaccccttctttgattcttgccgcagaacatggacactttggagtagatccagctggaaacaaagcgacggccgtggtgatgggcatgtactacctgtctggatcggtctacgcctgccaagcgacctttttcgcatgggcgaacgacgcgatgacgagggatggaaaggaggccgtgttcagaggggtggtgctggcggggatgaatatggggaataacgctgtgaatgcgtggtggagcatagtgttttatggggcggacatggcgccgtggtttgagagggggatgtgggctatgattgggacgagtgttgggctggcggtttggacggggttcctgtcgtatatggagaggaggtcgaggaggaggaggagg

SEQ ID NO: 27591 - DNA, 1794 bp, Neurospora crassa
cctgacttctttgctggtgcccgactaaacttcgccgagaacctcctgttccctggaaatgcccaagtcaacggatctgatgttgctgtcatcacagccactgaaaacgacgagcacctcaccgaaaccacatgggacgagctgcgagagcaggtccggcaatgctccaatgccctccaagctgctggagtgaaggagaatagtgttgttgctggctttgttgctaaccacgtgcaagccttggtcgccctactgagtgctgcctccctcggcgccatctggacgggaatcagccctgataatggtgtcagtgccgtcttggaccgtcttgtccagatcaagcccaaggttctcttctccgataatgccactctctataacggcaaggagtggtccggcaaggccaagaccctcgaggtcgtcgaggcgctacagaagcacggactcgagctcgttgtcgtagttaagggccttcagaactttgagaccggactggacgagatccgcgtcaagggcgtcaaggcggaggagtacgatgagttccttcacagctcgcccaaagaggagcccctcgtcttcgcccagcttcctccctcacatcctctctacgtcctctattccagcggcaccaccggcctgcccaaggccatcgtccacaccgccgccggcacccttctccagcacaagaaggagctcttcatccactctaacctctccccgcgatcgcgcatgctctactacaccaccacctcgtggatgatgcaccactggtccgtttcctcgctctcatgtggcgcctcgctggtcctctactccggctcccccttccgcccgcacggttacctatccctcccgcgcctgctctcctccctgaaggtaacccacttcggcacctcggccgcctacctgaccacgctcgaagccaacagcgtacgccccatcgatcccgtccacaacctcgacctctcttctcaagaagccatctattccacaaaaaaaaccctccccccttctacctttgccttcgtctacactgcttttccctccaccatcaacctagcctctatcactggcggcacagacatcatctccctctttggcgccccttgccctcttctcccggtccgggcgggagaagtccaatgcgccggtctaggaatggccatcagcgtaatcgattctgcctccgacgcctccgacccccgccctgtcgaccccgtcggctccgaaggcgatcttgtctgcctcaagccgttcccctgccaacctctgactttcttcggccccggaggcgacgacaagtaccgtgccgcttactttgagcgcttcggcacggccatgtggcaccacggcgactttgtgcgcatgaacccgtccacgggggcgttggtcatgctgggccgctccgatggcgtgctcaagcccgccggtgtccgcttcgggtctgccgagatttataacgtgctcatccgcttttttgcttctgaagtcgaagacgcggtgtgcgtaggccgcagacgcgagtttgatcgtgatgagaccgtttgcctttttgtggtcatggtgcccggcaagtcgtttacttcggaactgagggatcggatcaagaacgtgattaagcgcgagttgagtcctaggcatgtaccgggcgtggtggaggagtgcggaccggcgggtattccgaggaccgggaatgggaagaagattgaggttgctgttaagcagattttgagtgggttaaaggtgaagacgaatgcgagtgtggcgaatccagaggcgttggagtggtttagg

SEQ ID NO: 27592 - DNA, 1722 bp, Neurospora crassa
agccatgagtccaccactcttttccagcccccctccctcgaggaaacgctcaagcgccaacgcgccgaggcccagttcggtcctctgaacagccagagccaccgctacatcagcacacacgatggcagcactctcgagccgcccgttgaagacgagcccccatattattacgtcctcactacttatctcagctaccttatcctaattttcttcggtcacgcccgcgactttttcggcaagagattcggcgaccagaaccactacaaggcactccgggctcagaacggctacgcacctctgaacgacgattttgacaacttctacgtccgtagactcaagatgcgcatcgacgactgcttcgccagacccaccactggcgtccctggccgctacatcactctccttgaccgcaagtctgatgacttcaatcgcaactaccagtacaccggtacctgcaccgaaaccctgaacatgagctcgtacaactatcttggtttcgcccagtccgttggcccttgcgccgatgccgttgaggagtgtgttcacaagtatggcctcagcgcctgcagccctcgcgcggatacgggtacttctgatctcgctctcgaggttgaacgcgaaatcgcaaaattcgttggcaagcccgctgccatggttttctcgatgggcttcgtcaccaacgctggttccttccctgcgctcgtctccaagggtgatctcatcatttctgatgagctcaaccacgcctccattcgtatcggtgcccgtctgtctggagcggtcatcaggtcgttcaagcacaacaatatggacgatctcgagaagctgcttcgtgaggctattgcccagggtcagccccgcactcaccgcccctggaagaagatccttgttgctatcgaaggtctctactcgatggagggaaccatgtgcgatctgcccggtatcttggctctcaagaagaagtacaagttcttcctctacatcgatgaggctcacagtatcggtgctgttggtgccaacggccgtggtgtctgcgattacttcaatgtcgatcctgctgaagttgacattctcatgggaactctgaccaagtctttcggtgctaatggcggttacgttgcggccgagaagcacatcatcgataagctcaaggctaccaatgccgctaccctccttggtgaatcgcctgctcctgctgttctgatgcagattctcgcctcgctcaagattattgagggtgagcttgctcccggtcaaggcgaggagcgtcttcagcgcattgccttcaactctcgctatctccgtcttggcctcaagcgtcttggcttcattgtttacggccacgacgactcccctatcattcccgtcatgctttacaaccccggcaagatttctgctttcagccacgagatgctgaagcgcaagatcgcggtcgtcgttgttggatatcccgctacacctctcatcagctctcgtgcccgcttctgcgtatcagctgcacacaacaaggacgatcttgatcgcctccttgctgcctgcgacgaagtgggtgacattctccagatcaagttctctaccggtgtcgcgggaggtctcgaacccttgcctgcaggtgttacccctgagatggagaaggagtacattaaggctaagggccaggctctcatcaagccaccaaggtggaagctggaggacgtcattgcacgtggtgtcgaagacgcc

SEQ ID NO: 27593 - DNA, 1257 bp, Neurospora crassa
gtcttgaaaggatccaagaaaagacaggctgaggataaatggaagctgccaaactcaccgtgccgtacccgttttgcgccctcgcctaccggatatctgcacctgggatctctgaggaccgctctattcaactaccttcttgccaaggcgaccggcggccagttcattctccgcatcgaagacacagaccaggtgattaccactcagcaccttgtaccccaggatcacaggtggtcaattcgtagaaggagcagaggctgatgctctctattgtatccgtagactcgccttgtacacgacgctgagcagaggctatttgatgacttgagatgggccggcctctcttgggatgaaggcaggcaatgacatcccatgagtctgcactcatcgtttatacctgcttctccatgctaactttgtttgttttgtgaaaaggccccgatgttcagggaccatatggaccgtataggcaggtaagacgcaaagcaactctggtgtatcacgggtgggggtttggttaaccatttacatatgccagtccgaacggctgttactttatgacgagcatgccaaccagttgatccgcgagggcaaggcgtacagatgcttttgctcgcccgagaatcttgagcgccacaagcaggccgcacacgagtctggagagtcgacagcgtatcccggcacatgccgcaacgtctcactagaggaatcagacgacagagctgccaaaggggaaaagtatgccgtgagattcaagagcagcgacaagcccatcattatcgaggatatcctctatacccgttaccgcaagagagagcccgaggaggacttcatcatccggaagcgtgatggttttccaacctaccactttgccaatatcgtcgatgaccgggccatgaagattactcacgtcattcgcggcgccgtacgttgtattttcctcaacctatcagtcatgtttcctatatctgctaacccttcaccatccaggaatggctcatttcaacccccaaacacgtcgagctatacaacgccttcggctgggaaccacccaaatttgctcacgtcggcctcctcgttgacaaagagcgccagaagctgagcaaacgccacaagggcgtcgacatgtcctggtacaaggacaaccagatccctcccgaggcgttgctcaacttcgccgtcctgctcgggtggagccagaagagtggcgagcccgacttcatgacgctccaagacatggtcgaccggttttccttc

SEQ ID NO: 27594 - DNA, 918 bp, Neurospora crassa
gatgctctttacgcctacgactcagaagcccacaaagccgttgtcaactcgcgaccatggaccaacgatcacaaatacttcaagaccgtccgcatctcctccgttgccatgatcaagatggtcatgcacgcccgctccggcggcaatctcgaggtcatgggtatgatgcagggctacattgagggcagcaccatggtcattaccgacgcctatcgtttaccggtagagggcacagaaacccgcgtcaacgcccaggacgaagcgaacgagtacatggtcgagtatctccgtctctgccgtgaggagaaccgccttgagaacgttatcgggtggtaccactcacacccgggctatggctgctggctaagcggtatcgacgtcggcacccaatccctacaacagcagttcaacgagccgttcgtcgcagtggtgatcgacccggacaggacagtaagccagaacaaggttgagatcggcgcgtttaggacaattccagaagggatcaagcctttcgcagcaaccaacacgacaacgggtgatggacagagcgtccctctgaacaaggtggaggactttggcgctcatagccatcgatactacgcgctcgacgtcgagcacttcaagagcacactcgatagcaagctgttggagacgttgtggaacaagtactgggtgcagacgctggcccaaaacccgctgcttaccaacagggactacacgagcagccaaatggtggatttgggatcccgcatttcgaaggcgtcgaaatcgctggagatgctctcaacgactgggcaaagaggtccaaagagtgatgcggtcgatcaaaacatagagaaattgcttagcgaagtgaagcagattgctgcaaaggagaggtctggactgatggcggcggaggtcaaaggcaaggtgttt

SEQ ID NO: 27595 - DNA, 1217 bp, Neurospora crassa
attctccgtaacggtcatttcgtgtctcgcgccagcgattatatcatctacagtgttgaggcggcggtcatcgatcgtgtcgtcgcccagtacggtccatgtgtgttgccatgacctctctccccgtcacgtagacttgaccttaaccgcgtacctcgtttttagcgaccaagctcggcgctattgttggtggccaaacgtcctgtaaagatcctgagatcaaggctttcgaaaagtacctgcccgccgacgttgacatcgtatcctgccactcccttcacggccccaatgtcgatcccaagggccagccgctggtgctcatcaagcatcgcgcctccgacgaatctttctccaaggttgagcacgtactctcctgccttaactccaaggttgtctacctgagtgccgatgaacatgaccgcatcacggccgatacccaagccgtcacccacgccgctttcctcagcatgggcaaggcctggcatgcaaccaagcaattcccctgggagggaacccgttatgtcggcggcatcgaaaacgtcaagatcaacctcatgctccgcatctatgcccaaaagtggcacgtctacgccggcctcgccatcctcaaccccgaagcacacaagcagattgcccagttcgccaagtccaccaccgagctgttccaacttatgctggagggtcatagcgacgagcttcgcgcccgcgtgtacgccgccaaggaaaaagtcttcggtgccgaaggaagccccaagtgggcgagcaaacctctcctccgtgacgatgtgctcgaccagttcagcctccgccagccggaaaatggcggcccttcggctccctccttgcccaacaaccacctctcgctgcttgccatggtcgactgctggagcgctctgggaatcgtgccgtacgaccacatgatctgctcgactcccctgttccgactctggctgggcgtcaccgagcacttgttcaggaccccaggcttgctggatgagtgcctgaaggtcggcatcgaggatcggactttcagaagggatgacttgcagttcaccattgcggcggcgggctgggccgagtgtgtgggtctgaggcaattcgagacgtggagggagcggtttgcggttacccaggctttcttcgagccgaggttcaagggagcggtggaggtaggtaatgcgatgatcaaggcagtcctggcaagcgatgagaaggac

SEQ ID NO: 27596 - DNA, 1089 bp, Neurospora crassa
ctactcttcgctcttggatctaatggctccggccagctaggcatcggccacaaagaagacgtttccgttccaaaggatgcccattttgatgcagaccttccggctaccgcctccatcaccaagattgttgctggaggtaaccacacaattattttgactacgaccggcgacatctactggagcggagacccgaataccggtgcctgtggcaagttcactcaaacacaaatttcgcagcctcctcgatttcacccggtcgacatttcatctgtatcaacaccccaagacccattcagggtaggtatggttgcagctgcctgggaagcaagcatctttacccgcctggatgcccaaggtcgcaacaccagagtctactcttgcggcaccggcctgaaaggcgagttgggcttgggcacgttcatcttccgtacggcgactccgtctctgattccagattttcctcccccggacacggaagttgtcgatctcgccgcttgtatgggccatgtcgttgcagttttaagcaatggtgacgtttggggttggggtaatggccggaagggtcagatcggagcgccggaggatattgttcactcaccccgcaaaatcgagggtttgggcttcaaggttgtgaaagcggtctgtggaaaggaattcacatgctttctgggaagccctgaaagcggtaacatcatggtccttggttcagacaaatgggggatcaggggtgaagttccggaccaggttgtcggatggcgagaggtcggtgctagttggggcaacctgttcatcttgaagggagatggaagcttattgagctggggccgtaatgaccatggtcaactcgctcccgcgaacctaccccaaaccaaacatattgcggtggggagcgaacatgcactggccttgagcgaggagggcgacgttacagcctggggctggggtgaacacggcaactgcggaccgctcagtagttcggatgtcacaaagggtcagcagaacgttattgcgtcgtcgaagttcattccttcgggcgctaaaataaccaccatcggggccggctgtgccaccagttgggtggcaatacag

SEQ ID NO: 27597 - DNA, 1374 bp, Neurospora crassa
gacatgccgattcaggatgcgctggagctcagcgatgactctgatgtcgaggttcatcccaacgtcgacaagcggtctttcattcgtgccaagcagaaccagattcatgcggaacgccagcaacgcaagctccagatcgagaccctcaagtacgaaagaatcatcaatgatactctgatcaagcggatctcctccctacttgcctctctcaaggcccatgcttcggaagtcagctcgcgcaacccaggcgaggtggccttccaggctgtcatagagtcggccgctggtctagatcccaaggatgaccagcccccaccaaggcctgccggtgttcacaatgcagaacaacccctgcctacgtacaccaagatgatggccacgcttcttgacgatgtcaacaagaccttggaggagaagaaagtcgagcaagacaagagatacgaagctactatcgcggaagtggaggagcacctcaagaaagtcacaaacctacagggcgagttgctcaacaagcttgacgagctggaaaagattgacaagagcaaaattacgagcgagtctatccacacgggctttgacagcacgcacatcaacaaggcgaaggcctctacctcaggagacaagaaggaggcgtccaaggtcgaacttctaaacccgaactacagcgccaccgatagcctacctgcacccagcacgactacgaacgatgatgacgatgatgctgaaattgaggcttctcctgccgccaaacaatttgcttcgatcaaggcagacgactaccgggagtccctcgccttccttacgaaacacccagaaatccttaccgaaaaagaaaccgatggtctgctcgtcctcgctttcgacgcacagcttcaaaatcgtgacgactatgctcgcaattgcgtccaccaagcactcctgctgcaatactgccgggctttgggacgcgacggtgtcgctttattcttcaagcgcatcacgacacaaggccaccaggcccaggaggtcttcttcaaggatgtgcaggacacattttacaagatcaagaacagggccagagagatcaacctgcagagggcaaaggaagaggccgaaggtggcagccaagagggagtggaacagatccaactgcatgcggtagagcctggtacggtgatcaacatcaacattcctccagctgacagtgaagacccggaggtacagcaagctagagctatctttgaaagctttagtcccgagatgaagaaggctctggaatcgggcaagttggatgaggtgaacaaggttctgggcaagatgaaggttgaggaggctgaggagttggtgagcaaatttggagatgtaagttgacagtcgttttcttccgtgttgatt

SEQ ID NO: 27598 - DNA, 1619 bp, Neurospora crassa
aaggcccatgacgccgttaagcccgtcgccgactcgttcgcgcacactacccttgaaagctttgaggaggccttcaatggcatgaactcccaggccaaggccctttgggacgagatcaagctgcttgttcctgagaatgctttcgataagcccacctggttcagcaagcccaaggctgctaagcgccgcaaggactgggaccacgtcgtcaagggcgctgatgtccaaaagctgtgggttaagggcgccgatggcgaaaagcatcgtgaggttggcggccagctcgacaacttcaacctgcgcgtcaagtcggtcgatccttccaagctcggcgtcgacaaggtcaagcagtacagcggttaccttgatgacgaggagaacgataagcacctgttctactgtaagtcaatcacgctcgaatgtacttggttagtaaaaatcacggtgctgactcggactgtccagggttcttcgagtctcgcaacgatcccaagaacgaccccgtcgttttgtggttgaacggtggccccggctgctcttcgctcactggtctcttccttgagctcggcccttcttccattgacaagaagctcagggttgtcagcaacgagtacgcttggaacaacaacgccagcgttatcttccttgaccagcccgtcaacgtcgggtactcgtactccggcaacgccgtcagcaacactgtcgctgccggcaaggatgtttatgctctccttaccctcttcttccaccagttccccgagtatgccaagcaggacttccacattgctggcgagtcttatgctggtcactacatccctgtctttgcttccgagatcttgtcccacaaggatcgcaacatcaatctcaagtccgtccttattggtaatggcttgactgatcctcttacccagtatgagcactaccgccccatggcctgcggcgaaggtggctaccccgccgttctcagcgagagcgagtgccgcagcatggacaatgccctccccagatgccagtctcttatccgtaactgctacgagagcggcagtgtctggtcgtgcgttcctgccgccatctactgtaacaatcagttcatcggcccctaccagcgcactggtcagaacgtctatgacatccgtggaaagtgcgaggatgatagcaacctctgctatagcgctcttggctggatcagcgactacctgaaccagaaggatgtcatggacgctctcggcgtcgaggttgagggctatgagagctgcaactttgatatcaaccgcaacttcctcttccagggtgactggatgcagcccttccatcgcctcgtccccggcatcctcaaggagatccccgttctcatctatgccggtgatgccgacttcatctgcaactggctcggcaacaaggcttggagcgaggctcttgagtggcccggcaagaacggcttcaacaaggctgagctcgaggacctctctcttcccaaggctgacaaggagtacggcaaggtcaagtcctccggaaacttcaccttcatgcagatctaccaggctggccacatggtgccaatggaccagcctgagaactcgcttgacttcctcaacaggtggttgggcggtgaatggttc

SEQ ID NO: 27599 - DNA, 2793 bp, Neurospora crassa
aacagcccggctcccccgagtgtcctcaataggggccgggtgcaacccagatccggtcgtacgccagggtgcgttggcttgcagaacctgggcaatacatgctacatgaattcggctctgcaatgtctacggagcgttgaagagttgaccaagtatttcctcactcacgaggccaagaaagagatcaaccctgacaatccgctttcccataacggagacgttgctatggcatacatgcggctgttggatgaaatatacaagaatcctgcgcccaactcggtcgcgccccgtcacttcaaaggcatcgtgggccgatatgcccccgccttctctggctatgggcagcaggactcccaagaattcttgggtttcttgctcgatggcctacaagaggacctgaaccgcatcaagaagaagccgtacattgagaagccagactctacagatgacatgatcggtaaccctgctgctatcaaagaaatggccgagaaggtttgggatatcacaaagaagcgtgacgactcgatcattgccgacctgtttaccggattatacaagtcaacccttcattgccctgtgtgcgacaagatcagcatcacattcgatcccttcaacaacctcactttgcccttgccaatgagcaacgtctggtcccggactgtcaagtattatcccttaaacgaacccccagtggaaatcgttgtagaggtcgataagacgagcgctttcaaggccataaaggagttcatttcgacgagagtcggtgtccccccggagcgtcttgttggaggtgaagagttcaagggtaaattcttcaagcagtacgacgacatgatggcgatcaacgaagagattcagccgggtgacgttgcagtgatacatgaagtggaagcgccgcctaccaatgtcaacgcaaagaaggccaagaagcaggtatacaggtcgctgctggacgatgccgaggaagagcccgctcaacccacgtcgaatcccctggcggaacgtctccttgttccagttctgcatcgtactatggaccctaatggggccggtgtcagatatcataggaaagtagaggacatcccaccgccacattacattgtgttgacgcctcaggaggcttgtgatgagaatatcatccgcagaaaaatcctgcaaaaggtggccaccttgtctacgtggtcggaattcactgccgacgaagaggcatcagaagctacggatcccgagatggtcaatggcgcatcggatattgactctgcagactctaaggtagttgccaagtccgtcgagggcgaggaagatattgtcgacgtgacgatgggcaacactggttctgccaaaccaacagcgtcgccagctcctcaaacgtaagtgacttccatgagtatgttgatctgtacatggtgtcgctgacctggaacaaaaatagtcttccggcgctcctcaagcgtttcaagtcgcagcagcctaagtggttagacccttcagtttttctgaatccagccctgcagaacctctttgcgatgtcttactttagggagttgcatggcggtgttcctacagggtggcaaagcgtcaacgacaccagcaaacacgaaagactgagctcgagggcccctaagacggattcgtcggatgtggagatgcggagcccgaatgcattggatggctcggatgacagcggtagcgaagaagcttcttcggaacaggtagattccgtgacacggatggccgatgagtcgagcgagggctcggatgccccgaaaggaagtgtaagtcaaattgatgcattgtccctagtagttcggttaacgtggtacaatgtgctgacgccttgatcaggatcgattcatcgctagtcctcctaggggagcaaatgccgttccacgaggcaaaaacaagaagatgaaagctggccgcacttatggcaagaaggctaagaagcgttttgagaaagaacagctgagaaaacgggctgcggccgcccagcaacccatcgaggtccctgagcaagattaccgtgtcgactccgaggaagggccccttgtgcgtcttggcgaaggcatcgttgtggactggtacgaggacgcttttgatactgtcttctcccctgcgaacaggacctacaacaagattgagactctaaatgacccgtcgttgggtgccaagaagaggcaacgggagctgcgtaagaagcacggtatcagtctagatgattgtttggccgagttcgagaaggaagaaatcttgtccgagcaagatacatggtattgtccccgttgcaaggagcaccgtcgcgcaagcaagaaattcgacctttggaagacgccagatattctagtcgtccatctgaaacgctttagctccgttggctggcgtcgggataagctggatgtccttgtcgacttccccatcgagggcctcgacctcaccgagcgggtcattgacaaggaagacggtaaacaggagatctatgacctgattgctgtggatgaccattggggcggcttgggcggtggccattacactgcctttgccaagaattttgttgatgatcagtggtatgagttcaatggtaagactttcaatgccctcgttcttggcggacaaggcaaatgctgacaagcagtagattcatccgtttcgaaggtgaccgatacctccaaggttgtctcacccgctgcctacttgctgttctaccgtcgccgctcagacaaacctctaggcgggcccaaatgcgaggaagtcgcccagcgctattcccttgacgacgatgaggaaatgctggac

SEQ ID NO: 27600 - DNA, 3021 bp, Neurospora crassa
tcacccgctgttgagcgggtcaccgatcagctggagaaaccctctcttgatgatcgcagctaccgggtcatccgcctccccaataagcttgaggctctcttggtgcatgatcccactacggacaaggccagtgctgccttggacgtgaatgtcggaagcttcagtgatgaagatgacatgcctggcatggcccatgctgtcgagcatgtgagtttccgcgccttgttcacacgtaaagggaaattcttttgtgatatttttgtttactgaccctggtgatcataattctagcttctgttcatgggtaccaagaagtatccggtcgagaatgactacagccagtatctgtcgacaaattctggtagctctaatgccttcactgcagcgactcacaccaactattacttcgaggtgtctgctaaacccagcaatgatgaggagctttcggctaccaatccctcgcccctttacggtgctctggatcgttttgctcagttcttcgttgcgccgctctttctagccaacacccttgacagggagcttcgggctgtggactccgaaaacaaaaagaacctgcagaacgatacgtggcgacttcaccaattagacaagtccatctcgaaccccaagcatccgtactgccatttctctacgggaaacctggaaacgctcaaggtgttgcctgagtccaagggcgtcaatgttcgtgaaaagttcattgagttttatcagaagcattactcggccaaccgcatgaagctgtgcgtgctcggaagagaaccactcgacgttcttgaaggctgggtcgccgagttgttctcagacgtagagaacaaagatctgccacccaatgagtggacagatgaagctcctcttacgccggagcaactcggagtcgtgacctttgccaaacccgtaatggattcacgagaactcaacatcaccttccccttcttagatgagcatctcttgttcgaagagcttccaagccgttacctcagccacttacttggccatgagggcccgggcagcatcatggctcacatcaagtcaaaaggttgggctaatggtcttagcgctggtgcgtggactgtttgccctggctctcctggcatgtttgatattcagatcaagttgacacaagaagtatgtcctccttatctcgtgattatactttaaattgctgacccaaatgcaaaggggctcaaaaactacgaagaggttgtcaaagtggtgttccaatacatcgccttgcttaaacaaacgggaccccaggaatggatccacaacgagcaaaagattatgggagacattgacttcaagttcaagcagaagactcaggcttccagcttcgcaagcaagacagccggagtcatgcaacggccactgcccagagaatggctcttgagcggaactagcaagttgcgcaagtatgatgccaacctcatccgcaagggccttgattgcttgcggcctgacaatttccgtatgtccatcgtctcgcgggaggtgcctgggaaatgggagcacaaggaaaggtggtacgggactgagtattccgtatccaagattcctagcgaacttatggaggaaatcaagaaggccgccaccatctccgatcaagaacggatccctgaccttcatctcccgcacaaaaaccagttcatccctacaaagctggaagtggaaaggaaggaggttaaggagccagctctggcgccgcggattgtgcgcaacgatgacctagtacgcacttggtataagaaggacgacacgttttgggtgcccaaagcgaatttgattgtcagcatgaagagccctttgatccacgcgtctgctgagagcgttgtcaaggcgaggcttttcactgaccacgtcaaggatgccttggaagagttttcgtacgatgccgaccttgctggcttgtcctacctcgtatcactcgacagccgtgggttgttcgttgaggtatctgggtacaatgacaagcttccactcctcctggaacgcgttttgatcacgatgcgggatctcgaggtccgagacgacagatttgatatcatcaaagaacgtctgaccagagcttaccgtaactgggagcttcaggtcccgtggtatcaggttggcggcttcacggaatggctcactgcagagcatgaccacacaatcgaggagctcgcggctgagctaccacatattacctcggatcacgtccggcagttccggaaagcccttcttgcacagctacacatggaggtttacatccatggaaatctctacaaggaggacgctctgaagttgacggatatggtcgagtctactcttaagccgagggtgttgccgcgttctcagtggccgatcctgcgatccttggtgctcccacccgggtccaactacgtctggaagaagacgctcaaggaccctgccaacgtgaacaactgcattgaatactttctctatgtcggtgacaagaatgactctcttatccgtgccaagacactgcttttggcccagattctccaagagccatgcttcgatcaactcaggaccaaggagcagctaggctacgtggtcttctctggagtgcgtgccacttccacaagctacggattccgattcctcatccagagcgagaagacagccccttacttggagaacaggattgagctgttcttggaaaggatggcaaagtggatcgaagagatggaccctcggcaatttgaggctcacaagcgcagcctgatcgtgaagcgccttgagaagcccaagtttttggaccaggaaaccaacaagcaatggagtcaaatccatagcgagtactatgattttgagatctgtaagtacttgacatttgagattgcccttactaccttgagtctatactgacctttccccttagcccaacgcgatgctgctcacgtcaaacctcttactaaagaggaactgatcgagttcttcaagcattacatccacccctcgtcgcctagcagggccaagctcgccatctacttggaggctcag

SEQ ID NO: 27601 - DNA, 2157 bp, Neurospora crassa
ctgtaaaccctgattgactttgggcagcacgacgaggtcgtcctccgattaaacgccatccaccgtctttcgactatcgcccttgctttgggtcccgagcgcactcgcgaggagctgattccctttctcgatggttagccaacccttcgacccagcttcagcctagcaaacccacctgcgccggcctctggctacacagccgctgggactcttgagatacggctgctgacacttctgaatgcagaatcggttgaagatgaagatgaggtcctcgttgccctgagtgaagagcttggtaactttgtcgagtacgtggggggccccgcatggggacatgtccttctttccccccttgagaacctcgctgctatcgaggagcccgtggtgcgagacaaggtacggatacgtgaccatttcctggcttcttgtcatgcgacccgcatgtgtactgacaaacgttttaggctgtcgaatcattgaacaagatctgcactcaactctcttcgcagcaagttgaagaatactttatccctcttacgattcgcctctccaaggccgactggtttacgtccaaggtttccgcatgcggcctgtatacaaccccctactcgaaagtttcgccgcctattcaagaacaattgcgccagcagtttggacagctcgtccacgatgagacccccatggtgcgccgtcaggccgccaccaacatggccaagttcgtgaaggagatgccggctcccatcgttatcgaggaaatgatacccatgttccaacacctcgcccaggacgaccaggacagcgtcagactccttacagtcgagattttgatctctattgcggaggttgtgcccaaagagcaacaagccagccacaccgtgctcctcacatcgctacgcagcttgatagaggacaagagttggagggtccgctatatgatcgccgacagatttgagaaggttcgtggtcgcgctaagcacttggcctcccctcatatcaattcttggatgactaacagcacatacagattgcgaaggcggttgatgatgaggttgtgtccagagatcttgttcctgcattcgtaaaactcctgaaagataacgaggctgaggtgcggactgccatcgccggccagatccctggcttctgtgctttggttgaccgcaacgttctcctgaatgacatcatgggaagtgttgaggatctcgtctcggatagctcccagcatgtcagagctgcccttggcacacaaatcagcggcctcgctcctatcttgggcaagcaagagtacgttcccgcagtcagacacggtttctttgatgcgtatgctaattattgcacaaggactattgatcatcttctgcccatgttccttcagatgctcaaggacgagttcccagaggttcgccttcacatcatcagcaaactggagcttgtgaaccaagttatcggcatcgacctcctttctcagtctctccttccggccattgtacagctagccgaagataagcagtggcgtgtacgcttggctattatcgactacatcccgcttcttgccagccagctgggcgtcaagttttttgacgagaagctcagccagctttgcatgggctggctcggagatactgttttctccattcgtgaggccgctactcaaaacctaaggaagctgaccgaggtgtttggtgttgagtgggcaagcgaggctattattcccaaggttatggctatgggtgcccaccccaactacctttaccggatgaccacttgctttgctatcacggtaagagactcaatggcatacgaaaatcagtgaagtccctgtctgactagtgtttacagaccctggctaccgttgtcagtctggatgtgattgccaagtccatccttccgatgctggaaaagctcacagccgattcgatccccaatattcgctttaacgtcgcaaagacatatggcatcatcatcggtgttctgcgtcgtctgcccgacgagggcaccatctatacgctagagaaggagggcaagcctgccaccccgtcgcccaagggtcaggagctcatccagcagcgcatcatgccgtgcttggagaagttgcaaaaggatgatgatgtggatgtgcggtactttgcgacgactgctgcggcccaagcaactggt

SEQ ID NO: 27602 - DNA, 1817 bp, Neurospora crassa
ccaaaggaagtgttcaactggaggctatggttcgccgtcttgtccttcggcctgttgggcgctgcccgtggtgtcgacgaaggactgatcaatggcgcattgaagagcaagaacttccaggacagcatcaactatgcctcgtattctacggttgagcaagcgaacatcaaggcaaacatctcgtctatggtacaaattgggagtgtcgggggggcattaatgtaaggaacaatcccgtttcagcacctcttcttcttcttcgtcttcttcttcttcagtccctcttggtttactgacagataccggctgcagtgcctttatgatctgtgacagaatagggcgaatctgggctactcgaatactttgtctactttggatgttgggcatcgccatcttcatgggttcgaacggcaacctgagtttagtttactttggtagatttgttgcaggactcggtgtcggacaggttggttttaccctactgatggcctcatcgcaatgggaattcagctaatacgagaggaaccgctcattctagtcacctgtcgtcgggccagtttatatcgccgaaatagctccagctagcattcgtggtttctgtgtttgtaagtaatcccctttcatcccttctgcagtatattcattattttcacataaaacgctcagtactcctactaacagcttactttgattgaaaaaaaggtaccttcaccggcttcgtctatctcggtatcgtcctagcatacttcaccaactacgggtgccagcttcatcttgccgagacgccagcccgttggatggttcctaccagcctccatatcatattcgcgggccttattcttctccttacctttctccagtatgaatcgccccggtacctagtcaagacaggcaaaagcgacaaggcgctccacgtcatgtcccgtctgcgccacttgccccccgaccacgactacgttcggcgcgaaatcaacgccatcacgctcagccaccacgaagaaatggaagcttccaaaggcgccggctggctcggcatcctcaaagaaaccttcaccgtgcgcagcaacctctaccgcgttggcctgactctcggtgcccaggttatgggtcaatggtccggcgccggctccatcaccatctacgcgccggacctgttcgaactccttggtcttacgggcaccaaagagtcgcttttggtaacagccatcttcggcatcgtcaagctagttgccgccatcgtctgcgccctcttcctcgttgacttcatcggccgcaagcgctctctcctcttgggaatagcctgtcaagccatctcgatgatttacattgcagcctttttatccgcgacccccgaactcggcaacgaagaggggtacgtgattcccgccaactcaggaaaactacgcgcttcgcgaggcgccatcgtcatgatttacctatcgggaatcggctgggcgctgggttggaatagcatgcagtacttgctcagctcggagatcttttgtctgcgcctgcgtgccttttgctcgagtttggcgatgtgtctgcactttgccaaccagtacggcagcgcgagggctgtgcctgacatgttgctccccgtgagagagggcgggatttcgggacagggaactttttggttctttagtgctgtaacgatattgggcggagtatgggtatggttcttcgtaccagaaaccgcctctaggagcttggagagtatggatagattgtttagtttgccgtggtggcaaattggcaggtatggaaacagggaggcggaggcgctcgatgaggcggagcgggttggaggggag

SEQ ID NO: 27603 - DNA, 1011 bp, Neurospora crassa
gtccgtgtcaaccaccacgatgccaaaacctttgcggccgcccttttaacggcctccggcgtgtccgccaagaacgccgaaattaccgcctctgggctcgtccaagctgacctgcgcggcgttgaaagccacggcatcctgcgattgccatcctacctctcacgcgtgcgtagcggggttttggacccagccgccgagccggaactaaagcagatcacgcccgtagtcgcccaaatagacgcgaggaacggattcggcttccccgccgcgcacctgggcatggacaccgccatcaaaatggcgggcgtctatggcattggaatggtaagcgtcaagcatagcaatcattttggcatgtccgcttggattgtgaagcaagcggtggatgcggacatgatgagtctggtttttaccaattcgtcgcctgcgctgcccgtgtggggttccaaggagaagatgatgggtgtaagccccatcgcctgtggagcgccgggtgggaagggcgaggggtcgaagccgttcatcttggacatggccccgtcggtcgcagcgaggggcaagatctataaggcgctgaggaggggagagaagataccgactgactgggctttggatggggagggcaagcaaactgatgatccggccaaggcgctggaaggcgtgatgctgcctatgggtgggccaaaggggtcggcgctggcgatcatgatggatgtcttctccggcgtgctttcgggttctgcgtttgctggaggcgtcacggggccgtatgatatgtccaagccgggggacgttggccacttcttcgtggccatcaagcctgacttgttcatgagcctggacgagttcagggaacgcatggatatcctataccagaaagcggtgaactcggagaagatgcatggcgtcgacagaatttacttcccgggcgagattgagcagctgaacgaggagcagagattgaaagatggcataccatatgccaaggcagagattgatgctctgaatgca

SEQ ID NO: 27604 - DNA, 1314 bp, Neurospora crassa
acgacaaccctggttctcgacaacggcgccgacaccatcaaggctggattcgtctccgatgacaagagcgacggcaagcctcgcatcattccgaattgcctcgctcgagaccgtcacaggaagatctatgtcggctcggaactcgaaaaatgcaaggacttcagcgaattggccttcaggcgccccgtcgaaaagggctttatcgtcaactgggaggcccagaaagagatctgggatcgcgagttcttcgacgataaagctgcgcagaaatgcgacccatcagacaccaggctcattctcacagagcaaccaaattcattgccttctctccaaacacactgtgaccagatcgtctttgaggagtatggctttgcgagttactaccgtggcctgggtatgtcgcctcctagagagctgttagggaaagggtgctgaccttgttttctaggtcctgtcttcaacgcgtaccgggacatacaatccatcttccgaacaccccaatccaccatagacagtccagcccaagtcatcctgctcatcgactcgggttactctcacaccaccgttacgcctatcctccaaggccgaccgctacatccggccatacgaagacttgatgtgggtggcaagctcatgaccaattatctcaccaggttactgtccgtccgccacttcgacatgcgcaacgaaccatacattgtgaacgagatgaaagaagcagtctgttacacctccctggacttcaagggagacctggaaaagacttggaaagggacgcgcggcgaaaagagggaggactacttgagcggtgctggcatcgccaaagactacgttctgcccgactcccacacgcgcttccacggtgttgtccgcgactacgagcctggtgtctcggcgcgcgcccgcaagggcattgtatccacagaggacgtcctgacgctacggaacgagcgttttgttgttccagagctcctcttcaacccttctgatatcggcatccggcaacctggcatcgccgacctagtcaagcagtccctcttggctgtgccaattggactgtggcctggccttctggctaatatcgtagttgtgggaggaaacagtctctctgaagggttctgtcagcgcttgcaaacagagattctcaagcgattccccgatgaatgcagggtcagagttgcccgcccggaagaccctatcatcagcacctggttgggagctgccaatttcgccaagcatgaacatgccagtaagctcgaggtcaccaagcaagagtatgaggaacatggagctgcttgggtggcaagaaaattt

SEQ ID NO: 27605 - DNA, 1404 bp, Neurospora crassa
aggcagcctgtggacaagaagcctgagacaggaactattgatctcacaggcactgatgacgaagaggactcggccccacttcctccggcacccaggaacatacccaagaacctacccaagactcgtcccactttcgatgaccccactccttctgctttgggtagcaggaagcgtacccacgacgacgagatcaagttgcctcatgctaggctgaagaaggcaaccagggcgcctgtaggtggaaagattcagcctgagtggcgagcagtccccagccaggactcctgcccctggatgagagatgccgaagatcattcggccagccccacgatgggccgttggctgcacaaagagatcattgatttttacgaatacgttaagcctcgtgctttcgagaaacgtatccgcgaggaggtgctcgacgaaatcaacaggtttgttcgcaacaccttttctgacgctggggtctatcctttcggatcgttcccgtccggactttacctacctaccggtgacatggacatggtcctctgctccgatcagttcaaaaggaactatcgggccaagtatgacactagaaggaccatgtacaggctcagtgacgccctcaagcaacgcaaacttgcgttccagaacgaggttgagatcatcgcctttgccaaagtgccgctggttaagtgggttgactccaggacaggcctcaagattgatgtgtcctttgagaatgacacgggcttgcaggctatcaagacgttccatgcctggagagatcagttccctgtgatgcctgttctggtcacgctgatcaagcatttcctttgcatgaggggcctgaacgagccggtcaacggcggtataggaggcttcactgtcacctgcttggtcaccagcatgcttcagctgatgccccaaatacaaagcggatctatggatccgaaccatcacgtcggggaccttttgatgcatttctttgacctctatggtaaccggttcaactaccggaccacggcgatttgtctgaacccgcccaaatatcttcccaaggtaagtgctcattattgtatgccctgcgctcgcttcggctgatgcattatacagcacaagatcaacacctttgcgtacaagaactatgaccgattttcgatcatcgaccccaacaactcggagaacgacattgctggcggctccagtaacaccggcacgatcgtggcacttttcaagcaagcctatgaactgcttgcagaacgcatggcgcagctagctcagtcccctgatcggcgcaatgccagcattttggaggtcattttggcgggcaattactcgacgttccgaaatcagcgagcccatctggagaagctggcagcgcctaatggcccagccggtcctcggagacgctaggtggta

SEQ ID NO: 27606 - DNA, 4653 bp, Neurospora crassa
cccactcatcccgagccgggctcttcacactctcataacgaccagatgacaggaacacgggccacatccatgaccgatgtcgacggaagcaccgctcggtctgagaaggagaaggacgcccagcatgccaacgacagcgacagcacctgcgaggaggacgaggaccgtatcgaggaaaaccgccgcgcaagccaagtcctcgccctggcacgaaaatacacctcgcagtcccacgctgccgttcccgagggaaaaactgtcttccaggtcgacgacgagaactcaccactcaaccccaatggtcccaacttcaattctcgtgcttgggccaaggccctcgttgagcagatcagtggcgatggccttcagttccgtaccaccggtgtcgctttccagaatttgaacgttttcggtttcggctctgccacggattaccaaaaggatgttctcaatgttggcctcgaaatcttcagccaggtccgcaacctcattggtatggggcgacagcgccgcatcgacattctccgtgactttgacggtgttgtgcgcaagggtgagatgttggttgttttgggcccccctggttccggctgcacaaccttcctcaagactattgccggcgagcacgacggcatcttcatcgacgaccagtcctacttcaactatcaaggtatgtggtgccgaaaaatttaatctctttttgttttgtgtgtcgagttggtctcgctaacacgacgtctacttaggtatgaccgccaaggagatccacacacatcaccgtggtgaggccatctactccgccgaagtcgatacccatttcccccagttgacggtgggtgagacgttgacctttgcggctcgcgctcgtgctcctcgtcacatccccgatggcgtcaccaagaccgacttttccaaccatctccgagatgtcgtcatggccatgttcggcatcagccacaccatcaacactcgtgtcggtaacgagtatatccgtggtgtttcgggtggtgagagaaagcgtgtctccattgccgaggccgcgctctctggtgctccccttcagtgctgggataacagcaccagaggtctcgacagcgccaatgccatcgagttcgtcaagaccctcagactgcagactgagctcttcggaagcactgcctgcgtgtccatctaccaagcccctcaaagcgcctacgacctcttcgacaaggctgctgtcttgtatgagggtcgccagatcttcttcggccgtgccgacgaggccaagcagtacttcgtcaacctgggtttcgaatgccctgctcgccagaccactcccgacttcctgacctccatgaccagccccacagagcgtatcgtccgccccggctttgagggcaaggctcctcgcacacccgacgagtttgctgctgcctggaagaatagtgccgagtacaagtctctccaggctgagattgaagagtacaagaaggagcatcccatcaacggacccgatgctgaggctttccgcgcctccaagaaggctcagcaggccaagggtcagcgcgccaagtctcccttcacactctcctacatccaacaggttcagttgtgcttgtggcgaggatggcgacgcctggtaggagatcctagtatcacaatgggttctcttattggtaatttcatcatggctctcatcatctccagtgtcttctataacttgcaacccaacacggacagcttctaccggcgcggcgctcttctcttcttcgccattcttatgaacgctttctcgtcggccctcgaaattctgaccctctacgctcaacgtccgattgtggagaagcacgctcgttatgctctgtaccacccgtccgctgaagctgtcgcttctatgctcgtcgatatgccctacaagctcgccaactccatcgtcttcaacgtcacgctgtacttcatgacgaatttgcgccgagaaccggggccgttcttcttcttcctgctcgtgtccttcgtcactgtactcgtcatgtcgatgatcttccgtaccatcgccagttcctcgcgtacgctgtctcaggccatggtgcccgctgccatcatcatccttgcgctcgttatcttcaccggtttcgccattcccaccacttacatgcttggctggtgccgctggatcaactacatcgatcccatcgcatatgccttcgagtcgttgatgctaaatgagttcgtcggacgcaagtttcagtgtgaagcctatgttcctagccctagtattcccacgtacgccaacgtcggtaacttgaaccgcgtctgctcagccgttggttctgtcgcgggccaggactacgtccttggagacgactacctccgtgagagcttcaactacgtcaacagccacaggtggcgcaactttggcatcatcatcgccttcatctgcttcttccttttcacctacatcgttgctgccgaggctgtatcggccaagaagagcaagggtgaggttcttgtcttccgcaggggctacaagcccgcttccttcaaggagaacaagggcgatgccgagtctggtggcgttcaggttgccggcaagggccacgtcagcgatggcaacacttccgacaaggaggctggtttcttacaggcccagactagcgtcttccactggaacaacgtctcctaccatgttcccatcaagaaggaaattcgtcagattctcaacaacgttgatggctgggttaagcctggtactctgaccgctctcatgggtgtctccggagccggaaagaccacgttgctcgactgtttggctgaccgtatcaacgtcggtgtgatcactggtgagatgttggttgacggcaagcctcgcgatacttctttccagcgcaagaccggttacgttcaacagcaggatctccacctcgaaaccactaccgtccgtgaggccttgaacttcagtgccctcctccgccaacccgcccacgttccccgcgccgagaagctcgcttatgtcgatgaggttattaagctcctcgatatggaggagtacgccgacgctatcattggtgtccctggtgaaggcttgaacgtcgagcagagaaagcgtcttactatcggtgtcgaacttgctgccaagcctcctcttcttctcttcgttgacgagcctacttccggtcttgactctcagacttcgtgggctattctggaccttctcgagaagctgaccaagagcggccaggctattctatgcactatccaccagccctcggccatgcttttccagcgcttcgatcgtctgctcttcttggccaagggtggtaggaccgtttactttggtgacattggcaagaactccaagaccatggcttcttacttcgaacgccagagcggtgtcaagtgccctcctgatgccaaccccgccgagtggatgctcgaggtaatcggtgctgctcctggaactcactccgagattgactggcacgatgcttggcgatccagccccgagtaccaagctgtccaggaggagttgcaacgtctgaagaacaactcgaaccacgcggacgctttggaaatggatggtgacgctggcggctaccgcgaattcgccgctcccttcttcgagcagctcagagaggtcacctaccgtgtcttccagcaatactggcgtacaccgtcgtacatctactctaagaccgccctctgcatttccgtcgccttgttcatcggtttcgtcttctacaacgcccccaacactatccagggtctccagaaccagatgttcgccattttcaacctgctcaccatcttcggccagctcgtccagcagaccatgcctcacttcgttgtccagcgttcgctttacgaggtccgtgagcgcccctccaaggtctacggctggaaggttttcatgctctcccagatcatcgtcgagcttccgtggaacgcgctcatgggtgccattatgtacttctgctggtactaccccgtcggcctgtaccgtaacgccgagcccatgggccaagtcactgagcgtggcggtctgatgttcctgctcctcctcgccttcatgtggttcacctcgaccttcactgactttatgattgccggtttcgagaccgccgaggccggtggtaacattgcccagctgcttttctccctctgcctgatcttctgcggtgtcctcgccagccccgaggccatgcccggcttctggatcttcatgtaccgcgtcagccccttcacgtacctggtcagcgccatgttgtcggtcggcgtggcgaacacggacgtgcattgctcggatgtcgagttcctcaagttcaaccccctcaacggcacttgcggggagtacatgtccgactacatcaaggccgctggtggttacctcctcaacccggacgccacggacgagtgcagcttctgccccattgacaagaccaacatgttccttgctagcgtgtcgtccgactatgccgatagatggcgcaactttgggtatgtattctttttttccccgctctctcctttcccctcgtcacgtcttgaacaacggttactaatatactcctcaacaatagcatcctctttgcctacatcgccttcaacatcctcgccgccctcgcagtctactggcttgtccgcgtccccaagaagaacggcatttttggcttcctc

SEQ ID NO: 27607 - DNA, 1947 bp, Neurospora crassa
atgaacggaatcaaggacctgggcctgggcttctccaaagcctcgacgcgcttgcatttctttagtctgttgcttgctcttggctcatttgtctgggggtaagacttttcgagttccagctctcccaaacatcgtggtatcacagagatcaagtctctgtaccaagtgaagtgcatcgatttggtgatcggagaactggctccggagttacacttactgacactgcacagatacaacgttggcgttctcgcctcggtcctcgcccatccaggcttccgcgagaccatccctggctatggtccatataagcgcggcctcatcacatccatcaactacctcggcacatggctgagttacatcttcttctcccgtcccgcgacggatctgctcggccgtcgctatgctgccatggtgggcatgtccgtgttatgcgtaggccaggcacttcaggctgctgcgtctgggtcggtggctcttagtatggtgatatttggacgggttgtttctggcttgggcaccggtattgtctcgacgagtgtgccattgtatcagaggtatgtgacagggattttcttgtttgaaattcatcacaagcgagatgatctacatgtccatagggctgacccgtgatctgttgcacagtgaaattgccccggccaaacagcgaggcagacttgttgttttgaaccatgtcgggtttgtagccggacttgcctctggcttctggtaagtggtatccatcacaacaacctcgagtcactctgacattttgtagggtcggctatgccataaccttctggaacagctcacacggctacctcagcggatggcgcctgtccgtgtccctctccttcatccccgccctcatcttcttcgtcggcctccccttcctgcacgagtctccgcggtggctcgtcgagcacggccgccctgacgaagccctcaaagccctgcagttctaccgcgaaggatccttcaccccttcgcaaatccaaagcgaactgacagacatcaagcgcaatgtgtgcgcctaccaggccactagcctgaagaaatggacctcccttttcaccaaccccagcttgttcacgcgcctgtggcgagctgcactgctccatttcatggcgcagatgtgcggcgctacggccatgaagtattatctgccggacctgtttagggtgttgggactgagcccgcgcgtgtcgctgctggcgggcgggatcgagagcaccctgaagattgggtgtacggtgttggagatgtttgttattgataaggtgggaaggaggatgacactggctgttggggcggggattatggcttttgcattgttggtgagttacacgtttctatttgcctgttggacctaactaggacttggactgggacaaaggaatgtgaaagtaaagttttgactgctgactccaaaacccggacatcaagatcaacggtgccctccccctcgcttaccccaacaacaccaaccgcgcctcagactacacctgcgtcgtcttcatcttcatctactcgcttggctacagcatgggtttcggcccggcagcttgggtctacgggtctgagatcttccccactgccgctcgcgcgcgtggtttgagcttcgctgcttctggtggcgcggtcgggtcaatcattgtttcccaactgtggcctatcgggatcgcagagcttggctcgaagatttacttcttcttcatggcggtcaatttggcgtgcgtaccgattatcttcttgctctatcctgagaccaagggacgtccgctggaggatatggaggtgctgtttggcgggtatgagggtggaactccgtcaactacgtctttgcttttggctgatgagagggaagatgggaacgaggaggacgaggagaatgagacactgggtaggccgttgcttggtgatggaagaggcatggcaaggtaggtcttg

SEQ ID NO: 27608 - DNA, 1620 bp, Neurospora crassa
atacggttcctgaaactggtcgccattttcgcgccggtgatcatcacggtaccagtgatctggttcggagagcgccagccggatcgtgacgatgaacgatcaggaacgctgtggtggtatgggttcttggtgcaggctatggagtgggctggtcccgcctttatcaagcttggacaatgggccgcctcgcgatcagacatattccccgacgagatgtgcaacatcatgtcgaagctgcacgacgacgccccggctcattccctccatgctacaaaacgtatcgtggaggcggcatttaatggtcgccacttcgacgagatctttgaggaattcgacgagaagcctttgggtgttggtgccatcgcgcaggtctacagggccaagctaaaaccagacctcaccatgcctgctgatgctgacctttccagctcgactcatcggtttgtcaagaacgttgggaccgttctgaaggctacgccaaaacgggtcccatcgtcccacgtcgccatcaaagtgctgcaccctggtgtcgagcggactgtacggcgcgatctccggatcatgcgattttttgcttccatgatcaatgcgattcctaccttggagtggctctccctccccgacgaggtagatcaattcggtgacatgatgaagctacaactcgacctgcggatcgaagccgccaacctctcccggttccgcaagaacttcaaagaccgaacaaccgcctggttcccctacccctacaccgagttcagcactcgcaacattctcgtcgaggagttcgcccacggcgtcccactagcggacttcatggccaatggcggcggcgtcttccagcacgacattgctagcgaaggtctcgacgctttcttacgcatgctcctcctcgacaactttgtgcacgccgacctgcacccgggcaatatcatggtgcgcttctacgagtccgagaagccccctctcagcctgcactgggacaagcctagtgacgcgaacccggcgggcaaaaatggagatgtcacagagaaagtcctgtcacgcctgtggccgtacagaaataacaaggagctgtggatcgccgagctggagaagattgacgaggaagggtaccgcccgcagctgattttcatcgatactggtctggtaacggaactcaacgctaccaaccgccgcaacttcctcgacttgttccgtgccgtggccgaattcgacggatacaaagctggccacctgatgtgcgagcggtgccgacagccggatgcggtgctcgataaagaggtgtttgcgctcaagatggagcatctcgtgcgggacgtcaaaaacaagacgctggcgctagggaatatcaagattggcgatatcttggagaaggtgttgaatatggtgcggcaacatcacgtcaggctcgaaggcgatttcgtcaatgtggtcattagcatcttgctgctggagggtatcgggcgtgctttggatcctgatgtggatctgctgagcagctcgcttcctatcttgagacaactcggtgcgcagggcggcaaggatatgttgatggagggggatgtgcatatgatggctgtttggctggggttggaggccagaaggtttatgcaggctagt

SEQ ID NO: 27609 - DNA, 1231 bp, Neurospora crassa
atgggttggttttgggctgacggaaacgcttccgccgctgcgccggtcgtccctccgtcgcataaggatcttgccgccagcggtgctgttcctcctgtatgtcatcgtcgtcctcgaaacccgccctcaccggggccctcccaactgccagtagagtctgatctaacctctttgtcgcaaccatgtagccttcctgccctatgcacaacaagaccatggacgccttgagcgcccacaagcccgtaacaccagcacccgaaccgactcccgccgccgctgccccttccaagtgtcccgtcaaccatggcgccaaggataccctcgccgctgcggccgccgccgttgcgcccaagcagccccagccagaaaaccaccaacccgccgccgcctccgagccttccttcttctccaagctcaaccccctcaactacatgttctcctccatctcccaagagcctgcgcccaaccaggccatcgccctcccgacggagcgcgacccctcctccatccccaagggcaccggcgacggcaactgggagtacccttctccccagcagatgtacaacgctctcctgcgcaagggctacaccgacaccgacattaccgccgtggagagcatggtggccgtacacaatttcctgaacgagggcgcatggaacgagattgtcgagtgggagcgccggttcggcaagggtctcatgcgcggctgggaaattatgaagcgcggcgaggagaacgcgcccatgatgctgcgccggttggaggcgcaggagaacgaccccgagccccagccgacgctaattcggttccagggcaggccgaaggatatgacgcccaaggcggccttgttgcaggttttgggcaggataaactccaagtatgcgtaagtacagtcctcttttgtcttttttttttctagatgaggttggaaaaagtagctttttttttgctaacgatgtgactttactcactatctagcaccgaacctccctttgatcgccatgactggtatgtctctcgcgacgaaaacggccagaagaaggaggtccgctacgtgatcgacttctactctgctcctcctgagcccactggcgagcccgttttctacctcgacgtcagacctgccgtaacggtcaccggtgcttgcgagcgcttgctgaggtggggtggcgatgtgtggtggaaggcttccggcggagaggtccgggagcgggagagaagcaagtaaaga

SEQ ID NO: 27610 - DNA, 6674 bp, Neurospora crassa
gccgtggccgtaggtcagacattgagcaaatatatggaggcgctcctggatccaatcttcgcctgcgagctcaccccgaaactaacccaggctttggttgacatggccttctacattcccccagtcaaggctaccatccaggaacggttgctcgatatgctcagcaaggttttgtgtggagaaccattccgaccgctaggagcaccgcatcccaacacactcacttcgatcccggccatcccaaaagatcccaaggatccatcagtgcaggagcgaggaaaggccgaggtcaaattggctttgaacaccctcggcagttttgatttttcaggtacgttactcttcagttccccaagaagccggactggccaaagaaattccaatctcggtccgatgctgccagttacgaagaagggcagtcgtcgggacattggccggcctacactgataccccattggagcgagaactgaccgtagctgcaggacatgtcttgaacgagttcgtccgcgacgttgcgatcaaatacgttgaagatgacgatccggaaatccgtgaggcagctgctctcacctgctgtcagctttacgtgcgcgaccccattgtcaaccagacaagttaccatgccctccaggtggtcgcagatgttattgagaagctcttgacagtcggagtttcggatccggatcccggcatcagacgcactgttctggccgccctcgacgagcgcttcgatcagcacctagccaaagctgagaatatccggaccttgtttttcgccctccacgacgaacaattcgccatcagagaagttgcggtttcgatcatcggacgtctggctcgttacaacccggcctacgtcattccacagttgcgtaagaccattattcagatgctaacggaactggaatacacggatgtggccaggagtaaagaggagagttccaagttgctcagtctgcttacgcagcatgcccaggacttggtcaagccctacgtgaactccataaccgaggttctcttaccaaaagcgcgtgatcccacgccttctgtggctgcaactgtccttcaggcgattggcgagttgtgcacggtcggcggtgaatcgatgcttgcttacaaggatacgttgatgcccattatcattgatgccctacaagatcagagtgctcctatcaagcgggaagctgctctccacacactcggtcaacttgctagcaacgctggctatgtcatcaaaccctatctcgaatatccccaacttctggagattctccagtcaatcatccgcggagagccccaacacggcacattgcgacaggagaccatcaaacttatgggcatcctaggcgctctggacccttacaaacatcaggtataggataccctgaggtcaattccagacgaaatcaagcaccttcggcatttgaccgatcacctatatgaaatgctccaggctagtcctgcaaaggacagtatggccagccaagtggccaatgtcgcgagtgcgaggagcggaaacccctcaaacaagacccccgattccctcaaaaccgcgttgactaacttgatgcaggtcgaagaaaggactgatgacaacaagcggaacaatgaagccgcccaactgactgatgtctctctgatgatgggtggcctaacaccatctaatgaagactactatccgaccgtggtgatcaacgcactgcttcagatcctgaaggatcagtctttagtccagtggcacggaaacgttgtcgatgccatcatgagcattttcatcactctgggactgaagtgtgtacagttccttgatcgtgtggtccccgccttcatatcagtcatccgtgcgtcgagcaacgcccggcttgagttctacttcaatcacttgagcaggctggtcagtatcgttcgccaacacatccgagtttatctcaaggacatcatcgatgttcttcaggagtactggcacacaactctcgcgcttcagagcactatcctggggctgatagagtcaatctcgcggtctcttgagggcgagttcaagatttacctcgccaagttactcccacttatgctaggcgtgctcgagaaggatgttagcacgaagcggcaacctagcgagaaagtgttccacgcgttcctggtatttggctcaagcgccgaagagtacatgcatttgataatcccagttattgtacgcctcttcgacagtcacagccagccattgttccttcggaaatcggctatcgagacgatcggcaagctttcgagcatggtgaacttgaacgactacgcgtcaaagatcatccatcctctgactcgtgtgttggctagtggcgagccgagtcttcgggtagcggctttggacacactttgcgcccttatgctgcaactaggacgcgactacttgcatttcgagcacacagtcgacaaggcgatctccatgtatgccatccagcactcgaattacgaaaaggccatcgagaagctaaagaagggcgaggccctcccacaaaatctcgctcctcggtttgaagacatctccatggagggctttgctgccgaaaacaacccgcccaagaagttgaccctgaatccggtgcatctcaagcaagtgtgggaaacaaagggcaagtccaccaaggacgattggcatgagtggttcaggaagtttagcacaactcttcttaccgagtcgccgaaccattccttgcgtgcttgtgccagcttggccagcaactaccagcctcttgcgcgtgagctcttcaactcggccttcgtgtcctgctggagcgagctttatgaacagttccaggtatgtcagcgcggtatttagaatgatccgagccggatactaacagcttgtttaacaggaggacttgatcaccaacattgagaatacgatcaaatcggagaacgtgccaccggatctccttggccagctcctcaaccttgccgagttcatggagcacgatgataaggcgctgcctattgacataagagtattgggacgtgaggccgcacgttgccacgcatacgcaaaggctcttcactataaagagctcgagtttttgcaggaccataatagtggtgcagtggaggctttgattgtcatcaacaaccagcttcagcaatccgatgctgccatcggtattcttcgtaaagtcaagacctacagggagggtatccagttgcgcgagagttggttcgagaagctcgagcgttgggacgaggccctcaacttctactgccaacgtgagcgcgaaattcccgaagaccagcctgttcccgtcgacattgtgatgggcaagatgcgttgttatcacgctcttggcgagtgggattctctggctacgcttgctggaaagacctgggccaattcggcccctgaaattcagagacgcattgctccattggccacaaccgctgcctggggtctcggcaaatgggactcgatggacagctaccttcagtcaatgaagcgcttctccccagatagagctttcttcggtgcgattctggcccttcaccgcaatcagttcagggaggctatggcatgcatcgagcaagctcgcgaaggactggataccgagcttagtgcgcttgttagcgagtcttacaaccgggcttatcaggttgtagtacgcgtccagatgctcgcggagctggaagagctcattgtctacaagcaatgcgacggagagaagcaggctaccatgcgcagaacctgggagactcgtctcaagggctgccagcgcaatgtcgaggtatggcaacgcatgctgcgtttgagatcgcttgtcatgactccgcaggagaacatgcatatgtggaccaagtttgccaacctttgtcgcaagtcgggccgcatgggactcgccgaaaagtcactcaagcagcttattggaaccgactcgccattggactctgtcattccctactggcacgatcgccatccgggctcggtcggcaacagaatcgcgtctccgatcttgtatgcggttctgaagttccagtgggagattggacagtcaccaggattccgcaattcggagcacagggttgccgagaagacgctgtactgcctgcagaggttcacgcaggagactgcgcaccgcgttgaaacctcgcgtatgcacatggctgcccatgcacagaacggcatggaggtgcaaaaccagccagggtttgccgagttcaatgaagagatgatgcatccacaggcacagaaacactggcttgagcagactgtcttgctggccaagtgctatctacgccagggtgagtggatggtctcgctgaacaaggacgattggcagcagaggtaccgcgccgaagtccttgactgctactacaaggctacccactacaacaacaagtggtacaaggcttggcacgcatgggctctggccaacttcgaagtcgttcagtacctgacaggaaaccgtgaggttgatgtgcgcaacaatggggagcagaattacatcattcaatacgtggtgcctgctgttcgcggattctttgaatccatcgcgctgtcctctggcagctctttgcaggacactctgcgcctcttggctttgtggctcacacacggtggccacattgatgtccataacgccgtcactgaagggtttacgcgtgttagtgttgatacctggcttgaggtcataccccagttgatcgccagaatcaaccagcctcacaagagggtgcagcagtcagtccatgggttattagccgacgttggtcgtgctcacccccaggcgttggtgtatccgttgacagtcgcaagaaagtcctggcacaacacgcgtagggtacggtcggccaaccaaattcttgaaagtatgcgtcagcacagtctccggcttgttgagcaagcggagattgtcagtggtgagctcattcgcgtcgcagtgctctggcacgagttgtggcacgaggccctcgaggaagcttcgcgcttgtactttggcgaccacaacatcgagggcatgtttgccactctcgagccgcttcacgagttgctggaggctggcccgcaaacccttagagagatctctttcgcccagacctttggccgtgatctgagcgaagcgcgggattggtgccgtcagtatcaagagacgcaagactccaatgaccttaaccaggcatgggacctgtactacacggtgttccgtcgtatcacccgccaacttccgcagatgacctccctcgagttggcttactgctcgcctaatttgctaaacgccaaggatctcgaacttgctgtgcccggaacgtaccgcagtggccaggaggttgttaggatcatgtcttttgacgccaccttcagcgtgatcagctccaaacagcggcctcgcaagctcgatatcgttggcagcgacggcaagacatacactttccttctcaagggacacgaagatatccgccaagatgagcgtgtcatgcagctgttcggtctttgcaatactttgttggccaacgactcggaatgcttcaaacgacacctcaatattcagcgatacccggctattcccctttcacagaactctggtcttctcggctgggtccccaacagtgacactgtccatcagttgattcgggagtacagagattccagaaaaattctccttaacattgagcatcgtatcatgttgcagatggctcccgactacgacaaccttacgcttatgcaaaaggttgaggtctttggatatgctcttgataataccactggccaagatctgtaccgtgtcctgtggctgaagagcaagtcttctgaggcctggctggatcggagaacaaactacacacgttctcttggtgtcatgtcgatggtcggctacatcctcggcttgggtgatcgccatcctagcaacttgatgcttgaccgtatcacgggcaagatcatccacattgatttcggtgactgcttcgaagtagccatgaagcgcgagaagtatcctgagcgggtgccgttcagactgactcgcatgctcacatatgctatggaagttagtaacatagagggtagtttccgtaccacctgtgagcatgtgatgagggtgttgcgcgagaacaaggagagtgtcatggctgtccttgaagctgtaagtatcctttgctatgttcctttcttaacgggatcgctaactgatacgcgaaatagttcattcacgatcctttgctcaactggcgcttgaccaaccccaccagcccgcctggtcccaacttcaacgccgagcgagaggtcgccatgcccggtggccctggtccgcgcgcccgcaggccatcaatccttgacgctcccgtggcacccaccgagttccttgccgcgcaggctgctcctggtgcggatgggcatggaatggggatgtccgctaaccccggacgctcccgtgcccgcaccaattcgtctgccatctatccgactggtagcagcatggttaatggccatggaaacaaccagcaagagcaacaggaggttcagaacgcgcgcgccctcgaggtcttggaccgtgtgcagcagaagctcactggtcgcgacttcaagcctcatgaggagctcaatgttactgatcaggtcaacaagctgatcatcgaggccaccaagcttgagaacctgtgccagcactacataggatggtgcagtttctggtagacagtc

SEQ ID NO: 27611 - DNA, 1586 bp, Neurospora crassa
gtcaccgcgataggaggcttccttttcggctatgacaccggtcagatctcgggcatgcttctattcagcgacttcaagaacagatttggccagatcacccaaccagatggatcaaaggaattcgagtccatcatccagtcactgctagtatctcttatgagtatcggtacactcctcggttctttgacttcatcatagtaagctctcctctttcctccctctccctctccaacacactcaacctagacaccaacaatactaaccaacacttctctacagcaccgccacctggtggggccgccgcaagtcccttacattcggcgtcggtctcttcatcatcggcaacatcattcagatcaccgcaatgcactcctgggtacacatgatgatgggccgcttcgtcgccggtctaggcgtcggtaccctctccgtcggtgtgcccatgttccaatccgagtgctcccctagagaaatccgtggtgccgtcgtcgcctcttaccaactgctcatcacctttggtatcctcatcgccaacattgtcaactacggcgtgcgcgagatccaggagcaggacgcttcctggcgtatcgtcattggtttgggtatctttttctcgcttccgcttggcgtgggagtgctgttggtccccgaaagcccaaggtggctggcgtccaaggaggattgggagggagcccgcatgtcgatggcgagactgagaggcttgaagcatgacccgcataacgagctggtggaggatgatatgaaggagatgcgggaggttttggagaaagagcggactgcggccgtgggaacttggaaggagtgtttcatccccaacaagaacggtgttcccaagcaggtgtaccgcacattcctgggtatcggcatccacttcctgcaacagtggactggcgtcaactacttcttctactatggcgccaccatcttccagtcggcgggtatcaaggaccccattcaaacacagctcatcctcggcgctgtcaacgtcttctcaaccctgttcggtctctgggtcgtcgagcgcttcggacgcagatggccgctgttcatcggtgctatctggcaggcgtcttggctggccgtgttcgcttccatgggcaccgctctcgaacccgaccaaaacaaggcgtcgggtattgtcatgatcgtctcggccgcactcttcatcgcttcctttgcttgcacctggggtcccattgcttgggtcgtcatcggcgagagtttccctctgcgcacccgtgccaagcaggcttcgcttgccacggctggtaactggcttggaaactgtaagttcatcatttttcccccttccctttttccccatacatcaacaaaaactaacaaacctccccacagtcatgatctccttcctcacccccctcgccaccgatggcatcggctatgcctacggctacgtctttgtagccaccaacatcatgggcgcacttttggtctggttcttcctgtacgagtccaccagcttgtccctcgagaacgtcgacctcatgtacagcgagccgggcatcaagccgtggaactcgcacaagtggatgccgcctggctac

SEQ ID NO: 27612 - DNA, 1537 bp, Neurospora crassa
atggtctgcgacttcttctttccccaacccggcggcatcgaatcgcacatctaccaactctccaccaagctcatcgaccgcggccacaaagtcatcatcatcacgcacgcctacgaagggcgaacgggtgttcgctatttgaccaacgggctgaaagtctaccatgtaccgtttctcgtcatctaccggagcgccacctttccgacggtgttctcgttctttcccgttttccggaatattgtgttgagggaacggatcgatatcgtgcatggccatgcttctttgtcgagtctgtgtcatgaagccattttgcacgccaggacaatgggactaaggaccgtgtttacggaccacagtctgtttgggtttgcggatgcggcgagtattctcacgaacaagctgctcaagtttgccttgagcgacgtggaccatgtcatttgtgtttctcatacttggtacgccccctctcatcccccctcttcttctcttcaacctcctactaacaaggtgacacagcaaagaaaacacggtcctccgcgcctccctcgaccccctcatggtctcggtaatccccaacgccgtcgtcgccgacaactttcgtccattaggctacccaaccaccacctccacccctccctcctccatctcctcccccatccccggcctgccccccaacccatcatcctccctttcctcctctctaacccctccgcgccgcatcctgggtccgcacgaccccatcaccatcgtcgtcatctcccgcctcttctacaacaaaggcaccgacctgctcacagccgccatcccccgcatcctcgccgcccaccccaacacgcgcttcatcatcgccggctccggtcccaaatccatcgacctcgaacaaatgattgagcaaaacgtgctccaagaccgcgtcgaaatgctcggtcccatccgccactccgaagtccgcgacgtcatggtgcgcgggcacatctacctccacccctcgctcaccgaagccttcggcaccgtcatcgtcgaagccgcctcgtgcggcctttatgtcgtctgcacccaagtcggcggcatccccgaggtcttgccagggcacatgacggtattcgccaaacccgaagaagacgacctcgtcgccgccacggggaaggccatcgccgcactaaggcggaacgaagtgcgcaccgagctgtttcatgaacaggtcaaaaacatgtacagctggaccaacgtcgcggaacgcaccgagagggtgtataatgggatatcgggcgccattagcgaagcagagttttacgggtatgatcacctgaaagaccaccggaacggaagtaacgggtcgtggacggcggttacggccacaagggggatgaggagcggggtgcagagttttgctctgattgatcggctcaagaggtactatggctgtggagtctgggcgggcaaactgttttgtgtctgtgtgattgtcgattatttgatcttcttgtttttggaactggtctttcccagggaaagtattgatatctgtccggattgg

SEQ ID NO: 27613 - DNA, 1278 bp, Neurospora crassa
ctactcgagaagacgtatgctcatgagctgattttcaacaaggaaggccaagtgactggaggttcccttccggcgctggttgaacgtctcactactcatgagtcgactcctgatgccatgtttgtgtccacattctacctcaccttccgcttgttctgcacgccgctcaagtttgctgaggccctaattgaccgcttcaactacgtcggagaggctccgcatgttgctgcccctgtcaagcttaggacgtacaatgttttcaagagctggatggaatcgcattggcaggaagaaactgacgcggaagcattgcccgtgatcaaggattttgccgagtccaaactcacagagcttttgccttctgctggaaagcgactgcttgacctcgccgagaaggtggctaacagcggcggtactcttgtgccccgtttggttgcctccatctccaagacgggcacttctggctctcaattcctgtccgccgagacgcctctcccttcgcccaatctctcaaggggtcaagtgcacgcactcaccaactggaaggctggtggcgtctccccatccatcatggattttgacccgcttgagatcgctcgccaaatcaccatcaagcagatcggtctcttctgctccatcactcctaaggagcttctcggctccaagtggaccaagaacaagggagttggcgcacccaacgtcaaggccatgtcgactttcaccaccggactgtccaacctcgtggtggacactatcctccaattcgatgagatcaagaagcgagccgccatcatcaagcactggatcaagatcggcagccagtttcttgccctgaacaactacgacggtctgatggccgtcacatgcgccttgaacgactccagcatcaagcgcctgcggatgacgtgggacaccatcagctcgaggcgcaaggagacgctcaagtctctgcaggccattgtcgagatcggccaaaaccacaaggccctccgcgctcggctcgccgagcaggtccctccctgccttccgtacgtcggcatgttcctgaccgatctcaccttcattgatgcgggtaatcccgccaaaaagacgactgacacgggcctgacggtggtcaacttcgacaagcacatgaagacagccaagtgcatcggtgagctgcagcggttccagatgccctaccgcctcaccgaagttccggacttccaagaatggatcgtctcgcagattgagagggcgcgggagattgagaagaccggaaggacgcctgctcaggtg

SEQ ID NO: 27614 - DNA, 2201 bp, Neurospora crassa
tcaccaggcattgtgcttgctaactgaacacccaggcatcagatacaggctgttatcttcatcctcaaacgagaacctggaaaccggttttctcaagcttcgaaagctagtgtcagcacctccatgtgcccacggtatgtcttcctatcaaacacattcagacaccaaacgtacggcacagtgctgacagatgcttacctaccttaccttcacctatgaagtagcctgggagtttctcaagaaaatcacggtgggctcattgccgacgtgatgggaatgggcaagtcacttacaatactcacaacgatcctatgcactgtagaggatgctcgcaactttcctcatttctctttccagtcgcgaaacgtcgctgaacccgaacgaagaacaccaacaccagccactctggttgttgtaccctcagcgcgtaagttttcgttcaactcccctgttccaaacctgcactaaccactcaaagagctcatgcacaactgggtagcagagatagcgaggtatgtccaccgcacagcacttcatttcctgagttgctggcgcctttggtgagctaaagcgaactacgtacctctagtcacatgcctggagccctgaatctcatcctgttccatggtcaaggtcgacctaagagtcccgagtcgatggcgtcaactgatgtggttcttacaacatacggaacgcttgctgctgatcacaagaacgctcgcttacttcagaaaatggagtggtatagagttgttctggacgaaggttagaactgaactttccattgcagtgtatgtggacatcataacaaaccccttgctaattaggcaataacagcacactggattcgaaatgcatcctctcagcaattccgagcggctaccagtcttagcacgagccgccgatggtgtttaacgggcactcccatacaaaacaagctcgatgatctggcgtctctcgcccactttcttcgagtcccgccgtatcctgagaaaactgtgtttcggaaatatgtgcttgaaccccttgagaagggagatcaaggatgtgctgatcccttacggtcatatcttcgccagcattgtcttcgccgcaccaacaagtgtcttaacctacccaacttatccgaaaaaaccgtctatctgcaactctcaatgcaggaacaggagacatatgacaagattctgagcaccgcgaaacgtgcactggatgacattgtcagtagtgccaacaagcctaaacaggtcaaaaatgagaaagtcaccgtgttcttcacaactcttacaagcttgcgtagactgtgcgaccttggaacgttgccacctatacagtcttcgccgggcgacctcggacagccaacagaggataccgacatgctgtgtgagctttgttcatcgcaagatgcggacggatctctgttgttgaaggatcatcaattctgtcccgagtgctcgcgaccacttcgcacccagagatcagcaagcaacactggctacctcacgccagctagtttgccagggactgttagcgatcgtgcaatgagccccctcatcctgtccatggacaatggcctctccacaaagctcttgaaggtcagagacagcgtgctccaggccctccaatctcaaactggcatcaagcagtaagtagttattttgtttcaggcagcacctcgactcctgacagctaacgctccgccagtctaatattttcggcttggacatcgagcctccgctatctcgcccagcttatgcagcaagctggaattcctcacgcgcagatcgatggacgaaccagtaacgcagagcgtctgagacatatcaaggcttttcaggaagactctcaggtccctgtcctcctcatgtcaattggcacaggggctgtcgggtaagcaatgattcaccttatcgtttcagtagtctcttcacctttcctcaccttcctcaccgagtaaaccctccctcctcacgtcctctcttccccatgcccttatctccttccaccatacagtacctctaattatatctccccaaccgcgaagcctcaccctcacggcagcaagccacgtccacatcatcgaaccgcagtggaacccctcagtcgaggaacaagccatcggccgagcgctacgcatgggtcaaacgaaagaggttgtagtgacaaggtacatcatgaaggggaccgttgagcaggtgagtcca

SEQ ID NO: 27615 - DNA, 2179 bp, Neurospora crassa
ggtgtgggcctttcagtcttcggcggtgtcttgcaggaaatcatgtacttcaagccccaggtcgtttatgtgtccgtcatgttcttgaccgtcctcgcccaggctttgggtacagcgctgtctcagcttatcccgagaaaaggtgccatcggccgcttcctcaacccgtttccctggaaccgcaaggagcacacggctgccgtcctcatggcctcggcggcttcggtatcggccctttccaccgaagccctgtcggtgcaggagctgtggtacggcggctaccccagtaccgcagccggcgtcttcatcaccctgtcctctcagctcatcggctacggtgccgctggcatgatgcgctctgttctgctgtacccgaccaagatgttgtaccctgccaacctgcccatcaccaccgtcatggagaccctgcacaagcccaaggccgagacggccaagcgcttcaaggtcttttggatcatcttcgtcgccatcttctgctgggagtggttccccgagtacatcttccccatcctgtccgccgtgtccatcttctgcttagccgaccagaacaatgccgtcttcaccaacctctttggcggttcgcagggtaacgagggcatgggctttctcaacatctgtttcgattggaactacatcgccggcttcggctccccgctgtggatgcccctgcagactctcaccaacagcttcatcggctacctcggcggcatcatcctgtccatgggtctctactacagcaacatctggcgaggcatggacttccccttcatgtcccagcttctgtacgacggcagctctaactcgaccaactacgtggtctataacgagaccctcatcatgaactcggacttcaccattgacactgacgccgtcgataaggttggcgtcccgtacctgactgccacgtacgtcaactacctcatcaccaccaacgccagtctcaccgccaccctgatccacatgctcctttggaactacgacgacgtcagcaaggcctggagctggatcactctcgacaagctcaagtcgctgcttaagccatccacgtacttcttctggaagtccaccggggcccggactgaagtcgagaaggaggcgattcgccaggacccaaccatcgacccccattaccgtctaatggtcgactacgacgaggtgcccagcagctggtactttgtcgtctttgttatcagcattatcgtcggtatcgtctgcctctacgtcatgaagtcgactttgccgtggtggggattcatcatcggcaccctcctcctgatcgtgctcatcatcttcttcggtgcccagtccgccatcacgggctttaccgtcaacatgcagccagtcatgcaaatgctagcgggctacatgtttcccggcaagccattaggtacgtacctcaacttcaatcccacctccaaaaccaatctcagtactaatctccttctgtcccatagcaaacatgtacttcacaacctacacctacaacggtctttcccaaggcatcctcctccttcgcgacctcaaactcgcccagcaaaacaaactctccccccgcgccaccttcaccacgcaaatggtcgggtgcgtcatcggcgcccttctcaactacgtaatgatgatcagcatcgtcaagaaccaggctcccctcctcaagtccgccgagggaagcaacgtctggtccggcgcccaagtccagcaattcaacacgctcgccatcgcctgggccatcgcccccaaaatgttctccatcggcgcccgctaccagtgggtcacggccgcctacctcgttggcttccttgcccctttgcccttttatatcatgcaccgcttcgtcttcccccgccagcgcatctggtcgtatctcaacacgtccatcatcctgtggtacctaggcgaactgtttgtcggtcttaatgcgtcgattacaagttattatatcttgggtgcctttggacagttttacctccgtcggtataggccgcagtggttcgtcaagtggaattacttggtttcggctgcgctggatggtgggacccaggtcatgattttcattgcgacgtttgctgtctttggtgggtcgggcaaggcggtgccgtttcccgagtgggcggggaatcatccgaataacttggattattgcaagtataactctagttag

SEQ ID NO: 27616 - DNA, 1026 bp, Neurospora crassa
atgtcgccgtccaccctcagacaaagcacatgcgcactactcgctctgagcctcgttactacggccacagccgggccctgcgacctttacgacgcagccggatatccttgtgtagccgcacacagcaccactcgagccctgtatagtgcctacagcggtccgctctaccaagtacaacgcaccgacggtaccaccaccgacatcgcacctctctccgccggcggcgtcgccaatgcttccacgcaggactctttttgcgccgggacgacatgcgtcatctccatcatctacgaccagtccccccgcggcaaccacctcacccgagcaccgcccggaagcgccggtagcggtccggctccgggaggatacgacaaccttgctgatgcgactgctgcgccggtgtacttgaacggccataaggtgtacggcgtcaaggtcgcgcccggtaccggatatcgcaataacgatgctaagggcaccgccacgggtaatgcggccgagggcatgtacgccgtcttggacgggacgcactacaatggcggatgctgcttcgactatggcaacgccgagaccaacagtgtcgacacgggtgcgggccacatggaggctatttactttggaaactgcaatgtctggggaacgggacagggaagtgggccgtggatcatgggtgatttggaaaatggcttgttttctggccagaacgcaaagtacaacggtggcgacccggcgattaactaccgctttgtcacggcggtgatcaagggagactcgtcgaatctgtgggcgatccgcggtggtaatgctgcatcgggatcgctgtcgacgtactatagcggcccgcgcccgtctgggtactacccgatgaagaaggagggtgctattatcctcggtattggtggcgataacagtcatggggcccagggtaccttttatgagggggttatgactactggctatccatccgatgcggtcgaagacaaggttcaggccgatgtcgtggctgccggatacgccacctcgtcg

SEQ ID NO: 27617 - DNA, 1954 bp, Neurospora crassa
atgccgccctccgcctccaagcagaagcgcctcgccgagaaggccgccaaggccaacaagggcaaggccgccaaggaagtcgagctcgatgcttttggcaagcccgtcgtctcggatgagcccgctaccaagagcgagcagatggacgaggtcaagcgcctcgcccaacagatggacaagcacggtctctcggatcgtgtcaccaccggtgtcttggcctctaccaaggcttccaaggacgtcaagatcacctccgtctccctcgtcttccacggccgcgtcctgatcaaggatgccactctcgagcttaccctcggccgcaggtacggtcttttgggtgagaacggttgcggcaagtccacccttctcaaggccatcgccgcccgcgagtaccccattcccgagcacgtcgacatctaccttctcaacgagggtgctcctcccagcgagctcggtgcccttgactgggtcgtcaccgaggccaagaacgagttggcgcgcctcgagagcgtcgccgagaagattcttgaggaagagggccccgattcgcccctcctcgaggacctctacgatgtatgtatcccccaaatcctatgatcacaccgaactgggcgcattcacaatactaactctgccatcacagcacattgacaagatggatccctccaccttcgagacccgcgcttccctcattttgaccggtctcggtttcaacaagcagaccatccagaagaagaccaaggacatgtccggtggttggcgtatgcgtgtcgccctcgccaaggccctcttcgtcaagcccaccctcctccttctcgacgaccctactgcccatttggatctcgaggcctgcgtgtggctggaagaatacctcaagaagtgggaccgtaccctcgtcctggtttctcactccgaggatttcctcaacggtgtctgcacaagcatgatcgacatgcgcctccagaccctcatctactatggtggtaactacgacacttaccacaagacccgcgccgagcaggagaccaaccagatgaaggcctaccagaagcagcaggatgaaattgcccacatcaagaagttcattgctagcgctggtacctacgccaacttggtccgtcaggccaagtctcgccagaagattctcgacaagatggaggccgacggcttcatccagcctgtcaagcaggacagagtcttctccttccgcttcgccgatgtcgagaagctccctcctcccgttctgtcgttcgacaacgtcaccttctcgtactctggcgaccccaaggacgacctgtaccgccacatcgatctcggtttcgacatggactcccgtaccgctcttgtcggccccaacggtgttggcaagtccaccctgctccgtctcatgaccggcaagctctcccccaccgatggtgtcgtccagcgccacacccacttgaagctcggtctctactcccagcactctgctgagcagctcgacctgaccaagtcggctctcgacttcgtccgtgacaagtaccccgacaagtctcaggactaccagtactggcgccagcagcttggcaagtacggtctctccggtgaggcccagacctcgctcatcggtactctttccgatggtcagaagtcccgtattgtcttcgcccttctcgccatcgagtctcccaacatgctcttgctcgacgagcctaccaacggcctcgatatccccaccattgactcgcttgccgatgccatcaacgctttcaccggtggtgttatcgtcgtttctcacgatttcaggttagttttgttcccactttgctacccgcatgtgacttggatgctaacacaatgaaaaaacagacttttggacaagattgccaagcagattctcgtgtgcgagaacaagaccatcaagcagtgggagggcagcatctcggattacaagaactacctgcgcaagaagatg

SEQ ID NO: 27618 - DNA, 399 bp, Neurospora crassa
acacatagctctatcccaacagtaggcttcaacctcaagcgtgtccaacgcgggcatgtcacgctcaaatgctgggatctcggtggccagccgcgctttcggcagatgtgggagcgctactgccgaggcgtcaacgcgatagtctttatcgtcgacatcgccgatcctcgtctgctcccgcaagccaaggacgaattgcactcccttatgcgaaacgaaaccctccagggtatccccttgttggtgttgggcaataaatccgatttgccggaacggttgagtgtcgacgagctgattgatgcgatggatttgaagagcatcgccggacgggaggtcagctgttatgggatctcggccaaggaggagatgaatctcgatgcggtgctgcagtggttgatg

SEQ ID NO: 27619 - DNA, 3700 bp, Neurospora crassa
cagccgaccagccaggactgggacgtcgagttcaaccaggtccgccgcgagaagctcttccgagaccccccgaccgaccgcaccgcctatcccgccctccaggccgccgtcgacccccacatcgagtccttcaacgccctcttccgcgacgatggcaagccttcccttctcgaccacgctctggccgagattggcaccaagacattcctagacggcgatgagcgcgctgatccccagggcaagaacaagctcaccatccgctacaagagcatcgagttgcaaaagtctcaggtcccgcccaccaaccgctgggccaagaaccgtgaaatcttcccggccgagtgcagagaacgacatgtctcatacaggggcaagctgtcggccacctttgagtatcgcatcaacgatggcgagcctcacgagtttgtgcgcgagctcggccagatgcccatcatggtcaaggtaagcctggtgacccgagatattcccagtctacatcatcgatgtctaacaattctgcttgcgaaaaaaacagtccaacaagtgccacctccaaaacaactcccctgcccagctggtagcaagaaaggaagagtccgaagaattgggcggttacttcatcgtcaatggtatcgaaaagctcatccgcatgctcctcgtcaaccggagaaacttcccgctcgccatcgtccgtcccagtttccagaacagaggcgcctcctacaccccgtacggtatcataatgcgatccgtccgccctgacgagacctcccagaccaacgtcctccactacctcagcgacggcaatgtcaccttccgcttctcgtggagaaagaacgagtacctcatccccgtcatgatgatcatgaaggccctcgttgagacaaacgatcgagaaatcttcgagggtcttgtcggcccaccccagtccaagggcgtcgccaacaccttcttgaccgaccgcgtcgaactcctcctccgcacttacaagaaatacggcctttacagcaagacccagactcgcgcgtacctcggccaaaagttccgcgtcgttctcggcgtccccgacaccatgtccgactacgaggttggcacagagttcctccgcaagattgttcttgtccatctcggctcccaggacgtcaccgagcagcaggatgccgacaagttcaacatgctgctcttcatgtgccgcaagctgtacgccctcgttgccggtgactgcgctgtcgacaaccccgatgccgtccagaaccaggagattctcctgggtggtttcctctacggccagatcatcaaggagaggctcgaggagctgttgaccgtttccttccgggcctcccttcgcgactacctcaggaggaaccccacggtatctttccagtccgacactttcctcaaggacttccccatcgccatcttccgcagggccaacgaaaacattggtcagtcgctcgagtacttcttgtctaccggcaaccttgtgtccccttccggtctcgatttgcagcaggtttccggcttcaccgtcgttgccgagaagctcaacttcttgcgtttcatcagtcacttccgcatggtgcatcgtggttccttcttcgcccagctcaagacgacaacggtccgtaagcttttgcccgaatcgtggggttttctctgccctgtccacactcctgatggttctccttgcggtcttctcaaccatttggcccacaagtgcaagatcatgacggagtctgtagacgcctctaccatttctcgtctggctttcgagctcggcgttgtcaacatttcctcggctgccaccagcgagagcgtagtcgttatgcttgatggcaggatcgtcggttggtgcacccctgaggagtgcaagtccatcgccgagactctccgttactggaaggtcaacggcgagaacggcgtacctcttcagctcgagattggctacgtccctccttccaacggcggttcttaccccggtctctacatgtcctctcagcccgctcgtatggtccgtcccgtcaagtacctccctctgcagaaggaggactttgtcggtcctcaggagcagccttacatgtcgattgcctgcacggagcaagaggtcatccccggggattctacccacgtggagttcgatcctactaacatcctctccatcctcgccaacatgacccccttctccgacttcaaccagtctccccgtaacatgtaccagtgtcagatgggtaagcaaaccatgggtacaccagcaacggctcttgcccaccgtacggacaacaagatgtaccgtctccaaacgggtcagacgcctgttgtccgcgcacctctgcacaacacgtacggtttcgacaacttccccaacggcatgaacgccgtcgtcgctgtcatttcatacactggttacgacatggacgacgccatgattctcaacaagtcggcacacgagagaggatttggtcacggtagcatctacaagaccaagaaggtcagtctcaaggatgacagcaggacacgctcggccaagagcatcgtcaagatgtttggcttcgcgcccaacagcaccatccgggagtccacccgcgacatgctcgacaacgacggtctccctcgcgtcggccgtcttctccgtgagggcgacgtcatctgcgcgtggcacaccgtttccgccgactacaacggccagctcgtcaaccgcgacggcgtcactcactacgagcggtacaaggactcggaagacgcctttgtagaggaagtccgcgtcatcggcgccgacaatggcaccgagcccctgcagaccgtctccatcaagttgcgcattccccgttcccccgtcattggtgacaagttctcgtctcgtcacggtcaaaagggtgtcctttcgcaaaagtggcccgccaccgacatgcccttctcggaaaccggtatccagcccgacgtcatcatcaaccctcacgctttcccgtcgcgcatgaccattggcatgtttgtcgagtcgctagccggcaaggctggcgccctgcacggtctcgcgcaggactccacccccttcaagttcgacgagcaaaacacggcgggcgattactttggccaccagctcatgaaggctggctacaactaccacggcaacgagcccctctactcgggtattacgggcgaggagttccaagcggatatctacattggtgtggtctactaccagcgtctgcgtcacatggttaacgacaagtaccaagtgcgtaccactggtcccgtcgtgcctacgactggtcagcccatcaagggtcgtaagaagggtggtggtatccgtgtcggtgaaatggagcgtgatgcccttctcgctcacggtacttcgttcctccttcaggaccgtcttctcaactgctcggattactccaagagctggatgtgccgtcagtgcggctccttcctttccacgcaacccaccgtgtcgccatttatcggcaagcgcaaggccgtcagcactgttaggtgcaggaactgcgcggtcaggctcgacgatatggaggatgtcgatctcatgcagattgacggagagatttgggaagatggcagcggtacccagtggatcggtggagagaacactaccatcgttgcggtgccgggtgcgcttaagtacttggatgtggagctggcggctatgggcatcaagctgaagtacaaggtagataagaaggat

SEQ ID NO: 27620 - DNA, 1561 bp, Neurospora crassa
aagctcgacgcttttacaaaaacagtcgaagatgccaggatcaggacaacatccggaggcatcgtcaccattgtctcgctgcttgtcgtcttgttcctctcgtggggagaatggagagactacaggaaggtggtgatacaccccgagttggtggttgacaagggacgaggtgcgcatacttaccccaacaacagcaacccatagacagtagaactggatagacaagacaagacagataggaagaacaaaagctgaccatgacggaatgcaacaggcgaacgaatggaaatccatctcaacatcaccttccccaaagtaccctgcgaactcttgaccctcgacgttatggacgtatccggcgagcaacaacacggcgtccagcacggcgtcaagaagatcagacttaggccccaaagcgaaggaggaggcgagattgacgccaaggttctttctctgtacgttttcccttacccgtctcccccttccattacctattaccaatagcaccaccactaacacatcttacacccaacagccacgccgccgacgaatccgccacccacctcgacccctcctactgcggtccctgctacggcgccccggccccttacaacgccaaaaagcccggctgctgctccacctgcgaagaagtgcgcgaagcctacgcccaggcctcgtgggcctttggcgatggcgccaccatggagcaatgccagcgggagcactacacggagcggctggccgagcagcgccacgaaggctgccgcatcgaaggcggcctgcgcgtcaacaaggtgattggcaacttccacattgcccccggccggtccttctccaacggcaacatgcacgtccacgacctggcgcagtggtggagcacgcccgtccccggcggccattcgttcagccacatcattcactcgttgcgattcggtccccagctgcctgacgacttggttcgcaagttgggtggtaatgggaagaacacgctgtggacgaaccaccatttgaatcccctggacaacaccaagcaggagacgaacgatccgaactacaatttcatgtactttgtcaagatcgtgccgacctcttacctgcccctcggctgggagaagcaggcggcgcagaacaaggcggcctgggagcaggaccacagtgttggactgggcgcgtatgggtacggatcagatggaagcatggagacgcatcagtatagcgttaccagccataagcgcagcttgacagggggtgacgattccaaggagggtcatggtgagagattacacagtaggggaggtattccgggcgtgtttttctcctacgtaggtcccctatccctttttgggtgttgttgttgttggatggtgttggtgatgacaagtgctaacaaagtgggcgacaggacatctcccctatgaaggtggtcaaccgtgaagagcgcgccaagtccttccttggcttcttggctggtctttgcgcggtcgtgggtggtaccttgaccgttgcggcggcggtagacagaggcttgtttgagggcacggtgaggttgaagaagttgagg

SEQ ID NO: 27621 - DNA, 872 bp, Neurospora crassa
ggcttcgacttctccaactacaaccgcaatgcggcgctacacgcccgcggcgtcccgctgcccaaggccaccagcacaggaacaaccattgtgggctgcatttacgacggtggtgtagttgtgagtacagcgtcgttctgtccctcttccatcatgcattacaccctgcatgccacagctccctagctgtcaccacactccatgttcccatgtacccgagcaacaactcactaaccacttgctcccccttccagatcgcagccgatacccgtgccacgtccggtcccatcgtcgccgacaagaactgcgaaaagctgcacttcatcgcccccaacatctggtgcgctggtgccggtaccgccgccgacacggaattcaccacggccctgatctcctcccagctggagctgcactctttgtccaccggccgtaagccgcgcgtcgtgacgtgcatgaccatgctcaagcagcacctcttccggtaccaaggccacattggtgcgtacctcgtcgtcgccggcgtcgacccgaccggcacccaccttttcaccgtgcacgcgcacggttccaccgacaagctcccctacgtgaccatgggctctggttcgctggcggccatgtccgtcttcgagacgcagtggaagccccagctgaacaaggaggaggccatgaagttgtgcagccaagcgatcgaggcgggtatctggaacgatttgggctcgggaagtaatgtcgatttggcggtgatcacgcccgagaagacgacgctgcacagaggcttcgtcaagccgaacgagaggacccagaagctcaagagttacaagttcaagaggggcacgacggcggtgctcaatgagaaggtcatcaagaag

SEQ ID NO: 27622 - DNA, 291 bp, Neurospora crassa
gccaggctgtgccaggccattgtcgacgaggatgttgagcatgtccaagactggcttgctcaggagggcgccaatcccaacaccagagaccacacaggcaggactccccttcaccttgctgtcatgtcttcctcgcccgcagtggttcgtgccctcgttgaggctggtgcccgccttactgcgcgtctcgcggacggaagaaccgcactccacctggccgcttctcgtggcgacgtggaaattgtcaagatcctcatgaataagagcaacgccaacgaggaagagtttgag

SEQ ID NO: 27623 - DNA, 804 bp, Neurospora crassa
cagaccaccttcgtcaagcgccacttgactggtgagttcgagaagaagtacatggccaccctcggtgtcgaggtccaccctctcggcttcagcaccgtaagtcttgatggccctcgattacaacaaacgtgtgcttgcacgcgcgctcgctcgacgaacccgatgctgacccaaccatccccccgtgcagaacttcggccagatccagttcgacgtctgggataccgccggtcaggagaagttcggtggtctccgtgacggttactacatcaacggccagtgcggtatcatcatgttcgatgtcacctcccgcattacctacaagaacgttcccaactggcaccgtaagcgcccctcatcatgcagaacccgtcacgacgtatgacagccctctctgacaacacatctaggtgatctcacccgtgtctgcgagaacatccctatcgtcctctgcggtaacaaggtcgacgtgaaggagcgcaaggtcaaggccaagaccatcaccttccaccgcaagaagaacctccagtactacgatatctccgccaagtccaactacaacttcgagaagcccttcctctggctcgctcgcaagctcgtcggcaacaacgctctcgtatgttatcccacccccagctccatgagaggtctgatgtctaactgtgtctctaggagttcgtcgctgcccccgctcttgctcctcctaccgccgttgtcgaccaggagcttatggagaagtaccgcgccgaaatggacgaggccgcccagatgcctcttcccaacgaggaggacgatgatgatctc

SEQ ID NO: 27624 - DNA, 1596 bp, Neurospora crassa
gcggcgcgaaggatacatgccaccgccaaccacctccgtcctgccgccgcagccctcgagagcaccgcgaccagctatcctaccactcacgacaagatcgccgacgtcaaggacactccttggttcatcgacaacaagttcgtcacctcctccaccacccagtacatcgacctccacgatcccgccaccaacaacctcgtcacccgcgtgccgcaaaacacggatgaggagcttaaggccgccgtcgcctcggcccagaaggcctttgagtcgtggaggaacaccagcgttctccaccgtcaggccatcatgttcaagttcgtcggcctcatccgcgagaactgggaccgtctcgccgccagcatcaccctcgagcaaggcaagacctttgccgacgccaagggcgatgtgctccgcggtctgcaagtcgccgaagccgcctgcgctgctcccgagcttctcaagggcgaggtcctcgaagtggccaaggacatggaaacgcgcagctaccgagaccccttgggcgtcgtggccgccatctgccccttcaacttccccgccatgatccctctctggtgcatccccatcgccaccgtgacaggcaacaccctcatcctcaagccctcggagcgcgacccgggcgcggccatgatcctagcggaactcgtccagaaggccggattccccgagggcgtcgtcaacattgtccacggcgcccaccgcaccgtcaacttcatcctcgacgagcccgccatcaaggccatctcgtttgtcggaggcaacaaggcaggcgagtacatctttgcgcgcggctccgccaacggtaagcgcgtgcaagccaatctgggcgccaagaaccacgccgccgtcctgcccgactgcaacaagaaccagttccttaatgccgtcgtgggcgccgcgtttggtgccgccggccagcgctgcatggctctgtcgaccctcgtcatggtcggcgagaccaagaactggctgcccgagctggctgagcgcgccaaagcgctcaatgtcaacggcgggtttgaagagggcgccgacttgggacccgtcattagcccgcaaagcaaggagcgcattgaaagtctgattgcctcggccgagcaagagggcgccaccatcctgctggacggccgcggctacaagcccgccaagtatcccaacggtaactggattgctcccaccatcatctccaacgttactccctccatgaaatgctaccgcgaagaaatctttggtcccgtcctcgtctgtctcaacgtcgagacactggatgaagccatcgagctgatcaacagcaacgaatacggcaacggtgtcgccatctttactcgcagcggtcccaccgcggaaacctttaggagacgcattgaggccggacaggtcggtatcaatgtgccgatcccggtgcctctgcccatgttcagctttacgggcaacaagaagagtattgcggggggtggagcgagtacgttttatggaaagccgggagtcaacttttatacgcagctcaagacggtgacggcgcattgggcggcgcaggacgcgattggacagaaggcggatgtggctatgcctacg

SEQ ID NO: 27625 - DNA, 1619 bp, Neurospora crassa
cctaccaagctcaaggctcccttcctcgagcagtttaccgatggctgggatgcgcgctggaagccttcccacgccaagaaggagaccggccccgataccgaggaggagtgggcttacgtcggcgagtggtccgtcgaagagcccgtcgtcttcaatggcatggagggcgacaagggtctcgttgtcaagaacgcggctgctcaccacgccatctcggccaagttccccaaggcgatcgaccccaaggcaaggacctcgttgtccagtatgaggtcaagcttcagagtaagtcactattgcccgctacccgttcttcatagcaggcaattgctaacacacaccgtccagacggcctcgagtgcggtggtgcctacctgaagctccttcgcgagaacaaggctctccaccaggacgagttctccaacaccactccctacgtcatcatgttcggccccgacaagtgcggccacaccaacaaggtgcacttcatcttcaaccacaagaaccccaagacgggcgagtacgaggagaagcacctcagcgctcccccgacggccaagatcgtcaagaccacggagctctacacgctcattgtccaccccaacaacaccttcctcatccagcaggatggcgagactgtcaaggagggcagcctcctcgaggactttgttccctcggtcaaccccgagaaggagattgacgaccccaacgacaccaagcccgaggactgggttgaccaggcccgtatccccgaccccgatgccaagaagcccgacgactgggatgaggaggccccgtacgagattgtcgacgaggaggccaccatgcccgaggactggctcgttgatgagccccagactatccccgaccccgaggcccagaagcctgaggattgggatgatgaggaggatggtgactggattgcccctaccgttcccaaccccaagtgcttcgaggtctctggttgcggcccctggaccaagcccatgaagaagaaccccgactacaagggcatctggagcgctcctctcattgacaaccccgcctacaagggaccctgggcccctcgcaagatcgccaaccccgactactacgaggacaagactcccgccaactttgagcccatgggcgctatcggtttcgagatctggaccatgcagaacaacattctctttgacaacatctacattggtcactcggttgaggacgccaaggctctcgctgacgagactttcttcaagaagcaccccgtcgaggagaagctcgaggaggctgagaagcccaagcccgaggagaacaagccttcttcgcccagcgaccttaagttcaccgaggaccccgttacctacatcaaggagaaggttgacctctttgtgaccattgccaagaaggaccccgtcgaggctatcaagtttgtccctgaggttgctggtggcgctgccgccctcctcgtcaccttcattgccatcctcgcttcccttgtctctggcggcagctctcctgcccctgctgtcaagaaggctgccaaggatgtcaaggagaaggccaaggacgtcaaggacaaggctgccgaggctgttgccactggcactgagaaggccaaggaggctaccaagcgc

SEQ ID NO: 27626 - DNA, 882 bp, Neurospora crassa
tccgaccgcaaagagggcgccatctaccaggtcggcaagcccctgggaaagggcggcttcgctatctgctacgacggcaagctgatcggaagctccaagcgatatgccctcaagatcgtcaaggcccagatggcctccaagatggagcagaaattccagaccgagctccagattcactccaaaatgcgacatgtgaacattgtccagttccaccgcgcctttacctttgaaaactgcacctatctggttctcgaactgtgctccaatggctccctcatggacatggtcaagcgccgcaagggcttgacagaacccgaggtgcgcttctacaccgtccagattgccggcgccatcaagtacatgcacgccaagggcatcattcaccgcgatctcaaaatgggcaacatcttcctcgacaagtacatgaacgccaagattggagactttggcctggctgccttgctcctcacaggaaaggatatgcagattatgaggaggacgaccctatgcggaacacccaactatattgcgcccgagattctcgaaaagggaaagaagggccatgatcacatggtggatatctggagtctgggtatcattgtctacgctatgctcacctcgaaaccacctttccagtcttcaaccaccgacgaaatctaccgccgcgccagagaacgtgattacgagtggccatcgcccgatgccacacaaaagtactacagcttggaggccaaggatcttgtcgcaagcatgctgcaagacgcagatatgagaccggatcctgacaccatcgtctctcatcccttctttacctctggctacatgcccgttccttccgacatttcgtccaggctccgggattccccaccacagaaccctgcc

SEQ ID NO: 27627 - DNA, 2529 bp, Neurospora crassa
ctcaccaacccccgccacctctcaaaaatgtcacgcaaaagaaaagccgaatccggcgaagtcctcaaaatcggcaacaaaaccatctccctcgaaggctacctcaccaagaaaccaaaaactgccagcaccccttcaacctcgacatcagacaacaacaccccagcaccatcaaccgaaaatgatacaacgacgacagcaacagaccccaaggagttcaagccctctcgccccctcacaggagatccctccctgttcgccacccgccgcgccctcccgctctacctctaccaagaccggatccgctccatcctctcgaaaaaggacgtcctggtactagtgggtgagaccggttcgggtaaatctacccaggtcccgcagttcttgtaccaggagcggtggtgtcagcgacggagggtcaaggttaagaccaaggtgttggataaagatgggaatgaggttctggaggagggtggtaaagcaaagaccagggaggagacggttaatgtcggtggagtgattgcgattacccagccgagaagggtagctgctaccacgcttgcggggcgtgtggcgaaggagtgcgggacgccgttggatacgagtgggagggggacagggttcaagggacggggaccgaaagggaaggatggaaagggaccgaaaggtgggaaggagggagaggagtgggatgaggagaaggatgtggtggaggagatggggaagaataatggtggtgatgaggaggtgattgaggagaatgggaatgagaagaaggacaggaaagaccaggagaagggtctggttggttattcagtccgtttcgaccatcgagtaccaccggggacgaagatcaagtacgtgacggagggtatgttgctgcaggaactgctgagggacccgcatctacgacaatactcggccatcatcgtggacgaaatccacgagcgcagtgtggatgtcgatttactatctggtttcctcaagcagatcgtcacgggcgacaaggccggtcgtggaggaatcccgctcaaggtggtggtcatgagtgctacggcacaggtcgaaagaatcaagaaattcttttctagcgacgacagtcttaagaagggaacatccggggaggaagtggaatatctcgagatcgaaggccgacagttcccggtcgaagtcatccacgagcccaaacctgttccagacatccaggaggcactcctcaaaaccgtcttcaagatccacacccaagagccgctctccgacaaacacggcaagaaggacatcctgtgtttcttgacaggtcaagaagaaatcgaagccgcccagcgcctaatcgaagaattcgccgaaaccctcgaccccaaagtgcccaaagtcaaagtctttcccctcttcggccaactctccatggaagcccagcacgaagccttccagcccatcaaacaccccttcacgcgcaagatcgtgctagccaccaacattgccgaaacctccgtcaccgtccccggcgtgcgctacgtcgtcgactgcggcaaagccaaagtcaaacaataccgtccccgtctcggcatggaatcgctgctcgcaaaacccatctccaaatcctccgccatccaacgaaccggtcgtgccggccgtgaaggccccggcaagtgcttccgtctctacacagccgacaccttcgccaccctgccaaagacggacctccccgagattctgcggaccgacgtcctcggcgccgtcctgacaatgaaagcccgcggcatcgacgacgtgctctccttcccgttgatggaccgtccggaactcgaagccgtcgaaaacgctcttgtacatctacatgtgctcggcgcgctaggcgacgacggccgcatcaccgacaccggccgcaaaatggtcttgttccccgtgactgcgccctacgcgcgcgtcctgctcgcggccgctgacccgcgctatgactgtctgctggaagccatcgacatcatttcgtgcatcacggccggcgacgacatcttcatgcaagtccgctcggaagaagacaaggaagccgtggacgtgtacagaaaagaactccagcgccgcgagggcgatttgatcacgtacctgaacaccatgcaacgcttcgtttccacgccctcagccgaccgtgggacgttctgcaaacaacgccggatcaatgtgcggaatatgcggcaggcgctgaatatcaggaaacaactccggtcgctgtcggtcaagaataagatgctggcggagtttccagccccagatgcggaagtgacgtaccagcctgtgtcgccggagacggcagagaggatcctcaaggcgttcttgaaggggttcgcgatgaagacggcggtgctggcgcccgatgcgagttatgtgactgcccatgggaaacatgtggttgctattcacccgagtagtagtttgcatggggtcaagagggaggccatcatgtttttggagcatgtgtatacgcaaaagaattatgcaaagaaggtgagcgccattcaggcggggtggatt

SEQ ID NO: 27628 - DNA, 1957 bp, Neurospora crassa
ctcaagacggtcggcttcaacatatgcgagcaggacgcccaggtttcggtacaaagggctgatatcacctacaacaacgccgacaggaccgttgttttcaacgtggcgggaacgagcaaccaagtacagaacgtcacggctcatctttcagtgacggcctacgggatgaacatctacgacaacacgttcaacccttgcgatgagggtacttttgtgaagcagctatgccctggtatgtggaagttctggatcaagcgttattggtgtaggtgagatatgctgacgatcgatagtccccgctggttccttttccgccaaaggatcccaggtacttactccagaggtagccagcatgataccgccgatagccttccagatccccgatattgccgccatggccaagctcgagctgctatctaaggagtctggacaaaacgtcgcatgcatccagtctgaagtaacgaacggtaaaaccgccgccgtccccgccgtctcctatatcgccgccggcgtggccggcgccgccctcatcttgaccggtatctcggccgctggagctgccgttgccggaagtagcgccgccgcaggctcagcaggaggagctgcgagtagtgccggcgtgggcaccatcagccccagcttcaccgaagtctttggccatttccagggcatggctatgaacggcatgctgtctgtcagctaccctcccgtctaccgcaacttcgccaagaactttggcttttctacgggcatcatcccgtgggcggccatgcagacctccattgacgacttccgccagaagacgggcggaaacctcactcacaacagcttcaccttcctccgggagaacgccacgctcgtctttcccgacaacaccaccaccacgcttcacgagaacaaggcttcttccgcgcccgtcaagcgcgccttcaccgagttcatccgcctcgccgctcgcgagatcgagaccagtgtcaacctcacggattccagcgcagctaacactaccgactccggaaacggaaccacaaccgcctccgacaacaccgacagtttccgcgtcgccgtcaagggcatccaaagctacgtccagcaactctccatcccgtccgccaatatgttcatgacgatcctgctcatcgtcgccatcattatcgccgccattgtcgtcggcatcctgctggtgaaggtcgttctcgagatctgggccctcttcggctctttccccgccaagctctccggttttcgcagaaactactggatctccatcacacgcaccatcacctcgctcatcatgcttctgtacggcgtctgggtcttgtattgcgtcttccagttcacgcagggcgattcctgggcggccaagcttcttgctggccttaccctcgggctcttcaccggtattttggccttcttcagctacaagatctggagtaccgcgcgggagctcaagaagcgcgagggcgatgtggcagggctctacaatgacaagaacatctgggttcggtactcgcttttctacgagagttacaggaaggattactggtggattttcgtgccgactatcgtctacatgttcagcaagtcggtcgttctcgcgggggcggacgggtcaggcatggtgcagacgattgctcagctcactatcgaggggctgatgctttgtttgctgatctggagccggccgtacgagaggaagagtggaaacgtgatcaacatcatgattcaaacggtcagggtcctgtcggtggtctgcatcctggtgtttgtcgaggagtttggcattgcgcagacgacgcagacggttacgggcgtcgtgctcatcgcggtgcagagcacgctgacgggcattctggcaattctgattgtctggaatgcgatcaatgctctttgcaaggcgaacccgcatcggcagaagagaaaggagatgggtatgtttttcactttcctcccctta

SEQ ID NO: 27629 - DNA, 726 bp, Neurospora crassa
caggtcgtcgacgccatcaaggacctcgtgcaggactgcaacttcgactgcaacgactcgggcatcgccctgcaagccatggacaactcgcacgtcgcgctcgtgtccatgatgctcaagacggagaccttctcgcccttccggtgcgaccgcaacattgcgctcggcgtcaacctgacgtcgctgaccaaggtgctccgcgccgcccagaacgaggacatcctgacgctcaaggccgaggacgcgcccgacgtgctcaacctcgtcttcgaatcttccgaaaacgaccgtatctccgagtacgacctcaagctcatggacattgaccaggagcacctgggcattccggataccgagtacgcggccaccatcagcatgccgtcttctgagtttaagcgcatcaccaccgacctcatggccatgagcgagagcgtcaacattgaggcgagcaaggacggcgtcaagtttagctgccagggcgacattggcaacggcagcattaccctccgccagcacaccaacgttgataagcccagcgagaatatcgagattgagttgagcgagccggtttccctcacgttctcgctcaagtacctggtcaacttttgcaaggcgagcgcgctgtcgagcacggtcaagatctgcctctccaacgaggtgccccttttggtcgagtacaacatttcggctagcagctacttgaggttctatcttgcgcccaaggta

SEQ ID NO: 27630 - DNA, 1191 bp, Neurospora crassa
ccagacaaaatgactgcctccagcgaccaccccattaccactcccccccgcgctccctcgcccgtccatgggttcggtacgctcgccgtccatgcgggatccccgcacgaccccgccactggcgccgtgatcgaggccatctcgctctccaccacctttgcccagacggccgtcggcaagcccgtcggcgagttcgagtactcgcgcagcagcaaccccaaccgtgccaactttgagaagatggttgctgctctcgagcacgccaagtacgccctcgcctactcgtccggcagtgccaccacggccaacatcctccagtcgctcgccgctggctcccacgtcatctcggtctcggacgtctacggcggcacccaccgttactttacccaggttgccaaggcccacggcgtcaaggtcaccttcactcccgagatcgaggtggacatccgcgaccacatcaccgatgccaccaagctcgtgtggatcgagacccccagcaacccgaccctgcgccttgtggatatccgcgccgtcgctaccgccgcccatgagcgtggcatcctggtcgtggtcgacaacaccttcctgagcccctacgtccagaacccgctcgaccatggtgccgatatcgtcgttcacagtgtgaccaagtacatcaacggccactcggacgtggtcatgggtgttgccgccttcaacagcgacgagctctatgcccgcctctccttcctccagaacgccatcggcgccgtcccctccgcctttgactcgtggctcgcccaccgtggagccaagaccctccatctccgtgctcgtgaggccaccaccaacgcgaccgccattgcccatgccctcgaggcttcccctcttgtcatctcggtcaactaccccggccttgagtcgcacccccaccgcgccattgctctcaagcagcaccgcaacggtatgggtggtggcatgttgagcttccgcatccacggcggccacgctgctgctgagaagttctgccagtacaccaagatcttcactcttgccgagtctcttggtggtgttgagtccctctgcgagattcctagctccatgacccacgctggtattcccaaggcccaacgcgaggccgtcggtattttcgatgaccttgtccgcatctcttgcggtgttgaggatgccgaggacctcaaggccgatgtc

SEQ ID NO: 27631 - DNA, 1390 bp, Neurospora crassa
ggtcgcaagatcttcaaggtcttcaatcaggactttattgtcgacgagcgctacaccgtcaccaaggagctcggtcagggagcttatggcattgtctggtacgtccacctgctcctgctcccgttcctgcttagccgcttgtgcttttgggccgcggcgcatctacatgtgtcatgccatattctcatgattcaagctgacctccctttcctcctaaacagcgccgccgtaaacacccagacgaacgagggagtcgccatcaaaaaggtcaccaatgtcttcagcaaaaagatcctagccaagcgcgccttgcgcgagatcaagctcctccaacacttcaggggccaccgtaacgtaggttgctcacatacacatattacaatcgatgcatggtagctgaccgtggcgatttctggttctttagattacctgcctctacgatatggacattccccggccagagatgttcaacgagacctatctctacgagggtacgtcatggctcatgcctcacgagaagatgggcctacatactaacctgggggttcttttgcagagttgatggagtgcgatcttgctgctatcattaggtccggtcagccacttacagacgcccacttccagtccttcatctaccagattctttgcggtctcaagtacatccactcggcaaacgttctgcaccgtgatctcaagcccggtaacctgctggttaatgccgactgcgagctcaagatctgcgactttggtcttgcgcgtggtttctccgtcgaccccgaggagaacgcaggttacatgacggagtacgttgccacgagatggtatcgtgctcctgaaatcatgttgtccttccagaactataccaaagccagtatgtcttttcctcaagctgcccccttgatatcgttttcaggctaacactcattccttagttgatgtatggtccgttggctgtatccttgccgagcttctcggtggccgcccattcttcaagggcagagattacgtcgatcagctgaaccagatcctgcacatcctcggcacaccgaatgaggagaccctctcccgtatcggctctcctagagctcaggaatacgtccgcaacctgcctcccatgcccaagaagtccttccagcagctcttcccccaggccaaccccgacgccctcgatctcctcgaccgcatgctcgccttcgaccctaccagccgtatcagcgttgaggatgctctcaagcacccctaccttgccatctggcacgatgccagcgacgagcccgactgccctacccccttcaacttcgactttgaggttgtcgatgatgtcggcgagatgcgcaagatgattctcgatgaagtcttcaggttcagacagcttgtgcgcaccgtgccc

SEQ ID NO: 27632 - DNA, 1137 bp, Neurospora crassa
tatgacgacaacaacccaaaccaccactactggtggacagcctgcgctccctcccttacctccatcctccgccactcccactcctacaccccttcccaacaatccctccacatctcttggttccgcaacaacgtcatccccaacctcggtccgcgtccctcttcttcctaccgcctccgttcccctctcaactacgaaggctctccctaccgagcaacctggaacttttgctctgcccccgccgggtctccgtcgtcatcctcggtggcagggacactgaggttcagtttcgacccaatacctgccactggaagcatcaaaaaagacccgacgaatcaagaggagtataagcggttattccccttacttgccagggagtgtcatggaaagggggagacaaaggttgatctcacgtggtatgacgaggttaaagagcacatgtacctgactccgtcggaacaggtggtattccagtcgaagattgtctctagaggtagtcaactaccgccagagcacgcagccatcgccatcggatgcgtaggcgagaagagggtgttgaaaccctacttttttgcagggccgaaaagtatggtgacggggttgtcccctcatcaagttctcttttccgcgctgagagccatccggacaaaggccgaggaattgaaacccgctattgatctagttgaagactacgtcgcttccagaaaggcggtgatgatgcccaactgcatcggcatcgacgccgtctctcccgaccaaggcgcgcgagtgaaactttacaccctcatacccagcaacgccttttgcgtgatgcgcgacgcgatcacactcggtggccgcttgacctcccccgaagcgatgcgtggcgtgggaattctgaggggcatctaccacctcttgcgcggggacagatcaccgataaatgacgcaacggaaaacatgagcaagccctgtcggtatgagagtaagagtaatagctactggaaggggttcaccagctatgagatgcgtccggggagggaggagccggaggtgaaggtgtatgtgccgctgatgcagatttttgagacggagcaagcggtaattgagggcttggaagaggtgtggagggggtttggatggggagagttggggaag

SEQ ID NO: 27633 - DNA, 483 bp, Neurospora crassa
gaataccgcaccaagttcctcacgcgcgctttcggcggcaatgcccaggtagcctgctacttcctggccgtcaccatcttcggcctcggtcttgtccgcgacttcctctacgaacgcgctctccgtgaccagccctcccacccgctcctcgagggcacctatgtcaaatacgccgcctatgccctccttgccctcggcaaccttctcgtcatcacctctacaatgcgtctgggtatcacgggaaccttccttggtgactactttggcattctgatggatggcattgtcaccggcttccccttcaacgttaccagcgctcccatgtactacggctccaccatgagcttcctcggcaccgctcttctctacggcaagcccgctggtctccttttgactgcctgggttctctttgtgtacataatcgctatccaattcgagaaccccttcactgccgaaatctatgccaagcgcgaccgcgagagg

SEQ ID NO: 27634 - DNA, 4512 bp, Neurospora crassa
ccgtgatcgcggagccagaagcacgggatacgcaagaaattcagtcacccccgcggaagcgtagaactcttgtgcggcgcctcagcagatcgccagcaaagatcatgcagcaacaactcgagctgcaacagcaacaagccagccgtcaagggacaccaacgccaggctctccgtcaactcaacgcgtcgatcgccaacctgctcctctacaggacatcacccagaccctcatcaacctaccacctccagcgaccgcggcatcagagacccttgtcaacacacagccaacatcaacagcagatgaaaccgtcgtggcggcccagaagcccgtcagggctatggatactattctggaaaagcccatggatattgtgctcaagtcacggaccatggctcttcccgtcgtcgaggataccggcccgaagccacgcattgtcatcaccaatcttgtgctcatcaacttcaagagttacgccggtagacaggaggtcggccccttccatgcttcgttctcttcggtcgtgggtcccaacggttctggcaaatccaacgtcatcgactcgttgctgttcgtctttggtttccgtgccagcaagatgcgacaaggcaagatctcggccttgattcacaattcggcgcagtttccgaatctcgactactgtgaggtggaagtgcatttccaggaagtcatggacttggtaagtcaaacattgttttgaaggggagtcattgtgctgacattgatagcccggcggtggccacgaggttatccccgactcaacactcgtcatctcgcgcaaagcattcaagaacaactcgagccagtactacatcaacggcaaatcatccaattttaccaccgtgaccacgctactccgcgaccgtggtgtcgatctggatcacaagcgttttctcattctccagggcgaagtcgaatcgattgcccagatgaagcccaaagccggcaacgagcacgaagatggtctgttggagtacctagaagacattattggcacttccaaatacaagacaccaattgaagagtcggccaccgaagtcgaaaccctcaacgagatctgcatggagaagagtggtcgtgtccagcacgtggaaaaggaaaggaacagtctcgaggacaagaagaacaaggcgctggcgtatgttcgcgatgaaaacgaactggcgctgaaacagtcggctctctaccagctatacatcagcgaatgcgacgacaatattgctgtcacagaggaggctatcggtcagatgcaggcacaacttgacgctgagcttgagaagcaccacggcagcgaacagctcatcaagcagttggaaaaggcctactccaagggtagcaaggaatacgactcttgggagaagcagacacagcagctggtcaaggagatgaacaagttcgagcaggaacgcgtcaaattcgaggagaagcggaagttcttgacggacaagcgtaagaagcttgagaagacgatcgctaacgccgagaagacggctgttgaagcggaggagaccattcagaactgcaccaaggagattgagcgtcgtcaaaaggacattgttttcctggagaagaaggtcaaggaagaggaggccgagcttgcgacgatacgtgagagcctcaagggcaagacgcaaaagtactcggatcagatcgcggcaaagcaaaagtctctcgagccttggaaggacaagatcaatcagaaacagtccgccattgccgttgcggagagtgagctggccattctcagggaaaaggccaatgccggaactgtggcccttgaggagatggagacgaaaattgtggccatccaggaaaggcaagcggcgaaggcggaggagatggagcagtgcaaagctgagagagcgaacctgatcaaggagggcaagaagatcgaggctgaactttccaagcttgcggaggaggaacccaagtaccggcaacagctttcgaatgcccgccaaaaggctgacgaggcgcggtcgagcttgtccgccacacaaaaccgaggcaatgtcttgactgcccttatgcgcatgaaggagtcgggtcgtatcgatgggtttcatggacgacttggaaatctcggtgctattgaccagaagtacgatattgccatctctacagcctgtggtgctctggacaactttgtcaccgacactgttgaggccggtcagcaatgtattgaatatctccgaaaaaccaacctcggacgtggtaattttatgtgcttggacaagttgcgagtccgcgacatgtctcctattcagactcccgaaaacgcccctcgtctctttgaccttgtcaagcccaaagacgacaagttccgacctgccttctaccatgctcttcaggacacattggtcgccaaggatctcgctcaggcaaaccgcattgcctatggcgctaagagatggcgagtagtgacccttgccggcgagctcatcgataagtcaggtaccatgaccggtggtggcactacagtcaagcggggtctgatgtcctccaagcttgtggctgacaccaccaaggagcaagttgacaagcttgaggcggaccgtgataccttggagcaggccttcaacgagttccaagaccgccaacgagaactcgagtcccgtctgcgccagatccagtccatgattccccagcttgagaccaagatgcagaagatcaacctcgaagttgagagctcggagcgcaaccttgccgatgcccagcgccgtatcaaggagctcagcaaggagcaacagccttccaagacggatgacaaccgcgtcgccgcccttgaaaaggaaattgccaagcttgagggcgaggtcgagaagctgcgcgaggagatgtcctccgtcgaggatgaaattaaggctcttcaagataagatcatgaaggtaggtggtgaaaagcttcgctctcaaaaagccgctgtggactcgttaaaggcagagatcgccacgcaaaacgaggaaacttctgccgccgaggtgaagatggcgaaagcggagaaacagaagcacaagctagagaaggactttaacaaggcgtctaaagagctgcagaatgccattcaggagaccgaggctctggaagaggagattcagaaccagggcgatactgccgagagcctcacgacccgtgttgaagaggcccaggaggcactcaaggagaagaagaaagaactggcagctatgaagaaggagctggatgagaagacggccgagctcaacgagacaagggcggtggaaattgagatgcgcaataagctcgaggaaaaccaaaagatcctgtctgagaaccagaagcgtctgcgctactgggaagacaagctctccaagctcgccctccaagacattgaagatctcgagcgcggcaccagcggcgacgcagcagcacctcaacaacttgccgaccctgatgccatggacgtcgacgaccctgattccattctccaagcccaactcgaggccgaagccgccgaggccgaagagaacgaggaggacgaggaggaagaggaggaggaggaagacgaagatccagaagccatgtccctcgacgaagacgacgaggaacctcgccagcgcaagcagaaaacccccaagaagcaaaagcaaaagcgccgtcaacaaaccggcaaaaccccgcgcaaaccccgcaaccccctcgaactcccccgctacacccgcgacgagctagccgacatgtccaaagagaaactcaagggcgagatcgccgcgctcgaagagaagatctccaacgtgaacatcgacctgtctgtactctccgaataccgtcgtcgcgtggaagaacatctcgcgcgttcttcggacttggcctcagccgtctcccagcgcgacgccgccaagaagcgtctcgacgagctccgtcgtctgcgattggagggcttcatggaagggttctcgaccatctctcttagactaaaagagatgtaccagatgatcaccatgggcggcaacgcagagctggagctggtggacagtctggaccccttctcggagggaatcttgttcagcgtgatgccgcccaagaagagctggaagaatatttctaatctaagtggtggcgagaagacgttgagttctctggcgctggtgtttgcattgcatcattacaagccgacgccgctttatgtgatggatgaaattgatgcggcgctggatttcaggaatgttagtatttccccttttccccttttccttcctttgccttttctttttttttttttttttctttcctcgctacgctcgatccccgcccctcccccctccctttttttttcattccccactgacaaagcgaaaaaggtctccatcgtagcctcctacatcaaagaacgcaccaaaaacgcccaattcatcgtcatctccctgcgcaacaacatgtttgagctcgccgcccgtctggtcggcgtctacaaggtcaaccacatgaccaagtcggtcacaattgagaatcatgattatatccagcgaggcaaa

SEQ ID NO: 27635 - DNA, 1016 bp, Neurospora crassa
ctgcagctcgcaacctctgcccacgtcaagtacatccagagtctcgactcccgaaaggacgaatatgactactggttgacggagcatctgcgtctcaatggcctctactggggcttgaccgctctgcacctcctcggccaccccgaggctctcccgcgcgctgagaccatcgactttgtgctatcatgccagcacgagaacggcggcttcggagcggcacccggccatgatgcccacatgctgtccaccgtcagtgccgtgcagatcctcgccatggtcgacgcctttgatgacctcgagacgcgtggccggggcaaggcacaggtcggaaagtgtgcgttgcttgtcatcaaacctaggtaaacccccattgacactttgtactgacactgtcgggtccagatattgccagcctccagaaccgccagaccggcacgtttgcgggtgatgagtggggtgaggaagacactcgcttcctttacggcgccttcaatgccctttctcttcttggcctccttcaccttgtcgatgttgacaaggccgttgaccacattgctgcgtgcgccaactttgacggcggctacggtgtcagccctggtgccgagtcccactctggtcagatcttcacgtgcgtcgctgccctcaccattgctggccgcaaggagctcattgacgttgatcgcctgggccgctggttgagtgagaggcagatcgctggcggcggcttgaacggtcgtccggaaaagaaggaggacgtgtgctatagctggtgggtgctgagcagtctggaaatgattggcaagacgcactggatcgacaaggcgaagctcaccagcttcatcctgagctcgcaagacacggacaagggtggcatctcggacaggcctggcgacatggtggatgtctggcacacctgctttggtattgcgggtctgagtttgctggactatccgggcttggagccggttgacgaggtgtattgcatgcccaagtcgaccatcaagcgtgtcctgggt

SEQ ID NO: 27636 - DNA, 3603 bp, Neurospora crassa
atgggtgtgaatggcctctggaccgtcctccaaccctgtgcccgcccaaccaacctctccaccctcaaccgcaaacgcctcgccatcgacgcctccatctggatctaccaattcctcaaagccgtccgcgacaaagaaggcaacgcccttcgcaacagtcacgtcgtcggttttttccgtcgaatatgtaaactactctggtacggcatcaagcccgtcttcgtctttgacggcggcgcccccgctctcaagcgcgccaccatccaggctcgccggcgaagacgagagggcagacgcgatgacgccacgcgaacggcagggaaattactagcggtgcagatgcatcgtatggcagaggaggaagacgaacggaggcgcaaaagggcagaggcacgagaaggcaataaaacggcggcagcagcagcagcagcagaagaagaagaacaggaagtactgcccgacatggacaaagtcgtttacgccgacgaattaggcatgtcaaaacaagaacgccaaaagtctcgacgcttccacaagcaagacgcctaccatcttcctgacctcgacggcggcatcgaagccatgggcaagccggatgatccgcgcatcatgtctgtcgaagaactcgaagagtacgctaggcagtttgagaacggggaggatatcaacttgtacgatttcagcaagatcgactttgatggcgagttcttcaagtctttgccgccggctgatcggtacaacatcttgaatgcggcgaggttgcggagcagattgagaatggggttgagtaaagagcagttggacgtcatgttccctaaccggatggatttcagccggtttcagattgagagagtcaaggagaggaatcacttgacgcagagactgatgtacgagatgggcatgacgggattggatctgacgctggcagtcaacgcgacgagagtggcgggcgatcagaatagggagtatatcctggtcaagaatgaaggtgccgaaggcggatatgcgctgggagtcgtgagtacagagaaggataaaggacagatgaccaatccaattgatgtggacgaactcgagtttcagtttcagggcaagggagaggaagaggaggattcggaagaggatgtcgagttcgaggacgtgccaattgaggggttgaatcggttgcccaagctgactagggctgctggttacaggccgagggggactgcgaattcgaggaggcagttctacgagccgagacagagtgaagaggcggaggacgaggacgaagatgacgaggccttgtttgttgacaacggacaagatgccgtctatggagaggagaatgcggtcgaagctgatgaggaagaagacctcaacaaggctattgccatgtctcttcagaatcagcatggtgttggtctatcagaagagaaggaggatgaggatatggagttcgaagaggttactccgccagagtggacgcagaaagcggtggaagcgcccaagcccattgttagtaccagtggtcgcatggtcgcacacattgtcaacaacagggcgagtgctgccgtcccaaggcgaagggagagtaccgacagcagtgacagcgagggggatattcgagcagccatggccgctgccaggaggaagcaagcaaaggctccagcgccaaagccagtggtcgaaaaccgccctgctcctaccaacactccctttaaaggtccccttccatttgagaagctgaactggaagcaactgcttgggggcaaccgaccgaaagcaaaatctcagaaggaaaaggtgtctgaaccgcccaagccagttgaaactggtgagatggaacctcagtctgatgacgatgctggcggttttgagaaagagccgaaggatgctcctcgtccactaccgccatggctagcgaataacgacgaagacattcgcgacactgtacggaagcagcgagaacaggacaggcagatggctgaggaggatgaaaacttggctcgagaagagcaggccagaattcgaaagcaacgagaggatgaggtcatgatgattgagtcatccgatgaaagtgatggtgatttggagatcctcgatgctcctccatcgcccaagaagctcactcagatgccggggcctagcttgccttctttggacgacgaagtgtcgcaagagccagttgaaaccagccgtcaatcaccctcccctaatgaggaagaaggcgacgacattgtgtttgaagacgtaacccttccgtctcaaaccatgaccctctccttcggaccacccgcaactcaagccgaagaagacgcccagatcgaagcagacctcttcaaagacgtccttcctccacctgcccaacaggaacgagttgaaggtttggcggcggttccagacgataccaccactgacatcgttcccgaccccgacgcccccgccctctccgaattcgaagacgacttcagcgaccccgaagaacaagaactcctcgcttccctcgcccaagaagccgaagaacacgcccgcttcgccactcaactcaaccacaaaacctttcaagaaaaccaagccgcctacgaacaagaactcaaagctttacggacccaacaacgcaaagaccgccgcgacgccgacgaagtcacccaaatcatgattaccgaatgccaagccctcctccgcttcttcggcatcccctacatcaccgcccccatggaagccgaagcgcaatgcgccgagctcgtccgcctcggtctcgtagacggcatcgtcaccgacgactcggacacttttcttttcggcggcacccgcgtctacaaaaacatgttcaacggaaacaaattcgtcgaatgctacttatcttccgacatcgagcgcgacctttctttgtctcgcgaccaactcatcgccctcgcccaactcctagggtcagactacactgaaggtttatcgggcgtcggccccgtaacagccgtggaaatcttgtcggaattccctcctgaacctacacccatctcctccctcacaaccttcaaagaatggtggaccaaaatccaatcgtcccctcaaccagacccgtctttactctccaccccgttcaggcgcaagttccgcaaagcccaagctaccaaattatttcttccagtcgggttccccaacccggctgtcttcgatgcgtacttacatcccgaagtcgattcgaccccggagccattccaatggggcgtcccggacctcgaaggcctcagacagtttctgatgcagacgattggatggagtcaggaaaggacggatgaggtgttggttccggtgataagggatatgaataagcgggagagggaggggacgcagagtaatattacgaggtttttcgagggcggggtggggtcggggaccgtgaggaatttgggtggtggggggaatgaggaggcatttgcgccgaggagaaatgaagtcaagggaagtaagaggatggcggaggcggtggggaggttgaaagctaggaatagtaagggaaattctggaggagggggactgagtctggcgttgccggttatggcgatggggccgttgaatggggaggaggagggtggtaataagaagaggaagagggggaag

SEQ ID NO: 27637 - DNA, 1620 bp, Neurospora crassa
atgggcaactcatcctccaaagatgcgggggcatcttccaagaaccgaggcgatgacgacctcaagtcctacccatcctttagcaaatccgacaccaaggactcctcgcgctcttttcgcggactccgctccaaaatccccggtggaagcaagacggacagcccccggaactcaaccatcctctccagcgaggaagtcgctgagaaaatgaacgctctgagtggaaagaatggcaggccatcggtgcatacgcggccaagccgcagagacatgtcgccatcacccgcctctccctcgacgtcttctccctcgtcaccttcgctcgataccgcaacgctagcgtctccgaccggtgaacccctacctcctccgtcgccagttcacaatgctacaggcggccaccacgatgtccgcgccgctcaggaaagtggagaagtcgaccacatttccgaccaaccgccctctggaggtggcggagccaactccaaccaacagcctggccagtctatcctcgtgaagcgcgagaacaccattaaccccgtctacgatacccccaaccaggatccccagaatgagcaagcagtttcgggtgttgccatgagcgacatcaaggatatcgatctcgatgatttcatcaagcgactgttggatgccgcctatgctggaaaggtcaccaagagtgtctgcctcaagaatgccgagattgtggccatttgccaccgcgcccgggagttgttcctttctcagccggcccttctggaactggatgcgcccgtcaaaattgtcggcgatgttcacggccagtacactgacctcattcgcatgtttgaaatgtgcggcttccctccaaactccaactatttgttcctcggcgattacgtcgaccgcggaaagcagtcgctcgagactatcctgcttctgatgtgctacaagctcaagtaccccgagaacttcttcttgctccgcggcaaccacgaatgcgccaacgttacccgggtttacggtttctacgatgagtgcaagcgcaggtgcaatgtcaagatctggaagacttttgtcgacaccttcaactgcctccctattgctgctatcgttgctggtaagatcttctgcgttcacggcggtctgtcgcccgctcttggccacatggacgatatccgcaacattgcgcgccccaccgacgttcccgactacggactgctcaacgatctcctctggtctgatccagccgacatggatcaggactgggaggcgaacgaacgaggtgtcagttactgtttcggaaagaaggttatctcggacttcctcgccactcatgactttgatctggtttgccgtgcgcacatggttgtcgaggacggttatgagttttacactgatcgcattcttgttactattttcagtgctcctaacgtaagttgtgtcactttcggatccatatgcaaaatttcactgacctggtaacagtactgcggcgagtttgataactggggagctgtcatggctgtttctaccgagcttctctgcagcttcgaactactcaagccacttgactccgctgctcttaagacgcacatcaagaagggtagacaccgtcgtaacaacatgctcaacagtcct

SEQ ID NO: 27638 - DNA, 2450 bp, Neurospora crassa
gacacaacgcacacgccgaccaacgtcacactggagtttggcggctggaacgagacggctccccatcacggcgtcgacctgcgcagtctgtccaggtcgatacggcgcgctctggcagctggctatacctcggacgacaagcagtcgttggtgttgtttgtgcaaaccgtcactggcactgccggcctctacctcggcagaaacgtcaacatccagtccacggcgccagacgcactcattgctttcgagaatgccttgtacgcttccaacaacacgggcggcagcaaggccatacagctgtgcgggcacgactacgacggcgaccacgtcgttggcttcatcgccacgagcaacacatccttcacccccgtacagcaggcgattcggtcatggaagaacgctacttgcctgtctttcgacacagtgcggaacatacccgcgaccgtcgatttcacgacaccgttggtgttaccgtcgaacggaaccaccaactcaacctacagcgccagcacagccttgcgggcgattcgcggcaaccacctacaggcccgcgccgaatgtagaaccatccaggtggcctcgggtgacagctgtgccaagttggcgaccaagtgcggcatctcgcccagcgatttcacaaagtacaacccggattcgaagctttgctcctcgctgatgcccctgcaacacgtgtgctgctcgtccgggacgctgcccgacttcacgcccaagaaaaacagcgacggatcgtgcgcatcatacgccgttgtacaagacgatacgtgttcggccatcgcggccgcccatagcctgacagtcgaccaaatcgagagcttcaacaagcagacgtggggatggagcggctgcagtcgactgatggcccaggcagtcatctgcctcagctacggcacgccgcccatgccggccccgctggccaatgccgtgtgcggaccgcagaagcccgggaccaagaagcccgacaacatggacgacatacagaagcttaacccatgcccactcaacgcctgttgcgatgtatggggccagtgcggcatcacggccgagttttgcactgatacaaatacgggcgcccccggcacggccaagccaaacaccaacggctgcatctccaattgcggcacgaacgtggtcaagggtaaaccgcccgctcagtggatcagtctgggctactatgaagcctacagcttgggcggccgcagttgtctatatcaggacgtgcggcagatcgataccaacaagtactcccacatacactttgcctttggtgacattaccccggacttcaaagtatcagcgggcgatgttatcagtacgtacgagttcgaagccttccgaagcatgaccaacgtccaccgcgtgatatccttcggtggctgggccttctcaacagacgccgctacttacaacatcttccggactggagtgacggccgctaatcgcttgaccctcgcaaccaatatcgccaactttgtcaaagagaaaggcctggacggcgtggatattgactgggaataccctggcgtatgcacactccctcttcttcttcttcttcttcttcctcctcctcccttgcggacccgagccacggagcgctgctaactgtttccaggaaccggacatcccgggtcctccaccgggcgccgacgacgaaggcaccaactacctcgccttcctggttgtgctgaagaacctgttgcccggcaagactgtgtctattgccgcaccggcatcgtactggtacctcaaacagtttcccatcgctcaaatctccaaggtggtcgactacatcgtacttatgtgttatgatctccacgggcaatgggattacggtaataagtggtcgcaagaaggctgtgcgaacggcaattgcctgcgtagccacgtcaacttgaccgagacaaagacggctctagctatggtgagttgagtgcccaacatatcccaagaccctttgcccctcggtgtgtacctacgtactttgatcccccttctgactcctcctcctgctccagatcaccaaggccggtgtggactcgggcaaagtcgtcgtcggtgtctccagctatggccgctccttcaacatggctgacgccggctgctacagcaaggattgcttctttaccggctcggcgacggcatccgacgcctccaagggtccctgcaccgatacagcgggctacatctcgaacgctgagatcaacgacatcatcgtgaacaatgccagccgcgtcaaccagaacttcatcgacagcagtagcaacagccgcatcgtcgtctacgataataaccagtgggtcgcctttatggatgacagcatccgtgccgcccgtaccgcaatctacaaggggctgggcatgggtggtaccagtaactgggccaccgacctggagaagtaccacgatgcgccctccatcagcaaggactggagc

SEQ ID NO: 27639 - DNA, 2355 bp, Neurospora crassa
atggcgccatcgtatagtagcaatgggggctacggctacagcagctcatccttccaacccaaacaccgccgctccgactcgacctcgtttctcgacgacctgcgcgccttcctcgcccactcgtcccgctccgcctggcgcttctggagggaacgcggtcgcttcatcgcctgggccgccctcgtcaatgccggccgaagactgcgcatgaatctgacgtataaccgcctgttcagcttcccgcatttgctggtggccgcgtggatcgtggtcttgctttggggcgagagatgggtgtttcattcagcggtggaggagtgtgagtgggggaactgggagagatgggtaagaaagaccagccctatttcctgttgtgtatgggaaaaggaggagaatgaaaaagaaaagatgctgataatggtgtgactacagccccccggcgcgaacccccaccgcctcgttctggtggccgatccccagctcatcgacccccattcataccccggccgaccgtggccgctgaacccgttgaccatgacgattgtcgacaactatatccgccgatcttacacacagatgcaatcgcagctcgatcccgatacaatcttcttcctgggcgatcttttcgacggcggacgcgagtggaagacagcacatggagactttagagacccggaatggggtccgcatccgaaagacgagcagaaatacctaaagagctggaataaaaagtataatgagttttactggttgaaggagtacgcgaggtttggcgagatcttctttactccgtggcttgaggccgggcagaagccggagaacgaacataagaggaggaaactgattgccagccttccggggaaccacgacttggggtttggtgccgagatcaaactccccgtgaggaacaggtttgaggcgtactttggcgagggaaaccgcgtggatgtggttggaaaccatacgtttgtttcggtggacacggtctcgatgagcgctgctagcttgtcggagattgccaggcaggatgtacagcctatctacaaaccgaccgaacactttctcaaccaagtgaagtggacgaagcagaaggcggtggagaaggagctgcggtatctgaggggagaggttcccgaggttaagctccaccacaggattgaggagctcaaccaggccaacttcaaggaccaaccgcatcttgtccacgacgagaacagtcagaaagttcccgacctcccgaccatcctactcacccacgtcccactctatcgaccacccggcaccccatgcggcccgaagcgcgaacattggccccctacaccaccgcccaagggtcagaccgagcccgtatttcccgaccaccgcaacgccatctccgtgtatcgaggctaccaataccagaacgtcctcgacgagaagcaatccataagcctgatcgagaaaatcggcaacgtcatccacgccttctccggcgacgaccacgactactgcgaagtagtgcacgcgcccgaccaaggttctgtccgcgaaatcagtgtcaaatccatcagcatggccatgggcgtgcccacccctggcttccaaatggtcagcttatacaaccctctcgaccccgtcaccggcaagcccttggcaggtgacggccaacccaccatgcaaacccacctctgcctactccccaaccaaatcagcacctacctgcactacgtcggcctcggcattttctgcatcatcctcctcgccatccgcgctttcttggtccccgtcctcaatttaccccgattcgccctcgattcagacagcgacagcagccaccaccacccgagcggcatctccatcctgcccgtcttcaaagccaaacaagaagattacgacgaatacagccttccctctgccggatactcggcctcatccaagtacggctcctcaggcacttcaggcgaacgacgaagtcgtaccgcgtccgtcagttcgtcttcactaaagtcaaataatttgagaaatggtcatcacaacgaaaagagtggaggtagtagtgggagaagcaggaaatcgagcgtttacagtaatagcaataaatcagttaaaggaggatggtcgtggggtgggaagcatggacatcatcatcattatcatcagccgaggattgagatcccaggggagaatgaggaggatctttattatggtggggcgtttacgacttcgagttcgagttcaaaatggagggcgaggcagagtaggaagaagcaaaagcccaagaccgccatgggcgtggtggtgacggagttgtggacgacggtttggagggtggcgtggatggtggtggtggtttttgggtggttggcttggaagggg

SEQ ID NO: 27640 - DNA, 927 bp, Neurospora crassa
aagttcaacaaggagaaatgggtagcttctctgacgcccgagcaacgcgaccttttacagctggagatcgacacccttgatgagagctggttggcgcatctgaaggaggagattgtaaccaaggagtttttcgacttgaaaaggttcttgaagaaagagtgggagaccaagacgatattcccgcccaaggaggatatatatagctggtttgtcttttttttcccctctcttttttccccttcttcccttcttcccttccccccctcctcccctctcttttaccatcccgtccattcaattttcatcactaacacccacccaaaacaacacaggtcccgccacacccccctccccaccgtccgcgtcctcatcctcggccaagacccctaccacaaccacaaccaagcgcacggcctctccttctccgtgcgacctccgactcccgccccgccctccctgcgcaacatcttcatcggcctcgcacgggactacccctcctttacccccccgccctccaagagcgggctactaaccccctgggcaacccgcggcgtcttgttgctcaacacatgcctcacagttcgcgcgcacgaagccaattcccacgcgaaccgcggctgggaacgctttacccagaaagttatcgacttggtaaatgagcgacagaaaaagggggtggtgttcatggcgtggggagcgccggcggggaagcggatggccaaggtggatgggaaaagacatttggtgttgaggagtgtccatccgagtccgttgagtgcgcatagagggttttttgatgcggggcatttcaaaaaggggaatgagtggttggagggaaggtatgggaaggaaggaagggtggattggagtttggtggaggggaagtcgatatttgctgatgaagatggggagaaggggaaaacagag

SEQ ID NO: 27641 - DNA, 1227 bp, Neurospora crassa
aacgaacccgtcgagatcacggccgcccaaaagatgctctccgccacatccggcagtctactcaccggcctgctcgtgactcccctcgacgtcgtgcgagtccgatggcaatcccaatcctttacccggccgtcaccaaccgcacataccgttaccgactttgcgaaactagccggctcacaaatatccaaccccgcgtttcgccccgcgaacctcggcgtgaccgcctgctgccgcgaagtcttctttgccaacaattcggaaggatgcatcgtcgccaccgggccgcgcatcggctctggtgctatcactgctagtgctatcccctgcgcagtcgaagagacaaagcaacgaaacttcaactccaccctcgacggtctccgcaagatcgcccgcaacgaaggctttacctcgctctggcgggggctttctccaaccctgctaatggccattccagccaacatcatctacttcaccggctacgagtggctgcgctttaacccttccagtcccatccagcaaaccgtcaaggaggagtatgcagctctggtagccggtgcgggcgctcgcatccttgccgctacagccgtcgggcctatcgagctattccgcactcgtatgcaggcttcccccggcagcacgacggggtcacacctcactcatacctttagggggatcaaggacatggtttacgcgcacggctaccgctcgctctggaggggtttgacactcaccctctggcgtgacgtacccttttccggcatgtattggtggggatacgagacaattcgaggaaagttgacggatgcgcgcgaggctcgctctaggggacgtggcaggacacttgacctcgattctgaagagcgccacagagttcgtcggaggtctcaatcaagggaaaaccacgccgagacctttaccgacagcttcattgccggcgcgttatccggagccttcgccagcgtggccaccatgcctttcgatgtcggcaagacaaggacacaggtctaccgcgacaccggcgctgcaacaaaggctgctattgcggtgacgatggagaaaagcgccgtgagaccggaagagaggaacatggcaagactgctgtggcatattttctccacggaaggcgtcgccggtctcttcaggggatggataccgcgcactctcaaggtcgcgccggcgtgtgccataatgattagcagttatgaggtcggaaagagggccttc

SEQ ID NO: 27642 - DNA, 946 bp, Neurospora crassa
gacctcctccgccgcctcaaccccaaacacacggccgagcacctcaacaacctcatcaccctcgcccccgacctgaccgaagacctgctctcctccgtcgaccagcccctgaccgtcaagcgctgcaagcaaaccggccgcgactacctgctatgcgactacaaccgcgacggcgacagctaccgctcgccatggagcaaccagttcgaccctccgctcgagggcggcaaccagggcggtagcggtggagatggcgagggagatggaggagaaggcggtgcggcgggatcgatcatgcctggcgagagggtgaggaagatggagatcaaggccaacgaggcgtttgacgtgtacagggagctgtattatgaggggggtgtgagttcggtgtatttctggaatttggacgatgggtttgcgggggtggtgttgttgaagaagtgtgagttattcctctgtcgtcgtcatttgttttgggttggactgcacgggatggaccgatgcgcgtgagactcttgcgcttgccggagcctatcgacactacatacaagaacaagtctgctaacctacacttatgtcaacagcctccccaaccaatccctcctcctcgggcgtgtgggactccatccacgtcttcgaagcctcggagcgcggccgcacctccaactaccgccttacctcgaccgtcatcctctcgctggccaccaagggcaacgctctcggcgaggttgatctctcgggcaacatgacgcgccaggtcgagcaggacctgcctgtcgagaacgacgagagccacattgccaatattggccgcctggtcgaggacatggagctcaagatgcgcaacctgctgcaggaggtctactttggcaaggccaaggacgtcgtgggcgatctgaggagtgtcggctccctcagcgagggacagagggatcgcgatgcgcag

SEQ ID NO: 27643 - DNA, 957 bp, Neurospora crassa
ctgtactcctcccaatactatgccgcatgcacattcggtggcttgatggcctgtgtaagtctataattcagcgatattgccgtgcgtgcaggaaaatggcgggactaactggttttgtagggcgtcactcacactgcggtaacaccgttggatcttgtcaagacgagacgccagatcgactcgaagctgtacaagggcaacttccaagcttggggtcacattctcaggcacgaaggtgttcgcggcatcttcaccggttggagtccgaccttcttcggttactcggcccagggtgcgttcaagtatggctggtatgagtttttcaagaaaaagtattcggacctcgctggtcccgaaaacgcgcacaagtacaagacagcactgtacctgagcgcgtccgcctcggcagaattcttggccgatattgcgctctgccccttcgaggccatcaaggtccgcatgcagggtaccattccgtcgcagtacaagggcacctttgatggcttcagccagatcacggccaaggaaggctggggcggtctctacaagggtctctaccctctctggggtcgccaaatcccttacaccatgatgaagttcgcttcgttcgagaccattgttgagatgatctacgaccgtctgcccggtggcaagagcgactacggcaaggctgcccagaccggagtctccttcgttgctggttatgctgccggtatcctctgcgccattgtgtctcaccccgccgatgtcatggtcagcaagctcaacgcctaccgcaagcccggcgagggaatgggtgctgtcacttcgagaatctacaaggacattggcttcaagggtctctggaacggtctgccagtgagaattgtcatgattggtacccttaccggtctgcagtggatgatttatgactacttcaaggtcttcatgggtctgcctaccactggtggtgccgca

SEQ ID NO: 27644 - DNA, 957 bp, Neurospora crassa; identical to SEQ ID NO: 27643

SEQ ID NO: 27645 - DNA, 774 bp, Neurospora crassa
aaccaaagaaccacgctgcccaccaaccaggtcggacaagagctccgcaagatgacggccttcatcaagcaagaagccgaggaaaaggcgcgcgagatccagatcaaggccgacgaggaattcgccattgaaaagtccaagctggtccgccaggagacggacgccatcgactcggcctacgccaaaaagttcaagcaggcccagatgtcgcagcagatcacgcggtcgacaatggccaacaagacgcgactccgggtcctgggcgcgcgccaggagctgctggacgagatctttgaggccgccagcgcccagctcggccaagccacccacgacctgggccgctacaaggacatcctcagggacttgatcctcgagggcttctacgccatgaacgagccggagctggtgatccgcgcgcgccaggcggattatgacgcggtcagggaggcggcggggtgggcgagcgcccagtacaagcacaagacggataaggatgtcaaggcgacgattgatgcggagaatcccgttcctgaggggaggtaggttatacatacacacaccatgcttcgggctgtggtgaagaggaagaagaagaagagatgatgctaacaagagttgatatacagcgccggtggcatcatcatcgttggcggaaacggcaagatcgatatcgacaacaccttcgaggccaggttgaccctgcttaaggacagcgctctcccggcgatgcgcaaggctctgttcggtgaaaaccccaaccgcaagttcttcgat

SEQ ID NO: 27646 - DNA, 4217 bp, Neurospora crassa
cccaggaccatcttctgtggcctgccattagccgatgagttcaaggatgacgaaggccatccaacgcagcagtatccgcgaaacaagatccgaacagcaaaatatacgccgctgtccttcgtccccaaaaacttgtggtttcaattccacaacattgccaatatttttttccttttcgttgttattttagttgtgagtagccgtctcctccaccgctgtgctgcaccgctgcatccgctctcccttgggagccccttgccccctgccgattacgcccacccctgttcaggacccagagctagcgatgccttctgagcctctagtgttgttgatgctgatgcgtaaccgtctttctagattttccccatatttggtggcgtcaaccctggacttaacgccgtccctctaattgttattatttgcgtcacggctatcaaggatgcagtcgaagactaccgaagaaccgtcttggataatgttcttaacaatgcgcccgtccacaaattgcatggcattccgaatgtcaacgtcgaggcggacaatgtatctctatggcgcaggttcaaaaaggcaaactcgcgcttctttggtgctctgtggcacaaaaccgaaggactatggaagaaggaggacgacaacccgattctcaagaaccacacggcctcgcacgatgaaccggacccgcgtatgtcaatggagtcgagaacctcgcgtgctagacggtccctgaatgtcgtacgagacgaagttgagatgacgccagttccctcgccacttccgcatcagccgaatgaaatggacttccccggagaaggatcgagtcgccaggtggacaacaaatacgctctgcaagatatcaagggagacttggtcaaccgcaaccttcccatttctggcaaggccagattcgccaaggacgcctggaagggtttggttgtgggagattttgttcgtatctacaacgatgacgaaattccggcggatatcattattctggcaacttcagacccggacggcgcctgttacgttgagaccaagaacttggacggtgaaaccaacctaaaggttcgctctgctctccggtgcggccgtggcatgaagcatgcccgtgattgtgaacgtgcgcagttcatcatcgaaagcgagcctcctcagcccaacctctacaagtacaacggtgcggtcaggtggctccaggaacttcccaacgacgaggatggcgacccaattccaatgtcggagcccattagcatcgacaacatgcttcttcgtggctgtaatctcaggaacaccgaatgggctcttggcgtcgtcgtcttcaccggccacgataccaagatcatgatgaacgcaggagttactcccagcaagcgggctcggattgcccgtgagcttaacattaacgtcgtctacaactttaccattcttctgatcatgtgtcttatcgcggctatcgcaaacggtgtcgcttgggcaaagaccgacgcttcttcttactggttcgaatggggctctatcggcggaacatcgggtctcacgggatttatcaccttttgggctgcggttattgtcttccagaacttggtgccgatctcgctttacatttcgctcgaaatcgttcggacgttgcaggcttatttcatctatagcgacatcaacatgtactacgagccgatcgatgcgccttgcatccccaagtcctggaatatctcggatgacgttggtcagattgagtacattttctccgacaagactggtaccctgacgcagaatgtgatggagttcaaaaaggccacaatcaacggacagccgtacggagaagcctttaccgaagcgcagattggtatgagcaagcgaagtggcggcggcgacattgaatctgagatcgccaggatcaaggacgagattgagcaggccaaggcacgcactctccatggactccgtgagattcacaacaacccctatctccacgatgaagaccttacattcgttgctcccgacttcgttgaggatttggctggtaagaacggtcccgagcagcaaaaggccaacgagcacttcatgttggcccttgctctctgtcacactgtcgttgcggagaagcagcccggtgattctcccaaaatgatcttcaaggcgcaatctccggacgaggccgctctggttgctaccgctcgtgacatgggcttcaccgtcctcggtatgtctgatggaggcgttaatgtcaacgtcatgggcaaggacatgcactaccccgttctcaacattatcgaattcaactccagcagaaagagaatgagcgcgatcgtcagaatgcctgacggcaagatcaagctcttttgcaagggtgccgacagtatcatttacgcccgtttgaagcgtggcgagcaaaaggagctgcgcagggaaaccgctgaacacctcgaaatgttcgccgtcgaaggtcttcgtactctctgcattgcggagaaggagctgacagagcaggaatactacgaatggaagaaggagcacgacgttgctgctactgctctggagaaccgcgaggagaagctcgaggaagttgccgacaaaatcgaacaggatctcactttgctcggcggtactgccattgaggatcgtctccaggatggcgtgcccgatgccattgagctcctcggcaatgccggtatcaagctttgggttcttaccggtgacaaggtcgagacggcgatcaacatcggtttctcttgcaatctcctcaacaacgacatggatcttgttcgcttacaggttagcgaggacgaggctggtgtccagcaggaagctgagtaccttcgccttgccgaagaagaactcgacaggggtttggccaagtttggcatgaccggcagcgacgaggagctcaggcaggccaagaaggaccacgaaccgcccgcgcctactcacggtcttgtcgttgatggatttacccttcggtgggttctcagtgacacgctcaagcagaagttcctgttgctgtgcaagcagtgcaagtccgtgctctgctgccgtgtcagtcccgctcagaaggctgctgtcgtctccatggtcaagaacggcttggacgtcatgacgctctctatcggtgatggtgccaacgatgttgccatgattcaggaggcggatgtcggtgtcggtattgctggtgaggaaggtcgccaggctgtcatgtcttctgattacgccatcggccagttcagattcctgacacgcttggtgctcgtccacggtcgctggtcctaccgtcgcttggcggagacgattagtaacttcttctacaagaacatggtgtggacatgggccatcttctggttccagatcttttgcgacttcgacatctcgtacattttcgactatacctacattctcatgttcaacctgttcttcacttctattcctgtcatcctcatgggtgtcttggatcaggacgtgagcgacactgtgtccctggccgttcctcaactttaccgccgcggtattgaacggcttgagtggacacagaccaagttctggtaagtatttttcgcacctataataatatggttgaaggtgtccgctaacaaattcccagggcttacatggctgatggtatctatcaatctgtcatgagcttcttcatcccattcatcttctgtatcctcacccctgctgcctctggaaacggtctcgacgtccaggaaaggacaagactgggttgctacattgctcatcctgccgtgttgaccatcaacatgtacatcctcatgaacacttataggtgggattgggtgatgctcctggttgtcttccttagtgacatcttcatcttcttctggaccggcatctacacggccaccagctactcgggccaattctaccaggccgctccccaggtctacgccgagttcaccttctggatggccttcatcatcacgccgaccatctgcctgctgccccgccttgtcaccaagtgcatccagaagcaaatgttcccttacgacgtcgacattatccgcgagcgcatctccaccggcgaatacaaggctattgaagtgcccgtcgtcgctcccgttgaggacgaagcccttaagggtacctcgtctggctcctcggaatcgtccagcagccgcgccaagtccaagtcgtccaagcactccaagcacacgcactacgccagtgtcgacgaggatcgccggcctatctatccgccatccgtc

SEQ ID NO: 27647 - DNA, 1865 bp, Neurospora crassa
accgtacgtgcataatacactctgccttttccctcctacacctttccggtacgctcataaccttactgacaagcccaccacaacagggtagtaggaagctacattcccgaatcatcatgggctctcgtctggtcagccctcgccgcgctggccgtctggtacatggcgagccgcgaagaccagccgatccgctacacgattcctcccgccaacttccccaaggaggagaacatccttgaaaacccctcgatcaaagcctcgggtacctcagcgatccaatgctacgcccctgccaccggccaattcctcggcttcgtcaacccctcgacccccgaaggcatcgaccgcgctatcgaccaagcccacgccgcccaggtcgaatgggccaagaccaccttccgccagcgccgcgccgtcctccggtcactgcttcaatacgtgctcgacaaccaggaggagatctgcagggtggcctgtctcgacagcggcaagaccatggtagacgctcagctgggcgagatcctcgttacggccgagaagctgcagtggactatcaagcatggcgagaaggcgctgcgcccggagtcgaggcctacgaacctgttgatggcgtataagaggaacacggtgcactacgagccgctgggcgtggttgctgcgctggtgagctggaactacccgtttcacaacttgatcggaccggtgattagcgcgctgtttgcgggcaacggtattgtagtcaaggtatcggagcagacggcttggagctcgcagtggtttacgagtgtgatcaggggcgcgttggttgcgcatggtcataatcctgcgcttgttcgtacgtatcactggtctcttgttcctacagcttaccttggcccttgctaacaaacctgttccgcacagaaaccgtagtctgctggccccaaacggccaaccacatcacctctcatcccaaaatcagccacatcactttcatcggctcccagcccgtctgcaagaaagtcgccgaatcggcttccaaggccctcattcccgttctcgccgagctcggcggcaaagacgcctccatcatcctcgcctcggcccccaagtccgacctccctcgcatcgtcaacacgctcatgcgcggcacgttccaagcctccgggcagaactgcatcggcatcgagcgcatcgtcgtcgccccccaacactacgacaccctcctctccatgctcaccccgcgcgtgcgcgctcttcgtctgggtcccaccgctgatgtgggcgccatgatctcggataacgcttttgctcgtctcgaaggactggtcgctgacgccgttaaacaaggcgctagactcctggccggcggcaagcggtacgcacaccctgaatacccaagcggtcattacttcgtgcctacccttctcgtagacgttacgccggacatggctatcgcgcaagaagagtgcttcgggcccattatggtggtgatgcgcgccgcttcgtcctcggcagaagacatcctcgccgtagccaacgcgcccgactttggcttgggcagctccgtgttcggatcggaatgggattccacgctgcacgaggtggtcagggggttgaaggcgggtatggtagccgtcaacgatttcggagctacgtatgcggtgcagcttccctttggaggcgtggcggggtcgggatatggaaggtttgcgggcgaggaaggactgcgggggttgtgtaatatcaaggcggtttgtgaggatcggtttggttggctgggtgtgaggacggcgataccgcggccgatgcagtatccggttcctgatcaggagcggagctggaggtttgcaaggggcgtggtggaggttgggtatgggatgggc

SEQ ID NO: 27648 - DNA, 2823 bp, Neurospora crassa
taccaacagaaactgtttgaagagcttcgtaaagaagatgagcttgtcattctcgcccgaggcctcggtctcatgcgcctcatcaccaacctgcttcactcgtatgatgccgcaggaaacaacctgattgtggttgtcaacgctgaagacagggagaatgcctggattggtgaggccctggccgagcatgccgctatcagcatgtctcccaaggccaggggcttgaccgtcgtcaacacggactttaccagtgtcgggacaagagagaagatgtatgcccagggcggcatctttagcatcacgtcgcgcatcttggtcgtcgacttgttgacaaacctcctgaacccggagaccatcacgggcatgcttgtcctccatgcggatcgcatagttgccacttcgctcgaggccttcattttcaggatataccgccaaaagaacaaggttggctttctcaaggccttttcagataacccggatccttttacggtaggcttttcgccactggctaccatgatgagaaatatgtttctccgaaaggcttcactctggcctcggtttcatgtccaggttgcccaatccttggagggaaagaagaaggcagaagtcatcgagttggaagttcccatgaccgactccatgagagagatccaaactgccatcatggaatgtgtcgagatcagcattcatgagctcaaaaaggagaacaccgggctggaaatggaagactggaacctggacagtgctctgaccaggaactttgatcgtatggtacggagacagctggagccaaactggcatagagtcagctggaaaaccaagcagattgctggcgatctgacagttcttcgtggtatgctccagtctctcctcgccctcgacgccgtgtcattcttgcaacagttggacaccattcatgcggcacataagcctgctcctgggactacccggcagacagagtccccttggctgttctctgacgcggctcaaaccatcttcgagactgcacgacaacgagtctattctagcaagcaaaaggcgggtccaaactcaaccatcgagtcactgaagcctgtcttggaagaacagccaaagtgggctgtccttgcagatgtcctggaggaaattgacagagatctttactttgaaccagctgttcgcgatgattccaacgggaccatcctggtcatgtgtgcagacacagacacatgtcgtcagctacgcgactatctacaaacaatgcacatccggcctcgaacggcaaagaaggtggaagaggtatatgaccctgaagaggacagaccatcgggtgccttcctaatgaggcgaaagctacgaaactatctcaactggaaacgagaattcgcccaagtcaacgccacccttttctccgagaaccaaaaggccctcagcggcgccgtcgacccacgactcccccaggctagaggccgaggaggagcgccagcaaacaaacggcgccgagtccgcggcggtggtggtggtgtcggaagcaaccccagccgccatgagaacggcagcatcgtccaacactttgaaaagcccaacgaagtagctgacctaatgtccgagatccaaattaccgaagacgacgcaggcggccaagcagccgaagaaatcatcacttttgccacagccgacccgctcgaggacatggacgattactaccaactctacgatatgcaagacctagtagtcatccacgcctacgagggcgaccaagacgagcacgtcctcgaagaggtaaagcccaaatacatcatcatgtacgagcccgacgcctcctttatccggcgcgttgaggtctaccgctcctcgcacaacgaccgcaacgtgcgcgtctactttttgtactacggcggctccgtcgaagagcagcggtacctctcgtcggtgcgtcgcgagaaggacgcctttacgaaactcatcagagagcgagcctccatgtccatcgtcatgacgaccgactcccacggggtcgaggaccccgagtccgcttttctacgaaccatcaacacccgcatcgccggcggcggcaagctcgccaaagcgacggcccagccaccgcgcgtagtcgtcgacgtgcgcgagttccgctcctctttgccttccctcttgcacggccgctccatggtcatcgtcccctgcatgctcaccgtaggcgactacatcttgtctcccaacatctgcgtcgagcgcaagtccgtctccgacctaatttcctcgtttaaggacggccggctatacgcccaatgcgagaccatgttccagcactacaggaacccgatgctcttgatcgagttcgaccagaacaagtccttcacgctggaaccttttgccgacttgtcgggtagtttgcgcagcgtcaacccggaaaacgcgggggccaacgacttgcagtccaaaatcgtgctgctcacgctcgcgttcccgaaactgcgcatcatctggtcgtcgtccccttacgagacggcagaaatctttgagcggctgaaggcgctcgaggaagaaccggatcccgtcgcggctgtcagggcggggttgggggaaggagaaagtcccgaggatggggtgaatgagggcaagggggcggtgaatgggggtagtacgttcaatatggaggcgcaggagatgttgggtaaagtcccgggcgtgacgccgaagaatatcaggaatattactgccgaggcggagaatgtgagggaggttgcgaatatggaggtggaggagctgggcagactggtggggagggaggcggcggggaagattgtcgagtttttcaaaaaggatgttttggaggattac

SEQ ID NO: 27649 - DNA, 1919 bp, Neurospora crassa
atcctcagcgacgacgacaaggaaacggtcaagcgctgcgtgcccaagcagaccaacaagatccacgccgtcgccgtcgccaggctctatgtagcctaccccaacccgtccagatggacctataccggcctccagggtgccgtcgttctggcaaatgatctcgtgggcaacacatattggatcaagatggttgatatctcggtaagtgtgaaaatgacgattgcgtggctggccaccatttggctgacatcggacagcccggaaacaggggagtgatatgggaccaggagatcttcgacacttggaactacaaccaggaccgtgtcttcttccataccttcgagcttgaggaatgcctggctggcttgtccttcgtggacgagaaggaagccaagcagttcctcaagaagatgaacgacagggaaaagaacgccagcaaggctaccagcaagacacctttcggaggcgcatcccaggcacaccaccacaagcaccacggtcttttcggcggtctgtttggaggacataagcacgcgtctccgacagccaccccgcccgagtcgccacgtgccgctgcaccggcaggccgtatgagagctggaagcactaatggaataaacggatacaagcctccttccgagtttgcgaccctggatgctttcgatcccctgtggagggaacacttcggtgacgacctcaaggcccaaggcctcgacgacgacttcatccgcgaaaaccaggactttatcattgagttcttgaaacaggagcaagcgaagcagggtatacacacgagcactcctccgccgccgccgccgccgccatccgctcctcctaatggtcccgcaatgagagctcccccaccacctcctcctgctgctgctccgcgcagtgtctccgagtcgataactccatcgacctctaggagagggccagtacccccgcctccccctccagcaaggagatccggcaagctcgacacggaaaaccaccaggaaccggcccctccgccgagatttgctgttcctcctcccatcgccgatgctggcaagtttgcccactctgatcccccgcgacatacgccctctgcgcctggacctccaccacctccccggccgccgaagacgccactcgaagatcaggacccgagccagaggttcagcgttcctccgccattcacaggccaacgaagtgtacccccgccgcctcccagccgtagctctgttcctccgccaccgcccccgagaaattcagctgcgcaacctcctctgcctcccaaggcaccgggaccagcacctcccctcccgcctgcgagctcacggccgccccccatgttgccaactagaagcccggcaccaccgcaggcaccgcctctcccgacctcgaacgcgccacctccgccgcctttaccggccacccaggcgcctccaccacctccccttcccgcaaccagcgcgcctcctccgccaccaccggcaccgccagcacctccggcgccccctctacccgcagcacatgctcccccgccgccgcctcccatgccacccatgcccgcaccatcaggcggcgcaccgcctccgcctccgcctcctccaccgggtggtatgggtggtgtccctccccctcctcctccccctcctccaggtggtatgcctccaccgcccgcccctgccttgccacctgttgacggcagtcgttcggccgtgttggacggcatcaagaccgcgggaggtatcagggcgttgaagaaggtagacagaagccagattcgcgatcgttccggtgctgctgttcctggtggctccgatagtgggcccgcaagcagtggattgccgcccgctggagctgcgccgggtggcggtggtggaatggcggatgcgttggcgttggcgttgcagaagagaaaggagaaggttagc

SEQ ID NO: 27650 - DNA, 1592 bp, Neurospora crassa
tccagcgtcaacaacgagaaggctgtccatcccgagtacactgaggacgtcgctctggaaagtgccggctgggatgagcaaagaaccaagaagctacttcgcaagatcgatagcaggctactccccttccttgccttgttataccttctatccttcctcgaccgtacaaatatcggcaatgccaagctcgagctccttacgcaggacttgaagctcaccggcctcaagtacaacgatgcgttgggtatcttcttccccttctacgtcctcgccgaggtcccctccaacatggccatgaagcgttttcgcccgtccatttggatcccatccattatgattgcgtggggtgtttgctgcacccttatgggcgttgtccagaattaccatggcttgatggcagtgcggtcttgcttgggtcttgccgagggaggtctctttcctggtatcacctactagtatgtatcacccttttgcttgtcgtcaaatcgcattcacttacagtacccaagcattacaatgtggtacaggcgtcacgagtgcggcttccgcatggccatattcttctccgctgctaccgccgccggtgctttcggtggtcttctggctcgtggtatcctggagatgaagggtgtcggtggctacaatggatggcgctggctcttcatcttggagggtatcttgacttttattatcggtatgttaacctgtcctgcctttttctgcggtgcgctttctgataatttctcccagccgtcattgccttcttcgccatgtacgactaccctcagaccgccaaattcctcaagcctgaggagcgtgaagagatcgccgcccgtctcaagcgcgatcgttcttcccttgcggatgagttcgacatcaagtacttctatgcagccctcaaggactggaagatctgggtccacatgttcatcaccattggcgtttacactggcttgtactcgtactcgctcttcgtgcccaccattatcaacagcatcggtaccttcagccccgagcagagtcagcttttgactgtcccgccttatgtggtggcctgtcttttctgcattggtgctggctggtatgccgacaggctcaagcagcgtggtatctttatgctcttcttcatgggcatggcgtacgtatctccccaaatccagctttgcatcacttgctaatgactcagcagtatcattggcttaatcatgttgatggctaccaggacgcctgctgtccgctacctcggctgcttcttcctcgcttcgggtatctaccccaacgtcccccagggtgtcgcatggaacggcaacaacattggtggctcgctcaagcgcggtgttggcattgccatgcacgtcggtttcggcaacctgggcggtgtcatctcgtcgtacctcttcctcgccaagcaatctccccactactaccagggttttggcacccttctcggctgccaggtcatggcttttgtcctgtcggcctttatgaccatctacctcaggcgcgagaacgctcgccgggaccgcgagtacaagcccccaagcgagtacactgaggaggaaaagattgcggagcgcgagaagggtgataat

SEQ ID NO: 27651 - DNA, 636 bp, Neurospora crassa
ggcgaagtcgtctacccccagtttgcctacccgatgcgcaaggaaatcattcccatctggcttgccgccttcctggcctccatcattcccatcttcatcatcctgtgcatgcagattcgcatccgctccttctgggacgtcaacaacggcgtcttgggtcttttgtacagtctcatcaccgccgccgtcttccaggttttcatcaaatggcttatcggtggcctgcgccctcacttcctgaccgtctgcaagcccgacatcactcgcgctaccaacacccaaattgccgagaagggctactcggcccaaggtttcgccgagatttactacaccaaggatatctgcacgggtgatccgaatgagattgatgattcgctcgagtctatgccatctggtcactccaccgctgccttcgcgggattcatcttcttggccctctacctcaacgccaagctcaaggtcttctccaactaccaccccgcgctctggaagctcgccgccgtctacgctcccgtgctcggcgcgtgcctgattgccggcgccttgaccattgatgagttccaccactggtatgacgtcctcgctggcgcggttatcggcaccatcatggctttcagcgcctaccgcatggtgtat

SEQ ID NO: 27652 - DNA, 1500 bp, Neurospora crassa
gattttgagaccaactcggtcaatgaaaattcactactccggaaactcgacgttcgtctcctacctgccgttggtattctctatctgctctccttcttggatcgcagcaatgtgggcaacgcgaggattgagggtctcgcgtcagaccttggtatgacgggcaaccagtacctaactggtctgacgctatactttatcggctatgccatttttgaagtatatcgtgtttactcccgacagtatcgtgaagacttctcactgacacgctgatagatcccatgcaacatcgttctgaagcgcacaacacccaggttttggctaccaaccctcaccatcctatggggaatcgtagctaccctgatgggcatcgtccagaacctgactggctttttcatcgcccgcttcttcctcggtgtcgctgaaagtggtctcttccccggcgtagtctactatttctccatgtggtacaagcgccgcgagaggcaattccgcatttcactcttcttcggagccgccgctcttgccggatccttcggcggcatcttggcctatggcattggctttatgcgcggcactgtctgggagcatggctggcgctggatcttcatcctcgagggcatcgctacggtcttaatagcctttggagcttactggttcatctacaactacccagacactgctgaatttctctcggacaaggagcgcaagttcatccgcgcccgtcttgcctccgacagcgacgccacccacgacgagcgcttcacctgggacaatgtcctccgcgccataaaggaccccaagtgctggctctacggactgagtttccacaccatgagcttacctctctacacattctctctgttcttggtaagctgatacaaaaaaaaagagaggacatcacttacctgcctcatatactaaccactgccacagccctccattatcaacgccctaggctaccgcgccgcaaccgcccaactcctcaccatcccgccctatgccttcgccttcctcaccactctcactgtagccaccgtctcggagcgtctgcaccagcgtgccatcttcatcatcgggtccgccaccttcgccataatcggctacatcatgctcctcgccaacaaggaccccatagcccacccgggcttgtcctacgccggtaccttcttcgccgcaggcggcatttaccccgccacagccctggcgctctcgtggccggcgattaatgtctctggccagacaaagagagcggtggcgaacgcgatgcagatcagtatcggcaacttgggtgcggtgctggggacgcagttgtataggagccgggatggaccgaggtatatagttggtcacagcttcgcgctgggttatctggcggggaatgtgattgtctcgagcttgttgtattttattttgagtagggagaataaaaagcgggatgggattgtgccggaagtggcagaggtagggcatctgaaggattgggatggggatgaagatctc

SEQ ID NO: 27653 - DNA, 2461 bp, Neurospora crassa
atgtcgaggctattgcgagcaaagaagctggtcgccccggcccttgtggccggtgtcgctggtggctccctctactacatgtataagccccgaaacatccccgggtacgaaggccccgttgtcccgccccctatcttcggcgccgacggcaccttcaagctcccccgcttccctcaggtcaagtctcgcgaccagcagattgccgatctaaaaaagagcaactcgggaaacaaggaggacgaatatgatgtgcttgttatcggagctggcgcaaccggtgccggtgtggctctcgatgccgcaactcgcggtctcaaggtcgccgttgttgagcgagacgacttcagttccgggacaagcagcaagagcaccaagctggtacacggtggtgtgcgttatctcgaaaaggccgtctggaacttggactacgcccagtatgagcttgtcaaggaggccctcaaggagcgcaagtacttcttgaagactgcgccccatctgagctcgtggctaccaatcatgttgccactcgaccagtggtggaaggttccttactactgggctggcaccaagttctacgatttcctggctggttccgagggcatcgagagctcatactttttgaccaagagcaaggccattgatgccttccccatgctcaaacagaccgacctcgttggcgccctcgtctactacgatggtgcccacaacgactcccgcatgaacgtctcgatcggtatgactgccgccctctacggtgctactgttgtaaaccacatggaggtcactggccttcagaagggcgagaacggaaagctctgcggtgctaccctcaaggaccttgtcactgagagagacggcaacgaggcgactcccttcaacatcaaggccaagtgcatcatcaactgcactggtcccttcacagacagcatccgtaagatggacgaccaggactgcaaggagattgtcgcccccgcctccggtgtgcacgtcatcctccccggttactacagccctggcaagatgggcctgatcgacccctccacctccgacggcagagtcatcttcttcctcccctggcaaggcaacaccattgccggtaccaccgacgagcctgcgaccattaccaagaacccccttcccgacgagaagtccatccagtggattctcaacgagatcagccactacctctcccccgacatcaacgtccgccgcggcgacgtcctggctgcctggtccggtctccgccctctcgtaagggaccccaaggccaagaacaccgagtcccttgtccgtaaccacctgatcgatatctccccctccggcctcatcacctgcgccggtggcaagtggaccacctaccgccaaatggccgaggagtgcgtcgacgccgccatcaaggagttcaacctgcccgtcaagcccatcgccaaccctcccctggtcagcggcactgagcacgtggaagacgatgccgtcctcgacggctcctgccagacgcaccgtgtccgcctgatcggcgctcatggcttcagccgcaccttgttcatccacctgatccagcactttggcgtcgagaccgaggtcgccaagcacttgaccgagagctacggcgaccgcgcctggaccgttgcttcgctgtgcaaggccaccaacaagcgcttccccgccaagggcgagcgcattgcagagctttacccctttgttgacggcgagatccgctacgcggtcaggcacgagtatgcccagacggctgtggacgtgctcgctcgtcgcacgagattggccttcttgaatgcgcaggcggcgctcgaggcgttgcccaaggttattgacatcatggctgatgagctcaagtgggatgcgaagaggaaggatgttgagtggaaggacagtaagttattcgccccatgccattcattactccattacccattactaggtcatcccttgatgtcaacttctctccctttctttttacaacttcagacgaacaatagctaacgaacatgttcccacacagccgtcgccttcctcgagtcaatgggccttccccaaccgatgctcaccaccacccgccaacaagtcgagaagggcaagctggactggtccaactcgctcgagtggaagatgtactcgagacacgataagccggtcgacgagaaggagcgcaacgagcaggccgagattgccgggcgcgcggggactcatcgttaatgatgggctctgtctccctttggcgcgaaaagagatgggattataaaaggaacagtagaagaaggatgacagaacctatattgcattggcgattgaatgggttttccttggttcaggcagtaaaggcgtttttgttgttctagactggactggactggactggactggactggctggttgggttggcatgaatgtcagagggtcgcttacgttaacgttattcagcgttggtgatgtggtgtcttga

SEQ ID NO: 27654 - DNA, 1851 bp, Neurospora crassa
atggcgcaatatacagcatcgactggctcgtccttgagagcctcgccaaacctccgacaacaccatgccgacaccagcgcggccccagataccaccgaaaagttccccgacttcgatacctcacaaacaacgaacggctatcccagcggaaacggccggtctacgaatgccggttctaatgcgccctcggatcaatggcgaccgagaagggaaagcaaagtgacatgggctcctagagactccccagggcccgtaaacgcctactcccatggccgtggtcattctaggcaaacgagcattagcaatgcgatacaccggatgcgctcggggagtatgagccagaatgctcatgagattgcggaagcacttcgtgcgcctgtatcctacaaactaatagtacgaacatttgccccaacggccattcctctgtgcaaagctaacctcttctcctcttctctataggggctctgtatgatgtggtactggtcctcggcgctgaccaacacctcttccaaatcgatcctcacgacctttgacaaacccgcgaccctcacgctgatccaattcgccttcgtttgttcctactgcctcctagcctcctggttagcttcgacgtttcccaagctgcgcaccgccgtgcccgcactcaaacacccgattcgcaagccctcgcgcgatgtcattgtcactacgcttcctctggcggccttccagatcttcggccacctcctctcctcgtccgcgacctccaagatccccgtctcgctcgtccataccatcaagggtctatccccattattcaccgtgctcgcctaccgcttgatattcgacattcgctacccgcgcgcaacatactactccctcgtgcccctgacaatcggcgtcatgcttgcctgttccggcaaacactcgtttggcgagggccagttcctcggcatcctctacgccctaatagccaccatcatcttcgtcacccagaacatcttctccaagcggctcttcaacgaagccgcgcgcgccgagcaagaagacgggcacagtaacggtcaccggtccaagaagctcgacaagctgaaccttctctgttactcctctggcatggccttcatccttaccggtcccatctggctgtggtctgaaggcttctccataatcggcgacttcctctgggacggctcggtcgacctgagcgagacgcccaactcgttcgaccacggccgtctgaccctggaattcatattcaacggcaccttccatttcggccaaaacattctcgcctttgtgctgttgagcatggtaagccccgtcacttacagcgtcgcctccctgctcaagcgcgtcttcgtcatcatcatcgccatcatctggttccgctcgccgacgaccaacgtccaagccgtcggcatcgccctcacctttttgggcctgtatttgtacgaccgcagccaggagaagaacaaagccgaccagcgcgcgcgctcgctctctcgttccaagatgcacgaatcgatcctaccgcttaacaccaagcaaaccaccgaaacttcttcccagtatcaaccctcctcaagcctgaatacccaaataggcgggtacgggtatatgccctcaatccagcccaccacaagtagtgccgaccttggcgcgaataaaaaggatgatgggcccaacccttcgtcagtgtcaacaacagcaggaggtgggagacaaagaggcgcgagcatggccaaggctaatggtggatggctgccgccggggacgaggcaggaacatacatggagggttggggacgggcgtgggcagaatggtggtgccgaagtttcagggccggcgggagttgctgttatgtct

SEQ ID NO: 27655 - DNA, 1810 bp, Neurospora crassa
ccgcgctactttctgcccacaggtgccgtcgtcgatggtcagtaatatcaacaacatccaactacgcccgcgccgtggctccgttgccgcccggtcacgacgctcgctctttatactgaccccgcttccgtccaacagtcaagttcgataccgacaagctccctcccattctcaacgcccttgagacccagaacaatggccagaagctcgtcctcgaggtctcggtacgtggaacaaaaaatggcctcatcaaccccgacgacgaccagcgggattagtgtagctgagcgaatgcgctaaccagccccgcagcaacatctcggcgagaacgtcgtgagatgcattgccatggacggtactgagggtctcgttcgtggtgccaaggcctccgacagtaagcttctcttttgatccccaagatgaagggtttggccagattcgctgacatgatcttatattatagctggtgctcccatcaccatcccgtgggtttcccccagtttttagcttaccgcgaaaagcggacaagcaactgcgaatggagctgttttactgacgcaaaagtgtagtgtcggccctgccacccttggccgtatcatcaacgtcactggtgaccccatcgacgagcgcggtcccatcaagaccgacaagttccgccctatccacgccgaggctcccgagttcgttgagcagtccaccactgccgagattctcgtcactggtatcaaggtcgtcgatctcctcgccccctacgctcgtggtggaaagattggtctcttcggtggtgctggtgtcggcaagaccgtcttcattcaggagctcatcaacaacatcgccaaggctcacggtggttactccgtcttcaccggtgtcggtgagcgtacccgtgagggtaacgatctgtaccacgaaatgcaggagacctccgtcattcagctcgatggtgactccaaggtcgctcttgtcttcggtcagatgaacgagccccccggagctcgtgcccgtgtcgcccttactggtcttaccattgccgagtacttccgtgatgaggagggtcaggatggtatgttgctctggagaagttatgccgcttgaaggaaaaccgttgctaacgcagtctgtagtgttgctcttcattgacaacattttccgtttcacccaggccggttctgaggtgtccgctcttctcggtcgtattccctctgccgtcggttaccagcccactctcgccgtcgacatgggtcagatgcaggagcgtattaccaccaccaccaagggttccattacctccgtccaggccgtctacgtccccgctgacgatttgactgatcctgcccccgccaccactttcgcccatcttgacgccaccactgtcttgtcccgtggtatctctgagttgggtatctaccccgctgtcgatccccttgactccaagtcccgtatgctcgacccccgtattgtcggccaggagcactacgagaccgccacccgcgtccagcagatcctccaggagtacaagtccctccaggatatcattgccattcttggtatggacgaactttccgaggccgacaagctcaccgtcgagcgtgcccgtaagatccagcgtttcctcagccagcctttcactgtcgctcaggtcttcactggtatcgagggtaagctcgttgaccttaaggacaccattgcctccttcaaggctattctcgctggtgagggtgatgacctccccgagggtgccttctacatggttggcgacttcgcctctgctcgcgccaagggtgagaagattcttgctgagcttgagggc

SEQ ID NO: 27656 - DNA, 2638 bp, Neurospora crassa
atgaacgacatctcagacaactcttccaactcgctggccaacggcggcaccgttgccaacagcgacattcccaaggatggcaccggtatgtctctctatattccccgattttctctgccgatctggtgccagaagctgatacagaagatgcgcaggtgtcttgagcattgacccctggctcgagccgttcaaggataccctcaagagccgctattccaaggcccaatcctggatcgataccatcaacaagacagagggcggtttggagaagttcagcagggtcagtcatgagccgcgttgtggaagctaccaaagctgctgacacacgtacaactacagggtaccgaaatctttggtttcaacgtcgacaaggacaacaccatcacatacagagaatgggctcccaatgccaaacaagcctccctcattggcgaatttagtacgtatcatgacacgagaccaagatactgtgaattgggagctattctaacactcatcagacaactgggataggaacgcccaccgcatgaagaagaacgagttcggcgtctttgagatcacaattcctcccacggccaacgggcaaccagctattccccacaactccaagatcaaggtatgtgaatgtttcaattcggcctgtgctacgccaattcgtcacaacgtactaatgtttatctcctgacagatcaccctcgagctccccgacggccaatgggtcgacagattgccagcatggatcaaatatgtcacccaggacctctcagtctcgcccgcatacgaggcgcggttctggaaccctccccaatccgaacgatacacattcaagcacaagaggccctcaaagccggagagccttaggatctacgaggcccacgtcggcatttcctccccggagtgcaaggtggctacctataaggagttcaccaagaccatgcttcctcgcatcaagaacctgggatacaacgccattcagctcatggccatcatggagcacgcctactatgccagtttcggatatcaggtgaacagctttttcgcggcaagcagcagatacggcccgcccgaggatctcaaggagttggtggataccgcccacgccatgggtattgccgtgttgctcgatgtcgtccacagtcacgcctccaagaacgtccttgatggcttgaatgagtttgacggtactgaccaccagtacttccacggcggcggcaggggcaagcatgatctttgggacagcaggcttttcaactacggtcatcacgaggtcatgaggttcttgctcagcaaccttaggttctggatggatgagtacgcctttgatggcttcagatttgatggtgtgacaagtatgctttacctccatcacggtatcggaacgtgagtaatctgttccccaatggtgaatttggccttggctaaccgtatccagtggtttctctggtggctaccacgagtacttcggccctgatgttgatgaggaggcggtcgtttacctcatgctcgccaatgagatgcttcaccaactataccccaacgtcattacggttgccgaggatgtatcaggaatgccggctctgtgtctcccactatccttaggaggtgttggcttcgactacagactcgccatggccattcccgacatgtggatcaagatcctgaaggagaagaaggacgaggaatgggatatggccaatattacctggaccttgacaaacaggcgtcacggcgagaagaccattgcttactgtgagagtcacgatcaagcgtaagtgacctaccccgtggcaacgtgttccgactcaggctaacgctcaaacaggctcgtcggtgacaagaccctcatgatgcatctctgcgatgccgagttgtacaccaacatgtctatcctcacgcctctaaccccggtcattgaccgcggcatggcactgcacaagatgatccgtctccttacccattccctgggaggtgagggttacctcaacttcgagggcaacgagttcggccaccccgagtggcttgacttcccccgtgagggcaaccagaactctttctggtacgccaggcgccagctcaaccttacggaagatggtcttttgcgttaccagtacctcaacaactttgacaggtcgatgaacctgaccgaggacaagtatggctggttgcacgccccacaggcctacatctctctcaagcacgagggcgataaggttattgtctttgagcgcgccggcttggtctttgtcttcaacttccacccctccaacagctacaccgactaccgcatcggtattgagcaggcgggcacctaccgcatcgttctcgactctgataccaaggagcacggtggcttcaaccgtctcgatccccagactcgcttcttcacttcggaccttccgtggaacaaccgcaagaacagcacccatgtgtacattccggccaggacagcctttgtaagtttccctcgttatgctgcagcccattgcatcttggctctgaatggttgactaatttgcggttctcaggtccttgcgctcgagtccaccctttcagagtagggtatgaacgaccagatatcccatccgttgtccaagtgcgggtgatgagaattacagcggccgggtgaaggccacaagcg

SEQ ID NO: 27657 - DNA, 3070 bp, Neurospora crassa
tcccagcagaggcgccatgagagcgccctccacagcccgcccgaccccaacgacaacttcctctcgggcagcgccgccaactatatcgacgagatgtacctccagtggaagcaggaccccaagagcgtccacgtctcgtggcaggtctacttcaagaacatggagagcggcaacatgcccatctcccaggccttccagcctcctcccagcctggttcccggtgccgccaacgtggtgcccggtctcgctgccggcgccggcgtcggcattggcgagggtgccaacgtcaccaaccacttgaaggtccagctcctcgtccgcgcctaccaggcccgtggtcaccacaaggccaacattgaccctctgggcatccgcaacactcctgcctccaagggcttcggcaacatcaggcccaaggagctcacccccgaatactacggcttcaccgagaaggatctcgacaccgagtacagcctcggccccggcatcctcccccgtttcgcccgcgatggccgcgagaagatgacgctccgcgagatcatcgacgcctgcgagaagatctactgcggctcctatggtgtcgagttcatccacatccccgacagggagaagtgcgactggctccgtgagcgtctcgagatcccccagcctttcaagtactcgatcgatgagaagcgccgcattctcgaccgcctcatctggtcctccagcttcgagtccttcctcgccaccaagtaccccaacgacaagcgtttcggtctcgagggttgcgagacccttgttcctggtatgaaggccctcatcgaccgctccgttgactacggcgtcaaggacatcgtcattggtatgccccatcgtggccgtctcaacgtcctctccaacgtcgtccgcaagcccaacgaggccatcttttccgaattcgccggcatggccggtgccgatgaggagggttccggtgatgtcaagtaccacttgggtatgaacttcgagcgccctaccccctcgggcaagcgcgtccagctctccctcgttgccaacccctcgcatctcgaggctgaggaccccgtcgtcctcggcaaggtccgcgccatccagcactacaacaacgacgagagtgaccacaagagcgccatgggtgtcctcctccacggtgatgccgccatcgctggtcagggtatcgtctacgagtgcttgggcttccacaacctccccgccttctctaccggtggtaccatccacttggttgtcaacaaccagatcggtttcaccactgacccccgttttgcccgctccactgcctactgcacggatatcgccaaggccattgacgcccctgtcttccacgtcaatgctgacgatgtcgaggctgtcaacttcgtctgccagctcgcttctgactggcgtgccgagttcaagcaggatgttatcatcgaccttgtctgctaccgcaagcacggccacaacgagaccgaccagcctgcctttactcagcccctcatgtacaagcgcatcagcgaaaagagccctcagatcgacatctacgttgaccagctcctcaaggagggcaccttcaccaaggaggacatcgaggagcacaagcagtgggtctggggcatgctcgaggagagcttctccaagtccaaggactaccagcccacttccaaggagtggaccaccagcgcctggaacaacttcaagagccccaaggagcttgctagcgaggttctcccccacatgcctaccgcggttgacaagccgacccttgagcacattggtaccgtcattggcagcactcccgagggcttccatgcccaccgtaacctgaagcgtatcctgaccaaccgcaccaagtccgttgtggagggcaagggcatcgactgggctaccgctgaggctcttgcctttggtaccctcgtcaaggagggccaccacgtccgtatcaccggtcaggatgtcgagcgtggtaccttctctcagcgccacgccgtcttccacgaccaggagactgaagacacctacattcctctccagcatatcagcgaggaccaggcccccttcgtcatctccaactcttccctctccgagtatggtatcctcggtttcgagtacggttactctctccaggaccccaacggcttcaacatgtgggaggcccagttcggtgatttcgccaacactgctcaggtcatcattgatcagttccttgcctctggtgagagcaagtggatgcagcgtaccggcctcgtcatgtctctcccccacggttatgacggccagggtcccgagcactcttccgctcgtatggagcgtttcctctcgctttgcaacgaggatcctcgcatctacccctcccccgagaagcttgaacgtcagcaccaggactgcaacatgcagattgcctacatgacctcccctgccaacctcttccacattctccgccgccagctgaagagacagttccgcaagcgtaagtttccgtggttgaactagcacgtatctcgtcaaaatgctaactttgtgtcacttagctctcgtcattttcttctccaaggcgctcttgcgtcaccccgttgctcgttccgacatcgaggagttcactgacgacgcccacttccgctggatccttcccgactctgctcaccagactggtgagatcaaggcccctgaggagattgagcgtgtcattctctgcactggtcaggtctatgccgctctcctcaagcaccgccaggacaacaagatcgacaacgtcgccatcactcgtatcgagcagctccaccccttcccctgggagcagctccgtgagaacctcgaccagtacaccaacgccaagaccatcgtctgggcccaggaggagcccctcaacgctggtgcctggtcttacacccagcctcgtcttgagactcttctcaaccacaccaagcaccatgaccgcaagcacgtcatgtacgctggtcgtgctcccagcgcttctgtcgctactggcaagaagtcttctcacgtcaaggaggagaaggagcttgtcgacatggctttctctgttactcagagcaagctcaagggcgagtaa

SEQ ID NO: 27658 - DNA, 1989 bp, Neurospora crassa
atggccccgattgagattccccggggacaggcctcttacaaaaaaagagagggcatcatcacattaaccccagacaagacagccctgatatggagccccttgccgggcactggcccacccgtcatctcactttccgtatccaacatcacaaacctccaacagacccccaagacgaatcccaaggtcgtcttgagagtcgtcgagaaacccaaggcgcccggagccgatccggctgcctatcccttccagttcacacatgccaccgaggccaggaatgaggccgatgccatcaaggatcttctctctcagatcattgctgagcttcgtggcgatgacccttctctacccaagccggcaaagtctggccccaacggcgccggcgcctctgccgccatggccatggccagtgccgtgaactcgaagcatttgccgtttcgctggttcgaagacgacatgctaaaggccgatgtagaacttcagcagtccctcatgaagaaggataaggccttggcccatatatataacgacgcaaagctgtccaagccagattcattatcagatgcctccttcaacagccagttctgggccacccgcatcagcctgctacgtgcctatgccatcgagctgaaccagaagaagggctcatataacgtcctatcaaccatcaagccccggaccgagaacggcgagctcaagttgaacatcaaccatgagcaggtccagctcatcttccaacaacacccactggtcaagcgcatctacaacgagaacgtccccaagctcacagagtccgagttctggtcccgcttctttctcagccgtctctccaagaagctccgcggcgagcgcatcaccgacaatgacaacaccgaccccttattcgacaagtatctcgaagccgacaacaccatggcagtcccagccaagatcaccgccacgagtgtgccccccatcatcaacatcgaaggcaacgaagaaaaccaaggtggcttcaggggtggcaacctcaaagacgtcgagatgcgtccgcgcgccaacatccccatcatcaaaacgctcaattcgctctccgagaaaatcatggccaacgtcgcccccacagacgtcgacccctccgccgcctcctactccaaagacggcatcgccgacgccctatccaaacaactcgccctgcaagacctccgtggcgacgccgaggcccagctgatccggctttccgtcaaggacacctccaccttcttcacaggcaaccagccctcgctcaccgaccaagaagccgccgacgcgcgcctctacgccacccaagtcccctcggacgtgctcttcgaagtgcaagcggacatggacactctcgactcggacgggcgcggcggcatcgatctccaccggtccatcggggtcgatcccgactctgacgacgagggtaataactctctggactctaaaagcggacccaagccccaacacgtcggctcccgcgctgcgctacggttcgcccagaaccagatcctcgagagcatgaagtccgctcggtcgcacctcaccaccaccaccacccacggtggctcgcacaccaccaccaccaatgcgtccgaagaacgacccatgtcgttgccgacggacattgcccaccgcgctacgctaacctgcgctacgaccgccgagttcctgaaacagttctggacggtgtttaataactccagcaacagcagcccagaaaagcagcaagaattggcctacctggccgactcgctcgtgcgctcgaaacagagaatcgaggcgctggctgacgaagcggagaagaggagacaggagattatggagaagcggaaaagggagattagagagtattatcaaaagacaggccgcaaggcgaagtgggttcccgttggagggggcagggatgcggtgtgggcggcttttgagggcgtggtgggcgggttggagagggctgtggcggtttgggagatggttaaaagtgggaggatc

SEQ ID NO: 27659 - DNA, 1421 bp, Neurospora crassa
atgtctaccttcggccactatttccgtgtcacgacgtatgtctacaaacaaaccgcaatgccaattggcatccaacgttaacaatccaacagctatggcgagtcgcactgcaagtcggtcggctgcattgtcgatggcgttcctcccggcatggagctcaccgaggacgatatccagcctcagatgacccgcagacgtcccggacagagcgccatcaccaccccgagagacgagaaggacagagtcatcatccagtccggcactgagttcggcgtcactctcggaacgccaattggcatgctggtcatgaacgaggaccagcgccccaaaggtgagtgccagctgttacatcacaagcctctttgttctgcttgccgctgacgctgttctgtccagactacggtaacaagactatggacatctacccccgcccttcccacgccgactggacctacctcgagaaatatggcgtcaaggcctcctcgggtggcggccgctcttccgcccgcgagaccatcggccgtgtcgctgctggtgccatcgccgagaagtatctcaagctcgcctacggtgtcgagatcgtcgccttcgtctcctcggtcggttccgagcacctcttccctcccacggccgaacaccccagcccgagcaccaaccccgagttcctcaagctcgtcaactccatcacccgcgagaccgtcgacagcttcctgcccgtccgttgccccgatgccgaggccaacaagcgcatggaggatttgatcaccaagttcagggacaaccacgacagtattggcggcaccgtcacctgcgtcattcgcaacgttcccagcggcttgggcgagcctgctttcgacaagctcgaggccatgctggcgcacgccatgctcagcattcccgcgaccaagggcttcgaggtcggttccggttttggaggctgcgaggttcccggctcgattcacaacgaccccttcgtctctgccgagaacaccgagatcccccctagcgtggccgccagcggcgctgctcgcaatggcatcccccgccccaagctgaccaccaagaccaacttctctggtggtatccagggtggtatcagcaacggtgcgcccatctacttcagagtcggcttcaagcctgctgccaccatcggccaggagcagactactgccacctacgatggtacttcggagggtgttctcgccgccaagggtagacacgaccccagcgtggtgcctcgcgccgtgcctattgtcgaggccatggcggctttggtgatcatggatgctgttttggcgcagcaggccaggcacactgccaagagcttgcttcctcccctcaagcagaccatcaactccggaaaggacaccgtaggaaacggtgtttctgaaaacgttcaggagtcggaccttgcgcaatag

SEQ ID NO: 27660 - DNA, 865 bp, Neurospora crassa
accgaacccacccaaggcaccttcaacttcaccgaaggcgatatcgtcgtctccctcgcgcaccagcaccacaaggtcttgcgatgccacgccctagtctggcactcgcagctcgctccctgggtagaggccggtacctggaccaaagacgagctccgctctgttattgtctcgcacatcaccaacgtcatgacccactacaagggccagtgctacgcctgggacgtggtcaacgaagccttcaacgaggacgggacctatcgcgaatcggtgttttccaccgttttaggtggggatgagtttatccagttggcttttgagacggcgagcaaactggatccccaagcaaagttgtattataatgattataacttggagagcccgagcgccaagacggaggcggtcaggaagctggtgaggcagttgcagaacaagaaaatcaagattgatggcgtgggactccaggcgcatttgacggcggagagcaggccgacgctggatgagcatgtcgctgccattaaggggttcgcggagttgggcgtggaggtggcgttgacggagttggatgtgaggttggagatgccggcgaatgcgacgaatttggcgcagcagaaggaggcgtataagaatgtaagtcaactggtttctggagtttatactcagcacttgctaatagtttcattgaaaaaactaggccgtcggagcttgcgtccaagtcgacggatgcatcggtgttaccatttgggatttctacgaccctttcagctgggtccctgccgtctttcccggtgaaggtgctgcccttctctggttcgatgactttagcagacaccctgcttacgagggtgttgtggaggctctgacc

SEQ ID NO: 27661 - DNA, 1980 bp, Neurospora crassa
cagtgggccgccatcaacaaccagtatgccatgtgcaagttcctcatcgacaagggcgccgagatcaacaagaagggaggagagagcgtcgcaacgcctctacaatgggccgcccaacgatgccactactacaccgtccacctgctgctccagcacggcgccgatcccttgatcaccgattctcaggggtacaacacactacacatcagcaccttcaacggcaacgtcctgctcatcgtcctcctcctccaccaaggcatccccgttgacgtcgaagatgcctacggtcatacagctctcatgtggtccgcatacaagggcttccccgcttgcgtcgatgtctttctccgctggggagccagtgtccacgccaaggacgagcaggggttcacggcactacactgggccttggtcaagggaagcccgggttgcatccagaagctgattgagtacggcgccgaccggttcgcaaagacagccaacggcaagacccccgccattacggcccaggagctcaacacggttgccgcctggcaaaaggcgctggacgagtgcggttacgacgagcatggcaacgccatcgtccccagctggcctggcgcgtcgtatctccttcaggacaggaggtccttcatgaccaagtttacgtttctgtggccgtttgtgatggtgtgggcgacgatggttgtcatggctggcatgcctgtgttcgttggaatcccgttgggcgtcttggcgggctatgccgttcagtgggtggcacagcaggtcatcgcttatgccccgccagacatgaggcaactgcagaagacgccttggatggctggtatctttgctgggtcgctgttcttgtgcatcatgaactggctgctacacatctttggcagcacaatgtttggacaggattcggcagtcatccccaacttgctgtttgccttcttcatctccatgactatctggttctacatccggtgtatggttgatgatcctgggttcgtgcccaagatgggaggtgtcgctgagcaaaaggccgtcatcgatgagcttatcagcctatggaagtttgacgagtccaacttttgcgttacctgcatgatccgcacgcctttgaggagcaagcattgccgtaggtgtcaacgctgcgtggcgaagcatgatcagtgagtatatcgaatcaaaactaggtcagaatgggaaagctaacggggaatagtcactgcccttgggtgtacaactgcatcggcgtcaacaaccaccgtcatttctttttctacctcatcaaccttactctgagtgttgtcacctatgactggttgacctacagatgtgagtctgtcccatcgccctcctacagaccaattgctaacgcaagcagacctttccaccctctccgagaccgcctccgacgagtgcaacatccttgccccctcgctctgccgcatcgtcaacgccgatacctacagcctcctaactgccatctgggcctcgcttcaactcacctgggtctccatgctcctctttgtccagttcgtccaagtttctagcgcgatgaccacgtacgaaaacatgcacggcatcgacaattactcggccacctccctcaacagctccttcacctccaccggcgcccccctcaacccaccctctcttcccgcccccggtccatcccccgctgcaggcggcgctcgtcacggtggccgccacgcacacggacacaaccacaagcaaggcttcatcaagcaatggtctcggctcctcggcgtcgacgcctttattgaaactgcggcaggtcggggtgcgactacgggcaagggatccaagaggaacaagcgcggcaacccctatagcagagggtgcgtcacgaattgtaaggacttttggtgtgatccgagccccatgtttgggaagcatgagaatggcgcggcggtgttgggcggtgtgccggtgaactatacggatatgtatgagagtccgggggtc

SEQ ID NO: 27662 - DNA, 618 bp, Neurospora crassa
gacaccgcaatccttttactctctgacagctccggcctcgactcccctgcaaaccttctcctcgccgactccttcgcccgcgcaggctacctcaccgtcgtaccagacctcttctctggctccccctcccccatcgacctgaccacgcccggcttcaacctcactttgttcctctctgaacatccaccgagcgtcacggaccccatcatcgcttctaccatctccttcctccgctcctccttgaacgtaactcgtatcggagctgcgggttactgtttcggcggccgctatgccttccgcttcctcgatgactcccttcctcccaatgaaagggtagatgtagcgtttgttgccaccccaactctgctacaggacgacgaggtactggagatcgatggaccagtgagcgtggcggcggcagacaatgatgggatggtgagtgcggctaggcgggccgagattgaggcgctgttgctggagacggagcaggagtacatggttagtttgtactcgggtactcttcatggatttgcgagtagtgcggatgtgagtggaagagaacaaagatttgcgaaggagagtgcgttcttgcaggcggttaggtggtttgacgagttt

SEQ ID NO: 27663 - DNA, 1361 bp, Neurospora crassa
gttgactgtgaccatataggtggaccaactgccgccgtcattgcctaccacaacccagacatcacggtcaacgttgttgatctgaacgagcagcgaattgcggcttggaactcgagccagctcccaattcacgaggatggtttgttgaaggttgtgaggacagctcgcgatggtacggtggacaccacggtgaagattccggggcttcctagatccttcaagctcgatgctcgcagtcccaacctggtattctcgaccaaggtgaacgaggccatcgaggtggccgatgtcatcttcatctgcgttaacacacccaccaagacctatggtctgggagccgggtcgatggccgatatcagcatggtggaaagtgctagcaggaccgtggcgcaacacgccaagaagggagccatcattgttgaaaagagtactgtcccatgcggtacagctcgtgtcattcaagatattgtaagtggccttgattgagatgtcttgactggagacaggatgctgacagcgactagttcaaatactaccgccccaatgacgagttcgagattctatcgaaccccgagttcctggccgagggcaccgccgtcgagaacctcatgcacccggatcgcatcctcattggcagtgcccgcaccttggccggcatgaaagcggccgagagtctcaagaacgtatatgccgcgtgggttcctcaagaacgtatcattactgtcaacacctttagcagtgagctgtcgaagcttgtcgccaacacgatgctggcccagcgtatcagcagcatgaacgcggtgagcgccatgtgcgaggagattggtctgggatcggatgtggacgatgtcagcctggccctcggacaggattcacgaatcgggcccaagttcctccaggccggtgtgggtttcggtgggtcttgttttgagaaggatatcctcaacctctcgtatttggcaagggaactgcacctggatgtggtcgccgactactggctaggtattctgaagatcaacgagtatcagcgtgagaggtatgcgcacagggtggtcaaggagttgaacggatcgctgcgcggaaagaagatttccgtgctgggctttgctttcaaggacggcaccaacgacacgcgcaacagtattgcggtgcacatcatcaagagcctggcggaggagatgccattggagattggcatctttgaccctgggtgcgccgcaaacgagatcatggaggagattgagaagatcggcttgaccaaggcgcaactggagcgtgtcaagatttgcagcaactggcgcgaatctgtcaagcaagcgagcgctgtgtgcatcctgacccagtggaagcagttccgcggc

SEQ ID NO: 27664 - DNA, 2138 bp, Neurospora crassa
atggcagccgatgctggtcttgacgcgggcttcattcccgcattgcataagccatctgcacttctgcccatcgccaaacaccgcgaggcgttgctgtacacggtcgaaacgcacccggtcaccattgtcgtcggtcagactggttccggaaagagtacgcaaatcccccagttcctcgagaaagcagggtggtgtgctgatggaaaggtcattgcaatcactcaggtatgccctgcccttctcaatacaccaaacaatccacgcttgacatggatatgctaacctttcccttgttctagcctcgtcgtgtcgctgcatccacggttgccatcagagtcgccgaagagtttggctgcgaacttggaaaggaagtcggcttctccatccgcttcgaggatgtcacctctgaagcaacccgcatcaagttcctcactgacggtcttctgattagagaggcgctcgtcgatcccttgctttcgcgctactccgtcatcatgatcgatgaagcccatgaacgatccatcagctccgacatcttgcttggcttactcaagaagatccgcaagaagcgccccgagctgagaattatcatcagcagtgcaaccctgcaagccgaggaatttctcaggttcttctccgatagcactggcgaggccaagtccgctgacaatgttcagtctgacgagaagcaggatgcccccgtcggcgccatcgtcagcctagagggccgaacctaccccatcgatattctttacctcgagaagcccgccgaggactatctcgagaaggccatctcaaccgtctttgacattcataccaacgaaccaaaaggcgacatccttgttttcctgaccggcagagacgagatcgaaaaggccgtcgaagctgtctccgagcgctcggcccagttgcccgtgggatccgaagccatcttgcctctgccgctttatgctggcctcccgactgagaagcagatgtacgtgtttgatgagactcccgccaatttcagaaaggtcatattttcaacaaacatcgccgaagcctccgtgaccattgatggcattgtctatgtcgttgattccggctttgtcaagctgcgggcatacaatccccagaccggcatcgagacattgaccgcgactcccgtatccaaagcctctgcggcccagcgtgccgggcgagcgggtagaacgaaagccggaaaatgcttccgcctctatacggaggaagcgtaccaggctctccatgatgccaatcctcccgagattcaacgctcaaacttggcacctttcgttctgcagctcaaggcactgggtatcgacaatgtcttgcgctttgatttcctcactccaccccctgctgagctcatgacgcgggccttggagctactgtactcccttggtgctttggatgattacgccaaactcacaaagccgctggggctgaggatggctgagctggctgttgaaccaatgatggccaagacccttctctccgccccctctttcggctgccttggcgaaatgttgacaattgcagccatgaccagcctgggcggttccatctgggtccagcccgatggcggaaaggatgaagcggagagcgcgaggcgcaagttcgctgctgatgaaggtgaccatcttacgcttctgaacgtctaccaggctttcgttaccaagggacgcaaagaggctcggttctgtcatgacaacctgatcaacttcaaggccatgacgcgtgccatgagcattcgcgcgcagctgagaaggtggcttgagcgctttggaatcaccgaggacggtctgtcagtccctcaaccagcagcagcagcagcagcagcagcagcagctggagtcaacaaggcagagcaaatccgacggtgcctgacgacgggttactttgcccatgctgcgcgcatgcagccagacggatccttccggaacgtgtcgggcaccacggtgctgcacgcgcatcccagctcgctcatgttcaaccgtaaggctgactgggtcatcttccacgagatcatggagtccggagagaagacctttatccgggacattaccaagattgagaaaaattggctggtcgagtatgcgtccgccttttacagtacaatgtaaaggcaatcaatcatc

SEQ ID NO: 27665 - DNA, 1523 bp, Neurospora crassa
atgagcgagaagctcatggacaccatccggcactatgcgagctttcctgccaccggcgtcagcttgcgccagatggtccagttcggcgagaagccttctactggtaaggggggacagaaaagacacttggtccgtccacaaagcatcttgcaagctaacctgcgccgccatacatccaggaaccctcttccgcgcctcccaattccttgctgaagagctccccatccgtctcgcccacagagtccaggagcttgataaccttccagatggccttaacgagatgccttcggtcaagaaggtccaggcctggtatgcccaatcgttcgaggtgcgcacaataacagtctcctcttatcccccctccccctgtcccaccatgttagtgaatatctaacgggtcaactctaggaaatcacacaactgccacggccacacctaccaaaagatgttagggagcgcttgatgaagccgtcgagaagcggaaaacacgcctatctaccagaggcgacaccaaaccccagcatagaggaaggccagtacgcctcacacaacggagcaagctacgcaagcggactgaaccacaaaaagttctcggcctcaaggagatactttgctatggttgatgacacaggggattggcctcccgacctacacctttacaaccagaaatttgcgcagactctgcacaagatcaagaggcggcacgacagtgtcgtcaccaccatggcccagggcatcctcgagtacaagcgcaaaaggcaacgcatgcagatcgaccacaacatccagtctttcctcgaccgcttctacatgtcgcgcataggcataagaatgctgattgggcagcacatcgccctgacggaccagaaccattatcgcgatccctcatatgtcggtattatctgcaccaagacgtatgtcaaggacctcgcccaggaggccattgagaacgcccggtttgtttgcgaggatcactacggtctctttgaggctcccaagatccagctggtttgcaaccctaacctcaacttcatgtatgtaccggggcatctgtcgcacatgctcttcgagacgctcaagaactcgctgcgcgccgtcgtcgagacccacggccaggacaagcaggaattccccgtcaccaaggtcattgttgctgagggcaaggaagacatcaccatcaagatctcggatgaaggaggcggtattccccgtagcgctatcccgcttgtttggacctacatgtacaccaccgtcgatcgcacacccaacctggatcccgacttcgacaagagcgactttaaggcccccatggccggtttcggctacggacttcctatctcgcgcttgtatgcgagatactttggtggcgaccttaagttgatcagcatggaagggtgagtagcccggactgcgtcttgaggcgttatgcatgctaacagcttgggatcaatagatacggaaccgatgtctacctgcacctcaacaggttgtcaagttcgtcagaacctctgcaatagcaacca

SEQ ID NO: 27666 - DNA, 813 bp, Neurospora crassa
gccaccaacggtatcgtcctcgccaccgaaaagaagtcctcctcacccctcgccgacccctcctccctctccaagatcagcctcatcacgcccaacattggcatggtctacagcggcatgggccccgactaccgcgtgcttgtcgaccgcgcgcgcaaggtttcgcacacgggttacaagcgcatctacaacgagtacccgccgacgcggatattggtgcaagacgttgcgcgcgtcatgcaagaggccacgcagtccggaggtgtccgcccctatggtgtctcgctgctgatcgccggctgggacgagggtattttgcccgaggacgagctggaggagcaaaagagcaaggacgagatggtggctgacgatggcgagaccaagaagaaggcgacgggcaagacgggcggcatcctgaagggcggccccatgctgtaccaggtcgacccctcgggcagttatttcccttggaaggcgacggccattggcaagaacgccacgacggccaagacctttttggagaagaggtataccgagggcttggagctcgaggatgcggtgcacattgcgctgttgacgctgaaggagacgattgagggagagatgaacggtgacaccattgaaattggtatgttatgcgatggatacggatgcacttgtcttaccgacacaggatgtggctaacatgtttgcacaggcatcgtcggaccaccggcggaccacctccttggcgtcgagggtgtcgagggagcaaagggcccccgcttcaggaaactctctcctcaggagatcgaggattacctgacgaaccta

SEQ ID NO: 27667 - DNA, 3502 bp, Neurospora crassa
atgcctgccgacattcgctcgttttttggtccaaaaggtggcgcgccgcctgctaagccggcaacaccagcacccaagaaggaagaggagaagaagacccggggtagtaagcttgaaccatgatcgccatcacaagcttatcacgttatattaacaatcttgtcgcagggccaagaaaggttgttgaggacagcgaagatgacgaggttgttgagtaagcttagtgaaaagcatctcttctcagaactagcatctaaccagcatgtgtagagtcaaaaagccaaccaaggctgcgccaaagaagaaagtagcgtaagtgtttatgaaacacctctcagttccatgtcatcctattcctgctgacagactatctagggaacccgtaaaaggagttgaaaccgatgctgccaagtactttgcaacctcaaaaacaaaaactgctgctgcgtcccagtcaacaccgaaaaagacacccgcaaaacccgagccagaagaaccaaaagtagcgcttcgaacaagcccgcggaagaaagccacccccgctgccaaagcaccagagcctcccaagactactacaaagaagacctcgactacgaagaaacccacgacggcctacaagagttacgacaaggatgacgatggcgatgcctacatggatgatgagcacgatgctggagaggacatatttgcggcggaattcaagggtggcagcaagaggaaaaaggacgacgactatgccgaggaggacagtgacgaggagctcctccccaagcccaagcgaatggcatctcgcgccaaaacagcagccgtagccgagtctgacgacgaagacgtcaagcctggacccagcaagccgaacaagaaatctacaactactacggcagggaagcggaaatcctcggttgttataagtgacgaggaagacgaagaggaagaagaagtcaagccagcgaagaagaagggagcccccgctaagccccgtgcgccaagggcaaagaaggatgcggcggttgaagaacccgaggacgtcaagaagatcctcgacaatattcccacaattgaagcaccagatgctcctcccaaagaccccaacgtcaagtttgactggaagaccaaggccgccggagctggcaatgcgggtccaccccccatggcgggcactgccgacattcctgaaggtgaaattgattgtctggcgggtaagacctttgtgttcaccggcctgctcaagactatcgcgcgtgaggaagcccaagcactcgtcaagcgctatggtggcaaggtcacaggagcgccatccagcaaaaccgatttcgtcgttctcggcgacgatgcaggacccagcaagctgaggaagatcaaagagcatgggatcaagaccattgatgaggagggcttgttttacctcatcaggacgatgcccgccggtggtggcaccggaaagggggcggagaaggccaagcagaagcgggaggaggaagagaagaaggtgcgtgaagaggccgagaggctagatcgcgaagagaaggctctgcgactggcggctgagaaagaggccaagaaggccgctgctgctcgcggtgtttctggtcccgtccctgctgctctgcccccaccgtcgtcacagctctggacaacaaagtatgcccccacggcgatgaaccagatctgcggcaacaaagccaacgtggagaagatacagaactggcttaaaaactggcccaagtctagaaagtacaacttccaaaagagaggcgccgatggttcaggtggataccgtgctattatcatctccggtcctcctggtatcggcaagacaactgcggcgcatcttgctgccaagatggaaggctacgacgtgatcgagagcaacgccagtgacactcgcagcaagaaactcatcgagagcggtgttagtgaggtcatgaccaacacatctcttctaggtttctttggtggagatggtaagcatgctgatgcccgcaagaagaagattgttctcgtcatggacgaggtcgacggtatgtccgctggtgatcgcggaggtgtcggtactatggccaaattctgcaagaagaccgaggtgccgctcatcttgatttgcaacgagcgcagattgccaaagatgaagcctttcgatcatgtcgcctttgacatcaagtttcagcgtcccacggtcgaccagatccgctcgcgtatcatgaccatctgccacagagaaggtctcaagatcccgccaccggtcgtcaatgctctcatcgaaggtagcggtagggacattcggcagatcatcaacatgatctctacagcgaagctggatcagaccaccatggattttgatcaaagcaagcaaatgagcaaggcctgggaaaagcacgtcatcctcaagccttgggatatttgccagaagctgatcggcggtggcatgttcgccccttccagcacggcaactctgaatgacaagatcgacctctactttaacgatcacgaattctcctatctcatgatccaggagaactacctccgttccaggcccatggtcctgaaccaaaagggctacactccaagggaacaaaaccttaagtacctcgaactcgtcgacgaagcagctgaaagcatcagcgatggtgatctagtagaccgcatgattcatggcccccagcaacaatggagtttgatgcccacacacgccgtcttcagtactgtccgtccctcaagtcttatcgccggccaattcgtcggacaggcccagttcacttcctggctcggcaacaacagcaagtacggcaagctcaaccgcttcaaccgcgagatccacgcccacatgcgcctcaagtcctcgggcgacgcccaagaaattcgccagcagtacatgcctgtgctgtgggacaagctcgtcaagcgcctcgaggtggagggcaaggattgcgtgcccgaagtcatcgatctgatggatagctactacctgacgagagaagactttgactcgatcaaggagttgggattgggtcatatggcggaggagacggtcaatattgagacgcagactaaggctgcttttacgaggatgtgagtttcttttccctccccccattttaccacccacctcattttactaaccatccctcccttccacaggtacaacgcagcctcccaccccgtccccttcatcaaagccagcagcgtcctcgcccccaagaaactcgccaaggaggtgcccgacctggaggaagccatcgaggaagacttcgagggcgatgacgccggccttattgatgatgccgcggaagttgacgaagacgaagatgtggatatcaccaaggataagtatattaaacagcccaaagcgaagaaggctgccgctaagaaaagtaccgctgctgctggcaagaagaaggcggcggcgaaggccaaggatgaggatattgtagatgatgacgaggatgatgaggatgttggagcgaaaaagccggctgcaaggggaaggggaaggcctgctaag

SEQ ID NO: 27668 - DNA, 1181 bp, Neurospora crassa
cttattgttgacaagcacaggccgaggtctctcgatgccctcacctatcataccgaattgtcggagaggttacggtcacttgtaagtagaccctcttgttcccctcgtgcaaaagaagctccccgctgatgacactcctaggcgcaaagcggtgactttccccacctcctcgtctacggtccttccggcgcaggaaagaagacgcgaattgttgctaccctcaaggagttgtacggcccaggtgtagagaagatcaagatcgacgcccgtgttttccaaaccagcagcaaccgcaagctcgagttcaacattgtcgcatcagtgtaccacctcgaaatcaccccgtccgatgtcggaaactacgaccgagtagtggtccaggacctcctcaaggaggtggcgcaaacacaacaagtagatctgtcggcgaagcagaggttcaaggtggtggtcatcaacgaggccgaccacctcaccagagacgcccaggccgccctccgtcggaccatggagaaatactcgcccaacctgcgcctcatcctcctcgccaattcgacagccaacattatcgcacccatccgatcgcgatgcctgctggtgcgggtagcggctccgacacacaaagagatctgtgacgtccttgcttcatcggcgaagaaggagggttggccgattgtcaagggtctacaccagaggatcgctgaggaaagcggaaggaatcttcgcagagcgctgttgatgtacgaggcggtatatgcgcaaaagtaagcagtacaccctaacccgaaggcctgtcacgccttgcagttgctaacaacaaacgccgccatagtgagaaagtcacagatagtacgcccataccacccccggactgggaggctctcatcgggcaaatcgccaaggagattatggaggagcatacgccagcacgcatcctccaagtccgagcgaagctttacgaccttttgacgcactgtatccccgcgacgatcatcctgaagacgctcacattcaaactgatccccctgatcgacgacgcactgaaagcggatgtaatctactggtcggccttctatgaacatcgcatcaggacgggtaccaaggtgattttccatctggaggcgtttgtggccaagtttatgaggatattcgagatgtatctgatgagcatggacttgtga

SEQ ID NO: 27669 - DNA, 1567 bp, Neurospora crassa
atccacgttttgcattatcgttgcaccaccatcaccaccatcatcatgggttacaccactctctggaagaggctgtcgcctacccagctcaatctcgccatccagaccttctccctcatcagtatcttctttgaaggttatgatcaaggtgtgatgggaggtgttaatgcctctccacgttatgtcaccgaggttggtatcggcttgcctgatggcacagtaacggacgaagttcaccagggtggtattgtatcagtctactacgtcggatgtatctttggttgctttgccggaggatggcttgcggataggattgggcgaattaacgggtatgtgctcctacctccctacctacttacctacctactacatcttagaagatactgccccctttttttttggttttgaagaagtgatctgatagctaatgacttcttgatggtattacattagtctcttcatcggagccgtcctctccctcatcggcggtgtgctgcaggcggcgactcagtcgagcgacttcatgatcgtggcccgtgtcgtgaccggtctcggcaccggcgcccttaccggcatcacccccgttctcgtctccgaaacctcaacagcatcacacagaggcggcttcctcggctacgtcttcatcgccaactacctcggcatcgcagtcgcgtactggatctactttggcatgtccttcctcgacaacggatactcggacgttcaatggcgcttcctgcttgctttccagtgcttccctgccatcctccttgtcctcggaatcaagcttctgcccgacagccctcgatacctagcctcagttggccggctcgatgacgcaagagaggtcctggagcatgtgcgaggaactcacgatgccactgctgtcgagatggagttccaggagattgccgctgttgcgaagacgagccagaagagctcacccattcaattcgcccagatcctagctggacaaggcggcaaacccggttctcatcttggccgcagggcgtggttgtgcatgctcttgcagatcatgggttcatggaccggtatcacagcagtgacggcttatgcccctgttctcctctcagccgccggttacgaccgtcttacccagaacggcctgaccggtggccttagcaccgtcggtattgttggaaccatcatcagcgcccagatcgtggaccgccttggtcgccgcaagtgcctcatgggcggatcattcgccttgttcgttgtcaacctcgttgccgcctgtgtctacgaaggcgcaagggcacacccggagcgctcttcatcctttgctcctgctgctgtcaccatgctgtttctcttcaacatctgctacgccgcaacctggggtactgttgcgttcctgatccctaccgagatctggtcctcggacatgcgtgcccagggcaacggcttcggtatcacggggtgggctattggtgttggttggaccgtgctggtcaaccccatcatgttcagacacctcgagaacaggacctacttcctctttgcgggactcaaccttctttggattcccattgtgtacctctgt

SEQ ID NO: 27670 - DNA, 2196 bp, Neurospora crassa
gcaaccctatggaaatcgccagagaggatagacaaggccagcgtccagctgtatgatgcctttagagatgcatgcggctaccaggctggagttcaggtcaaggtcacagtccaggaagggaagctccccgaagccgaagaggtcgtcctcgaacagctacctcccgagaaggctggcaaagatgcagagactgccgcatctatcgacccgtccgatcttcccggctgggagttcttccttgccggaaggctttctatgatcgagcatgtccacgctggtttgacgttcaagaacctctacgctaggggcccgcagaggtcgttcgtggtggcttcggtaaatgggcggccaaccggcaacgcgcgctatttggatggcaagacgaaagtcaggataggcgcgccttcgcccgctggccaggtggacggagtgccccagggaaagctggaggtgacaggtgttcgtggactggacgctcagatcgagaaactcaacgacctgctgtctcagttcaccgacccctgggtcttccagggcaagcctaggtaccgcggtatcgtgattcacggcggtcacggcacgggaaagagcatgctcctaaacaccattgcggctactggatggggcacagtctatcgcatccagcccaaggacaagcttgccgatatccaggacatgttccagaaagctagacttgaacagcctagtatcatcctgatcgaccaactagaaaggttaatcgacaaggagaggaacaaccgcacctctgtgatacaggccctgtgcgaggcactggacactctgggggccgacgcccaggaaaccggcgagattcccaaggtagctgtcgtcgtcacttgcttagattacacaaccgacgtccccgaggatctcaaggatcccgggaggctcacaggcgaggtgtacctaccactgcctgacgtggatggccgcaaggagattcttgcctctttcaacctgcgcgtaacgcccgaggaagaagacgctcttcttcgcagcctcagcgaacgcacacatgcctacaacggcaaggatctccggcgtattgtcgacgaagccgagttcattgcaagaacgcgaatcaacagggtaaagaagacgacaacaccaacatcaaccgaggacgtgatcagtcttgatgatcaacctccggcaacagaagaagtatcaaccctccttgagtccatgcacctgtccccttccaacgccagcacagccaccaccaccaccaccctaacatcctacttccttgcctccgactacgaagaagccctccgcctcgtccggccctccgccatgcacgacgtgaacctcaagccgcctcccatccactggtcggatatcggcgggcaagcctccgtcaaggtttctctccgacgcgccgtgcgcatgtccaccgaacccgtccacgtgttatctcgcttcttcgcccgcccacccaagggttttcttctgtatggcccacccggttgctccaaaaccatggcggcgcaagcgatggcgaccgagtccggcctcaacttctttgccgtcaagggcgccgagctgctcaatatgtacgtgggcgagtcggagagggcggtgcgaaggctgtttcagagggcgagggaggtggcgcctagtatgattttctttgatgagattgattctattgcggggcagcgggccggttttgggcatggcggatcctcaacatctgggggaagtagcagtggtctgaacgtgttgacgaccttgctcaatgagatggatggcttcgaggctttaacgggcgtggtggttctggctgctaccaacaggccgcaggcgctggatccggctttgctccggcccggtcgctttgatgagctgatttatgttagcccgccagaccaagaagcacgcgcggcgatattcaagaaggaggcggagaagaggcagatgctaatcggtgatgaggacatcaaaaggttggcgactatcacggacgggttctcgggcgcagagattaaggggatttgcgcggtggcgggaacgagggcttatgatcgctatctaaagctggattcggttgaggaggatacagcggtaggtataacgatggaggatctggagatggcggctaaggggatgatgaggcagattacgcccgagatgattagaggtttcgagcagtgggagaagcagtttaggagg

SEQ ID NO: 27671 - DNA, 1371 bp, Neurospora crassa
caaccctcgacgacaacaacatcaaagacagtcgccagccgtcgccatgccagctcgctctcccagagaccagatgctagccatgtcatgtttccgggagccgtcaaatctgctttctgcaacaccatgacctttgaggaaccctcaaaatacgatgctctaccaacctaccgggccgtcgaccaacacggccaagtggtcgacccttcgttcaagcccgacttgagcgataaggaagtgatcaagctctaccacgacatgctgacggtttccatcatggacctgatcatgttcgatgcgcaacgccaaggccgcctcagcttttatatggtatcagcgggcgaagaggccgtttgcgtggggagtgcctcggcgctttctccggaggacgtggtgttctgccaataccgcgagcagggtgtattcaagcagcgcgggtttcagttgagtgactttatgaaccagctgtttgctaaccacaaggattcgggcaaggggaggaacatgccggtgcattacgggagcaaagagttgaatattgtaggtttatgttgtctttttcgggctcatgtcactatccttttcggaataaaataatggctaaccttgttgtttgactattagcatacaatctcctcgccattagctacccagcttccccaggctgccggagctgcgtatgctctcaagatccaaaggatgcaaaatcccacagtgcccccgagggtagtagccgcctatttcggcgaaggcgccgcaagcgaaggtgatttccacgccgcgctcaacattgccgctacccgtggctgcccagcggtcttcatctgccgcaacaacggttacgccatctcgaccccaactctggagcagtaccgcggcgacggcatcgccagccgcggcctcggctacggcatcgagaccatcagggtagacggcaacgacttctgggccgtgcgggaggtgaccaagcgggcgcgcgagctagccctacaagacggcggcaagccggtcctgatcgaggccatgacttaccgcgtcagccaccacagcacgtcggacgattcgtttgcgtaccgtgccaaggtggaggtggaggactggaagaggagggacaacccgatcggaaggctgcgcaagtggatggaggccaagggtatctgggatgagaacatggagagggaggcgcgcgatagcatcagaagagacatcctcaaggcgttctcccaggcggagaaggagaagaagcctgctatcaggaccatgtttgaggatgtgtatgaggagatgacgccggagatcaaggcgcagatgaaggagttgaaggaacatctggagcagtacccggaggagtatgaccttggggattttgag

SEQ ID NO: 27672 - DNA, 2616 bp, Neurospora crassa
cgcgatctcactcgaaagtcccttagcttcgacgacaatcaagtaggggtcaagttcggcgaaagcgaggacgaggaagaagaggtagagaactcaccttatccagaagtccgagccgccgttcccaactttgatcaggacctgccatgtaacaccatcagggcgtggaccattggacttgggctcatatttcttggggcttcaatgaacaccatcttctcactgagagccccatcaatcagtctcgggtcacttattgcccaaatcatcgcttggccgctgggacatggctgggccaggtttatgccgcaacgtgagttcaacacctttggtaaaaggtggactctgaacccggggcctttcaacatcaaggaacactctgtcattgttgttatggccagtgtctccttttctgtggcctacgctaccgacatcattttggcccaaaaggtgttctacaagcaggactttggcctattatggggggttctccttacgatatcgacgcagagcctgggctatggaattgctggaatgctaagaagatttctcggtaagttctgtatgatttccaaggttacgaattcattcattaactttactatcatcgatacagtctatccagcttccatgatctggccgggaaacctcgtgggagttaccttgatgcacgccatgtacgggcagaacgagaagaaggatcccacaataatgggtggctcaatccctcggtaccgatggtttgcctacatcaccctcggctcttttttgtactacttcatccccggtttctttgcacagttcctcagctcctttgccgttgtgacttggatggcaccaaacaatcctgtcgtcaaccagttgtttggctactcgacgggcctctccctgcttccgatcacgttcgattgggcgcagattacaggatatgttggctcgcctatggtacctccatggtaagatcaaatgtcaccatgccttagactctctaaaaggcaatgctaacactccagttaggcacgcaattgccaatacattggccggcgtcgtgatatttttcataattgccgccagctttttgcagtacactggagcgtggtacggcaagtatctgccgatgagcgactccaacgtctatgacaatacgggcaagacatatgatgtttcacgagtccttagcaaggaatttacgctcgatgaggaggcgtataacacttactcgcctctgtttctcaggtacgttgcgcccccctcccttttggtgcgattccaacctacagctgtgatctaacttgagcatagtacaacatttgccatagcgtacggtttgtcctttgctgccatatcctcactgatagtgtacacgtacctacatcatgggaaaacaatctggagacaatggaaaaacagcacgagcgagaggcctgacgtgcatatgaagatgatgaggaagtacaaggaggccccgacgtggtggtatatgtcgctgtttgcagtggtgagtacgaacttttgccttgactaacacataacatgtagaactaaccactgtgcatgaaaactagatgctcgccctaggcttcttcaccgttctcggctggcaaaccaacctcacatggtgggccttcctcctcgccgtctttatctcgttcgccttttcccttcccatcggtatcatccaagccgtcaccaacaaccaaatcggcctgaacgtgttgaccgagtttgtgtttggatacatccagccaggccgccctctagcacttatgatgtaagaggcctcccccttttcttctcggtctttgtcccttttatccatacctaggtaactaaccaaaaccgcaccccttgcaaaataacagcttcaaaacctttggctacataaccatgtcccaagccctcaccttcgtcggcgacctcaaatttggtcactacatgaaacttcccccccgcgtgctcttctccgcccaagtcgtcgccaccaccttctcctgcatcattcaaatcctagtactcaacttcgccctccgcactatccccgaagtctgcaccccttcccaacctcaacacttcacctgccctggcggtcgcgtctttttttccgcaagcgtcatctggggcctcatcggccccgcccggatgttctccccgggccagatctactcttctttgttcctgtttttcatcctgggagccgtcgtgcccttgggtatttggttgctccttcgtcgtgcgcaaaagcggaatccgcacacaaaaacatggctgcgctacgtcattgcgcccgtcatctttggcggcgcgggctctatcccgcctgcgagtccgctgaactatttgagttggggcatcgtcgggtatgggtttcagtacgtagtgcgcaagaggcactttgggtggtggagcagattgaacttcttgacaagttgcgggctcgatctgggactggcgctggcgacgctggtggtgtttttcgcctttaccatcaacgagattagtccgcctagttggtggggaaatgacgtggtaaaaggcacgttggatttcaaggggatggcggtaagagagagagtgggggaaggcgagacatttgggccgagggtttgggctcttgga

SEQ ID NO: 27673 - DNA, 1443 bp, Neurospora crassa
atgagacgcgtggtagtgacaggcctcggtgccatcacgcccttggccgtcggcatccgtcccacctggcgccggctcttggactctcattcgggcatcgtcagcgtcgctgacctcgagccccaggacaaatggaaggagctcaccagcaccgtgggcggccttgttcctacgcctgcgaggaacaagcagaatgttgacgagcagcacacttggaaggctgcggactggttggagccttcggaccagagacgcatgtctctcttcgcccagtattctgtcgctgctactgaaatggccctgcaagatgctgggtggaagcccacgaggcaggaagaccttgaagccacaggtgtctgcatgggaagcggaatcggtaacttggatgacttttataacaccagcgtcacgtatgacaaagaggtaagagcgcacacaggttcgaccttgaacctgatgtacctccgtgatgtacgagtctaacatgcttattgtagggctacaagagggtctcccctctctttgttcccaagattcttatcaacctcggggctggccacatcgccatgcgctacggtttccgtgggcccaaccactctgccaccaccgcttgtaccaccggcgctcactccatcggtgatgcctcccgcttcattgcctttggcgacgctgatgttatggtcgccggcggctccgagtcctgcattcaccctttaacttttgctggctttggccggtctcgctcgctgtctaccgcgtacaaccacgatccgacatctgcctgccgaccctttgacaaggaccgcgccggcttcgtggtatccgagggtgctgctgtcctcattctagaggagctggagcacgccaagaggcgcggcgctaggatcttggccgagctgacggggtatggatgcagtggtgatgcacatcacatgacggcgccaagggatgatgggtcaggggcattcctgtctatgaagagggcgctcaaaaatgcgggtgtcaagccgggggacgtggactatatcaatgcccatgccacggggacggctgtaggagatgcggctgaggcgattgccattcggtcgctgatgatgggtgaagaaggagtggacgacgagtccaggattacggtgagcagcaccaagggagcgattggtcatcttcttggtgcggcgggggccattgaatctgtgttttcgattctggccattgctgaggtgagtgtctggaatgtagcgcctgagagttgttgcctctgctaatatgtgaccacagggagccataccccccactctcaacttgaccagtcccaatgtcggtgttggattcaactttgtccctgttcaggcgcagcaaaaggaagtcaaggtggccatgtccaacagctttggcttcgggggcaccaatgcctccttggtattttcaaagttcgagtagcca

SEQ ID NO: 27674 - DNA, 823 bp, Neurospora crassa
ctcacactcgtcctcgccgccacgcgcgacatgggcattggtctcaacggtggccttccatggactggtctcaagaaagagatggcctactttgctcgcgtaaccaagaggttgcccagtcaggtaatttgactttatgtccttccttcccttctttttctgtcctcgtcgtgtacctcctcccctccctcccttgctttccttgcaacgcaatccccctcccccaatcaagactaactccacatcgcagctcgccggtaccaaagccctcaacgccgtcataatgggccgcaaaacatgggagtctattccgcccaagttccgtcctctcaaaggtcgtctgaacatcgtcatcagtcgctcagtcacttcatctccctctctttcctctccgtcttcgtcttcttcttcttcttctgaagtagaagagggaccggtcatggcttcttccctcgagcaagctatcgagtatcttcaccattgccagcagcagcagcagcagcagcagcagcagcagcagcaagagcaacaacaaaaagttggcaaggtatttgtgattggcggcggacaaatctacggcgcggcgctgaagctacccaaggaggtaagcaagcggatcttgttgacgagggtcttgagtccggagtttgagtgtgatacgttttttcctttggagttgaaggaggaaggggaggcatcaggatctgaggaatgggtgaggaagagcaaagaggagttggaccagtttgtgggcgaggaggttcccgagggattgcaagtcgaaaatgggacggagtatgagtttcagatgtgggagaggagg

SEQ ID NO: 27675 - DNA, 2207 bp, Neurospora crassa
cgaatcctgtgtgtggctgaaaaaccgtcgattgcaaaggcggtcgctacacatctgtctggtggctcatatcaaaccgtgggttgccgcttcgtcttcacaatgtctggaagagatcattgctaacgtgctaggcagcatgacactcgggacaggtataccaaaaattatgttttcacttgcgatttcggccctccctggggacgatctacggtcaccatgactgctgtgaggggacatctcacgcagctagactttcaccaggagtttaagaagtgggaatacccaccaccagatcgcctctttgacgcgcctgtccagacagtctatccgcatgtatgtctcgccatcgccaacaagtgtcgggcacatcatccttgcttgcatttttgatgttgacaaagggattcatgctaggacatgaagaatattgcccagaacatcgaaaaccaggctcggcaagctgacatactctacatctggacggattgcgatcgagaaggtgagcacattggaagtgagatccgggaggccgcaaggaagggcaagaggaacattcaagtctacagagcaaggttcagcaacattgaacgagcgtgagttcgccatccaggtgtctaaacccaagcataactgacatgccgaacccgatatccagacatatcctgtctgctgcccgacgtccggtagccttggacgacaaacaggctgaagcagtcgctgcgcgtatcgagttggacctgagaatcggatctgcattcactcgctttttgacgttaagtctgagaccccttggtggggcaatggccgaccttgtgctcagctatggtaagtccgaatggagcttatactgtcattatgagtctgactgaacaggatcctgtcagttcccaactcttggtttcgtcgtcgaccgatacttccgcgtcagaaactttgttccagaaccgttctggtctatcaaggtgatgcacgagaaagaaggtgtcaaagtcaacttcaactggtccagaaaccgtctgttcgacaggttgtccgtgctcctcctttacgagcgatgtctcgccgccaagattgcaaaggtcacagaagtcaaagaaaagcaaaccaagaaatggaagcctcttcccctcaccaccgtcgagcttcagaagatggccacacggtttcttcggatgacgggtcaagaagccatgacggtagcagaaaaactatacaacaagggtttcatcagctaccccagaacagaaacagaccgctttgacaagggcatgaacttgcgggcgctcgtccaaaagcaaacccaggaccaacgctggggtcccttcgcacagaatctggtcgacggagccttccaacaacctcgccaaggtaggaatgacgacaaggcccatcctcccattcatcccatcatatatgcggcacccaccgtgcttgacgatcaggaaaaaagactatacgaattcgtggtccgccgatttctcgcctgctgctccgaagacgccagaggagcagccaccgacgtggaaattacctacggcgaagaaaagttcgtcgcccatggcctgatcgtccaccagcgcaactacctcgacgtttacccttacgaaaactggaccggaacggccgggctaccgaaattcaccgtgggcgagacgtttgaaccgaccgaagctatgatgaccgaaggcaagaccactgcccctagctatctgaccgaggcggatctgattgccctcatggacgcgaatggaattggcaccgatgcgaccatggcccagcatattgagaagatcaaggagagacagtatgtgcaggtggttgagcgaggaggtaatggaggcggcggtaacgacgaggatgacggtgcagctggtggcgcacggggcggacgcggtggccggggaggacgtggaagaggtggtgggcggggcggacgaggaggaggcggagttggcggtggtggcgctcgcggtggtgtcaaggagtttatcccgaccagcctgggtgtcgccttgattgagggctttgagaggatgaacttcgaaaccagcctcggcaagcccttcctccgcaaggagatggagctcaagatgaaggcaatttgcgaaggtcggcttacaagggatgccctcttgcgggagagtattgcgagttatcgtcaagtttatgatcagtcacgggaggaggtcaacttgctgaaagct

SEQ ID NO: 27676 - DNA, 3243 bp, Neurospora crassa
atcgacattcccgtccaagaccaagatgacgaagctgtcgaaatcgaccttgaagtcctcgccgatgacccgaccgagctctgcacccttttcgagatggaaggcgccgcccggacatattggatgacagtgtccctcgcctacgccaagcagaaaaagatcgacttcgccatcgagatgctaatcaaaggagccaacgccatgcaggccaacaaccccagggagaagctcagtatcgtctcagctctctgctggatgtatttgtggaagagcagggaagcacccagggtagcccccgaggacgcccttgtctccgaagcaaagaccaaagaatactacctccagctcgctacccagagcctcaacgaagcttcccgcatcaatccagctttccctccgctcttcctggctcgtggcgtcctccagcttctgagggcatccctccagccaccatcaaaggctcccggagcagtcgaccccgaaaagaccgaaaccctgcgcgccgcccttaaatctttcgacgatgccctccgagtttccagcggcaagaacatgcttgccgttattggcaaggcccgcgcactcttctcgcttggcagatatgccgacgctttggtcgcctaccaggacgccctagccagagccccagatctcgtcgaccccgacccgcgaattggcattggctgctgcttctggcaattaggatacaaggatgacgccaggattgcctgggaacgagctctcgagatcaatgctgagtccaaggtcggcaacattctgttaggtctctactacctcgacgcgagcggacacgtccccatcaacagcccggaattcatcaagctgtacaagaaggctatgaccgagtacacacagaagtcctacaagcttgacaaagatcttccccttacatgtgccacatttgccagctattttctttcgcgaaagcaattcgatcatgtggaagctctggcccataaggccatacagtttactgacgtcaacgccattgcgagcgatggttggtacctgctcgcgcgcaaagaacattacgccaataacctcgagcgtgccgccgattactaccgtcgtgcggatgacgcccgaggtggcactgaacgcggctacctgccggccaagttcggtgcggcgcagctgtccgtcatcaagaacgacctaggtgaagccaaacttcgcctcgagaagatgattcaacagtccaagaactatgaagccatgatcctgctcggcaacttgtatgccgaggaggttttcgccaaccagtttgccccggtcaaggaggataagtccgccgaggcaaagaaggccatcagcctgctggagagcgtgcggacggcgtggaaggatcctaagaaaagcctcgcgccagatgccgctgtgcttctcaacctagcccgtctctatgagaccgagaaccccgacaaggccctccagtgccttcagcaagtcgagcagctggagcttgaccaggttccccaatcagagcgcccggatgaagttgagggcgaagccgctatcaaggctgcgctccggaggtttctcccgccgcagctgttgaataacatcggctgtttctactaccaggaagaaaagcacgagcttgcgagcgaactgtttgaggctgcactcagctcttgcatgagaattggtgagaaggacgatgacaccgacaccgacgccttggttaccaccatcagcttcaatcttggccgtagttacgaggctcgtggcatgtctgagaaggccgttgaggtgtatgagggcttgctaaaacgccacgatgactacactgatgctcgtaccaggttggcctatatcaagcttcggaataaccccggcaccaaggaaggcccggatgcagtcgccaagctgtatcaagagaactcttccgaccttgaggtgcgtgctttgtacggctggtttctcgggaagcttagctccaggaagcgacccaacaacatcgccgaagacccagagcaacgccattacaagcacaccctgcagaactacgataagcatgaccgctatgctctcgttggcatgggcaatctacaccttatttctgctagggaaatgcgtcgcgagtcggaggcagacaggcagaagcggagtgccgcctacagccgtgctgttgagttcttcgacaaggcactccagttggatcccaagaacgcatacgcagcccagggaattgctattgcactcgtggaggacaagaaggactacaagggggcattgcaaatcttcatcaaggttcgcgagaccatcaaggacgttcacgtctttgtcaacttgggccacatttacgccgagttgaagcagttcaccaaggctatcgaaagctacgagatcgcgcttggcaaggagggcaaggcaaaggatgccaacattctctcatgccttggtcgtacgtggctgaacaagggccgcgctgagcgtaacttggacgcttacaagacagcattggagtatgcgcagaaggtatgttgattccaacaccaaagttgaaggcagtgactaacactttttcagaccctcgaagttgcccccgagcaggtccacttcaagttcaacgttgcttttgtgcagatccagctcgcctcgttcatcaacggtttgcctgagcaccagcgcacctctacccaactcgaggaagctgcatccggtctcgagtcggctatcaccgccctcgacgagatcgcggcctcggaccatccaccttatccaaagcatgatatcgagcagcgtgccaacatggctcgcaacactcaacgtaaacagctcgagcgtgccctcgcctcccagcgggattacgagtcaaagaacaaggagaagctccaactagcacttgagcagagacaagtagcactcaagaagaaggaggaagagattcgcaggaaagaggaagaggagcgcgagcgccaagagaagatcaagcgcgagagagaggagatcgccgcccgtgaccgcaagttagctgagcagagagccgaggaagaccgacagcgtagggaggccgagatgaccaccgacagcgagaccggcgaaaagatcaagagacaaaagattaagaaggccagcagcacgcctgccaagcgcgagagaggtggcgaggagcgggagcggaagggccgtgctcagaggaagaagaagacgagccgaagggaccgagacaatgacgatagtgacggctcaggctcggatgccgaagagggcggcagg

SEQ ID NO: 27677 - DNA, 2721 bp, Neurospora crassa
tttacagaccgggccaagaaggcattggaggatgccatggccctggcagagcaatacgcccactcgcaactcctccccgttcatctggcagtcgcgcttctcgaccctctcccagatccgagcaaggaccagcaaaatgcaccagccggggcaaccagctctctcttccgccaagtcattgagagagcccacggcgatccccagctgttcgaccgcgccctcaagaaggccctcgtccgcctccccagccaagaccctcctcccgaccatgtctcgatggctccttccttccatacagtcctgcgcaaggccaacgagctgcagaagacgcaaaaagacacatacattgccgtcgaccaccttatcacagccctggccgaggagccctcgatcatgaatgcgctcaaggaggccaacattcccaagccaaagctcgttaccgatgccatccaggccattcgcggtaccaagcgcgtcgactctcgcaatgctgacactgaagaggagcacgagaatctcgccaagttcaccattgatatgacagccatggccagggaaggcaagattgatcccgtcattggtcgtgaggaggaaattcggagagtgatccgtattctttcacgtcgtaccaagaacaaccctgtccttatcggtgagcctggtgtcggtaagactaccgtcgttgagggtctcgctcagcgcatcgtcaacgctgatgtgcccgacaatctggccaactgcaagcttctgtctcttgatgtcggtgccctggtggctggtagcaagtacaggggtgagtttgaagagcgcatgaagggagttctgaaggagatctccgagtccaaggagatgatcatccttttcatcgatgaaatccatttgctcatgggcgctggcgcgtccggagaaggtggcatggatgcggccaaccttttgaagccaatgctcgcccgtggtcagcttcactgcattggcgctaccaccctggccgagtaccgcaagtacatcgagaaggatgctgcctttgaacgtcgtttccagcaggtcattgtcaaggagccttccgtttctgagacaatctccattctacgtggtctcaaggagaagtacgaggtgcaccatggtgtcactatttccgatgctgccattgtggccgctgcaaatcttgcggcccgctacctcacttcccgcagacttcctgattcggctatcgatttgatcgacgaggcggctgccgcagtcagagtcgctcgagaatcgcagcccgaaatcatcgattccttggagcgcaagttgcgtcagctcaagattgagattcacgccttgtctcgcgagaaggatgaggcttccaaggctcgtcttgaacaggcgaagaaggatgccgagaatgtggaggaggagctcagacccctccgtgagaaatacgaacaggagaaacagagagccaaggctctccaggaagccaggatgaagcttgagagcttgagacaaaaggccgaagaggctagcagaatgggagatcacagccgtgctgctgatcttcagtattacgccatccccgagcaggaggcagtaatcaagaggcttgagaaggaaaaggctgcggctgacgctgcgctcaacgccgctgcggccgaaaccggcggtgccatgatcaccgatgtcgttggtcccgatcagatcaacgagattgtagcacggtggaccggtattcccgtcacacgcctcaagaccagcgagaaggagaagcttttgcacatggagaagcatctcagcaagattgttgtcggtcagaaggaggccgttcagtctgtgtccaacgctatcagactgcagcggtcgggtctctccaaccccaaccagcctcccagcttcctgttctgcggtccttcgggtaccggtaagactctgctcaccaaggctcttgccgagttcctgtttgatgatcctaaggccatgatccgtttcgacatgtctgagtatcaggagcgtcactctctcagccgcatgattggtgctcctcccggctacgtcggtcacgactctggtggccagctgactgaggcccttcgccgcaagccgttctccatccttctctttgacgaggttgaaaaggcagccaaggaggtcttgaccgttctgctacagctcatggatgacggtcgtatcacggacggtcagggcagagtcgtcgatgccaggaactgcatcgttgtcatgacgtctaacttgggtgctgagtacctttctcgtcccaacgccaaggacggcaagattgatccaaccactcgcgagcttgtcatgaacgccctgcgcaactacttccttcccgagttcctcaaccgtatcagctcaattgtcatcttcaaccgtctcactcgtcgcgagatccgcaagattgtcgagctacgcattgcggaaatccagaagcggctccaagacaacgatcgcaatgtcaaaatcgaggtgtcggaagaagccaaagacaagctgggtgctcttggttactcgccagcttatggcgctagaccactgcaacgtgtgcttgagaaggaggttctgaaccgcttggccgttttgatcctccgtggcagcatccgcgacggtgaggttgccagggttgtcgtccaagacggcaagattacagtccttcccaaccatcccgaggtcaatgatgaggacgacgaaatgatgttggatgaggaagacgcagttgacgag

SEQ ID NO: 27678 - DNA, 929 bp, Neurospora crassa
atggcctccgctagcgtgtcttcgacaggtacatctacatccgagtcatcctctagcgccggctacgaacagtcgatatcccctaaacaattccaccttggcatgtttgaaatcggtcggccgcttggcaaaggcaaattcggccgcgtatacctcgcgcgggagcgcagctctggtttcatctgtgccctcaaggtgctctacaagtcggaattgcaacacggcactggagtcgagaagcaagtgcgtcgcgagatcgaaattcaatccaacctacgacaccccaatatcttgaagttgtacggacacttccatgacagcaagcgcatctttttgattctcgagtacgccggcaagggcgagctgtacaagcacctgcgcaaggaaaaccgtttccccgaatggaaagcagcgcagtatgttgcgcaaatggcatccgccctcaaatacttgcaccgcaagcacgtcatccaccgcgacatcaaaccggagaacattctagtgggcattcacggggaaatcaagatatcggatttcggctggagcgtgcacgcgcccaacaaccggaggcagacgctctgcggaaccctggattacctgccgccagagatgatccggagcggatccaaggataactggtacaatgagaaagtggacttgtggagcttgggcgtgttgacgtatgagtttttggtcggcgaggcgccgtttgaggatacgccgatcatgacacagaagaggattgcgagggcggatatgaccattcccgagtgggtcagcaaggaggcaaaggatctgatcaagaaggtaagaagtcattgtttcccataaggatggtctttcaatgctaacccattatccagttgctggtactcgaccctgagaagcgtcttcctttggaggaggtggagaaccacccttggatcttg

SEQ ID NO: 27679 - DNA, 2532 bp, Neurospora crassa
tccgactccgactttatcgatcagctcattcctgtcctcaaagatgcgacagcaagcggccgaacagcaacgctcgtccagagcctttcccagtatgcagaggagcgggagggcgacatcgaacggatcggcttgacgcaacacgaagagtttcttggttccgtcagccaactacaaacgatacgcgaggagactgtggccctgactgccgaaattctcgatttaaaccagtcgatccaagcaagtaccgaaaagttggcggagcagaaacaggcattggtcgatacacgccgcgtccgccagaacatcaccgacgtctccgatgcgctcagggaatcgctcaagatcatgcatgctgtcaacaacgcccatgacctgattcgcaagaagaagtactatggcgcgctcaaatcgctggaggacctgcagaacgaatacctagtacccatcatccagaacaagtacgccacccagtaccggctggccgatttgatacaaaagtctattcccgcttcgcggaaaaccatctcggaggctgtcatgaccgatttgaacacttggctgtatcgcattcgtgagacctcacagtttcttggcgaggttgctttctttggcacaaggcagcggctggaccgtcagcgagaacgtgccgaacaaaacccatacctgggtcacttcaaactgaactctgcgatcgagctggttttcgacgagagtgatgagtttgatgtcctcgataacgaagaagtccaggtcgactttacaccactacatgaagcgcttcatattcacgaggcgctgggtcaaatcgacaaattccgtgccgagtatgcggccactcggcgtcaacaaaaggaacttctcatgccgagttctgtgaatttgtcatccgacgaggaagaaaactcacttcgtgatcttctggagcaaatcactgggttcgccgtgattgaaaaagcaacgatacagcgtgctccgcaactgcgatccacagtcgaagttgacgagttgtgggattccatgtgccagactgccatccgcctcatttcaagatccctcacagacgtggacaatgctgaactgcttctgaaaatcaagggggatattgcgttattcatacagacaatggaggtgagtagtctcgtgcctgttgaagtcttcgggacgctaatttgtcttgcagagctggaattactccgtttccacgttgaacaacttccagttaaccctcttctacaagtatgccgagctgctcaagcgcagattcagcgatgactttcaagagattgtctcaaccgacgattatatgcccatgcaaatcaacaacgccgaggagtacgaaaaggtcctcaaagtcagttggtataccgaggagaaagccccagaagagctcacgtacgtcacctatcacctgctttgcaagtgagtttctgcactaacacgagatcaggttcccttgtgtccttcccttttcacagatgtatcccctctgctgcattgacattaggaatttcctgaatcagttctacttcttctctaatgatcatttccaacatcccaacattgttgatgaaacactcagaaaggtagccatttccctcctttcacatttcaattttatggtgtcgagatctaacgccattggcagtcactggacgagctgttgaccgagaaggtctgccggaccctggtggaacgcctaaactcccaatatttgggtcagatcgttcaaatcttgatcaacctcgaacatttcgaagaagcttgccaccaattggagcaggaactcattcgcgcacgatcgtccacgtccgcaggcgggcctgtctctctcaaatcaaccgaagagtttaggagcaataagaagacagccgagaagcgcatttttgagcttgtcaactccaagatcgacgaccttgtcgacacctccgactacaactggtacgttcgacctaccgctccgcgcgactttctgcctactgaccatcgcaacaggatgactccgtctaagcccactgaacctagtaattacatgcagactttgacgaggtatctagagaacataatgggttccacccttcttggtctgcctcgagaaatcaaggagctcatctactttgacgcccttagccacgctgccaacaagattctggtaagctaccaccccattccccttccgaactttgacccctttccctcatgaaagtttttgcagtcctcactcctcctgaaaccgtgctaacacaatgtcgctcatctaaacaggctctaccgctatccccagacgtcaagaaaataaacgccaacgctgttgctgccatggccatggacgtgcagcacctctctgccttcgtcgccaacctcgaaaatgcccctatgcttgagcagaacctagacgaacttcagcagacaatcgcgctcatgcaatcggacaaccacgacgagttcttcgacatttctacgaggaacaagaagtacggtcgtgtggatgccatgaacgggccgatactattggaaaagtgagtttgccga

SEQ ID NO: 27680 - DNA, 1530 bp, Neurospora crassa
ttcttctaccttagcggcgccgactttcccggttgcgcagtcacctacgacatcccccgccaggagctgatcctttggatccgccgtaacgacccacgcctatccctatggtacggcaccaccccctccatcgacgaatccaagtccaaatccgacgtctccgacgtccgctacattgacggcctcaccgcgtacctccatgccgtcctgactcccgaaaacggcggcggcggcggacctctttacgtcctctcccccgaccagcttcccaaactctcgccctcgccaccgcagtacagcttcttcaagggcatgcatggatctgcatctagaggactaaaaatcgacactacctccctcctccccgccatcgaagccgcgcgcgtgatcaaaaccccgcacgaaatctctcgcatccggcgcgccgtgagcctcacctcgctcgcgcaccgcatggtccttcaacggatcaagcacctcactaacgagcgcgaagcacacgccgtcttcgaagggttctgcatctcgcagggcgcaccgcaccaatcgtacgcggtcatcgccgcttcgggccccaacgctagcacgctgcactacgacgccaacgacgagccgctggaggggaggcagaccatgttgttggacgcgggctgtgagtgggggtgttatgccagtgatgtgacgaggacgtttccgttgaacggaaagtggacaaaggagggggaggagatatacaaggtggtggagaggatgcagagggagtgtattgacgctatcagacccgggaggttgtactacaagctgcatttggtggcgtgtttgattgcggttgaggagctgatgaagctggggattttgtataacgggacgaggtcagagattttggcgagggggacggtagcggcgtttttcccgcatgggttggggcatcatgtgggactggaggtgcatgatgttagtggaagggagaggctgttgttgactggatctaccgtttcttcttcaggcgtgaacagtcaaagagttccgggctttcaagaaccaagaaggcgcatgaagagggaacaagtcacccccgaggacttggcggccatgtatcgcgaggcgatgatggatagggatgacgttgagcagaacgtcgtcgggcctccaccaccttacaagggcaggcaaagactcagggaaaatatggtcgtcaccattgagcctggaatgttcgtatattttccttcccttttcccccttcttctttttctcctcccccaactcttctctctttttctttcttcagaagcttccagcaagactaactccctaacccaaagttacttccaccgcccctacatccaatccttcttcctctccaaccccgatcacgcaaagtacatcaacaccaaggtactagacaagtactgggacattggcggcgtgcgcatcgaggactgcatcctggtcaccaaggacgggtacgaaaatctgacgacggcgcccaagggtaaggaggcattgaagatcattaacgcgggaatc

SEQ ID NO: 27681 - DNA, 1947 bp, Neurospora crassa
atgagtactgattacgcctacgacgaggagggccacctctggcccttcttcgtgtttacccttacgtccatcgtcaccgtacccatcacgtactcgctaataaaatcgtcgcggaacgacccagctgccgctcttaagcgcatccagacggactacaagcacgaccagtcggcggtagtcgacacattacgcaagtcggagaagcgcaaggacggtagcaagccatggctaatcgccctcgtcatcgccgggtgggctgtcatgggctacatgatctacctcatcaagaccaccgacgccccggtacaacacctctggaacccctatgacatcctgggcatcgccgagagcgccaccgagaagcaaatcaagaagacgtacaagatgctctccctcaagttccatcccgacaaggcccgccccgacgcctccaagaacgagaccattgacgatctgaaccgccgctacgttgagatctccaaggcataccaggctctgacggatgaggacgtgcgcaacaactttatccagttcggcaaccccgatggaaagcaaggtttcagcatcaacatcgcccttcccaaggccattgtctccgatggcaatggcaagtacattgttctgatctacttcgccctgtttggtgtcctcctcccctatctggtcggctcctggtggtacggcacacttcgacgctccaaggagggtgttcttatggagagcgccaaccgtttgttcaaggagtatcaggacaacattgacgagggtggtgtagtggcggctctcagcagtggccaggaatttgaagacctgttcaaaggcgacaaggcagatgccggcctctccaagatcgagtccaaggttatggcttccgacgaacttccacccaaagagaagaagaagctcgaggacgttgagaacggcccccggagaaaggctctcgctcttctctgggcttaccttgggcgcattgagcttggtgatgctactcttgagaaggccaagttccaggtcgctcctattgcccatgctctgaacaagtctttcaatgccatcgccctcgcctacatgaacactgctccactcctcgcctcctactttgccagccagcgcctcatccaggccatcccgcccaaggcttctcctctgtaccagcttccacacttcaattcggccgttgttcgggctgtcgagggcgactcccgtgtccacaccactgtccaggccttcatggaccagcctgatgctaagcgccgcagccttgttgttggaaagggcctcttgaccgatgctcagtacaaggaaaccatcgcctatgccaagcagctcccctacctccgtgtcgccaaggctttcttcaaggtcactggcgagaagttcatcattccctcttccctcgtcaccctcgttgtcaagggccgcttcgttcctcccggtagcgagaaggtacctgacgtcacccccattgatctcgaggacattgaccccgccgaagacgatcttgacgccatcctcggccgcaagaagaccaagaaggtcgtcggcaaggacgaaaagggcaagcccatctacgaggagtccgccgaaagcgaggacgtttacccaccgcttgcttcctccccttactttgcccgcgaccacagccccagatggcacgtcttccttacggattccaagcagggacgcgtggccgtgccgcctttcacctttgtcagctttgacaggcccatttacgagtcggacggcaagacgccgacgttcgccatgcaaaccatgaaggcgcagttccaggcgccgccacaggccggccattacacgtttgtcatgcacgtggtgtgcgacagctatgtcgggttcgacaccaagatggaggtgacgctcgtggtggaggacgcgagccgggcggccgagatgaaggatgaggaggagattagcgagcctgaggag

SEQ ID NO: 27682 - DNA, 2355 bp, Neurospora crassa
tcactacgcattctcctcatcggcagcggcggccgcgagcacgccctggcttggaagctcagccagtcgcccagcgttgagtcaatcattgcggtccccggcaacggtggcactgccggcctccccaaggtcaccaacaacaacaccgtctctgagaacgactttgctggccttgtcgacctcgccaagaaggagcgcatcaacctcgtcgtccctggccccgagcagccgcttgtcgatggcgtcgagaacgttttccgcgaggtcggtatccccgtcttcggcccttccaaggatgccgcgcgcatggagggtagcaagaccttctccaaggacttcatgaagaagcacaacattcccaccgccgcctacgagaacttctccgactttgaaaaggccagcgaatacctcaagaaggtgggccacaacgttgtcatcaaggccaccggtttggctgctggcaagggtgtcatcatccccgagtcccaggaggaagcccagcaggctctcaaggacattatgctggataggcagttcggcaatgccggcgatgaggttgttatcgaggagttcctcaccggtgacgagctcagcatcctctccttctgcgacggtactaccatcaagtctctgcctgctgcccaggatcacaagcgcattggtgagggcgatactggcttgaacacgggcggtatgggatgctatgcgcccaccaagattgccacccctgctctgcttgctcaggtcgagcgcgagatcctccagccgaccgttgacggcatgcgcaaggacggcttccccttcaagggctgcctcttcaccggcttgatgattacccccaacggccccaaggtgctcgagtacaacgtccgcttcggcgaccccgagacccagaccgtccttcctctgctcaagtccgacctcgctgagattatggtggcctgctcaggtcccattcccctcctcaagtatgtgcccgtcgaggtcgagcagaagttcagcgccaccgtggtcgttgctgcccctgggtaccccaactcctaccccaagaacattcccatgcaggtatctacacctcctgctggtaccaacatcttccacgcgggaaccaagctatctggcgattccctcgtttcttccggtggtcgtgttattgctgccgaggccgttggcgagactctgcgtgccgctgtcgacaaggcttacgagggcgttaagctcattaacttcgacggcatgtactatcgcaaggatattgctcaccgtgctttccgcgacgaaaagtcttcgtccgacaagcttacatatgcccaatcgggtgtgagcattgacgctggtaacgagcttgttgaccgtatcaaggctgctgtcgccactactcgccgccccggtgctgatgctatcatcggtggattcggtggtgaggtcgatctttctcaagccggctaccctggggcccccatcattgtcggcgctatcgatggcgttggcaccaagctcattatcgcccagaagatgaacaagcatgacaccgttggtatcgacctggttgccatgaacgtcaacgacttggttgttcagggtgctgaaccgttcatgttcctcgactactacggttgcagcaggctcgacgtctcggttgccgccgctttcgtcgaaggtgtcgctcaggggtgcaaggacgccggctgtgcgctggtcggtggagagacggctgagatgcctgatctctacaccggcgatgactatgatgcggctggtgctgctatcggtgtcatgaagccgactcagcgtcttccgaggaaggaggccatggccgagggcgatgtgctcatcgctcttgcctcttctggtgtccactcgaacggcttctcccttgttcgcaaggttgttgacaagtgcggcttgtcctacactgacaaggcaccctgggacagctctgccaccgttggtgagagccttctcacccccacacgcatctacgtcaagcctctgctcaaggtcctcgctcagaccggcgaggcagtcaagggtatggcgcatattaccggtggtggtttgactgagaacgtccctcgcatgctccccaagcacctggccgccgagattgacgtcgctacctgggaacaccctcctgtgttcaagtggctcagagagtctgtggtccctaccgagatggcgagaacgttcaacaacggtgttggtatggttttggctgtcgctcctgaggctgcggatgctgtggtcaagggcttggaggctgagggcgagaaggtctacaccattggcaagctggtcaacagagagggtggcgagaagggcgagtggtgtgttctcaagaacttggagagctgg

SEQ ID NO: 27683 - DNA, 1378 bp, Neurospora crassa
taccacgctgccgcgaccaacgttgccatcgccgccgagaacgagtatgccgcccacaactaccacccgctccccgttgtctttgccaaggctcagggcgttcatgtgtgggatcccgagggcaagcactaccttgacttcctttctgcctacagcgccgtgaaccagggccattgccatccagagctagtcaaggccctcacggaacaggcttcgcgcctcaccctgagctcccgcgccttccataacgatgtcttccccgtctgggccgcaaaggtccgctccgtcttcggatacgacatggtgttgcccatgaacaccggtgccgaggcggtcgagacagccatcaagattgcgagaaagtgggcgtacaaggttaagggcgtgccacatgacaaggccctggtgttcagcgctgctgacaacttccacggacggacggtaagttgtgtcttgagcgccaagttgttcaccccgatattctaactaaaactcttgcagatgacagccatctccctctccgtcgatcccgagtcgcgtgataactatggcccttacgtaccccagatcggcgccgtttccccttcgactggcaagaccatccgctacaacaatattgccgatctagaagaagtactggaggcgcatggaaaggagaccgctgccttcatcgtggaacccatccagggcgaggccggtgttgttgttcccgacgaggactacctccagaaggtttccgcgctttgcaagaagcacaacgtcctctttatctgcgacgagatccagaccggtattgcccgcacgggtcgtatgctctgctccgattgggctaatatcaagcctgacatcatcaccctgggcaaggccatctcgggcggcatgtaccccgtcagcgctgttttggctgacaaggagatcatgctcgtcgttgagcctggtactcacggctccacatacggcggtaacccgcttggatgtgcggtgtcgctccgtgcgctggagcttgtagaagaggagggcctggtagagaaggccgagaagctgggtcagatcttccgggaaggagtggaggcgttcaagtctcccattgttaagctcgttcgcggcaagggactgttgaatgccgtggttattgatgagtctgcggccgctgggcggacagcctgggatttgtgcattttgttgaaggagaagggtgtcctcgtgagtaatgtccgttccttccgttgctgatgatagtgctaaccacaaattccaggcgaaacccacacacggaaacatcatccgcttcgctcctccgctagtcatcaccgaggaggagctacggggtgctatcaagaccttcggagaggccctgcaggagctcccaactgtcacg

SEQ ID NO: 27684 - DNA, 4344 bp, Neurospora crassa
tccaccagtgcctcttcaaggacccaggacatcgaggagcttcgtgaggaggcccgccgcaacaaccccaacggccttagccgcgctgtctccggtatctctgtcgaacaagctgagaacgactttcgcgagctgcgaagggagttgtctcgcgcgagtcgtactcagagccatgccaataggtcgacacaccatggagacgccgagaagggacagatgcacgtcgaaacctcatctgagagtgcgccggagcaattcgaccttgaagctgccctgcgtggcgatctggaggcagaaagggaagccggcatccgccccaagcatatcggtgtttactgggacggcttgactgtgaagggtattgctagtagcactaacttcgtcaagacgttccccaacgcctttatcgacttcttcgacgtcgtcactcctgtcgtcaacatgttgggtcttggtaagaagatgcccgaggcgaccttgctgcacagcttcagaggtgtttgcaagcctggagagatggtcctggtcctcggaaagccgggctctggatgtaccacgttcctcaagaacattgtcaaccagcgcgatgggttcacgtcggttactggtgatgtgctctatggaccctttacgtctgaagagttccttcagtaccgcggcgaggccgtctacaacatggaggaggacatgcaccatcctaccctcacggtcgagcagactcttgccttcgctctggacgtcaagatccccggcaagcttccccctggtatcacaaagcaagatttcaaggagaaggttatcaccatgctcctcaaaatgttcaacatcgagcacactcgtcacaccatcgtcggcaaccccttcgtccgtggtgtttctggtggtgagaggaagcgtgtttccatcgctgaaatgcttatcaccaacgcctgtgttttgtcctgggacaatagcacccgcggtttggacgcttcaactgctctcgacttcgccaaggcgctccgtatccagacggatctgtacaagacgaccacctttgtttcgctgtatcaggcctcggaaaacatctacaagctctttgacaaggtcttggttattgacgagggacgccaagtctactttggtcctacttcggaagccagaggttactttgagagcttgggctttgctccacgcccacgacagaccacacccgattacgttactggctgtaccgacgacttcgagcgtgaataccaagagggccgttctccagagaacgcacctcacagcccggagacactggaggcggcgttcaacgaatccaagtttgctcgggaattggaacgtgagatggcggattacaagcaatcactcgttgaggagaaggacaagtacgaggatttccaaatcgctgtcagggaacaaaagcggaagggtgctggcaagaagtcggcttactccgttggattccaccagcaggtctgggctctgttgaagcgccagttcgttctcaagatgcaggatcgccttgctctcgccctctcgtggctgaggagtattgtgattgccatcgtcctcggtactctgtatctcaatctcggtcaaacctccgccagtgcgttcagcaagggtggtctcatgtttatctctctgctgttcaacgctttccaggccttctcggagttggcaggaactatgcttggacgaggtgttgtcgaacgccataggcgttatgcattccatcgtccttcggctctctggatcgctcaaatctttgttgatcaggctttctctgcgtctcagatcatgttgttctcaatcatcgtctacttcatgacaaatctgttccgcagtgctggcgcctttttcaccttctacctcatgatcttgtccggcaacattggcatgactctctttttccgcattatcggatgcgtgagtcccgatttcgattatgccatcaagtttgccgttgtcaccatcaccttctttatcaccacatccggctatctgattcagtaccagtcggaacaggtttggctgaggtggatctactggatcaatatcttgggtctatcgttcagctcgatgatggagaatgagttttcaaagatcgatatgacttgcaccgacgactccttgattcctgctggtcccgagtacaccgacatcaaccaccaggtttgcacgcttcccggttcgactcccggcaccaagttcatctccggcaaggcctacatctcgcaaggcttctcctacaatgccagcgatctgtggaggaactggggtatcgtcttggcactgatcatctttttcctcattatgaacgtcgttctaggcgaaatcatgaacttcagcggcggaggcagcctcgccaaggtcttccagcgacccaacgaagagcgtaagaaactcaatgcggcgctgcaagagaagcgtgatgcccgccgcaaggcccggaaggagcatgatggttcggacctcaagatcaactcggagagcattcttacttgggagaaccttacctacgacgtccctgtccccggtggcactcgccgcctgctcaacaacgtcttcggatacgtcaagcccggtcagctcactgccctcatgggcgcttcgggagccggaaagactacccttttggatgtccttgctgcgaggaagaacatcggtgttattggtggcgatatcctggtcgatggcatcaagcctggtaaagaatttcagcgtagcacatcctatgccgaacagctcgacgttcacgacccctcgcagaccgttcgcgaggcccttcgattctctgccgaccttcggcagccttttgagacaccccgggaagagaaatacgcctacgtagaggagatcatctcccttctagaaatggagacctttgccgatgccattatcggctctcccgaggctggtttgaccgttgaacaaagaaagcgagtgaccatcggtgtcgagcttgccgcccgtccgcagctgctcctgttcttggatgaacccacctcgggcctcgacagccagagcgccttcaatatcgtccgcttcctcaagaaactcgccgctgccggccaagccattctctgcaccatccaccagcccaacgccgccctgttcgagaactttgaccgcctgctcctcctcaagtccggcggccgctgcgtctactttggagacattggcaaagatgcctgcgtgttgagcgactacctcagccgtcacggtgctgtgcccaaggagaccgataacgtagccgagttcatgctcgaagccatcggcgccggttccgccccgcgcatcggcgaccgcgactgggccgacatctgggccgactcgccagagctcgccaacgtgaaggacaccatccagcaaatgaaggaagctcgcaagagcgccggcgagcaagtcaaccacgacctagagcgcgagtacgcttcccctctttggcatcagctgaaggtggtcacgcaccggaccaacctcgccctctggcgctcgcccaactacctgttcacccgcgtcttctcccacgccgtgattgcgctcatcaccggtctgaccttcctcaacctcgacctctcgcgcgaatctttgcagtacaaggtcttcgtctgcttccaggtcaccgtccttcccgccatcgtcatctcccaagtcgaagtcatgtaccacatcaaacgcaccatcttcttccgcgagcagtcgtcaaagatgtacaactccttcacctttgccgcgtccatggtcatcgccgaaatgccctacaacatcttctgcgccgtcatcttcttcgtgtttgtgtactacatgcccggcttgaactcggaatcctcgagagcggggtatcagttcttcatggtgctcatcaccgaagtcttctccgtcaccatggcgcagtgcttgtccgccttgaccccgacagtctttatctcgagtcaattcgaccccttcatcatgatcacctttgccctcttctgtggcgtcaccatcccggcgccgcagatgcccaagttctggcgcaagtggctgtacgagctaaaccctttcactcgtctcattggcggcatggtggtcaccgagttgcatgacttgcccgtcatctgcaaggactatgagctgcaatcttttactgctcccgcgggacaatcctgtggggagtacatggaacctttcttcaagaggggaggagcgggttacttggtgaacaacgccacgagcgcgtgtcaatactgcgcgtacaaggtgggcgatcagttttatgagccactggggatcagctttgataacaggtggagggatttggggattttcttggccttcattgggagtaatttgattattcttttcatggcg

SEQ ID NO: 27685 - DNA, 2092 bp, Neurospora crassa
gaccccaacaccctgtccaactatgatgcttggaggactcgtcacaccacggccaacctcaagatcgacttcacagccaagtgtttacgcggctccgttatccttgagctcgagtctcagacggacaaggccagtaaggagatcgttcttgactccagctatgtcaccgtgaactccatcaagctcaactcggccccctcgttatgggagaccaaggcccgcaccgaacccaacggttcccccgtccacatcgccgtccccgagggtgccgccaagggcgaggtcgtcaaggttgagattgagcttgccaccacggacaagtgcactgccctgcagtggctcaccccggctcagactagcgacaaggcggcccccttcatgttcagccagtgccaggccatccacgcccgctcgctcttcccctgccaggacactccagacgtcaaaagcacctacgacttcaacatcaccagcccctacgttgttgtagccagtggcgtgcccgtgcctgacgagaccaaggatttgggcgaggagaagctgtacaagttccagcaaaaggtgcccatcccgtcctacctgttcgccctctcgtctggagagattgccagcgcccctgtcggcaagcgctcttgtgtttgcaccggccccaacgagctgaaggcgtctcaatgggagctggagggtgatatggacaagttcctggaggctgcagagaagattgtgtttccctacaggtggggcgagtacaatgttctcgtcctgccccctagcttcccttatggaggtgagtgcaaaaaagcgagataacgagaatgaagatatgctgtgaacgctgacaatgtgcctcctcccataggcatggagaaccccatcttcacctttgctacccctaccatcatcagtggcgacaagcaaaacattgacgttattgcccacgagctcgcgcacagctggagtggaaacctggtcaccagttgcagctgggagcacttgtaagttgcaggtcattggtcaattaatcaccggtaattgctaacatctggctagctggttgaatgaaggatggaccatgtatctcgagcgccggattcttgcctccattcacggcggcgatgcccactttgacttttcggccatcaggggctggaaggcgcttggtaagaattaatgacacagaccagaaccccgcctctcctctctccctccttgagtaggaggtccccactaacaattgtcttacagaggaggccatcaaggagtacggagaggatcacgagttcacaaagctctgcattagccacaagggtatcgaccccgatgatgccttcagcacggttccctacgagaagggtttccacttcgtctggagtctcgaccgtctcgttggaagagagaactttgacaagttcatcccatactattttggcaagtggtccaacaagtcgcttgactcgtacgagttcaaggacaccttcctcgagttcttcagcgcccccgagtactctgatctcaaggacaagattgcttcgattgattgggagggtcgcttccacagcaccggccttccccccaagcctgagttcgacacctcccttgcggacgtgtgctacgagctggcggaaaagtggaagagcaaagacttcacccctagcccgtctgacgttgcgtcgtggactggtaaccaggtgttggtcttccttaacgccgtgcaggactttgaggagccgttgacggttgagcaatcggtaagtttcaggtgtctacctctctacttccagtcagcagtacgctgatacaaccacagcaagcgcttggcaaggcctacggcctctctgaatccaagaacgccgagcttaaggccgcctactaccacattgcgatgcgctccaaggacgccagcgcctaccagggcgttgctgaccttttgggagaggttggtcggatgaagttcgtccgccctctcttccgtggtctcaacaaggtcgatcgggagcttgcgctcaagacctttgagaagaaccgcgagttctaccaccctatttgcaggcagatggttgagaaggatttgggcgtttctgaggccgccaac

SEQ ID NO: 27686 - DNA, 1313 bp, Neurospora crassa
atgtgtttcgggggtcgtggaaaggacgatgaggctgaggcctcccggtcgcgcgagctagacaagcagatccgcgcggatgagaagcgcctgtcgaaggaggtcaagctgttgctgctaggtacggatctccagttgttactagaccctgcactgcgaccaaggcgactctaacatttggcatcaataggagctggtgaatccggcaagtctacgattttgaagcagatgaagttgatctatgcacaaggtttcagcaaaaatgagaagctggaatggaggcctgttattttcgccaacattctgcagtcgttccgattgatctttgatgcgatgaatgagttcaacatcaagctggaggatgaagataatgaggcaagtttgattcagtggaccttgatatctgcggttcttcaactaacttgagtacttacagaagaacatggtacaaatgatggtcgattacgagatgaggggagacgagcctctaccactagaatatttcgagccagcgaagaagctatggcaggattcaggcgtcaggcaagctatcgagaagggcaatgagtttgcgttacatgacaaccttcagtagtatgtgttcgcaatcccctctccatgtttctgcatctcgctaacctatcattcagcttctgctcggacctggacagactatgggacaggaactatgttcctagcgaccaggatttgctgcgctcgaggctacgaacgactggtatcaccgagactgttttcgacctaggccaactcacataccgtatgtttgacgtcggtggccagcggtcggagcggaagaagtggattcactgctttgagaacgtcaactgcttgctgtttttagtagctatctcaggttacgatcagtgcctggttgaagacaaggatggggtacgtccaagtcccgcatgttgttgagaaggtggaggctaacctttgcgcagaaccaaatgaacgaggccctcatgctctgggaatcgatcgccaattctcactggttcacaaaatcggccttgattctgttcctcaacaagatcgaccttttcaaggagaagctgccccgaagcccgataacgaaccacggtttcactgattatcatggccccccggacgattctaagcaggccagcaagtactttatggacaagttccgcgcgctgaaccggaatccggacaaggagatatatgggcatttcacaaacgcgaccgataccaatcttctgaagatcaccatgggttccgtgcaggacatgatcatccagcgaaacctgaaacaacttatcctgtagggggat

SEQ ID NO: 27687 - DNA, 1013 bp, Neurospora crassa
aaggagagccaatatctccctgaggagcttcccatctggaacttcgatggttcctcgactggccaggcccccggcgagaactccgatgtctacctcaaggtaagttaaagcaggctttggcattcttgcacgctttgccgaaccatggcactaacatgactttcctctcacagcccgtagccgtcttccctgacccgttccgtggtagccccaacattctcgtcctctccgagtgctggaacgccgatggcacccccaacaagttcaaccacagacatgaagccgccaagttgatggaggctcatgccgaccaggttccctggttcggtctcgagcaggagtacactctcctcgacatcaacgacaggccctatggttggcccagaaacggtttccccgctccccagggcccctactactgcggtgtcggcactggcaaggttgtccagcgtgacattgtcgaggcgcactacaagtgctgcttgtacgccggcgtcaagatctctggcaccaacgccgaggtcatgcctgctcagtgggagttccaggtcggcccttgcgacggcatcgagatgggtgaccacctctggctcgctcgcttcctcctccaccgcgtgtcggaagagttcggcgccaaggtctccttcgaccccaagcccattcccggtgactggaacggcgcgggcctccacaccaacttctctaccgagaacatgcgcaaggagggtggcatgaagtacattgaggatgccatcaagaagctcgaggcccgtcataaggagcacattgccgtctatggcgagggcaatgataagcgtcttaccggccgtcacgagaccggctctatcgactctttcacatacggcgttgccaaccgcggcgcctctatccgtattcctagggaatgcggcgccaagggctacggttacttcgaggaccgtcgccctgcgtccaacgccgacccttaccagattacgggtattatcatggagacttgctttggcgctgtttcg

SEQ ID NO: 27688 - DNA, 1429 bp, Neurospora crassa
aagaacattcctgatgttgactttgatgtgggagagtcctatgctggcactttgcccatcagccaggaccccgaggagaagagcgagcttttctggtggttcttcccatctacgaaccccgctgcgaagaaggaaattctgatatggctcaacggtggtgtaagttcaaccttatcaaacccctaatatgaatatatcagcctgacaaactatactttcttagcccggctgctcctcactggaaggtttcctccaagagaacggaccgttcctctggcagtatggcacttacaagcccgtcaagaacccctggagctggcacaccctgaccaacgtcatctgggtcgagcagcccgtcggcaccggcttctctaccggcaacgtcaccgccactagcgaagaggatgttgccgctcaattcatgggtttctggaagaacttcatcgacacctttgccatgcagggctacaaggtgtacatcaccggcgaatcctatgccggcctctactgcccctacatcgcctccgccttccttgacgccaatgacaagacctactacgacatgtccggcctgatgatctacgatcctgtaatctcgtgggacgaagtcgccgagcaggtccctgtcgttcagttcactgagtactggtcgggactcttccccttcaatgacaccttccgggagcacatcaagtcggtcgacgccaaatgcggctattccgacttcgtctcgcagtacctggtgtatccgcccaagggcctacagccctctaagctgcccggtaccgataagaccggcaccacgcgcgacgaatgctggggactgttctacgagatcttcgacgccattttgctgttgaacccgtgcttcaacatctaccaggtggccaccacctgtcccctgctgtgggacgtgcttgggtttccgggatcgatggggtacctacccgagggtgccaaggtgtattttgaccgagacgacgtcaagaaggcagtccacgcccctgagaacgtcaagtggtccagttgctcggagcagaacgtgtttgtgggcggacgcgaccggtcggagccgtcgagcttccatgccttgccgcacgtcatcgatgcgaccaagaacgtgatcatcggccacggcgcgctggatatggtcctgatcgccaacggcaccctcctgggcatccaaaacatgacttggggcggcaagctcgggttccagaacaagcccgaccaaccgttttatgtgccgtacaacaccatgtcggacctgtcgacgctggcggccggcggcgtgtttggatccatgggcagcgagcgaggcttgacctgggtccagatcgacatgtcgggccacatggtgccgcagtatgcgccgtcggcggcgtacaggcagctagagttcttgctgggcagagttaactgcttgaac

SEQ ID NO: 27689 - DNA, 838 bp, Neurospora crassa
tctccgcaagggcgaattttccaggtcgaatatgcggcggaagcagtaaagcagggttcggtggtggtgggaattgctagcaagacacacgccgtcctggtagcgatcaaggtacttcgccccgaccacccctcgcgcaccaccctgccgatacatgtatcctcccatccatcctagggccaagtgaagctgaccatgttcctgtcactttgtccagcgtaacgccgaagaactctcatcgtaccaaaagaagctctttcccatcgacgaacatgtcggcatcgccatcgccggcctcacctcggacgcgcgcgtcctctccaacttcatgaagcagcagtccctcggccaccgcctcacgtacggccgcaacatgcccgtgcggacccttgtcgacatgatcggatccaaggcgcagatcaacacgcaacactacggtaagcggccctacggtgtcggtctcctggtcgccggcgttgacgaccacggcccgcaccttttcgagttccagcccagcggcatgaccgaggagatggtggcctttgccattggcgcccgcagccagatggcgcgcacatatttggagaagaacctagaggcctttgccgactgcggccgcgaggagctgattcgtcatggtctcaaggcgctcaaggagagcctggtgcaagaccgcgagttgaccatcgacaataccagcgtcgccattgtgggtgtcgagaagcaggaggacggcacgaccaagccgcagccattcatggtgtacgatggacaagacgtcagcgcatggatagagagtgtggcggataaccaagaggctgccccggcagctgccgag

SEQ ID NO: 27690 - DNA, 849 bp, Neurospora crassa
gcgacgctcatcttcatccacggattcagcgaccatatcaaccgatactacggcttcttcccgtcactcgcagcgcgcggaatcgccgtttacgggttcgaccaacgcggctggggacgcagcgtcaagaagccagccgacaggggcctgaccgggccaacgtccagggtcatcgccgacatggtggcctttatcgagccgcacctgtccgatgcccccggggcgccgcccgtcttcatcatgggccactccatgggtggcggccaggttctcacgcttgcctgcgacgagcagtaccaggagcgcatcgtcagccgagtgcggggctggctgctggagagccccttcatcgggtttgcacccgagctgaaacccggtttcatcaaggtgtacggcggccgatttgcgagcaagatttttccacatcggcagctggtcaacaagatcccgcctgaagacctgtcacgcgacccggaggttcagaagagcatcgcggcggatgagctgctccataacaccgggaccttggaaggtttgtcgggaatgctggaccgcacggatggcttgacgcggggaacgatcaggccggttggaggagagaatactaagatcaaggcgatctggcttggccatggttcgagtgataaggcgacagattataatgccagcaagcggtattatgatcgtgttattgcgagcacggtgaaggatagaatgttcaagcggtatgaggggtggtttcatcagttgcatgctgatggtccatgtagtgaggagttctacaaggatgtcggcgattggatcttggagaggagcgaggatgcagattcggggaagtttgaggccaag

SEQ ID NO: 27691 - DNA, 1657 bp, Neurospora crassa
tgctcgtatcttcacaagaatgtctgcgagtatcccactgtgacttccgccaaggccgtattccccaagcccaagcctaagaagcctgctgagcctcgtcggagtgggaagaaggtcaaggtgttacacctatcagatctacatcttggtgaggcgacctgctgaatcatttttaggtcggccaatatgctaaccacctttagaccctcgatacagcgtcggatctgaagcgaactgcacatcttacatgtgctgtagatactctgaaccaccagcaaacggtacggtccccgagatctccgtgtcggctcctctctttggctactacaaatgcgactcccctttctacctcgccctggccgctctgcaatccattggtccgttgacgggtacttccgcgaagaacccacccgccttctcactctacacaggagacctgatcgcccacgacgatgaaaaccaggcgtcgcgcgcctacgtcgaggccaccgaagttgccatctgggagactttcaaggcctatatcggcggacctatctatactgctctgggggtaagttcaactcgtaaccgttgaaatccattctattctgaaccagcatgaaactcaccacccaatgccgtctagaaccacgacacaaccccagccgactacgaagcccctcacgccatcgacaacaattccacactaggctctcaattctcctggaactacgcccacgtctcctccctctgggcgcactacaactggctcccctcttctgtcgcccaacaagcctctacccactacgccgcctacgccgtttcccctccccaccacccaaacctgaaaatcatcaccctcaacagcgacctctactaccagcacaacccgttcgcccttttgaatgcctccaaccccgactacagcggcatgttttcttgcctgatcaccgaactccaagccgccgaagacgccggccagcgcgtttggatcgtggcgcacattcctaccggctgggacggcgggagcgctctcccaaatagtgcggattacttttaccagattgtggaaaggtactcgccgcatgtgattgcgaatatcttctttgggcactcgcatgaggaccaggccacgatatactaccgtaacaacggcacggcgcaaactagagaagaagcgctggtgacgggttgggtcggccccagtttgacaccgctgcagaacttgaatagcgggtataggatgtatgaggtggacacgggcagttgggaggttatggaggccttcacgttctacagtgatgttgggagttataccaatctttcatcatctgttgacggagaaggaaacggaggacaaggagaaggaccggtcttcaaactagagtactcgactcgtgctacctatgggccggcggtcaactggccgagcgacgcaccgcttaatgccacgttctggcatggggtgacggaggcgatggagcggaacaggacgcttgctgagctgtttacgcagtatcaggggaagagtagcgccaagagtaagaaatgtgagacggaagaatgcacgaaagcgaaaatctgctatatgcgcagtgggagcacggcgctgggcaagcagtgcaagcaaggatatgggagtgtgcagtaaggcagtgtcggctttttgtggtgc

SEQ ID NO: 27692 - DNA, 1163 bp, Neurospora crassa
cggcccaccctcgaccgcccgttcggcattcatctatggcccatcttcagcaaggcctttgaggccgtcgtcggctaccctgccgaagacttcagattcgtccccggcgagacgcccatgtccactctcaaggagaccagcatcttcatcgtcatctactacaccatcatcttcggcggtcgcgagctcatgcgcaaccgcgagcccttcaagctgcgcacgcttttcctgatccacaacttctacctgaccgccatcagcgctatcctcctggctctcttcattgagcagcttctccccattgtcgttcgcggcggcatcttccatgccatctgccacatcgacggcggctggactcagcccctggttgtcctctactacgtatgttgttgcggctcaccgcctgatgggcttttgggatcggcactaaccttgtgcagttgaactaccttaccaagtacctcgagctcctggacacctgcttcttgttcctcaagaagaagcctctcagtatgttgccgttgaagaagagaatgtcgcgcgccgtacaacgatttctaacattttgcagctttcctccactgctaccaccatggcgccactgctcttctctgctacacccagttgatcggctccacctccgtctcctgggttcccattacccttaatttgactgttcacgtcgtcatgtactggtactacttccagagcgcgcgcggcatccgcatctggtggaaggagtggatcacccgtctccagatcattcagttcatcattgacctcggtaagctttttttttttctcgttcgcaacgatctcgtcacccacgctaactctttgcgcgtacaggctttgtctacttcgcctcttacacctatttcacctcgacctacttcccgtggatgcccaatgctggcaagtgcgctggcgaggagtttgctgccttctccggcattggtatcctcagctcttaccttgtcctcttcatctccttctactttgctacctacaagaaggacggaaagcgccccactggtcgcaagtctctccgcagaatgtcccaggccccgttgcccgaccctaaggatatcgtcagcgccaaggcttctggcgctcgccccagtggcgccgctactgcccgttctcgcaaggcttaaatcgtt

SEQ ID NO: 27693 - DNA, 2368 bp, Neurospora crassa
atggcccacgacaaccgtgaaccccgcgaggtcaaaaaccacctcctctttgaggtggcgaccgaggtcgcccatcgaggtatgcgcaaaagtatcaattgcgccaggaaggagcttccaatctaacaattgttctagttggtggaatctactccgttctcaagtcgaaagctccagttacaaccgctgaatatggcgaccgttacactcttatcggtcctttgaaccaccaatcggtacgctgctcttgcgccctttacactgtggcttgaaacatggttgttgacaggaatgattccaggcggccgtcgaggttgaagagctagagccatccaaccccgaactaaaggcgacgattcaggccatgagagaccgtggcatcggcattctttacggacgatggctcattgagggagctcccagagtgttgctcttcgatacaaagaccgcttacggttacatgaacgagtggaagacggacctctggaatgttgcttctatcccatctccggacaacgacgaagagacgaacgaggccattgtctttggttacctggtcgcatggttcctgggcgaggtcagtacttgcgtcacaaagcagagaggcgcccgaagctaacaaaatcgtagtttgtatgccatgagaagagaaaggccgtcatcgcccacttccacgaatggcttgccggtgtcgcgctgccattgaccaagaagaggcagattgacgttaccaccatcttcacgacacatgccactcttctcggtcgctatttgtgcgccggctcagtagacttctacaacaaccttcagtggtttgacgttgacgccgaggctggaaagcgtggaatctatcatagatactgcatcgagcgagctgccgcccattcctgcgatgtcttcaccaccgtttcccacattacagcttacgagagtgagcatttgctcaagcgcaagcccgatggtgtcctccccaatggtctcaacgtcaccaagttctcggccatgcacgagttccagaacctccaccagcaaaacaaggagaagattcatgactttgtccgcggtcacttctacggccattacgattttgagccagaaaacacgctctacttctttactgcgggtcgctacgagttcaggaataagggtgtggacatgtttatcgagtcgcttgcccgtctcaaccaccgcctcaagaccgccggaagcaagacgacagttgttgctttcatcatcatgcctgcccagaccacttccttgaccgttgaagcattgaagggacaggctgtcatcaagtctctgagagataccgttgatgttattgagcgtggaattggccgtcgcatctttgagcgctctgtcaagtggcacgagggcgacccgttgcctgaggagaaggagctgattaccagtcaggaccgtgttctccttcgtcgtcgtctctttgccatgaagaggcacacactcccacccattgttacccacaacatgctcaacgaccacgaggacccaattctgaaccagatccgccgggtacagctcttcaaccatccctcagaccgagtcaagattgttttccatcccgagttcttgagctcggccaaccccgtgttgcctctcgattacgatgactttgtgcgcggcacccatctgggcgtcttcgcttcttactacgagccttggggctacactccggcagaatgcactgtgatgggtgtaccaagcatcaccaccaacctctctggattcggctgctacatggaggaactcatcgagaactcgagcgactacggtatctatatcgtggatcgtcgctccaagggagtcgatgactcggtcaaccagcttactcagtacatgtttgaatttacccagaagagccgcagacagcgcatcaaccagagaaacagaaccgagcgtttgagcgatctcttggactggaagcgaatgggtatggagtacgtcaaggcacgccaacttgcgttgcgccgcgcctatcctacatctttcaatggcgaggaggaggaagacttcattccaggagtcgagcaaaagatatctcgtcccttctcagtaccgggctcgcctagagaccggactggtatgatgacccctggcgattttgctagtcttcaggagagtcacgagggtctgagtaccgaggactacgttgcatggaagttaccgtaagtgatggtgatgtcctctcaacatgttgaaaaatgatactgacttttctgattctagtgaggaagaggaccctgaagagtatcctttcccgcttaccctgaagcagcgtacggggccgggtagccccctcgacagtattcagggtctacaactcaacggcaccaggtaacgcgagctc

SEQ ID NO: 27694 - DNA, 864 bp, Neurospora crassa
atcggttccggtacgtatggaaaggtattcaaagccctcaatgtttacacgaaaaagcaagtggctctcaagaggatacgaatggaaggagaaagggatggcttccctgtgacagcggtgcgagagatcaagctgctccgatctttaagccataggaatattgtcaagctcatggaagtgatggttgagatgaacgagtgtttcatggtatttgagtacctatcacacgatcttacagggctcatcaaccatcctaactatactctggacccggcccagaagaagcatttggctttgcagttgttcgagggtttggactatcttcatactaggggcgtcctgcatcgagacatcaaagcagccaatatcctggtcagcaacgagggagtcctcaaacttgctgattttggcctggctcggttctatgccaaacatcatcaactcgactatacgaaccgtgtgatcaccatttggtacagatcaccggaactacttctcggcgagacacagtacggtcccgccgtggatatctggagcgctgcttgcgtgatgatggaaatatttaccaagcgtgccatcttccctggcgatggtagcgagatcaatcagctggacaagatccattctgttttgggcacaccgaccagaaacgactggccaaacatcatcgaaatgccttggttcgaactgctacggccaactcagcggcgagcaaatgtatttgcggagaagtataaggagctagtgacacctgccgcgtttgagctgctcctttggatgttcaaatacgaccctgataaacggcccagcgctgcccaagtattggcgcatccttacttcaccaccgaagagccagctccgcga

SEQ ID NO: 27695 - DNA, 1248 bp, Neurospora crassa
gagcagcgcctgatcaacgaagagtacaaaatctggaagaagaacagccccttcctctacgacatgatgctcagcacggccttggagtggcctaccctcacgacacaatggtttcccgatgtcaagaaccccaaagacaagagccacaccgtccacagactgcttctcggaacccatactgctgagggcaagcccaactacctccagatcgccgaagtcgagatccctaagatggtcgagctgaatccccgcgactacgacgaggaacgtggcgagattggtggctatggcagcaaggcctcttccggggagcccttgtgcattcgcttcaaaatcacccagaagatcgaccaccccggcgaggtcaacaaggcccgttaccagccccaaaaccccgatattatcgccaccctcgctgttgacggccgtgtcctgatcttcgaccgtacaaagcacagcatcacgccttccggcactcctagccctcaacttgagctgattggccacaaggaagaaggcttcggcttgaactggaatccgcacgaggaaggctgccttgtgactggcagcgaagacaagaccgtcctcctgtgggacctcaagacctatgaagggaccagcaagcagctcaagtactctcgcaagtacacgcaccatagccacatcgtcaacgacgttcaacaccaccccttggtcaagtcatggatcggcaccgtctcggacgatctcactctccagatcatcgacgtccgccgtccagagaccgacaaggcagccattgtcgcccgtaacggccatagtgacgccatcaatgctttggcgttcaacccacgggtggaaaccatcattgcgactgcgtccgccgacaagacgattggtatttgggacatgaggaacatgaagtccaaggttcacaccttggagggccaccaggatgcggtcacctctcttgagtggcacccaactgagtcggccattctgggcagtggcagctacgacaggagattgctgttttgggacatcagccgtgtcggagacgagcagacccaagatgacgctgaggatggccccccggagctgctcttcatgcacggcggccacaccaaccacctagccgatttcagctggaaccgcaacgacccctggcttgtgtgcagtgctgctgaagataacctgctccagatctggaaggtggccaacagcatcgtttccaaggagcccgctgacatgtctactcccgaactcgat

SEQ ID NO: 27696 - DNA, 1334 bp, Neurospora crassa
atcgagtctaactacgatgagaccgttgattcattcgacgagatgaacctgaagcccgagttgcttcgcggtaagaataccattcccgaccgagcggtgtatacatgttcatatgctgatcgtcgatgttaggtatctacgcttatggtttcgagcgcccctctgctatccagcagcgcgccatcatgcccgtcatcaagggtaagaaaataccgcttctcgacacgatgggtaactcgcgctgactcttcaaaggccacgatgtcattgctcaggctcagtccggtactggcaagactgccaccttctccatctccgttctccagaagatcgaccccagcctcaaggcctgccaggctctcatcctcgcccccacccgcgagcttgcccagcagatccagaaggttgttgtcgccatcggtgacttcatgaacatcgagtgccacgcctgcattggtggtacctccgttcgtgatgacatgaaggccctccaggacggcccccaggtcgttgttggtacccccggccgtgtccacgacatgatccagcgtcgtttcctcaagaccgacagcatgaagatgttcgtccttgatgaggccgatgaaatgctttcggtatgtatactttccagtgctcacaataggtcggatgcagaacgctaacctttctcctttctacagcgcggtttcacggagcagatttacgacatcttccagctccttccccagagcacccaggtcgtccttctctccgccaccatgccccaggacgtccttgaggttaccaccaagttcatgcgcgagcccgtccgcattctcgtcaagaaggacgagcttaccctcgagggtatcaagcagttctacattgccgttgagaaggaggagtggaagcttgacaccctctcggatctctacgagaccgttaccatcacccaggctgttatcttctgcaacacccgcagaaaggtcgactggctcaccgacaagctgactgcccgtgatttcaccgtctccgccatgcacggtgacatggaccaggctcagcgtgatttgattatgaaggagttccgttccggttcttctcgtgtcctgatcgccacggatctccttgcccgtggtatcgacgttcagcaggtttccctggttatcaactacgatctccctgccaaccgcgagaactacatccaccgtatcggtcgtggtggtcgtttcggtcgtaagggtgttgcgatcaacttcgtcaccgctgacgatgtccgcatgatgcgcgagatcgagcagttctacagcacccagattgaggagatgcccatgaacgtcgctgatctcatctaa

SEQ ID NO: 27697 - DNA, 2699 bp, Neurospora crassa
gttactcgcatcgtcaccccgggcactctgatcgacgagaacttcatggacccgtacgcgaacaactacattatggccattcatctgccttcggattcgttggaaggaagctcgagttttcaagaagccttgaacaccggaactgggcaaaagaaggagtcccttgtaggtttagcatggctagatttatccacgggcaacttctacacccagcagacgagcctcatagccttgggcagtgtcctcttgcgggtatctccgcgagaaatagtcctcgataagtcccttgagtctgccgaaggtcacgatatcttgtccgtcctaaacgaagagagatatcccgttacttactcaccccagagcgagaatatacaaaccctcaaggactgggcgccgatgctggacgcaaaaatacctacagaaacagtaatcaggttcacggacgatgagatcaaggcaggcaatgtcttgcttcactatgttacagaccgacttcaaggcttgagcatgaagcttcagccgccaatacgtcacgacaacatgcaaattatgactatcgacaagaacagcatgcgatctctggagatcaagaaaaccatgagggaaggcttcttcgcgggaagcttgttacatgccatcagaaggacagtgaccaagagtggtgcgagactgcttaatgagtggctcagtaagccatcccttttaccgctttgtccctatgtcgatagataaaatcgctgaccgacttaggcgccccttcaacgtccctttcggtgataaactctcgtcttgatctcataacccgcttcatctcgaacccagatctcagcgacgccatcacggtcctcctccatcgctcccacgacactcagcgtctcgtccaaaaattcgccctcaaccgcggtgacgccgacgatctcctccggctcgccagcaccatcaaggccaccgaggacatcgtcaaccacctaaagtccaccatgtcctccgaagataataacccagaagaagatgattgcctaaccaagctgatcgaccgcataagcctcgagcaacccctcaagctcgccaagcggatctgggacgccatcgacgaggaagggctcgtccagcaacaccagctcgaagatagcgagacgggcgagatgcttgctctcgcgcaggaaatcgtcaagggcgaagggacggaggaggatgggcgggcgcttttgcccaagggggcgacggccaagagtaatagggctagggcggagctgacccaaaaccgaaatcaacaggaaaaggatctgtcaaaagacaataggaaaatgagtctgcgaaattactacggcgaagacaaccaggtctggatcatgaagcccaaagccaacagggccctggctaagctccacgcggaactcagatcgctgcaggaacaaaaggagaagctcaccgaggagttccgcgcaaagtatgcggcgccgtcgcttacgctgaattggaaagccggattgggccatgtttgtgtcgttcgagggagggatgctcgattggcgatgggagaaaccagtcgtcgcaccagaacatccagcagcagcagcaacagcatgtccgaccccatcgctgacaccaccgacgccgatgctgcggacgccgatggcgaacccatccccgaacccgtcccagaacctgaatccctctccaccctccgcacgctctctaccacccggaccacccgcaccttccaccaccctctctggacgtccctcggcgaatccctcgaccacgtccggctccgcattcgctccgaagagacggctctcttctcctctctccgctccaacgtggtaaccttgctcattaaactccgtcgcaatgcgctcgtcctcgacgagctcgacatcgccacctcgctggcccggctggcgacggagcaaaatctcgttcggcccattctgcacgattcctccactaccaacggttctcaagggatgggcacgaggacggtcatagtaggcggtcgccaccccaccgtcgaaccctccctcctctctcgaggcatgacctttcagaaaaacgactgcctaatcggctcccccggacaaggtgcgatctggctgattacaggaccgaacatggctggtaagagcacgtttctgcgacagaacgcgctgattaccatcctggcgcagatggggtgttatgtccctgccgattacgcggagctgggtattgttgatgccatcttcagcagggtcgggtcggcggataacttgtatgcggaccagagcactttcatggtggagatgatggagacggcggcgatattgcgacaggcgacgccgaggagctttgtgataatggatgagattggcagggggacgacaccggaggatggcacggctgtcgcgtttgcgagcttgcatcatctgttgacggtgaataagtgtagggggttatttgcgacgcatttccatgcggttggggatatgctaaaggagcaggggttggtggttgaagatggtgcgagtagtgcgggtgcaagttggggtgtggctatgtattgcacggatgtggaagaggacgagagcggcggatttgtctatgtgcacaagttgcggaaaggcatgaacaggcagagccatgccttgaaagtggctcgcctggctgggctgccagagccggccatcaagatcgctcagcaagtattggcggttcag

SEQ ID NO: 27698 - DNA, 3188 bp, Neurospora crassa
atgggcggggaatcagcaactcagagcaagcccatctcggcttacccgctacgcgcacccaagccggtcggccagtacatcaccaacatctacaaggatcgtatcagtcagttttacgcaaagggacaatgggagcacaacaatctcaacgccatgatgtacgagggtgtcgccgagggcgagccccatgtcaagctgttcgtctgggatgcccccgaccaggatcgaccaacctttgacgaggccgtcaagcacgagttcagaaagacagaagtcggcgctcgattcggccctgcctggtcgacccactggttcaaggttgtccttacggtccccgaggacttgcgcgataagaggctgctcgaactccactgggacgccaataacgagggcatggtctggacgcacgatggcaagccgctgcagggcttaacgggcggtggtgagcgtaccgagtggatattgccagactcgttccgtgacggaaaggaacatatcatctacatcgagatggcctgcaatggcatgtttggtgcagcgggagggggcgatatcatccagcctcctgatccaaacaagcactttcgtctcgacaaggccgaaattgtggctgtgaaccccgatgcgaggcagctatacatcgatatctggatcattggtgatgcggcacgcgagttcccgagtgaatcgtgggagcagcatcaggcgctgaagacgtgcaatgagattatcgaggcctttgagctcggcaataaagactcgctcaaaaagtgtcgggaaattgctcagcagtaccttggtccggacgttgactcggccagggtatacgacaccaagaggggaaaggcaccgcttgtttttggtatcggccattgtcacatcgacagttgctggctatggccctgggatgagaccaagcgcaaggtagctcgatcttggtctaaccaatgcgacctcatggaccgctacccagaactcaactttgcttgctcacaagcacagcaatacaaatggtgcaagactctatacccccatgtctgggaacgtgtcaagagcaaggtggccgacggtcgtttccatcctatcggaggtagctgggttgagcacgacaccaacatgcccagcggcgagtccttggtccggcagttcgtgtacggccagcgtttcttcgagagcaactttggaaagaggtgccaaacattctggctgcctgacacttttggctattccagtcagctaccccaactctgccgcctcgctggcatgactcggttcctaacccaaaagctgagctggaacaacatcaacaagttcccccacacaaccttcaactgggttgccctcgacggcacgcaggtcatctgccacatgcccccttcagaaacctacaccgccgaggcccactttggcgatgttaagcgcagcatgtcacaacacaagtctctcgaccaagatcatacgtctttgctcgtctttggcaagggagatggaggtggcggccctacgtggcagcacctagagaagcttcgtcgctgccgcggtatcagcgatactgttggtctcctaccgcgggtgtctctgggcggttcggtagatgacttctttgatagtctcgagcggaaggctgattcgctggttacctggtttggtgaactgtacttcgagctgcaccgcggaacatacactacgcaagcgaacaacaaaaagttcaaccggaaagctgagtttgtgctgagggacatcgagcagctcgcaacgattgcctcactcaaggacaaggactacaagtatccaaagaaggaaatcgacgaaatgtgggaggcaacactgctctgccagttccatgattgtctccctggcagctcaattgagatgtgttatgatgattcggataaggtatgtttgggcttgattagtttgttcgtgatgaaggattactgacttcccttcgacagctctatgctcaaattttcaagaccggtgagaggctcttgagggatgcatgcaaggcattaggcgttttccaagtagacgccacgggcgtggagcgcggcattgccctgaacactttaccctggtaccgcgaggagcttgttgagatttccaagggtgattttgcccttgccaagggtgtaggtcctctccttaaactccagcaatacgaaatcatgcaagtggacgacggggtcaagctccacaagctatccaacggtgttttcgtcctcgagaataagcgactcaaggtccgtgtcgaggccggcaccatcacgtccctctacgacaaatacgacaggcgcgaggtcatccctgaaggccagcgcgccaaccagttcgtcatcttcgacgacaagccgctctactggcaagcctgggacgtcgaagtctatcacctcgacacgcgcaaggagctccagtccagcgagacccaagtgcacgaagaaaaaacgcatcgcgtcagcgtcatcaccaagaccaagatctccgagcaatcccacatctccaccatcatcagcctctcggcggctgtcaacgagctccaatcctacatcgaagtccaatccaccgtcgaatggcacgaaaccatgaaatttctcaaggtcgaattccccgtcgacatccgcaatacagaagcttcatacgaaacgcaattcggcatcgtccgccgcccgacccactacaacacctcctgggacatggccaagttcgaagtttgctgccacaagttcgccgacctgtctgaacatggctacggcgtgtccatcctcaacgactccaaatacggcttcgccaccaccggttctctcatgcgcttgtccttgctccgctcccccaaagcccccgacgctcatgcagatatgggcgcgcacaccatccgctgggccatcttcccgcacacaggctccctgggtgccatgaccgtccgcaaagcctacgaattcaataacccgcttaaactcctcgagtctccgcactctttcgctaccctcgacgaacaggaaccacccgtctggttcaccgataactcgaacccatccctgatcctcgacacaatcaagcgcgctgaggatgatgaggatgtctctgttgaaacaattgaaagtccggtgaaaaagaagaagggacagagtgtgattctgaggatctacgactcgcttggtggacgcgcgaggggaacgatcgagacgagg

SEQ ID NO: 27699 - DNA, 2496 bp, Neurospora crassa
atcccctccttcgcctccacccaactcaccctcctctcctccgagctcgccgccgaaatcgctgagaactccgagctcatcgggctgcacacgcccaccgccctgcagcgcgccggcctggccctgaccaacctagtcgtcaatgcccagcggaccggctatggcggaaagaccgtgttggaactcgggcccgattctgctactgttactatcacttcttcttcttcttcttcatcgtcaggccagaagggtgggggctatgatggaccggaattaccagaacatggaattcggacgggcgatatcgtggtagtgtctgagcagccggctgggagcgcaaagaagcgagaggtcagggaattggagaagaagggcgcgaagggggtggtgacgagggtgggcaggggtgtggtgggtgtggcgctggatgaggataagggggaggagaatgtagttgggacggggggtttggggggcagtgggagggtttggatggttaagttggctgatgatgttacttataggaggtgagctttcgatgatttgatgcgagagtgagagttggggagaggaggtcgattcgggttggtggatgatgagaggaaagccaaaaaagagaacagaggctgggggaacaggaatttgatggtgattacagtcaaacctcagctaacacggtgattgcaggatgaacggaaccatggagaagcttcagaagatgagcgagtcggaacactccatgttcatccgagtcctcttcggacagtcatcaccctcacctgtcccggcggatctaactaatgacccagaggttggcaacattgattgggttgatcctactttgaacgactcacaaaaggatgctattaggtttgcactagcatcgagggagatagctctcatccatggtcctcccggggtatgtttatacgttccctccccgcagtcagtcgcttatatgtctaatccaccattacagactggcaaaacacacactctgatcgaactaatcctccaactcctccgccgagacctccgtatcctcgtctgcggtccctccaacatctccgtcgacaacatcgtcgagcgactctcgccacacaaactgcccatcctccgcctcggccatccagcccgccttctcccctccgtcctctcgcactcgctcgacattctcaccacgacctcggacgccggggccatcgtcaaagacgtgcgcgccgagatggacgccaagcaggcctcgatccgcaagacgcgcaatggtcgcgagcgccgagccatctacgcagagctgaaggagctgcgcaaggagtaccgtgagcgggagcggcgatgcgtgagcgacctggtaggcaggagcaaagttgtgctggcgacactgcatggcgcggggggataccagcttaagaacgaggagtttgacgtggtgatcatcgacgaggcaagccaagcactggaggcacagtgttgggtgcccctgctgtgggcgaagaaggcggtgttggctggtgatcacttgcagctgccgccgacaatcaaatcgttgaactcgagggctgccactacaaaggagaagaaggagggccagacgctggagacgacactgtttgacagactactgaccctgcatggcccctcaatcaagaggatgcttaccacgcagtaccgtatgcacgagaagattatgcggttcccgtcggacgagctttacgagtctaagctggtggcggccgagcatgtcagggagcgcttgctcaaggacttgccgtacgagggggtggaggccaatgacgacaccaccgagccactgattttcattgatacacagggcggtgacttcccggagaagaacgaggaggagctggacggtaacggatcaacagacaaaaagaaggtcattagaagtcttcatggcgagagtaaaagcaatgagatggaggcggcgcttgtaagacagcatgtgcgtggcctgatcaaggcgggagtcagaccggatgacattgcggttgtgacgccgtataatgctcaggtaagttttttttttttctccccctctttgatcgtattcattcttggtgctcctgcctgttccctttccctacttggttcctttttttttttgggaggaagaaaagaaatgcctaccctggcagcccgtatgctttgcatgaaacaacgtgttgtgtgcacccatgccacgacatggaaaaacacattacacggccttgacaactgaccaactcttcttttgtgcttgcgtgatcacagctctccatcctggcacccctaaaggacgagtttcccggtattgagctcggcagtgtggacggattccaaggaagagagaaggaggcagttatcgttagccttgtccgcagcaacgacgaaggcgaagtcggtttcttgggcgagaaacgacggctgaacgttgccatgacgcggccgaagaggtcgttgacagtcattggagactcggagacagtcaagaagtaa

SEQ ID NO: 27700 - DNA, 849 bp, Neurospora crassa
gtcatcgcccccctcgacgtcgtcaagatccgcctccagctgcaacaccactccctctcagacccgctccttcaccagcgtcgcgccgaaatcatcggcggcgggcccgtctacaagggcacccttcctacaatccgacacatcctgcgcaccgaaggtctcacagggctctggaagggcaacatccccgccgagcttctctacgtctcgtacgccgccgttcaattcaccacctaccgctccatcacccagtttctccaagccgctttccccaaagaccaaaacaaacaactgcccccatcggtcgagtccttcatagccggcgcctcagccggtggcgtcgccacggcagttacctaccccctcgatctactacgtacccgcttcgccgcgcaaggcgtcgagcgtgtctacccttctcttgtacaagcgctcaaaaccatttacgcctctgaaggcgtcacgggttacttccgcggccttgggcccgggttggcgcaaatcatcccttacatgggcacgttcttctgcgtgtacgaaacccttcggccccggctctccaagctcgagctgccctacagctcgggtagcgcagtggcaggcgtgctggcgagcgtgatggccaagacaggcacgtttccgttggatttggtgaggaagaggatccaagtgcagggaccgacgaggggaatgtatgtgcataagaatataccggtttatgacggggggatggtgaagacggtagcgacgattgtgaggagagagggggtgaggggactgtatagaggactgacggtcagcttgttcaaggcagcgccagcgagcgcagttacaatgtggacttatgag

SEQ ID NO: 27701 - DNA, 1389 bp, Neurospora crassa
gacttcgagatcatcaaacccatcagcaagggtgcgttcggaagcgtctatctatccaagaagaagtcaaccggcgaatattttgcgatcaaggtcttgaagaaggccgacatggtagccaagaaccaggtcaccaatgtcaaggcagaacgtgccatcatgatgtggcagggcgaaagcgactttgtcgccaagctgtattggacgttttcgagtaaggactacctctacctggtcatggaatatttgaatggtggcgactgcgcgtcattgatcaaagtactggggggtctccccgaggactgggtgaagaagtatctcggtgaggttgttctcggtgtcgaacacctccacagtcggggcatcgttcaccgtgacctgaagcccgacaatctgcttattgaccagaagggacacctgaagttgactgactttggcctctcgcgcatgggtctcgttggtcgacagaagcgtgctcttaacaatggcgctgacgcagctccggatttgctcaagcaaggcccttttgttcggtcctcttcgatcgcatcatctcgttccacttctctcgacgttcatgctcgcaacccatcccctctgtcgaccccacaaatgacgccgagcgactatggtgccggcctaggacagccatcctacttcaacctcggggtgttgtctcaagaacctcggcggttatgcgcgaaccgcagtgacagtggcggtagcgaagcactgtcgcatatgcttccaaatctgtccctgaacgacaccctgtccgtcccgcctcaagccattcagtctcctggcgagcgtagcgaagccgacgagggcacaactcccgacttcgtctcgctctcccacgcaaccacgcaaagcaacgtagacgccaacagaggtactcctccacaacagcctcatatgcccccgccgaattgggcgcttttcgaccctcaggataccaatcgccgttttgttggaacacccgactacctagccccagaaactatcaggggagagcctcaagacgagacaagtgattggtggtccgttggatgcatcatgtacgagtttttgtatggaatcccccccttccatgcacctgaagcggaacaagtctttgggaacatcctggcacgcaaattggagttccctgatgacagtgatatggaaatctcttcagaggccaaggatctgatcaacaagttgttgtgttcggatcctcatcagcggcttggggcgaaccgcgaagacaagtttcagtcaggaggtgaagaaatacgtagccatccgtggttcgagggtgtcaattgggagacattgctgcaagacgatgctcagttcgttcctcaacctgagcatccagaagataccgaatattttgattcacgt

SEQ ID NO: 27702 - DNA, 1412 bp, Neurospora crassa
ttccgcaacgccgtccttcccggtgccggtcttggtctcgagggctacgtcctcttcagtatcggcaacatcgagcctctcttcaaagccacctggccgcaatgctggggccacaatgctaccgagtgcagcagcaactggatcgctgccgtaacatatctcgaggttatcggtattatggttggccagctagtcgttggtgttattggtgattggattggtcgccgctggggtctcattcaggatgccgctatcatgtttgtcggtttgctcatgctcacggcttcttggggtttgaccctccagggctgggtcatctgctatgcttggtctctcttcttctacggcaagtttctcctaaaggcacaacaaagtcgcattacgtgcaaagctaacacattttgcctgcaggtttcggtgtcggtggagaatatcccattactgctacctcctctatggagaactctgtcgcgtccggaaagctttccacgagaaacgaccgtcttcaccgtggccgcaaggttaccaccgccttcttgatgcagggttggggtcagcttatcaaccaggccctcctcattatcctcctcctcatcttccatgccggtagcggatccccgccctatggcctcgccactgtccagtggacattcagattgtcgttcgccattcccgccgtcggtaccctttggctcgtctactacagaacctacaagatgccccacgccagtcgacagcttattgccgccaagaagaagaccaacgttaccggttacgattttgattcccttgccatgaccaccaggcactttggaggccgtctccttgccacggctggttgctggttctgcaacgatgtcttcttctacggaaacaagctcttccaggctcaattcatcgccgtcatcagcggcggctcgagctctgtcttgaccggctggatttggaacttgtacaacgtcatcatctctcttgtcggttattacttggcctcgctcctcatggacaaccgcttctatggccgcaagatgatgcagcaagtcggtttcctcatgtgcttcatcatgttcgtcgttcccgccttcaagttggaatactacaccagccccgccggtatcaagtcgttccaggccatgtacttcctctccagcttcttcaaccagttcggccccaacagcgtcaccttcctcgttgccggtgaggtcttccccacccccatccgcgcctccgcccacggcttcagcgcctgctgcggcaaggctggtgcgcttctcgcctccgttctctacaactacatcgatacccagaccaagttctacgtcgttccctggttcggtctcgccggcatgatcctcacctggctgttcctccccgacaccaccggtcttgaccttaaggagcaagagcgccgg

SEQ ID NO: 27703 - DNA, 1379 bp, Neurospora crassa
gcggaccaggagcgccaacatgccttggcttcgttcaaggcgaaactgatcgagtcgcgagagtgggaagcaaagcttaagaacttgcgtctggagctcaagggcctacagaaggagtacgaccaaacagaagagaacatcaaggcgttgcaaagtgtcggccagatcatcggcgaggtcctgaagcaactggacgatgagaggtgtacgtcttgcatcccctatccattctctggagaccattacgaacttattatgccacagttattgtcaaggcctcctccggccccagatacgtcgtcggctgccgatcaaaggtcgacaaggcgaagctcaagcagggaacacgtgtggcgctcgatatgacaactctcaccatcatgcgcatgctcccccgcgaggtcgacccgctagtatacaacatgtcgctcgaggatcctggccaagtcagcttcgggggtatcggcggtctcaacgatcagattcgtgagctcagagaggttattgagctgcccctcaagaacccagagctgttcttgcgagtcggaatcaagccccccaagggtgtcttgctctatggccctccaggtaccggaaagacattactagccagggctgtcgcgagcagcttggagaccaactttttgaagggtaagctcgcaccctctttgtcttgcatcttgacggcgccaatactcgaacacatgtcactaatactgcgcgttcgtagtcgtctcctccgccatcgtcgacaagtacatcggtgaatccgcccgtttaatccgcgaaatgttcggctacgccaaggaacacgagccctgcatcatcttcatggacgagatcgatgccatcggtggcaggcgtttcagcgagggtacatctgccgacagagaaatccagcgtacacttatggagctcctcaaccagctcgacggtttcgactatctcggcaagaccaagatcatcatggcgacgaaccgccccgataccctcgaccctgctttgctgcgtgccggccgtctagatcgcaagattgagattcctctgccgaatgaggtcggtcgtctggagattctgaagattcacgcctctggtgtggttattgagggcgatatcgactacgagagtgttgtgaaaatgagcgatggcttgaacggtgctgatttgcgcaatgtggttactgaagcgtaagttgacaatttcctgcttttaaaaaaatgccgaccatgcagcacccagctaactcttctattttacatagtggtctgtttgcgatcaaggactaccgcgatgcgatcaaccaagacgacttcaacaaggcggtgcgcaaggttgccgaggccaagaagcttgagggcaagctcgaataccagaagcta

SEQ ID NO: 27704 - DNA, 2175 bp, Neurospora crassa
gactctgccaatctaggtctttcccgtctcgagtaccgcggctacgactctgccggtcttgccatcgatggcgacaagaagaacgaggtgcttgccttcaaggaggtgggcaaggttgcgaagctgaaggagcttatcgacagccagaacctcgaccttgaagagaccttcgattcccactgcggcatcgctcacactcgctgggccacccacggccccccttcgcgtgtcaactgccacccgcaccggtaagttctgcggctctcaggaactgccttcgaacagtggacaagttctgaccaagtaaatcacagttctgatcccaactgggagttctcgatcgttcataacgggatcatcacgaactacaaggagctcaagactttgcttgagggcaagggttttaagttcgaaaccgagaccgacaccgagtgcattgccaagctcgccaagtacctttacgaccagcaccctactgtcggcttcactgatctcgccaaggccgtcatcaacgagctcgagggtgcttacggtcttttgatcaagagcgttcactaccctcacgaggtcatcgctgctcgcaagggttcgcccctcgttatcggtgtcaagacccaaaagcgcatgaaggtcgacttcgtcgatgttgagtacgctgacgatcagcccctgcccgctgagactgcctctcaaaatgttgctctcaagaagtctgcggctggccttctttctcccaacggccttttgggcgctgccgacaagtctctgctccaccgttctcagtcgcgtgccttcatgaccgatgatggcatgcccatgcccaccgagttcttcctctcttcggacccgtccgccattgttgagcacaccaagaaggtcatgtacctcgaggacgacgatatcgctcacatccacgagggctctctcaacattcaccgtctgaaaaaggccgatggtagttccaacgtccgtacaatccagacgcttgagcttgagcttcaggagatcatgaagggcaagttcgaccacttcatgcagaaagagatttttgagcagcccgaatccgttgtcaataccatgcgtggtcgtctcgacgttgccaacaagacggttactctcggtggcttgcgcagctacattgacaccatccgtcgctgccgtcgcattatcttcattgcctgcggtacctcctaccacagctgtatggcggttcgtggtattttcgaggaactgactgagatccctatttctgtcgagctagcgtctgatttcctcgaccgcgaagcacctgtcttccgtgacgacacctgcgtctttgtttctcagtctggtgagaccgctgattcgcttatggcgctcaggtactgcttggagcgcggagccctcaccgttggtattgtcaacgttgtcggttcttccatctccatgatgactcactgcggtgtgcacgtcaacgccggccctgaaatcggtgttgcttccaccaaggcctacacttcccagttcattgccatggtcatgtttgctctgtcccttggcgaggatcgcgcctccaagaaggagcgtcgcgaggaaatcatggagggtcttggaaagatcagcgagcagatctcgtccgtcctcacgcaggatcggaagatcaagcagctgtgcgaggagaggttcaggaaccagaagtctctcctgctccttggtcgtggaagccagtacagcacagctctcgaaggcgccttgaagattaaggagattagttatctccactgcgaggccgtcatgagtggtgagctgaagcacggtgtactggctcttgtcgacgagaacctccctatcatcatgatcttgacccgcgacaagctcttcaggaagagcttgaacgcctaccagcaaggtacgtttaccacattttcccaatgactaaaacccacagacaagatgctaacgctagccccttcaacagttgtcgctagaaagggcaagcccgtcgtcatctgcaacgagagcgacgccgagttccagaccagcgatgccgtcaagatcgagatccccaagaccgtcgactgccttcagggtatcttgaacgtcattcctctgcagttgatcgcctattggttggccgttatggagggcctcaatgtcgacttcccccgaaaccttgccaagtcggtgactgtggag

SEQ ID NO: 27705 - DNA, 850 bp, Neurospora crassa
cagcccagagacgatgtctacggcgcctatgaccattcctacctccagaacagcggcccgaagcaggcgacacaagcacccatcgtgacgggtacctccgtcattgcaatgaagtacaaggacggtgtagttatggccgcggataaccttggtatgctccgaaaaaaaatcaaatgacacccatcccatatcaccccgtgctgacttgttctggaaaacagcctcctatggctccctagcccgcttccccgacgtcaagcgcctccgcgtcttcctcgactcctccgtcgtcggcttttccggcgacgtatccgacatgcaattcctcgaccggcacctgacggacctctccatcgatgaagcgtacgaggacccctcgtgcactgctgctcccaacggcaagggtcacctcaacgccgccaacctgcacaagtatctgcaaaaactcctctacaagcggcgcaacgatttcgacccgctttggaaccagcttctgatcgccggtttcgacggccactccaagccctacctggccagcgttgacctgcgcggcacttctttcacttctccatccctggcgacgggtttcggaagcgcgctggcgcagcccatcatgcgtcggtatgcggagacggaggaggatgcggccaagttgacgcgcgagcaagccgttgaggttatcaaggagtgcatgaaggtgctgtattatcgcgacgcgaggagcttggatcggtacagcattgcggttgtgacgaaggatggcgtcgagctgaaggaggatgagcagctggagaagcagagctgggcttttgctgagcggatcaagggatatggtactcagactgtttga

SEQ ID NO: 27706 - DNA, 1845 bp, Neurospora crassa
agctccggacttcgtaaaaaagtgaccgtattccaacagccacactatagcgaggccttcatcacgagcatcttgctctccatccctgaaggcgccgaaggtaggagaatacacaagccaataccaaaatcttgatacaccaagctttaattgcaagtgggctttgggagctgaccggttgatacaatcaataataggtgccttcctcgtcatcggcggggatggccgattttggaaccctgaggtgatccagctgattgccaagattggtgccgcgtatggcgtcaagaagctcctgatcggccaggatggcatcttgtcgacccctgccgccagccatgtcatccgcaagcgcaaggcgacaggtggcatccttctgaccgctagccacaaccccggaggtgaggaacagcagcccccctagctgtcacggctcacccggtgttaacaatggcttaggtcccaagaacgacttcggcatcaagtacaacctcgccaacggtggcccggcgcccgagtcggtcaccaacaagatctacgaagtctccaagaccctgacctcgtacaagattgcgagcattcccaacattgacatttcaaccattggtaccaagacgtacggtgacctcgaggtcgaggtggtcgatagcaccgcagactatgtcgagatgctcaaggatatcttcgacttcgacctgatcaagaagttttttgccactcatcctgatttcaaggtcttgttcgacggtctttcgggcgtgaccggaccgtacggcaaggccatcttccagcaggagctcggtcttggctccgagtcgacacagaactgcgagccttcccctgacttcaacggtggccaccctgaccccaaccttacttacgcacacagcttggttgagactgtggagaaaaacaacattccgtttggcgccgcctctgacggtgacggagatcgcaacatgatctacggtgctggcgcttttgtgtcgcccggtgacagtttggctattatcgctcaccatgcccagcttattccctactttaagaagaatggtgtgtacggcctggcacgcagtatgcctacttcgggagcagtggatttggttgccaagaagcaaggcctgaactgctatgaggttcccactggctggaagtttttctgcgccttgttcgatgccaataagctctctatctgcggcgaagagtcgtttggaacaggcagcaaccacatcagagagaaggatggtctctgggccattgtggcttggttgaatatcattgcgggattgggtgtcgccaaccccggagtagcgcccagcatcaaacagatccaaaaggatttctgggctgagtacggacgaaccttcttcacccgctacgattacgaggatgtggattcagaaggtgccaacaaagttgttggtatcctcagggatttggtggcggatccaaactttgtaggaagcaaggttggaggtgagtcttgtgacgattgcccttaccaagcggtcttacagatgctaaccggagatccgtttttgtctagatcgtactgtcacggaagctggagacttttcgtacaccgatttggacggctcagtctcttccaaccaaggtctgtatgcccgcttttcctcgggcagcaggatcgttgttcgcctgtccggcaccggttcttccggcgccaccatccgcttgtacatcgagcagcacagcacggatcccgccacatatgatatggatgcccaggacttcctggcgcctgaaatcaagatggcaaccgagctcttgaagttcaaggaattcgttggtcgtgacgagccggacgtgaagacatgagtttgg

SEQ ID NO: 27707 - DNA, 2155 bp, Neurospora crassa
ccagacccgcgtattaccactgagcttctgaagcatcagaagcaagccctttactttatgactgaacgtgagaaagacctgattcaggattatggtgacaaactcacacggtccacttggcagcgcagaaaggatccgcgcggagtcgatttttattacaacgttgtcactatgcagaaccagagagagcgtccgccgccagccttgggaggtattctggcagatatgatgggtaagttgttcgtctattcccattacgaatgttcagactaacagttcgcaatcaggtctcggcaagacattgagcatcttgtcactcattacaaaaactatggaccaggctgcggcttggagtcttgaagctcctgtgcagccgccaaagccgcctgagaagaaacagcccaatgcagcgagatactttgaggtgcccaaacctcaggccatgggcctaacgccggtgcgattgaatggaaaggcaaccctcttggtttgcccactgagcacggttacgaactgggaggagcagatcaagcagcatatcaaacccgacaccttgtcttaccacatctatcatggtcccaaccgtgtgaaggacgtgaagaaactggcacagtacgacctcgtcatcacgacctacggatcgatctcaagcgaactcaacgcccgcgccaagaacaaggctggcatataccccttggaggagatagcttggttccgcattgtgctggacgaggcacatatgatccgagagcaaaacacgttggcgttcaagtcgatttgccggcttcaagcaagccgccgctgggctgtcactggtacgccaatccagaacaagctcgaggatctggcctcgctcctagcatttctgcgcgtcaagcccttcgacgagaagatcaaattcttgcaatacataattgctccgttcaagaatgccgatcccgaaatcgtaccgaagcttcgcgtcctcatcgacacaataacgttgcgtcgtttgaaggacaagatcaaccttccgccacgaacggacgagataatcaggcttgattttacccccgaggagcaacgggtgtatgactggtttgcaaagaccgcaaaggagcgagtttcggtcttgaccggtcaagccatcggtcaggaacgcattattggaggcaagaccatgattcacatcttgcgttccatcttgcagcttcgccttatctgtgctcacggcaaggatctcctcaatgaagaagaccttaaagagctccagggaatgacggcagacacggccattgatatcgatagtgacgatgattccggccagcttgtcctctctgagagcaaggcctacgagatgctctacctgatgcaggaaggaaacagcgataactgtgctaggtgcaacacgaagctgggttccaacgaggtggtggacgtcgaatctgagcgtcaggaggacatcatcgggtacatggtcaaggccaactgctaccacgtttactgcaacaaatgcgttgaccacatcaaaaacgaagcgtgtcctacgtgctctggcatgaccaggcctggttgcatagaactccaccgcgcccgtgccatggccgaacacgaatcgagaaccgccaaggtcgagaacggagacgcaaaccaggacctcaccgcctactcaggaccccacaccaagactcgcgcactcgttgccgagcttctagccgacaagcaaaagagcgaggcggcgccccacgagcccccgtacaaatcggtcgtcttctccggctggacctctcatctcgacctgattgaactcgccctcgaagacgccggcatcaccttcacccgcctcgacggcaagatgacgcgcaccgcccgcaccgcagccatggacaagttccgcgaggacccctcggtgcaggtcatactcgtcagcatcatggccggcggtctcggtctcaacctgaccacggccagcagcgtgtacgtgatggagccccagttcaacccggcggcggaggcgcaggcggtcgaccgcgtgcaccgcctcggtcagaagcggcccgtgcgtacggtcaggtatatcatggcgaatagctttgaagagaagatgctaaggctgcaggagaagaagaagaagttggcgagcttgagtatggatggtagggataagggacaggtg

SEQ ID NO: 27708 - DNA, 1329 bp, Neurospora crassa
cacgaatacaacatcacccgccccaagggatacacggtctcgtaccacttcaaccccgacatggagcctcaccacttcggcctgacccatcccatgaagcccttccgcctgaccctcaccaagagcctcgtcaccgcctacggcatgaactttgccatggacaactacaacacccgcatagccacgtacgaagagctcaactcgttccacaccagcgactatctcgactacctgcacatggccccgcccgaggagatgccccgcgacatcgacaaccccgacaaggaagtcaagttcaacctcggcggctccgactgccccctcttccacggcctctacgactactgttccatgtcggccggcagctccctggacgccgcccgcaaaatctgcaacaagcagtccgacattgccattgcctggggcggcggccttcaccacgccaaaaagtccgaggcctcgggcttctgctacatcaacgacattgtcattgccatcctccagctcctgcgctgctatccacgcgtgctctatatcgacattgacgtccatcacggcgacggcgtcgaggaggccttccacagcacagaccgtgtcttgacctgttccttccacaagttcgcccccgaggtcttcttcccgggcaccggcggtctcgatgacaacggccccaagtccgagcacaatccgggtgcccaccacgccatcaacgtgcccctcaacgacggcattaccgacgagcagtacggccatcttttccagtccgttattggcaagatcaacgaaaagttccgtccttcggtcatcgcccttcagtgtggtgccgactcgctcgccggcgaccgcctgggtaggtttaacctgcaagtccagggtcacggtgcctgcgcaaagttttgcaaaacttttggcattcccatgatcatgttcggcggcggtggctacactcctcgcaatgtcgcccgcgcatgggcctacgagacatcagtagccatcgacgttgacgaaaagatcaacaagattattcccgaccacactccctggcggaagcactttgtccaggaggagctcttcccctcgctagagcagatcctgggtgaaccgcgtgcgaatcggaactcgcagaagcgcctacaggaaatcattcaacatgtgcacgagcagctgcgcttcgtcaacgccgcccccagcgtgcagcagcaggtgattccgccagacctgggcggcatccgggacgatgtcgaggaccgcctcaaagaggaaagcgaggagcgggatgaagggctcagacgggacagggaggaaggtttgggtatcagtggcgagttt

SEQ ID NO: 27709 - DNA, 1532 bp, Neurospora crassa
gctttcgagaacacctccacaagcattgccgctgcccagatgcgcaatgccctcacaaagcttgccgagacggtcaaggaccccgaccagaagaagctcttcgagaccgagatggacaacttcttctcgctcttccgccgctacctgaacgacaaggccaagggcaacgaggtgtacgtatcttgacatgccctgtcgccagccgcgctcctctcgcagacagctaactaactgttcacagcaactgggacaagattgcccctcctgcccctcaccagatcgtcgactacgagagcctcgctaacaacaactcggtcgacttcctcaacaagcttgccgttctcaagctcaacggtggtctcggtacctccatgggctgcgtcggccccaagtccgtcatcgaggtccgtgatggcatgtccttcctcgacatgtccgtccgccaggttgagcacctcaaccgcacctatggctccaacgtgcccatcctcctcatgaactcgttcaacaccgatgatgacactgctgccatcatcaagaagtacgagggccacaatgtcgacatcctcaccttcaaccagtcccgctaccccagaatctacaaggactccctcctccccgtccccaagtcctttgactctcctctccatgactggtaccctcccggccacggtgacgttttcgagtccctctacaactcgggtattctcgacaagcttattgagcgcggcatcgagatcatcttcctctccaacgccgacaacctcggtgccgtcgtcgacctccgcatcctccagcacatggtggagaccgatgccgagtacattatggagcttaccaacaagaccaaggccgacgtcaagggtggtaccattatcgactacgagggctccgtccgtctcctcgagatcgcccaggtccccaaggagcacgtcaacgagttcaagtccatcaagaagttcaagtacttcaacaccaacaacatctggatgaacgtccaggccgtcaagcgtgtcgtcgagaacaacgagctcgagctcgagatcattcccaacgagaagaccatccccggcgacaagaagggcgagtccgacatcagcattgtccagctcgagaccgccgtcggtgccgccatcaagcacttcaagggcgcccacggtgtcaacgtgccccgtcgccgcttcttgcccgtcaagacctgctccgacctgatgctcgtcaagtcggatctctacactgtcaagcacggccagctccaaatgagctcggcccgcttcggtgacgctcccctcatcaagcttggtaacgacttcaagaaggtgtcggacttccagaagcgcatccccagcatccccaagatcattgagcttgaccacctcaccattaccggtgccgtcaacctcggccgtggcgtcaccctcaagggtaccgtcattatcgtggccactgagggccagaccattgacattcctcccggatccatcctcgaaaacgttgttgtccagggtagcttgcgcctccttgagcactaa

SEQ ID NO: 27710 - DNA, 1156 bp, Neurospora crassa
atggactccgtaccagcccagacgcaccagggcttcaaggaagcgggtgctgcttctgcctctcacctcacaacaaccacttctctaccgaccaaggttgagtcacggacagcagtgatggaggctctggaggatatcgtctacggatctgtacgttcactcaccaacaacatccacaacctttcaaacctgtcacttactcacctaagcataggccgccggtatcgtaggcaaatacatcgaataccccttcgacacggtcaaagtccgcctgcaatcccaacccgaccaccttcccctgcggtacacgggacccctcgactgcttccgccaatccatccgcgccgacggcttcctcggtctgtaccgtggcatctcggccccgctcgtcggcgctgccctcgagaactcgtccctcttcttctttgagcgcatcggccgcagtcttttgtactcatccggcttcgccccgcgcgactcggagctctctttgtccgccctctggttcaccggcggcttttccggcgcttttaccagcctcatcctcacgcccgtggagctagtcaaatgcaagatccaagtccctgatgaacctggcggagcaggagcacgacagcggcagctgaagccgatccccgtgatcaaggagatctttcggcatgaaggactacgtgggttctggcatgggcagctcggcacgctgattcgcgaagcgggcggttgcgcggcctggttcgggtccaaggagaccacgtccaagtggttccgggggaggaacgagcgggcgctgctgaagcgcggtgcgagccaggaggaggtggtggcgagtagggaacggccgctgccgctgtggcagcaggcgattgcgggggcgtcggcgggcatgagctataatttcttgtttttcccggctgatacggtcaagagccggatgcagacgagcccgattggtggtggtggggataatggaggaaaaggagcagcgacgatgatgcccaagaagagttttggcgaggaggcgagggcgttgtggaagcaggcgggcatcaaggggttttatagggggtgcgggatcacggtgttgaggagcgcgccgagctcggccttcatctttatggtgtatgatgggttgaagaagtattttcctatggcttga

SEQ ID NO: 27711 - DNA, 2106 bp, Neurospora crassa
agacgggaacccccagacctggcagcactgctgcgcaagaagaaggaggaagaagccgccgccgcgaaaccaagattcatccccaaaaaggaacgagagaggctagaagccgagaaaaaggcaaaggaagaagaggaacgcaagcgcaaggaagaagccaagcctcaaccaaatggaacaaatcataacggcaaccgcatggacggtatccagagtcatcacaaccacaaccctcaacgaaacatcccaaccggacccaaggcgatgcggtacgacgatgaccggggacccaacggcatgagcaacggtcgggactacagagacaatcgcgacaacagagataaccgagacagaaaccaacggggcgcaaaacgcggcgcacccaacgatgacgaagagaagcgagccaagatggagaggaacgacgaggcagagctgcgcgcccgctacatgggtccagtagtaaatcagtccacattctcggccaagaagaagaggaggaggacggcagcgaacaagttcaactttgactgggatgccgatgacgacactagccgacccttcgaccccatctacgcagagcgtcaagagcctctggtccgacttggtggttacgagatgacggaagagatggtgatgcggaaggccgaagccatccgtcgtggcgatcccgagacgggcgaggagcgcgccaggcaatacctggaacaacacagacggatcaaggagatggaacagcgcaagaacctgggcaagcactggtccgagaagaagctggaggacatgaaggagcgcgattggcgtatcttcaaggaaaactttggcattgccaccaagggcggtgccattcccaaccctatgcgcagttgggaagagtccacgctgcctaggcgtctgctcgacattgtcaagaacgtgggttacgacgagccgacgccgattcagagagctgccattcccattgcccttcaagcacgcgacttgatcggtgtggccgtgacgggttccggtaaaactgcagctttcttgctgcctctgctggtttacatctccgaactaccacccctgaccgagtacaacaagaacgacggtccatatgccctgattctggcgccaacaagagaactggtgcaacagattgagagcgaggccaagaagtttgctacacctctcggatttacagtcgtcagtattgtgggtggtcactcgctcgaagagcaggcgtttgctctacggaacggtgccgagattattgtcgccacacctggtcgtctcgtggactgccttgaaagacgtttgctcgtcttctctcagtgctgctacacaatcatggatgaagccgatcgtatgattgaccaaggtttcgaggagccgcttaccaagatcttggatgccatgccggtaaccaacgaaaagccagatacagacgatgcggagaatccacaactgatgagccggtacgtggacggcaaagatcgatacagacagactatgatgtacacagctaccatgcctccgatcgtggagcgcatcgccaagaaatacctacgtcgtccagccatcgtcaccattggtaacgcaggcgaagccgtcgacacggtcgagcagcgcgtcgagttcgtatccggcgaagacaagcgcaagaagcgtctgcaggagatcctcaactcggggcagttcaagccgcccattattgtctttgtcaacatcaagcgcaactgcgacatggttgcgcgcgacatcaagggcatgggctactcggcggttactctgcacggttccaagacacaagagcagcgtgaggcggcgctggcgtcgctgcggaacgggcagacagacatcctggtagccaccgacttggcgggtcgtggtatcgatgtgcccgacgtctcgctggttgtcaacttcaacatggctaccaacatcgaatcctacacgcatcgtatcggtcgtacgggtcgtgcgggcaagagtggtgtggctattactttcttgggtccggaggataacgatgtgttgtatgacttgaggcagatcatctccaagtcgtccatctccaaggtgccggatgagctcaggagacacgaggctgctcagaataagccg

SEQ ID NO: 27712 - DNA, 975 bp, Neurospora crassa
atgggccacgaggatgctgtttaccttgccaagctcgccgagcaggccgagcgctacgagggtacgttaaatcaatcaatgcccgatgccgaccgacatagactgataagttccgccgtgcagagatggtcgagaacatgaagatcgtcgcttctgaggaccgtgatctcaccgttgaggagcgcaacctcctttccgtcgcctacaagaacgtcatcggtgcccgccgtgcctcgtggagaatcgtcacctctatcgagcagaaggaggagtccaagggcaactctacccaggtcagcctcatcaaggagtaccgccagaagattgagagcgagcttgccaagatctgcgaggacatcctctccgttcttgaccagcacctcattccttccgccaccactggcgagtccaaggtcttctaccacaagatgtaagcgtacaacgccccgagtcgcttaccttgccgctctctaacccccgtaacaggaagggtgactaccaccgttacctcgccgagttcgccgttggtgacaagcgcaaggactccgccgacaagtcgctcgacgcctacaagaacgctaccgacgttgcccagaccgagcttcctcccactcaccccatccgcctcggccttgccctcaacttctccgtcttctactacgagattctcaacgctcctgaccaggcttgccacctcgccaagcaggccttcgatgacgctattgccgagctcgacacattgagtgaggagagctacaaggactccactctcatcatgcagctcctccgcgacaaccttgtgagtacactcgaggaggttggattcggttgaacggcgctgactctttttttttcccacagactctctggacctcttccgaggccgaggcgcccgccgctcagggtgaggctgcccccgaagagcccaaggctgacgcccctgcggcggaggagcccaaggccgagtaaagaggt

SEQ ID NO: 27713 - DNA, 1151 bp, Neurospora crassa
cgcccgacatgctacaggagttacaagtccgagaaggaggttgatcccccttgcgagcgcgagggttgcgagggcacctaccgtctgttgcgccatgtctcgtaagttgtttaacataacatcatttgcgccaatgaatgactgaccatgtgtctcctcctcccagcttcgtcgactgccctggtcacgatattctcatgagcactatgctttcaggtgccgccgtcatggacgccgctctcctcctgattgccggaaacgaatcctgccctcagccccagacctccgaacatttggccgccatcgagatcatgaagctcgacaagatcatcatcctccagaacaaggtcgatctcatgcgcgaggaggccgccaagcagcactacgagtccatcctcaagttcatccgtggtaccgttgccggaaagtcgcccatcatccccatctcggcccagctcaagttcaacattgacgccatcaacgatgccatcgtcaacaccatccccgttcctcccagggatttctccatggacccccagatgattgtcattcgttccttcgacgtcaacaagcccggtgccgagatcgacgagctcaagggtggtgttgccggtggttccattctccacggtgtcctcaagctcggcgacgagattgagatccgtcccggtatcgtcacccgtgacgagaagggcgacctcaagtgcactcccatcttcagcaggattgtctccctcaactccgaggccaacgacctcaagtacgccgtgcccggtggtctcattggtgttggtacccgcatcgatcctaccctttgccgtgccgatcgtctggtcggtttcgtcctcggtctcaagggccgcctccccgaaatctactccgagatcgaagttaacttctacctcctccgccgccttctcggtgtccgcaccgccgacggcaagcaggccaaggtcgacaagcttgccaagaacgaagtcatcatggtcaacattggttccacctccaccggtgccaaggtctccgccattaagaaggatgccgccaagctcatcctcacctcccctgcctgcacgagcatcggcgagaaggttgccctttccagacgtatcgagaagcactggcgtcttatcggttgggctaccattgct

SEQ ID NO: 27714 - DNA, 1233 bp, Neurospora crassa
cccaagaagatcacgctcaaggcaccttcgggcacaaccccagttcaaactccgcttctagctcccaaggttcgcctaaaatcgcagggcaaaataccgacgcggccgctgggggagggttacgattcggaggccgatgatagggaagtcgacccagtaattgaagagcagctgatcttgcgcatgatgcctggtgagcactgcgactatctccggaaagccgtggctgaaaggaaagtgggcgttcctaaacatcaaggtggcgccgatgttacaatgaagtttctggatgaagaaggacggcgagtaatgtttgttattcaagggcaaccgtacgccgctattctggttgatctacccacaatcaccgagggcatgaagacgtgggataagaaatccatggtcaagtcagccgacatttgccaaatgatccttgtctttgctaaggtcaaagacgaggcggaggccaagtcggttcctttacccaaggctgtcgagcatggccacagatggccccatggtatcaccccgccgatgcatgatgcacgaaaccggaggtttagaaaacgcctcagcaaattggaaatccagaacaaggaagccgaggtcgagcggttgctggcagcagacagggaagccctcaactccaggtacgagcttgtagcagagggcgggcacggaaataccgctgcgcccgagtccgatcacgaatacggtgacgaggacggaggcatgggaggcgaagaagaccgactagaggactatttcggggacgcaaatatgcagaaccaagacgacgacaacctgttcgacgatctcgaggcagaattcgaaaacgcggcagacacacctgccgaagcaatggacgccatggactttggcgctgccacgcccacggcgttaggcggcggcatggatcttcccacaccccccaccgccaacacgggtacgcctaccgctgcacaaaccgaggagagtgcggccgaagcagtcagcgaggaggacgaatcagatgaagacgacgaggatgatgagggtgacatggacgatgacggcgatgaagagcgccatgatgaggtggcgggagtcaaggctgagattgccacactgaggaagcagctggcctcgtacgaggagcagttgtccaaggcaacaagcattatcatgaagaaacgtctggaaggcagtataaagaacatcaagtcggagattaaactgaagcaatcttcgatt

SEQ ID NO: 27715 - DNA, 1705 bp, Neurospora crassa
agatgcttcggcgacaagggagatgttgaggacatcaccgaaggtacgacccacccctcctcccacgacgggtccctcgaccaggagcccgtcaatgcccctcctcacgtcatcaataccctcagccatactgacccgcctttaccagccgatatcatctccacggtagaatttgaccacaccggaaactacttggcgactggtgataagggtggacgagtcgtgctatttgaacggaacgagacggttagtggagttgcggcaaaccccccctccccctttcccttccggcttatttgctggcccgcttcttgtctatgtcttgcttacctgtggacagaaaaaaacctgcgaatacaagtttcataccgaatttcagtcccacgagcccgagttcgactacctcaagtcccttgaaattgaggaaaagatcaataaaatcaagtggtgcaggagacaaaatgcctcccactacctcctctcgacaaacgataagacgatcaagctatggaaagtgttcgagaagtcgcttaaggttgtcgccgagaacaacctatcccatgatttgacgcctgcaagcgtagccggcggtggaggcgcacctcgtgccttacctcatactcagtttcgcagtcccgccgatctcaagctacccaggcttacccatcacgacacagtcgttgccgccgtgcctcggagaacatatgccaatgctcatgcgtaccacatcaacagcatttccgtcaacagcgatggcgagaccttcatcagcagtgatgatttgcggatcaacctatggaatctgaatatccaagaccagagcttcaacattgtggacatcaagccggcgaacatggaggaattgacagaggtcattacagccgcagagttccaccctctgagctgcaactggttcatgtatgccagttctaagggcacaatcaagctggcagatatgcgcgaaagggcgttgtgcgaccagcacgcaaagagtacgttggatttcggtgaactgtgtttgaagtgtttttttttttttttttttttttttttttttatctctattctccgctgatcattgcttacaattcgtttttttcttccctgtatagtgttcgaacaagaagaagacccatcgtcccgatctttcttctctgaaatcatatcttccatctccgacgttcgattctcccatgacggccggtatatcctttctcgcgactacttgacggtcaagatttgggatgtcaacatggagcggcagccagtcaagacgattccaattcatgaacacctcaggccgagactctgcgacacatacgaaaatgacagcatttttgacaaattcgaggttgtattctctggagacgccaagaacgtaatgacaggaagctacaacaacaacttcatgatctacccatcggatcccgacaaggaggtggaggtcgtcctgcaagcggataagtcggcgttcaaggccaagaaagttggggtgccgacacccattaattcgtcgacaagtcccacagctaacggtggtaagaagggaaattcacgggcaggaagcccggcagcggcaggccagggccaaaggatgcgtaaagagacagacgccgatcaaatcgacttcaacaagaagattctccatatgagctggcatccgttcgaggacagcatcgccatcgcagcaaccaacaacgtaagt

SEQ ID NO: 27716 - DNA, 1404 bp, Neurospora crassa
atgataaagaggcatctcgaatttacccccttggccacccgcgtgctctcccccatgcacatccacaactccccctaccaactcgcccgcacccaactgcacgttgcctcggtcccgacctccctcccctgccgcgaagccgagttctcgctcgtgtactcgcacctcgaagcggccatcactgacggaagcggcacctgtatctacatctccggcacgccgggcacgggcaaaaccgccacggtgcgcgaagtcgtctcgcacctggacgccgccgtgcgcgccgacgagctggatgacttcatctttgtcgaaatcaacggcatgaagattaccgacccgcaccaatcctactctttactctgggaagccctcaagggccagcgcgtcagcccctcacaagcgttggacctgctcgagcgcgaattcagccacccgtccccgcgccgcgtgccgtgcgtggtgctgatggacgagctggaccagctggtgaccaagaaccaaggggtcatgtacaacttcttcaactggcccgggctgagacacagtcggctgattgtgctggccgtggccaacacgatggacttgcccgagcgcacgctaagtaacaagatcagcagtcggttggggctgacgcggattacgtttcccgggtataatcatgagcagctgatgcggatcgtgcaaagccggttggagggcgtgccgggggatattgtggatgcggacgcggtgcagtttgcggctcgcaaggtggcggctgtgagtggtgatgcgagacgggcgctggatatttgtcgacgggcggtggagttggcggaggcggacgcgaaggttgttgctgaggctgaaccgccaacgccaagcaaaaagaagggtgttgaagataaagtggtcagtaagaagaaggggtcggccggtcgagtcacgattgagacggtgcggagggccattaacgaggctacgagtaatccgctgcagcagtacctgaggggcctcccctttgcgtcaaggttgttgcttacggcgctgctgttgcgtactcagcggacagggttagcggagagcacgttcggagatgtgctggaggagatgcaacggatgattaagctggcgaccggaggcgatagtcggccattgaatgccttaatggccacggctggagtgagcgcggcagactatggagatggtatcatgggtgggcctagatccaaacccgatgtcaggcagatgcggccaggcggactcgccatcgcagcggtcgacctaacaggagcgggtgtcatcaacttggaggctcacaaggctgagcgaccgagcaagattcggctggctgttggagatgaggaagttaggttggctttccgtgatgatccggagatcaagacgctaggtgtgcttctt

SEQ ID NO: 27717 - DNA, 1122 bp, Neurospora crassa
atggttcccgtaaatcgggcacaaagtccagtatgtccccagtccaaagcttccatcgcaatcgttgtaacctttgagacctcctcgctgacttaatcccctcccaaccaaacagccttccacttcgtagctggtctcggctccggtgtcctctccgctatccttctccaacccatcgacctcctcaagacccgcgtccagcaatccggcaaacactccctccgcgccgccctcgccgagctccgctcctcccaacaaggcctcctcccctctctctggcgtggcaccctcccgtcagctctgcgcaccggcttcggctccgccatctacttcacgaccctcaacaccatccgcgaaaatgccgcgcgccatctgccctcgctcgcagcggccgcgcccaccatagccgccgcatccggcattgtcgcccccaacgcaaaccagacatcctcctccctccctaagctctccaacacaggcaacctcctcgcgggcgccgtcgcccgctcctttgccggcttcatcctcatgccgctcaccgtgctcaaggtccggtacgaaagcagtttctacaagtacacctctttagccggcgcggcgcgggatatcgcgcgaacggaaggggcgcgcggcttctttgctgggttcggcgcaaccgccattcgcgatgcgccgtacgcgggactgtatgtcttgttctacgaaaaatccaaacaacatctcagcaatcttttcccgcagccaccacaaccacaactatccaccaccaccacccttgaggcagcagcgggacaagacggaggaggacgcatgagccaatcccgcgccgcttcgatcaactttgcctcgggcgtcttctcggcaatcatctgctcgattatttcgaacccgtttgatgcggtcaagacgaggatccagctgcagccgaaaaagtaccgaaatatggtgcaggcttcgagaaagatgttggccgaggaaggggtgaggagcatgatggatggactggcgctcaggatgagcaggaaggcgatgagctcggcgttggcgtggacggtttatgaggagctgattagacgggcggagggggcgtggacgaagaggggaccggaggaggttcagctg

SEQ ID NO: 27718 - DNA, 3722 bp, Neurospora crassa
atgggcttcctcggcgtctatagggccatttacgattacacgccccagggcgagggcgagttgacaatctccgagggcgacattctctatgtgttggaaaagagtcaggaggacgattggtggaaggcgaagaagaaggccaatgctgccgacgatgacgagcccgtcggcttgatccccaacaactacattgaggaggtatgtaatgtggtccgaggtctagatctggattgcgtgcagtgtcatctgggcacttgtacctgcttggaggatagcaagctggctggccttggcattcagatggatcacttgaactgaccgcgcacaccatgacgccaggcgaaacccgtatcatacgctcgcgcgctctacgagtacacgcgtcagaccgacgaagagctctccttccccgaggatgcgcagctctcagtcttcgacacttccgaccccgattggatccttgttggccacgatggcgactacggcttcgcgcccgccaactacatcgagttgggcgatggccaggctggccaggtcgaggaggaggaagaagcgactgccccccctcctcctcttccgcagaggacacccagcgtcagcgtcgatgtagccagcccgcccctgcccgccaggagtgtgccctccgagccaagcacccctgtcgccgcttccaaccctgctgccgccgccatcgccggagttatggccaaccgctcttctttccaacctccagcgcctatcagtgttccccagccccagcgacagtcatacgcttcggaagattacgaaaatgaggtaaggtccccgccgcttccgagccgcccgcggggcgattcgcaaattgctccggagcaaaaatcctacagaccggtgccgccgcccgctcagtcagcagcccacgacaccgacgactatggcattagcccgcgaacctcccaggctcctcctcctcagaccgccgcgcttacccctggcggtttccacatgtacaacatcaacgagatgacgtcggtgatgggcaagaagaagaagatgcctaccacgctgggcatcaacctgaggacgggaatgattctcatagcgccggaacattcccacgacggtccatcgcaggaatggcgggccgattgcatgacacactactctcgggagggcaagcacgtgtttatggagctcgtacgaccaagcaagagcgttgactttcatgcgggcgccaaggacaccgctgaagagatcgtcgcgatgctgggcgacatggccggaactgtgcgcctcgagggactcaaggagatcattgccgcgggagccggaggcaagaagaagaagggtgctgtgctgtatgattttatggctcagggtgaggacgaggttactgtcggcgttggtgatgaggtagttattctcgacgataccaagagtgacgagtggtggatggtgcgtcgcgtcaagaacggcaaggagggtgtggttcccagcagctacattgagatcaacggcgtgtgggaagagccggagacggccgttaccggtattgccgtgggcatgtcggaagtcgagaagaaccgcctggaagaggcgcgcttaaccaaggaggctatcaaggctgcccagcgcgaggaagagaaggagaagcagaagaggaactctgaggtaggcccaggattgcaattgcaagaacgaaatagtagtttgccggccacagatgataacaggagaggaaaacagcgaagcagtaggcgcgaacccggtcagaacagcagctccaagtcgtcaagcaagtcgagtaagtacacccatgtccagattttctttcagagtatgcagaatactgacagtttgtcgcagagcccgatccttccaaagtgcgaacatggaccgatcgatccaagtccttcagcgttgaggcccagttcctcggtgtcaaggatggcaagatcaggctccacaagatgaacggtgtgcagatcgccgtgcccgtctcgaagatgtcagttgaggatctcgagtacgtggagcgcgtaactggcgaatctctcgacgaagacaagcccctatccgatcttaggaacaagcgatccgccggtgagtcttcgaggtctagtcgatcgacgcgcgacagggaaagagaccgtggttccagctcccgggttggcgccaccatcgattcctcgaagaagcccgactacgactggtttaacttcttccttggttgtgacatacaggttggtttgtgcgaacggtattctcaagctttcctgcgggaggctatcgacgaaagtgtcttgccagatgttgatgctactgtgctgaggaacttgggcttgcgtgaaggtgatattatcaaggtcatgcggtacctggacaacaagtacatgcggaacaagaaaggcgaagagggcgagggaggactcttctctgggccaggaggtgcgctccgcaacaacacgaagaagggcaggccggcgccccccgtcgaggtcagcaacaccgttgatcccaacgctttctctaaggactcgggtgctggtagtggcaagtcatcatctcctacggctgcggctacgccaacaccgtctgcctcgaagccttccagtggctttgatgatgatgcttgggatgtcaagcctaccaagacgaaaacccctgagccggctgcgcaagccgttgctcccgctcctgcggcggcacccgctgccgctccagcccctgctgcgccagctctggttgacgcgccggccccccctccgccggcggctcttaccaagtcgatgcaggagttgtcgttgcttacccagcctttggaacccgagaaggtcgctcctccgccagttgtgcaaccggccatcacgttgcctccgccctccgcggctccagctccggctgctgctgctcctgcacaggtccctcagcttaccggcgccactcccggcttcttcaccggtatgcaacctcctgctgttggtgcacagatccttcctcaaaacattgcccgtcaaagacctcttgctcctcagttcactgcggccccgggtggtcttgttgctccacctccatctcgccccctctcggcgcctcagtccgctcaacccagcgccttcacgccaccccctatccagcctcagatgaccggtttccaggcaccccagattgctcctcctggccagagcctcggcgatctcgcccagcaacgtcttcagcagcagtacaccgcccagatgcaggcccagcaacaacagatgcaacagcctatgatgacgggcatgcaacctatgatgacgggcatgcagccccagcagaccggcttcggccaattcccccctcaacaacaacccttcatgccccagcctaccggctttggtatgcagcagcaacaacaacccatgatgacaggcatgcagccccagcaaaccggcttcggtcaattccctcaacaacagccgcaaccctttatgccccagccgaccggttacggtcacgtcggtggtggactgccgcctcctctccagcctcaggctacgggcatgagcttcactcagggctttggaaacggaccccagcagcatcagcagccgttggtgccgcagcagacggggccggcgccgcctgtgaggttcggtattagtggtgatgcgaagaaactggcgccgcaggcgacggggaggagagccaacttggctgctgctagtaagttttgcccgcataaaaggcatgtcttgttgtag

SEQ ID NO: 27719 - DNA, 983 bp, Neurospora crassa
atgcctcttgaagcggtaatgattgtggtggacaacagcgagagcagtcgcaatggagattacataccaacccgctacgacgcgcaagcggacgctgttaacatcatcttccaaaacgtcgtacaaggcaaccctgagtcgtcggtcggtctcatgagcatggccggcaggggtcctgaggtcctggtgacgcttacaacggaccaaggcaagattctcgagggtctgcaccggacgaagaagaacattcgtggctcggcacagttgtcaagggctatccaggtggcgtgggtatgtggcatcccctcttgatctttgctcggagattacagacagttgactagctattctacctaccacagcttgctctcaagcaccgacagaacaagtcccaacggggtcgtatcgtcatttttgtttgctcgcccatcgaggaagaagagagcgacctcgttaagcttgccaagaagatgaagaagaacaacaccagcgtcgattttgtgcttttcggcgacatcgacgacgagaaccagaagaagctcgaggctttcaaccgcgaggtcaagagtggcgaaggatccaacatggttgtcatcccaccgagcagcaagcttcttagcgaccagctcatctcgacacctatcctcctcggcgaggctgctgctggcggtagcggaggcgctggtggcgatgctggcggagcggccaacgaggacttccccttcggtatcgatccatccgtcgaccccgagctggcccttgcgctgagaatgagtatggaggaagagaaggcacgccaggagaagcgcgccaaggaggaggccgaggcggcgaaaaaggcgagcttggaggacgtcaaggaagaggctggcgagtcggaaccattgctaggcaaggacggcgaaccgagcggcagcggcagcaaaaaggatggtgacaagcccggcaaatcagatgatggcgacaagatggatacctcctag

SEQ ID NO: 27720 - DNA, 1363 bp, Neurospora crassa
atgtcgcgctatctccgacccgcagtccgcctggctgccacggcctcgcgtgtccaggttgcccgtcctgccgccccgtccttcttcaagcccgcctccgtggccgctttccaaaaacggacctacgccgatgctcccgccggaaccaaggactacacggtccgtgatgccctgaacgaggccttggccgaggagcttgaggccaacgacaaggtgtttgtcatgggtgaggaggttgctcagtacaatggcgcatacaaggtcaccaagggcctactagatcgcttcggcgacaggcgtgttatcgacacacccatcaccgagatgggcttcactggtctcgccgtcggcgctgctctcagcggtcttcaccccgtcgtaagtacactcttaagaagggacccatcgtgacgcacacaccggaccagccatgactcgtagaagcttggattcatcctaagctatacctccagccctacatcagttcagccctatggctgcgactacgcccatgatagtaacgacggccagcagcggaacagaaacaaacatttagcagaagcacacaagctgatcatgttccttcttccccaacatctagtgcgagttcatgaccttcaacttcgctatgcagtccatcgaccacatcgtcaactctgccgccaagacgctctacatgtccggcggtatccagccctgcaacatcaccttccgcggtcccaacggttttgccgccggtgtcgccgcccagcactcgcaagactacagcgcctggtacggttccgtccctggtctcaaggtcgtgtccccctggtctgctgaggacgccaagggtctgcttaaggcggctatccgcgaccccaacccggtcatcgtgctcgagaacgagctcatgtacggccaggtcttccccatgtccgaggccgcccagaaggacgacttcgtcattccctttggcaaggccaagatcgagcgcgccggcagcgacctgaccatcgtgaccatgtcgcgctgcgtcggccagtccattgtcgccgctgaggctctgaagaagaagtacggcgttgaggttgaggttcttaacctgcgctccatcaagccccttgacttggacgccatcctcaagtccatcaagaagacgcaccgcctcatgacggtcgagtccggcttccccagctacggtgtcggtgctgagatcgttgccctggctgttgagtacggcttcgatttcctcgatgctcctccccagcgtgtcaccggtgccgatgtccctacgccctatgcccaggggctcgaggagatggccttccctactgagtctcttatcgagaaccacgccgccaagcttctcaagcttatctaa

SEQ ID NO: 27721 - DNA, 1217 bp, Neurospora crassa
atgccttccaccattgccctcgagaaggaggaccaccagcgtgatgctgagttcaagaaggtcatgcacggcgactcggccaaggccgctggcggtgtcgctgctctgctgaagaagaacaccgaggctcagcagattgccgtggacgagtacttcaagcacttcgacaacaagactgccgaggctgagacccaggctgatcgcgaggcccgtactaaggagtacgcgaccttgaccagacagtgagttccctcgccttgcctcgcaagattcttgctttgtgcgaacacgtggagactgacaaacgcgtttcctgcagctactacaacctcgcgaccgatatttacgagtatggctggggccagtgcttccacttctgccgttactcccccggcgagtccttctaccaggctattgcccgccacgagcactacctcgctgcccagatcggcatcaagaaggacatgaaggttctcgatgtcggctgtggtgtcggtggccctgcgcgcgaaatcgccaagttcactgacgcccacatcaccggcctgaacaacaacgactaccagatcgaccgcgccactcattacgctgttcgcgatggtctctctggtcagctcaagttcgtcaagggtgactttatgcagatgtccttccccgacaactcgttcgatgccgtatacgccattgaggccaccgtccacgctcctaagctcgagggtgtctacggcgagatctaccgtgtccttaagcccggcggtacctttggtgtctatgaatggctcatgactgacaactacgataacgacaacgttgagcaccgtgacatccgtctcgccatcgaagtcggcaacggtatctccaacatggtgaccatcagcgagggtctcgccgccatgaagaacgtcggtttcgagctcgtccaccacgaggatcttgccgatcgcaacgaccccatgccctggtactggcccattgctggtgagctccgctacatgcagagctacctcgacttcttcaccgtcgtccgcatgacccacaccgcccgccgcatcctccacggtttcgccggcatcctcgagaccgtcggccttgcccccaaaggtaccaagaagaccgctgacgcgcttgcccgcggcgccgatggcctcgttgccggtgccaagaagaagctcttcacccccatgtacctcatggttggcaagaagcccctcaactaa

SEQ ID NO: 27722 - DNA, 1151 bp, Neurospora crassa
tacaacaatgccgtatattggccgaatcacagcgtgtaccgaggtgacactcccggttcactcaactacggatgcatcaaccgtgtttactatgcctttgccaacatcatggcagacggaggggtgtttgtaagtttgttccgacgccatcttccatcgttaagcacttcagctgacttgttctggtagctcagcgatgagtgggcagatgtcacagcgccttgtgacggtgtccaaggggctctcgggtccttgatgcatctcaagcagaaatatccccatctgcaagtggtcttatccattgggggtggcgcttccagtgagacattcgcactggtggcttccagcgccattctccgtaacaactttgcacagtccgctcgcggtctggtggaagcatccggcctggatggaatagacagtacggctcctttcccttcgcctcatctcgcctcgtccaatatcgtagccaatgaccacgtacgcgtgagaaggctcagccactcttgcctcgtcacacatgtacaaatccccaatgatcttgttgagatgtttgactgacagcaccagttgtatgggactacccctgctccccgcaacaaggaagtgatttcgtatctttactggccgcagtccgcgtccatcttcccgaggaccgttacctgctcaccgctgctctccctggggccaagtccatcttgcagaatatcaatgtgcggcaggcagctgaatacttggactccattaacttgatggcgtacgactattttgggtcttggtcacaccgaagtgggcatcactcccagctttatgcaatgaataaagaagaagcatcaggggcgtcgagtgtgcaatatctgatggcttccgctgtcccgggcaagaaaatcttgtttggaatccctctctttggacgcagctttcttcacgcgagcggctcaggccacaaattccagggtgccgggggcggcgacgacggatccttcgagtattgtcagctaccacgacgaggaacgaaggaacaagttgacaagcgggccgttgccgcccagtgtgtgggcggagacggtgggttcgtcacttacgataatccggatacagtgaaggccaaggccactttttgtaagcaaaagggactcggtgtaagttgc

SEQ ID NO: 27723 - DNA, 1301 bp, Neurospora crassa
tcaggcgacaagaaccacacagtcaccattgccgagtctgcgaccgtccttcagctcaagaccctgttagcgggggaggaatacgagaacatctcgccggagcagcaacgcctcatctactccggaaaggtcatgaaggacgatgaagttcttagtttctacaagatcaagcacatgaacacagtgcacatggttaagcgtccagccagcgccgcgacagccagcagtggctcaacctcgacacccgctcagcccgcgatacctcagaacatggctgccggcactccctcgaataaccttttagctggcctcacaggcgctcgctttgccggtcaggtgccgctaccaagccgagacctgtttgggccggacggaggagtacgccacccctttctcggccccctggacccttaacatagctgtttactaatgatgttttatagatgggcgcgcctcctagcgaggatgaaatcgcgaacatgctctcgaacccagcgatggcccaggtcatggccgaggcgttcaacaaccccgccgtcatcgaccagatgattgcctccaacccgatgttggccaacatgcccgctgatcgcgctcgcgagcttctcaactctccgatgatgcgcaacatgatgacgaacccggaggcacttcgcatggcggcacgcatgcgtaggatgatgggcggaggcgccaacgcctttccagcgcccggggtaacggacaacactccgaacgcgacgaccggtgccggtaataacaacgccaatgccgatgcgcagaacccgttcgccatgtttcttccatttggtgttcctccggcgggcgctcccccagcaggtaatccctttgccgcgctctttggaaaccccgcggggtcttcgcctgcgtctaccggagcttcgaccgagagtgccaggagcggggatgccgcatctgctccggctactggcgccacttcggggtctgggcagcaagcagatccgttggcatctttgttcggagcgcttggaggtgctggtcagcctggtcaggctggtgccgcgaacccttttggtttgccccctatctcgcctgaggccttgcagcagatgatgcaggcatttggtggcggtggtttgggtggttttggcggaaatcccgttgctcctcccgacaacaggccgccagaggagaggtatgctgagcagctgcgtcaactcaacgatatgggtttcttcgattttgatcggaacgttgctgcactacgccgcagcggtggtagcgtacagggtgctatcgaacatcttctgggcggttct

SEQ ID NO: 27724 - DNA, 1164 bp, Neurospora crassa
tggcgcaaactgcctatcagtctcacagagctctgcatcgaaaccacactccgatgcggccagtcctttagatggcgcaagataaatgaacaatggtccgaatgcacaccactatcttactttttttctttttatttcttctctgttcaaagtatcaagtcctaacagttttccaggcactgcgtcctcaaaggccgtctcatctccctaaaacaagatcccacccatcttcactacaaagtgacatggcctaccagtacagcaactcccaaaaatgaacacccccaggacttcgaagacgacacgtccgtcctcctccacaactactttgccctctctcactctctcactaccctttacgcccaatggtctctttcagatgccaacttcgcccggcgtgcgcccgctttcacggggatccgcatccttaaccaggacgcatgggagacgctgatctccttcatctgcagcagcaacaacaacatttcgcgcatcagccagatggtgctgaagctgtgtacgcactacggtccttatgtggccaccgtggagggagaagcgtttcatgatttccccgggccggaggcgttggcgggggaaggggtcgaggcccatctgagggagctgggctttggttatagggccaagtacattgctgagacggcggggtgtgtggcgcaggtttatggggagaggtggttgctgaggttgaggaatccgggtgttcctgcgttgagagcggctgaggaggatattttagtgaagaaggaagaaggggcagaagagaaggagtctgttgaatccaaggctgacttggacaacccaccgacctaccagaaggctcatgaagctctgttgactctgccgggtgttggccccaaggtgtcggattgtgtgtgtctaatgggtctcgggtggggcgagtctgttcccatcgacacgcacgtttggcagatcgcgcaaagagactacaattttggtgggaaagggtctgccaagaccaagacgctcaacaaggccatgtatgtggccgtaggcgaccatttcaggaagatatggggtcctcaggctggttgggcacagagtgtcctctttactgcgaatctcaagtcgttttccgaacaagcagctggggtagagaagaagagggtggtgaaagtcgaa

SEQ ID NO: 27725 - DNA, 1800 bp, Neurospora crassa
ggcacaacaggctgcgtcctggcctcgcgcctctccgaatctcccaacgtttccgtcctcctcctcgaaaaaggccgagtacacgataacttcctctctcgcatacctcttctctcgcaaaacttcgaattccccttcctccagtccgtccgtcgtgactccgacccaatccccgctgcgaatggcagacgagcggcactctggaccgctgaggccttgggcggggcgacacggatcaatgccttgctatggacaagaggtggggcaggagggtacaaccagtggtctgaagactatggactagaggactggagctgggagagggtcgaaccgtggtttaggaggagcgaggatgttgtcaggcctaggaagccggggctcacacttgggtgtatacccttcgtggaggaagcggcgatgagagttgggttacctgtgggagatggggtgaatgatccttgtgcaaacgcccaaggatgctttgtaatggatcagactattgatggaaagggtcagagaatgtcggcatacaaggcttggttgccgaaggagatggtgagggagaggaaggggttgaagatctgtaccggagtggtagcttcgaggctcttcttcagcaaggatgggacacgggtgacgggtgtgagggttcgagaaggtgaccgcgagtacacggtcaaagctcgaagggaggtcattgtctgcagcgggactatttgcacgcctcagctactgatgctgagtggcatcggacctcgccagcatctcgaatccctcaagatcccagtcctccacgaccttccagcagtaggacaaggtctctccgaccatacctccgtccccatcatcatggagctcccgcgcaaacataccctccactgcctcgaaaacgccttcgtcttcctctggcaccttctcctctacctcttcttcggcagaggcctactcgccaatggaaccactccccgaagcatcttcgtacgtatcgcagctctggacgagaacacaatgacagttcgacacgttgacgactcagaccaagacaccatggacatttctcctcctcgagatattccggatgtcgagattatgatcaatcccgtcaactgcctgaccgtgagcgtctcgggcaagtcactcttcacgtggtacacaacgctcatccaaccatattcgagggggcatgtcaaggttgcgtctgatgacccgctggctgacccgaagatctgttacccgatgatgaccgatgccagagatcgagcgacaatgaggaaggcggtgcggttcactatgcggttggcggaagagtttacaaacacgggatatccgcaagaggcaccactgacgattgcgccagggatggatttggtgtatttggacgccctctacaaaaccaagacgggattgttgcaaaggttctggacgacgaagaagccggcggatgaggagcccgttcctgtgcctggtaaagatcctttgccaggagccacacaactatctgcttccacgtccacaaacagcgaatccgaaatgcagcagttccaaaaaccaaattggcgcacagtcacagacaaggaaatagatgcctacgcctcccgcgtctgtgtctccagcctccacgtctcctgcacctgccggatgtcaaacaactcaagagagggagtggtaaaccagatgctgaaggttcatggcattgagaacttgagaatcgcagatgctagcgtgtttcccaagatcccgagtgcgcatacgatggcaccggtggtcatgatggcggaacgatgcgctgagtttgtcaag

SEQ ID NO: 27726 - DNA, 1323 bp, Neurospora crassa
tctctgaacaatgtcctctccgtcgaccgcgccaccaagacagccctggtcgaacccaacgtgcccatggacaagctcgtcgaagccacgctgcctcatggcctagtcccgcccatcgtcatggagtttcccggtatcactgccggtggtgggttcgccggaacagcaggagagtctagttcgtttcgccatgggtttttcgacgataccgtgcgggaagtggagatggttttgggtaatggggaggtggtcaaagtgaagaatcctgatctgcctcgagaggtatcatcaacggcaacggcagcagaaaacggcggggatctcttccgcggagcagccggcgccgtgggaactctcggaaccacaacactcctagaagtccaactaatggacgccaaaaagttcgtcaagaccgaatacaagcgcgccaacagcgtagcggaagcgatccgcatggtgcgcgaggaaacccaaaatgccgagaacgactacgtggacgggattttgtttagcaaagaccacggcgtcatcgtcacaggcaaactcgtcaacgagttaccttctcctcccccttcttcttcttcttcttccgcctccgaaaagccaatcaaaccccaaaccttcagcggaccatgggacccctggttctacctacactgccaatcccgcaccctttctccctccacctccaccaccccaaattcttccccggtggtagcgaccgactacgtccccctagccgaatacctcttccgctacgaccggggtggattctgggtcggcgccgccgccttccaatacttcagctgggttcccttcacgaaactcacccggtggttcctcgacgactttttgcacacgcgcatgatgtaccgcgctttgcacgggtccggcgagtccgcccggttcgtcgtgcaagacattgccatgccgttcgagacctccgaggaattcatcaactacacctcttcctctctgggaatctggccactatggctttgcccacttaaacgccgcgcgcccccgacttttcatccgcatacgacccgtcctggcaccgacccgtcggacgaaaaggcgcaagatgacatgatgctcaacattggcgtctggggctgggggcccgattccccccaagagtttgtcgccaagaatattgagttagagaataaagtacatgagttgggtgggatgaagtggttttatgcgcatacgtattacgagcaggaaaagttctggaagatgtatggtggacggacgtggtatgatgcgctgagaaaaaagtatcatgccgagcacttgccgacggtgtgggacaagatc

SEQ ID NO: 27727 - DNA, 1886 bp, Neurospora crassa
aaggacgatgccgacttgaccttctccgacctgggtctcgaccctcgccttgtgcaggccgttgcgaaacagagctttgagaagccgacgctcgtgcaaaggaaggcgatcccgcttgcgctggcgggccaggacgtgctgtgcaaggcgaagacaggatcgggtaagacggcggcatatgtgttgcctgtgttgagcggcattcttaagaggaaggctgtgagttaccttgacacccgggagaagaagttgtgttgtgacaaggttggatgctaacgaaaaggaaaccacaaacagaccgacccaacccccttcacctccgccctcatcctcgtccctacgcgcgaactcgccgaccaagtccacaaagccatcgatgccttctccgccttctgcaccaaggacatccaatccgccaagttgaccgacaacgtgtccgacgccgtcctgcgctccctcctcgccaatgcccccgacgtgatcgtctccactcccgcccgcgcctggcacaacatcgagtccggcgctctcagcgtcgccaagctacagtacctcgtgctcgacgaggccgacctcgtcctgtcctacggctacgatgaagatatggagaacatcgcccgctcgctgcccaagggcggtgtgcagaccaccatgatgagcgccactctcgtctctgacgagctcgacacgctcaagggctttttctgccgcaatcccaccatgctggacctgaaggaagagttcagcaacgaggacgagaagctcacccagttttacgtcaagtgcggcgaggatgacaagtggctcatcagctacctgatcttcaagctgcagctgatcaagggtccctgtctggtgtttgtggcggatatcgatcgcgcgtaccgcttgaagctgtttttcgagcagtttagcattcgcagctgtgtgctgaactcggagttgccgattaatacacggatcaagattatcgaggagtttaacaggggtatttatgatatcatcattgcgtcggatgagaggagcgaggtcttcttggaggacgagaagactgaggagaagaaggaggagcaaggtgaaaagaaggagggcgatgagaagaagaacggcaagggaaagaagaagaagggcaggagggatcaggagtatggtgtttcgcgaggtaagtctgtctgcgttttggtcctacatggttctggatactaacccaaatgatcccaggcatcgacttcaaaaacgttgccgccgttatcaacttcgacatgcccacttcttcctcttcctacattcaccggataggccgcaccgcccgcgccggtcgcgccggtattgctctatcgatggtcgtccctcacgatctctttggcaagcacaagcccaccagcatcaagcagtgcgagaaggacgagaaggttctggccaaggtgatgcgccagcaggccaagctcaaccgcaagttggagccgtacaactttaacaaggatcagatggaggctttccgttatcgtatgaacgatggtcagtaccccctttcccccttatcatttcgtccatttgaccattcattctctaactgagcaatagccctccgcgccgtaacaaaagttgccatccgcgaagcccgcacccgcgaactgcgacaagaactcctgcgctccgagacgctcaagcgctactttgaagagaacccgcacgagctgtcgcacctgcgccacgacggcgagctcggcaccaagatgcgccagcaagcccatctcaagcacgtgcctgattacttgctgccccaggacggcaagaacgctctcacggaaacccagattgggttcgtgccgtttaagaagcagggcgacgataagaagacgagaggcaagaagggggccaagggt

SEQ ID NO: 27728 - DNA, 1815 bp, Neurospora crassa
ccagcggcctttttggtcagcgccttgaccctcactcaggtagtcactgcaacacctttctctccgccacgacagaaaaacattggcaccagcgacgactctgcagcagcagcatcatcatcccaagccgcctcaaaccaagaaagacgagatgctgtcaagcaagcctttcagatctcctgggacggctactacaaatatgcgtttcctcacgactcattgaggcccgtgaccaactcttacgaggatgaccggtaattcccccattcttttttaccccttctcagccaactgaacaccacactaacaccaccacacagaaacggctggggtgcctcagcaatcgacgccttctccaccgccatcgtcatgcgcaactggcccgtcatcaaccaaatcctcgcctacgtgccccaaatcgacttcacccgcacctcgagcgaaatctccctctttgaaaccaccatccggtacctaggcggcctcctctccgcctacgacttattgaccaccccgcctctgtacgccgacgccaaagccgcagccccagatgtccatctcaattctacttcttcccaaactgccaccgacgccatcctggcccaagccatccgcctagccgacgccctgtccgtggccttcgacaccccctcgggaatccccgataacaacctcatctttgaccccgtgacaggcccaaagaggacaggatcgcagacgaacggcatcgcgaccattggcacgctggtgctcgagtggacgcgactctcggacatcacagggaacagcacctacgcgcagctcgcgcagcgggccgaggcctttttgctcaatccgcaacctagcgcaatcgctgagccgttcccgggcctgctggggaccaacgtcaatatcaccagcggcttgttcgtcgacagcaccggcgggtggggcggcgggaccgattcgttttacgagtacttgatcaagatgtacctgtatgacccggaccggttcgcgttgtatcgggatcgctggatcttggcggccgattcgtcgattcagtacgtggcttcgcatcctactacccggccggacttgacgttcttgggcgggtggaaaggaccgagggggaacaccacgctgcggttctcgagcggacatctggattgttttgatggtggtaatttcatccttggcggattgacgctgtcgaataagaagtatttggactttgggctggagctggtcaagtcgtgcgcggaaacgtactcggctacagctacggggattggtcccgaactgtttagctggcaggacaaccgcacgccgctgaatgcgacgaataaccgcgggcctccctcggcggaacaaaaggcgttttatgagaagaacgggttttggattactaacgagcagtatgtcctgcggccggaggtgattgagagtatgtactatgcgtggcgggcgacgaaggatgaaaagtatagggagtgggcgtgggcggcgttcaaggcgatcaatgcgacgacgagggcggggagcgggtatagtagcgtggcgaatgtgaataaggtgggagggggcagcaagacggatttccaggagagtttttggtttgccgaggtgttgaagtattgttggttgattttccaggatgtgagtttttgttctcttttttttccccttctcttatgttctcgacgtggagggatcgataagaagaagaagaagatgctaacaggaaaacaggaggatgacccctggcaagtcaaagccgaccagaccaacgagttcgtctacaacaccgagtgtcatcccatcaggctggcaaag

SEQ ID NO: 27729 - DNA, 663 bp, Neurospora crassa
caacccaccccacaagccctccccggcgcccgctcctcctcgggctcctccatcctcgtctccccgcgccaaaaaggcaaccccgtgctcgcctccatcaagtccaccgcgtgggaatactccgacatccccgccgactacgtcctcggcaccaccacctgcgcccttttcctgtctctcaagtaccaccgtctgcacccagaatacatctacacgcgcatccgcctgctgcagcaaaaccggtacaacctgcgcatcctgctcacgctcgtcgacatccccaaccacgaggagcccctgcgcgagctgtccaagacgtcgcttgtcaacaacgtgacggtcatcttgtgctggtcggcgcaggaggcggcgcgctacttggagctgtacaagtcgtacgagcacgcgagcgcgagcgcgatccgaggccagcagaagacgacgtacgcggagcaaatggtggagtttgtgacggtgccgaggagcgtgaacaagacggatgcgattgcgctggtgagcacgtttgggagcttgcggaatgcgatcaatgtggcgacggaggcgaatggggaggagcggttggggaacgtgcaggggtggggagagaagaaggtgaagagttggaggagagcggtggaggggagttttagggtgaggaagacg

SEQ ID NO: 27730 - DNA, 1149 bp, Neurospora crassa
cggagacaggaagacgaagggctgaagaaccagaacttgggcacgacttataccattgacattgacatcgggacgcctccgcagacggtgacgctcatcttggacacggggtcgccggatctgtgggtgaacccgcaatgtgagacttcgggccaggagaagtactgcaacagtttccggcagtttgactacacgaaaagcaagacgatccaggatacaggggcagcggatattttgaaatatggcaaaggaaatgtgacgattgagtatgtgactgatgatgtgattattgggtgtacgtaccttttgtcccccccccccccccccccctttttttttttttttctttttgttttcagtgccagtacgtaagctaacaaagcaacaacagccgccaaaatcaaatcccaaatcctcggtatcggcttcgaatccatcgatattccccttgggatcctcggtctctccccctccgtttcccccgacggcacatctccctacccgtacctcctcgactccatggcctctcagggcatcatctcctcgcgcgccttctcgctcgatctgcgcagcatcgacaaccccagcggggcaattatctttggcggcgtcgacctcggcaagttctccggcagtctcgccaaactgcccatgctcgatccgtcccagactcccgcgggcgtcgaccgctactggatcgtcttgtccggcgtaggcatgacctaccccgacggagaggaagtcgagtccgaagagattggcgtccctgtttttctggactcaggcggtactttgtcccgtctgccggaaacgatctttcaagctattggcgatagtttccccggcagtcagtatgatcccgagtcagggttttatatcgttgattgcgcggtggcagaacaagctggctcggttgatttcatttttggatcgtctgggtctaggtcgtccaagaaaattcgggtcccgtatggtgatttcgtctgggaagtgcaaacgggggtgtgtgtggtgggggtcctgccgacggatgacgagcccgtgtttggggattcgttcctgagagcggcgtatgtggtgtttgatcaggataatcggaacttgcatctggcgcaggcggcgaattgcggagagcaaatcgtggagatt

SEQ ID NO: 27731 - DNA, 1481 bp, Neurospora crassa
caacaggtcttcggccacccagccccccacgtcgccggcggctggaacatctccccctcccgtcaacaactcatctcctcgctcatgaccctcggcgccttcctgtcttcctccctcgccggccccaccgccacttttctttcacgccgccaaactatctgggctgcttctttgctatgtatcgtctccaacgtcatcatgatggccaccacctccatcggcgggctctacgccggccgcttgttacttggtctagcaaacgggttctacatgaccttttcgcagctttacatccaagaggtagcgccggctcggtatcgcggactgatgatttccagttttcaggtgtggacgagcgtaggtacagtgattggcggggtggtggataactttactgagaagattgatggaagggatagttacttgatcccgctgggattgatctttgtgtttcctgtggtgattagtctgggactgtttgcggttcctgaaagtccacggtggttgatgatgcaaggacgcgaagagcaggcgagaaagagtctaaggtggcatcgcccgtattcggatcggatggtggaggaggagatcagggatattcagctggcgctggcggcggagggggagacggtcaagggggcgagtgtgtgggatatgtttagggatccggtggataggagacggacggtgttggcggtttgcgggttgacggtgcagggggcgtcgggggctatgtatatgattggtatgtttgattcatgataaccttgtggtggtggtgatggataatggctgacgagcaacagcatacggcacatacttcttcaagatggctggtatcggcaagccgttcgaaaaccacgtcatcttgacatcccttggcgtggtggccatcctcgtcaactcggctatggtcacgcactttggtcgtcggcgcatcttcctcatcagcggtctgatcctctgcggtgttgcccagctccttatagccgttgtgtataccgtcaagccgggcaccaagtccaccggtcaagccatagttggactcgctgttgtctatatcctggggtataacggcatggtagcgacgtatgcgtggatctcaggcggcgaactcccctcgcagaggttgcggtcgtatacgttcggactggcgacagcgattggattctttgcggcttggttgacgacgtttacggcgccgtactttatcaatcccgagtcgatgaactgggggccaaaatatgggtatatctggacgccatcgtgttggatttctgcgtgagtgttcccctgtctcctgtctcccgattagtggacgatgagctgacgagaagagcgcgcgcagtctctgggtgtacttttacctaccggaagtcaagggccgtaccttggaggagattgaccaaatgttcgaggcgcggttgccggcgaggaagtttcgcaaatacgtgtgtgttggtcgcgatggtggtggtggt

SEQ ID NO: 27732 - DNA, 1404 bp, Neurospora crassa
gaagcttccgacaagggcacctttaacgtcgtcaacccggccaccggcgagatgtcgtgcaaggtccctgaggccactgaagacgataccaaccgtgctgttgctgcggcaaaagcagcacaacctggatgggccgccctcgaccctgccaagcgcggtgcctacctcaagaagcttgccgccttgatccgtgagcacaagtcgaccctccaccacctcgaggccatctccatgggcgtgcccgtcaaccacttcttccacgctgacttcggcgccgatgagctcgactactttgccgaagcatggccgcacatccagggccagtccagcgtcaacacgcccggctacgtgaccatgactttccgccagccctttggcgtcgctgcctgcatcatcccctggaacgcgcccctgtacttcttcgctaccaaggccgccgccgctttgatcacgggtaacactgtggtcctcaagtcctccgagaaggctcccctcgccgtcgcctacgccgccgagcttgtcgccaaggccggtttcccgcctggcgtcttcaacatcctctccggccacggccttccctccggccgctgcctcgcccgccacatggacgtgcgcgccatttccttcaccggctcctcccgtactggcaaactaatccaggaggaggcagccaaaacgaacctcaagagcgtcacgctcgaactaggcggcaagtctcccgccatcatctttgatgacgccaacatcgagcaggcgctcaccgataccatgtcgagcattgtcctcaacgcgggccaagtctgcatcgccaactcgcgcgtgtacgtccaaaagagcgtagcgcccaagttcatcgaagccttcaccaagcgcatggccactattcggggcggtaacccgctggacccgcaaacgcagatgggtcctcaagcggacgagatccagtacaaaaacatcttgtcctacattgaagaaggcaagaagagcggcaagctagctgtaggcggcaagggccagctggacgagagaaagggatactttgtggagccgacggtgttccttgatacgccggaggacgccaagatcatgaaggaggagatctttgggccggtgttgaatatcaatacgtttgagacggaggaggaggtggtggccaaggcgaacgataccgagtatggattgtgggcggccgtgtttaccaatgatctcagtagggcgatgaggatggccaaggcgctggagagcggctatgtcagtatcaactgctcgagtccatcgatcgggagggatttgccgtttggggggtataaggggagtgggcaggggcgggagggaaggttgcacagcatgaatcacttcttggagatcaagagtgttattatcaagttggatgaaaaggcttcc

SEQ ID NO: 27733 - DNA, 1182 bp, Neurospora crassa
cagactctcgatgagaagccagagggctacaagcccgaggagctccccatctggaactttgacggtagctcaacaggccaggctcctggtgacaactcggatgtttacctgtaagtcattatgcgcttgatagtgatgatgaaacaggggcatcatttattgaccacttcacagaaagccggtcgccgtctaccccgatcctttccgccctcccaacagtaagccaccagtccatattgcaacctgcatatcgtcttgttgctcactgtacatatagacattcttgtcctcgccgaatgctgggatgccgacggcacccccaacaagtacaaccaccgccacgagtgcgccaagctcatggagcttcacgccaagcatgagccttggttcggcctcgagcaagaatacacccttctcgatctgaatgatcgtccctacggctggcctcagaatggtatgtctctcccatcggctcatccatgcccatgtccagacacacactgacaacatgcaggctaccccgccccgcaaggtccttactactgcggtgtcggtgccggaaaggttgtcatgcgcgacattgtcgaagcgcactaccgcgcctgcctgtactcgggcatcaagatctcgggaaccaacgccgaagttatgcccgcccagtgggagttccaagtcggcccctgcgtcggcatcgagatgggcgaccagctttggctcgcccgtttcttgctgcaccgcgtagctgaggagttcgccgtcaaggtgtcgctcgatcccaagcccatccctggcgactggaacggtgccggtctacacagcaacttttcgacggtcgagatgaggaaggagggcggcatgaagcagatcgaggcggccatcaagaagctggagggaaggcataaggagcatattgctggtgagtttgtccgatcagaggaagaatggagtggggttgggacggaggctaatgcggggaaaacagtctacggcgaaggcaacgagaagcgtctcaccggccgtcacgagacgggtgccatcgacaccttcacctacggcgtggccaaccgtggcgcgtccattcgtatccctcgcgagtgcgccgccaagggctacggctactttgaggatcgtcgtcctgcttccaacgcggatccctatctcattactggcatcatcagtacg

SEQ ID NO: 27734 - DNA, 1158 bp, Neurospora crassa
atcgtcgtcacctgcgctctccgcactcccttcaccaagggtggcaagggtggcttcaaggacactcacgctgctgacctgatggccggtgccctccgcggcctcatcgagcgctccaagatcgacccctccctcgtcgaggacatcaaggtcggcaccgtcctcgcccccggcggtggtgcgaccgagatgcgcgccgccgctctcgtcgccggcttccccgagtccaccgccgtccacaccctcaaccgccagtgctcctcgggtctccaggcctgcgtcgacatcgccaacgcgatccgctccggtatgatcgaagtcggtgtcggtgccggtgtcgagtccatgtccaccaactacggccccgccgccgtcgccgagttctcggacctgctcgagtcccacaaagaggccgccaactgcaaggtgcccatgggtgtcctgtccgaggacatggccaaggacaagggcgtctcgcgcaaggaccaggacgccttcgctgcctcttcgttccaaaaggctgtcaaggcccaaaaggagggtctcttcaaggaggaaatcctcccgctcaaggccaagttcgaggaccccaagtcaggcgagaccaaggagatcctggttgaccgcgacgacggcatccgcgacggtgtcacggccgagtccctcggcaagatccgcgcggcttttgccaaggatggctccatccacgccggcaacgcctcgcaggtctcggacggtgccgccgccgtcctgctcatgaagcgctctaccgccgagaagcttggtcagcccattctcggcaagtttgtcgccgcttccgtcgtgggcgtcaagcctcttctcatgggcatcggcccctggaaggccattcccaaggtgtttgagctcacgggcatcaacaaggacgacgtcgacatctttgagatcaacgaggcgtttgcttcgcagtgcttgtggtgcgctaacgagcttggtattcccatggagaagatcaaccccaagggcggtgccattgctttcggtcacccgcttggctgcaccggtgcccgccaggtttctacccttctctatgagttgaagaggacaggcaagaaggttggtgttacgtccatgtgcgttggtaccggtatgggtatggctgccgtttgggtggccgag

SEQ ID NO: 27735 - DNA, 1241 bp, Neurospora crassa
atgtcgactttcacaacaaacggagctggcgccgagaacgacggtgagaaggtgaacacccacattgtcaccctcaccagattcctcaccgaggagcaagtaaagcacaaggaggccactggagactttacgtatgttatccatcacttacaccaattcccttcctgttgaccgcgcaaacaaccgaatcaaagagaactaccagctaacatgaaaccccaaaagcctcctttgccatgccctccaattctccttcaagtccatcgcctactacatccgccgcgccacgctcgtaaacctcacaggtctcgccggctcctccaacaccacgggcgacgagcaaaagaagctcgacgtcatctccaacgacctctttatcgaagccatgcgctcgtcgggcaagtgcgctttactcgtctcggaagaggaagagcacgtaatctacttcaaggacgccaagaacgcgcgctacgccgttgcctgcgaccccattgacggctcttccaacctggacgccggtgtgtcggtcggcaccatcttcgccatccacaagctggccgaggacagcacgggcacgaaagaggacattctcaagcccggcaccgagctcgtcgcggccggcttcaccatgtacggcgcctcggcccagctggtcatcaccatgaagggcggctccgtcaacggcttcacgctcgaccagggcgtgggcgagttcatcttgacgcaccccaacatgacgatccccaggaagaggagcatctactccgtcaacgagggtaactcgctctactgggaggatgacgtcaaggcgtactttaacagtctgaaggaaacccaggaggacagcggaaagccttatagcgctaggtacatcggttccatggtggccgatgcgtacagaacgctgctctatggtggtatgtttgcgtacccggcagacaagaagagccccaagggcaagctgcgtattctgtacgagtgcgcgcccatggctatgatttttgagaatggtaagtcttgtcactcgtcttccatcacatcaccccttgagcgcccagataggaatatgatgatggatactaatatgttgtgttaaaacgatagctggtggtcaagctgtcgatagcaagatgaaccgcatgctcgaggtcgtaccggagcacatccatgacaaggccggtatcttcatgggttcatatgatgaggttgagaaggtcaagaagtaccacggcaaggcttga

SEQ ID NO: 27736 - DNA, 1059 bp, Neurospora crassa
gtcaaatagctactgatttcgctctgcaacagcatgaagaaggtcctcgccatcaaccgatacacgggcattgatcagcgctcctcgataggaaaccctgaccacccgctcgtgaacaagcccaacccacctaccgtcaaagaacttcatgaggtcttcatgtccgatggtgtccctcttgctgtagaagcctcgcgaaaggctatggccgaagcgcggctagtaccggctcagatcacacacatggtctcgacgacatgcaccgactcggccaacccgggctacgaccattacgtcgcaaaagagctcggtctcagtgaccgcctggagaaggtcctcctccacggcatcggctgcagtggtggtctcgccgcccttcgcacagcggcgaatctctgtctgggccacacagcgcgcggcaagccagcccggattctggtcctcgcgctcgaagtctccacgaccatggtccgcagcgagctagaaagcatcgacgctttgcaagaaacgcgcattggcatcgccttgttcagcgactgcgctagcgccgtgatcctgtccaacggcatcggcgaggcaccgggcaagcccgcgatctacgacctcttgggttgggaaaaccgcgtgatcccggactccgaacacgacctcggcttcgacgtcgacccaatggggtggaaagtcgtcttgtcgccccgagtcccagtactagccaaagcctccctccaaccaacctacgccgacctcctatcctctctccaagaccaactcccttcgtcgtaccagaaacctgccgatttcgactgggcaatgcaccccggcggcgccaccatcctgtccggcgccgaaagcgccatgggtttgacaccagagcacatgcgcgcctcctacgacaggtacatcaaccacggcaactcgagctccgcaaccatcttcagcgttctcaaccggctcagggaaaaggacatggatgcactggcgcccggcggcaaagtaaaggagtatgtcgtcggttgcgcgttcggaccggggatcaacgtcgagatgtgtatgttgaag

SEQ ID NO: 27737 - DNA, 1949 bp, Neurospora crassa
agagttgtagagcggcgaaaagcactaagcaaatccgagaaggaacaacgaagggagatacacaaaatccacctcctttgtcttcttgcgcatgtggagcggaggaatagatggtgtaacaatcccaaagtccaggaggctctgagaccgctcttgacggacaaaatgcgaaagtcactaataccgagagcgagtttgaaccagtatgggcgaaccgagtcgctcaaggcaggacttcaggagacgagcaccatgtttaaaacgaagttccagatcacggaacggggactacggcgagcactgtgggcggaagatgaggagcagttgaaaaatgtagatggctattcactttttctttccacttcgtgttaccctttgtcgtttgagtcgctggctaatacgcctttcccgtatagtaccaactcccagatgacctcgaaactgtcaagtccaaaggcgactttcttcaagccgccaaatgtctttccggttctcgtgatgttggagcccagctcttctgtgcactccttcgttcgattggcgtccaagcccgccttgtatgctcccttcaaccactttcttgcgtcccgggggctcctacgatgcctaaacaaccaaaaacgaaatctttaaatgcctcaaagggaccatccgcagccgatcggtatgccgctgcaatgtccaagtacgacaatacagtcgccactccagatccaagaaccccagcattcctgtcaggccgaagtcgtctcggacacccaaatgcaacagcctacaacgtcccgtctatgaccgctcccccaccacctccttcccgccccgaaatccctaaagccaagacaataaaaggggaatccccataccccatatactgggttgaagtcctcgacgaagcccagcaaaaatggcaccccgtagaccccctcgtcaccaacacccaatggcgcccgcgcgctctcgagccccccgcctccgacaaggaaaacagcctcacctacgccatcgccttcgacgaagacggcttcgcccgcgacgtcacccgccgctacgccaaagcctacaactccaagaccaagcgccagcgcatcgacggaccgatttcgcccaccactccctcggggatcaacacaggcgagcgctggctccgccgccttttcttgcgacactacaccgctaccgattttcccaccgacctcgaccaaatcgagctcaacgagctcgccgctctcgagggtgcagagcccatgccccgcaacgtccaggactttaaggaccaccccatctacgcgctcgagagacacctccgtaggaacgaagtcttcctgccgggcgctcaatcaacagggacagtgtcagcgggttccaaagcccccgttgagcgcatctaccgccgtaaagacgtggtcgtcgctcgctcacgcgagaaatggtttcggctcggccgcgtagtcaaacccggtgaagagccggtaaaagttcttcctcccaagaggaaacggagttccaagtttggtggggagatgatatcctctacttctccttctctcgagactgataatgaagacgacgagggagatctgttcggggattactcccttgccaaagctggcgggacgccactctatactccgcagcaaacagaactttacgtacccccacccgtatcgaagtcggggaagattccaaggaacaagtttgggaatgtggaggtgtatgtcccgtccatggtccctgctgggggagcgcacatcccgcatgagagagcggcgcaggcggcgcatatactgggtgtggactacgcgcctgcgttgacggggtttgagtggaagggaagaaaggggacggcgaggattttaggagtggtggttcccgaacaggcggcggaggcggtgagggcggtgattacagggttggtggatatgatggaggaggagagggaggagaggagg

SEQ ID NO: 27738 - DNA, 1145 bp, Neurospora crassa
atgggctacccagagactttcgagggcttcgtcgttgactcgcccaagacctggaaccagttccaccgccacgagctcaagcccaagccttttggcgatgacgacatcgacgtccagatcgagtgctgcggcgtgtgcgggtccgacattcacaccgtaaccggcggctggggtgactttgagggtcctctctgtgtcggccacgaggttgtcggcaaggccatcaaggtcggcaagaacgtgaccgagatcaagcagggcgatcgcgtcggcgttggtgcccaggtgtggtcctgcctcaagtgcgatgtctgcaagagcaagaacgagcagtactgccctcacatggttggtatgtgtttatcccccttaccccattaacctttccgagcacatcactaataaggacttctaaagacacttacaatgccaactacgaagacggctccaccgcccacggcggctgggcctctcacatccgcgcccaccagtacttcaccttcaagatccccgacgccatcccctcccacctcgccgcgcccctcctctgcgccggcatcaccacctactccccgctcgtgcgcgccaacgtcggccccggcaagaccgtcggcatcatcggcgtcggcggtctcggccacctaggcatccagtgggcgcgcgccctaggcgccgaggtgcacgtgctcacgcactccgcctacaaggccgacgacgccaaggccctgggcgcgcaaaacgttatcgtcaccagcgacgacgagaagtgggccgagccgtacaagttcaagttcgactttttgctcaactgcgccgacgcgacgcacaagttcgacatgaagacgtacctctcggtcctcaaggtgggcggcgagttccacatgtgcggcatccccgacaagccgctgcccccgctcgaggtgttggcgttcatgcagaacggcgccaagttgtcggccaaccacttgggtaaccaccaggagatgaaggccatgttgcagctggcggccgagaagggcatcgtgcccaaggtggagacggtgcagcttggagaggatgggtgcaaggaggcggtggagagggtcaaggagggcaacaaggtgcattaccgccttactttgacgggctttgacaaggtttttgga

SEQ ID NO: 27739 - DNA, 821 bp, Neurospora crassa
accgcgggcgccgaccactacaatggcatgcttgactgcttcaagaagatcgtcaagaacgaggggtatgctttttgttccacagagcttgggttgtatggcgcgagttgacacctttcttccatagcccctcccgcctttaccgcggcatcactgcccccatcttgatggaggctcccaagcgtgccaccaagttcgccgccaacgacaagtggggcaagttctaccgcgacctctttggccagcagcagatgacccaaggtctttccgtccttaccggtgcctccgccggtgccaccgaggccttcattgtcgtccccttcgagctcgtcaagatccgtctccaagacaaggcctcggccggcaagtacaacggcatggtagatgttgtcgtcaagacggtgcgcaacgagggtctcctcgccatgtacaacggtctcgagtcgaccctctggcgccacatcctctggaacgccggttactttggctgcatcttccaggtccgccagctcatccccaaggccgagaccaagaagggccagactatcaatgatatcattgccggtaccgttggtggtactgtcggtaccatcttcaacactcccatggacgtcgtcaagagccgtatccagaacaccatcaaggtgcccggccaggtgcccaagtacaactgggcctggcctgccgtcctgaccgtcttcaaggaggaaggtttcggcgctctttacaagggcttcatccccaaggtcctcagactcggcccgggtggtggtatcctcctcgtggtttacaccggtgttatggacatgttccgcaagatg

SEQ ID NO: 27740 - DNA, 979 bp, Neurospora crassa
gagctcaatgcaaaggctctcgacaactttgtctacagcaaggtcgacagggacatgatcaggtttttggctaccgccgccagcgaggttatccaatgcgatcccaccatgatgccatcaccaacagtcgcggccacttctggaagggaacagcaacccacggcgccacccaaggttgtcaaatgtgaagatggcggactacctaccctcgaggccttcatcagccagcttgtcgtcagctccaacgtccaggttcccactctcatgtcgagtctggtctacctcagacgtctaaagtcccgccttcaacccaatgccaagggcctccgctgcaccacccatcgcatcttcctcgctgccctcatcttggccgccaagtatctcaacgacagcagtcccaagaacaagcactgggccagctacaccaacatgtcgagctccgcctacaactttggcttcagccgcaccgaggtcaacctgatggagaagcagcttctctgcctgttggattgggaactgcgcatcaccgaggaggatctctaccgcgagctggactacttcctggcccccacccgccgtgattacgaggtccgttatgcccgtcgcatgcgcgagaaggccgagaagcgccagcgccagttggaggaggaggcctgggtccaggttgccgctgccgccgccgccgcccagcacatccagcagcagcagcaacaacagcaacagcctacttacatctctcctccctcatcccgcggcagctcccgctcgcgcaacggttacgcctctcgcgacacctcgccacccggtctttccagctccgcatcttcgtacaccagctccaccagccgctcgacaacccccgacagcgaactggatcttcctcactcttacgttgccatcaacggcgacgactactaccagtctgctgctatcccgccttgcgtaccggagaaggatgccgcggccgtgtacttcagca

SEQ ID NO: 27741 - DNA, 4189 bp, Neurospora crassa
ctcaaacacaaggttgaggccatcaaggagcttgaacaaagctctggaatccccgcccgcgagctgggtgtgacttggaaagatcttactgtccaggttatcaactcggacgccgccatccaggaaaacgtcctatcccagttcaacattcccaagaagatccaagaaggaaggcagaagccccctctcaagaccatcctcgacaacagccatggttgtgtcaagcccggtgagatgttgttggtcctgggccgtcccggttccggatgcaccacccttctcaacctcttggccaacaagcgcgaaggctatgttgccgtgaacggtgatgtccactttggttccatgaacgccaaggaggctcacaagtaccgcggccagatcgtcatgaacaacgaggaggaagtcttcttccccaccctcactgtcggccagaccatggactttgcgacccgcctcaacattccttacaagatccccgatggcgttgcctccccggaagagtaccgcaaggagaacatggacttccttttggaggccatgagcatccctcataccaaggacaccaaggttggtaacgagtacgtccgcggtgtctctggtggtgaacgcaagcgtgtttccatcatcgagtgtatggcatctcgtggttccgtcttttgctgggataactctacccgtggtttggatgctagcacgtaggttacccccatcatgctcaccaaacactctagaatcagactaacatatccctagtgctctcgagtgggccaagtgcatccgcgccatgaccgatgtcatgggtctctccaccatcgtcaccctctaccaggctagtaacggcatctacgatctcttcgacaaggtcctcgttctcgattacggcaaggagatttactatggtcccatgaaggaggcccgcccctttatggagtccctgggcttcgagtgccaggagggtgccaacgttgccgactacctgaccggtgtcaccgttcccactgagagagtgatccgctctggttttgaaaagaccttccctcgcaacgccgaccaactccgggaagtctaccaaaaatccgacatctaccctcgcatgaccgccgagtacaactatcccaccaccgaggaggccagggagaagaccaagctgtttgaggaaggcgtcgctgttgagaaggacaagcatctcgcaaaggacagcccttacaccgtcagcttcttccagcaggtcaaggcctgtatcgctcgccagtatcagattgtccttggcgacaagccaaccttcctcatcaagcagggctctaccttggcccaggccctcatcgccggttccctcttctataacgcccctgataactctgctggtctcttcgtcaagtcgggtgccctcttcttctcccttctccacaacagtctgatgtccatgtccgaagtcacggactctttctctggtcgtcccgttctgctcaagcaaaagggcatgggtttcttccaccctgccgccttctgcattgcccaggttgctgccgatatccccgtcatcattctgcaggttactgtctggtctattgtcttgtacttcatggttgccctgtccatggacgccggtgcttggtttacctactgggtcattctcatcgcggctaccatgtgcatgacggccttcttccgagccatcggtgctgcattcaggactttcgatgccgcctccaaggtttccggtttcatgatttccgctctcatcatgtacaacggttacatgattcagaagcccaagatgcacccttggttcggctggatctactggatcaaccccatggcctactccttcgatgccctcttgtccaacgagttccacgacaccatcattccctgcgtcggtgtcaacctggtccccaacggccccggctacgctgatctcgaccatcagtcttgcgctggtgtcggtggtgccatccagggtgagaacattgtctatggtgacaactacctcaagtctctttcttacagccactctcacgtctggaggaactttggtatcatctgggcttggtgggtcctctttgtcggcatcaccatctttgcgactagcaagtggcgtcctctttccgaaggcggtccttccctgctcatccctcgtgagaaggccaagatcgtcaaggccatccagaacaacgacgaggagaaggccggtgctaccagcagcggcgaggagactgtctacgacaaggaggccagcgctggcgaggccaaggactccgacaaggacttggttcgcaacacgtcggtcttcacctggaagaacctcacttacaccgtcaagacgccttctggtgaccgcgttctcttggacaatgttcacggttgggttaagcctggcatgttgggagccttgatgggctcttcgggtgccggaaagaccactcttctcgatgttttggcccagcgtaagaccgacggtaccatcaagggttccattctcgtcgacggccgtcctcttcctgtttccttccaacgttccgccggttactgcgagcagcttgatgttcacgagcccttctccaccgtccgtgaggccctcgagttctctgccctccttcgtcagcctcgtgagattcctcgtgaggagaagctcaagtacgtcgacaccatcattgatctcttggaacttcacgatctcgccgataccctgattggtcgcgttggtgctggtctctctgtcgaacagcgcaagcgcgtcaccattggtgttgagttggtcgccaagcccagcattctcatcttcttggatgagcccacctctggtctcgatggtcagtctgcctacaacacggttcgtttcctccgcaagctcgccgatgttggccaggccgtcctcgtcaccatccaccagccttcccagcagctctttgcccagttcgacaccctcttgcttctggccaagggcggcaagaccgtttactttggcgagatcggtgacaacgcccagactgtcaaggactactttgccaagtacgacgccccctgtcccgaggagaccaacccggccgagcacatgatcgacgtcgtgtccggctcactctccaagggcaaggactggaaccaagtctggctcgagtcgcccgagcaccaggccatgaccgaggaactcgaccgcatcatcgacgacgccgcctccaagccgcccggcacgctcgacgacgggcacgaattcgccatgcccctgttggaacagctcaagatcgtctctatgcgcaacaacatctcgctcttccgcaacaccgactacatcaacaacaagttcgctttgcacattggctcggccctcttcaacggcttctccttctggatgatcggcgacagcatctcggacctccagatgcgcctgttcaccatcttcaacttcatctttgtcgctcccggtgtcatcgcccagctgcagcctctctttatcgagcgccgcaacattttcgaagcccgcgagaagaaatccaaaatgtacagctggatcgccttcgtcacgggcctcgtcgtgtccgagatcccctacctctgcgtctgcgccgtcctctactttgcctgctggtactacaccacgggcgccccgcacgcctcgtcccgcgccggcggcaccttcttcgtcatgctcatgtacgagttcgtctacacgggcatcggccagttcattgccgcctacgcgcccaacgccatcttcgccacgctcgcgaaccccctggtcatcggtatcctcgtctccttctgcggtgtcctcgtgccctaccagcagattcaggtgttctggcgctactggatttactacctcaacccgttcaactacctcatgggctccatgctcgtgtttaacctctgggacaaggagattgagtgccgcgaccaggagtttgccgtgttcaacccgccgaatggcacgacgtgcgccgagtacttggagggctacatgatgggcatgggacgggcgacgaacttgattaacccgagcgcgaccgaggggtgcagggtttgtcagtatacgtccggtagcgattacttgcagacgatcaacctcaagagttatgggtatggatggagagatgcggggattgtgtgtgtgtttgtggcgagcagttatgcgatggtttatgcgttgatgaagttgaggacgaagacgagtaagaaggctgagtaa

SEQ ID NO: 27742 - DNA, 1639 bp, Neurospora crassa
caccatgtcttcagcgaccctgccattgctgcgtactgggcggaggtctacgagcgcgccgggtacgagaaccggcaccgatttgaccctttgttccaatgggacgcgtcggaggagcgcaagcttgtgcgcaagatggactttcgcatcgtgttttgggcttggatcatgttttgcagcttggacttgcatcggaagagtatcaaccgggctattagcgatgatatgttgccggagctaggtacgtaggtatgtccagtccttccatgtcgtggttctgcccttccttgtatccatgtcgactttggatacctctacctagaggtgtaggtagtactgacgcatcccaggaatgaacacaaacgacttcaactatggtcaaaccatcttccttgctgccttcctgctcgctgaacttccctctggcctcgtagccaagaagctcggcgctgatcgcttcgttcccatgcaaatcgtgtcttggtccatcctgtcgggcgcgcaagtctggatcacgaaaagagcgcatttctacgtcatcaaggcgcttatgggctttgccatgggtggcttcatccctgaaattgttctgtggttgacgtacttttacaagtccaacgaaatgcctctccgcttggctttcttctggactgctttgtcgaccgtcaacattgccggttctctcatggccgctgggattttgcagatgcggggaatccgaggctggagtggctggcagtggctgttcctgatcgaggccctgatgtctttcgtcgtcggcatctgcgcattcgtcctgatgcccccgggtccttgccagaccaaatcctggttccgcggaaaggacggctggttctcggagcgcgaggaattcatcctggtcaaccgcctgctgcgcgatgatccctccaagggcgacatgaacaaccgcgagggtgtctcggcccagggactgctcaaggccctcaaggagtgggagatgtggccgctctacatcgtcggcgtgtgcgcttacatccctcccggtccgcccggcgagtacctgagtctgattctccgcacccacggcttcagcgtctttcaagccaacctgctcaccatccccgcttacttcctcttcgcgtgcaacttggtcatcctttcgtatttctccaggcggttcaaggagcgtggcttcatcgcctccctttcgcagtggtggatgctttccttctttgctgccatcgttgccctgcccgacgccggcgtctgggtccgctatgctcttctaatcggtatcttgtcgtacccgtactgccacgccatcctggtcgcttggactgctgagaacagcaacagcgtgcagacgagagcggtttcgacggcgctgtacatcatgtttgtgcaggatggcaatattatctacgataatatctaccgcgaggacgacaagccgctgtacaagagggggaataaggtattgctggccatggtctgcttgaatatcgtgctgttttatctgaccaaggcgttttatgtatggagaaataaggtgaaggaggagaagtggaaggccatgacgccggaggagcagcgggactatgtgttgactaccctggatgaggggccgaagaggctggattttagatttgcacactga

SEQ ID NO: 27743 - DNA, 1074 bp, Neurospora crassa
atggcggaccataccgaagtcgacctcgactctataatcgaccgcctcttggaggtgcggggcagccggcctggtaagcaggtgcagctgctggaagccgagattcgctatctctgcaccaaggcccgtgaaatcttcatttcccagcccatcctgcttgagctcgaggctcctatcaaggtaagcattgtgttctttctattatccctttacatagcctcggcatgcgccatactgccccttcggcagtgttcatagctgacgtcgtgccccacctccctagatttgcggcgatatccacggtcaatactatgatctcctccgcctcttcgagtacggtggcttccctcctgaggccaactacctcttcctaggtgactacgtcgatcgtggcaagcagtccctggagaccatctgcctgctcctcgcctacaagatcaagtaccccgagaacttcttcatccttcgtggcaaccacgagtgcgcgtccatcaaccgtatctatggtttctacgacgagtgcaagcggaggtacaacatcaagctttggaagaccttcaccgactgcttcaactgcctaccgatcgctgccattatcgacgagaagattttcactatgcacggtggtttgagcccggatctgaactcaatggagcagatccgccgagtcatgcgaccaactgacgtacgttacaccattcatgcccgggctttccgtttgctcaggctagttgccgtaacatgagacactaacaatagcgccagattcctgactgcggtcttctttgcgatctcctgtggtcggatcccgataaggacattactggttggagcgaaaacgatcgtggtgtttccttcacattcggcccggatgtcgtttctcgcttcctccaaaaacacgacatggatttgatctgccgtgctcaccaggttgttgaggacggatatgagttcttctcgaagcgccagctcgttactttgtttagtgcccccaactactgcggcgagttcgacaacgctggtgctatgatgagcgtcgacgaaagtttgctctgctctttccaggtatgtttt

SEQ ID NO: 27744 - DNA, 1046 bp, Neurospora crassa
gaggagctcaaggccgagatcaaagctgaggccaaggccgccgcctccgcgggcgcctcccagctaaggtcttttgttgctggtggtttcggtggtgtctgcgccgtcgtcgtcggccaccccttcgatcttgccaaggtccgcctccaaacagccgagaagggcgtctacaccggcgccatcgatgtggtcaagaaaagtattgccaaggatggtttgaggaggggtctctacgctggtgtcagcgcgccgcttgttggtgttactcccatgtgtatgtccacccaccacctttccatctttaccctttccctcccccctctctctctccccaacaacccccccgctaacatttctccccccaaaatcaagtcgctgtctccttctggggctacgatctcggaaagcaaatcgtccgggccacctccaccgttgcgcctgacggcaacctctccatcgcccaaatctccgccgccggcttcttctcggccattcccatgaccgccatcaccgccccctttgagcgcgtcaaggtgattctgcaagtccaaggccagcagaagctcgcgcccggcgagaagcccaagtactctggtggcatggacgtggtccgccaactctacaaggagggcggcgtgcgctccgtcttccgcggctccgtcgccactttggcccgcgacggccccggttctgccgcttacttcgccgcctacgagtacatcaagaaggcgctgacgcccaaggaccccgtcacgggcgaggccagcggcaagctcagcctgggcgcgattactgttgctggcgcgggcgccggtgtcgccatgtggatccctgtcttcccgatcgataccgtcaagagcaggctgcagaccgccgagggcaacgtgacgattggcggtgtcgttaagcagctgtacagggcgggtggttacaaggctttcttccctggctttgcgccggcgctggctagggcggtgcctgctaatgctgctaccttcttgggcgtcgagttggctcatcaggctatgaacaaggcttttaactaa

SEQ ID NO: 27745 - DNA, 596 bp, Neurospora crassa
tcgtcagcagcagcgacgcagttgcgcaaggaactgaagcagatgcagaaggacacggacattcccgggatatcatgcggcttggtgaacgacaacaacatttttgagtgggaggtgatgttgatgattcccgatgaggtcaaatactatggcggttcgttctttgtctctcccctctcttcagttccttctcctcttgcctaagtactgagtacactgacattttttttcggcaaacaggaggcaacttccgcgcccaccttcacttcccacccaactacccgctcatgccacccactttcacgttccagaacccgatcccgttccaccccaacatctacccgtcgggcgagctctgcatcagcatcctgcacccgcccgaggaggacaagtacgggtacgaggacgcgtcggagcggtggtcgcccgcgcgctcgcccgagaaggtgcttttgagcatcatcagcttgttcagcgatccgaacccggatagccccgctaatgtcgaggccgcgcgcttgctgagggaggagaaggaggggaaacacaaggagtttaggaagaggtgcagggcttgtgtgcgggagagtttggga

SEQ ID NO: 27746 - DNA, 3291 bp, Neurospora crassa
tgggtcaggggggtgtatcaggctttcaaacacaaatccgtggtcccatctcaaagaggaaaggaggcgcctgcgtcaactggaaaaatcctcaacctgcttcgcggtgacgtgtatgaggtggcccaaagattctgggaggcatcaacgcttctcacaaaaccactcagtgtcattgtttccatagttcttctgtggaacatcttggggtctgcctcattgtatggcatccttgtcatcgtcgtcggcatggctgtgaactattacatgacgggcttgctaaaaagagtagagaaaaagcgtcgtgctactaccgacgtcaagcttgagcgcaccagtcagtttgtggaatcacttcgtcatcttcgctggtacgattggcaggaccgatggcttgggcatattatggaaattcgacagaaagagttgttccagcgcgtcaaaagcaatgttgtcgacagaagcatcaacgtcatcaacaacataacctcgtacatgtttcctgttgttggatttgccgcatatacgcttatcttgcataggcctctaacagtcgacatcgccttcccggctcttggtctattcaccatgttgcagaacaacctacgcgacctgccttccctctacacctctctgaccaacgccagggttgccatgcgtcgcatcgaggattttatgttggagccagacaaagacgacaatgaggatgacgaaacagtcacccctgccttccaccagagcaatctggaaatttctatccgcaatgcatctttctcatggccaggctctgacacaacagtgctggataatatctcctttgtttgtgagcccggtttggccttggtctgtggtaaggttggcattggcaagacggcattactgcaagctatcttgggcgagctcgaccagcattctggtgagaagaatgtccctgccgaaatgattggatactgtgcccaaatgccatggcttgaaagcatgagtatacgtgacaacatcttattcagtactccttttgatgaggcgcggtactggcaggtcctcagggcatgttgccttgtggaagatctcagaaagtttaagggaggagatagatccctgattggggagaatggtactgggctttctgggggccagcgagctcgtgtggcgctagcccgggctgtttatagcaggagtcggatcctccttctcgatgaccctatcgccgctcttgaccaccaaaccgccgaaactatctcacgcaatctctttgccgaccaaaactcaccactaactgcgggtcggttgatcgtactagtgactcaccgcgttgatattgttcagcaatatgcctatcaggttctggacattgttcctggtggacaagtcaagactttcaacagaagggaaattgcggaacacgagaaggaactggaagcacaggccgctaccacaccggagagctcaccgatcgccggatcttctaccagtcaaaacaccgaggattcatcgtccgaggaagaggctgagctggccacggtggctggtaagtttattcaggaagaacaccgggtgcatggtggtgttatggccaccgtctactggcaatatgttaaggccggtaaactttcttggtgggccacgatggttacgctctgtttactgatccgaatgaccaacctcggctataactggttcttgaaagaatggggcgaacaatatcgggaatcaactgagctcggggatagaccatacattctcatttcccacgccgccttcaaagccgacggcatcattgagcccggccgacatcttcctccacctggaaagaacgtacgaccttggcttacctgtctggccattattgcgctggttcaggttttgttcgaagccctgtcggatcttgccctcatcgctatcatctacaatgctggaaaatccctcttcgccaaggccatgcgctgcgtcacgaatgccacatttcgcttctacgacgtgacacctgttggacggctcatgaatcgtcttacttccgacatgggcacgatcgacgggcagattgcgactcaggtgttaacactagcgttctattccctgggctggatgacctcaatgttcgtaatagcaacagcaacaccggtcttcattatacccagcgttggcacgaccatgttatttgtctatttgtatggtcgttacctacctgcatcgcaggacttgcgtcgtctcgagacggtctccctgtcgccgcttatgtcgaattttggcacgcttctcgaaggcttgactacggtacgtgccttccgcgcagagccacatttccagaaccgcatcatcgccacgaccgatgactttcagaaaatggatcacatatactggtcactgcaggcctggctacaataccgcttcgatcttgtgtcaggtctctcggtgtacgccctgaccctgacagccattatccacggactatccagcggcatgattggctttgtattagccgccgctgccaactttgtagagagtacgcatcaagtgtgccatcgctatggcgatatgcaaatgcagtttgtcagcgttgagcgtatcatcgagcttctcagcctcgaacaggagcaagcaaacaccgacaacccgcctccagctggttggccttcttgtaccgatgacatcgtcttcgacaaggtgacgttgcgatatgcacccgaatttgaccccgttctagtggacgtgagcttggtcattcccggcggctcgactgtggcggtgacaggtaggactggctccggcaagagtacgctcgcatatgccctgcttagcacgatccagcctgatgcaggtacaggcggtcagatccgcataggttccgttgacatcgccaaagtggacaagcatatactgcgtcgacacataacctttgtagcgcaggatcccgtcctctttgccggtacactaagggacaatcttgaccctctagatgagcacagtgagggcgagcgggctcaggttctcaagacggttttgaacaacggattcacgcttgacaccagagtggatggcgggggcaagaatctcagtcaggggcagcgccagttggtggggctaggcagggcgattctccgaaggagtgcaattgtgattatggacgaggcgacggcgtcgattgacgtggagacagcaacgtatattcaccagttgctgaggatggagttacggcatagcactgtgattacgatcgcgcacaaggtggaggcggttaaagatgcggactttgaaattgtgctggacaagggaagggtagtaaaggctggg

SEQ ID NO: 27747 - DNA, 2132 bp, Neurospora crassa
atgtcgtggaaactcacaaagagtatgtcggcgaacccgcgccttttccctttccctttccccacggcagaacaccatatctgacatgttggcacaccagagctgaaggagacccatttgggtcctctttcaagccccttctcccgctcgccctctacctccaccatcacagataaggaagacaagagccaagcgggcagctcgggagcagccaccccttcgaacgagaacaccattggtaggcgctcagcccgtcttgttcactcggccatcacaagattaacctcttttcctttcacagccgcctcggaagcccttacgcaagctcccatcgtcaagcctcctaagcccggtatcctcgtcgtcaccctccacgagggttccggcttctcgctacccgaacagtatcgcaatgtcttttcctcaaaccatggcggtaactcgatgtcgacgggaagtgcccttaacgttgcaggctccattcgcaccaacaactcgtcacgaacagccaacttcctgagcggttcttcgcgcccacagagctcgggcggctttggcgccattcctacaaatcacggccgtatctccacaaagtatatgccctatgccctcatagattttgacaaggttcaagtttttgtcaactcggtcgaaggcaaccccgaaaaccccctctgggccggctccaacactcagtacaagttcgatgtgtctcgagttacggagcttgccgtacatctttacatcaggaaccccaacgcggcgcctggctccggccgcagccaagacatcttccttggtgttgtccgtattaaccccagattcgaggagaagcagcagttcgtcgatgaccccaaggccagcaagaaggaccgggaaaaggccgccgccgactttgccaacaaggagcgcgccctcggacacagcggtgtggagtgggtcgacgttcagtatggtaccggaaagctcaagatcggcgtcgagtatgtggagaaccgcgccggtaagctcaagattgaggatttcgagctcctcaaggttgtcggcaagggctcgtttggtaaggtcatgcaggtgcgcaagaaggacacgaaccgtatttacgctctcaagacgattcgcaaggcgcacatcatctcgcgttccgaagtcgcccacacgctcgctgagcgatccgttctggcccagatcaacaacccgtttatcgtgccgctcaagttcaccttccagagtcccgagaagctatactttgtcctcgcctttgtcaatggtggtgagctgttccatcatttgcagaaagagcagcgattcgacgtcaaccgcagtcgtttctacacggccgaactgctgtgtgcgctcgaatgccttcacggtttcaacgtcatttaccgtgatctcaagccggaaaacattcttctcgactaccaaggtcacatcgctctctgcgatttcggtctctgcaagctggacatgaaggatgaggaccgcaccaacacattttgcggcacccctgagtatttggcgcccgaattgctgatgggtaatggttacaacaagactgtcgattggtggacattgggtgtgcttttgtacgagatgttgacgggtctcccgcctttctacgatgagaacaccaacgagatgtaccgcaagatcctcagcgaaccgctgcacttccccggacccgaggttgtacccccagctgccaaggacctcttgaccaagctgctcaaccgcgacccgcaacaacgtctcggtgccaacggggcggccgagatcaaggcgcaccccttcttccacgccatagattggcgcaagttgttgcagcgcaagtacgagcctgcgttcaagcccaatgtggtaagtatcaagagcgctgcctactcaccggttgaacaagctcaatgtgctaactacggtgactataggttgacgcgctcgacaccgccaacttcgaccctgagttcacatcggaacttcctcaggattcttacgtggaaggaccgattctgtcagagacgatgcagaaccagttcacgggcttcagttacaaccgtcctattgctggtctcggggatgcgggtggcagtgttaaggacccatcattcgcgagcagtcttcaagacaacagc

SEQ ID NO: 27748 - DNA, 1744 bp, Neurospora crassa
gcgaacaccctctccgcctggtctgacctccagtcgcaccactccaaggttggcaagaccttcgtcctcaaggatgccttcaagtccgatcccgagcgcttctccaagttcgctcgtaccttcaccctccccgccgacatttcgagcgacagccccaatgccaccgatatcctcttcgacttctccaagaacctggtgacagaggagacccttgacaagctcgtccgtctcgctgaggaggccggcgttgagaagaagcgcgatgccatgttcgctggcgagaagatcaactttaccgaggaccgtgccgtctaccacgtcgctcttcgcaacgtctccaaccaagagatgaaggtcgacggcgttgatgtcatgaacaccaagggcggcgtcaacgaggtcctccagcacatgaaggagttctcggagcaggtgcgcagcggcgagtggaagggttacaccggcaagaagctcaccaacatcatcaacattggtatcggcggttccgacttgtaggttcaaacgtcctgcctcccttctgcccgagagaggagcattgactgacaagtaccatcacaggggtcccgtcatggtcactgaggccctcaagcattatggtgccaaggacatgacccttcgcttcgtctccaacgttgacggtacccatatcgccgaggccctcgctgcctctgatcccgagaccaccctcttcctcatcgcttccaagactttcaccaccgccgagactatcactaacgccaacaccgccaagtcgtggttcctcgagaagaccggtggtcagggcgatattaccaagcacttcgttgccctctccaccaacgaggccgaggtcaccaagttcggcatcgacgccaagaacatgttcggtttcgagagctgggtgggcggtcgctactcggtttggtctgccattggcttgtctgtcgccctctacgttggctacgagaacttccacaagttcctcgctggtgcccacgccatggacaaccacttccgcaccgctcctctcaaggagaacatccccgtgctcggcggtatcttgagtgtctggtactctaacttctataacgcccagactcacctcattgctcccttcgaccagtacctccaccgcttccctgcctaccttcagcagctgtcaatggagtccaacggcaagtccatcacctcggacggttccgcggccaagtacactaccggccccatcgtttttggcgagccctgcaccaacgcccagcactccttcttccagcttgtccaccagggcaccaagctgatccctgccgacttcatcctcgccgccaagtctcacaaccccatctccaacaacctgcaccagaagatgctggcatccaactacctcgctcaggccgaggccctcatggtcggcaagaccgccgaagaggtccgcgctgagggtaacgtgcccgagcacctcgttcctcacaaggtcttcctcggcaacaggcccaccaccagcatccttgtcggcggccacattggtcccgccgagctcggtgccctcattgtctactacgagcaccttaccttcactgagggtgccatctgggacatcaactcgttcgaccagtggggtgtcgagctcggaaaggtgttggccaagaagattctcaaggagatcgacgagcctggtgcgggcagtgggcacgacgcttctaccggcggtctcttgggggcgttcaagaagtatgctgacttttga

SEQ ID NO: 27749 - DNA, 930 bp, Neurospora crassa
ctcatgtgcccagagtgcaaggaagatccgcctcaccttgtcgaagagttctcgtcaggagacatggtttgcggctcctgcggtcttgtgctgggcgagcgcatcatcgatacccgctctgagtggcgtactttctccaacgacgaccagggcaacgatgacccctctcgtgttggtgatggtcccaaccagctgatcgatggtgaccagctccagaccactatcgcgttcgatggcaaaaacggcaagaacctgtcccaccttcagaacaagatcactcaggacaagaactccaagcagcttatgcaggcctatcgcgatatccagggcttgacggacagcatcaacgctggtacccaggtggcaaatgctgccaagcacatttacaagctcgtcgaggacaacaaggccctcaagggcaagtctcaggaagccatcaccgctgggtgcatcttcattgcatgccgccaaacgggagtgccgcgtacgttccgcgagatttacagcctgaccaaggtttcgaagaaggagattggcagggttttcaagcagttggaatccttcctccagaagatcggaggcgaggagcatgcaatcacgaccagcatccccaccttcaaccagcaataccagggcaagggatctactacagctaccgagctttgcgctcgttactgcagcaacctcaatttccgcaactcagttgcggtcgaggatgttgcccgccagttggccgacaagaccagcactatttcggagctggctggccgttctcccctttccgtcgccgctgcgtgtatctacatggcatcccacatcaggaacgagtcacgtacgtccaaggagattgcgacagtggctggtgtcagtgacggaaccgtcaaaacagcttatcgtctcctctataacaagaaggacaagctgcttgag

SEQ ID NO: 27750 - DNA, 1633 bp, Neurospora crassa
atgccttcgaatacccagaccgagttcgctcccgctcccgagcggaaccccgacaaatatggccccaatgccaacaacaaccagaagaagtgctcacagctggcctctgacttctttaaggacagcgtcaagcgcgccagggagcgcaaccagaggtgaatgctgcagcgatgcgcttttgcccctacatcccgccgtgatcggtgctgacacccttttcagacagagcgagatggagcagaagctcggtgagaccaacgatgcccgccgtcgcgaatcgatctggtcaaccgctggccggaaggagggccagtatttgcgcttcctgagaaccaaggacaagcccgagaactaccagaccatcaagatcatcggcaagggcgctttcggcgaggtcaagctcgtgcagaagaaggccgacggcaaggtttacgccatgaagtcgcttatcaagacggaaatgttcaagaaggaccagcttgcccacgtccgagcagaaagagatatcttggccgagtcggacagcccatgggttgtcaagctctacaccaccttccaggatgcgaacttcctttacatgctcatggagttcttgcccggtggtgacttgatgaccatgctgatcaaatacgaaatcttctcggaggatattacccgtttctacattgccgaaatcgtcttggctatcgacgcggtccataagctgggcttcattcacaggtaagcttcgccggaagcaatgctctggaaaagagatactgacacggttgtgcatgcagagatattaagccagacaacatccttcttgataggggtggtcatgtcaagcttacagatttcggtctctctaccggcttccacaagctccatgataacaactactacacacaactgctccagggcaaatccaacaagccgcgcgacaaccgcaactcggttgctattgaccaaatcaacctgacggtcagcaaccgtgcacagatcaatgactggagacgctccagacgtttgatggcctactcgaccgtcggtacaccagattatattgctccggaaatcttcactggccatggttactcgtttgattgcgattggtggtctttgggtaccatcatgttcgagtgcttggtcggctggcctcctttctgcgccgaggatagccacgacacttaccgcaagatcgtgaactggaggcactcgctttacttcccggatgacatcacccttggtgtagatgccgagaaccttatcagaaggtatgcatgcttttgacttcccccaaaatcacgcgctcaccatattgacttgtcatagcctcatctgcaacactgagaaccgtctcggccgtggtggtgctcacgaaatcaagagccacgccttcttccgcggcgttgagttcgacagcttgcgtcgcatccgtgcgcccttcgagccccgtcttacatccgccatcgataccacatacttccctacggacgagattgaccagacggataacgccacgctgctcaaggctcagcaggccgctaggggcgccgctgcccctgcgcagcaggaggagagcccagaactcagcttgcctttcattggatacacgttcaagcgtttcgacaacaacttccgataattgcgt

SEQ ID NO: 27751 - DNA, 3520 bp, Neurospora crassa
atggtcagaaccagaagatccgtggttgcggccgacgaggttgttggtaggtctttcgatgaagctcttctggttgaaactggagatagactggcacttggtgtaaatgtgatcacagactgacatgaatattccagtagcagcacccatcgcggaaatcaagaaacctcgtggtcggcctcgcaaatcggccaccccagccgttagtgccacggcgtcttccgtaccgactccggcgacatatacatctggtagtgagtatgctacgccgcttaccagtcatgctgcgaccccgacgccatctctactcaaggagaacgtacggtctaccaggtcgactcagtccgcaccaaagattgaggttgctatacccgttctcaaggcttcacataccatgcaaacaacgcttcgcagtagtgcctctgctacaactagcaagcggaagagaaacatggtggcagacagccaggaagatgactcagatgatggtcacgatgcaaaacttgcgcggatgcttcaggacgaggaagatgcaaaggtagcatcatcatctaaaacaccctcttttcgagttgatcatttgggcagtaccccgcgtagcacgcggtcttctcatcgggggaacaccaatgtctcgagcagcaagaccaagaaggaggtcattgcggacagcgaggatgatggttttgacgattctcctgatgctacacttgcccggaaacttcaggctgaggaatacggagaggaagattccgaagtggaagcggccacatccaacgttaaggcacttggacttcgtcgcagttcgagaaggctcaactcgtctccagtccgggcgtcatccaacgtcactggcaaatctaccgccgttgcaaaaggaaatcagtctgcacctacacggaactccactaggcgtggtgttgcagagtcttcgactcaagttcttggctttaggacagctaaagacttgattgccgattcacaggatgacgacgatgattttgattctctgtcggctttcgaatctgatgataatgatagcgatgtcagcgcccagggaggtcgcccttccgcggcccagaagggtaaaggaaaggcgatcgcgcccccgccagagtcggaggacgagaacgatagcgacgattctgtcctatcgcttccagacgaggcagacgaaatgtcggttctaggtactggcagttacgtgtccattgacgaggaccctgatttccttttaccccccaacttgcaggcttcggttcacggtagcgacgatgatgaagacgccactttgggtgcccatatcgctgaggccggagagggtcttgatcgtatcagggcacaaatgagcaaccggcgtgcgtaccgatcgtaccggagcaataggcgcgttaagaaagaccgactccgtctcgagaagcaacaccccgaactcacgacgatgtggaaagacctggagaacatgcccgttttgaaggctggtagggctgaacagccaaagtccatttcacgacagctgaagccttttcagctcgaagggttggcctggatgacagcaatggaaaagacagagtggaaaggaggacttctcggcgacgagatgggcctggtacgtcatggattcctccttgatttcagtttagtttctgtgtgctaattgcttcttgtcacatcatagggcaaaacaattcaggcagtgtccctgatcatgtcagattatcccgctaagaagccttcactcgttcttgtgcctcctgtggccttgatgcagtggatgacggagattgagtcatacactgacggtacactgaagacactggtcgttcacggtaccaactccaagtccaagaacctcactgtcaagaacatcaagagctatgatgtgattatcatgtcttacaacagtttggagtccatgtaccggaagcaggagaaaggcttcaagcgtaaggaggggctctacaaggagaaatccgtcgtccaccagaccgagtggcatagagtaattttggacgaagcacataggtgagtcctgaatcgtcgaatactgactaccgaataacggcttacatatcataccacagcatcaagagccgaacgacgatgacggccaaggcatgcttcgctctcaaggttacatatcgctggtgcctcagcggtacgccgttacaaaaccgcattggagagttcttctctctgatccgcttcctcaatatccggccattcacatgctatctgtgcaggggatgcccttgcaagacccttgaatggggcatggatgatgacaacaggtgcaagcactgcaaccacagcgccatgcaacacgtctcagtgttcaatcaagagctcctcaaccccattcagaaattcggaaaccgaggtgagggtgctttggcctttaagaagcttcggatccttacggaccgcatcatgttgcggagactgaagaaggaccacaccaacgcaatggaacttccagtcaaggagatcaacgtcgagcgccagttcttcggcgaggtagagaacgattttgcaaacagcattatgaccagcggccagcgaaagttcgacacatacgtggccactggtgtacttctgaacaactacgccaacatttttggactcattatgcagatgcgacaggttgccgaccatccggatctgattctgaagaagaatggcgaaggtggtcaaaacgtgctcgtgtgctgtatctgtgacgagcctgccgaagacgccattcgctcccgttgcaagcacgacttctgccgtgtttgcgtcaagacgtatgtgcattcggctacggacccgaactgcccttcttgccacattcctctatccatcgacttggagcagccagagctcgagcaggacgaggcgcaggtcaagaagtcatccattatcaaccggatcaagatggagaattggacctcgtcatccaaaatagagttgttggtacacgaactccacaagctccgatccgataacgcctcgcataagtccatcatcttctcccagttcaccaccatgcttcagctcatcgagtggcgtttgcgccgcgctggtatcactacggtcatgcttgacggtagcatgactccagcccaacgccaggcttcgatcaaccacttcatgacaaacgtggacgtcgagtgcttcttggtgtccctcaaagcaggaggtgtcgctctgaacctcactgaggcttcgagggttttcattgtagacccttggtggaacccagccgcgtatgtttacccttatggcgttacatgaaggacgttctgactaacttgctcgcagtgaatggcaatccgccgacagatgtcaccgtattggtcaaagccgaccttgtacgatcacccgactttgcattgaagactcagtcgaaagtcgtatggtccttctgcaagagaagaagaccaacatgatcaactcgacaattaacgctgatgatgcggcaatggattcgctgagccctgaggatttgcagtttctgttcagaggaaactgagcatca

SEQ ID NO: 27752 - DNA, 1673 bp, Neurospora crassa
atggcagagcaagaacacaacggagtcaatggattccattccgagtccgagcagagaaaccaacccgtaaatggtgatgcgagcgaggccgtcaacggaaaccccagcaatggtctcagagtgacgattgaagaaagcgccagcagcgccgtcaacgggggctctcctaccaacagcatgttaacacccatacgacagagaatggaacgcaaaaagtccagtcccatgatgccgacgttcatggtttcggcaccgggaaaagtcattgtgtttggagagcacgcagtcgttcacggcaaggtacgtcgatcaagcacctagatcatggtgatgctggaaaagggggtaatgattcccagaggctaacggttgtctctcttcgccaggctgcgattgctgccgccatctcgctgcgatcttacctgctcgtcaacacgctttccaagtccaagagaactgttacgctgaaattccctgacatcgacttcaatcattcgtggaatatcgacgagctcccatggaagatcttccaacaaccagggaaaaagaagtactactacagtctcgtcaccgagattgaccaagaactcgttgacgccgtacaacctttcctcgccgatgtctcgatagacaagcccgccgacattcgcaaggtgcaccagaactcggccggctccttcctctacatgttcctttcccttggctcacagtcgttccccggctgccagtacacattgcgctcgacgattcccatcggagccggcctgggcagcagcgcgaccatcgcagtatgcttgtcggcagcgctcttgctccagcttcggacactgtccggtcctcaccccgaccaacctcccgaggaggccaggctacaaattgagcgcatcaaccggtgggcatttgtttacgagatgttcattcacggcaacccctcgggcgtggacaacacagtatcaacacagggcaaggcggtcgtcttccaacggacagactacaaccagccgccctctgtgcgccccctgtgggacttccctaagctcccgctgctcctcgtggacaccaggacggccaagtcaacggcgcacgaggttgccaaggtggccacgctgaagaagaagcacccgcagctggtgggcaccattttgacggccatcgaccaggtcacgcaaagctctgcacagctcattgaggagcaagggttcaacacggaggacgaggagagcctgagcaaggtgggcgagatgatgaccatcaaccacggcctactggtgtcactcggcgtgtcgcacccccgtctggagcgcgtgcgcgagctcgtggaccatgagggtatcgggtggacgaaactcactggtgcgggtggtggcggatgctcgatcacgctgctgcggccgggagtgccgcgcgagaagctggataagctggagcagcgcctggatgaggaggggtactccaagttcgagacaacactaggtagcgacggtgttggcgtactctggccggctgtactgaagaacgggatggacgaggatgaggagggcggtatggagatcgaccttgagaagttcctcagtgcggacagtaacgaggcgcttgagaaacttgtcggtgtacatggcgaccggggcgagcgggagggctggaagttctggcgggttgagaaccgggactag

SEQ ID NO: 27753 - DNA, 1764 bp, Neurospora crassa
aaaggtagctaaccagggcggtcctctcctgtcaaagctccagcgactaccacctccaatcccaccacgaccaatactacaagccaaacagcatcgcaaccatcagaacctactaccgtactcgaacgtagccaacagcgttacgaaaagacccgtccattcgaagctgcccgtcagcagaaaggacttagcaaactccccaaagaagaccagaaaggttggatctgcgaccagctcctacatctgaccaaccgcctgcccgcagccagccgctcaagcctcctcggtcctaaagcgtccaaggagatctggtggaccgtcaacgggaccaactcaatcgtccgcggactcaagcacaagccgaagccacatactacctggggcactgatcggaacggccacgacgtcggcagctacacgatcgagcggttcgacgagcgattcaggaagcggatcgcattgacagcgctccaagtgtcgagcagagtatttcgggagaacgttgagcgtgagaagagagggtttgtcgacgcaaggtccggacgggagattattgttacggaaagagagattgacgaagagaaggtcagacgaagcaagatggctgcgctcaagaaggatctgtacggcgctatcacggggaagctggctgagagcgtggagtgggaggatgtcgttcctattccgcatgaggagcccgagggcgcgctggcggcaatcatttatccggctgagtatgctgagggtatgttacacacttcctttctttcccctccccatcaatcaggtcatgatcaaagctgattctcgtcaaaaaaaatagcaatgtcctacctccgcgccgtcatgaccacaaaggagtactcaccccgctgccttcgcctaactgagcacatcatcgccatgaaccccgcccactacaccgtctggctctaccgcgccgccaacatcttcgccctgggcatatccatcccggacgagatcgagtggcttaatgaagttgcgctcgccaaccttaagaactaccaaatctggcaccaccgccacctgctcgttgagcactattaccccaccatctcttccgaccccgacgctcttgcccaattcgccaaacaagaacgtggcttcctcatcgccatcctgtccgaagacaccaagaactatcacgtctggtcgtaccgctcgtggctggttggcaagctggggatgtgggaggacgaggaagaactgaagtcgattgagaaaatgattgacgaggacgtgcgaaacaacagtgcttggtcgcaccggttcgttttggtgttctctaacccaaagtatgcaacgccgggtaaggcggcgacggaaaaggatgaaaaggtgccccaggagctggtggagagagaggtgaagtatgcccagaacaaggtgtatctggcgccgcagaaccagagcccatggaattacatgcggggcgtgttggtgaagggcggccagcctctggcaagcgtgcaggagtttgtggaggagtttgtgaataagttgggtgaaggggaggaggaggaagaggtgaaaagtacgcatgcgttggatttgttggcggagatttatgcggagaagaaagagaatgaaaaggcggatctgtgtttgaggaggttggcggagaagtgggataagattcggggagggtattgggagtggaggaggaagtgtttgacacaaagtgagacggagaaggcgcccggagagcaggttgaaaaggctgaggagggaattgcagcggcc

SEQ ID NO: 27754 - DNA, 622 bp, Neurospora crassa
atgtctctcaacgtagcccaacgtcgtctcctccaagaataccgcgctctaaccaacaacccacccgaaggcatcaccgcgggccccatttccgaagacgacctgctgcactgggaatgcctgatccaagggcccgaaggcaccccctttgagggcggcgtgttccccgcagaactcaagtttccgaacgattacccgcatatgccgccgaccatgaagtttctgggggatatattccatcctaatggtgtgttcttcttctccttcctcttcttccttttttatttctcttatccttcacttggttcttctcaccatctgtggtggtcaggcatgcaaagtgctaacggaaatcaaccctccaacagtctacccctcaggtctggtctgcatctcgatcctccacccacccggcgacgacccgaaccactacgagactgcctcggagagatggtcacctattcagtccgtcgagaaaatcttgttatctgttatgagcatgttggcggagcctaacgacgagagtccggcgaacgtggaggcggccaagatgtggagggagaagaggagcgagtacgaggcgagggtgaaggctagtgtgagggctagcttggggctttaa

SEQ ID NO: 27755 - DNA, 837 bp, Neurospora crassa
atggtggggaacaaacaggtgctatacaagttggtggtgctcggtgacggaggcgtggggaagactgccttgaccatccagctctgcttggagcacttcgtcgaaaccgtaagtgtgctcttctcacaacccttctcccttcaggctgatcgtctgcctcctcaattgcatatccctgcattgcccacgtccctccctggcttggccaactagccgcctacctgcattctcagcctgtcgctaatctcgacgatctagtatgatcccactatcgaggactcctacaggaaacaggtcgtcattgacggtcaagcatgcatgctagaggttctggacacagcaggacaggaagagtacacggcactacgagaccagtggatccgggatggtgagggcttcgtgctagtatacagcatttcatcacgctcctccttcgcgcgcatcaagaagttccaccaccagattcaaagagtcaaggagtcgacctcgtcgccgtcagcatacccaggatcttcacctctcgccgccaccaacccgtccgcgcctgtgccgattatgctagtgggcaacaagagcgaccgcgtaacggagcgcgaggtttccacacaagaaggacacgctttggcgcgagagcttggctgcgaattcaccgaagcgtcggcaaagacacgcacaaatgttgaaaaggccttctacgacgtcgtcaagcagctgcgaaaacagcgacagcaaggacaatcaacaccgcgcgcgctaccgccatcagggaatagcaagagcgaaaagtacagtgggacagaaaagcccaagcgtcctcgtggaaagtgtttgattata

SEQ ID NO: 27756 - DNA, 2744 bp, Neurospora crassa
cagggcgaccagcacgacgatgcgcaagctcccttcctctccgaaaaccctatgccttacgacaacgaccgcttgggcaccgatacgcctccagtccgccctgtctcggcgtatagcttgaccgaatcctatgctcctggtgctggcacgacgcgagctggtgtcgctgtcaaccctaccccgccacctcacgggggttatggcggcggcggcgttagcagtggtgtcgatcagggctacaactacggtggtgactatgcgacggatccggcctacaggatgtccgccatcgatgaggacgatagctggctccgtcgtcagcagcccaacgctgctcccaccggcggcctgaagcgttatgccaccagaaaggtcaagcttgtccagggttccgttttgagtcttgactatcccgttcctagtgctattaggaacgctgttcagcccaagtaccgcgatgaggagggcaacaacgaggagttcttcaagatgcgttacactgccgccacttgcgatcccaacgactttacgctcaagaacggttacgatttgcgccctcgcatgtacaacagacataccgagcttctcatcgccattacgtactacaacgaagacaaggtcctgctctccagaacgctgcactccgtcatgaccaacatccgcgatatcgtaaacctgaagaagtcttcgttctggaaccgcggaggaccggcgtggcagaagattgtcgtttgcttggttttcgacggtcttgataagacagacaagaatgttctcgacgttctggccaccatcggtgtttatcaggatggtgtcatcaagaaggacgttgacggcaaggagactgttgcacacattttcgagtacacaagtcagctttccgtcacaccaaatcaggcgctcatccggcccgtggatgacggcccgcagacactgccccctgtgcagttcattttctgcctgaagcagaagaacaccaagaagatcaactcgcatcgttggctgttcaatgcctttggccgtatcctcaaccccgaagtatgcattctgttggatgccggtaccaagcccagccccaggtcgctgttggctctttgggagggtttctacaacgataaggatcttggcggtgcttgcggtgaaattcacgccatgttgggcaagggcggcaaaaagctgctcaaccccttggtcgccgtccagaacttcgagtacaagatttccaacattctcgacaagccgctggaaagtgcttttggttacgtttctgtgttgccaggtgccttctcggcctaccgtttcagagccatcatgggccggccgctggagcaatacttccacggtgatcacaccctgtccaagcttttgggcaagaagggtattgagggtatgaacattttcaagaagaacatgttcttggccgaagatcgtattctctgcttcgaactggtcgccaaggctggccagaaatggcatctgagctacatcaaggctgccaagggcgagaccgatgtgcccgaaggtgcgcccgagttcatctctcagcgtcgtcgttggctcaacggttcgttcgccgccagtttgtactcgctcatgcatttcggaagaatgtacaagagcggtcacaacatcgtccgcatgttcttcttccacgtccagctcatctacaatatcgcaaacgtcatcttcacatggttctctctcgcttcctactggctcaccaccactgtcatcatggatcttgttggtaccccggttacggcttctagctcttcggcagaacatcacggttggcccttcggtgacacggtaacgcccttcttcaacgcggttctcaagtatatctacctggcattcgttatcttgcagttcatccttgcattgggtaatcggccgaagggttccaagtggacatacattacctcgttcttcgtcttctcgctcattcagtcctatatcttggttttgtccggttatcttgttgcccgcgcgttctccgtaccgctcgaccaacaattacagctggacaacgctaaggacgcaatggcttcgttattcggcggctcaggatcagcaggtgtcattttggtggccttggttaccatctacggcctttacttcttggcctcctttatgtacctcgacccctggcacatgttccactcgttcccttactacatgctcctcatgtcgacctacatcaacatcctcatgatttacgccttcaacaactggcacgacgtctcgtggggtaccaagggttcggataaggccgaggcactgccgtccgccaacgtcagcaagggcgagaaggatgaggccgtggtggaagagattgagaagccacaggaggatatcgaccaacagttcgaggctactgtcaggcgcgctcttgctccgtacaaggaagacgagacgccggagcctaaggatctcgaggactcgtacaagtctttcagaaccatgcttgtcgtgtcttggctgttttccaactgcctcctcgcggttgttatcaccagtgataactttaacacatttggcatcggggtaagcattgctgttcaccttattgtgactttgaaccacttactaatatatattgatagcaaaccgcatccgcgagaactgcgtggttcttcaagttccttctgttcgctactggtgcgctctctgtcatccgctttattggcttctgttggttccttggcaggaccggtattatgtgctgctttgcccgtcgctaa

SEQ ID NO: 27757 - DNA, 438 bp, Neurospora crassa
cgctgatgaacagatctcagcgagctttcactaggcagcacaatgaagaccgagttcccggacccagacgatatcctcaacttcatcctctacatcgagccggacgagggcatgtacaagggcggcaagttcagcttcaccttcaacatcacacccaacttcccacacgagccgcccaaggtgcagtgccgcgaaaagatctaccaccccaatatcgacctggaaggcaaggtgtgccttaacattctgcgcgaggactggaagcctgtactcaacctgaacgccgtcatcgtcggcctacagttcctcttcctcgagcccaacgcgagcgatccgctgaacaaggaggctgccgaggacctgcggtccaacagggaaggcttcaagcgcaacgtcaggacagcgatgtcgggcggtacagtcaagggtcagacgtat

SEQ ID NO: 27758 - DNA, 1868 bp, Neurospora crassa
cctgtccccatccttcaatgtctccagatcaagaccctcgactccaagaatgggggcgcgggcgccacggagaggttccgcattgtgctgagcgacctcaagaactatgtccaatgtatgatggccacgcaaacaaaccatcttgttcacgatggcctcctgcaacgcggctgcatcgtgcgcttgaagcagtatcaagctcaatgtctcaagggcaaaaagtacgcctatctacccctccgccaattcgggaaatccataacactgactgtttaaatccagcatcttgattgtcctcgatctcgaagttatccagtcccttggctgtcccgaaaagatgggcgatccacagcctcttggcccccgcagtgcagaaccacagcagaaccccaatctcggcagcaccggcttctatggcgtcaagagcgaacctacccaagacacgaaaccacagtttccacgccagatgccctcgcgtaatgccagcgggggtcagggatcaagcacgatatatcctattgaaggtctctcgcccttctcgcacaaatggaccatcaaggccagagtcacctccaagtccgatatcaagacctggcacaaggctagcggcgagggcaagctcttcagcgtcaactttcttgacgagagtggcgaaattagagcaacaggattcaacgaccaagtcgaccagttctatgatttgctacaggagggtcaggtttactacatttctacaccttgcagggtacagcttgccaagaagcaatggtcgaatctccccaatgactacgagctcacctttgagcgggataccgtgatcgaaaaggccgaagaccagacatctgtaccacaggtacgcttcaactttgtcaacatccaggagcttcaggatgttgagagggatgcgactgtcgatattattggtgtcctcaaggaggtccaagaggtgacccagattgtatccaagaccacacagaagccgtacgacaagcgcgagctgacccttgttgacaacactgggtactcggtacgttgtaccatctggggtaagacggccacgaactttgatgctcagcctgaatccattgtggccttcaagggcacaaaggtcagcgatttcggtggacgcagcttgtccctgctttcgtctggcaccatggccatcgatccggatattccagaggcccatcatctcaagggctggtatgatagcagcggcaggaacaacaccttcgccacccacaacaacatgcagaccttgggtggtgcgaccggtcgcaaggacgacgccaagaccatctcacaagtaaaggaagagaaccttggcacaaacgaggcgccggattacttcgctctcaaggcaacggttgtattcatcaagcaggataactttgcctaccctgggtgccgaagcgaaggctgtaacaggaaggtcacagatatgggtgatggtacctggcgctgcgagaagtgccagatcaaccacgatagacctcagtaccgttacattatgagcgtcaacgtcaacgaccacacaggtcaactttggcttagctgcttcgacgatacggcgcgggtcatcatgggcaagtcggccgatgaacttatggagattcgagagaccgacgagacgcggttgcccgccgagtttgagcaggccaactgccgcaagctgaactttaggtgcagggcgaagatggacacatttggtgaacagcagaggtacgtatcgggggttattctcacgattagatggacgttgctgacacattgcttgttgcaggattcgataccaggtcatgagcgtggcgccccttgactacaagatggaaggaaacaagcttaacgagctcatcaattcttacaac

SEQ ID NO: 27759 - DNA, 2074 bp, Neurospora crassa
gatgtcatatatgagctccagtcgattatgcgcctgcacgaactcgacgttcaagacatgttcttcaagtgggagtcgtactgcatcaagatggacatggaccagcccaagatgtccatgtccactgttcgcaagttcaagcaggacctacaagacacactagaacgagcaaaccgagctcaggcgttggagcaagtcaagaccgaaaagcgaccgggaggaacaccaaggccaggagcgaggaacaatagcgatgtgtttggtatgcttgatggactcacaacaccggcagctcgacgggcagcaaagcttggttcggctaggaaaacaccaatggggactcccatcggctcccgcttgaagaatgagcccgtaagctcgccgatgaagctggaggcacaactagatgccatgggcgtgattccgtatgtccagaccagttccctgcatacgtactgtatgtaccttgctaaccgttccaagaccatcttctttcaaagatagaccaaacgccggcgaagtgatcgaaatcctcaacgaaaatctccctgcgcccgaaccacccatcgctcccttcggcgagtcccgcatcaaacttactgccgcctccgatctgaagaaattgggctacaagccactagcaatgaagctttctgaagcatccgagatcttggacgacaggatagacgactttacaagtttggttctggaacattacaagttggacgagtcggtattcggcagcgcggctatgcagagtaccacagagatcgtggcagtcgggcgtgtcgcctctgatacgtccgagggcaagctcaacgccgcttccctcgtgttagaaacctccagaaagttgggcggcggtttccgggtacccctaaacgtcagcaagctcaagggttaccagttcttccccggacagatcgtcgcactacgcggaaccaataccacggggcgtgagttcaccgtcaacgaagtcatacgcatgcctctcatgggcaatgctgcctccacactagagaccatggcagcacaccgtgagaggctacgcggcggtccggacgccatggacaccgacgacgaaaaccccatgcctcttaacgtcatctttgcctctggcccctacaccgccgacgacaacctcgacttcgagcccctccacactttcatcaacgaagcagcagacacctatgccgacgccgtcatcctcaccggccccttcatcgacgccgagcaccccctcattgcatcaggcgacttcgacctccccgaggaagccgtctacgaccctgacgctgcaactctgaacactgtcttcaagtatctcatctcgcccgcgctgaaccgactcgtgtccgccaatccgcacgtcaccatcctgctcgttccctcggttcgcgacgtaatcgaccgccacgtctcttggccgcaagaccccttcccccgcaaggagctcggcctgcacaagagcatcaagatccttggcaacccaatgacgctcagcctcaacgagacgttggtggggatcagcagtcaggatgcgctgtgggagctcaagcatgaggagctgattggcggcacggtggaggataccaatggcttgtcgagggtggcgaggtatctgatcgagcagaggcattatttcccgctgtttccgccgacggatcggacgaagctgcccaagacggggagacaggtgattgatgggcaggctgcgccgggcgccatgctggatatcagttatttgaagttgggcgagatggttaatgtgcgtccggatgtgttgattgtgccgagcgcgttgccgcctttcgccaaggtatgttttttttttgttgtgttgctgaatttgcttttcatcctgggaatgcgtgcagttactgactttcttgtctaggtcattgaaagtgtgttggtcatcaaccccgggtatctatcacaacgcaagcgagccggtacatatgccaggatgacactgtatccgccaaaactgtcggaggcggatgctgcgccaggtgggatgcttgcccataggatctttgagagggcaagagtcgaggtcaccaggatttaa

SEQ ID NO: 27760 - DNA, 3909 bp, Neurospora crassa
attgttgaaggccttctgcgacaaaggccaatacccccaagtaaagatggaaggcacataccgctgaaacctggtttggtacgacagacaccgttgaacgacgagcggacgggtcagccttacgtctcaaactttatccgttccagcagatataccctctatgacttcttgccgaagcaattactttttcagttcggcaagctcgccaacttctatttccttgtcatcggtatcctacagatggttcctggattgagcacaaccggaacgtacacgacaatagccccgcttatagtttttgtgtgcattagtatggcaaaagaaggttatgacgactaccgccgttacagactcgataaactggagaacaggagtgccgcgtttgtgctggatcccgatggcaccgtcagcaccagagtacgagggaggaaacgggggatgctcatggaaatggtcaagggcaaaaagtcggctgagggtggtgctgctacggaactagctggtttggaaagggtgaccacagctgaagtcgaccagagcgagggagagggcggaggcgagccttgggcacgaatcgaatggcaggacatcagagtcggcgacattgttcagctgcggagagatgaaaacgtgcccgccgatatggtgcttctccatgccactggcccgaacggagtcgcatatatcgagactatggcgttggatggcgagacaaatctcaagagcaaacaggcctgtcctttgttgctcaaccattgctcctctaccaacgacatggcccactgcgatgctacagtcgtctccgaggacccgaatctcgacctctacaactacgaaggccgagtgacggtaaacggagagacgatgcccttgacctccaatcagatcgtgtacagaggatcaaccctccgcaatacgacccaagcgattggaatcgtcgtcaacactggcgaggagtgcaagattcggatgaatgcgcacaagaatgtgcggaccaaggcacccgagatgcagttcatggtcaaccgaattgtcatgcttctcgtggtcttcgtcgttgcactcgctgttgggtgtactggtggatataccatgtggcatcgcagcaatgaaaggaaggcttggtatctcattcagcaaaaggtcccaatcaaggaaattgtcattggcttcattatcgctttcaacactctgattcccctgtcactttatgtcagtcttgaaatcatcaagcttgggcaactttacctactggcggatgtcgagatgtatgatcccaaaacagacacggcaatgagcgccaacaccacaacgattttggaaaacctcggtcaggttagctatgtgttttcggacaagacaggtaccctgactgagaacctcatgaggttccggaagatcagtgtgggaggagcggcctttctccatgacatggatatacggagagacgcagagaaggcaaagcaagagcaactcgcccaggatctgccgaaaaggagcctttcgatctcagcaaaaccgcggccctctaatgtcgaggcctccttggaaccacttgcagaagagtcgagcaacgagcctattgtcgccaaccaatctgcgtggcactcaagcgctggtgtgaaacatggacagcgggaaccgaataccgaggagttgattcgctatcttcagcagaggcctaacacgcctttctcccgtatcgccaagcacttcatactctgcattgcgctttgccacacctgtctccctgagaccaaggaggatggcgaaatgactttccaggccgcctctcctgacgagttggcgttggtggaaggagctagggacttgggctacttggtgatcgaccgtccctcacaggccatcaggcttcaaactcgcgatgcggacggcaaccctgttactgagacatatgaggttctagacgtcatcgagttcagtagcaagcggaagcgcatgtccattgtcattcgcatgcctgacgggtctacctgtatctttaccaagggtgctgatagcatgattctgcctcgcctcaagcagagcaatctggctatccagactgctggaaagatcggacagatggccagcatgcgtaagagtatggaacaggagaaggctctgcgtcggcttagtctccacagtatcaagcgtgacagcatgaaccttgttcgggcttctcgtgcttcgatggaccaccgaagggttaagggcagtcagcgccggtctacgttctttacggatgaggttgattcttggctagtacgtcgtgagactgacgagtttgatgattccaacccacccccgcgtcgctcgatgcagcgtggccggtcctttgaagtcggtcgtccccatgatccgctcgacggaatggttgacgaacatttggctctgaacgaggccgccgtgttcgaacgctgcttcaagcacattgatgacttcgcctctgaaggtctgcgaaccctcgtctttgcctaccgctatctggatggtgaagagtacaggaagtggaagactatttatcatgaagccactaccagcctggttaaccgccaagagcgcatcgaggcggctgctgagatcattgaacagaactttgaccttgctggagctaccgccattgaggacaagctgcagcacggtgtgcccgagaccatcgacaagttccgccgtgccaacattaagatctggatgcttacgggtgacaagcgtgagactgccatcaacatcgctcactcagctagaatctgcaagcccttctcggaggtctacatcctggacgcgactcaaggcgatcttcaggagagacttgcctcgactctgatagatgtgggtcgtggcatggttcctcactcggttgttgttattgatggtcacactctgagtgtcgtggaggaggacgagtccctccgcgttttgttctttgaccttgttgttagagtcgactcggtcatctgctgtcgcgcatccccatcgcagaaggccacgcttgttcagagcatccgccagcaagttcccaaggctgtcactcttgccattggtgatggtgccaatgatattgccatgatccaagcttcgcacgttggcatcggtatttccggaagagagggtctccaggctgctcgaatttcggatttttccatcagtcagttccggttcttacaacgcctactctttgttcacggtcgctggaactatatcaggactggcaagtatatccttggtaccttctggaaggagattgtcttctacttagtacaggcgcagttccaacgttacaacggctatacgggtacttctctgttcgaatctaccagtttgactgtcttcaacaccctgtttacctcgctcccggttattctctttggtatcttcgagaaggatcttgaagccgacacactgatggcaatacccgaactctacacatacggacagaaggagaaagccttcaacgtcaggctgtacattggttggatgttcatggccgtctccgagtcagtgctaattttcagcattgtctggtatgtctatggtattaccctgccgcccgagaacgctgctctctatcccgtcggtaccctggcctttaccatttgcgtcattttcatcaacattaaaatgcttgtcctcgaactccacaaccgcatcgctatctgtttcgccggtctcttcatctctgtctttggctggttcctttggaacctcctcctcagcggcatcttctcggccaagatgagtccgtaccttgttagagacggtttcatcagaggtttcggccaacacgcgccctggtgggtcgtctgcatcatcgcgctgtctgcccttcttatctttgaggtagccatcagcgcagtgcgcagatctctatggcctaccgatcaagacctgatgaaggagattgagcac

SEQ ID NO: 27761 - DNA, 1783 bp, Neurospora crassa
gagcgaaaactaggaacatggtccacagccttcctcatttttaaccgcgtcgtcggcgccggcatcttctcaacgccatcctccatcatccacaacaccaatagcgtcggcgccacgcttctcttctgggtgttaggtggtgtaatgaccttttggtgagttttgtatcatcctttcttaccttgccctacaccatctctatgtactttcaccactttgaccactcgaaaagcggctaactcgcatcctcaaccacaaaagcgggctagccgtctacctagaattcggcaccgccatccctcgttccggcggagagaaagtttacctcgaacgcgtctaccgcaaacccaaatacctagcgacctgcatcttcgccgtgcaattcatcctcttcgccatctccaccgtcggctccgtttccttttcctcgtacctcctccgctgcgtcctcggctctcctgacaccaccaccaccggaggcaccgcgcaagaagatgcaaccaaatacgaaggcacgtggctaaaccggggcatcgccgtggcagctattaccgccgtctgcctcatccacgcattcttacctaggttgggcatctggctatccaatggtttgggggtgttcaagctggtgctgctgatcttggtggtatgtacggggtttaggcgttagcggggaatatggagggagaaagcccgagaaacttttcgagctttgatgggccgggggatgccacggggaatggagacgaccagacggacgggatggggaataatgtcgcgggcagtgcggcggggtatgcgttggcgttgttgcaggttttgtatagttatggggggtgggagaatgccaattatgtgagtgacccctcggaagtgggcggtgatgggttggtgaggtaatgctaacaacgggtttgtaggtgttgagcgaagtgagggatgcgccgaagacgttgagactggcggcgccgattgccatcgggacggtcaccgtcctttacgtcctggcgaacattgcctatgtgagtatcccctcaagtgtctcacaagaacttccatgactgacaacacacagttcgccgccatgaccaaagacgaactctccaaatccggcgtcgtccccaccgccatcttcttcacccgcgtctggggtccctcggccttcaccgagcgcgtcatgcctctcttcctcgccctctccgcgctcggcaacgtctttgcgcaatccttcgccatgccccgtgtgaagcaggagctcgcaaaggaaggcactctccccttctcgcgcttctgggcgagcgactggcccgagcaaaagtcgccgacgggcgccattttgctgcattggatcttcaccgtggccttgatcctcggatccagcaccaaggacgtgtaccagtttctgtccaacatttttacctactcgggcaactggatcaaggtcttcctgggggtggggctgctgtatctcaactttacgccgagcgagaactggacgacgccggagaacaagcggttccatagttatcccgtcctgacggtgttttgggttgtcgggctgctgtatacctgtgcggcgccgtttatcccgaacacgctgctgaccaaggttcacttttcggtggtgccggcgctggggacgggcatgctggttatcggcgtcatgtattgggtggtttgggccaaggtgttgccggcgtttgggttctctatacagcacgaggtggtggtgttgccggatgggagtgagagggtcaagtataagagggtgaggccgagggga

SEQ ID NO: 27762 - DNA, 557 bp, Neurospora crassa
caggataattccggtaccatcgagcgcgaagagttcttgagcctaccgcaaatatcgacaaatcctctggctacaaggttcgttacattctacccctatacctacccttgctcatatcagtatatcgcatgcttctggctttctccgcgtggaaatgctgtctgggcacaatatgcgacatcatttagagtgaagactggcgactaacggtttccgacttgggtgttatgcagaatgattgccatcttcgacgaagacggtggtggcgacgtcgactttcaagagttcgtatccggcttaagcgccttctcgagcaaaggcaacaaggagcagaagctgcggttcgctttcaaggtgtacgacattgaccgtgacgggtacatcagcaacggcgagttgtttatcgtactgaagatgatggtaggcagcaaccttaaggaccaacagctgcaacagattgtcgacaagacgatcatggaggcggatttggacaaggacggcaagatcagctttgaggagttcaccaagatggtggagaacacggatgtcagcatgag

SEQ ID NO: 27763 - DNA, 752 bp, Neurospora crassa
gcctgcctgtttgacatggacggccttctcctcgacaccgaggacatctataccctctgtgtgaatgagcttctgcgaaaacacaagaaggagaagtttcccttgccatggagcatcaaggctcagctccaaggtcgcccgggtcctgcggcccttgacatcttccataactgggctgatttgcccatcacccgtgagcagtacaaggaggaatactacgctcttcaagctcagaaattcaagcataccacggctctccccggtgtcgaggagcttctgcagaagcttggcagtacccgctactgggatctcaagggggatgcgtctgctactaccaatggcgccaccgacaagcccgccccgaagcctcatcgggttcacatcgccctcgccacatcatcccacgaggcgaactttcgcatgaagacaaaccacatccaggagctcttttcggttttcgagacccaccgtcgcgttctcggcgacgacaagcgcatccccgagggccgtggcaaaccccttccggacatctacctgatcgcccttaagacgatcaacgactcactacccgagggcgagaagcccatcacacccgaggaatgcctcgtctttgaagacagtattcccggtgttgaggctggtcgtcgcgccggcatgcgcgttgtctggtgcccccacccaatgctcaagaaggaggtggacaagaatggcgacgccaagctggttctcgcgggtcttcttaaccaagctga

SEQ ID NO: 27764 - DNA, 1437 bp, Neurospora crassa
gcaccaaccgaacccctttttctccactcgggccaacggcgatcccagatcacgtggccaccctcatcgtcaccacttgctgactcttactcttcactacaggtctggaagatcaaccgcgagcgtgctgtcgactacctcaacaccaggaatcgcatctacgtcgttgacggttatgccggctgggatgagaagtaccgcatccgcgtccgtgtcgtctgcgcccgcgcctaccatgctctcttcatgcgcaacatgcttatccgccctccccgtgaggagctcgagcacttccaccccgactacaccatctacaatgccggctctttccccgccaaccgttacactgagggcatgtcctcctccacctccgttgccatcaactttgccgagaaggagatggtcatccttggtaccgagtacgccggtgagatgaagaagggtatcttcaccgtcatgttctacgagggccccgtcaagcacaacatcctcactctccactcctccgccaacgaaggcaaggatggcgacgtcactctcttcttcggtctttccggaactggcaagaccaccctctcggccgaccccaaccgccgcctcattggtgacgacgagcactgctggtccgaccgcggtgtcttcaacatcgagggtggctgctacgccaagaccattggtctctccgccgagaaggaacccgatattttcaacgccatccgctacggttccgtcctcgagaacgttgtcttcaaccccgaaacccgcgaggtcgactacggtgacgccaccctcaccgagaacacccgctgcgcctatcccatcgagtacatccccaacgccaagatcccctgcctgtcgcccaaccaccccaagaacatcatcctcctcacttgcgacgcccgcggcgtgctccctcccatctccaagctcgactcggcccagaccatgttccactttatctccggctacacctccaagatggccggtaccgaggacggcattcttgagccccaggcgaccttctcttcgtgcttcgcccagcccttcctggccctgcaccccatgcgctacgccaagatgctcgccgagaagatcgagaaccacaacgccaacgcttggctcctcaacaccggctgggtcggtgccggcttcgcccagggcggcaagcgctgcccgctcaagtacacccgcgccatcctcgacgccatccactctggcgagctcgccaacgtcgagtacgagaactacgaggtcttcaacctccaggttcccaagagctgccccggtgttccctcggagcttctcaaccccaagaccgcctggaccgctggtgccaactcgttcgacaccgaggtcaagaagctcggtggtctcttcctcgagaacttcaagaagtacgagagcgaggctactgaggatgtcatcaaggctggcccc

SEQ ID NO: 27765 - DNA, 417 bp, Neurospora crassa
ttcgacctcttcgactccaacaaagacggcctcctctcctacgaagaattccgcttcgtcctccgcgccctcggcttcgagctgcccaaagcacagactttcgacttgttgatccgccacggccaaaagcccgccaactggccgcttgaccaggagtgtccgcccgtctaccggctcttcaacctaccgacggcgcaggcgattgcggggacactaattcggcagcgcgaccccaaggaggagctccgtcgcgcgttcaggctgttcgatatagacggcaagggcatgatcacgcaggacgatctgaggagggtgagcaagcaggtggggaataacataccggatgcggatatcacggccatgattgaagagtttgatgcgagtgggaaggggggagtggacgaggatgagtttttg

SEQ ID NO: 27766 - DNA, 1449 bp, Neurospora crassa
gacgcaccggtttacacacttgccgagggacgccccgtccaggacccttcggctgccacggtcctgatgggctcgaagcctcgtggcggagccctctctctcctcgcagacacccagctgatcgaaaccctcgcccacttcccccgagaacgcatccccgaacgtgtcgtccacgccaaggcagccggtgcctggggagagtttgagtgcacggaagatgtctcggactttacatctgttgactttctcaacaaggtcggaaagaagaccaaggtcctggcccgtatttccacggtggcgggtgagaagggctctgccgatacggttcgtgatatccgcggtttcgccgtcaagttcttcaccgaggaaggcaactgggactttgtcggcaatgacctgcccgtcttcttcatccgcgatcccgtcaagttccccagtctcaaccgctcccacaagcgtcacccccagaccaacgtgcccgactcgaccatgttctgggacttccacaacaacaaccaagaaggcgtccactgcttgatgcagctctttggcggccgtggcatccccgcctctctccgcaatgtcaacgcctttggcaaccacacctacaagttcggcaagcccgaggacggcacgttcaagtacgtcaagatccacttgaagcccgacgccggcatcaagaacctcgagtccgacgaagccctccgcctggctggcgaggaacccgatttccacatcaaggacatgtacaatgccatcgagcgcggcgactaccccacctggaccatgtacttccagatcatggaccccaaggacgccgaaacctaccggtacaacatctttgacattacgcagacctggtcgcatcgggactatcccctgcgtcccatcggtaaactcaggcttaacaagaacccggaaaaccacttccaggatatcgagcaagccgccttctccccctccaccatggtccctggcatcggccctagcgccgaccccatgctccaggctagaatgttctcctaccctgatgccgcccgctaccgtgtcggacccaactaccaacaactcccttgcaaccgcgccttgcacgtctattctccgtaccagcgtgacggtccaatgcgcgtagacggcaactatggtggcgacccggattatgtgcggtcttccttccgtcccatgcgtttcggtccccctgacgtcgctcacgacgagtgggccggtaaggttgccttgttcacctcggaagtgaccgacctcgatttcgagcagccgagggatctgtggaagatctttaaggagaccggagaagacaagcggtttgccaagaacgtggcggcgcatgtgggcaaggcgttgccggaggtgcaaaagaagacaatcgagatgtttagtaaggttgatcaggaggtgggcgaggctatccaaagagagttggatgagctt

SEQ ID NO: 27767 - DNA, 1497 bp, Neurospora crassa
agcataggtggtactattggtactggtctcttcatcggttccggcagcgccctcgccaagtcgggccctgctggcgtcctcatcggctactgctttatcgcctccattgtttacagcatcatgatgtccctcggtgaaatggccacctacgtccccgtcaccggcggtttcaccacgtacgcggctcgctttgtcgacagctctctcggtttctccatgtcgtggatctactggttttcgtgggccattacctttgcgctcgagctggtcgctactggtctgatcattcagtattgggacgactctctgtccatcggtattttcatcgccatcttctgggtcgtcattttcgtcatcaacctgttccccgtgtcctggtacggcgaggcggaattctggatgtcctctgtcaaggtcatcaccgtcctcggcttcctcatcttcggcatctgcatcaacgccggcgccggtcagcagggctacattggcttcaagtactggcacgagccgggtgcttttgctccctacattgttgaccctagccgccctgtcgccaagtgggttggcttctggtccgtcatgatccaggccggcttctccttccagggcaccgagcttgtcggtatcgctgctggcgagaccgaagacccgcgccgcaacgtcccccgtgcgatccgcatgaccttttaccgtatcttcctcttcttcatcatgaccgtcttcttcatcggcatcctcatcccctacgacaacaaggacctgaacaatggcggctacaccgcggctgcctctccctttgtcattgcggcccagctcgccggcgtcaaggtcctacccgacatcatcaacgctgtcttgcttactgtcgtcctctctgccgccaactccaacgtctactcgggctctcgtgtcctcgtctccctcgccaacgacggcatggcccccaagtggttcaagatgaccaccaagtccggcgtcccctatattgccgtcatgtttacctcggcgttcggtttcctcggcttcctcaacctctctcccaacggcagccaggccttcgactggcttctcaacatttcgggcgtcgcgggtttcattgcctggtccggcatcctcatcgcccacctccgcttcatgaagggtcttgaggcgcacggcatcccccgctccaagctgccctatcgcgccacctgggccccttactacgtctactacgccctgttcttctgcatcttgatcaccctgacccaaggcttcaccgcgttcatgccctggagcgtcgaagaattctttgtggcgtacgtttcgctcatcatttttgctgtcatgtacctgggccacaagctctataccctcattgtctacggcgccgcggcgtgtaagccggtctctgccaaggacatggatgttactactgggtctttggatctggatgccgagatccccgacgaggtcgaggagcctacgagtatctggaagaagattggaacgggtatc

SEQ ID NO: 27768 - DNA, 699 bp, Neurospora crassa
ttatacagtaacatcacctggcatccgtcgctttcgcgacatgaacgcaaccagttgcgtggccagcgtggtttcaccatctggttcacaggcttgtccgcatcgggaaagtcgacggtcgcaaccgctcttgagcagcatctcttgcacatcggcctggccgcttaccggctggatggtgacaatgtgcgtttcgggctgaataaggatcttggcttctcggaaaaggaccgcaatgagaacattcggcgcatcgcagaggtatgtccaatccaccagctcccaagctttctccccttcactcttgtttgcttctcgtgcttactcccttggattttgccctttcaggtagccaagctttttgccgactctgccacaattgccctgacctcgtttatttctccttaccgcgccgaccgtcagatcgcgcgtgacctccacgcaaatgcgacacaggctggagatgacgtgcttccattcatcgaagtattcgttgacgttcctcttgctgaggccgaaaagagagatcccaaggggctgtacaagaaggcccgcgctggggaaatcaaggacttcactggcatttcggcgccctacgaggcaccagagtcgcctgaaattaccatcaggacagaccttctaagcgtggaggagtgcgtcaagaagattgtagattacctggccgaggctggtctcatc

SEQ ID NO: 27769 - DNA, 1237 bp, Neurospora crassa
atactcgagttctccataccctccttcaaaatcggtacacttgatgccttggtgcagcatgccgatgacctgacaaagctcaacgccatctgtgaggcagtagtgtccaaagtggccgattccctggcaggcattcttgacggggacgaagacaagatatcgcagcaaaagatggtgaacgatagtaagcattgctcctccgtagacctaatggcgccattgctatgtcgatgatgctaacaatgcccagagcccacggacagctatatttgctccttccagtggaacaaggttcgctaccgcgctgaaaagcccctgggcgagttgatcgagaatctacagaaagatatccagaacatcgataacgatgttaaggccaagttcaaccagtataatgccgtgaagacgaatttatctgccttgcaaagaaagcagacgtaagtcactcaatgttgcaccgtctctcggttactccgcaagacactgactgctcttcagtggtaaccttgcaaccaagtcccttacgcccatagtccagcctgacgtccttattcaagactctgaatacctggaaacacacctgattgtggttcctttgagtgcacgcaaagacttccttcggagctacgaaaccattgccgaaatggttgtacccaggtcggctcttcagatcgcgcaagatgacgagttcatcctatttgccgttacaaccttcaagaaaaccagtgccgactttttgcacaaatgtcgcgaacacaagtggacaccccgtcaatacaagtacgtcgagggtggaaaggaagaagagcaacgcgagcttgagcgcatggtcagggaagaaaaaaaagtctggggcgaagctttgcacatgggaaggtcaggttggagtgagagcgtcatggtctgggcacacgtcttgactttacgtgtttttgtcgagacagtgctgcgatacggtctgcctctggagtttgtgtgtgctcttgtcaaggtagggcttcgatgagggatgacgacactgcgacttacgctgacactgtggcagaccatccccaagcaggccaagaaagtcaaaactgctttggacaaggcatactcgtacctcggtggaaatgccttcgggagagacaaacgagggcggtttactaaagatgatgcctctttagcgtcggaaatggccgcggcaggttattccgcgggcgatgccaacgagtacacggcttatgtgtattatgaa

SEQ ID NO: 27770 - DNA, 2515 bp, Neurospora crassa
gctgcccctgagccggtacctgagccgatccccaaggtgaccgacgagtctgagcaaaagggtgacgtggtggcgagctttgaggaaagcgccgtgacacctaggcccgaaccaagccagaagccctacgagccgacatcgttccttaaaaagtatccggtcagtcttgttaatgtagagaacttgacggaagaaccctacgaccccaagagccaggttatacgcgccgttacgaacgagatcgtaaacgtcttcaaggaggtcgctagcatgaacagtctcttccgggatcagatttccacctttagcatgagccaatcgaccggtaatgtcatggctgagccagccaagcttgcggattttgccgctgctgtcagcgccggtgagcctgctgagcttcaggaggttctttctagcctgaacgtggaagaaagaatgcacaaggctcttcttgtcctcaagaaggagcacgtcaacgcccagcttcagtccaagattaccaaggacgtagagcagaagatcaccaaacgccagcgtgaatactggctcatggagcagatgaagggtatcaggcgcgagcttggtatcgagtctgacggcaaggacaagctcgtcgaaaagttcaaagagctcgccgacaagctggccatgcctgaggccgtgcgcaaggtgtttgatgacgagctgaacaagctcgcccacctggagcctgccgcttccgagttcaatgtcacgcgcaactacttggactggctcaccaacattccttggggccagagcagtgccgagaactttgacattctgaatgctgtcaaggttctggatgaggatcactatggtctcaaggacgtcaaggatcgtattttggagttcattgccgttggaaagctacgcggcaccgtcgagggtaagattctctgcttcgtcggtcctccgggtgtcggcaagacttcgattggcaagtccattgctcgcgcacttggtcgccaatactaccgcttcagtgtgggaggtcttaccgacgttgccgaaatcaagggtcaccgccggacatacgtgggtgcccttcccggccgtgtcatccaggccctcaagaagtgcaagaccgagaaccccttgatcttgattgacgaaatcgacaagattggccgcggctaccagggagatccctcgtctgcacttctcgagctcttggaccccgagcaaaacggctctttcctggaccactatctagatgtccctgtagatctgtccaaggtgcttttcgtctgcactgctaacctgactgacaccatcccacggccccttctcgaccgtatggaggtcatccgactttccggatacgtcgcagatgagaagatggccattgccgaaaagtaccttgctcctcaggcccaggagatggctggtctcaagggcgttgacgtgcaactaacaaaggacgcgattgaggaactcaacaagtcctactgccgcgagtcgggtgtccgtaacctcaagaagaagatcgagcaggtataccgcaagtctgccctgaagatcgttcaggacctcggcgagcaggcccttcccgagtctgaagctcttaccgaggagggtaaggctgcccaggaggagacggaaaagaagaagagcgaggaggccgcgtccggtgagaccagcagcccgaaggccgccaccgaagcttctgagaaggagaccacggagaagcctcgggtagccatgaagattcctgaaggcgtccatgtcgttatcaacaaggacaacctcaaggattacgtgggacccccgatcttcacttctgacaggctctatgatgtgacaccccctggtgttaccatgggcctggcctggacctccatgggtggcgctgccatgtatgtcgagtctattctccagagcgcgctgacctccaagagcgcgccatcgctcgagattaccggcaatctcaagaccgtcatgaaggagtcctccgctatcgcctactcgtatgccaaggcggtcatggccaaggacttccccaagaaccgcttcttcgacaaggccaagattcacgtgcacgttcctgagggcgccgtgcaaaaggatggtccttcggccggtatcaccatgaccacctctttgctgtcgcttgcgctcgacactcctattgacccccagatcgccatgactggtgagcttaccctcactggcaaggtactccgcatcggtggattgagggagaagactgtggcggctaggcgagctggctgcaagatggttgtgttccctgaggacaacatgtctgactggcttgagcttcctgaggtaagactatacatcctagcccatcaacataaccctcatccagacaagttactaacgctttctctttcaccagaacgtcaaggaaggtatcgagggccggcccgtgcgttggtactctgaggtctttgacctgattttccccaagctcgaccgggagaaggccaacaagagccggatcatcgaggacgacaagtccgagaaggaggag

SEQ ID NO: 27771 - DNA, 924 bp, Neurospora crassa
cctgctgaggttcaggctgtgaatgtccctgatggcaccaccgatttcatccccctcagaggcaagaagtatgacctcaagaagcctcacattaccgagctgcccatcacctggggcaactggtgtaagtaactcttttttttttctgatagcttcgaaagcctcggcaaacaaaagacgctgacagtatctcccctcacagacaagcacgtcaactggttgaacaccaccttcatcatcttcgtgcctctcgccggtctcatctctgcctactggatccccgctcagaccaagaccatcctcttctctatcgcctactactacttcgccggtctcggtatcagtaagcatgctccgcatccaaggatatcagaaccaggtccatgactgactcattctcctctagctgccggttaccaccgactttgggcccacacctcttacaaggccaccctccccctcaagatctggctcgccgctggtggtgctgctgccgtcgagggttccgcccgctggtggtccagggaccaccgtgctcaccacagatacaccgataccgacaaggacccctactcggtccgcaagggtctcctctactcccacatcggctggatggtcatgaagcagaaccccaagagaatcggccgtaccgacatcaccgatctcaacgaggaccccgtcgtcgtttggcagcacaagcactacatcaagtgcgtcatcgtcatggctctcatcgtccctacccttatttgcggtctcggctggggtgactatgctggtggcttcatctacggcggtatcctccgtatcttcttcatccagcaggctaccttctgcgtcaactctcttgcccactggctcggcgaccagcccttcgacgaccgcaactcaccgagagatcacgtcatcactgccctcgtcacc

SEQ ID NO: 27772 - DNA, 4331 bp, Neurospora crassa
ttcaaaaacctctttgccttcacccgcccagcccatgtctcactcatggtcaccgctctctgcggctcagccgtcattgccgccggccggaccgcctacgctgttcttctcggcaagatttttgaggtctgcacctcttacggcgcaggagtcatcgccgcatccgaattgcttcaccaggtttcccactggtgcctgtatatgttcctcctcggaatcggcatgtgggtggtttgcagctttgacgttgcactttgggtcatggccggcgagttgcgcgcaaagacgaccagagagactctattctcgacccttctcaagaaaagtgcggcttggttcgatctccgagagcatggcatgtccagcttgatgactgccatccagacgtgagtcctccgttccccctttggagagaaacactacttaacacacacacccccggaagacaagcccgcgaactccaaatgggcacctcccaagtgttcggctttctagtttgcgacctgctcgtcttcttctcctgtatcatcgtggctctctactactcttacaagctgacactggtcatgctctccaccgctttgccgtctgccctcattctctggctcatcgcccgctttcttgaccctgccatcgccggccaaaagcgcgaacttgccgaggctgctaagcatgcaacggctgctacgaccgccatcgacctcgtcaaggcttacaatgcggcagatcacgagtctttccagttcatttcggctgtgcgacgctcgtccaagtactacacccgtcaggtgttgtccaataatgggcagatgagctacatcaagctgtggatgatgtcactcttcgttgttggtttttactttgccgtcgtgctcgtcaaccgggaggagctgacccccggaaacgccttgacaaccttctactgcgccctcatctcctttcagtcccttcaaaacctcggccctcaatggattatcctagcaaaagggatggcagcaggccaatctctccacgatctcgtccgccaagctgatcccggtcagaccaagacttgtaaagagcctggcggccttcgaccccctacctgtcaaggcgacatctctctctccaacatctccttcgcctacccgtctgcaccctccaacttggtccttcagccttcgtcgtttcactttacacccggctctctgacctttatcgtcggtcgttccggctccggcaagtccaccctcggcaatctgctcgtccgtttctatgagcccttgacaggccaaatcactgtcgatggacaacccattacgcgtctcgacctaggatgggtcagacagaacattaccctgatccagcaatccagcgttttcttcaacgatagtttattccagaacgtcgcatatggaggctatcagcccgaccgcgtcacagtggaagacgtcaaagtagcctgctccatggcattgctacaaaccaccgttgccggaatgcctcagggtctagacacgcaaatcggacctggcggttattcgctctctggcggacagcgtcagcgcctggctttggcgagagccaagatccgcgatccacccgtgttgatcctcgatgaaattacctccggtctggaccccgtgtcgaggggattgatcatggacgctattcgcatctggaggaggggtaaaacaacaatcatcatcacgcacgaggtgggttgcataggagagggcgagatggtttacgtcatggaggacggacgagtcgtgcaacaaggacatggaaagcagttgagagaggagagagaggggttgtttgctgggcttgttgcctcggctgatcatgacggtggtgatcatggagagggtgcagaggacagcgagaaggaggagaaggaggtagagagcgagttggaggatattcaagagcttgaagaagaagagtcagaggaggaggtgattgaagaggctacctacgtccagctagttcgcggactgagcctgcgtggccagaggggcagtatcgtctttcccaggttaacgtttggttatgatacctactcttccgcggacaaccgacagtcacgaccactttcacgattgttgggcgcgggcagagtaccagtccaccacccccacccccacgcgaaccccgatggcactcgtgatgtctctcccttctcaaagccagacgaccgcagacacagcacctcttccatcgaactcatcacccaaactggcctttcagtcaagaaaacccgcgtggctaatgcccggcgggctcagcaccctgatcagaaggtcactgaagctcaatcaaacggaagcctggattctcttgagctcttcttcctcgacaagcttgccaataagaaacaaagagctggattccgcaagaagcgtaggaatagcatggcgtctgttgtctcggctgcttctcactcttccaatccccagctaagcaaaaaacagcgacactcggtcaacaaccgcctcccttctttgtcggcaatcctccgcaccgtctggcccactctggacctgcgctccaaactcgaactttttctgggtatctgtctgggtctggtagtagcagccgccaacccccttttttcatatgtctttgcgcaactgctctcctccttctggtcgtctccttccgcccgactcgccgccggttccaaatacgcagggatcctcgccgccattgcctgtgctgacgctctcgctacgtttggcagttattacttccttgagaaagtagcaacgaaatgggttaccaccctccgctccgaagccatgacgcgcattttggcgcaaccaaaatcgtggtttgacaagaactcccacagcccggccaagatcgtggcctgcttggaccgtaacgccgaagaaatgcgcaagctagtcggcatgttcctccccattctgattatcgtctgcacaatgatcaccgtcgccatcgtctgggccttgaccatccaatgggacctgaccctcgtcaccctcgccggtattcctgctgccgtcatcaccggccgtcttaatgctttgttcagcgacaaatgggaatcccgctgcgaccaagccgccttgcggactggacaagtcctcaccgagacctttggcaacatcaaagtcgttcgcgccctgacactcgaggggtggttcacgcggaaatacgaagccaagacaaccgaagcgtaccagctcggtttaaggagggccacctacgttggtctcttctttggtctcaaccaatccatcgcttactacctgaccgccatgatcttttactacggcgccaagatcttatcccaggatcgcgcctcggtgaccgatttgctgcgcgtcatcaacctcatcttattcagcttgggaacctgcgtcaacatgctagccaacgtcccgcagatcgccgcagcaaaggcaacagcgacccaaatgctttacttcgccaacctctcccactcgtcaagccatgaatcccaaggttctcagcgcatctccaaccccttgcccatccgcatgcaaaacctgcgctttgcctacccctctgcgcccgatactctcgtcttgcggaacttgaatctgacaatcaaccccggcacatgcacagcaatcgtcggttccagcggctgcggcaaatcaaccattgcttctctcctcctcaacctttaccccccttctgtttctacccccaccaataattccttaactttcaactccatcccctctgaccaagtacacaccccctccctccgctcgtgtgtgggatacatcccacaacaccccttccttttacccaccactctccgcgaaaatatcttgtatggtctccctgactcttcacccctgcgcctcccctcccacttccactgtctagttcacgcatgccagttagcttccatccacgactttatcatctcccttcctgcaagttacgacaccgtcgtaggcgagggtagcggcctacaactctcaggcggccaagcccagcgtgtcagtatcgcgcgcgcactagtgaggagtccgaaagtggtggtggctgatgaaccgactgctagtttggatgcggagggtgcggaagctgtaagggaggtttttgctcgacttgttcatggtaatcggaccggagttcatatcgatacttctaaggaagggaaaggacatcaaggaaaggaagggaaaaacgaagaaatggcaatcatcgtagtaacccactccaaggaaatgatgcggattgccgatcgcgtggtgatgatcgagggagggatggtggtggaggaaggcgggtatgacgagttgaggagaacaaaagggggaaggttcgcggggatggttagt

SEQ ID NO: 27773 - DNA, 2214 bp, Neurospora crassa
atctgacagatcacaaacgaagtctccaaccgggctactccttcgctcgttggctttggccccaagagccggtatatcggtgagcccgccaagacccaggagatctccaacctgaagaacaccgtcggctgcctcaagcgcctcgccggccgcactctcgacgaccccgatgtcgccattgagcagcaattcatctccgccaccttggtcgacgtcaatggcgaggtcggtgccgaggtcacctacctcggcgagaagcgcaagttctccgccacagagctcatcgccatgttcatgagcaagatcaagcagaccacccaggctgaggtcaaggtcgccgtccaggagcttgtcttgagcgtccccgcctggttcaccgacaagcagcgcaggagcatcttggatgccgccgagattgccggtctccgtcccctccgcctcatcaacgacaccaccgctgccgctctcggctggggcatcacaaaactcgaccttcccggccccgaggagaagcccaggagagtcgcctttgtcgatgtcggctactccaactacacgtgctccattgtcgagttcaagaagggtgagctttccgtcaagtccaccgcctgcgaccgtcactttggcggccgcaacttcgacaaggccctgctcgaccatcttcataaggagttcctgggcaagtacaagatcgacatcttcaccaaccccaaggccgtctgccgtgtcctcgccgctgccgagaagctcaagaagatcctttctgccaaccagcaggctcctctcaacatcgagtccctcatgaacgacatcgatgtccgcgccatgatcacccgccaggagttcgaggccatggtcgagcccctcctcgccaaggtccacgttcccctcgagcaggccctcgccgacgccaagctcaccaaggacgatatcgacatcatcgaggtcgtcggtggtggctctcgtgtcccctccgtcaaggagcgcatccaggctttcttcggcaagcagctttccttcaccatgaaccaggatgaggccattgcccgtggctgcgctttcagctgcgccatcctctcccctgtcttcaaggtccgcgacttccaggtccaggacatcatcaactaccccatcgagttcacctgggagaaggatgccgatattcccgatgaggacaccagcctcgttgtcttcaacaagggcaacgtccttccttccaccaagattcttaccttctaccgcaagcagcctttcgatctcgaggccaggtacactaaccccgaggagctccccggcaagacgtcgcctttcattggccgcttctccatcaagggtgttcatgccaccgagggtcccgaggactttatgatttgcaagctcaaggctcgtatcaacatccatggcatccttaacgttgagagcgcctactacgtcgaagaccaggaggtcgaggaggaggtcaaggatgagaacggtgatgtgagtaatattcttattagtgataacaggacgtcatcggacagtcctacgaagcgccgtaaacttttcgacggttcaacgcagtctctcgatggtggaacgcacgaaaatttggacgaggaaaagctaacccacgaaaaggttgtcatggaaggcgacaagcccaagacccgcaaggtcaagaagcaggtccgcaagggcgagcttcctgtcgtcagcgccaccccgtccctcgaccccgccgccaagaacgccgccattgagagggagcaggccatgatcatggaggacaagctcgttgccgataccgaggagaagaagaacgagctcgagacctacatctacgaccttcgcaacaagctcgacgaccagtacgctgacctcgcctccgaggaggagaaggagaagatccgtgctaagctcatggaggttgaggtatgtcatttttttcctcccctaagcaagtaaccagctgatactaaccaaattaaacaggactggctctacgatgagggtgacgatgccaccaaggctgtctacgtcgccaagatcgaagagatccgcgccctcgccggccccgtcgtccagcgctacttcgacaaggttgaggccgagaggcaagctctccaggagaagctcgaggccgagaaggcggccaagaaggctgaggaggaggcccgcaaggccaaggaggctgccgagaaggccgcccaagaaggtgccaaggacgacgag

SEQ ID NO: 27774 - DNA, 3550 bp, Neurospora crassa
aagaagggaaacaagaaggccaacgatgactgggaggccgagctgggcgagtccatcgcccccgtcaacaacaacggcgccgatgctgctgccgcctctcccgctgccgccgacgacgaggccgcttccggtggtggcggtctgatggagagaatgcgcaaggccaaggagaagcgcaagaagaagggtcttgccgacgactgggaggctgagctgggcgaagacgctcccggcgccgagaagcccgctgccgccgagcccgtccccgatctgtcggccaaggtcgccgaggaggccaacctcgacgacgagttcgctctccccgagaagaagggcaagggtggcaagggcaagcagcagcagcagcaacagaaggctgctcccgccgccgccgccaagaaggacgaggatgctgccgatgaggatggccctagggtgttgaccaaggccgagaaggagaagctcaagaaggagcgtgagaagcagcgcaagaaggagcaggtgagtacccagtcattatcactattacccactaatgactatacatacatcagacacaaacggaagactaacaacaacttcttttcactaaacaggctgctgctaagaagaagggcaccacacccgccgccgccgccaaggccgagcccgcaaaggaggagaagaaggccgaaacccccagccccgtctcgacccccgcttccactcccgcccccgaagccgccgccggtggcaagaagaagaagctccccgcccacctgctcgccctccagaagcagcaggaggagctgcgccgtcgccaagaggaggaggctaggctcctcgccgaggagaaggccaggatagaggaggaggagcgcgccgctgccgaggaggccaagcgcaaggaggaggagcgcgcccgcaagaaggagaaggagaagcagaggatcgagcagctcaagaaggagggcaagttcatgaccaaggcccagaaggaggagaaggcccgcaacgagaggaagctgcagcagatgttggcggccggtatcaaggtcaacgcgctcgagggtgaagagtccaagaagaagcctgtctacgacgacaagaagaagagggctgctaacaagaaggtgagtctgtccgggattcttgctacaattacggtatactatggacggcgctaaccagtgtctacttgctacagaaggacgaggaaaaggctctcgccgaggccgctgagcgcgcaagactcgccgctgaggctctggtcaaggagcaagaggagaaggcccgcatcgagcgcgagaaggccgagaaggaggctgctgccaaggctgaggccgccaaggccgccgctgaggacagcgtcgacgaggactgggaggccgctgttgcctctgacaaggaggatgtcaaggacagctgggacgccgactccgacgaggaggaggagaccaagaaggaagagaccaagaaggaggcttctaagcccgccgcggccaacggcaagactcaggccaagaaggaggagtccgagtccgagtccgagtctgaggaggaatctgaagaggaatcttctgaagacgaggaggctaccgccagggaactggaggaggcccggaggaagaaggaggctgccgagcgccgcgagaaggctcaccaggccgctctggctgccaggtctgcggacaacctccgctcgcctatttgctgtattcttggtcacgtcgatactggtaagacgaagctgctcgacaagattcgtcagaccaacgtccaggagggtgaagccggtggtatcactcagcagattggtgccacttacttccccgttgaggccatcaagcagaagacgcacgtcgtcaacagggacggcaagttcgagttcaaggttcccggtcttcttatcatcgatacccccggtcacgagtctttctccaacttgcgttcgcgtggttcttcgctctgcaacatcgccatcttggttgtcgatatcatgcacggtctcgaaccccagactctcgagtccatgagactgctccgtgagaggaagacgcccttcatcgtcgctctcaacaagatcgatcgtctttacggctggaagaagatcgagaacaacggcttccaggagtcgttggccctccagaacaaggctgtccagaacgagttcaagaaccgtctcgagcagaccaagctcgccttcgccgagcagggtttcaactcggagctcttctaccagaacaagtccatggccaaatacgtctccttggtccccacctctgcccacaccggcgagggtatccccgacatgttgaagctcattgtccagcttacccaggagcgcatggttggctctctcatgtacctctccgaggtccaggctaccgttctcgaagtcaaggccatcgagggtttcggtatgaccatcgatgtcattctcaccaacggtatcctcagggaaggtgaccgcattatcctatgtggtacagaaggcgtcatcaaaaccaatatcagagccctgctcacgcccgcgccgctcagggaactgcgcctcaagtcgcagtacgttcacaataaggaagtcaaggccgctttgggtgtcaagatctctgcccccggcctcgagggtgccattgccggttcccgtctgcttgtcgtcggccccgacgacgacgaggacgatctcgaggacgaggtcgaggctgatctcgcctcgctcttcagccgtgtcgaaaagtccggccgcggtgtctccgtccaggcctccacccttggttcgctcgaggccttgctcgacttcctcaaggagtgcaagatccccgtcgccaacgtcggtatcggtcccgtctacaagcgtgatgtcatgcagtgcggtatcatgttggagaaggctcccgattatgccgtcatgctctgcttcgatgttaaggtcgacaaggaagcgcaggagtatgccgatcagcagggcgtcaagatcttcactgccgacatcatctaccacttgttcgactcgttcaccaagcacatggatgagctgctcgagaaaaagaaggaggagtccaagctcctcgctgtcttcccttgcgtgctcgctcccgttgccgtcttcaacaagtctggtcccattgttatcggtgtcgatgtcgtggagggtcagttgaagatcaacacgcccatttccgccgtcaagacgaaccccgttactggcgctagggaggtcatcgatctcggtagagtgtatgttcctccttttttttttccctttcaccccatgatcctcctctccatgacatgatcactaactgattcatgcaaatgtagtacctccatcgagcgcgaccacaagcagatccccgtctgcaaaaagggtcaaccttccgtcgccatcaagattgaaatgggcggcaaccagcccacgtacggccgtcatctagaggagaaggacatgctctactccaagatctcgcgtgcctcgatcaactgcctcaaggagttttaccgcaaagacgtgaccaacgacgagtggcagctgattatcaagttgaagcccatgtttgacattgcttaa

SEQ ID NO: 27775 - DNA, 710 bp, Neurospora crassa
agaagtaaaagaggagcaacaggcactaaccgaagttacaggcaaatcttcactcgctgtgcgctttgtggatgggcactttgtcgaatcctactatcccaccatcgagaataccttctcaaaggaaatcaggtggaagaaccaggattactcaaccgagatcgtcgacacagcgggccaggtacggttttttctcactcctttcccaccttacccaattgatgtgaatttcaccagggcgacacattttactgacacgagcacttcaacaggatgaatattcgattttgaatagcaagcatttcatcggcatccacggctacatgctggtctactccgtttcttcactggcatcttttgaaatggtccaggttatccgtgataagattctcaaccatctggtaagcagcatcttgttcatccagacttcgtcttggataattaccatgatttcttactgacttcaacagggtaccgacaacgtacccatctgcatcgtcggcaacaagagtgatctccgtcctgaacagcgccaggtcactcctgaggacggcaaggctctcgccgagaaatacaaatgcgcctggactgaggctagtgctcgctataacgagaacgtcgccagagcatttgagcttctcatcggcgaggttgagaagtcaaataaccccacggcgaccaacgagaacggaaagtgcgtggtcatgtaa

SEQ ID NO: 27776 - DNA, 5092 bp, Neurospora crassa
agctatgatgttggcactcgagcctggcagcccgatcctaccgagggttgggttgcctctgaagtagtcaagaagacagtagacggcaacaaggtcactcttatcttcgagtgcgagaatggcgaggtaggtagcttatgctttcccaagtctcggcatattccgacttttgtgctttggtttacgtgctttgcgggctggtgcgcttcaagatgctaacatgtgttactgcctgcagactaagaccgtggaggtctccctcgaggccctccagtcaggcggccatgagtcgctaccgcccttgatgaacccaacaatgctcgaagccagtgatgacttgacgaacctatcacatctgaacgagcctgctggtaaatatacacacacctttgcgctgactcgccccgccatcgggcgcactccgagaacgtgatgctgatagcatgtgctgtgcttagtgcttcaggctatccgccttcgatatgcccagaaggaaatctacacatactcgggtattgttctaatagctacaaacccgttcgcgcgggttgactctctttatgtcccaggcatggttcaagtctatgccgggaagcaaagagcaacccaagctccccatcttttcgccattgctgaggaagcgttcatgtatgggctctttgccaatttgacgattcatgttgacttgtaatcgctgacataacaatagggacatgttgcgcgatggcaagaaccagaccattgtcgtgtctggtgagtccggtgccggtaagactgtcagtgccaagtacattatgagatacttcgcgacaagagaatcgcccgacagccccggatcacgagtaaagaagggtggccacgagtctatgagccagaccgaggaggctatcttggctacgaacccgattatggaagcttttggtaacgcaaagacgacaagaaacgacaactcctcgcgattcggtaaatacatcgaaatcatgtttgacaaggccaccaacattatcggtgccaagatcaggacctaccttctcgagcgatcgaggttggttttccaaccgttgaaggaaagaaactaccatattttctaccagctggttgctggtgtgacggacaaggagcgccaggaattgggcttgcttcccgttgaacagttcgagtacctcaaccagggtaacacccccacgatcgatggcgtcgatgacaaggccgagttcaatgcgaccaaggcatctttgaagaccatcggtgttgacgagggcaagcaaacggagatcttcaagcttctggctggtctcctccacttgggtaatgtcaagattggtgccatgcgaaacgacagttccctcgatccttccgaaccatcgctggttaaggcctgcgagattctcggcatcgatgctccagaatttgccaagtggatcgtcaagaagcaattggtcactcgtggtgaaaagatcgtgtccaacttgacccaggcgcaggctatcgttgtccgagattccgttgccaagtacatctactcgagtctgttcgactggctcgtcgaaatcatcaatcacagtcttgcttcggaggaggtcctcaccagagtcacttccttcattggtgttctggatatttacggcttcgagcatttcgccaagaactccttcgagcagttctgtatcaactacgccaacgagaagcttcagcaggagttcaaccagcatgtgttcaagttggagcaggaggaataccttagggagcagattgactggaccttcatcgactttgctgacaaccagccctgcattgaccttatcgagggcaaacttggtatcctgtcccttctagacgaggaatcaagactacccatgggttccgacgagcagttcgttactaagcttcaccacaactacgctgccgacaagcacaaattctacaagaagccccgtttcggcaagtcatccttcaccgtctgccattatgccatcgacgttacctacgagtcggacggttttattgagaagaaccgtgataccgttccggacgagcacatggcggttttgcgcgcatcaaccaaccagttccttgtttcggtcttggacgctgcttctgcggtgcgcgagaaggatctggcctctgccagctcaaatgctgtcaagcccgccgctggaaggagaatcggtgtggctgttaaccgcaagcccacactcggtggtatcttcaagtcctctcttatcgaactaatgaatacaatcaacggcaccgatgttcactacatccgctgtatcaagcctaacgaggcgaaggaaccctggaagtttgaaggacccatggtcctgagtcagctccgcgcctgcggtgtactagaaactgtccgcattagttgtgcgggttaccctacaagatggacgtacgaggaattcgcgttgcggtactacatgttagtgccatcgacgcagtggacatcggagattagggagatggcaaatgccatcttgaccaaggcctttggcgctagcaccggtaagggtctcgacaagtaccagctgggtcttaccaagatcttcttcagagccggtatgctcgctttcctcgaaaatctgcgcaccaccagactcaacgactgcgcgattcttatccagaagaacctcaaggccaagtattaccgtaagaggtatcttgctgctcgcaatgccattgtctctttccaagccttgattagagcaaacaaagctcgcaattcagcacaggagcgccgcactaccaaggctgcaatcacgattcagagagtttggcgcggttacaaggacaggaagcaattccttgaggtcaggaacgacgtcattcgtgcccaagccgccatcaagggctacatgaagcgcaagaagattatggaggagcgggtcggaaatgcggtgctcatcatccagcggaattggcggtcgaggcagcagctgcgctcctggagggattatcgccggaaagttactatcgtccagagcttgtggcgtggtaagacggcgcgtaaggattacaaggctctccgtgccgaggcacgggatctcaagcagatttcatacaagctggagaacaaggtcgtggaactgacacagtcgctgggtaccatgaagaaccagaacagggagctgaagactcaggtggagaactacgaaggacaggtggcgatctggaggaatcgtcacaaccagttggaggcacgcgctaaggagctgcaagccgaggccaaccaggccggtattgccgccgctcgcttggagcagatggaggccgagatgaagaagcttcaagcaagcttcgaggagtctgtggccaatgtgaagaggatgcaggaggaggaacgcgagctcagagagtccctgcgcgctaccagcgtagagctcgactctgctcgtatcgagagtcaacggcaagaggctgagaagaactcgctccgtcagcagttggctgacctgcaggaggctctcgagcaagcaaggaggcaagtaccgatcaacggcgatatcctgaacggcaatggtattgcccctcaggttcctactgggttgatcaacctggtatcgtccaagaagcctaagcggcgtagtgcgggtgccgaaccacgggagatggaccggtacagcatggcctacaacccacggcccgtttccatggctgtccctggtctgaaccgccaaacaacactttccggctcaaccttcgttcctggtgtcgatagcatcgagcttgaacttgaaggtcttctcgccgatgaagatgctctcaatgaagaggttaccatgggcctcatccgtaacctcaagatcccctccccttccaccaatccgccaccttccgacaaggaggtgctcttccctgcttacctcatcaacctagtaacgtccgagatgtggaacaatggcttcgttaaggagtcagaacgcttcctggccaacgtcatgcagtccatccaacaggaggtgatgcagcacgatggcgaagaggccatcaaccccggtgccttctggctttccaacgtccatgaaatgctctcgtttgtcttccttgcggaggattggtacgaggctcagaagacggacaattacgagtatgaccgcctcctcgagattgtcaagcatgacttggaaagcttggagttcaacatctatcatacctggatgaaggttctcaagaagaagcttttcaagatgatcattccggccatcatcgagtcgcagtccctacccggcttcgtcacgaacgaaaacaacaggttccttggcaagctgctgcagtctaacacggcgccggcctatagcatggacaacctgttgtccctcctcaacaatgtctaccgtgccatgaaggcctactacctcgaggactcgatcatcacgcagactatcaccgagctgctccggctcgttggcgtcactgcattcaacgatttgctcatgcgccgtaacttcctctcgtggaagcgtggcctgcagatcaactacaacatcactcgtatcgaagagtggtgcaagagccacgacatgcctgagggcacgctccagcttgagcatctcatggtcagtatcgtcaagtgaacgtttcatgatgcattaggtgctaaccattcaacagcaagccacaaagcttttgcaactcaagaaggcaacccttaatgatatcgagatcatccaagacatttgctggatgtgagtatatttccttgtcccgacaagttacgcaccaatcatactgactttcattcgtaggctatcccctaaccagattcagaagctgctcaaccagtacctggtcgccgactacgagcaacctattaacggcgagatcatgaaggccgtggcatctcgcgtcagcgaaaagagcgacgtcctcttactgcaggctgtcgatatggacgacagtggcccgtacgagatagccgagcccagagtgatcacagcgctggagacttatacaccatcctgtgagttcgatcagactttttggataacgcgaatgcataactgaccgagaaaccacagggttgcaaacccctcgtttgaagcgtcttgccgagattgtatctcaacaagcaattgcgcaacaagag

SEQ ID NO: 27777 - DNA, 1656 bp, Neurospora crassa
ggctgctctaggattgccgactatgaagtcctgggtaaactgggcgagggtacctttgggtatgtgttcatcgtgtgtttccccagagcaatcgttgcgattattgacactatcctgctcagcgaggttcaccgcgcgaggtcgaggaaaacgggcgccttggtcgcactcaagaagatcatcatgcacaacgagagagatggggttcgtcaccgtgcttgcccttcgattcggtcttggtttcgacggtccctaacgttgacttgcccatcagttccccatcaccgctcttcgagaaatcaagttgctcaagcttctctcgcacaaaaacgtcttgcgcctagaggagatggcgattgagcatccacccagaagtaggtcaacctgccatgagctacaatgacgatggcccttactaaagtaaacaccgtcatcagccgacaagcgaacaagacctatcgtatacatggtcacaccctacatggaccacgatttatccggcttgctcgataacccgtcagttcgcttcactgaaccacaagttaaatgttacttgctgcagttgctagaaggtctcaagtatctgcacgcgaaccacattctgcacagagatatgaaggcggccaatcttctcatcaacaacaagggtgtactacagattgccgactttggtctagcgaggcattacgagggcgacattccccaacccgggaagggaagcggcgaggggaagcgtgactacactagcttggtggtgaccagatggtaccgccctcccgagcttctgatgcatctcaaaaggtacaccacagcaatagatatgtggggtgttgggtaagactagacatgttccctagatgcgctctctttcatgctaacaaccattacagatgcgtattcgcagagatgctggaaggaaagccagtcctacagggcgagagcgatcttcaccagttagagcttgtttgggacctctgcggaacaccatctgaggagacgatgccgggatggaggacgttacccggtggccaggcattctcgtcaaagcctaggccaggaaatctggcacgcagatttgagaagcacggacccgtggttatttcgctgcttaaggagctgttcaagcttgactggaggtcacgcatcaacgcgattgatgctctcaaccacccatatttccggactgcgccactaccagctctacctggcgatttaccaacgttcgaggagagtcacgaattcgacaggcgcaagtttcaagacaggaaagcggcattgccgcctgcgcctaagggaggcacggtgggccgcggggctgttgttaacagccaaggcccagataccggatttagcggtagggatggttacggcggtggtggtcgtaatggggcaaacggcggcagatacccgccataccaccgtggtcccccaccaggcgacgagcgagttccctcgtggcatagtgcacggggattgcctccacgacctccgatgcccgcagactaccatggcagcgggccgatggaccacaccgatgggtaccgtgaccgtccaccacgtagaggtcccggcggaccgcccggagggggaggtggtccgagcaacgtagacacttacatccccagctacgaccgcgacggacccgcgccgcgccga

SEQ ID NO: 27778 - DNA, 1800 bp, Neurospora crassa
aggacacccacccatcgcccacataaaccagagacaatgacgacaccccaagagcaggccatcgccttcaagaacgagggcaacaaggccttcgccgcccacgactggcccaaggccatcgagttttacgacaaggccatcgagctcaacgataaggaacctacgttctggtccaacagagcccaggttcgtgccgctgcccccgtcgcctacgtcgcctccccgacagtcgcgcttttttgaagtggtcgcgtgacaactaaccgcgattttctgctccgtcgcataggcccatctcaaaacagaagcatacggatatgctattcgcgatgccacaaaagccattgagctcaacccgggcttcgtcaaggtacgtccaagcccttcctggctgacattgccgcagtcttatcaatctctctggagacaagtcgcaaatgcaagcagtagctaatccgaacccctcccttctgtctaggcctactaccgtcgcgctaccgcctacgccgccatcctgaaccccaaggaagccgtcaaggatttcaagacttgcgtcaagattgcccccgataacaaggatgccaagctcaagcttgtcgagtgcgagaagattgtgcgccagctcgccttctttgccgctatcgaagtcggggatgagctgtctgctgctgagggcctcgatgtcgagtccatggcagtggatgcttcttacgacggcgtgcgccttgaagggaatgagatgacacaggagtttatcgacgacatgattgagcgcttcaagcgcggcaaactgatccacaagaaatacgtttaccaaatcattatcgccgtcaggaacattgtatataacgagcccaccatggttgaggtggacatccctgaggatgtgcagttgacagtttgcggtgatacccacggttggtttgcccttgcatggccccctccgagctgatggttactgacaaattgtgaataggccaatatttcgatctgatggagctcttcaggttgaacggtttccctagcgataagcactactacttgtttaacggcgacttcgttgacagaggttcctggtcgaccgaaattgccctcctcctttatgcctacaagtggttaaggccaaacggcttcttcatcaaccgcggaaaccacgagacagacgacatgaacagggtgtatggcttcgagggcgagtgcaagcacaagtacaatgagaggtaagcgagtcgaactctttgcgcccattatgcgacatcctgaattttcgagcacacaccagctgacacatctcaccttcttcccagaacctacaagctcttttcggaaagtttctcggccctcccgctcgccacgttgattggcaagaagttcctcgtcctccacggcggtctcttctcggacgacaacgtcacgctcgacgacatccgcaagctcgaccgtcacaagcagaagcagcccggtcaggctggcctcatgatggagatgctctggacagatcctcagccgttccctggtcgcggccccagcaagcgcggtgttggcatgcagttcggtcccgacgttaccaagcgtttctgcgacaagaacggtttggaggccatcatccgcagtcacgaggttcgcatggacggttacgaggaggagcacgacggaaagtgcatcaccgtcttctcggcgcccaagtactgcgacatgacggagaacaagggcgcttacatcaacattggtcccgattacaagttgaagttctcgcagttcgatgccgtgccgcatcccaatataaagcccatggtgagt

SEQ ID NO: 27779 - DNA, 5472 bp, Neurospora crassa
atgtcctcccacgacaagaatgggagggctacctcctcgagcggcaaggcctcctccttcttctcgagagccactggcaagaacaaggccgacaaacggaacgcaagcgatgagggtggccgataccttgccgccgacaacgacgccgccagcacccataccgcacgcagttcgcgccattaccgggactcgtctgtaatatcgctggaccgtcccgacacgcccgaatctggcctcaacatgacggcaggggtcgtcacgacgatcccctatgaccctgtttcccccgacaatcgctcccccgtcgccctcgaccaccttcccaggcccgaccaaatgcccctaaggcgagagctagtaccgcaccacctcaacaaaggcactggtgacttccaccagtatcccaccatcgaccaaagcccaagctccccctataatgggcagtcacccagcgcatcaagttcgcgctcaactctcgctactgctaacatcaccatggcctccacgggccgccaggcccagtttcagcaatggggaccaccgagagagagcagtttgcccgggtacaattccagaggccactcgtacatgacaacccgcagttcgggcgacaatgccagcatctactcaggtagggacggacactaccaagaagccccaggaaccagccatcgctcatccaggataggactccctagtacttcgtctcagtcatcctacctttctccccatgcccataaggacagagatacccagcggttaaccaaggtcgctgccggccaccagggctccgaaggattcaactttcccaagccagacgatgacaatgtgattgaacagatgttcataaacctgatgcaaaagcgaggatggcacaacctcccggaccaggccaagcgccagatgatcgcataccccgccgcgaagaaatggaccttgatttaccaggatcgactcaccgagtggcagggcgaacagaagcgcagacagacggccaagattggccaatacagcaatgtcgatattacccaatcctccgatgacgaaggcagccccgagtggtatgtgcgcaaggtcatggaaaacgctctggacagcaaagggctcggaggactcgaagtcaaccttcggacacagcagatcggctgggtcaagcgcttcatcgactgtcagggacagatcgccttgaccaatgtcctgctaaagatgaaccgaaagactgcctatggacctgctcagccggataatggaagattggataagaatttggaccgagaatatgacattgtcaaatgtttgaaggctcttatgaacaacaagtttggcgcagacgatgcgctagctcaccaacaggttattgtggctctggccacctcccttatatcacctcggctcaccacccggaagcttgtcagcgaagtcctgacattcctctgccattggggcgaaggcaagggccatgtcaaggtcatcgaggccatggacgtcgttaaggcccagcaaggcgaaaacgggcgcttcgatgcttggatgcgtcttgttgaggtcaccgtcgacggccgcgggaagatgggcagtttggtcggtgctagtgaggaggtacgaagtggtggcattggcatggagaatctgctcatggaatacgccgttgctaccctcatcttggtcaacatgttggtcgatgcccctgagaaggacctgcagctgcgcatacacattcgggctcagtttacggcctgtggcatcaggcgtatcctgaacaagatggaggcctttcagtatgagctgattgacaagcaaatcgagcggttccgctccaacgaagctatcgactatgaggatatgctcgagcgtgagaacagcagcatcaaagatagtatcgagggtgaggttaaggacctcaacgacccggtacaaattgtagatgctatacagcagcggcttaatggaaccaagacacaggactactttgtatctgctctccagcatttgctgttgatcagggacaatgatggcgaggagagattacgcatgttccagctggtggactctatgctcagctacgtagctatggaccgccggttgccggacatggacctcaagcagagtctcaacttcaccgttcaaagtctgttagataagctccataccgactctgaagcacgtcaagctctagatgaggccctcgaagcccggcagatagctgatgccgctatggcggagagggatgagatgaaggagagactggccttgggagctgatggtctggtggctaagctacaaaagcagattgatgagcaagccatgttcatcgaggcccagaaaaggcgtgctgagggtctcaagtcggagcttgccagtttgcagaccctgcgggcaaaggaggcgcaacgctacgagctagagacccgcgaactgtacctcatgcttcgcgacgctcaagatgtagctgcctccaatgccaccaagggcaacgctaagcttggtgaggaagacgtggcccgcatgcaaggcatcctcgatcgcgagaggcttctggagcgcctgcaaatgcagatcgagcgccaaaagacgcagttcaagcttgaaggaagagtatggggcgaagtgatcggcccttcggataggctccgagctcttcgggaggagatggatggctttggcgacgacacaccggaggttgtgccacccaaggacttcaccaacagcatgcttggtagcgtcaagaggtcgaccagaatacccagaaagcctgttggttcccggtcagaccatgtcgaggacgtcctagaggagagcgatgtcgagattggggacgacggcgagatcgtgtacgagaagcctcgcgtggtcaagatcaggaggcctgtcgtggaccccaagcagaccaatggtatgttcaacgaactcactgggaaggtcagaaggtacgatgccagcgactccgaggaaggagatggtatcacaaccggtccctcacatcccagcatggagtcccagacacccatcacacccagcgataccgagactcccaaaattcaagttaccgatgctaccggaccgtctgcgccagccgcggcatcaggccctccacctccaccacccccgccgcctccgcctccgccgccccctggcttcctccctggcgccccagctccgattcccggcgcgggcgggcctcctccgccgccgccgcctcctcctcctcctccgccgccgccaggaggccttccgggtgctgctcctccgatgcctggcgctggtggtccaccgccgccgccgccgccaccacctcctccgccaatgcctggtatggctggtatgccaccacctccacctccgccccctcccatgcctggtatgcctggtatgccaccaccaccacctcctcccatgccaggtcctgcttcgggccgcttcttggcacagaacgccgggcttcccacgaccaattctgttgggctacctgtcgtccggcccaagaagaagctcaaggctttccattgggacaaggtcgacacgccactggcaacgcactgggcggcacatacaccgtcccctgagtcgagggaagaaaagtatcatgagctcagcaagaagggtattctggacgaagttgagaagttgttcatggcgaaggagatcaagaagcttggcggtggaggtgccaagaaggatgacaagaagcagattatctccaacgatttgcgcaaggcattcggtaagaaacggatgatgagccgtaactctatgaaagcctcacgctaacagtttacagaaatcgcgcttgccaaattctcacagttccctgttgagaaggtggtgcagatgatcattcactgcgacaaagacgtgctcgacaacccggtcgtcatggatttcctgcagaaggatgatctttgcaacatttcggataacactgccaaagttatggcaccatatagcaaggactggactggaccagatgccggcaaagatacccgagaacaggatcctaacgagctcacaagacaggatcagatatatctgtatacggcgttcgaacttcatcactactggaagagtaggatgagggcccttgcactgactcgcagcttcgaacaagaatacgaggagattactgaaaagatgcgcgccgttgtagcagtgtccgaatctttgagagattccgtgtcccttatgaacgtactcggcctcatcttggatatcggtaactatatgaacgatgcgaacaagcaagcccgcggtttcaaactctcttctcttgccagactcggcatggtgaaggacgacaagaacgagtcgacgcttgcggatctcgtcgaacgtattgtgcgccagcaatacccagagtgggaagatttcgccaaggacatcgagggcgttattgcggcccagaagatcaacatcgaacagcttcaggctgatgccaagaggtatatcgacaacatcaagaacgtgcaaatgtctcttgactcaggcaatctctccgatccgaagaagttccatccccaggatcgcgtgtcgcagattgtgcagagggtcatgaaggatgctcggttcaaggcagagcaaatgcagttgtatctggaagagatggtgcgcacatacaacgacatcatggtcttttacggcgaagacccgtcagacgacaatgctcgtcgcgaattcttttccaagctggcgtcattcatcacggagtggaagaggtcgcgcgagaagaacattcaactggaagagcagcgtaagcggaacgaggcatcgatgaaacgcaagaatgcccagttcaaggctttgcaagcgagcgaggcacaaggaccggcaagcccaacgagtacgggggcgatggacagcttactcgagaagctcagagcggctgctccgcaaaccagagaccaaagagacaggaggaggagagcacgtctcaaggaccgacatcaagtccgcatcgcttcaggccaacaagtaccagatttcaacgaaatccccgaggtggaagctgccctccaaactggcaagagtgctgcatccgcgaccacggacgacgacggcgccggcaacggtcttgtcagccccgatgccctaccgccaacaaaggaggctcccgatgcggaggaagacgacgtcgctcgacgcgcagctgcattgttgcaaagcttccagggtggagacggggcggaagatgatgcagaaaagagggaaagtttgaggaagtcgaggagacagactgcggcagaggagaggaacatgagaaggcggaggagagaaaaagcccagactagcacggctggggaggaagggaaggacgagtcaacagcggcagatggatcagaagccgcgccttcagctagcgctgaggacctttcagctgccgaagccaagacggatgggccatcatcaccacgaccaggcacagcgacgggtgccgaggcatcggaggagactgagactacacctacggcgacggcgacg

SEQ ID NO: 27780 - DNA, 1416 bp, Neurospora crassa
cgcgcggacatcacctacttcggcgccggccctgccgcccttcccaccgacgtcctcgagaccgccgcccaagcgctgctcgactaccagggcaccggcttgggtatcgccgagcactctcatcgctccgaacttgcggccaagatcatcaacgaggccaaggccgatctggccacctacctcgacttctctcccgagcagtatgaggttctctttatgcagggtggtggcaccggcgagttcgctgcctccatgtacaacctcgttggcgcctgggtttcccgccagcacgccgctgtccagaaggagctcggcgagggtgcggccgccgatgaggcccaggtacttgccgcccttcgccagcgcgtagagtccggcctcaaggtcgactacatcgtcaccggctcctggtcgctcaaggcctaccaggaggccgtccgcctgctcggccctgagtacgtcaacctagtgtgtgacgcccgcaccatcaacgacggcaagttcggcaagattcccgacgagagcacctggaagcttagcaaggacgccgcctacgtctacttctgcgacaacgagaccgttgatggcgttgagttccccaacttccccaagatcctcgagcccaaggaggacggcaccggccccattgttgtgtctgatatgtcctccaacatcctctctcgccgcatccccgtcaacaactactccctcctcttcttcggcgcccagaagaaccttggctgcaccggtgtcgctgttgccatcctcaagaagaccttcctcccacctaccctcagccagcctagcccggccctgctcaggaaactcgcccttcctatccctcctatcgttcttcagtatgagattattgccaagaacaacagcttgtataacacgctgagcatctttgagtaggtttctcccgaacttcttcaggggggcgtgtgttccaggctaacaaagtgatagtgtctacatcgcgggccaggtcctcaagaagctcctcgccactttccccaacggtgttgacggccagcaggcccttgctgagaagaaggccgagctcatctactcggccttggaggcccatcctgaggcttacaagatcgttccggacaagtctgcccgttccaagatgaacatttgcttccgcgtcatcaaggtgggtcaagttttttcggtgccggttgctcctttgtcgttgagaaatgggctaacatgtctttccagggtggcaacgtcgacgaggccgagaaggccttcctcaaggagtccaccgccatcaacctgaccggtctcaagggccaccgcagcgtcggtggcatccgtgcttccaactacaactccattcctctggaaggtgctgagaagctggccaacttcatccatgagtttgccaaggcttaagctacgaag

SEQ ID NO: 27781 - DNA, 1204 bp, Neurospora crassa
gaggatgatatccaggaaattcaacaagagatctcggtgctcagcacatgcgccagctcttacgtcacccaatacaaggcgagcttcttgcgcggccacaagctatggatcgtgatggaatttctcgggggaggttcctgtttggacctcgtaagtctggtccctttgctattgctgtcgcataccatgtctcttttccctgcttgctaaacaagattgtgtgcgccagctcaaaccgggaaactttagcgaagtacacatcgccatcgtctgccgcgaactcctcctcggcctcgattacctacactccgaaggaaaaatccatcgcgacatcaaagccgccaatgtcctgctctcggaagccggaaaggtcaagctcgctgattttggcgttgcagcgcagttgacacatatgaagtctcaacgcaatacctttgtcggcaccccgttctggatggcccccgaggtcatccagcaggctggctacgacttcaaggccgacatctggtcgctcggtatcactgccatcgaactggctgtcggcgagcctccatatgcgaatatccacccgatgaaggtcctttttcagattcccaaaaacccaccaccacgactggagggcaagttcagcagagagttcaaggactttgtcgctcattgtctgatcaaagaccctgcccagcgcccgacagctagagacctactcaggcatcgatttatccgcacagctggaagggtcgaggcgctgcaggaactgatcgagcgcaagcagatgtgggacgccaagcaggaccgcgtcaagcttcccgtcttttaccaggaaacccttcacaccatgagccccaaggacgatgatgacgagtgggtgtttgatacgatcaagtcggttgcgctacccaagaaccttttgaacgtcagcactactcccacaaaatccagggatccatcaagggttcgggagactgaagaaggcatgcgaagaatggaagtcagagatggtcccctgcagccctctacccctcagacggtaaggaaagcaacagtacggcgacagccatcggccgcggccgcccaccagcaacggcgactttccacctcgactggctcaccacgcccacctgtcgcagcagcaaagaggccccttcagacggatatgtccttcggcaactcgggttcgacgatgcgactctttcgtcgtgtacct

SEQ ID NO: 27782 - DNA, 1228 bp, Neurospora crassa
aggctcgtcaacaagctccaggatgtcttcaccaccgtcggcgtcaacaaccccatcgatctcccccaaatagtagtcgtcggcagtcagtccagcggaaagagttcagtactagaaaacattgttggtcgcgacttgtgcgcatcccccctcccccgccccctttccccgcccctagtctttcttcgctttccacactagtttcccccctccccaaaattgctaacgcgagacccttgttcgttctcttctccagtcttcctcgcggctccggtattgtcacccgtcgtcccctcgtcctccagcttatcaaccggacagccacccagaacggcttcggcaatgagctcgacgataacaccgacaaggctgccaacacggatgagtggggcgagttccttcacattcccggccaaaagttctacgacttcaacaagatccgcgatgagatcagcagagagaccgaggccaaggtcggccgcaatgccggcatctcgcccgctcccatcaacctgagaatctactcgcccaacgttctcaatctcaccctcgtcgatcttcccggtctgaccagagtgcccgttggcgaccagccgcgcgatatcgagaagcagatcagggacatgatcctcaagtatatccagaagtccaacgccatcatcctcgccgttaccgctgccaatgtggatctggccaactcggatggcttgaagctggctcgtgaggtggatcccgaaggtcagcgcaccatcggtgtgcttacaaaggtcgacttgatggacgaaggtaccgatgtcgttgatattctcgccggtcgcatcattcccctcaggctaggatacgtgcccgtggtgaaccgtggccagagggatatcgacaacaagaagcccatcaacgcttcgctcgaggccgagaagaacttctttgagaaccacaaggcgtatcgtaacaagagctcatactgcggcacgccctaccttgcccggaagctcaacttgatcctgatgatgcacatcaagcagaccctgcccgacatcaaggctcgcatttccagctcgctacagaagtatacccaggagctcgagtccctggggccttcgattctcggtaacagcgcgaacattgtccttaacatcatcaccgagttcaccaacgaatggcgcactgttcttgacggtaagagcaccgagctctccagccaggagctgtcgggtggcgccagaatcag

SEQ ID NO: 27783 - DNA, 1812 bp, Neurospora crassa
cataaggccgcccatatcaacatgagcgctcgtctttccaaggatggcaaatcccaatcaggcaccaagcccggcttcgccgaggtctggcgtctgatcaagattgcgcgccccgaggtcaaggcgatgagtgtcgcattcgtcctgcttctcatctcgtccgcggtcaccatgtccatccccttctcgatcggcagaattctggatctttccacccagggtcccgccggcgaggttcggctcttcggtcttaccctctatcagttcttcggcggcctcgctggtcttctcactcttggtgcgacggccaactttggcagaatcatcattctccgtatcgtcggcgagcgcgtcgtggctcggttgcgcacgaatctctaccgccgcacctacgtccaggatgccgagttcttcgatgccaacagggtcggtgatctgatctcgcgactgaactccgacacggttgtcgtgggcaagagcattactcagaacgtgtctgatggtctccgttccatggttagcggagcggcgggtttcgcggccatgttctggctcagccccaagctgacatccattatcctcatcatggttccccctatcggtcttggagcggttctctacggtcgcaacattcgcaacttgagcaggcagatccagaagaacgtcggctcactgatgaagatcgccgaggaacggttgggtaacatcaagaccagccaggcctttgccgctgaagtgcaagaggtgggtcgctacaacaagcaggtcagaaagattttcgccctgggccggaaggaggccattgtctcgggtgtctttttcagcagtacgtcgtatgcaggaaatctggcgatcctggctctcttgattgtcggcgggaaccttgtgcgctcaggggccatgtctctgggcgatttgacctcgttcatgatgtatactgtctttgctggttcgagtctcttcggtgttagcggcttctactcggaactgatgaagggtgtcggcgcagcgagtcgtttgttcgagctcgaggatcgcaagccggccatcccccagaccgttggtgtgaaggttgaatctgcgcaaggtcccatcaagttctcgaatgtaacgttcgcctaccctaccagacctgcagttacgatattcaatggcctcgactttgagatcccctcgggcacaaacgtgtgcattgtaggcccttcaggcggaggtaaaagcaccgtggcctccttactcttgcgcttctataaccccacatccggtagcatcaccatcaacggcatcgacatttccaagatgaacgccaagtctctccgccgccgcatcggcatggtctcacaggagccagtcctcttttcgggtaccattgccgaaaacattgcttacggccgtccacgggctccgcgcaccgagatcattgcggctgcccagaaggccaactgcggttttattagcgacttccccgaaggcctcgagacccaggtcggcgcccgtggcgcccagctttccggtggccagaagcagcgcatcgccattgctcgcgccctcctcaaggaccccgatattcttatcttggatgaggctacctccgccttggacgccgaatccgagaccctggtcaattctgcccttgcggaactcctcaagggccgcagcaccaccatttcgattgctcacagactgtccaccattaagcgatctgacaagatcattgtgctctcgagcgagggtaccgtggctgagattggcagctacacagagctgagcgccaacaaggacagccacttcagtaagctgatggagtggcag

SEQ ID NO: 27784 - DNA, 1833 bp, Neurospora crassa
atggccgggccccaactactacagaacgacagccccaatggctggatcgtgcagaaattcggtggcacaagcgtgggcaagttccccgacagaatcgcagaggatatcatcaggtaagggcaatggggggaaatctgggtgtggtgtcacaccgctcatgaatgcttggttaacaagggccctgtgactgacctcactttgaaaacagagcgtatgtgaaggaccataggctagtagtcgtctgctcagcaaggagtacgggcaagaaggttactgggaccaccagtcggtgagtggtgcatctcattatgaaaccctcactcatcactcaactcaaccccttccgtccgtggccaacaccagcagctaactcagctacacaggctactggaggtattcaagaatctcaaagccattgccgcatatgcaagtgacgagcataaacaagatgccctcctcaaggacgccaagcgagttatgcaggacatctgcagcgaccacaccgccgcggccgacaaattcatccaggacgccgagcttgcagccatcgtgaaggaggagacggtaaaagagtgccagctactgatcgaatacttggaagctgccaagcggttccacctcgaggtaaactcgcgggcaaaggaccgagtcatcagctttggcgagaagctcagctgtcgcttcatggcctgcatgctcaaagaccggggagtcgacgccgagtacgtcgacctggccgacgtcttgcaccttgacgccagtatcgagcggctcgacgccaccttttaccgcgaagcggccgaggttatcgccaagaagatcctcgcctgtgagaaccgcgtaccagtcgtcaccggcttcttcggcaacgtgccgggcggcctgctcgacggcgacgtcggccgcggctacacggacctttgtgcgtctctcgcggccgtgggcctgaaagccgacgagctgcagatctggaaggaagtcgacggcatcttcacggcggacccatccaaggtgccgacggcgcgcctggtgccctccatcacgccctctgaggccgccgagctgaccttctacggttccgaagtcatccaccacctgaccatggaccaggtcatcaaagccactccgcccatccccattcgcatcaagaacgtcaagaacccgcgcggcgagggaaccatcgtcaagcccgaccccttgctggcccccgaccagacgctccagcgacaccaacaaaacggcacttgcaacggcaccaagaccaacggcaccggccaaaagagcaacaaacccaagcgccccacggccgtgaccatcaaggacaagatctccatcatcaacatccactccaacaagcggtcgatcgcgcacaccttcttggcgaggttattcgccatcctcaacaagcaccgcgtgtccgttgacctcatctccaccagcgaggtgcacgtctccgtggccgtgcacatgggcaatgccgagatgaccaactttgacgcggccgtcaaggacctgggcgactgcggcgatgtgagcgtcctccatggtctggccatcctcagtctggtgggcgccgagatgaagaacatgattggtatttcgggaaagatgttttcgacgttgggtgatcacagaatcaatattgagatgatttctcagggtaagttgggttcttgatcctgtttgtgtgtttgtgtttgtgtgtgtgagagtatatggatggctaatcattgtgggtgaataggtgccagcgagatcaacatctcgtgtgttatcgacgccagagacgccgagcgggctatgaatatcttgcataccaacttgttcaccttc

SEQ ID NO: 27785 - DNA, 399 bp, Neurospora crassa
ggccaaatcaccaccaaggagctcggtaccgtcatgcgctcgttgggccagaacccctccgagtctgagcttcaggacatgatcaacgaggtcgatgccgacaacaacggcaccattgacttccctggtatgatataaacatttcggactatggacctgccagctcgccgctgacaatagcctatagagttccttaccatgatggccagaaagatgaaggataccgactccgaggaggagatccgtgaggccttcaaggtgttcgatcgcgacaacaacggcttcatctccgctgccgagctccgtcacgtcatgacctccatcggcgagaagctcactgatgacgaggttgatgagatgatccgtgaggccgaccaggacggcgatgggcgtatcgac

SEQ ID NO: 27786 - DNA, 2457 bp, Neurospora crassa
atgactccacgatttgcccatcactcgcctcctccacattcgcctctccgcttttctcatctgccgacccaagctgtgatggagctctatcgtgttaaacatccaactaacgacgcacaggttacggattaccttaagaagaaagggttcaccaagaccgaagccgttttccgtcaagaaacagcccacctcgggcctgacggcaggcccgcgcagcgtaacgaggagaacggaccgcgaaagtacttaaaggcgttcatcttgctccgagattggatcgagaataatttggacatctacaaggtaagagacgacgaaggcgagcatccaaatgatccgtggcagtgatgctgacaagcaatagttcgagctaaggaagctcttgtggcctgtcttcgtttactcctacatcgagctcgtttccacggggtatgtggaagaagcaaagcactacctggcaacactacgacctcattttgacgctgtccatcgtgaggcgttagacctgtttacgactgtcacccttccacaacatattcgcgaaaaccaaacaatcaaactctaccgagagaacaagtatcgaatcccgctcaaccagtcactttctggcaacctcttccactttctcgagcgcgaggcggatgctggcggctcaacaatcacatttatcctccaaaccttctgccaggtagacgtcagcgcaagggggcccattgagccattcagctttgaggctatctaccgacgagctcataatctagatcttgatgagattgaccagctcgaaggcattcctggtgttttcaccggtgttacaaacagagacgttctcgactcatcagcaccgctgaagctcggccctcttccaatggaacctgaattgcgagaagacgtacgcgcagaacttgaggacgaggaccagcgacatccacctgtagagggcaggtctacactcgtggaggagttcgaccagcggatcaagcgagaagagagtgccgacgctccctcgagaacagacctccctcttccaccatctcgagccagggacgtcgtaatggagatgcaaaaagttcgagaaaatcgggaccggttcaagatagagggtcggactggcggtgcgggtgttcctgtctcggcctgcatgttcacgttccataacagcttggggaggtaagttttcgcacatgttcttcggtgcggctctatcatgctgactattttcttcttagcgtttcatgtatggacttttccaacgatcacgagctcgtggctgtcggaactatggactcttatatccgcgtctggtctatgaacggaaagccattaagatcatctgtagccagcgagaaggatctacaagtcaacaaccggaagctgatcggccactccggtccggtctacggcgtgtctttctcggattccattgccaacctggaccgtaatgtcttcccggaagccgacggggccaagcctgatacgagcaccaagctacttgtatcatgctcggcggacggtcaagtccgcctttggtccctcgaccactgggcatgtctatgcatctacaaggcccacgatggtcccgtcttccgcgttctttggggtcctcacggccattacttcgcgactggcggctgggacaagaccgtccgcgtgttcgcgcaagatagagcctctgcactgcgcattatggtcggacatgatacgcctatctcagcaatcgcgtggcacccgaacggaacgtacatcttctcggcatccgacgacaccgacaagtccatccgcatgtggtcggtagtgacaggcaattgcgtccgcatcttcacgggccacacggactacatcagcgcgctgcaatgcgcgccgaacggaaagatcctcgccagcgccgatacgggtggaaacattttcttctgggatattgccaagggcgcgcgtatcaagcggtgccgcggccacggcaagggtggtattccgtcactaagcttcagtgccgagtcgaacgtgctcgtgtcaggaggcttggatggcaccgtgaggctgtgggacgtggagttgccggccgatcccagcaagagcagccagcttgctatcacgagtagcggtgcggcggttggaggaggcgcatctggtcaacaggcggatggtgccgcgagtggcgacagtatcgccgtggcgtctggcggaggtcccaacggcaattcgattaccgtgggtggcactggttctgcggctacaccagcagctgctgctaatgctaccggcaacactggcaccgctagcggcagcgctaatggcagcagtggtgcggtcacagggaagaagaagggcaaggaggtgcagatcacacctgatcaaatcagcgcgttcgcgacgaagaaaactcctgttttgaaggtgcagtttacaagaatgaacctggtggttgcgggcggatgctatgatcctgagcgttaggag

SEQ ID NO: 27787 - DNA, 2183 bp, Neurospora crassa
atggcgaccgccgagactttcgagttccaggctgagatctctcagcttctctccctcatcatcaacactgtttactccaacaaggagatcttccttcgtgagcttatctccaacgcctccgatgctctcgacaagatccgctatgagtccctgtcggaccccagcaagctggactcctgcaaggatctccgcatcgacatcatccccgacaaggcgaacaagaccctcaccatccgcgataccggtatcggtatgaccaaggctgtaagtttgcctcgaatcaatcttggccttgtgaaagtgacgatgcgctgactgaatacgcttaggacctcgtcaacaaccttggtactattgcccgctccggtactaagcagttcatggaggccctcaccgctggtgccgatatctccatgatcggtcagttcggtgttggtttctactctgcctaccttgttgccgacagagttaccgtcgtctccaagcacaacgatgacgagcagtacatctgggagtcttcggctggtggtaccttcaccatcagacctgacaccgagggcgagccccttggccgcggtaccaagatcatcctccacctcaaggaggagcagcttgactacctcaacgagagcagaatcaaggaggtcgtcaagaagcactccgagtttatctcctaccccatctaccttcacgtccagaaggagatcgagaaggagattcctgacgaggaggccgaggaggtaaccgaggagggtgacgacaagaagcccaagatcgaggaggttgatgaggaggaggaggagaagaagaaggagaagaaggtcaagaagatcaaggagaccaagatcgaggaggaggagctcaacaagcagaagcccatctggactcgcaacccccaggacatcacccaggaggagtatgctgccttctacaagtccctctccaacgactgggaggaccacctcgctgtcaagcacttctccgttgagggtcagctcgagttccgcgccatcctcttcgttcccaagcgcgctcccttcgacctcttcgagaccaagaagaccaagagcaacatcaagctctacgtccgccgcgtcttcatcaccgacgatgctaccgacctcgtccccgagtggctcagcttcatcaagggtgttgtcgactctgaggatctccccctcaacctgtctcgtgagactctccagcagaacaagatcatgaaggtcatcaagaagaacatcgtcaagaagtccatcgagctcttcaacgagattgctgaggacaaggagcagttcgacaagttctactctgccttctccaagaacatcaagcttggtatccacgaggatgcccagaaccgcagcgcccttgccaagctcctccgcttccactccaccaagtctggtgacgagatgacctctctctccgactacgttgctcgcatgcccgagcaccagaagaacatctactacatcactggcgagtccatcaaggccgtctccaagtctcccttccttgacgccctcaaggagaagggcttcgaggttctcttccttgtcgaccccattgatgagtacgccatgactcagctcaaggagttcgagggcaagaagcttgtcgacatcaccaaggacttcgagctcgaggaaaccgaggaggagaagaagcagcgtgagcaggaggagaaggagtacgaggatctctgcaaggccctcaagaacattctcggtgacaaggtcgagaaggtcgtcgtctctcacaagctcgtcggctctccttgcgccatccgtactggccagttcggctggtccgccaacatggagcgtatcatgaaggcccaggccctccgtgacacctccatgtctagctacatgtcttccaagaagaccttcgagatctcgcccaagagccccatcatcaaggagctcaagaagaaggttgagactgatggcgagaacgacaagactgtcaagtccatcgtccagctcctctatgagacctctcttctcgtctccggcttcaccatcgatgagcccgccagcttcgccgagcgcatccacaagctcgtctccctcggcctcaacctcgatgaggagcctgaggctgctgccgatgcccctgctgccgctgagggtactcccgccgccgagactggcgactccgccatggaggaggttgactaa

SEQ ID NO: 27788 - DNA, 1858 bp, Neurospora crassa
atgacatccacatcgacatcagcggacgccttcgccggccaaggcgacaacattctccggcctcgaccacggaaacccttgcacactcaagtctcccaactctcccacgacgcaaacggcgacagcgaccatgcaaacggtaccggagctaccaggtacggccatcacaacaagacaaagcgtggaagagacctaccggacatctctccagagtgctaactgatctgctgacatcagtgtcaccggtgtaagcagcggccgctcgaccccgattccgtccgatgctcccccgtccatccaatccctctcgactgcccgcaagcaagtccgcgccgagcaacgccgccgcatcttccccacgatagagttcgcaagccgagtatcccacttcgatcccaacagcgactaccgcgacttccatggcttcttcaatctcttttggatcggcttggccatcatggccatcaccacctgcctacgcaacatcaaagacacgggctatccgctgcgcgtccagatctgggggctcttcaccgtcaagctctggcatcttgccattgccgacttcctcatggtagccaccaccgccgtatccctcccactacacaaggtcttccgcgctgcccccgcgggcggcgtgctgacctgggccaagggcggcatggccatccagagcatctaccaggccatctggctagccgtttggattgtgattcccttttggctggagtggacgtggactgcccaggtctttctgctgctacacaccatggtgctgctcatgaagatgcactcgtactcgttctacatgggccacctgtccgagaccgagaagcgtctccgggcgctcgacgacccggccaccgcctccaaggccccggcctatctctacccgacccccgaaaaccccttgggcaccgttgccagccccaagcagcgcgcggtcgaagccgccgccgaagccagcagcaaggaaaccgaggagatcagcaccccaaacgaggacgaagagatcactcagctccgcgaggacctcgctcgcgaactcacctcgcccatgggcaatatcacgtacccggccaacctgacctgggccaactacctcgactacctctgctgcccgacgctatgctatgaaatcgagtacccgcgcaccgccgccatcgactggcagaacctgctgtccaaggtcctggccgtcttcggctgcatctttttgttgaccgtcatctcggaggagttcatcctgcccgcgctgaccgacgcctccatccgtctcgatcctacgctgcgcgccgccgccggcgattccggtcccttgacggcgctcgaagccctcctcgttctggcggagaccatctcgtggctgctgttccccttcatgctcaccttcttgcttgtcttcctcgtcatcttcgagtatgtcctcggcgccttcgccgagatcacgcactttgccgatcgccacttctactcggactggtggaacagcacggactggatggaattttctcgcgaatggaacgtgcccgtatacaatttcctgaggagacacgtatacagcgccagcaggccgcatgtcggcaaggccaacgcgaccgtcattacctttttgatatcggccgtaggccacgagatcgttatggcgtgtatcactaagaagttgagaggctatggtttcatttgccagatgctccagctgccgattgtgatgctgcaaaagaccgagttggtcaggggcaagaagacgttgaataatgtttgcttttggtgtagtatgatcttgggtttgagtttggtgagttgttctcctcctttccttgccctttcattgtcgaatattgagggagattactaa

SEQ ID NO: 27789 - DNA, 1017 bp, Neurospora crassa
gagcagttctgtgctttcaaactcaagacaaccaagggcaacaacttttgcagaaatgagtacaacgtcagcggcttctgcaacaggcagagctgccccctagccaacagccgttatgcgaccgtcagaacctcgcccaagggcacaatatacctttacatcaagaccgtgcgtatccgctccttgtggcaaacctaccagatccccgggaccaactagctgacacacccttcccctttcttacagattgagagagcccacatgccctccaaatggtgggaaaagatcaagttgtcgcaaaactacgccgaagccctccagcaaatagaggatcgccttcaatacttccccaaattcctcctccacaagtgcaagcagcgcctcacccgtctcgtacaagtcgcgacccgcatgcgcaaactcgccgccgaggaagaccgtctcggcgagaagctggtgcccaagatggcgcccaaggtcaagcaccgcgaagaggccagagagcgcaaggccctcattgccgccaagctggagaggacgatcgagagagagctgctggaacgtctcaggcaaggaatgtacggcgaccagcccctcaactgctccgagtctgtctggaagaaggtgctgcagggtcttgagaaggagggtgagggtacccgcgacaaggatctggatgagggcatcgaggacgaggatgaggaggacgaggaggaggaagagctcgaggaggagatcgaggacggcaatgtcgagtacgtgtccgacttcgaagagaccgacgacgagctcaatgatatcgaggattggctcggcagcgatgacgaggacgatgcggaggacgacgatgacgaggatgatgatgacgacgatgagggcgacagcgaggaggataccaagaagaagacaaaggctggcgacaagaggaagagaggaaaggtcaccaagatgaaggcacggaaaaagaaggagatcgaggtggagcacgagacggacagggagaagttgcttgctttc

SEQ ID NO: 27790 - DNA, 855 bp, Neurospora crassa
atgcctcccaagaagcagtcctcctccggcggcaacaagccgtccggctctggctctagctccggccgctcttcctccggttcgtcttgccgctgcagctgccgctgccgctgcagtatcggtggctggctcaagttcttcgccatcttgttcgccctagttgcgcctatcgcctacgtcctggagcagcgtctcgagtccttctacgtcttcgatactgagcaccttcacgatctgtccaagcgcgccatcagcgcccacggcaacgacaccaaggctattgtcaagtacattgtcgacgagctgaacgaccgcaacggcgttgcgccctacgtcaacaacgatgaggagtgggtgttcaacaacgctggtggtgccatgggtgctatgtacatcatccacgcctccatcaccgagtacctgattatctttggtaagccccatcctccagcacgcgtttcgcaagcttgtgcttcccgcttcttcagacccatcactaacagcacactccacacaacaggcactgccatcggtactgagggtcacaccggccgccacaccgccgacgactacttccacatcctcaccggcactcagactgcctacgtccccggcgagtacgagcctgaggtctaccctcccggttccgttcaccacctcgtccgcggtaccgtcaagcagtacaggatgcccgagagctgcttcgcgctcgagtatgcgcgcggctggatccctcccatgctgttcttcggttatgccgataccctcagcagcacgctcgatttccctaccctctggcgcacctccgtcatcaccggccgcgagatgattagcaacttgctcaagggcaagttc

SEQ ID NO: 27791 - DNA, 4524 bp, Neurospora crassa
atggccgaattcccagacgaaaaagaaaaggagatcagcctcccgaaccccgtagccgaccagagacatcgagacgatgagatcgaggaagcacacaggagcgatgaagacgtcgaaaagatcgccataggctcgtcggttgtggaggagaacgatgagaagagggccgagctgaaccggatgaggaccaatgccaccaacaccagcgtgaccacggccgctaccatccacccccatgtcaaaccaaagccatggtacaagcagccaaacccactaagatgggggaaaatcgcaccaatccccgagacgaggaggccatcgccagagtacaatgccggtttcttcaggtcgctcttctttagttggatgggtcctttgatgacggtaagtgaagccgcactcgagagggttatctacacgctgaaaacaaataactaacacctctagacgggatacaaacgacagctggagctcaacgacatctaccaagtcaacccagcccgttctgtggacccccttacagaaaggatgcgagagtcctataagcggcgggtggagaagggggacaagtatccgttgctttgggcgatgcatgaaacctttttctgggaattctggattggtggcatgtgtcagcttgcggcctctatccttcaagtcatgtcgccctttactcttcgttacctcatccagtttgcaacgaacgcctgggtcgccacccactctggcgcaccaccgccgggtatcggatccggcctgggattggtcttcggtatcacggccatgcaaatcttgcagagcttgtgcatcaaccacttcatctaccgcggtatgcttatcggaggtatggctagggcctctctaatcagcttaatctacgaaaagtccatggttatctcaggtcgtgccaaggcgggtggcgctgatgcgtcagatgttcccgctgcaaaggcggctgctgagaaggacgcaaagaagaagagcaagaagaagggcaagaagggccaggccggtgttgaaggtgatggtgccggctggggtaacggaagaattgtaagtgcaaccgaagcgactacatgttactagtggctaacaagtttgcagatcaacttgatgagcgtcgatacttacagggtcgaccaagcctctggcttgttccatatcatctggactgcccccgtctccatcatcatcaccctggtgctgctgcttgtcaacttgacctacagcgcgctcgccggttttgccttgctgattattggtatccccgtgctcaccaaggccatcaagagtctcttcgcccgcagaaaggccatcaacaagatcaccgatcagagagttggcctgacccaggaaatccttcagtccgtccgcttcgtcaagttctttggctgggaaagttcgtttctcaagcgcctgcaagagttccgtgaccgcgaggtatcagctattcaggtgttgttggctcttcgtaatgcgatcatggccattagtatttcgcttccgatcttcgcgtccatgcttgccttcatcacctactctttgaccaaccacgggttggcgccggccaaggtcttctcgtctctcgcccttttcaacggtcttagaatgccattgaacatgcttcccctggtcatcggtcaggtgacggatgcatggtcctctatctcccgtatccaggactttttgctttcggaggaacgtgaggatgaagctatcatcaagcccgatgctccgaatgctatcgaagtccacgacgcctccttcacctgggaaagaacgccaactcaagagaacgaatctacagtgggtggggccggtccgaaatcgaagcctgaaaagggtgccaagggaaagcccaaggatgtcgaggcggctactcctccttccggtgacgactcgagtaccttggttgaagaacaggaaccgtttaagcttcaggatctcaatttcaccattggcaggaacgagttagttgccgttatcggttccgtcggcagtggaaaaacctcactgctctctgccctggctggcgatatgcgcaagaccagcggcgaggttgttcttggcgcccaaagagctttctgccctcagtacgcctggattcagaacgcgactctcaaggacaacattctttttggaaaggagatggaccctgaatggtaccgcgatgtcatcaaggcttgcgcgttgcagccggatttggatatgcttcccaacaacgacttgaccgagattggtgaaagaggtatcaccatctctggtggtcaaaagcagagactcaacattgcccgtgcgatttactttgatgccgatatcgttctcatggacgaccccctgagtgccgtcgatgcccacgtgggtcgccatatcttcgacaacgctattcttggtttgctcaaagacaaggcccgtattttggcaactcatcaactctgggttcttaaccgctgcgaccgcatcatttggatggatggtggtcgtattcaggctgtggatactttcgacaaccttatgagggattccgaggagttcagacagctcctagaatcgactgcccaagaagaaaagaaggatgaagccgaagctcctgccgcaaccagcgaggaagaagcgcccaagaagaaaaagaaggccaagggtctcatgcaggctgaggagcgtgctgtggctagcgtcccatggtcggtttatacgtcctacgtcaaggcctccggcagctatctcaacgcccccattgttctcgtgctcctggttatctcacagggatccaacatcatgactagcttgtggctttcgtggtggacttctgacaagtttggcctgagtttggggcaatacattggtgcctacgctggtcttggtgcgatgcaagctctccttatgttcgcattcatggtatctctatcgatgttcggtactacggcgagtaagaacatgttgaggcaggccaccttccgcgtgttgcgcgcccccatgtctttcttcgacactacacctctcggtcgcatcaccaaccgtttcagccgtgatgtggatgtcatggacaacaaccttacggatgctttgcgcatgtacttcttcagcattggagctatcatctcgacgtttgctctgatcattgcatacttctattactttgccatcgcgcttgtacctctcttcaccttgttcctctttgctactggctactaccgctcatcggcccgcgaggtcaaacgctttgaggctgtccttcgttctacggtgtttgccaagttcaacgaaggcttgtctggtgttgcctccatcagagcctatggcctccagaaccggtttgtggaggacatgaggaaggcaatcgacgacatggactcggcgtacttcctgacttattcgaatcagagatggctatcgaccagactggatatgatcggtaacgccttggtcttcaccacgggtattctcgtcgtcacctcccgtttctcagtcaacccctcgattgccggcttggtgttgtcctatatcttggctatagtgcagatgatccagttcactgtccgtcagctggccgaagtcgagaacggcatgaacgccgtcgagcgtctcttgtactacgggacccagcttgaggaggaggccccatccaagaccatcgatgtccgccccagctggcccgagaagggtgagatcattttcgacaacgtcgagatgcgttatcgtgctggtcttcctcttgttcttcagggtctcaatgtgcatatccagggcggcgagcgtattggtatcgtcggccggactggcgcaggaaagagttctattatgtctacactcttccgtctggttgagatttccggcggtcatatcaccatcgatggtatcgatatttccacgattggtctccaagacctccgttcccgcttggccatcatccctcaagacccgaccctcttccgcggcaccgtgcgcagcaacctcgatcccttcggtgagcataccgacttggagctttggtccgccctacgccaagccgatctcgttcaagatgatcaggccaccaccacaaccgccacccctagcgccagcggcaacgcccttgtcgtcgccgaaactcccgctgcttctaacggtaactccaacaaccgcatcggcctcgactcggtcgtcgaagaagacggccttaacttctccctcggccagcgccagctcatggccctcgcccgcgccctcgtgcgcggctcccagatcattgtctgcgacgaggccacttccagcgttgacatggagacggacgacaagattcagcgcaccatggccagcgcgttccgcggcaagacgctgctgtgcattgcgcatcggttgaggactatcatcaactacgaccggatttgcgtgatggataaaggacgcattgcggagattggcacacccatggagctctttgagatggagggaggtatcttcagggggatgtgtgagaggagtgggattagagcggaggatatcaggttggcgagggaaattgtggataacgatcgagctctg

SEQ ID NO: 27792 - DNA, 1352 bp, Neurospora crassa
tcgggtatgtgcaaggccggtttcgccggtgatgacgcccccagagctgttttccgtaagtgttcccactattcccgcgaggtgctcttgcttgagacgggcaacgtgtcagcagagctacttgcctccccgccaagacccaacgtcccagccatgctaacatgtcgcgatagcttccatcgtcggtcgtccccgtcatcatgggtatgcatgccactttcccccccgcgtcccgtgcgcgcaacactccaagactttcagaaaaaactgacaacatgccagtatcatgatcggtatgggccagaaggactcgtatgtcggtgatgaggctcagtccaagcgtggtatccttactctcaggtaccccatcgagcacggtgtcgttaccaactgggacgacatggagaagatttggcatcacaccttctacaacgagctccgtgtcgcccccgaggagcaccccgtccttcttaccgaggctcccatcaaccccaagtccaaccgtgagaagatgacacagatcgttttcgagactttcaacgcccccgccttctacgtctccatccaggccgtcctttctctctacgcctccggtcgtaccaccggtatcgtcctcgactccggtgacggtgtcactcacgtcgtccccatctacgagggtttcgcccttccccacgccattgcccgtgttgacatggctggccgtgatcttaccgactacctcatgaagattctcgctgagcgtggttacaccttctccaccaccgccgagcgcgaaatcgttcgtgacatcaaggagaagctctgctacgtcgctctcgacttcgagcaggagattcagaccgctgcccagagctcttctctcgagaagtcctacgagcttcccgacggtcaggtcatcaccatcggcaacgagcgtttccgtgcccctgaggctctcttccagccttccgtccttggtctcgaatctggcggcatccacgtcaccactttcaactccatcatgaagtgcgatgtcgacgtcaggaaggatctctatggcaacattgtcatggtaagtccccgttcgctgtggagatggcagtataggctaggtccgctaacagaatcgtcactagtctggtggtaccaccatgtaccctggtctctccgaccgtatgcagaaggagatcactgctcttgctccttcttccatgaaggtcaagatcattgctcctcccgagcgcaagtactccgtctggatcggtggttccattctcgcctcgctctcgaccttccagcagatgtggatctccaagcaggagtacgacgagagcggtccctcgatcgtgcaccgcaagtgcttctaaagt

SEQ ID NO: 27793 - DNA, 1078 bp, Neurospora crassa
gatgcgggcctctccccggctctcgtcgagacggtcgccggtctttcggccggctcaatggccactctgattgttcatccgcttgatattgtcaaaactcggatgcaaggtatgttcaccgtgcttcaaattctgtttcgataaacaactgacttttcacattccagtccaccgaagtagtccaaccaacccttcggcagcgctcaccaccgtctccgtcttccggagtctagcgcaaaccgaccggcccctcgccgccctctaccgcggcctcacgccgaacctcatcggcaacgcgaccagctgggcctcttttttcttcttcaagtcccgcttcgagcgactcatcgctcacctcaaggccccttcttcaccaccagcaccttcacatttaggtggtgaacctactactctcccccaaaatgtcaccccggaccgcgaaacccaagcccaaattaaatcccacctctcccccaccgacttcttcgccgcctccctcctcgccggcgccgccacgcaaatcatcaccaaccccatctgggtcctcaaaacacgcatgttgtcgaccgaccggcttgccgccgacgcctacccatccatgttcaccggcgccgtgcgcctcttccggagcgaagggatcctcggcttctaccgcggtttgggcgtcggcatgctcgccatcagccatggggcggtgcagttcgctgtgtatgaccccgcgaggaggatgtatatcgcatccagggatgcgaagcgacgactggcgggccaggagattgcttcggaggatgagcgagaaagtcaaaggatctcgaacgaggcgacgattgtcttgtccactgccgcgaaactggtcgcgggcacggcgacgtatccgttgcaggtcatgagggcgagactgcagcatcatcaggctgacgagctgtttggtaggggcataggaggggtggtggcgaaactgtggagggaggaagggtttagagggttttatagggggatgatgcctggcgtggtgagggtgctgccggcgacgtgggtgacgtttttggtttatgaaaacgtcaagtattacttgcct

SEQ ID NO: 27794 - DNA, 1209 bp, Neurospora crassa
gtgatccgtgagaaggtacaagacggcgttacaggagagacgcgggagatccagtacacccaatgcaagattgtcggcaatggctcgtttggtgtcgtcttccagaccaagctgtcaccttccaatgaagatgccgccatcaagcgcgttctccaggacaagcgcttcaaggtcggtacagcccgtattggacgtcgggtctcgaggttcatgaaactgaccgatatatagaaccgcgaacttcaaattatgcggattgttcgccaccccaatattgtccagctcaaggccttctactactcgaacggcgaacgtgtaagtccccaacgcattggagctcgtcgccatgcttttcatactcattgtctctgtagaaagatgaggtgtacctcaacctggtgcaagagtttgttccagagaccgtttaccgagcctcgaggttcttcaacaagatgaagaccaccatgcccatcttggaagtcaagctgtacacctaccagctattcagggctttggcatatatccactcgcaaggaatttgccatcgcgacatcaagccgcagaacctcctgcttgaccctactaccggtgtcctcaagctgtgcgactttggcagcgcaaagattctggtggagaacgagcccaatgtgtcctatatctgctcgcggtattaccgtgcacctgaattgatcttcggtgctaccaattacacgaccaagatcggtgagttctcttgggagcaccagcctcgttgcacatgtctcagacattggctaatcatgttgtgcagatgtctggtctactggatgcgtaatggccgagctcatgcttgggcagcccctcttccctggcgagtctggcattgaccagctggtggagatcatcaaggtcctcggaacacctactcgggagcagattcgaaccatgaacccgaactacatggaacacaagtttcctcagatcaagcctcatccgttcaacaaggtttttaagaaggccgacgctgatgctatcgacctcatcgcccgtcttcttgagtatacccccaccgagcgtctggcggcgattgatgccatggtccatcccttcttcgatgaactccgggaccccagtaccagacttcccgactcgaggcacaactctggaaccgttagggatctgccaccgctctttgactttacccgtcatggtatgtacttttctcgcaca

SEQ ID NO: 27795 - DNA, 1660 bp, Neurospora crassa
ttattcaaggacatctggcatgctatgaccagttatgatcgacgttagtgctttcttcccccctacttccccgtcctcggttcgatcgcttacatgtcatggttgggaaacagatgctggcatcgactctccttaccgaactggacgtcatgtcccattgaaccggaactccggtctcgcgggcgttactaccgcctccgactcgcgtgccgacatcaactcgccctaccttcaaggagatggccgtggttctaccatgagcttcgacacggcctacggtggacgcgccatatctcccatgccgagtcccgccaacggtggcccctattcgcccggcctagtgagccaacgacagtccgtccaccaggacgcattcgatgtacacagcccaaccggcgagattcccatgcagaacttccaaaatggcggtccgcctcccccaccagtcgctagctcctgggagaaaattgacagatgggccgaggaaaactaccccgagttgttcgaccaacttggcgagggctgcaccgtcaacgatctgaacgaactcgaataccagcttgattgcacccttccccaagatctcaggcaatccttgcaaatccacgacggccaggagcgcggtggtcttcccactggcattattttcagctccatgttgctcgactgcgaagagatggttcaggagtgggagaactggaagacggtgaaccaagagtttatgctggatcccgtgctcgtcaagcgacaatctcaggcatttgccgctcaggcctcatcatcaaaagatgcccctaaccgcaaccaaaactggcgacaagaacttctcaacaagcaggattccgtccccccggccgcgattcagaaggcgtatgcgcaccctgcctggattcctctcgttcgtgactggggcggcaacaacttggctgtcgatttggcgcctggaccaaagggccactggggtcaaatcatcctctttggtcgcgactacgatacaaagtacgtcgtggcccgctcgtgggcgcacttccttgccatggttgccgaggatctcagcagcgggaggtggtttgtcgatgaggacaccaacgagctcaagctgcgtgagtttaaggcgacccgtgttgagccgtcttatttcgagattctgaggtggagaatggatcagaagtatggtcgcacagccaacaagcgcaaatctatggcgccttccatggcgtcagcttccggcatgcgctctccccccactcccggctctccctaccaaagcccaacagagcacaacgagcctcgtggccggtcgctacaccgtctcactggcacttcacccatgtcgagtcccatccgaccaggttacggaaagccaagcccattggcgcgcgttgctgaggaggcaccccccacaacctctctcacggctagcaacgcctccctcgaggccaaagccgccgacaacttgatggagttgaacaccccaaggacaagcggagagcatagcaaggaggatatcaaggtcaatgaggattctcccgccaaggaaaggacaagcgaggataaggagaagaagcctgaaaccgaggcgaacggaaaggcgacggagtcaaagggcaagcaaacgacagtcgaagacgccgaggacatgaaggatatcgagatttaa

SEQ ID NO: 27796 - DNA, 3408 bp, Neurospora crassa
atggccgaccgatacggccagcagccgcaatcctatcggggcaacagcggtttcggcaaccttggccggcgtaacgacgactacgatccctacggtgacggatatcccagcgaccgctatggcaccagcactaacccggcttcaagaccatcgacggcctcccgaaatgcgcccccgccccggtctgcccagcgtggccgcacgggtgccggcgatatgcagatccagtccaatgccgagcgccagattggaaacgtgctggatctgatcaagagagaatggcccgccatggtcgagacagactgcatccccgtccagctggctctacagcttctcgacaccagctccgtcggccgcgcccacgaataccgcaacttccagcagacacaccagttcctccaagagtccctcaagaacattgtccacgaccaccaccaaggcttcaacagttccattggtacattccacaagatccaagggagcatacagtcctcccagaagaaggtgcgcgccctcaaggagtcgctggcagcctccaagacggcactctgcaccaccaatcccgaactcaaacagctacatgccacgtcacgcatgtacgatggcgtcctacaaacactgaacgagctcgatgacttgcgcaccgttccagaccagttggaggccaggatatccgagaagcgttttctgaccgccgtcgaggtcctgcagaatgcgctacggaagctgaggaagcccgagctggataacattggtgccctgagcgacctgcgaagctatcttgcaaatcaggagaccgccctcatggatatcctggtggaagagttgcacgaacatctctatctgaaatcaccgtactgtcaggaaaggtggcagaacctggcaaaggtccagggaatttctcatgagacctatggagacgccccaggcgtggcacccttccacggaatcttggacaccattgactgggaaaagtccgtggctgaggatccccaaaagaatcccgaggcggacacgttttactatgtgaccctcctcgttgaagctctgaacagactgggaaggctagagacagcggtcgacatgctcaagcagaggttacccgtcgagcttttcgcggtcgtcaatgagactatcaacgatgtagaccagaagcatccgagctcactacgcggaggcgcgtctgggtctcacggccttaacatttacggtcaccgcgaaacccgaatgcgagcagacgtcattcacgatttgctatcgacgctttacggcaagttcgaggccatcgctgagggtcatcgggtgctacacgaagccatcaaagccttgattcgccgtgaaggtgctggcaacaacagtgtgctgctagggggcttcaaggagctctggaacctctaccaaaacgagattcgggcactcctgcacaactacgttaccaccgatgcggatgtctatcagttcagccgtacacccagacctggcatgggcatgaatggcagggcggattctgcccgcgacaatctcttcaagttctccgaagttgatgccaagtcagccgaaatggcctcggaatatgaggccttggactccatcatccgggccgccgtacctggacttacggacagcacccggcgtgacaacaagaagggttctttgatcatcccgcgatctgagccaattacttcgaggaagtcggcagggtacggctcaggaagcagtcaacagaacagtggcacttacaaatccctggtagagcccagcgtgttcaacatgagcctgcttctaccacctactctcatcttccttcagaggttgaagagcattgtgcccccggggtccgatctggcaaccagcacgctgacatcgttccttgacaacttcctcgtcaatgtcttccagcctcaactcgacgagacccttggaaagctcagtgatactgtctttggcgaggcagacgcctttcagcaagactcggactgggcccaagttgcgaagcggcctgtgtacaagggaaccacagccttcttcacagtcatcacagccttttgccggatgctgggcactattccccacgaccaagcgctgagtacgctcatcatcacccaaatggtccgatactacgaccgctgcttcagctggtacaaagccctggtcaccaagacacaagaagggggggacaagcagatcagggaaaaggaaaagcttcgggcatctgccattctcgccaccgagcctagtgaagtccgcgagacgatacagaggctgtggaagtcggaaaacctgaacgatctggagcttctttaccgcgaggtgaaccagctcatcgcgtgggccaacggtcgggacctggacgccagtgacatcattcaggatcgcgacatgattcagtccatgtgtctgctatacaccagtatgaagtggctgtcggttaagatccacggtctgcgtcacataacgcgtaacgagacggactcatccaagtcgagcttcccgaccaaggcggagaagaagcgctggacgctgctgaacgacccgagcaaagctacaggaggggaagcccccgtttacctgcctatgacggaggagaccgttgagtaagtttactatcctatatattttccttcttcaaccctgataagtattcgcttgctaactcattccccccttagaaactttgatagtatcctagtatcctacgacgagctcgcctccaccgccctcctcactctacaccttgaaatccgcactcgcatcctgcactccctccaaacggccctgtccccgctcaccacggccccctacctgctcgatcaggaagtcaacgagccggacccggagatcctctcgctcaactcggaaatggtggcctacgacgaaattctagtgagatgcctccgcctgcgcgaggttcagtttgtcaggaacggcctcggcaagctgatcaacgggttcctgatcaagaacgcgcccatgacggcgcccatgaacgccaaggggtgcgggcgcatgcaactcaacatccttgtgctgcagcagaacctcaagaatatcgaggaaggagtcgatctcgtgagggcaagtaattactttgagatgtttgagcgcggagtggatgccattctcgagaaagccagggaaggcgtcgcctcttctggctcccaggaaactggtgacgcaggacgaaaaagtgaagacgccggagaagaaggggcggagacgcccaactcgagaaagtcggcggaaatttttggggacgataaggaccggttcagctacgatgaactcaaggcgctcgtggagctgtgttatagcgagcagttggcggatccggagcgcggcgtggcggcggcggcgaagaggcagatggcggataagttgctgaatttgagcgagtacatgtggcagtct

SEQ ID NO: 27797 - DNA, 510 bp, Neurospora crassa
caacacagcttcattgccgtcaagcccgatggcgtccagcgtggcctcgttggcaacatcatctctcgcttcgagaaccgcggcttcaagctcgttgccatgaagctcacccagcccggccaggcccacctcgagaagcactacgaggacctcaacaccaagcccttcttcgctggcctcatcaagtacatgaactccggccccatctgcgccatggtttgggagggcaaggacgccgtcaagaccggccgcaccatcctcggtgccaccaaccccctcgcctccgctcccggcaccatccgtggtgactttgctctcgtacgttggccttcatctctgcacccctttcatgacagcttatactgactcaatgactaaccacaggacatgggccgcaacgtctgccacggctccgactccgtcgagaacgccaagaaggagattgccctctggttcaagcccgaggagctcaaccagtggaaccaccactccgctgcctggatcttcgag

SEQ ID NO: 27798 - DNA, 2778 bp, Neurospora crassa
cacgacttcaagaaatgcgaccaggctggcttctgtaagcgtaaccgggcctttgccgaccacgtcgtcgccaataccgcatgggagtcgccctacaacatcctcgccgactcggcctccttcaaggatggccagttgcaggccaccatcctcaagacggtcaacgatgccggcgagaccgtccgccttcccatcaccgtttccttcctcgagtccggaaccgcgcgtgtcactgtcgacgaagagaagcgacaaaagggcgagatcgagcttcgcggtgacagcaaggccagaaagcaacgctacaatgaggccgagcaatgggtcatcgtcggcggcttgaccctcgacaaggaggccaaggtggactaccaagatgacacccagatcaccgttcagtacggccccgagtccaagttcgaggcctccatcaagttcgcccccttctctattgacttcaagcgcgatggagacacgcacatcaagttgaatgacaagggcttactgaacatggagcattggaggcccaggattgatgcgtcccctgcgcccgagaagcaggagggcgaggacaacagcagcagcgaaaccgagagcgccgagactaccgctgcccaggttcccgaggcctaccctggtgaggaccaaaacacgtggtgggaggagagctttggtggaaacaccgactccaagccccgtggccctgagagtgttgccctggatatctcctttgtcggttatgatcacatttacggtattccttcgcataccggccccttgtctctcaggcagactcgtggcggcgaaggcaatttccaagagccgtaccgaatgtacaacgccgatgtgttcgagtacatcctcgatagccccatgaccctgtacggatccatcccgttcctgcaggcccatcgcaaggattccagtgttggcatcttctggcttaacgctgccgaaacttgggttgatatcaccaaggaaaaggagtccaagaaccccctggccttgggtattggttctaagacgagcaccagcactcactggatctccgaggccggcctcttggacgtgtttgtcttcttgggccctactcctcaggaccttatccgcaagtactctgagctcaccggcactaccgccatgcctcaagaattctcgctcggctaccatcagtgccgctggaactatgtgtctgacgaagatgtcaaggatgttgatcgcaagatggacaagttcaatattccctacgatgtcatctggctcgatatcgagtataccgatgacaagaagtatttcacttgggatggccatagcttcgctgatcccattggcatgggcaagcagcttgaaagccatggacgtcagctggttgccattatcgacccccacatcaagaacgtcgacggctacaaggtttctgaggaactaaagtctcagaaatttgctgtgaataacaaggatggcgaaatttttgagggttggtgctggcccggctcgtcccactgggtcgacgccttcaatgccgccgcccggaagtggtgggccactcttttcaagtacgccaggtttgagggttccatgaggaacacctggatttggaacgacatgaacgagccctcggtgttcaacggccccgagactacgatgcccaaggacaacctccactatggtaactgggagcatcgtgacatccacaacttgaacgggttaaccttccataacgctactttcgaagccctcaagtcccgcgaggcaggcgaattccgtcgtcccttcgtgctcacccgctccttcttcgctggttctcaacgccttggtgctatgtggaccggtgacaaccaggccgcatgggaccatctggaaggctccattcccatggttcttagccagaacattgccggtttccccttttctggcgctgatgttggtggtttcttcgggaaccccgagaaggagctgttgacgcgctggtatcaggccggtgccttctaccccttcttccgtgcccatgcccacattgactcccgccgccgcgagccttatcttgccggtgaaccgtacaccaccatcatcgctgcggctctccgccttcgctacagccttctcccatcttggtataccgctttccgccaggcctaccttaccaacgagcccgttatcaagcccatgttctacactcatcccaacgaggaggctggctttgctatcgacgatcaattttttgttggcaacactggtttacttgccaagcctgttacccagaaggacaaggagacggtagacatctggattcctgataacgaggtctactatgactacttcacctacgacatcatcccctccaacaagggtaagacggtaactcttgacgcaccccttagcaagatccctctcctcatgcagggtggccacatcttcgcccgccgtgatcggccccgtcggtccagcactcttatgaagtgggatgactacacccttgtcgtgaccgtcggcaaggacggaaagaccgccgagggtgatctctatgtcgatgacggcgactcctacgagttcgagaagggccagtacatttaccgcaagttcatccttgacggtgatgccaagaccatctcctccgttgacggcgaggaccgcaagaaggtcaaggagggcgactggatgaagaagatgcaccaggttaccgttgataagattatcatcgtcggcgcccctgcgtcttgggataagcaggaggtcactgtggagtcagagggcgagacctggactgctacgctcgag

SEQ ID NO: 27799 - DNA, 3401 bp, Neurospora crassa
atgtcgaggtcttcagctggctcaagtcgctcagttcaaggtcccggcggcggccccgccggcggtgggagcacaaggcgaaacaatgtgagtaatcatcttcccgccttggcttcctttactgttgttaccatcggcctgttttgcagtccccctttctctcgagtctttccatctacatgcgcgcgtcatgatgcctctcctctcctctgttccaatcctcctctgccgtttgccagttcgctgctaaccagggcatctgacaacagtcatctggcggctcgtcgtccgtcccactatcgcaaatcgaaaggagcgtcacacatctacttgtggccaccaagcaactgctcgaaaccctgacacaatggtcccgtggaaacgcaaccgatacccaggtctccgacgtctacgtacggctgggctacgagtttaatatggcctgccgagcctttactgccatcaatgtcgatattgacgacttgggcaacgtacccgagatgctgcgcaccatcctggaggccactctaagtcaagaagccagcgctgaaagtctcgagaaatacctgccaaagatacgtgatattatcataaatctgctgcatggtttaaaaagaaaacagcaaaagctaaggcatcgccagcagcgggatagagagccgagtatcgcgggagacgatggaggctatggtccaagtcgcggacctgggcccagtagcagtggcgtgcccaccagaactacgagcactagtaccatggctagtgttaattctgggctcaccaacatgctgaacgaagggctggagagcaatggctaccgaccggactctttcagggatgattctcggaactctggtcctacaacggcatcacccaccagacgtcttccctcgcaacgggaccaatctcgcggctctgtcacctctgaccagtccagcctgtcgagcaacacgatgcaaaacatacccgttatggcgccttacccaggtgaagagacaattccaaccggcccaccggcaccacccgaaatcaacgtggacaacttccctccgccgccgccgccgcccaagggatcgggacagagcgccttggcggctctccaaagaggaggtaatctggaaagacgagcttcccgcagatatgaggcataccagatttccaagtatctcggcgctatggtcccaccccagacaacgccgatacccgataggggcaaccgcgaggctagaagagagtcgctgcgggcgatgcacgtaagggaaaccccccgccacagccgcaatgtttcgaaccagtcccaacgtaccattggcctcgattcctctcccgttcgagttcccagccgggttcctgaagagcctgaaacggccgattcttatacatttagcaaggccgacaacttgaatgtccaggcgccagatgacaagtatcctactccaagcgctacccttaatggcccgctcgcagatcctatcccgatggtggatgaggtagactcgtctaagcccgctgctacgaggcctgctcctgcgcctgccgctcctcagcatcaacacaagccgtccattcgcgcctcgactcccgataaacaaccgcccagctcgtttatgctcgagaattcaccccccgcaaccaaggaactgaccctcttcctgcagtacaagtccaaggtcaagaagttcgtgctccctgagggctacgagcatctgtctatggctcgtcttcagctggcctttattgagaagttctcgtggaacacgcagcagaatggagctgatctaccggaaatttacattcaagatcccgtctccggtgtccgccatgagcttgaggatctgtccgatattaaggaccgtacagtgcttgtgttgaatgtcgaggttttggatgaagtcaagaagcatattgacaagagtatcgggtccatcaagaccatcatccagcaggttaaacaaaatgtcgacgatcaaaacgccgccattcaacgtgtgtcggagcgccaacaggagaccgccaaggatctcgctcgcattgccgccacgccgcctcccactatcatcgcaccaagtggtatggactcgacggcttcgccacgctcttcgtcttcctctgtcgctggtgctgctgcccttgccggttcctcatccaagaagctcagcccaagccagctcaccgagatccaatcccttcgtcgcgacctcgccgttcttcgccagacctactccaacttccagtccgaagtccaagggtccatgactactcttcgcaacaaggccaacaatgtcaagaccgccgccgccaagttgtccgttcccgatggggaaggcgactctggtcgcgcttacgtcaccaagggtcggaaactgcttaacgccgatagtgaccggcttgtcaaccaggtagacgacctgcaagatctcattgaggaccttcgcaaggacgttgtccaccgcggcgtccgcccacgccctaaccagctcgagtccgtcaccaaggacatcaccacgctctccaaagagctcaagaagatggaggagttcatgaagaaggagaaacccatctggaccaagatctgggaaaaggagctcgaggaggtctgccaaggtcgcgacgagttgcgcctcatggaagatctgatgatcgacttgcgcgacgacttggagaaggccagcgaaacctttgcgcttgtcgagcaggcaaccaaggagcagatgaaagagggcggacagggtaatacggttaacggctcggtgtccaacggccccacgccctttggcgcctttagtcgcgggctgaagagcatctcggagaaggtgacgcatgcggatcctagcgaggccaaggagggcgttctgggcgaggtgcgcgccttgcagccgaatcaccagagccgattggaggcgattgagagggcggagaagctgaggcagaaggagttgcagaccaggatggtcaacccgcttacgaaggagctggcctcttttgtggaggaggggaagctgaagaagagtggtggtgtcgaggaagtggagagggcgcggaaggccaaggatgatcagatcagacgggaggtgtgggagcgcatgaatggccttattgcggagaatgacgatgatggtgaggacgaggaggatgacgaagaagaggaggaggaagaggaggaagagtagggagaggaggaggaggaggaggaaggagaggagcaggaagaaggagaagagggcgaggaaaaagcgagtggctctactaaggagtctgtcgatggagaggaggataagggggaggtgaaggagaagaacaaggagaacgttaaggctgaagagaagttagatgcggatgagggcgaggagggaggcaaggcgaaggccgaagccgcgaaagagcctgatgcaactgcttga

SEQ ID NO: 27800 - DNA, 1685 bp, Neurospora crassa
atgttcaagctcggccgcaaccgcgcattggcttctgcctttgctgccacctccagggttcgtcgccgccgcccctcagccagccgcgatgttgttctatgcaccgtcgcatcgcatcgcatccaaaacaaagcaacacgcaagctgacaacatgttccaaacacacaggctcccctcgcctccagactccccagcgtttcccaacaacaaaggagagccctcagcatccacgaatacctctctgctgatctcctccgtcaggtcagtacacacccccagagctctggtgcccatagaattggcttatctctctctctctctctacctctgcctacctaccccgccccgccccgtcgctatctgactccatcgatcggtcccgatttctaacgcgacaccacacataacagtatggcatcggtgttcccaagggtgatgtcgccaggaccggcgccgaggccgaggccatcgccaagcagattggcggcgaggacatggtcatcaaggcccaggttcttgctggtggccgtggaaagggtaccttcgacaacggcctcaagggcggtgttcgcgtcatctactcccccaccgaggccaagatgttcgccgagcagatgatcggccacaagctcatcaccaagcagactggcgcccagggccgtctctgcagcgctgtctacatctgcgagcgcaagttcgcccgtcgcgagttctacctcgccgtcctcatggaccgtgcttcgcagggacccgtcattgtttcgtcgtcccagggtggcatggacattgagggtgtcgccaaggagaaccccgaagccatccacaccacctacatcgacatcaacgtcggtgtcaccgatgagatggcccgcgacatcgccaccaagctcggcttcagcgagcagtgcgtcgaggaggccaaggacaccatccagaagctctacaagatcttctgcgagaaggatgccacccagatcgagatcaaccctctttccgagacctctgaccacaaggtcatggccatggacgccaagttcggcttcgatgacaacgctgatttcaggcaacccgacatcttcaagctccgcgacactacccaggaggatcccgatgaggttcgcgccgcccaggctggccttaacttcatcaagctcgatggtgacattggctgccttgtcaacggtgccggtctcgccatggctaccatggacattatcaagctgaacggtggccagcccgccaacttccttgacgtcggtggtggtgctacccccgcggccattagggaggccttcgagctcatcaccagcgaccccaaggttaccgccatctttgtcaacattttcggtggtatcgtccgctgcgacgccatcgcccacggtctcatcaacacggtcaagtctctggacctcaagatccccatcattgcccgtctccagggtaccaacatggaggctgcccgccagctcatcaacgactctggcatgaagatcttctccattgatgatctccagagcgctgctgagaagtctgtccagctctccaaggtcgtcaagatgggtaagttcatttttattcttcaacttggcaaagcaaagcaaagcatgtgtgtgctgactcttttattctcccagctcgtgacattgatgtcggcgttgagttcacccttggtatttaagcgaat

SEQ ID NO: 27801 - DNA, 2236 bp, Neurospora crassa
gtcgaaaatggacatggggccactgaggaacccctcatcgtttatgctcagtctggtcaagccactgtcggtctctacatcggccaaggtctgcagaaccaaggccttagcgagtcggccctgagtatcttgcaggacaacctcgacactctcaatgtctcgacacctagcctggccatgcagctttgcggccctggctacgacagcgcccatacttttggcgttatgcttaccagcaatgctacctttgctcccatccaagacgccatcaagacctgggccaatgccacttgcttgtcctttgcgggctccaagagtttcgccggcgaggctgtattcaccacgccgcttctgccaacaaatggcactgttgggtcgaactccaccatcggctccaactccaccatccaggctaggggactcggtcgcaggtatcacagggctctccatgctcgtgccgagtgcaagagtgtgcaggtcgagtctggtgatagctgtgcgtcactggccacaaagtgtggtatctcgggcgctgacttcacaaagcttcatcccgactccgacttttgcgccaagctgaagccaaagcagcacgtctgctgcaccaccggagatcttcctgattttcgtcccgtccccaactctgatggctcttgcttctcgtaccaggtcaaggccaatgacaattgcgccaaccttggtgccgagtatggcctgaccaacgaggacattgaaggcttcaacaaggacacctggggctggaacggctgtgagcttctgttcaaggacaccatcatgtgcttgagcaagggatccccgcctttccccgccccgatcgccaacgctgtgtgcggcccgcaaaagccgggctccaagccgccgacggatggctccaagattgccgacatgaacccttgcgctctcaacgcctgctgcaacgtctggggccagtgcggtatcaccaaggacttttgcgttgacaccaacaccggcgctccagggactgccaagaacggcacctacggctgcatctccaactgcggcaccgacattgtcaagggcgatgggtccggcgccatcaaggttgcctacttcgaagcctacaatctcggccgagactgcctcttccaggatgcctcgcaaatcgacacctcccagcacacccacatccactttgcttttggtaccttgacccctgactatgaggtcgaggtcggcgatgttctgtcctcttatcagttccaggagtttaagcgtgtcaggggcgccaagcgtgtcgtgtcgtttggcggctgggacttttccactatgcctgccacctactccatcttccgcaatggtgtcacctccgccaatcgtctcaagatggccaccaacattgccaactttatcaaggaacacgatctcgacggcgttgatatcgactgggaataccccggagcacctgatattcctggcatcccggccgccagcctggatgatggccccaactatctcgcctttctcgtcattttgaagaacctgctacctggaaaatcgatctccatcgccgccccctcctcctactggtatctaaagcagtaccctctcaagcagatcggcgccgtagtggattatattgtatatatgagctatgatggccatgggtacgtttttatttttcatcaataagtgcgatcattttgctaactccggaaacaggcaatgggatgcgggtaatcgattctctcaggagggctgtgacaccggcaactgcctgcgcagccaggtcaacctgacggaaaccaagcagtcgttggccatgatcaccaaggccggcgttcccggaaggaagatcatcgtcggcgtgactagctacggtcgctctttcgaaatggcgcagcccggctgctgggggcccagctgcactttcaccggtgaccgcacgaactcatacgcgaagcctggtgtgtgcaccggcactgcgggctacattgccgacgccgagattgccgagatcatggccggaaccggctcgaagcgttcaggcagagttacggctagcttcgtcgatgcaagcagcaatagcgacattcttgtgtacgataacacccagtgggttggctatatgagcgctgccaccaagaaatcccgcgcagcgctttacacggcgtggggaatgggaggcaccacggactgggccagcgatctgcaaaagtacaacgacgttccctcgcctgccaaggactggaactct

SEQ ID NO: 27802 - DNA, 1520 bp, Neurospora crassa
ttcgtatctcgctctccgggccgagtgaacatcatcggcgaacacatcgactactctttgtactctgtgcttcctatggccatcactgccgacaccatcattgccgtctcaacacacctaccagctcccaaggaaggaacctttaggatccagatcgccaacgtgctggactccaagttcaagtcgcgcgagttcgacattccctatgattccgtcgacatcgacgccaccgttcacgaatggaccaactacttcaagtcgggcctacgcggggcgttggagctgttgcgcaagaagcacggggccaacttcaagcccaagagcatgcaaattctcatggacggcaccgtcccggctggtggaggactcagttcaagtgctgcgtttgtcacggctagtgctttggccgtcatggcggccaatggagagcagacggttgacaagaaggaattgacggagctggctattgtcagtgagagagccgttggtgtgaactctggagggtatgtcaaaacatccaactatagatttcacacaagaacataaaactgacaccatgtcgcagaatggatcaatccgcctccgtcttctccgagcgtggttccgccctgttcgtctccttcacgcccaccctcctcgcccgccccgtctcctttccacccaccacccccgaactcaccttcctgatcgcccaatccttcgtcacagccgacaagttcgtcaccggccccatccactacaacctccgcgtcgtcgaatgcacgctcgcagccgcctacctcaacgccgtgctcaaccctcccggcactttattgcccggcgacgcctctcccctaggcatttcccttcaagggttccacgaaacctatttcgccctctccgagcataactcgggcgccacgtcgagtaaatccgttactgaacagctcgaacacctgctcgagctaaccaaacaaaccctcaccaaggaagagggctacacccgctccgaaatcgccgccgtcctaggcctgccttccacctccgaactagaccagaaattcacctcccgtttccccgtgcgcgccgagcgtttcaagctgcgccaacgagcgatccacgtcttcagcgaagcgttgcgggtgctcaagctcatggaccttcttgaaacttcctcttcttcgtcatcatcatcatcatcatcatcatcatcaacaattacaagcacaccaaaagacctcaacagccgcctaggtgccctgctcaacgagacgcaggattcgtgtcgcgaggtgtacgagtgctcatgtgaggagattgatcggatatgcgcgattgctcggcaggcgggcagctacgggagtcggttgacgggtgcgggatggggtggatgtagtgtgcacttggtgccggcggacaaggtgagtaatgtcaaggaggcactagagagggagtattatagcaagttagagttgacggaggagcagagggagggggcagtggtggttagtaagccggggtctggaagtgcgctttatttg

SEQ ID NO: 27803 - DNA, 1848 bp, Neurospora crassa
ggtaccaccaactccgccgttgccatcatggagggcaaggtcccccgcatcattgagaacgccgagggtgcccgtaccaccccctccgtcgtcgccttcactgaggacggtgagcgccttgttggtgttgccgctaagcgtcaggctgtcgtcaaccccgagaacaccctcttcgccaccaagcgtctcatcggccgcaagttcaccgaccccgaggtccagcgcgacatcaaggaggttccctacaagatcgtccagcacaccaacggtgatgcctgggttgaggcccgtggccagaggtactctccttcccagattggtggtttcatcctccagaagatgaaggagactgccgagtctttcctcagcaagcccgtcaagaacgctgtcgttaccgtccctgcctacttcaacgactcccagcgtcaggccaccaaggatgctggtcagattgccggcctcaacgtcctccgtgtcgtcaacgagcctactgccgccgctcttgcctacggtcttgagaaggagcaggaccgcattgtcgccgtctacgatcttggtggtggtaccttcgatatctccgtcctcgagatccagaacggtgtcttcgaggtcaagtctaccaacggtgacacccatctcggtggcgaggacttcgatatccacctcgtccgccacctcgtccagcagttcaagaaggagaccggcatcgatctttctggcgaccgcatggccatccagcgtatccgtgaggccgccgagaaggccaagatcgagctttcttcttccctccagaccgacatcaaccttcccttcatcactgccgactcttccggccccaagcacatcaaccagaagctcacccgtgctcagctcgaggccatggttgaccccctcatccagcgcaccattgagcccgtccgcaaggctctgaaggatgccaacctccaggctaaggagatccaggaggtcattcttgttggtggtatgacccgtatgcccaaggttgccgagtccgtcaagagcattttcggccgtgaccccgccaagtccgtcaaccccgatgaggctgtcgccatcggtgctgccatccagggtgccgtcctctccggtgaggtcaaggaccttctcctcctcgatgtcactcccctctccctcggtatcgagaccctcggcggtgtcttcactcgtctgatcaaccgtaacaccaccatccctaccaagaagtcccaggtcttctccaccgctgccgacttccagactgccgtcgagatcaaggtcttccagggtgagcgtgagctcgttaaggacaacaagatgctcggcaacttccagcttgtcggtatcccccctgcccaccgtggtgttccccagatcgaggtcaccttcgacattgacgccgattctatcgtccacgtccacgccaaggacaagtccaccaacaaggaccagtccatcaccattgcctccggctccggtctttctgaggccgagatcgagaagatggttgaggactccgagaagtatgccgagcaggacaaggagcgcaaggctgccattgaggccgccaacaaggctgatggcgttctcaacgataccgagaaggccctcaacgagtacgctgaccgtctcgacaagaccgaggctgacgccatccgtgagaagatcgccaacctccgcgagttcatcgccaagagccagtctggcgagcaggccctctccgccgatgccctcaaggagaagattgacgacctccaggttgccagcttgaacctcttcgacaagatgcacaaggcccgtgctgaggctggcgagcagcagcagcagagcactgagggcgagaagaaggag

SEQ ID NO: 27804 - DNA, 2016 bp, Neurospora crassa
tggtggaaagatggagtggtctatcaaatctacccggcgtctttcaaggactcgaatggagacgggttaggggatataccgggcatcatcagcaagttggactacatccagaatctgggcgttgatatcatttgggtttctccaatgtatgtgtgcgccagttgtcaaacactttgaaattgatggtgaagcgcgagtgctgacttgggttgtaacaggtttgagagtccacaggtaacaagcctcttcctcatcaacggttgtgttcttacgcgctgatgacctttttatataattcctacagcctgtttggaactactggctgacacgtctgatatgctagattgacatgggctacgacgtctcaaactatgaggaggtctaccccccgtacggcacagtcaaggacatggagaacctcattgaagcttgccacaagaggtaaacctcatgcatcgcaatgccataattggacctgtactaacgcgtatttaggggaatgagactggtcttggacctggttgtcaatcacacctctgatcagcatgcctggttcaaggagtcgcgatcctccaaggacaatccgaagcgtgactggtacatctggaagcctcctcgttacgccgaagatggaacacgccttccaccgacgaactggcggagttacttctcaggcagtgcgtgggagtatgacgaacatacaaacgaatattatcttcatctgtttgccaaggagatgccagacctcaactgggagagtgaagagtgccgcaaagccatttacgacagcgccatgcgcttctggttggataagggcgtggatggcttccgagttgactgtgtgaacatgttagtactctttatgccctgctctccttaaccaagaccagatactaactaacattggtttctttcaggtactcaaagtccacagaatttctcgatgctcccatcgttgactcacgcttctacgagcagccggcatggtgctattatgccaacgggccacgcatgcacgagtttctgcgcgagatgaatgaaaaggtgctcgaccgctacgacgctatgaccgtcggcgagttaccgcacactcccgacccgaagagggtgctcgactatgttgggcgcaaagataagcagctcagcatggtgtttcagttcgacattgtggacatcggccaaggtggcacccacaagtaccattttgaggagtggaagttacctgtgctgaagaagattgtcgagaagtggcaacgcttcatcgagggcactgatggatggacaacatccttctgcgaaaaccacgaccaaggccgttccatttcacgcttcgcctccgacgcccccgaataccgcgtcctctcgggcaagatgctctcgctgatgatgtgctctttgacgggaaccctcttcatctaccaaggccaagagatcggcatgatcaacgtgcccaaggactggcccatcgactactaccaggacatcgagtcggtcaacttttacaagctgatggccgccaagaccaacaacgaccccgaggagatggcgtacgtgatgcgcagcctccagactctgagtagagataacgcccggatacctatgcagtgggatgacagtccgtatgctgggttcactgaaaggaaggaaggtgcctgggcgcacgtccacgacctgtatcccgagatcaacgtggccaagcaactcgacgatccgaactcgacgctcagcttttggaaagacatgatccgtttccgcaagcaacatagcgaggtactggtgcatggaacgttcgaggcgtgtgatatcgagaacgagaagacgtttgtgttcgtcaagagattcggaggtaaacgggttgtagttactctgaacttcagcaatgaagagcaggaggtggtgttgccggagcatgaaaaggggttgaagtttatggtcggaaactatggcaacgaagaaggggggatgggcgaaaggagaaggttgaggccatgggagggaaggttgtacatggctgga

SEQ ID NO: 27805 - DNA, 1511 bp, Neurospora crassa
atcatgtactcgctcggctactccgggactatcatcatggagggttacggcatggcactcctcacgtatttcttcagcgtggaatctttcaacgcgaagttcggtgtcttcgacaccacgaccggaaaatatgaggtatgttgcactgctcagtcccatagtggttgggaccgtgtcgtctagaatagaggacaatgctaacacggatatctcatcagcttgcgtacaaatggaaggcccttttgcccttgttggcccaagtcggcgcgatcttcggcgtcgtccttacatcattcttcgtgaagtggtttgggtacaagcacaccgttcttttcatgctcatcctctgcgcggcatttggcttcgtacccttcttcgccaacaacgtcgtcatcttggcgatcggctgtctggcccagggcatcccgtggggcctatttcaagtcgctagtcccgcctactcctccgaaattgcttcattgcggatgcggccaatcttgaccacatggaacaatctttgctggatcatcggtcaactcttggcctctgccgtcgcctatggcttccatagtcttcaaaatgagtgggcctacagggtgcccttcgccctgaactgggtcttcatcgcctttctctttgttgccattttcgttgcccccgagtctccatactggtatctccagaaaaacagggtagaggatgctcacaaggccatcaagaagctcgtccgcaagggatccgaggaacgcacccaggagaagcttgctttgatgcagcacgccatctgccatgaaatgaagcacgttgccgacaaccagaccagatggcagagaatcagcgccatgttcagaggcactgacagaaggcgtaccgaaattacctgcaatacatggatgattcaagccctctgcggttcgagcctcattggttgggctcccaagctattcgagtctgtcggcatggcaagcgacaaggcactggccatgaacattgccttgccctgtgccggaattgtgggcacaattgcgtcttggtggttgatgcaaaagatgggacgtcgacggatctttttctggggcctaatcagcatggccatcgtgctcactgtgtgcggttccgcctcactagctacaactccggagtccgtgtccgctgccggagcgatccttgttgtgtatactgccatctatgacctgactatcggccccatttgctactcaattgtttccgatatcccttcggttcgcctccgcacagagaccattgctctcgcacgtggcctttacctggcggccaatctcttcaatctgttccttacccccaagatgctcggaatggactcgaagagctggaattggggcgccaagacgggttttctttacgcaggcatctgtggtctcggagctctgtacacgttctaccgcatcccggaaaccaaggatatctctgtccgaggactcagcattcttttcaacgagaaagtgaaggcgagcaaattcagcgctacgaag

SEQ ID NO: 27806 - DNA, 4337 bp, Neurospora crassa
gtagccaagcgagacaagtacgctgagctgcgcgaactgcgccagtccggcaagaagaagacctacgacgtcggcgagatcgacgagctctacgaagaagtcgacgagaaccagtacaagaaaatcgtcagagaccgcttgaacgaggacgatttcgtggttgacgacaatggcgagggttatgccgacgacggccgcgaagaatgggaccgtctcccccagtaccacagcgacagcgaggaggaattaggcctacccggcagcaagccgcgcaagtgtgagcagatcgagacgctgaaacccgacgatgggagcaacttataaagcactctggttctggtactgaccttcgttctcctccctcttagccaagaaacaaaaggaacatgaagatgcgaaacgagatgccaacgacagagacatcaccgaatacttcacgaaaggcgccgtcaaagccccaccaaaacaaaaggtcatcaaaacagaagaagatgaaaagttcttggacgacctcatcgaccaggtcaccgcacaaatccccgtcccggtcacacgagtatccaagaagcgagatcgatcagtcgagaggagaaaggtccgggtgctctccccggtacgggaacctcggccacccatggcaaagagagccaagacagtcgatgatcgggcatcatccccagcaggagacgacgaccttctaccagacgacgactacctgcctgctatggacgacgaacctgcaccagtctccgattatcttatgagcgacgccatcatgccctcctcaccggccgccaaagtagcaacacggaggacgtttggcaggccggaacccaaaaagaatgaggatgatgaggacgaagatgaggacatgatggaggttgcccatactggagcggtaacagccgccagcgtcaacatatcagcatcccgtcaaatcaaaaagattctcaagacagagcccgtcccggccagttcgtcacccgcaagggcaccagcgccagaggtcgacgctgcttcctggaacgagatcaatcagaagctcaatgtcgtatccatgtcacaaagcgagggcaggagcgttggcaagattgactacaaggacgctatcgaagaagacggcagcttgaacatgttctggacagactacacagaggtcaacggcagtttgtgcttgtttggcaaggtcctaaacaaaaagaccaaaacctacgtcagctgctttgtcaaggttgacaacattctccggaagcttttcttcctgccgcgcaagtaccgtgtgcgaggtggcgaggaaacaacagaagaggtggaaatgatggacgtctacaacgaggttgatgaaatcatgaccaagatgaatgtcggcatgcacaagatcaaggcttgcacccgcaagtacgcattcgagcttcccgacgttcccaaggagagccagtatttgaagctcctctacccatataccaagcctgcgatggaacccacccacaaaggcgaaaccttctcccacgtctttggtaccaataccgctctgttcgagcagtttgtgctctggaagaacatcatgggcccctgctggctcaagatcgaggatgcagacttcacttccttgaggaatgcttcgcactgcaagctggaggtcctggtagaacatcccaacatggtgtcggtcccggataacgccgagagtattgagcctcctcctttgacgttgttaagcctggctatgcgcacagcgttcaaccctaaggataataagcaggagattctcgcggttagcgggagagtctaccttgatgtgtcgctcagtgacaccactcccccagacaagcttgcttctcgtagtttcaccgctgttagaccttacggtagcgcatttcctatcggcttcgagacgcttgccaaggaaagaaacagaggtgtgctcaagctcttcaagcaggaacacgagatcttgaatttcttgctcgcacagatcgatgttgtcgatccagacgttatccttggccaccagctagaaggtgttgactacagcatcttgctgaaccggctgcacgagaaaaagacacatcaatggtctcgtttgggcagactcaggcgctctcagtggccctcgtccattgttaagatgggtggcaatgtatttgccgaacgtcagataatgtctggccgtctgctatgcgatcttgctaacgatgccggtaaatcagtaatgaccaagtgccagacctggtccttgaccgagatgtgcagtctgtatctgggaggcgaaagtcgtaggagggatatcgacaacgaagtcgccctgaagacgtgggctaacgctgacaaacatggtttgatggactacatctcccacgccgagactgacacttacttcatcgcggctcttgcactcaggactcaaattcttcctcttaccaaggttctcaccaacctggctggtaactcgtgggcaagaacacttaccggtacgcgtgctgagcggaacgagtacattttgcttcacgaattccaccgcaacaaatatgtcgtcccggacaagcagaccttcaagggtcggcaacgcatcgaggaggaaaacgcagaagaggaaggcggagaaggaggaaagaagaaggacaaatacaagggtggtttggttttcgagccagaaaagggtctttatgacaagttcgttctcgtcatggacttcaactccctttacccttccatcatccaagagtacaacatttgctttaccacagttgatcgaacatcactggtaagtcagggtccttcctccgttgacgtcacaagctaatgcaaagtagtccgaggacgatgatgctgttcccgaggttcccaaggagcaggcgcagggcattcttcccaagctgattgccacactcgttagccgacgtaggcaggtcaagtctctgatgaaagacaagaatgccacacctgaagagctcgccacctgggatatcaagcagctcgccttgaagttgactgccaactccatgtacggctgtcttggttataccaagtcgcgcttctacgcccgtcctcttgccgtgctcaccacctataagggtcgtgagattctgcggagcaccaaagaattggcggagagcaactcgctccaggtcatctacggtgacacggattccgtcatgatcaacgcgaacaaggacaacgttgctgaagccctgcgtgtcggccacgagttcaagaaggccgtcaacgagcggtaccgcctccttgagattgatatcgacaacgtcttccggcgcatcctcctccaagccaagaagaagtatgctgccatcaacatggtcgaggtcaacggcaagtgggttgagaaaatggaggtcaaaggtctcgatatgaagcgtcgtgaatactgcgggctatccaaggagatctccaaccgtatcctcaccgagatcctctcgggagacgatactgaggtgtctgtccaacgcatccacgagtaccttcgtgacatatctgccaagatgcgcgagggtgccgtccctgtgcaaaagtacatcatctcgactcagcttggtaaggcgcccaaggattatcccaatgccgactcgatgccgcaggtccaagtcgcccttcgcgagttggccaagggcaagaccatccgtaagggcgacgtcatctcgtacatcatcacaggcgacagcaagaccacctcagaagccgtcgccaagcgtgcctacacccctcaagacgtgctcaaggccgaatctggcctgtctccggacgtagaatggtacatcggcaagcaaatattccctccagtcgagcgtctctgcgccaacattgtcggcacgtcgacctcccaactcgcagaaaacctcggtctcgacgtccgccgctactcttccaacaccaacaacaactcctcaggcccacaagacctcgaaatccaccctctcgagtcccaaatccccgactccctacgcttccagtcctgtgcgcgcctctccctccgctgtcgcaagtgcaaaacctcgcaccccttcgagggcctcgcttccccatcatccgtcaacaacgtcacgccctccggcatccaatgcccctcatgccaatacgtcctccccatgctcagcgtcgtcgcccaagttgaagccgccgtccgcgcccaaacagcacgctactacgaaggctggctcgtctgcgacgactcctcctgcggcaaccgcacgcgccagatctccgtttatggcacccgctgtctcggatccaagggtctggcgcgcggcgagtgtggcggccggatgcggtatgagtacacggaacgggacatctacaaccagctggtgtactttgctagt

SEQ ID NO: 27807 - DNA, 1434 bp, Neurospora crassa
gccgaaaagaagaagcgcgaagcagaagctgcggcggcggcacaacgacaacaacagcaacaacaacaaaccggtgacgatgacgacgccaatgggcccccggccaagcgacgaagactctctcccgaccgcgacgcagcagcagcagcaccgacagcgagcagtaatgacagcagcaaactactacgcttcgaaggcggccgattcggcaagtgtcgcagcgtcgaaaactacgataagcttaacgacatcgaggagggcgcatacggctgggtggcgcgggcgcgcgagattgagaccggcaaggttgttgcgctgaagcgactcaagattgatccgaaggatcgtagcggcctgcccgtcactggcttgcgggagattcagatcttgaaggactgcagtcacaggaacattgtcaagctcaaggaggtggtggtaggcgacgacacgagcaagattgagaagtaggctacaatccctttctctaactttgccttttttttttctttccttcacgttctgtcggaattcgactaacgactattccatagcatctttatcgtcctcgaatttctcgaacacgacctcaagtccatcctcgaagacatgcccgagcccttcctcgcctccgaagtcaagaccctcctcctccaactctgctccggcatcgcctacctgcactcgcattatattctacaccgagacctcaagacctccaatttattgcttaacaaccggggccagctcaagattgccgactttggcatggcccgctacgtgcccgaccctccaccacccaaactgacccagctggtcgtcacgctatggtaccgcgctccggaactcctcctcggcgcggcccgctacgggcccgaaatcgacatgtggtccgtgggctgtatcttcggcgagcttcttacccgcgaacccttactgcaaggcaaaaacgaagtcgacgagctcaccaaaatctttgaactctgcggcttgccaacagacgagtcatggcccggtttccgccgtctacccaacgcccgctctttacgcttgccctcttcttcttcttcttcttcttcttcctctaaacccccttccacggggggcctaatccgcgccaaattcccgcttctaaccgccgccggcgtctctttgcttgcctccctcttatcgctaaacccctcccgtcgcccgacagcgtcggaaatgctggagcacgaatactttcgccaggatccgaagccgaaacaggaggccatgttccctactttccccagcaaagcgggtcaggaaaagagaagacggagagagacgccgaatgcgccccagcggggccagaaggtgcaggatttagggcaggtggattttagttcgctgggtgggattttcgggagtgggagggagagggaggagaggggtggggggtttagtttgaga

SEQ ID NO: 27808 - DNA, 1010 bp, Neurospora crassa
gcctttatagccggcggcatcgcagcctgcggcgccgtaaccgccacgcaccccttcgagaccgtcaagatccgcatgcagctccaaggcgagctccaatcctctacctcctcccctcacttctaccggggtccgatccacggtgtctccgtgatcgtgcgcaacgaaggactgggcggcatctaccgcggtatcgggtgcgcgtacatttaccagatcctcctgaacggatgccgcctggggttctacgagccgatgcgacacgcgcttgcgaccacgctctttaacgacgcaaagacgcaaaacctgggcatcaacatgtttgccggcgcggcgagtggcatcatgggcgccatggcggggtcgcccttctttttggccaagacgaggttgcagagctacagcccctttttgccggtcggcacgcagcatcagtacaagaacgcctgggacgggttgacgaaaatctacaagggggagggtgtgaaggggttgtacagaggtgttggggcggccatgatcaggacgggctttggatcttcggtgcagctccccacgtacttctttgcgaagaggcggttggtaaaacacttgggcatggaggaggggccggcgctgcatttggcgagtagcacggcgagtggatttgtggtttgcgtagtgatgcatcctcctggtatgtttttttttttttttttttttttttttttactcccctcctcttggctctcttcccccttgaccctcttctggcactctgggacaactgaaactaacaatgaacgaaattagacacaatcatgtcccgcctctacaaccaaaacggtaacctgtacaagggcgtcttcgactgcttggccaagaccatccgcgccgagggtttcttcgccatctacaagggcgtcatcccccatcttacccgcattctcccgcacaccatcctgaccctcagcttggccgagcagaccacgaagctggtcaagaagctggaggacaagattcttgggccc

SEQ ID NO: 27809 - DNA, 1292 bp, Neurospora crassa
acgagcactatacaggttacctccggtatccagaatctcaacatggactctcccgccaagaagctcgacttcggtgccaccgacaaggagaacaagcccttcgacgaggaccttgctaagctcgaagccgagatcgatgctgaacacaacgcgaacaagaaggccgccgaggccaagaagatggcccctaccctcaagcccgaggaggccaatgagcctctccttaccgagaaccctcaacgcttcgttctcttccccatcaagtaccatgaggtatgccacgcgtcccagacattccaaacaacgcgtaaagtggttcacggactaattggatatccacattacagatctggcaaatgtacaagaaggccgaggcttccttctggaccgccgaggagattgatctctccaaggaccttcacgactggaacaacaggttgaacgacgacgagaagttcttcatctcccacattctcgctttcttcgctgcctccgatggtattgtcaatgagaacctcgtcgagcgcttcagtggcgaagtccagatccccgaggctcgctgcttctacggtttccagatcatgatggagaacattcactccgagacctactccctccttatcgacacttacatcaaggagccctcccagaggacttatctcttcaacgctattgacaccatcccttgcatccgcaagaaggctgactgggctcttcgctggattaccgacaagagctccacctttgcccagcgtctcgtcgcctttgctgccgtcgagggtatcttcttcagcggtgctttcgcctccatcttctggctcaagaagcgcggtctcatgcctggccttaccttctctaacgagctcatctcccgtgatgagggtctccacaccgactttgcctgccttctcttctctcacctcaacaaccgccccagcaagcagctgatccaggaaataattgtcgatgccgtcagaattgagcaggagttcctcactgaggccctcccttgcgcccttcttggcatgaacgccgacctcatgaagcagtacatcgagttcgtcgccgatcgtctccttgtcgccctcggcaacgagaagatctacaggtcgactaaccccttcgacttcatggagaacatttctctcggtggcaagaccaacttcttcgagaagcgtgttggcgactaccagaaggctggtgtcatgaacagcaccaagaaggctgacgctgatgcggaggtggccaagaacgagaacggcggtgacttcaccttcgacgaggacttttaa

SEQ ID NO: 27810 - DNA, 1743 bp, Neurospora crassa
atggggttgagcgggctgccgctcaactttgcggtcgccggcattgctgccatggccttctggctgtttgggtaagacttgttccacttccttctagcttgactcgctcatgactacctgtaactaaccacgctcacggtgtctaggtacgacatgtcagtaatggtgagtacctgtaacatctccagcttcccctgccagcatagtaaagcagcagcagctaacgacctatcagggtggtgtcatcaccgagagcccattcacctccgtctttccctcgatggaagacccaaacatccagggcattgtcattgctgcctttgaactcggggccttggtcggagccctggcatgtctcgacattggtgatcgcctggggagacggtcaactgtctggttcggcatgcttttcatgttggtcggcggtattcttcaatgcgctgcctggcacgtcggtcagctagccactggacgtgtcatcagcggtattggtctcggtctacaggttgctaccgtgccgtcgtggcaagccgagtgtgcgaagccgcatagtagaggacgatggggtgagtaaatccatgagagacggaccttcgcatggaacttggtagctgacacagaataacaaagtgatgatcgagggcggccttcaaactttcggcgttgcttgtggacaattaatcggatacggcttcttctttgtcaaaggacaagcgcaatggcgtgtgccagtcggcattcagctcatcccagccttcatcgtcttcatctttatcaacttcctccccgagtctcccagatggctcatcaagcacggaaggattgacgaggtgagtggccttcgtctaagataccatacaaaatccatgctaagcaatagtccaggccacccacaacctcgccaaacttcgcggtctctcccccgacgacccactcctcctcgccgagcgcgacgccatcatcgcctcctacgaagcccaatcccaaatggccgtcttctcctacaaggagctcttcgacaacggccccaccaagactctctaccgcgtcgccatcggcaccttcttccaagccgcccagcagttgtcaggtatcaacatggtctccacctacgccaacaagatcctccaagagtccttcaatttgtctcccagcatgtcgcacctcatcgccgccatgggcggtctcgaatacgctttgtgctcgctcctctccgtgttgcttatcgagggtctcggtcgccgtcggtccttcatgatcaccgcggcgggcatggccgtttgcttcgccatcattgccgggctgactagcaccgctgataggacgtgtcagcttgtggctgcgggattcctctttctctttaacacgttctttggtctcgcctgggttggcggaccgttcctctacagtgcggagattgcacctttgcgatgccgctcgcaggccaatgccatcgctagcgctggtaactggttgttttgctttatcgtcgtcatgatcatcccccctgctttggcgaacattgggtggaagactgtaagtcctgtccgctctcccacttatttgcctgtgatggcatacggccgtccctttgaccagtcctgaccgctaactcacgatgtctattgacagtacatcatcttcgccgtcttcaacttcctcttcgtccctattatttacttcttctgtgtcgagaccaagaaacgctcgctggaggaactcgacgtcattttcgcggcgggc

SEQ ID NO: 27811 - DNA, 1959 bp, Neurospora crassa
ccagcgaaagagaaggcagaggaaggataacagattcgactcgctgggaatttgaacggaaccattgcgacgcccttttcccagagtatcgcaaccacccaccgacagtaccaacccccccacgccatcacgatggcttccgaatttagcaagaagcgcaagctcaaggacgccaagattgcgaccgaagatggcgccgccaccgacaagaagaccaagaaggtgaagaaggacaagaaggagaagaaggccgccgaagaggtcgtcgaggacgccacccccgaggaggagaacgatgcccaaaaggcggaggaacaacaagatggcgacgaggtcatccccaccggcaacggggacaaggaggacagcgacgacaaggacgctgaggccggcgacgaactcacaaagaccaacgactccctcatcgccccgtccatcgcgaccaatgccaccgacttctccgagctcaacctgtccgacaagaccatgaaggccattgccgaaatgggcttcaccaagatgaccgagatccagaggagaggtatcccgcctctgctcgccggcaaggacgtcctcggtgcggccaagaccggttccggcaagaccctcgccttcctcattcccgctatcgagatgctcagctccctgcgcttcaagccgagaaacggtaccggtgccattgtcgtcactcctacccgcgaattggctctccagatcttcggcgtcgcccgcgagctcatgaagaaccactcccaaacatacggtgtcgtcatcggcggtgccaaccgtcgtgctgaggccgagaagctgggcaagggcgtcaacctgctcattgctactcccggtcgtctgctcgatcacctgcaaaacactccctttgtgttcaagaacatgcgatcgctcatcatcgacgaggccgaccgtattctcgagattggtttcgaggacgaaatgcgccagatcatcaagatcctgcccaaggaggaccgtcagaccatgctcttctccgccacacaaaccaccaaggttgaggatctcgcccgtatctcgctccgtcccggtcctctttacgtcaacgtcgatgaggagaagcagttcagcacggtcgagggtctggaccaaggctacgttgtcgtcgacgccgacaagcgcttcctgctcctcttctctttcctcaagaagatgcagaagaagaaggtcattgtcttcttctcgtcctgcaactcggtcaagtactactccgaacttctccagtacatcgatcttcaggttctcgatctccacggcaagcagaagcagcagaagcgcacaaacacctttttcgaattctgcaacgccaagcagggcaccctcatctgcacggacgttgccgcccgtggtctcgacatccccgccgttgattggatcgtccagttcgatcctcctgatgacccgcgcgactacattcaccgcgtcggtcgtaccgcccgtggtaacaacaccaagggccgttcgctgctcttcctccagcccaacgagttgggtttcctcgcccatctcaaggccgccaaggtccccgttgtggaatacgacttccccaagagcaagatcctcaacgttcagtcccagctggagaagctgatcggccagaactactaccttaaccagagcgccaaggacggttacaggtcgtatctccacgcctatgcttcgcacagtttgcggtcggtgtttgatatccataagcttgacttggttaaggtggccaaggtatgttttctcttctctccctttttcttccccaacaccagaacagtcactaacgtactacaaaaacagtccttcggcttctccacccctcccagggtagacatcaccctggcctccagcatgtcgcgtgacaagaagcagacgagcaggagagcgtatggtagccagccgaagcagaaccgtcactaagcgaggcgggattcggtgttc

SEQ ID NO: 27812 - DNA, 2073 bp, Neurospora crassa
caacaagtcgatcgcagcatcgcattactcgaagagcgcatacaggcaggcgacgttatctatggcgtaaacactggctttggcggtagcgccgacactcgaaccgatgcaggaagcgagcccctgatgcgcctacaaggtgcattagttcagcaccttaacgttggaattcttacacatgccgacaaggaccgcgatgggagcaactcctgggcgggaaagccttacgacaacgagcttcttcgcagccatgctctcccgagtcctgtggtccgagccaccatgcttatacgctgtaactccctgatgagaggccattctggtgtccgaccgctgatcatggaaaacatcctgaagcttctgaacagagacatggtccctatcgttccgcttcggggaagcatttcggcctcgggtgacctatcgactctctcgtacattgctggcgctctcgagggaaatccagatatatacctcaaagccaggaagccacacaataggacggagatcttgccagccgacaaagctctgtcccttgctggcctggaacccgtgcgttttcaagtcaaggaaggactcggcatcaccaacggcacagcaccctcctgcgccactgcctctattgctatccaggaagccaaccagctggccgttcttgttcagcttctaacggctatgggtaccgaagccctggccggcacagcggcaaactatcatcctttcatctcctccgtccggccgcaccccggtcaagcagaagcagcatccaacatcctagcctttctcgctgggtccaaaatcgccgcaccctgcgaagcccatcccgaatctgaagacgaaccggctaaagtccggggtcttgctcaggaccgctacgctctccggaccgcaccgcaatggatcggaccacagctcgaggacctggagctggccacgaagcaggtacagacagaactcaactcgaccacagacaaccccctgatcgaccccacgtccgggctcatccaccacggcggtaacttccaggctatggcgcttacctcggccatggagaagaccttgctggcactgcagaacctgggccgcttgctctacgcgcaaagctcggagctgctcaacaacatgacgaacaagggactgccgcctaatctgtcggcggatgagccaagccagagctacacgtgcaagggcttcgacgtcaacatggccgcgtacatggccgagctggcgtacctggctaagccgatcagcccccatgtacaggtagcggaaatgaacaatcagagtgtcaattcgatggcgttagttgcggctcggtatgcactggaagcggtcgaagtggttaatttgatggctgcgacttacatatatgtgctctgccaggcactagacctgagagtgctgcagttagagttccgagaggccctatcggtgcgtttgcgagatctagttctctcccatgttgccaggcaaaggagtctcaagtccaaagaggaagagcacaagggcttgtccgaggttgacatcacggagagccaaaggcgtgccggcaagcttgcagagtgtatccttgaccaatgggacaagctagcctccctggacgtagcagagcgcgcgtccgtggcaactaagcagtcagccttggacgcccttgagcttcttcactgtgggacggagtacggtcgtagaacctggggattcagtgatttgcaagcctaccacttgaagaccgctcgggtggtggcagattgttatggtgatcaccgaaacgccttgctcgaaggaaagcaggacactcgacggtggctcagcggtggctcaacagtcgtctacgattttgtcaggaaggagttgaagactcctctgaacaggggcgtagttgaccatccgccgcttttaaaggagcagttgacgagactgaaggaggcaatccgcagcgaggcaggaacaagagccaaggagatagaggagggtaatgacttacggtcaaggaacaggattcttggaagcatggcgtcggagatttatgaggcgattcgcagtggggagttgtattcacggattatggcgttt

SEQ ID NO: 27813 - DNA, 795 bp, Neurospora crassa
ggccgcggtatcgggagggaaatggcgctcgagcttggacgtcgtggagccaaggtggtagtcaactacgccaacagcgacatctcggccaacgaggtcgtgcaggccatcaagaagatcggctccgacgcggtcgccatcaaggccaacgtcagcgatgtcagtcagattgagaggctcttccgcgaggccaagcagaggttcggcaagctcgacattgtgtgctccaattcgggtgtcgtctcgttcggtcacatcaaggacgtcaccccggaggagtacgaccgcgtcttcaacatcaacacccgtggccagttctttgttgcgcgcgaggcctacaaaaaccttgaggttggcggccgcttgatcctcatgggatccatcacgggccaggccaaggccgttcccaagcacacagtttactctgctagcaagggagccattgagacttttgtccgctgcatggctatcggtaggtggctgtcatggatacttctcggggataaatgctaaccacaagacacactgaaagactttggagacaagaagattaccgtcaacgccgtcgctccgggcggtatcaagacggacatgtaccacgccgtgtgcagggagtacatccccggcggcgacaagctcgacaaccagggtgtggacgagtatgccgctgggtggtcgcctcttcaccgcgtgggtctccccatcgacattgctcgtgttgcctgcttcctagcttcccaggatggcgagtggatcaatggtaaggttatcggcgttgatggcggcgcctgcatg

SEQ ID NO: 27814 - DNA, 1209 bp, Neurospora crassa
gacttctgggccggatacgtctccggcgccataggcatcgtcatcggcaacccgcttgacattctcaaggtccgcctccaagccggcggcggctcttcctcgtcgtcgtcttcctcctcttcttccctactacccaccccaatcccaaactcaaccccgtcaccaccaccatcagcagcagcagcagcagcagcagcagcagcagcaccgccaaccacctcaggcacaccatcaacaacctcgtggatccggcccttcctcaggggcactgctgccccggtcctcggctacggcgccctcaacgccctcttattcgtctcctacaacagaaccgaatcagccatcaaccactttgttttcggaatcgacccctctctacctttacaaacgggcgtcaacctctggagtacctggatcgcgggcgccgtaggcgggttggctacgtgggtggtgagcacgcctaccgagttgatcaagtgtcgggttcaacttgcagcagaggagcagcagcagcagcagcagcagcaggggcagcaaggatcgaggagggggacaatccaaggtagtagtagtagtagtagtaggaggaggaggagggggggaatagggattgtaggaacagagaaaaaagggtcatcatcatcatcatggcaagtcaccaaacacgtcctccgcacccaaggaatcaaaggcctttactttggcggggcggtgacggcgctgagggatagtatcgggtacggtttctatttttggagttatgagttgagttcgagatggatggtggctgctgctgctgcttcctcttcctcttcctcttcttcttcttcttctcaggccggaggtatcttgacctccgaagcaacccgcgtccttctctgcggtggactggcgggaatcatcacttgggcgagcattttccccctggacgtgatcaagacacgggtgcagacccaggggatccttccacttccacttgcttcgggttcgggtgttatcgaaacccaaggggagcaaactgcactcttggacaggacggcgagccagcggaagcaaaggccattgggagcttgggaagtcgccaagttgacctacagagagggcggggtcaagccgttctttagggggttggcggtctgtagtgtcagggctttcatcgtcaatgctgtgcagtgggcaatgtatgagtggatcatgacggaacttggg

SEQ ID NO: 27815 - DNA, 2759 bp, Neurospora crassa
aaacaggttaagcagaaccttcttgaggagggtaacttcatcaactacaagaagatgtccgagaacctcgccgttgtccgcagccgtctcaaccgccccctcacctacgctgagaagatcctctactctcacttggacaacccccatgagcaggacattgagcgcggtgtctcttacctccgcctccgccccgaccgcgttgcctgccaggatgccaccgcccagatggccatcctccagttcatgtccgctggcatgccctcggttgccaaccccaccaccgtccactgcgaccacttgattgaggcccaggttggtggtgagaaggatctcgagcgcgccatcaacatcaacaaggaggtctacgacttccttgcctccgcctgcgccaagtacaacattggtttctggaagcccggctctggtatcatccaccagatcatcctcgagaactatgctttccccggtggtctcctcatcggcactgactcccacactcccaacgccgccggtctcggtatggccgccattggtgtcggtggtgccgatgccgtcgatgtcatggccaacctcccctgggagctcaaggcccccaaggtcattggtgtcaagctcaccggtgctcttaacggctggactacccccaaggacgtcattctcaagctcgctggtatcctcactgtcaagggtggcactggctctatcgtcgagtactatggtatgtttcacttgtccaatcacgtttcccatttggttggatccatttttgggattccaacaatgccctgaacattccgccaatggcctcattcaaattcgtcaatgcttttgcagattattcagtggcattgcgattttctcgcattgcattgactggtctgtcaaatgcatcttgactttgtatggatgttattggttgggaagtcacggggcttggcagtataacctaccttttttcgtggggcgagctgccaacagtaactatcggccccaaaacaccaaaacgtcatccccgctcaacacgacgatgctaacaactacgcaggcgaaggagcttcttccatgtccgccactggcaaggtaagctaactccgccaaaaagcttatgtactgatcttcgctaacacctattgctaggctacttgcggcaacatgtacagttcttcccgacacttctgttgatgagcttttggatgtttactaactcttcaataggggtgctgagattggtgccaccacctccgtcttcccctacgacaaggccatgttcgactacctggtcgccaccaagcgttccgacatcgccgagttcgccaagacttaccagaaggagctccaggccgatgagggtgcggagtacgaccagcacatcgagatcaacctgaacgagctcgagcctcacatcaacggtcccttcactcccgatcttgccacccccatctccaagttcgcccaggccgccaaggagaacaactggcccgaggagctcaaggtcggtcttatcggctcttgcaccaactcctcttacgaggatatgacccgcgctgcctccatcgcccgcgatgccctcgaccacggcctcaaggccaaggctgctttcgtcgtcacccccggctctgagcagattcgcgccaccattgcccgtgacggccagctccagacctttgaggagttcggcggcaccgtcctcgccaacgcctgcggtccttgcattggtcagtgggatcgtcgcgacacccccaagggtacccccaactccatcctcagctcctacaaccggtaagaaactctccctctttcctttattgtgagaacgaggaatgctaattgcaattcatagtaacttcactggccgtaacgatggcaaccccgccacccactccttcgttacctcccccgaccttgttgttgccatgtccatcgccggctctctctacttcaaccccttgaccgacagcctcaaggacaaggacggcaaggagttcaagctccaggcccccactggtgctggtctccccgaccgtggctacgaccccggccagaacacctaccaggcccctcctgccgaccgcgccactgtccaggttcaggtctcccccacctctgaccgtctccaggtcctctcccccttcaacgcctggaacggcaaggacgccaccgacatgcccatcctcatcaaggcccagggcaagaccaccactgaccacatctccatggccggtccttggctcaagtaccgtggtcaccttgacaacatctccaacaacatgttgatcggtgccatcaacgccgccaacggtgaggccaacaaggtccagaacttcaccactggtgagtgggatgccgttcccgctgttgcccgtgactacaaggccaagaacatcccctgggttgttatcggtgactggaactacggtgagggctcttcccgtgagcacgctgctctcgagccccgtcaccttggcggtctcgccatcattacccgctccttcgctcgtatccacgagaccaacctgaagaagcagggtatgcttcccctcaccttcgccgaccccgccgactacgacaagatcagccccgaggacaaggtcgacatcctctgcactgagctcgccgttggcaagcccatcaccatgcgtgtccatcccaagaacggcaaggacttcgaagtcaagctcaaccacaccttcaacgacgcccagattgagtggttcaagaacggctctgccctcaacaccatggccaagaacgccaagaac

SEQ ID NO: 27816 - DNA, 1248 bp, Neurospora crassa
gcagcctcgatcccatcaacatctggtaaccacattaaagcgtcgtcctcctgcaccttcagcggctcaactggcttcgacctcctcaacaaaggacacagctcctgccaagagatcgtcatctccgacctccaagtacccgcgggcaagactctcagcctggacaagctcaatccaggaacgacagttaccttttccggcaaaaccacgttcccctacacttcctccggcttcgcgggccccctcctctccatctcctcctcctccaagctgaccatccgcggcctctcttcctctgtgttgtacggcagcggcgaaaagtactgggacggtttgggacaaaagggacccatcaagaaacccaagttcttccaggtgcacaatcttgaggattccgtgatcgagggtgtcacgatcctcaatgcaccagtgcaggtgatgagtatcaacggatgcaagaacttgacggtgacaagcttcacacttgacaacaaggcgggtgatggagactggaaggctggcaaaggaggaagaaacacggatgcgtttgatattgggtcatccagtaacatagtgattgacggcgcgaaggtgtacaaccaggatgattgtgtggctattaattcgggcacggtaagctttttccctcccctctctccttttctttctggggtaccttcggctaaccaaggtttttgcttcaaccaggatattactttccgcaatggtctttgctcggggggccatggtctgtccattggttccgtgggcggtagaagcgacaacaccgtcaagaatgtcctgtttgagaactcagtgattgcgaactcagagaacggtaagcaccctttttctccttggcttcaccgtcacttggcaacaggaggcatggattctaacgctccgacttgcgatacctcaggcgcccgtatcaagaccaattacggaaccacgggtctcgtctccaacattacttaccgcaatgtcaagctccaaaacatcaccaaatacggcatcatggttgaccagtcctacggttcttcctctaagaacgcgtcgccgactaatggtgtgcctatcaccgggtttacactttccaacgtgacgggaaatgttctgtcctctggcactaacatcttcatcaactgcggcgatggatcttgtaagcaatttgaatggaatcaagttgatgtcaagggtggtaagaagagctccaagtgcttgagagttccgtcgggcgcgtggtgt

SEQ ID NO: 27817 - DNA, 1231 bp, Neurospora crassa
tgcaaggctaacggtctccgtggtatctataatgccggagcaacttgctatcaaaacgttgtcctccaatcattcctccacaatcccatactacgcaacttctacctgagtgatgggcatcagtcaggcagttgcgacacaccccattgcctcagttgtgccatggacgatatgttccaggaattttatgccagcgaaacgacgaacggttataccgccgcaaatatcttgtccggattctggatcagcgagaacaaggcgtttgagaacttggtagccaacaaggagcaagatgctcatgagtttttccagttcatggctgaggaattacacgagagaaatggcgacggcaagagaccggaaattggcagtgagcatacctgcaactgcatcatccaccaaacatactacggaaagttacagacgtccacaacgtgccaaaactgtgggggcgtcaccaatcaagcccagagctttttggatctcagtgttcccttggaaaatttgacgcaaaaaaggggcaagaagaacttgacgaatggcgacggggtcgcatcgacaagaacgcaaaacagcgtgactctccaggaatgcttggacgaagaatacatcaaatccgataagtgcgagtatcggtgtcagaactgcaattcagtacagcaagcaagaagacagaccagtatcaagaaattacccaacgttctttctatccagctcaaggtcagattaccggaatccttcctcatgcacattccttactggccgttaccgctggcttcgcttggagacaacagaagctgacagttgccaacagaggttcgagttcaaacaagggcgtaatgatcgtgcccagaagatcgagacacctgtccagtttcctttacaactcaacatgctgccttatacgacacgcgcacgaacacaggatctcaaagataactacgagctacagcggtcctgcacttacgatcttctatgcgttgttgtgcacgttggcgacatggataccggacactacatttcttattgccgggttggcgaccaggtgagtctgactagtgaaccatgacacacatctagttcctgaagggttagacttgctgacccgctgcctttggcacatttatttaagtggttcgcatttaacgatcacaaagttgaactggcccagaagtctgatgtgctaaacgcaaaggcctatcttctcttttacattgttcggtccctgtct

SEQ ID NO: 27818 - DNA, 684 bp, Neurospora crassa
gctaacgcctttgcaactctactaggcctttgcggtatcctctccctcttctcttctttgcggtactgcctcggtgaccccgccgacaagaccaacatctactatgcgcttgccttcctcccctttggcttgtttttcgacttcatggatggcaaggtcgcgcgttggaggaagaagagcagcatgatgggccaagagctggactcgctggctgatctggtacgtgtacatcattattgcccacgctttcccaattcctcgaccccgaccctctccgggacatcaagcattctaactcacaacccatccaaccaacagatctcctttggcgtcgcacccgccgtcgtcgccttcgccatcggtatccgtacccccctcgaccatctctgccttggcttcttcatcctctgtggcctcacccgcctcgcccgctttaacgtgaccgcgaccgccatcccgaaggacgccaacggcaaggctgcctactttgagggcacgccgatccccacgacgctcggtctggacgccattatggcctactgggtgtcgcaaggctggattcatgattcacttccgtggggtaccatgttccagggcaccgcgctcgaattccaccccattgtcctcatcttcatgctccacggctgcttgatgacaagcaagaccattcatattcccaagcct

SEQ ID NO: 27819 - DNA, 1263 bp, Neurospora crassa
ggagctcgcaagatctccttcaacgtcagcgagcagtacgacatccaggatgtcgtaggtgaaggcgcctatggtgtcgtctggtaagttgatcaccacagatagtcctggcccatatgggagaaccacgaaagctgacaggtgattggaacagctctgcagtacacaagccttcgggccaaaaggtcgctatcaaaaagatcaccccttttgaccactccatgttctgtttgcggacgttgcgcgagatgaagctgcttcggtacttcaaccacgaaaacatcatctctatcctcgatatccaaaaaccacggagctacgagaccttcaacgaagtgtatctcatccaggtatgatcgcgtgctggctcggtcctccagaatgttatcatgttcctcactaacatggctggacatcctaggaactgatggagactgacatgcaccgcgtcattcgtacccaagagctctcggacgaccattgccaatacttcatttaccagacgctgcgcgccctcaaggccatgcactctgccaatgttcttcaccgcgacttgaaaccctccaaccttttgttgaacgccaactgcgatttgaaagtatgcgacttcggtttggctcgctcggccgcgtcgcaagaggacaactcgggcttcatgacggaatacgttgccacccgttggtaccgcgcccccgaaattatgttgacgttcaaggagtacaccaaagccattgatgtctggtctgtcggctgcattttggccgagatgctgagcggcaagccactcttccctggcaaggattgtatgtgtcatgccatcccaaattccaacatatggcagctctacggggttgagactaacgcgcgttacttgtgacagaccaccaccaactgaccctcatcctggacgtcctcggcacgccaaccatggaggactactatggcatcaagtcgcgtcgggcgcgcgaatacatccgctcgctacccttcaagaagaaggttccctttcgcacgctgttccccaacacgtcggagctggccctggacctgctagagaagctccttgccttcaaccctgttaagcgcatcacggtcgaagaggcgctcaagcacccgtacctggagccctaccacgacccggatgatgagccgaccgcgccccccatccccgaggagttctttgatttcgataagcacaaggataacctgagcaaggagcagttgaagcagttgatctaccaggagattatgaggtgaagtgtc

SEQ ID NO: 27820 - DNA, 935 bp, Neurospora crassa
acccccgtctttctgttgaagacaaaatccactcctggggactcgtaccaggagcaattctcttccgagacggatggctttaatttcgagcctttctttgttcccgttctggaacatcgattcaaggacgagggcttagctacggtgcgcaatcttctcaagacgaaagctataggaactggcttcgactgtgcttacggaggtctggtcttcacctcccaacgtgccgttgaagccttcacccacctcgtccaagaagtaacaggtaagacgtactgcatccatttcaaaaggccaaacctcataacagctgtgtaggcgatgacaggtggccccatctccaagatatccctgtttacagcgtcggccctgcgacaacccgtgcgttaaaggcagttccccaacgaccgccgctccaagtctttggtgagcatactggcaacggtgaaacattggcaccctacatcatcgaacactatggcgaatggtataaagaccggtccatcaagccgccgctgttgtttctggttggcgagcaaaggcgggatataattcccaagaagttgatggaccctgctttaccatcagacaagttcattcgcatcaaagaggtcgtcgtctatggtaccggtgttatgaaatccttccaacaagatttcacaaagcttctccaagagacccaagaccggccggcgagatgggtcgtggtgttctccccaagtggctgcgacggcatgcttagtgccctgggatggctgaacgagagtagcggcagagtgggagacgactttcaacaggaggataggaaaacgtacattgctaccatcggaccgacaactcgccttcatcttgtcaagaactttggctatgagcctgatgtctgcgcggagcaacccagcccggaaggggtttggcagggtatcagtaggttttgg

SEQ ID NO: 27821 - DNA, 1686 bp, Neurospora crassa
tcagtccacggcctgccaggagacttcaacctggttgctctcgactacgttcctaaagccggtttgaaatgggttggtagcgtgaacgagctcaacgctggtatgtctacttctctattcccaccagcatgatcgctgatatcaaacaactttagcctatgccgccgacggctacgcccgtgccaagggtatctctgcccttgtaaccaccttcggtgttggcgaactatccgccatcaacggtgttgccggtgcttactctgagcatgtccctatcgtccatatcgtcggctgcccttcgaccatctcccagcgcaatggcatgcttctacaccataccctcggcaacggtgacttccacgtttttgccaatatgagcgaaaatatctcttgcgacgttgccaagctagttaaacctagtgagatcgcctaccagattgaccatgcgatccgggagtgctggatccgcagccggcccgtctacatttggctacctaccgacatggttgagaagaagatcgagggcgctagattggacacagagattgatctctccgagccggagaatgatcccgacagagaagactatgtcgtcgatgtggtcctcagatacctccatggagccaagaatccggtggtcctggtcgacgcatgcgcaatccgccatagggttaccgaagaagtcaaacggttcatcgaaaagaccaagcttccggtgtttgttacacccatgggcaagggtgccttcgatgaaacgtccgagcactacggtggtgtctatgctggcaccggctctcttcccgaagttgctaagcgcgttgagggctctgatttggttttgtccattggcgcgatcaaaagtgacttcaacactgctggcttctcgtatcacacctcacaactgaataccatcgatttgcatagcgaccattgcactgtgcgctactccgagtatcctggtgttgcaatgaggggtgtgctccggaaggtcactgagcgcatcgacatgtccaaactctcgataaccccttctcccccggtcgagaatgctgtagctgagaacagggatgactcgcaggccatcactcaggcgtggttctggccaagagtaggcgagtacttccaggaaggagatgtcgttgttaccgaaacgggcacagccaacttcggcatctgggaaagcagattccccaaggacgtcatgggggtgacgcaggtactatggggaagtatcggctggtcggtaggcgctgcccagggcgcggcactggcagtgaaggatcttgaacaagataggcgaacaatcttgttcgtgggtgatggcagttttcaactgacttgccaggaagtcagcacgatgctgaaacataacttgagggtcaccatgtaagtgcttccgttttttatctctcgtatcttgtttagggttagcttgacgagcttcgactaactggattgcctcaaagcttcctcatctacaacgaaggctacactatcgaacgttacatccatggcatggacgcggattacaacgatgtcacccgctggaactataccgatatccccgcggtctttggcgccaaggaaggccagtctcagaagttcgttatcaagacaaaggatgagttggagaggctcctcaaagacaaagatttcaacgagtataaaggcctgcagtttgtagag

SEQ ID NO: 27822 - DNA, 3312 bp, Neurospora crassa
cccaaaacacaatatgagttgatgcgtgacaataactttgagcatctgcaacatcaggatgccgacgaccaacgagccactcagagactgcgcttcaaacctaatcagttgggcgacaacgcggtggccgataatggcattttggaaagcatcacgtgcatcaacttcatgtgtcacactcgactacactgtgaactcggcccgcttctcaatttcatagtgggtgaaaacggaagtggaaagagcgccatcttgaccgctatcactctttgtcttggtggcaaggccagctcaaccaaccgcggaggaagtctcaagagtttcgtcaaggagggcaccgaaaaggctgttctgatcgtcaaaatcaagaaccagggccaagatgcctatagacatgagctttacggggattccatcatcgtcgaacggcacttttccaaatccggcagcagcagcttcaaggtcaagacggccactggccaaatagtgtctaccaagaagcaggaagtcgaggagatcgtcgaatactacgccctccaggtggataaccccttgaacgtgctgtctcaggacaatgcccgtcagttcctcaactcgtcaaccaagcagcaaaagtacaagttcttcatcgaaggtgtacagctgcaacagttggacaatgactacaggctaatcgccgagagtctggagctcatggaatccaaaattcccgaccaagaggagcgggtcaaagcagccgcggaggaactcaaacgagcaaaaagcttcaaggacgccatggacggaaatcgcaagctgagagccaaacaacatcagcttcgaagccagatgtgttggctccaagtggttcaagaagaggccaagctgacaaaattggacgagaagattgcccaacttgcggatcaaatggctgaagtagaccgtcagagaaatgaaaagggcgtcgatttggagcgcgtcgagaatcagatcagggcctttcagcagagactggaagaggctatccagcgaaaaaccgaattcgaagagcaggtggacgaggggaggaagaaagctcaagcaatcagggacgaacttgcacaaatccaagcagatgaacgggcagcccaccaaaacttgagaagtgcagccacgacagtaaaggacttcgaagaaaaggttgcggccgaagaaaagcgacttgaggaagccacaggagaggcccttctttccaaaactcgggagcttgaaaaggcaaaggagtacgtcacagaggtcgaggccaagatttccaaggccaaagaggacgagaaagacctactcaacaagcgagacgaagcccagaaagcccgagatgctaaggctgttgaatgctctctcaagcgggacgaaattaccgtagcggaacaggagttgaggacctccgaaaaggatcaaggctctatctatgcagcttatgagcccaaacttcctgaactgctgaagatgattgagaaagagaccagattccagaagaagccggtggggccgcttggcgcccacatccagctgctgaagccggagtggtctttgatcctggaaaagacgtttggaaccgcccttaatgcattcatcgtccagagcatggccgaacaaaaattgcttcagggcttgatgaacaagctcaacatccgccagtgtccggtttttatcggcaatcgacatcccctaaacacagatggcaaagagcctgatccttcctttgacaccattctccgtgtgttgaagatcgacaacatgatggtgcgcgatcagttgatcatcaaccacatgattgagcaggtcatactgataccacagcgtaccaaggctgaggacatcatgttcagcggagcacgacctcgaaacgtcaaggcttgtctaagtttccatgataaaaagagagacgaaggtcttcgactggttgtcaacaacagcggaggaatgtcgacttctcctgtgccgcccctccgtaaccagcgcccacggatgaaggcggatatcggctcgcggcttgcttatcaaaaggagaccctgcggcagctggagctagagtactctgtacttgatcgtgaacatcgtcaactgcagcaagaggtccagaagatcatcagcgacctcaccaagctccagagagacaagaaaacccttgacagcgaattacggcatgctagagttcaagtcgagcaagtgcagtatcgacttgatgagtatgaaggcggtgattctcgccttacaggcttgaaggctgaattggctgctgccaaggagaaagaggaggcttgcgggcttcagtacggcaaccttcggataaggaaggatgagaagaaccaggcatctacagaagcccaggctcagctcacggaaatcaggaaggaatcggagaaatatgaaagggaggtgaaaaaactgcaggagaagaaggctaggctggaagatgttcggaagattaatctcaccgaggttaatgaagctcatgcctctttcgagatattcaagggggacaaggaggaggccgagaaggaacgtgaaaaaggtgccgaagacgtcgccacttttacaaaacagatcattgaagcattagggagtgaagaacgagcccatgtcaacccaaccgacaagtacgaggagctggaaaagcagtatcaaagcattcagaaccaactcgagaaagagcgacggaagaggggcatgaccgacgaggaagtttatgcgaacctcacgagggcgaaagagacgtacgatgatgccaagagatctcttgaaggcatcaagacggtcaactctcgtctccgtcggacgctgaccattcgcctcgagaagtggcgcaagtttcagcggtacatttcatcacagagccgggcgaacttcatctatcttctcagcgagcgtggcttcagaggcaagttgctgctggaccacgagcggaaggctctggacctagtcgtcgagcctgacaagaccgagaagagggcagcggggagaaacacgaagacactatctggcggcgaaaagtctttttcatcaatctgtctgctgctgagtatctgggaggccatgggaagcccgctcagatgcttggatgagttcgacgtgttcatggacaatgtcaaccgtgcaatcagcacgaacatgctggtgagttttattgatgacggcaacgatggagacaagcaatggtatatccatgaaccgttgctaacgtggccacagattactgctgctcgtcggtccgtaaatcggcagtacatattcatcacaccgaatgccatcgaggggcggaacactcttgacaaggacgtcaagattattcgg

SEQ ID NO: 27823 - DNA, 1560 bp, Neurospora crassa
gagaaggatctcgtcatcattggaggtggcgtcgctggctatgttgctgccatcaaggccggccaggagggtctcaaggtgcgtcgcatcgcgaatcaactacaccgcaacaccgacgaatgacgacaatatctgactgctatctcccatgttgcctggaaataggtcgcctgtatcgagaagcgcggcaccctcggcggtacctgcctgaacgtcggctgcattccctccaagtcgctcctcaacaactcccatctctaccatcagatcctccacgactcgaaacaccgcggcatcgaggtcggcgatgtcaagctcaacctcgcccagcttatgaaggccaaggaacagtccgtcagcggtcttaccaaaggtgtcgagttcctcctgaagaagaacggcgtcgagtacatcaagggtgctggcgccttcgccgatgagcacaccatcaacgtcaagctcaacgacggcggcgagacctccgtcaagggcaagaacatccttatcgccactggctccgaggtcacccccttccccggcctcgaaatcgacgagaagcgcgtcatcagcagcactggcgccattgctcttgagaaggtcccggagaagatgctcgtcatcggtggtggcatcattggtctcgaaatggcttctgtctggtcccgtctcggcgcccaggtcaccgtcatcgagtttctcgaccagattggcggccccggcatggaccttgaggttgccaagtccatccagaagatcctgaagaagcagggcatcaacttcaagaccggcaccaaggtcgtttccggtgacaagactggcgagaccgtcaagctcgaggtcgactccgccaagggtggcaagcccgagactgtgagtggcccatgataccctgcaggctatctgttcgttgtcgtgatcttcaaagctgacattgttcgaacacagctcgagggtgacgttgttcttgtcgctattggccgccgtccctacaccgagggtctcggccttgagaacattggactcgagaaggatgagcgcggccgtgtcatcatcgactccgagtaccgcaccaagatcccccacattcgctgcgttggtgatgtcaccttcggccccatgcttgctcacaaggctgaggaggaggctgttgctgtcgtcgagtacatcaagaagggttacggccatgtcaactacggctgcattccttcggtcatgtacaccttccccgaggttgcctgggttggccagtccgagcaggaactcaagaaggctggtgttccctaccgcgtcggtaccttccccttcagcgccaactcccgtgccaagaccaaccttgacactgagggcatggtgaagatgatcgccgaccccgagaccgaccggattctcggtgtccacatcatcggtcctaacgccggtgagatgattgctgagggtacccttgccctcgagtatggcgcttccagcgaggatattgcccgcacctgccacgctcaccctaccctcgccgaggctttcaaggaggcggccatggccactcactcaaaggccatccacttc

SEQ ID NO: 27824 - DNA, 1098 bp, Neurospora crassa
gacaccgtcatccgaaagtatcgtgaactcaacgagcgcatcaaggcggagggactctatgactgcaactatgttgcttacgccatcgaaggattccgctatactctcctcttctgcgggtgtcttctgttcctaaaatggggttggtacgttcctagtgcgttctgtctcggctctttctggcaccagctagtcttcactgcccatgacgccggacacatgggcatcacgcaccatttccatgtcgatactgtcatcggcatcatcattgccgacttcatcggtggtctcagtctaggttggtggaagcgcaaccacaacgttcaccatatcatcaccaacagccctgagcacgatccggacatagaacacctccccttcttcgccatttcccatcgtttcttcactaatctgcggtccacatactatgaccgtgtcatggagtacgacatctttgccaaattcttcgtctccctccagcactacctctactacatcatcatgatgttcgcccgcctgaacctctaccgtctctcgtgggagtacttactcaagggccaggcacccaagcacggtcctgcctggtggcaccggcatctcgagcttgtcggtcaggtcttcttctggtgctggttcggttatgggatcatgtacaaggcaatcgatggcaactggaaccgctttgtttttttcatgatctcccacgcggtcaccagcccgttgcacgtgcagatcactctgtcacacttcgccatgtccacgtctgatctgggccctcatgagtccttcccgcagcgcatgctgcgcaccaccatggacgtcgactgccccgagtggcttgactttttccacggcggcctccagttccaggccattcaccacttgtacccgcgcattcctagacataaccttcgtaagacgcagaagctagtccaagacttctgtaacgatgttgggatcccttatgcgctgtacggatttgtggaaggcaacaaacacgtcatcgggaggctagctgatgtagctaggcaggcagctatcttgaggaagtgccagcagactattgttgatggcagcatcggacattctcatgctcac

SEQ ID NO: 27825 - DNA, 2193 bp, Neurospora crassa
ctgtcactgcgtgagcaagagaacgtggtcaacaagattgaaaaggaaaactttgggttgaagctcaagattcacttcctagaagaggcgcttcggaaggcaggacctggcttcagcgaggctgcgctcaaggagaatacggagctcaaggttgacaaggttaccatgcagcgagaactgcagcgttacaaaaagacccttagcacggcggagaaggacctcgaaaagtatcgagcccagatgatggaaatgcaagagaaggcggccaagaaattttcagatgggaaccagcgtgccgaactggaccgcttgcgccagttggtggaggagaaggaagccgagatacggcgccttcagcaactgctcgagcagggccagggcgagaacgaaaaacttgaggagctacaggagcacattgaggaagaggcagaggagttgagggagaaggccgctgagtttgaagaacaactaaaagaggctcaggtgcgaatcgccgaattggaggacaaggcagcctctagcgacgtgctacgggaagcccaggaaaccatcgaggatcttcagcacgatgtgaggcgtctcgagcagcagctggacgacatgaaggacaaggcggaggaggccatttcacagaaggacagggcggaggcggacctgcaagagctgcagaatgagatggcgaacaagtcggtcattaccaagggcctttcgcggcaggttgaggaaaaggttgcccgcctacaaagcgaactggagactgctcggcaagaatgcgtgacggtagcacaacagcgcgatgcgcaatccgcccaggttgagaacctcaagtcgacccttcgccaagtgcagcaggagcggcagtcactcgagcaaacccgcgcatccatggcagctaggctggaacgagggcaggcgcaactcgatcagctttccagcgaaaagcaacttttgcaggagcgtcacgatgccatggcaaatgagtccgcctctttgcgacgcgaaatgtccggattgcagactgcagtctcagcgctcgaactgaatatggaacgcgaacggcagaatgcgctgaatatcgaacagaacatccgggcacagtacaaagacgagatggaccgtctaaacaaccatgccctcagtgtcgaacagaatcttcgggctcaatacgccgaggagatgaagcgactgaacaatgaaatctcggatctccaggccgagtgccgcgaaaaggataatctgtacgataacgacagtgagaagtgggaagctgagcgtcgaaaactcgaagcggagttgaacagggcccaggagcgggcttctggcctccaagtgtcacttgatcagctgcggcagacggaagggaacctgtccaacaaggaggcaaggctacagcacgctcttcagctggaaaatgagcggcacaagagagaagaggcacttctgagccggcaaatccaagaactgcaacagaaccttcaatctcgtcaagcaatgctcgaggacctccgaaaggaaatgcgccaagtgcaagaccaacatcgccagacccagctggattatcaagcgcaaacggacaagattgcggcgttggaggatgaagtagaggttctgcaagctgctctggatgaggagtctgagagagctggccaggacctcgaaaaactacaagaagaatgcatggatctgaaacagaaacttgcctctgcccaggccacatcgagtgctgccagagcttcgatgaatacctcgaattccaatgctccgacgtacaatgaaagtcaagcgagtctaagaatccagctggcggatgccaacgagaatctagcccgcatcatgaaagagcagaaaatgctacaagaacggtacaacaatcttgatgccgaggcgcgttcactgaggataaacctatcccacgccacggcagagcgtgacgaattagaggcggagcttcaacagcatagggaccaaggtcctgatcaggacacattccagcttgaccaggagaagcttaatttgcgctctgcgaagacaaggctggataatgaaatccgtaggttaagagaagaaaatcggtccctgcttgagcgacagcgctcgatgcagaaatcgctcgaagaagagattgagaaggcgtctgctgaagaagagcgcctcaaccaggaaattcttcagctccaagccaaggttcgcgat

SEQ ID NO: 27826 - DNA, 1796 bp, Neurospora crassa
agcaatgggacacgcataccaggcgactggtcatgggtcgtcctcggagccaatccaaaccgcctcatgcacggcctactccggaatcatcggcaccccgccgttctgatgagcatacacacactcgccaatcctccttcaccatcagcgctgctgccgcatcaagtgcactcaacgcattgactttgagggataacaacgagcgctcgccgttggaagggggggaaggacttcggctaagaacagctccgctacagacaccaaggaggaggcctctgcctgcgacggggaacacagatgaggaagacactgcatactctgcgaaaggaagcgcaacaacgaccagaaaatcgaacagaaagatgtccgatccaacgctggcccaacggaagcccatcagccgaacttcttacctaacaagcacggcaaggcctgcgtcgggcagatcggcaacgacacaggatgttgatacacctcggatgagcgctaaggcaaggggcaaaaagcttgaacaagtcccaatttcgtcaagttctgaggattctgaatatggaactccccgacggccgacaacaagacagcacctaagacagatactgaagcagagggatgtttccctggttgccgatacaccggcccacaactccgaaagtcaagaatctgaaggcaacgatggggcggctcaacaaaggtcagaagctgccaagtggaacaagcaaaaggcaaagatattgcgccgtcttcctccaggggttgatgaacatgctgcaaaacagattctaaacgaaatcgtcgttcagggtgatgaagttcactggaatgacatagccggcctcgaggtagccaaaaatgcacttcgggagaccgtagtttatccttttctccgaccggacctatttaggggtcttcgcgagccggccagaggcatgctgctttttgggccaccgggaacaggaaagactatgttggcgcgcgcagtggccacggagtccaaatctaccttcttctccatctctgctagtagtctgacaagtaagtacctcggcgaatcagagaaacttgttagggcactgtttacgctggcaaaggtattgtcgccgagcatcatttttgttgatgagattgactcgctgctgtcgcagagatctggctctggggaacacgaggccacgatgaggattaagacggagttcctcattcaatggagtgatcttcagagagctgctgccggcaaagaacctgcagcaacaggaacaaaggaaaacggcaccgatgatgatgtgaacagagtcttggtgcttgccgccacgaatctcccgtgggctatcgacgaggctgcaagacgacgattcgtgaggagacagtatatcccacttcccgaagctgatacaagagcaattcagttcaaaacgctcctcagtcagcaaaagcatacactgaccaacgaggatatcaatgagcttgtggatatgaccgatggtaagtggcgctacccgttcgtgaatgtttcgccagccaattaactccctggccgggctgcccgccaggtaccttttgctaagcacgtgcacctcgcaggattttccggatccgatatcacagcgttagctaaagatgcggccatgggtcctttgcggtctttaggtgaagcgttactacaaacgaccatggaccaaatacgcccaatagagctaaaggatttcgtcaccagtctggctaccattcggcctagcgttagcaaggcaaacctgaagttttatgaagattgggcaagagatttcggagaaagaggcggt

SEQ ID NO: 27827 - DNA, 907 bp, Neurospora crassa
cagacccgtatgcaaattgtgaactcgaacccttccgcggtctatcatggcgtcatccagagcacctatcgaattgcttcgaccgagggcatcttcagcttgtggcgcggcatgtccagcgtcattgccggagccggttagttcgcctctccgtctctccggatctcgcggctaccaactaatgtcaatctgataggccctgcgcacgccgtttactttgcgacttacgaagcggtcaagcacttgatgggcggtaacaaggttggcgagcatcatttcctcgctgctgccactagcggtgcttgcgcgaccatcgccagtgatgccctgatgaaccccttcgatggtatgcccacccatatatgcctatacactctgcggacccatacacgtaaaagcgtagttctaacgcagtcgcaacacagtgatcaagcagcgcatgcagatccagaactccgccaagatgtatcgctccatgctcgactgcgccaagtatgtttaccggaacgagggtctcggggctttctacgtctcgtaccccaccacgctgtcgatgaccgtccctttcaccgcgcttcagttcctagcctatgagtcgatatcaacctcgatgaaccccaccaagaagtacgacccagcgacacactgccttgctggcgccgtagctggcggcttcgcagccgcgcttacgacgcctatggatgtgattaagaccatgctgcagaccagaggcgcggctcaggacgctgaggtcagagccgtgaacggctttgtggcggggtgtaagctgctgtacaggagagagggtgtcaaaggcttcttcaagggcttgaagcccagagtgttgaccaccatgccgagcacggccatctgctggtcggcatatgaggcgtctaagtacgttcat

SEQ ID NO: 27828 - DNA, 3272 bp, Neurospora crassa
ctcaacccgagccccgcgcgtgctccttccgttgcccctacgaacatgactggcatgcgtagcggtgattacggtcttggtcccaagggcgatcaatacaagggacaggtcttctacaacgctgaaggccaactggtttcggaattagagcccgaccttgctgagggcaagaagatcgaggagcggcctatctcctcccaaaggaaaatttgggtctttactgtttgggctttgacgtggtggattccatctccattactcaagttcgtcggtcggatgaagcggcctgacgtgcgtatggcatggcgtgagaagtttgttctctgcctcattatcgttcttctcaacgccatcatcgttttctggattatcttcttcggtcgtcttctttgccccaatttcgacaaagcctggactctggaagaaattcagaatcatgcggcaggggatgacttctgggtcagcattgacggcaaggtttacgacatcaccaaattctggagattgcagcacagcgacaacaacattgacaccacgtcggatgtaatgatgccgcttgctggccaagacctctccgcttactttgtcgcgcctctctacattacctgccccggcctcggcatcgcggattcaactacgttgcaattcaacactacccctgaatatgttgtggcccagcatatctccggccccacgcagcctaatattcggagcaagctctctgaaagatactggtataccgagagattcttgcctgccatcaaggagtactaccatggcgacgtggtttgggattccaagaagattaagcaggaaggcctggattggaatcacccgtggttcatctacgaggatctcgtttacgacatgaccgattacatgtacaccgccaagcgtatgaataacgatgctacatacacgttcatcgacgccaagatcaccaacatggtcaagaacaaccccggccaggacttgaccgagcagattaacgacctgattgatcgcgccagtagcaacacgacccagtataatagtgttatgaacagtcttaactgtgtcaagaacgcgttctacgttggcaagcccgatttccgttattcggccaggtgtcaagtcaacaactacatcttgcttgcattttccgttattatctgcagtatcatcgtggtcaagttcgtgtcggctcttcaatttggatccaagagacgccctgctccccaggacaagtttgtcatctgccaggtgcccgcttataccgagggtgaagactcgctgaggaaagccctggactctttgacagccctccagtacgataacaagcggaagctgatctttgttatttgcgacggtgtcatcgtcggtgctggcaacgaccgtcctactcccaagatcgtcctcgatattctcggtgttgaccccaaggttgacccacctgccttggccttcaaatccgtcggtactggagccgaacagctcaactacggcaaggtctactctggattgtatgaatttgaagggaacgtggtaccttatatcgtggttgtcaaggtcggcaaggagtctgagcagtccaagacgaagcccggtaaccgtggtaagcgtgactcgcagattctgctcatgagcttcctcaaccgcgtccatcaccgtgcgcccatgaatcccttggaactggaaatcttccaccagatcaacaacatcatcggtgtggatcccgaactttacgaatacctcctcatggtcgatgccgatacctgcgttcgcgaagattctctcaaccgcctagtggcagcctgcgccaataacgccaagattgccggtatttgcggtgaaaccagtttgcagaatgaggatctttcgtggtggaccatgatccaggtttacgagtactatatttctcatcacttagcgaaggctttcgagtctctctttggcagcgttacctgtttgcccggttggtaagttttgccgttcctccgctcactgattgttgtaggcaatactgacaattcaatagtttcaccatgtaccgcttgcgtactgttgacaagggaaagccgctcattatctcggatgatattatccgcgagtacagcgattgctatgttgacaccctccacaagaagaacctgctctcgcttggtgaggatcgtttcctcaccacgctcatgaccaagcacttcccatacatgtcttacaagttcattcccgatgcctactgccaaacggccgcccccgagacttggagcgttctgctgtctcagcgtcgtcgttggatcaactcaaccatccacaacttggctgaattgatcttcctcgacgaaatgtgcggtttctgtttcttctcaatgcgcattgtcgtcttcatcgatctcttcggtactattattcttcccgccacttgcgtctacatcgtttatctcatttacacggcctcctcccacactgcaccgttccctcttctttcgatcatcatgattgcggccgtgtacggtctccaggcgctcatcttcatcctcaagcgccaatggcagcacgtgggctggatgatcatctacctcctcgccttccccatttactccttcatcctgcccatctactcgttctggcatcaggatgacttcgcctggggtaatacgcgcgttgtcattggtgaaagcggtaaaaagcaagttgtcgccgtcgacgaggagggcttcaacccccgtgccattcctctccagcgctgggacgaatatgccctcgccaacaaccttcccggtcgtcgcggtggccctcttgagaagggtatggacgagcatctgggcggtatgtacgaggagacctacgaggtcgatgacatgaagtcagtctactcttcggtccgccaaccgtccgttcttactgggttcggcggtcgcggtgccggagcttacatgccccctcacagccctggtttcccgcccaacggcggcggtagcggcgccatgacccatgccagcacctttgtcggcgcctcccctttcaccgagcagaacaacctcatgaaccgtcagagcatggcctcgatgggcaccatggtcgagatgcagcgccgcgccagcccgtaccaggacttccctggcggtcatagccgcggccccagccagggtgctatgcgctccatgaccaatacgcctcccgctctcggcgccggcggcatggtcaacgcccgcctgtccacggccacgggcatgagcctgggtattcctggacaccgtcccggcatgagccactcggaaagttcgcggtcg

SEQ ID NO: 27829 - DNA, 1224 bp, Neurospora crassa
ctcctctcctcggcgcgcttcaccctctccctgctccccatccgcctcgcccaccgcatccaagccctgcgcaacctgccctacatcgtcgtctctaaccccaacatctcgcgcatctacaacaactaccagcactcgctctcgactttgctcccctggcaaggcaagaccatcagctcgctcgacgacgagatcaaattcacccaggtcctcgccgagctcgtccaaacccacaccgacaccatccccatcctggccaagggcttcatcgaatgccgcaagtacatctcccctagcgaagtgacccgcttcctcgatgaacacctgcgcgcgcgcatcggcacccgcctggtagccgagcagcacatagctctgcactacagctctacgccgcacttcgacccggaagcctcgcccacgctctgtccggagcccaagacgcacccatcctacattggcgtcatcgacacgacactgcggcccgccagcgtgatcgactcatgcggtgactttgtcgccgacatctgcgagctcaactacggcgtgcgccccgagtgggtggtggacggcgagccggacgccacctttgcgtttgtgccgatgcacctcgaatacattgtcacggaacttttgaagaacgcgttcagagcgaccgtggaaaacggcatgagccgcgagccggtcgtggtaaccattgcgcccgagccggcgagcagttccgccagcgcggcgacacccggcgtttactcggattattgccctcccaattcttcccaaaagaactcttcttcatcttcttcttcgggttcgaattcgatttcttcgagtcagcaaggaaaagcagcagcgcaacaacaacaacagcaacaacaaaaacaagcgcagcatggcatcatcccgctacatgaccgtgcgcccggggtgacgatcaggatcagagataggggaggaggcattaacccggcggtgttgccgaacatttggagatactcgttcacaacgttcaacgacgcggatgatgatgatcatcatgagtcgccgggggcgtggggggaggaggccatggggctgatttcgaatacgggcgtgggcgggagcacgattgccgggctggggtatgggttgccgctgagtagggcgtatgctgagtactttgggggagggattgcggtgcagagtttgtacggatggggcacggatgtgtacttgaggttgaaaggggtg

SEQ ID NO: 27830 - DNA, 1020 bp, Neurospora crassa
attacagtcctaggctccctaaacatagacctggtagcctacgtctcccaccacccgcttccaggagaaaccatgaccgccaactccgtcgccgtctcccccggcggaaagggagccaaccaagccgtcgcatgcgccaagttatcccgctcccacacttcctcttcttcttcttcctcttctttcgctgaagaaaccgctcacatcaccatgctcggcacagtcggcgccgactcttatgggtccctgctcaaagaaaaccttgccaaacacggcgtcgacgtctcgggcgtgcgcgttctggattctcctcccggagccaagacgggcatggccatgattgtggtggacgagccgacgggccagaaccgcatcatcttgagtcccgaggcgaaccatttcctccagcccgagcacgtttccgaggttgcacacctcagtagcagcagtgttggtggtgcggcccaagaaaagccggatttgctcatcatgcagctcgagatccccgtgccgacggtgctgcaggcgctcaggacggccaagcagaatggggtgcaggtcctgctgaacccggcgccggcggtccccttgccggatgaggcgtttgacgggctggcgcacttggtggtgaatgagacggaggcggccattcttagcgggttggaggagtcggtgctggacacggaggaagggctggagaaagtgggcaaggtgtttttggaaaagggggtgaaaacggtgattgtcactttgggtgggcggggagttttcttcatgactggtggtggtgaggggggaagcaaaaagggattgatcaaggcggagaaggccaaggtggtggataccacggcggcgggtgatacgtttgtcggaatgtatgcgctggaggtggtgattgctgccaaaaagggggaacagttcgatatcgagggcgcggtaaggaaggcgaataaggcggcggcgaagacggtggagaggcccggggcacaggattcgattccttggagggatgagttgttg

SEQ ID NO: 27831 - DNA, 225 bp, Neurospora crassa
gccactaccgtccgctccgtcaagtccctcatccccctccttgaccgcgtcctcgtccagcgcgtcaaggccgaggccaagactgcctccggcatcttccttcccgagtcctccgttaaggacctcaacgaggccaaggttctcgctgttggccccggtgccctcgacaaggacggcaagcgtctccccatgggtgtcaacgctggcgaccgcgttcttatccct

SEQ ID NO: 27832 - DNA, 655 bp, Neurospora crassa
caggtctacgtccctaccgttttcgagaactacgtcgccgatgtcgaggttgatggcagacacgtcgagctcgcgctatgggatacggctggtcaggaggattatgaccgtctccgtcccctgtcctaccccgactctcacgtcgtcttgatctgcttcgccatcgactctcccgattcgctcgacaacgtttccgagaaggtcagtatcccgcctgcttacttggcgcgcccttgtctttgaggctacaattcgctaacaatcaaaaacagtggcactctgaggttcttcacttctgccgtgacgttccaatcatcctcgttggctgcaagaaggatttgcgccacgaccccaagaccattgaggagctccgcaagaccagccagaagcccgtttcccccgaagaggtacgtgaggctgagacattggcggctgatgatgccccttttgtttccaagtgctttccctccgcttgctcgggaatgtatgctaacgcgctcatcaacagggtgaggctctgaggaagaggatcaacgcccacaagtacctcgagtgctcggccaagaccaacgagggtgtccgtgaggtgttcgagaacgcgacaagagccgcccttctcaagaagacaaagacgaagaggggcctctgcaagagc

SEQ ID NO: 27833 - DNA, 2285 bp, Neurospora crassa
atggctcccgccgtcggtatcgatcttggtacgacgtactcttgcgtcggtgtcttccgtgaggaccggtatgttacagcacccggacggctcaccttggctcaccttgaaagttactaactcatcttcaccagctgcgaaatcattgccaatgaccagggtaaccgcaccaccccctcgttcgtcgctttcaccgacaccgagcgtctcgtcggtgatgccgccaagaaccaggtcgccatgaacccggccaacaccgtcttcgatgccaagcgtctcattggtcgcaagttctccgaccccgaggtccaggccgatatgaagcacttccccttcaaggtcatcgaccgtggtggcaagcccgtcatccaggtcgagttcaagggcgagaccaaggtcttcacccccgaggagatctccgccatgatcctccagaagatgaaggagaccgctgaggcctacctcggcggcaccgttaacaacgccgtcgtcaccgttcccgcctacttcaacgactctcagcgtcaggccaccaaggacgccggtctcattgctggcctcaacgtcctccgtatcatcaacgagcccaccgctgccgccattgcctacggtctcgacaagaaggtcgagggtgagcgcaacgtcctcatcttcgatcttggtggtggtaccttcgatgtctctctccttaccattgaggagggtatctttgaggtcaagtctactgccggtgacactcacttgggtggtgaggatttcgacaaccgtctcgtcaaccactttgttcaggagttcaagcgcaaggtcagtgatgcctggaagactgagttcaatgcctaaaccatttggctcatggcatgaaacgtctcattcaatgcatattgtcagatgctaaccccctcacagcacaagaaggacctctccaccaacgctcgtgctctccgccgtctccgcactgcttgcgagcgtgccaagcgtactctctcttcttctgcccagacctccattgagatcgactctctcttcgagggtatcgacttctacacctccatcacccgtgctcgcttcgaggagctttgccaggaccttttccgctccaccctccagcctgtcgaccgtgtcttgaccgacgccaagatcgacaagtcccaggtccacgagatcgttctcgtcggtggttccactcgtatcccccgtatccagaagttgatctccgactacttcgtaagtatcctccctcatgttcagtatggcaaggagccctattcgctaactttttttttttcttttctacaccagaatggcaaggagcctaataaaaggtgagctttttcctgccaatctctattcgatctttttttctgcgaatttttgggtattttcccttggtttttgggtaaatggactaacatttatatcacagcattaaccccgacgaggccgttgcctacggtgctgccgttcaggccgccattctttccggtgacacttcttccaagtccacctccgagattctccttctcgacgttgcccctctttccctcggtatcgagactgctggtggcatgatgaccaagctcatcccccgcaacaccaccattcctaccaagaagtccgaggtcttctccaccttctccgacaaccagcccggtgtccttatccaggtctacgagggtgagcgccagcgtaccaaggacaacaaccttctcggcaagttcgagcttaccggcattccccccgctccccgcggtgttccccagatcgaggttaccttcgatgtcgatgccaacggtatcatgaacgtctccgccctcgagaagggtaccggcaagaccaaccagatcaccattaccaacgacaagggccgcctgtccaaggaggagatcgagcgcatgcttgctgaggccgagaagttcaaggaggaggatgaggctgaggccaagcgtgtcgctgccaagaacggccttgagtcgtacgcctactctctccgcaacaccctcagcgactccaaggtcgatgagaagcttgacgctgccgacaaggagaagctcaagtccgagatcgacaagattgtcgcttggctcgacgagaaccagcaggctactcgtgaggagtacgaggaacgccagaaggagctcgaggctattgccaaccccatcatgatgaagttctacggtgctggcggtgctcccggtggcatgcccggtgctgcccccggtggcttccccggcggcgcccctggctccaacgacaacgagggccccaccgtcgaggaggtcgactaa

SEQ ID NO: 27834 - DNA, 1143 bp, Neurospora crassa
atggccgacatccaagacgaagcaggacccttcctgcccccgaccatctcccctcccgccctcctgtcgggcgtttctcaaacctacttctcgccaattcctcctcaactcctcgccgacaacaccccatgctgcctaggcgttgacgaagccggccgtggtcctgtccttggccccatggtctactcggccttctacctccctctcacgctctccgacccgctcctaaaacagaagcacagctttgacgactccaaagtcctgactcccgccgtccgcctatccctaatgaaggaactctgcaccaaagataccgagctacacgacaactgcgggtatgcaacgtcgtcgttgagtccgttgtcaatctcgagcggcatgctcaaagccagcaaagcccagatctataacctcaaccaacaagccatggacgccaccattgctctgataaagggtatctacgaacggggcgtcaatgttacggatatctttatcgacacgattggacagccggcggcatatcaaaagaagctggaacgggtgttcccgacggccaagatcacggtcgcgaagaaggcagattcgctgtaccccgtggtttcggcggcgtcagtagtggccaaggttacaagagatattgcgctcgaggtcctgtgggcggatcggagtaagcaaatgcggaagaggaaaagggatgacgaggctgggcttgagaagcgggcaaagctggagagaggggacacaacaggcacaaatggcacagatgctatggatgttgacgagccatcacatactcaaagcgattcgccaaaaccagcagcagaggaggatgaggaagaggaggtggaaacaaacgaagcgatggcatggggctctggctacccctccgacagcaaatgcgtctcttggctcaagcagaacatgcatccggttttcggctggggtcctgaatgccgattctcttggggaacagcaaaagacatgttggaaaccaagggaggggtgaaggtggattggccggaggaagaggaggaggagacacaaaagttgaccgacttcttcatggccaagagagaccaagcagaggtggatgtggatgacttagggacatggttcggtgcgcctgctggggtagaatgtttc

SEQ ID NO: 27835 - DNA, 1353 bp, Neurospora crassa
gaaaggcgcttcctcttcaagcttgacgcggtgattctgactctggcctccctcggatacttcatcaagtatcttgaccaagtcaacatcacaaatgccttcgtgtccggaatgaaggaagatttgaagctgtttggcaatgagttgaactatatgcagacttgctggacggttggatatgtcattggcgagattccaaggtgagtatcgattcccccgatgacgttttctccgcttactccccagcaatgctaatcatctcatagcaacatcttgttgactcgtatccggccgtctatctggatcccggcttgcgaagttgtatgggctattctgaccattttgctcgccaaatgcaagaccacaactcaagtctacgtcttgcgtttcttcatcggtctcgccgaaagtgtattctacccgggcatgcaatacattatcggctcatggtaccgcaaagatgaactggccaagcgatcttgcgtcttccatgccagtggcgccataggcaccatgttctccgggtatcttatggcggcagtccacaagaaactagccggcgtcggaggattcaaaggctggcagtggctgttcatcattgacacggtcatctccctgcccatcgccatctcaggcttcttcctcatgccagacctgcccgagatcaccaaagcgtggtacttctctgcggacgagattaccttggccaaggagcgtatgcgtctcgaaggtcgtgctcctagagcgccatacaccaaggccaaattcaaaaagatcttctccagctggcacatctacctcctcactgcactttacatcttcttcaacaatggtaacggagcctccggccagccagctttccagctgtggctcaagtcgaagggacaccctatcaccgaagtgaacactaatccgacaatcacggccgccatcactgtgatcacgacgctcatctacgcctggacgtctgatactgtgttccgcggtgctagatggccgcccattgtcttttcgggtctggtgaacattgtgatctactccagtctagcagcctggaacatccccgacggttggaaatgggcctgcttttttctggcgggcttcggcggaggtatcagtggactgacgtttgcttgggcgcatgaaatctgcggcgacgacaacgaggaaagagcgctggtgacgggcaccatgaacgagatggcctatgtcattcaggcgtggctgcccttgctgatttggcaacaagtggaggcgccggtgtaccacaaggggtatatgacctctatttttattgccgtggcaatgatactcactgcggtcttggtcaggtttttacatcacaaggaacga

SEQ ID NO: 27836 - DNA, 3154 bp, Neurospora crassa
gatacacaaagtgcgccaaatgctgacgagctcgacgaagaggctgcgctcaagaaacttactgaaaatgttcgagaccaagacgatttggaacgtgatatcaccctgcaagccagccgtgccttgatcgaagccgaagacaaacgagatcagaaacgcatcgaaaaggctgaggccactcgtacgagactcgagaaccagaagaaaacacagcaacagaaactgcggcctggtatcaccaatccaaccgcacgattacgcatacaacaggagatagcgcgaattgatgccgaaatcgaactttgcgacaaagacattgccgatttccgtgcccgcatcgaacagcgcaaccagcagggcgagacgggtacactggccccggccaccggcaaaatactccctaacgagacccaacgagaatatctcatccgaacgggcaagatcacgccgtttgctaaatttggtggacccagacctgccgaggttgagggtgatctcgccaacgccattgtcgatgcagaagacgaggctgtcgctgaagagttggaagaaaaggaaaacgacggccctcgatcccatcagaatcttcgtctccctggctttgccgacgaaaatgaggtcgctaccgtagctgtcgcagacgatttttctctacgtccccgaaagaggcgtagggtccagccgccgcccgaatccgacgatgagtttgtgctgggagagtctggatctgaagcggcttctcctgaggccgacgcatccgacgattacgatgattatgaaatggcgggcactacactcaagaagcggaagaaagcagtcagagaagccgatggtgatgacaaggtcgatctgactgggatcgatgatggcaacgaaaaagtctatcaagcaagactgaaaggctgggtaacgcgtaggagcaatgcacgacgggctcgtcagcagaggctcggccagccaattgataaggatgatgatggaacagaggaatggttcaagccagcgcctgaccagcctgaccaccagttcgaaaacgggctgaaattgccaggtgacatttacccagctctcttcgactatcagaagaccagcgtacagtggctagctgagctgtacgcgcagcaagttggaggtatagttggagatgagatgggtttaggaaagactggtatgttctctccgatgtcccccctgggaatccacggaacgttgctgacgggatgtagtgcaactgatttctttcgtggctgcgttacactacagtcaaaagctcgacaaacccgtcattgttgtagccccggcaacagttttgcgtcaatgggtaaacgagtttcaccgctggtggccaccacttcgagtatccatccttcactcgtctggcagtggcatgctcaatgtccgcaacgaaggagcgcttgatgacagagaggatgactacggcaagagaaagcctaaaaagtccagccaggctgcaaagaagatcgtcgatcgcgttgttaagcatggccatgtgctggtgacaacttatgccggtttgcaaacgtacggcgatatattgatcccggtcgactggggctatgctgttctggacgaaggacataaaatccgaaatccaaacacagcaatcaccatttactgcaaggaacttcggacgcccaaccgtgtgattctttccggcacgccaatgcagaacaacttgacagagctatggtctctctttgatttcatctaccccatgcgactcggcaccttggttgcctttcgaaatcagttcgagatcccgatcaaacttggcggttatgccaacgcaaccaaccttcagatcatgactgctcagaaatgtgcagagacgttgaaagagaccatcagcccctacctacttcagcggctcaaagtagacgtggctgccgatttacccaagaaaagcgaacaggtcctattttgtaagctgtccaagccccagcgcgaggcgtacgagctattcctcaagtcggatgacatgactgctattctcaacaggacgcgccagtccctctacggtattgatatcttgcgtaaaatatgtaatcatcccgatttgcttgatccgcggctcaaagatgatccctcttacaagtggggcagtaccagcaagtcggggaaaatggcagtggtgaagtcattacttcccatgtggaaacgtctaggccataaaacgctgctgttctgccagggtactcaaatgctggacatcatcgaggcatttgtgaggcgccaggatggcatcaactacctacgtatggatggcaagacgcccgtcaaagatcggcagacgcttgtcgaccagttcaacaatgacccggacttacatctcttccttttaaccaccaaagtgggcggacttggcaccaacctgacgggagctaaccgggtcatcatctttgacccagactggaacccatcaaccgatgtccaggccagagaacgtgcatggcggttgggacaaaagaaggaagtcactatctaccggcttatgacagctggaaccatcgaagaaaaaatctaccaccgccagatcttcaagcagttcctgtcaaacaaggtgttgaaggacccgaagcagcagacctcattcaacttaaatgaccttcatgacctgttcagtctaagctcgtatgaagacgggaagaccgagacagcagagctatttaagggcagtgaagtcaaacgcctgccttcaggacccacggagatagtcttgcctggtaacgacacgccggttctccgggcccctggagccagcaaaccagtggaagtcaaggacgaatccacaagtgaggacgagacaagcaacctccgtcatcttgaaggagttgcaggattggaaacattcaacgacgatggaccggcccctgcaccgaacgaggaggaccgtttgatggagggtatctttgcacgttctattcacagcgctcttgaacacgacgagatcatgaacggcaaaaagccaacggttaaggcagaccgcagaattctccaagcagaagcggatcgagttgctgctcaagcggccttggctctccgccgtgcgggtgaggaagccagaaatgtgcccatcggcacggtcacttggacgggcgagtacggcgaagctggtcgtccggcgccccgtcat

SEQ ID NO: 27837 - DNA, 1287 bp, Neurospora crassa
ggcggaggatatggcggcggtggtggtggctacggaggcggcggctacggtggtggtggcggcggtgataggatgtctgctctcggtgctggtctgcagaagcagaactgggacatgagcgctcttcccaagttcgagaagtccttctaccaagagcatcctagcgtcgccaaccgatctcctgctgaggtcgacaagttccgcgcagaccactccattgccgtcttcggtaacaacgttcccaagcctgtcgagaccttcgacgaggctggtttccctcgctacgttatggacgaggtcaaggctcagggtttccctgctcctactgccattcagtcgcagggctggcccatggccctttctggtcgcgatgtcgtcggtattgccgagaccggttccggaaagacgctcacctactgccttcccgccatcgttcacatcaacgctcagcctctcctcgctcccggcgatggccctatcgtcctcatcctcgcccctacccgtgagttggctgtccagattcagcaagaaatctccaagttcggcaagtcgtcccgcattcgcaacacctgcgtctacggtggtgtccccaagggtccccagattcgcgatctttccaggggagtcgaggtctgtatcgccacccccggccgtttgatcgatatgctcgagtctggcaagaccaacctccgtcgtgtcacctaccttgtcctcgatgaggctgatcgcatgttggacatgggtttcgagccccaaattcgcaagatcatcggccagattcgccctgatcgtcagactctcatgtggtctgctacctggcccaaggaggtccgcaacttggccgccgacttcttgaccgacttcatccaggtcaacatcggttccatggatttggctgccaaccaccgtatcacccagatcgtcgaggttgtttccgagtccgagaagcgtgatcgcatgatcaagcatcttgagaagattatggagggccgcgagaaccagaacaagatcctcatcttcaccggcaccaagcgtgtcgccgacgacatcacccgcttcctccgccaggacggctggcccgctctttccatccacggcgacaagcaacagaacgagcgtgactgggttttggaccagttcaagactggcaagagccctatcatggttgccaccgacgtggcttctcgtggtatcggtatgtatccatcttacccctccgccctgcccaaacccctccccccttcttctctcccccatctcaggcgacttccagcatacgtacgtgct

SEQ ID NO: 27838 - DNA, 377 bp, Neurospora crassa
cagcgcatgcaaaccgatcctcccgctggtgtttccgcctctcccgtacccgataatgttatgacatggtaaggagaacgatctttgctgcggtgtcgttatgggcggtcgacccccggcatggcaatgactgacatgagtctccatataggaacgccgtgatcatcggacccgccgatacgcccttcgaagatggcaccttccgcctggtgatgcactttgaggagcagtatcccaataagcctccttcggtcaagttcatcagcgagatgttccaccccaatgtttacgccactggcgaactttgtctcgatatccttcagaaccgctggagtcctacgtacgacgtcgcggctgttcttaccagtattcagagg

SEQ ID NO: 27839 - DNA, 1336 bp, Neurospora crassa
gccaggacagccgctggctcggcttcgcgcacttcccgtgtcgcttgcgctcgtcttttttccacccagtctgctctccgccagcagattcaggatgcctacattctcagtggtgtgaggacaccaacggccaaggtaaagcgctccgtaaaatcagccatttccacaacacagcgcttgtgctaacgtctgccagttcaatggctcttacaccaccgttcctgctcccaagctcggtgccgttgccatcaaggaggccgtcaagaggtcgggtatccccgttgagaagatcaccgatgtctacatgggaaacgtcctccaggggtctgttggccaggcacctgcacgccaggccgctatctttgctggcctttcccccaacgtagaggccattaccatcaacaaggtgtgcgcttccggtctcaaagctgttgtgttcgcggcgcaaaacatccagcttggcctagcggaggcccaggtcgctggtggtatggagaacatgacaaggacgccgtactacgttccacgcgctagcggcatgccccccttcggtcacatcaagatggaggatggcattatcaaggatgggctgaccgacgtctacaacgagttccacatgggcaactgcgccgagaacactgccaagaagttccaaatctctcgtgaacagcaggacgagtatgccatccagtcgtacaagcgcgcccaggaggcttgggcttccgggaagtttgctgaggaagttgtcccggtcaccgttccgggcaagaagggtgacaagatcatcgaggtggatgaaggctacaacgacatcaagctggacaaagttgccaccctcaagcctgccttcgtccgcgatggcaccggtaccgtgacggccgccaacgcctccaccctcaacgatggcgccagtgctttggttctcggcaataagtcgctcgcgcaagagttcggcaagggctcaagggtccttgcccgtatcgtcagttcagctgatgccgctatggatcccatcgacttccctattgcgccctctaaagcggttgagcttgcccttaagcgtgccggcattagcaaggaccaggttgccatttgggagtttaacgaggccttcgccgcggtcatcaaggccaacgagaagattctgggtctcgaaggcgctgtggtgaaccctcttggtggcgccattgcccttggccaccccttgggtagctctggatcccgcattctcgttaccttgcttcatcaactccagcctggccagtacggtgtagctgctatttgcaatggtggaggtgcggccactgcgatggtcgtccagaggatcgagtcggta

SEQ ID NO: 27840 - DNA, 906 bp, Neurospora crassa
ctacgttcctcacatgtagtccttattaccggcccgagtgagggaggcctcggcgccgaaacagccatctcgcttgcccatgccaacccagcactgctcatcctcgtcggacgctccctcaacaagattcagcccacaattgacgccatccacgccgtcaacccatccatcgccgtcaagttcatcgctgccgatcttacctcgctgaacagcgtacgtgaagcagcccgcagtatcctcgacgacgcatccatcgcccacattgacgtcctcatcaacaacgccgccgtcatggcctgtccttacgaactcaccgttgacggtttcgagatgcaatttgccacggcgcacctcggccactttgtgctgacgaagcacatcttacccaagctcagagcatcagccggtgcgggcaagccccagacccgcatcatcaacgtttcctccctgggaaacaccctcggcggcatccgctgggacgaccctagctacaccaagcgtccggaggagtacaaaccctgggacgcctacgggcaggctaagacggccaacgtgctcttcactgtcgcgctcaacaaacggctactcgccaagacgggtatcaggtcgtatgccctgcaccctggcggcatctatacccccttgctccggcacatgaacgatgagttgatggaggagattacgcagagggtgacgaagggagagatgcagttgaagacggtgcagcagggttgtgcgactacgctgagggcggcgctagatccggagctggagaaggcgggggaggacggcgtgtttttgagtgattgtcagtttaccaaggacccggagcttgtggcgcctcgggcgcttgatgaggaggatgcggaacggctttgggggttgagtgaggagttggttggggag

SEQ ID NO: 27841 - DNA, 2153 bp, Neurospora crassa
atggccgaactcgacacgctggacctcgtggtcctggcggccatccttctcggaacggtcgcctacttcacaaaaggcaaactgtggggcgttacaaaggatccttatgcgagctctctggccaatgccagcggcgcaaaggctggcaagacaagaaacattgtggagaagatggaggagcagggcaagaactgcatcattttctacggatctcaaaccggtactgctgaggattatgcttcaagactggccaaggagggcaagagccggttcggccttgaaaccatggttgctgaccttgaggaatacgacttcgacaatcttgataccattcctgacgacaaggtggtgttcttcgtactcgccacctatggtgagggtgagcctactgataacgctgtggatttctacgagttcatcaccaacgaagacgtcaacttcacggagggcaacgaacccgcgcttggcaacctgaactatgtcacgttcggtctcggaaacaacacctatgagcactacaactccatggttcgcaatgtggacaaggctctccagaagctgggtgcccaccgtatcggagatgctggcgagggtgatgatggcgctggtaccatggaagaagatttcttggcctggaaggaacccatgtggaaggctctcgccgagaggatgggtttggaggagcgcgaggccgtttacgagcccgtcttcagcatcatcgaaagggagggcctgaccaaggagtcccctgaagtctatctcggtgaacccaacaagatgcatctcgacggaaccgccaagggccccttcaacgcccacaacccgtacatcgctcccatcgcccagtcctacgagctcttctccgtcaaggaccgcaactgtctccacatggatatcgatatcagcgcctctaacctcaactaccagactggtgaccacatcgctgtttggcccacgaaccctggtgaggaggtcgatcgcttcatgaacgtcctgggtctttccgaaaagcgccacactgttgtcagcgtcaaggctctcgagcctaccgccaaggttcccttcccgactcccaccacctacgacgctatcgttcgctaccacatggaaatctgcgctcccgtgtctcgtcaattcctcgcccaactcgctgcttttgctcccgatgcggaggcaagggccgagatgaccaagctcggcgccgaaaaggattacttctacgagaagatcagtcttcaccatctcaacattgccagagtcttggatattgttggcaagggtcagaaatggaccaacatccccttctctgcttttattgagggtatcaccaagcttcagccccgctactactccatctcgtcctcatcccttgaacagcccaagacgatttccatcactgccgttgtcgaaaatacccagcttcctggtcgtgatgaccccttccgcggtgttgccaccaactacctcctcgcgctcaaacagaagcagaacggcgagcccgaaccttgcccttttggtctttcctacgaactcactggcccccgtaacaagtacgatggtatccacgtccccgttcatgtccgccactccaacttcaagctcccctcggatccatccaagcccatcatctgcattggtcccggtactggtgtagcgcccatgcgtggcttcatccgtgagcgcgtgcagcaggccaagaacggcgagaaggttggcaagactctgctcttctttggctgtcgcaagtctaccgaggacttcatgtacaagaacgaatgggaggtaagtcacgcgccacactggaaccgttgctggtcacctcgatatgctgacacaaatggcgaaaattccaggaagccaaggagatcctcggcgacaacttcgagctcatcaccgccttctcccgcgagggccccaagaaggtctacgtccagcaccgtctcaaggaaagggccgaggagatcaaccagcttctcgagcaaaaggcctacttctacgtctgcggcgacgctgccaacatggcgcgcgaggtcaacaccgttctgagccagatcatttccgaacaacgaggcatccccgaggccaaggccgaggagattgtcaagaacatgaggtcatcgaatcagtaccaggtacgtttacgttgtgatctt

SEQ ID NO: 27842 - DNA, 1238 bp, Neurospora crassa
gcaacgcaattcgaagtgtcacagccgcccagtgacgctatctcggccgtgatcttcgcccccgataacaccaaccgcctgcttgtttcttcatgggataggaacgtctatctttacgaaatcgccgaaggaaccgaggatgctaccctaatcaacaagttcgagcaccgtgctcccgtccttgatgtctgctttggcgcgaatggaaatgaggcctacacggcgagtctggactgctcagtcaagaggttcgttgcactcatagcttattacctatggatgctcagcattatgccacagatctttgtggatgctaacgcgaatcaaacagaatcgacctatccacaggagagcagaccgtgctaagcacgcacgaaaagcccgtccgctgcgtcgtctacagccctcagcactgtaagtccgaatcattacagtccaatcatccaactacaaccccacgcattacattcgatatgtatttgagacatcaactaatctggcaatctcctctcccagccatgctcatttccgcctcgtgggatcacactctccacgtccataacacctccgcgccggcctcgaccccgatcaccatctcgcttccaggcaagccgcacgccctcgccgccagcccttctaaagtcgtcgtcgccatgaccgcacgcctagtacacatctacgacctacccacgctcgccacggcgctctcgtcagccgattctgcctcggcaaacatcaccccctggcaacagcgcgagtcttcgctcaagttcctcacgcgcgccgtggcctgcatgcccaacgacgctggctacgccaccagctcgattgagggccgcgtcgcggtcgagtggttcgaggacacggccgagtcgcaggcgcgcaaatacgccttcaagtgccaccggcagacggcgcccgaggaggagggcggcggcgacgtggtctatcccgtcaacgcgctgacgttccaccccgtgtacggcacgtttgcttctggcggcggcgacggcaccgtggcgttgtgggacgccgaggccaagcgcaggatgagacagtatcaaaagttccctgacagcgtcgcggcgctggccttctcgaataatggcaagtatcttgccattggtgtgtgtcgcgggttcgagaccgatatggaggacttcaatagcgaggggaggacgaaggtgtttatcagggagttgggtgagaccgaggccaagggcaagggccccaagtga

SEQ ID NO: 27843 - DNA, 475 bp, Neurospora crassa
atggtccgccttaaagatcgctatctgttggtcaacattgtctacgcagacattcctcctggacaaaagggcactgtacccgatctgctactttataaccagcccacccttggagaactcaggccccaaaccatcttgaagggcattcgcagtcaggtgaatgcgttatttggtgattgcgggtcaggctctgtcgagcgcagcctacaaggtaaacacaccactgaactctaaaacttacatttggtaaaagcggccactaggctaacttggtataacagtcaagtacctttctactgcgacctcaaccttcattctacgtatctcacgagcccattacaggcttgtgtgggctgccctgacctttatggaccgcctcccagtcaaggacggccgaccgtgtatcttccgcgttgtccgcgtcagcggcaccatccgcaaagtcgaagaagaagccatccgccgtgccaagctc

SEQ ID NO: 27844 - DNA, 676 bp, Neurospora crassa
ggagctttcctcgaatcggtatcaccatacgcctgggcagatctgggtattgcgctttgcataggtctttccgtggtgggcgcggcatggtacgttagggaaaaggctacacatccatcccccagcgccgcatggcgtccgctacaaccagctagagaagagttgggctaatcactgggttgatcgacggaacaggggcatcttcatcaccggttcctccattctgggtggaggtgttaaggcaccacgaatccggacaaagaacctaatctccatcatcttctgcgaggtcgtcgccatctacggcgtcatcatggccatcgtgttctcggccaagctccaacccgtcaccggcgcacaatactactcgggtgacagctactacacgggctttgcgctcttttgggccggcctgactgttggcatgtgcaacctggtgtgcggtgttgccgtcggtatcaatggcagtggtgctgcgttggcggatgctgctgaccctacgctgtaagcttgctgtcgcgatccggacaaagaggtcgtcgagtcatgttactaatgtgtccttgtccttaacagcttcgtcaaaattctggttattgaaattttcagctccgttttgggtctcttcggcctcattgtcggcctgctggtttccggcaaggcccccgatttcggc

SEQ ID NO: 27845 - DNA, 1376 bp, Neurospora crassa
acgggccctcggccagcgccaaggacatctgctccatcaggaacaacagggacacggtagcatacggcgacggccccgtccaggtctcattcggcgagggttacggcgttaccaacaagggctggttcgacacctttgcgtcgctcgacctgctctccaagagggacgcgcgcgacggccaggcgctgggcgccttccagaacgccagctccatcgacccgaccaccaagacgcgctccttctctgctgttacttatctcactcccgaggtccgcgcccgcgagaacctcaagatcctaaccaacacccacgtcaacaaggtcctttttgatactaccggtcccgagcctgtcgccaccggcgtcgagatcaacgtcaacggcatcgtcagccaagtctccgccagcctcgaggtcatcctatccgccggcgctctccagtcccctcagatccttgagctttccggcgtcggtagcaaggagatcctcgcccagcacaacatccccgttgtcttcgagaaccccgccgttggcgagggtatgcaggaccacccgatcgtgtgccagtccttcgaggtcaaagagggcactccctccggcgacgtcctgcgcgaccccccagagatcaaggctctgcttgacaagtacacggccgaccgctccggccccctgggccagctgaccatctccgtcgcctacacgccccttgtcaacaagacgggcgtcatctcggacgagggtgtcaagaaactctttgctggccgtgacttctcgaaccctgcccgcgccgcgatccgcgacatcgtcaccaaccccaacgagcccactttccagtacatcctgttcccgacgcaggtgcacatcgccgacaagcccgacaacatggcgacgcacctgatccccgtggagcccgagaactttttgaccgtcatgaccatcctgaactctcccttctcgcgcgggtccgtgcacatccagtcctccgaccccaaggcggcgcccgtgtgggaccccaagtacaaccacgacgacctcgacatggagctgcttgcgcgcggtgtgcaattcgtcgagcacctggtcgcccccgagtcggcgctcggcaagcttttgaaccagagtggtcgtcgcctgccgcagctcaagggcgatgatctcgagacggccaaggagattgttcgccagagacagatttccgtcttccacgtctcgggatcgtgctccatgcgcccccgcgagcagggcggtgtcgtgaacgagcgcctccaagtgtacggtgccaaggggcttagagttgtcgatgcttccatcttccctatcgagccggcgggtaacatccagtcggttgtttactcggttgctgagcgggcggcggat

SEQ ID NO: 27846 - DNA, 1562 bp, Neurospora crassa
ggaaagcttaccgacatcctctgccccaaggcccagatctgcgccagagccgctggcggccacaacgctggtcactccatcggtacgtgaaccttgatggctccaagtcccggatgcgcctcggtgccttagggacacaatgtacgccagcaggaaagatcactgacattgccgccgtgccacagtcgccaatggcgtcgagtacgacttccaccttctcccctccggtctcgtcaaccccaactgcatgaacctcatcggttcctctgtcgtcttccacgtccccagcttcttcagcgagctcagcaagcttgaggagaagggcctcaccgatgttcacaaccgcatcctcgtctccgaccgctgccacgtcaacttcgaccttcacgctgccgttgatggtctcgaggaggttgagctcggtgaccgcaagatcggcaccaccggccgtggtatcggtccctcttacagtaccaagatggcggtatggtaaaccccgaaagacacactacggccagaatagaggcgctgacaagaccatgtctcatacagagaagcggtgtcagaatccacgagatcttcaacgaggagatctttgagcgcaagctcaggcaactcgctgccggctacaagaagagatttggtgatctcctcaagtacgatgtcgaggaggagattgcccgcttcaaggagtaccgtgtcaagctcgcccgctatactgtcgatgccatccagtacatgaaggaggcccaggaccgcggctacaagatcctcatcgagggtgccaacgccctcatgctggatatcgactacggcacctacccctacgtcacctccagcaacaccggtcttggtggtatcattactggtcttgccattaaccctaccaagattgacaacatcattggtgtcgtcaaggcctacgtgagtttcttttttttttcacacctttgaagccctgcagggtatgacgtcatgatctggtttgctaacccacgtttccgtgacaatagaccactcgtgtcggtggtggtcccttcaagactgaggacctcgaggaggctggtaccaagctccaagagattggtcgcgaatggggtgtcagcactggtcgcaagcgtcgttgcggctggctcgatctcgtcgtcctcaagtactcgaccgccatcaacaactataccgccctcaaccttaccaagctcgatatcctcgatactttcgagaccattaaggttgccgtcgcttacaaggaccctcagaccggtgaggaggtcgagtacttccctgccgatctcgacatcctcgacagccttgaggttgtctacaaggagcttcccggctggaacaagcccatcactgactgcaagacctacgtgagtttttaccgacttgggtcttttattaccgtctttgctgctttgctaaccacgcatctgtagtacgatctccccaaggaggctcgcgcctacattgagttcattgaggagttcgtcggcgtccccatttgctacattggcaccggccccaagcgtgaggacatgattgtccgcaagacctccgcc

SEQ ID NO: 27847 - DNA, 2908 bp, Neurospora crassa
gatggccgccaggagcgcgtccagttcgacaagatcacagctcgtgtttcgaggctctgttatggcctcgacatgaaccatgttgatcctgtagccattacacaaaaggtcatctctggcgtctacggtggcgtcaccacagcacaactagacgatctggtaagcaccttctccccagtccctctccttgtaccgattataaatcacgagctaacacataatctttccctaggctgccgagactgccgcctacatgaccgtcacccaccccgactatgccatcctcgccgcccgtatcgccgtgtccaacctccacaagcagaccaagaagcaatggtcgctcgttatcagcgagctgtacaactatgtcaaccccaggaccggaaagcactcccccatgatcgccaaggacgtatacgagtgtgtcatgcgccacaaggacgagttcgactcggcaattgtctacgaccgtgacttcaactaccaatacttcggcttcaagaccctcgaacgatcataccttcttaagctcgatggccagattgctgagcgtccccagcacatgatcatgcgtgttgctgtcggtatctggggagacgacgttgagcgggtcattgagacttacaacctcatgtccctcaagaccttcacccacgcttctcccaccctcttcaacgccggtactccccagccccagctctcttcgtgcttcctggtcgacatgaaggaagacagtatcgagggcatctacgataccctcaagacctgcgccatgatctctaagatggctggcggtatcggtctcaacatccaccgcattcgtgccactggctcctacatcgctggtaccaacggcacatccaacggtatcgttcccatgctccgtgtcttcaacaacaccgcccgctacgttgaccagggtggcaacaagcgtcctggtgctttcgccatctacctcgagccttggcacgccgatgtcttcgagttccttgacctccgcaagaaccacggtaaggaagaggtgcgcgctcgcgatctcttccttgccctctggatccccgatcttttcatgaagcgtgttgagcagaacggccagtggactctcatgtgccctcacgagtgccctggccttgccgacgtttacggtgacgagttcgaagctctgtacgaaaagtacgaaaaggaaggcaagggtcgcaagaccgtcaaggcccagaagctttggtatgccatcctcgaggcccagactgagacgggcaaccccttcatgctctacaaggatgcctgcaaccgcaagagtaaccagaagaacctgggtaccatccgcagctccaacctgtgcactgagattatcgagtactctgctccggatgaggttgccgtttgcaaccttgcctctctcgccctttccgcctttatcgactacgagaatgcctcttacgacttcaagaagctgcacgaggtcactcaagtcgtcgtccgcaacctcaacaagatcattgacatcaaccactaccccgttaaggaggcccacaacagcaacatgcgtcaccgtcccattggtgtcggtgttcagggtcttgctgatgctttcttggctctccgcatgcccttcgattctgacgcggctagcaagctcaacatccagattttcgagaccatctaccacgccgctcttactgcctcttgccagctcgccaaggagcagggcccgtacgccacctacgaaggctcacccgtctcccaaggaatcctccaatacgacatgtggaacgtcacccctaccaacctctgggactggactgctctcaaggcggacatcaagaagtacggtgttcgcaacagtctgctgcttgctcctatgcccactgcttccacttctcagattcttggcaacaacgagtgcttcgagccttacacctctaacatctaccaacgacgtgtgctcgccggcgagttccaggtcgtcaacccctggcttctcagggatcttgtggagatgggcctttggtctgatgccatgaagaaccgcatcattgctgagggcggttctatccagaacatccaaagcattcccaatgacatcaaggctctctataagaccgtctgggagatttctcagcgtaccattgtcaagatggctgccgatcgtggtgccttcattgatcagtcccagtccctcaacattcacatgcgcgaacccaccatgggcaagattaccagcatgcatttcgccggctggaagatgggtctcaagaccggcatgtactacctccgtacgcaggctgctgctcagcccatccagttcactgtagaccaggaggctctcagggccacggatgaccgagtggccccagcccactcgggtcttaagaagcgctcccctcccgctggcacttatacgtctatcgtgttgagggagaacacttcgggcccccgcccgtatgcccagactggtgttagtggcactagcacacccatcggcaccagggatgttcccacacccgccagcacacctcctcccactgaggttcctgaaactcttgtacagagtgacaacaggccccgtccacttgtctcgcccgccaagagtgccggtttcaaggccgatttgcccgagcctgagagccccaaggctctggccactgacccgattgttaagaccgaggacattggctcaccgctgctggagagaaaggagggccagaatgaggacgtggacgaagatagccaggagagggacgagaatatctactctaatgctccactttctgagcaacaagttgctgcttgtaagtgacaagacttagcccctaccagaccttgagacacacactaaccacatcaaataacaggcgcctggaatcccggtgccgacccctcctcctgcgagatgtgcagcggttaa

SEQ ID NO: 27848 - DNA, 1602 bp, Neurospora crassa
atgatctcccgatcggctctctcgaggggaagccagctggcccttcgccgcccggccgctgcgaagacggcccagcgcggctttgctgctgctgctgcttctcccgcggcgtcatacgaacccaccaccatcgccggcgtcaaggttgcctcgcgcgacgactccggcccgaccacccgcctcgccgtcgtcgcaaaggccggtacccgttacgagccccttcccggtctgaccgtcggtctggaggagtttgcgttcaaggcaggtccccggtccaccgcatccggaccatgagagagagagaagacgcccatgagctaataattggcacaccttggcgaggtacacagaacaccaacaagagaaccgccctccgcatcacccgcgagtccgagctcctcggcggccaattgcaggcctaccacacgcgcgaggccgtcgtcctccaggcctccttcctccgcgaggacctcccctacttcaccgagctccttgccgaggtcatctctgagaccaagtacaccagtgcgtgataataccttccctcccacgaaaccaaaagatggctgttgttgacagttgttgttgttgccttgccgccccatagcccacgagttccacgagctcgtcgagaactgcatccacgagaagcaggccaagctcgactctgccgccatcgccctcgatgccgcccacaacgtcgccttccacagcggcctcggttctcccctctaccctaccgtcgacacccctacctcgtcctacctcaacgagaactcggtcgccgccttcgccaacctcgcctacaacaaggccaacatcgccgttgtcgccgatggtgccagccaggccggtctcgagaagtgggttgagcccttcttcaagggtgttcccgccaccagctccggcaacctgaacactgccgcctccaagtactttggtggtgagcagcgcgttgccaagaacggcaagaacgccatcgtcattgccttccccggtgcttcccttggcgtcccccaccccgagacttccgtcctcgtcggtctcctcggcggtgtctccaacatcaagtggtcccccggtttcagcctcctcgccaaggccaccgccgccaaccccggcgccgaggcctttgctcacaactacgcctactccgatgctggtctcctcgccatccagatcaccggcaagggtgccgccgtcggcaaggtcgccgtcgaggccgtcaagggtctcaaggccatcgctgccggtggtgtctccaaggaggacctcaccaaggctatcgccaaggccaagttcaacctcctctccgccagcgaggtttccggcactggcctcgtccacgccggtgccaaccttcttgccggtggcaagcccatccaggttgccgagaccctcaaggctcttgagggcgttaccgctgagaagctccaggctgtatgtgtgaacctacaagaagttggaaaagaaaaaaaagatatgctaacaaacgttcaacaggctgccaagaagctccttgagggcaaggcttccgtttccgccgtcggtgacctccacgtccttccctatgctgaggatctcggtctcaaggtatagacg

SEQ ID NO: 27849 - DNA, 771 bp, Neurospora crassa
cagatctccaacaccgccgagcttaacaaggtcatcttcaagaacaaggccgaggcccccttcggtcgcaagttcgtctccctcttccccggtctcggctacgccgccggctacaaggttctccagcgcatctacaagtacggcggccagcccgttgcccgcgacttcctcggcacccactacggcaaggactttgagaacgcctttggcaagaagacgggcaaggccatcatgcactcgacggccggctcgctcattggcattggcgagatcgttttgcttcccctcgacgtcctcaagatcaagcgccagaccaaccccgaggccttcaagggccgtggcgtcttcaagatcatcaaggacgaaggcttcggcaacttgtaccgcggctggggctggacggccgcccgcaacgcgcccggctcgttcgcgctgtttggcggttccgccttcgccaaggagttcctctttggtctgaacgactacaacaaggcgacgtggttccagaactttgtcgcttccattgctggtgcctctgcctcgctcgtcgtctcggctcccctcgacgtcatcaagacccgtatccagaaccgcaacttcgataaccccgagtcgggcttccgcatcttgaccaacatggccaagaacgagggcgccggtgctttcttcaagggtctggtgcccaagctcttgatgacgggccccaagcttgttttctctttctggctggctcagactttgattcctgcctttgatattgctttccgcaag

SEQ ID NO: 27850 - DNA, 912 bp, Neurospora crassa
aagaaaggagtgcgcgacttcacctttgggaggatattgggagagggctcctacagcacggtttaccttgcgaccgatcgccaaaccctgagggaatacgccgtcaaggtcctagaaaagaagcacatcatcaaggagaagaagatcaaatacgtcaacatcgagaagaacacgctgaaccggctgaccgagcacccgggtatcgtccgcttgtattacaccttccaggacgagacttcgctgtattacgtcctcgatctatgtactggcggagagctgctgggcgtgctcaagaagacggggacgttcgacgtggaatgcaccaggttctatggcgcccaaatattggacgctatcgactacatgcactcgagaggtatcatccaccgtgacctgaagcccgagaacgtgctcctggacgaacagatgcacgtcaaaatcaccgactttggcactgccaagctactgcgagaccctcgagatcccagaccaccagaggaaacacccgggcaaagtggcgaggatgacgagcgagcggcctcgtttgttggtaccgctgaatacgtgagccccgaactcctgacggaaaagtcagcgagcacagcaagcgacatatgggcctttggatgcattatttaccaactcctcgccggtcggcctcccttcaaagcaggaaccgagtatcttactttccaaaagatcgtaaaactcgagtacgaattcccgcctggtttcccatccgctgcgcgcgatttggtagaacgatgtcttgtgctggacccggctcagcgctttacggttgaacatatcaagaagcacgagttctttgccggacaaatgtttggcaaggagctgtggaggatgaaggcaccgcggctgaggccgtacgtaccaggatcccaggagcagcaa

SEQ ID NO: 27851 - DNA, 1684 bp, Neurospora crassa
atgatggtccccgtcctctcaaggcaggctctccgccatgccagcgtcgcccgtgtcgccctccccagcctcacaagatggtacgcctggtacccccctcacaccgtcgtcaagatgcccgccctctcgcccaccatgacctcgggcggtattggcgcatggcagaagaagcccggtgacaagatcgagcccggtgaggtgctcgtcgagatcgagaccgacaaggcccagatggactttgagttccaggaggagggtgtcctcgccaagatccttaaggactcgggcgagaaggacgtcgccgttggcaacgtaagtacctacctacactacctgtcgagccacgagtcatcatacctgccaaacactccagccctacctactccaactccatgactccatgcacatctcctcccatcccgaccctcttccccactcgaccctgaatccactcttcttcctttatgcctcgtgcgcgcctcgtgccctgtgtctcgcctgtcgggtgatatgtcatggtgccgttgagcgtctacacgccccgcgtcgccttagcttgtgcgcgcctaatgtagacagacgacccatgctgaccatgcttcttcctccttctctagcccattgccattctcgtcgaggagggcaccgacgtcaacgccttcaaggacttcaccctcaaggatgccggcggcgagacctcccccgctgtccccaaggatgagcccaagaacgagagcaccgccagcgctccgacccccgctcctactcccgctcccgagcccgagaacactagcttcaccggccgcttccagactgccctcgagcgcgagcccaacgctctccccgctgccaagagactcgctcgcgagaagggcatcgacctgcgcaacgtcaagggctctggtcccggtggcaagatcactgaggaggatgtcaagaaggctcttgctagcgctcccgctgccggtgccgccgccgctgcctacactgatgtccccatctctggcatgcgcaagactattgccgcccgcttgaaggagtctgtcacggagaacccccacttcttcgtttccaccaacctctccgtcagcaagcttctcaagctccgccaggcgctcaacagctctgctgatggccgctacaagctttcggtcaacgacttcctcatcaaggccatgggtattgcttccaagcgcgtccctaccgtcaacagctcgtggcgcgacggtgtcatccgccagttcgagaccgtcgacgtttccgttgccgtcgccacccccaacggcctcatcacccccattgtcaagggtgtcgagggcaagggtctcgagagcatctcggccgccgtcaaggagctcgccaagaaggcccgcgacggcaagctcaagcccgaggagtaccagggtggcagcatctccatctccaacatgggcatgaaccccgccgtccagagcttcaccgccatcatcaaccctccccaggccgccatccttgccgttggcgccccccagaaggttgccgtccccgttgagaacgaggatggcaccaccggtgttcttgggacgagcagatcatcgtcactgccagctttgaccacaaggttgtcgatggtgctgtcggtgccgagtggatccgcgagttgaagaaggtcattgagaaccctctcgagctcctcctttaaacg

SEQ ID NO: 27852 - DNA, 3318 bp, Neurospora crassa
tcccaaatcgactctctcatctccttcatcgcctcccattgctcttccggcaaaggcctaggcaccacctcctcagccatctacgacaccgcctggctatccatgatccagaaacccgcaaactctagccacttcctctttccccaatgcttcacctacctcctccggcaccaacttccctctggcggctggacctcgtacgccacgccggtggacggcatcctcaacaccgccgccgccctcctcgctctcaagcgccactccatgtgcctcatttcttctcctccatgtccccaacccacacaacaacaccaacaagaactcgacaactggcccctgcaccaccgcatctcccaagccgaatcagccctccaatccatgcttctgcactgggacgtcgccaccaccgaccaagtcggcttcgagctcctcgtcactcgtcttctgtccttactccaagacgccggcgtgcaaggcctgtctgacttccctggctctgctcccctccaagccctacacgatgccaaactcgccaaattaccagctaattacgtctaccaagcccgctcgacgctgcatcattcgcttgaggcgctggtgggatacattgatttttccaaggtcggccatctgaaggaggaaaatgggagtatgctggctagtccggcgtcgacggcggcgtatttgatggggttggcggaaaagggcatgtgggatgaggaatcggaagcatatttgaggggggtgctggatagagagaggtttgaaggggaaggagacggggagaaagaagatggaggggtgccctgtgcgtggccgactgagacttttgaggttacgtgggttgttacgacgctggcggaggcgggggtgaggtttgggaataaggagggggaggtgattagggggtatctggaggaggggtggaggaggcaaggggggttgtttagtttttgtgagttccttccttgctgcagtacctaccctcggtggctggtgcttttggttgaaaggggaagaaccaaacgctaactgactcggttgtgtgcagtccccggcggccttgtcgatgcggatgatacggcaagagccatcatggccttgaatcatcttggtaccaaggtgggcgtcgagtcgctgatcagaacgtttgaagcaaaggatcacttcaggacgtacgaaggggagaggaatccgagtatcagcgccaactgcaatgttttgtcgtgtttgctgatgatggatgatccgacaatttatgctcagcagattgtcaagacggcaaagttcctttgtgaacaggtgtacacggatagtgtgagggagaaatgggtaagtgcttccttccccttttgatgagcgtcagggacaaacactgacaggaaggtccagcacatcaacgaactctactggatgatgctcctctcccagtccttggccaccctcttcgacaccatggccgccaacccctccctcgagacttccatcttccagcttgctcctgaacttcaggagcaaatcccaatgacttccctccatgttctcaccaaagtcctcggctcacagggcctcgatggctcctgggcaaatggcattgctgaagtcacggcatatggcatcctcacgctctcgtggctctcccatctcccctggatccaacaactcggtcgcatgcatggcgtcaacttcatcaccgctggcatcgaaagcggcaaggccttcctcgaagcccacaagcacgattggaagaaggggcaatacctctggattgaaaaggtcacctatgcctcgccggtattgtgtgaggcgtattgtcttgctgcggcagtgattcctgtgcctgatttcactggtttgactggtgatgcaaatggccaggttgtgtacagaaccaaggagtcgctcttcgtttccgaggggttgctcaagggcgtgttgaaggcaggacagctcatgtctcttacgcccttgttcagagacctggcaccacagctgctgagagtggcagagatgcaggcttgttatgctcttggcttcttgcagcggaaacgtaaggagctcggcatcttcccaagtactggaggggacgagaagtacatggctttcatccctcttacctggaccgccaacaacgctctccgcgtccaagccaccgccggctatggccacggccacagtggtggcttgagcaactacgtcctgcaagagatgatggtcctgtccatgctcaactaccaagtggatgagtacatggaaaccgccgtggagcgggactttttgggattttacagcggaagctggggaagtttagaggcggttcgggaagcgatcgggcaggtgtttgaagagttcgctcctccgggtaggaaaaggagtatctggggagacgccgatcatacacccaccaacctgaaagagattcggtccacgctctcccgctacgtcagacacatcttgctgcatccagctgtcagaagtgcaccggcgagtgtacaggctaggttgaggaacgaaatgcatacgttcttgttggcacatgttcagcatgctgctgataacatccactttgcggctgcatcgaaccaaacctgtcaagtcgacaactcctgggagcgcgaaaccggcctcccatctcctcccattaccgaaccccacgatccttcgtccccgccaccatccaaacgccgccgtcttgcatcttcctcttcttcttattcttcgtcttcacacaaagcacaagagcagaaacccaagatcttctcccccacagactcaaggactttctactcgtgggttcgcaccacctctgccgaccacacctcctgccccttctcttttactttttacacgtgtctcctttcccactgtcacccttacaacagcaacaagaccgagaacttgttcaacaaggacgccaggacaagttatgtcaccgaagcgatggtgaggagtctggcaagtttgtgcaggatgtataacgattatgggtcaatcgctagggatgcgagcgaaggaaatctgaattcggtgaactttgcagagtttcatttggcggctggtgctgctggaaagggctgcagcgaagaagggaatcaaaatagtggggaggaagaagaagcagaaagagaagagaagaaaaaggcgaaagaggagctgatgtgggttgccgagtatgaaagacgcggattagaaaggacgctgggagagctgggagggttggtgggggacgggaagatggagagagtcaagttgtttgtggatgtgacggatttgtatgggcagatttacgtggtgcgggatattggggttggggtgaag

SEQ ID NO: 27853 - DNA, 2286 bp, Neurospora crassa
agcacacttgcagacacccgcctacacgtcttgatcgcagaccgcgagcaaaacgtctaccagatccaagacaacatcctaccacggcctctctcacaaaatgcctcctcccaaaccgccgatcttcgctttacctacgaagcctaccccttctctttcaaagttacacgcgtcagcaccggcgacgtccttttcgatacttctccttcacccttgatcttcgaaacgcaatatctacgcctgcgcacgcgcttgccttcgaacccgaatttgtatgggctcggtgaacactcggattctttccggttggcgacaaacggatataagagaacgttgtggaactctgaggcgccgtacataccgcagaaccagaacttgtacgggagccatcctgtgtactttgagcaccgcggtggtaatggtacgggagggacgcatggagtcttcttaagaagtgccgcgggaatggacgttgtgattgggaagagcgatgccggggagcaatacctcgagtataacaccattgggggagtgcttgacttttattttctggccggaccgggtcccgaggaagtaagcaagcagtatgcccaagttgttggtctccccgcaatgatgccgtattggtcgctgggatttcaccagtgcaaatacggctggccggatctggggcatgtcaaacaggtcgtccagaactacagcgatgcgggaattccgttggaggcgctctgggatgatatcgattatatggacaacaagctggattttagtacggatccggtgcggtatcctcatgaccagctgaagggatttgtggacgaactgcacggaaaagatatgcggtatgtgcagattctggatccggggatcaggtacaagagcgactatggcccgtataccaggggtgccgagaaggatgtgtttctcaaggcagctgatgggtcctggtatcgtggcctgcagtggcctggggaggtggtctggccggattggattgcgccgcagacaaaggagtggtggacaacggagattctgacgttttatgatccaaacaacgggattaatgcggatgggctttgggtggacatgaatgaggcgagcaacatgtgtgcggacactacttgtctctcttcggctcagaaaactcgctcactgcctcagtccctaatcggcaaaatccatccacgcgccccaggcgatagacaccaaaaaactcgctcactacctcaatccctaatcggcaaaatccatccacgcgccccaggcgatggacaacacctcggcctccccaaccgcgacctcttcacccccaagtaccagatagcgaaccactaccccaccctctccagccgcaccctattcacgaacatcaccaactcggacggctcaacgcaatacgacacccataatctctacgccctcactatgtcctctgtctctcgctctgccctcatctcccgctcgcccaccaaacgtcccttcctcctcacccgttccaccttttcgggatcctcccgcttcgccgctcactggtttggcgacaacttttcttcctgggccgactaccgcgcctcaatccggcagctcctcagcttcagcgccatacacaactaccccatggtcggttccgacgtctgcggcttcaacggccaggcccaagagaacatgtgtgcacgctgggcagttctcggcgcttggcagcccttttaccgcaaccacgccgacatctccgctcccgaccaggaattctatcgatggccttctgtcgccgctgccgcgcgcaaagcgattagtgtcaggtaccgactgctggattacatttacacaggcctttactacgccagcaaaacgggtgagccggcactagccaaaccgctctggtttctctttccctctgacccggcaacatacggcatcgacacgcagttcttcctcggcgacgcactgcttgtgtctcccgtggtggaagacgacgcccactctgtcacgttttacttgccccaagggaaatggtacgatttctttacgcatcaccggattgatcaaacctccgctggcaccgttaccgtgtccggagtaggttgggatcagatccctgtttatattcgcggcggaagtatctcggcccttcgcctttccgacgcttcctttacgaccggacaggcaatgaccactgccgaagtccggacacgcaactttgagatcatcattgcccctgatcagaacggcaaagcgaggggaagattgtatttggatgatggcgagagtctggattcgagtgggaag

SEQ ID NO: 27854 - DNA, 1048 bp, Neurospora crassa
cagtgggttgtcaccagcaaggagaagggcttcgatggccttgtcaaggagcagggcgccgtcccccagcccggcgacaacgacgttctcgtccgtctctacggtgcttccttgaactaccgtgatctcatcatcccccaggtcagtacctagaggtacatattcccatcatgatgcactaatagacactgacaaaaaaaaactacagggcaagtaccccttccccctcgacctccccgtcgttgccgcctccgatggcgccggtgaggttgttgccgtcggctccaaggtcaccaagtggaagaagggcgacaaggtcaccaccctcttcaaccagtggcaccagttcggcgacatcgacactcgcgccgcctcctcgggcctcggcggtgttttcgacggcaccctccgccagtacggcgtcttccacgaggacggcgtcgtccgcaccccctccaacctcgaccacgttgaggccgccaccctcgtgtgcgccggtctgacctcgtggaacgccctctacggcctcaagaccctcaagcccggccagtgggtcctcacccagggtaccggtggtgtctccctctttgctctgcagttcgccaaggcgggtggtgccaaggtgatcgccaccacctcttccaaggagaaggccgagatgctcaagaagctcggtgccgatcacgtcatcaactaccgcgaggaccccaactggggcgagaccgcccgcaagctcactcccaacaaccagggtgttgaccacatcattgaggtcggtggtgccggcaccctcggccagagcttggctgctatcaagtatgagggcatcatttccattattggtttcctcggcggtgctcagcccaaggagagcatcctcgagacgctgagcaggatttgcactgttcgcggtgtctatgtcggtagcaggcagctcatggaggagatgtgtgctgccattgaggccaacgacattcaccccgttgttgacaagaccatcttcaccctcgaccaggccaaggaggcttatgagtacatggtaagttac

SEQ ID NO: 27855 - DNA, 2055 bp, Neurospora crassa
cacattgaacaaacctcgtccaacctcgaagccaacatcaacctcgaagccaagctcaagaacccgctcgacggcctttcccgcgtcgagctcctgtcacgcgtcgagaccttttgcgccgaaaagaacctaaccgagcacctccctcttttccgtaagggagcactcatcgcccagtccccggacagctatgcgtccatctcgggcccggaagccttggacgatgaggagaaggcagtacttttgaaggaggtcgaacacaagtggcggctgccggcaagactgttcctgacgattgctacttgctcgatcggtgctgctgtccaaggttgggatcagacgggcacgaatggcgcgaatatcttctttcccaactattacggtatcggaggcgacactgcgagggagaagttgcttgtcggattgatcaatgctgggccctatattgggagcgcgtaagttttctcttctgtttttcttgatgttcacgttcaacaaacacggtgatttcctgcagttgtcgctttgatactgactaaggtaacatcaaacagattcatcggttgctggctttctgatcccatcaacaactggattggtcgtcgtggtgttatctttgtctctgctcacttctgtatctggcccgtcatcggttctgctttctgtcacacatggccccagcaactggcctgccgtctgctgatgggtatcggtatgggtgtgaaggcatcaacggtgccgatctatgccgcggaaaactcgcctgcttctattcgaggtgcgctggtcatgtcatggcgtgagtacacccaagtgtttcttactacagccccctcggcacaattgatgaaagatgctaacaccagacctttccagagatgtggacagccttcggcatcttcttgggcactgcctttaaccttgccgtcttccacgccagctccaacgttaactggcgcctcatgctcggtgcccccttcattcccgccgtacccctgcttctgctcatctatctttgccccgagtccccgcgctggtacatgaagaagggccgctacccagaagcctggaaatccatggtcaagctgcgcaaccaccccatccaagttgcccgcgacatgttctacatccactcgcaattggaagtcgagcaccagctcctcgccggctccaactatgccaagcgcttcgtcgagctcttcaccgtccctcgtgttcgccgcgccaccctcgccgctttcaccgtcatgattgcccagcagatgtgcggaatcaacatcatcgccttttacagcaccaccatcttcaaggattccggctccaccgaattccaagccctgctttcctccttcggcttcggtctagtcaattggctctttgccttccccgccttctggactatcgacacttttggccggcgctctctgcttctttttaccttcccgcaaatgatgtggaccctgctagcagccggcctcttcaccttgctcgacatgggtcccgcccggaccgggctcgtcgccttattcgtcttcctcttcgccgcgttctactcacccggtgaaggtcctgtccccttcacctactcggccgaagtcttccccctctctcacagagaagtaggcatgggcttcgccgtcgccacctgcctcttctgggcatctgttttgggtattaccttccccttcttgcttgactctctcggcaccgtcggcgcctttggtctgtacgcgggcttcaacctagtggcgtttattgccatcttcttggtcgtgccggagacgaagcagaagacgctcgaggagttggattatgtctttgctgtgaagacgagcaagttcatgtcgtatcagtgcaccaaggcgctgccgtggttcatcaagaggtgggtgttttggcagaggaatgcaaagctggagccactgtatgagtttgatcggatcaaggaggcggagaaggagaggagagcagaggaggagagaagggcaaaggagacgggaacgatcacctctactgctacaggagctgagttggatgagaagaagggactgagtc

SEQ ID NO: 27856 - DNA, 665 bp, Neurospora crassa
ggagccgactcccgcacaaccacaggcgcctacattgccaaccgcgtaaccgacaagctgacccaagtacacgacaccatctggtgctgccgctccggatccgccgccgatacacaagccgtcgccgacattgtgcaataccagctgggattgtaccacatggtcaacggcaggcctccgacgacacagattgcggctgctgtcttccaggagattgcttatgccaacaaggataggttgacgtatgtttttggtggcccccttcccttcatctcactttgctgcgtttttctctctttctcttgcgccctcttcctcttctcttatcatgcacaggtcgggttccgtgctgactattggatttcaacagtgccggcctcattattgccggctgggatgcccgccacggtggtcaagtgtacaacattccgctcggcggctccctgcacaagcagccgtattcgattggcggttccggttccacatacatttatgggtactgcgacgccaactggaaggaaggaatggaggaagccgaagccgtagcgtttgtcaaggaggcactcaaggaggcgatcaagtgggatggctcctcgggaggtgtcatcaggatggtggtgttgacggagaagggcgccgacaggcatttgtatctgccggattcg

SEQ ID NO: 27857 - DNA, 1376 bp, Neurospora crassa
gagcaacaggaggatcaacacggggacgaagacgatgaccaagattcggtctcttccgacagctcagacgacggcattgtcgaccccaacatccaggacgacatggagaaactccaaaacacctttcccaatttccgacagcagtatcggctgatcaagcgcatcggagaaggttcgaatcaccaagaccaagacccttcatcaccagccacaatgctgaccacttcccttttccaggcaccttttcgaccgtttacaaagccgaagacctcgtctacgatcagtacgacaattcgtgggactacgaacaagaaagtgacaagtgggcgcctccccctctcaggacatacggacgcagctcgggctccagtatgaccagtcgcccacgacgcaaacccaaatatgtcgccatcaagaagatctacgtcacctcctctcccacccgtattctgaacgagctcgacttgctacacgacctgcgcggctgcacatcagtctgccccctaatcaccgccttccgcgagaccgaccaggttattgctatcctcccttacttccgccatgccgacttccgcgaatacttccgcaagatgacacctacggatatcgccatctacctgcggtccctcttcactgcgctcgagagcgtccaccgccacaagatccttcaccgtgacatcaaacccacaaactttctctacgaccccgccaccaggcgcggtgttctcgtcgactttggtcttgccgagcgtgaggggtccgaatgcaagccctgcctctgccatgaggattcgaccacccggcgcaaccgcctccgcaccgcccaccttaactccagtgtgccgcacaacggctacccgaaacaagacacgcgcccctcgcggcgcgccaaccgcgctggcacccgaggcttccgtgcgcccgaagtgctgttcaagtgtacggagcaaaccaccaaaatcgatatttggtctgccggcgtgatcctcctcaccatcctgtccaaacgcttccccttcttcaactcagccgacgacgtcgaagccatgatcgagattgccaccatcttcggtattaagcgcatgcgacaggccggccagctccatgggtgcatgtttgagacgaccatcccgacgataggtacgcaggggttcagttttgagcgcatcattctctggagcacgtgtcgggatacgggcgtcaagatgcccgaggatgagaaattggcggtggagtttttggccaagtgcatggacctggatccagcgaggagaatcagtgcagaggatgcattgaatcatccctttctgcagatgggattagagaaggaacatggtggaagccaaagtggcgaggaagaggaagagggggaggag

SEQ ID NO: 27858 - DNA, 2804 bp, Neurospora crassa
aaccatcactatccgtcactcccagaaccactaccagtaaagataaagacaaaggtccgagtagtagcagcagtgtccccaagggccacgcacaaatcgccctcttcgagtctcccaccggcaccggcaagtcgttatcactaatttgcggctccttgacctggctgcgtaaccacaagcggttgcaattcgattccgaaatcgaaaagattcagcagcaaatggaggcatctggggagccggaatggatggtggaaagtgccatcaagaggaaacgagaggagttggcgcagaagtatgaagagatggaaagaacgctggagaggataaggcaaaaggagagggagatggagaaggaaggggaggaagggcaagcgagaggtggaaagaggaggaagttggaccgggggaaaggggatgaggaaaaggggggaaaaaagaaggagagcggcgggagtagagggttgacagccagtgatgaggacaaggagttcttgattggggattggagggatgaagggggactggatgagaatgacccgatgggtcagttgagcaaggagaccagggagcttttggagaaggtggggatggggaccgcgggagggaagaaggaagcgaacgaggggccagtggctgaggaggagattaaggtgagttagactggatggcggggtttacaaaaggaatgaaacttacacaatggacagatcttctatacctcgaggacgcattcgcagttgacgcagtttattcaggagctgaggaggccggaatttcctgcttctgttccaacgccaaatcctcaagaaaaaccagctaaagaaatcgtcaagcaaattccgctttcctcacggcaaaaactctgcatcaatcccaccgttaacaaacttggcaccctcgccgccatcaacgaacggtgtcaatccctccagcaacccaagacacccaaagaccaacgatgtccctatctaccaaacgctgccaacctcaaagcgacccacgagtttcgcgacaccgctctcgccaccctcccagatattgaagacctctaccagaccggcaagcagttacagatatgtccttactacgcctcccgtgctgccattcccggagcagaggtgatcacattaccatatcctctcctcctacaaaaaagcgcccgtgaggcgttgggcattagattggaaggaaacattgtgattatagacgaggcacacaacattatggatgccgtatctaacgtgcatgctgccgagatcaagtacaccgacctcaaaagagcgaaactatcacttggcatgtattaccagcggttccaccaaaagctaactggcgaaaacaaggtcatggtcgctcagctacaaagggtcgtggaagctttgggagtgtacctcaaaacaaaactggacaaggctgctttggggctcaaggcagaccaggaaggaattgtgcttgacaccagccttttgttgaagacgggtggtgcggatcaaatcaacttgtacaagttgatacggtatgtccaggagagcaagttggcattcaagatcgaggggtatatcagttattgcgaggaagaaggtcgtgacacagatgatgaggaagccgagacggagataaaggcgaggcagggcagaccaccagtgctccacactctgtgctccttcttgacggccttgacgaatttgagctcggagggcaggatcttctatgagaagatacctccacctaggggcgaactgcaggatatgaagctcagctacatgctgctctcgccgacacacgcattttcgtcgattgcggagagcgcaagggcggtcatcctggctggtggaacgatgtcccctttcgaggactacaaagcacatttgttcccagacgtaccgccagagaagatcacaacactcagctgcggacatgtcattccccccgacaacctctgcgtctggactctgggttccatcgcccccaacccaaaagtggacacaggaatcggcgaggactgcttcgacttcacctttgccaagcgcagcaatcccaacatgatcaaccgcctcggattggtgctactcaatctttgctctgtcgtaccggacggcgtcgtcgccttctttccctcttacggctacctggaagaagtcattggagtctggaagacgcacgagcaagccatgggccccaaaaccatctgggagcgactcgaaagcaagaaagccctgttcatagactccaaaaccgagtcgagcgagcagacgcttcaaaagtacagcgacgtcatccattccgaagtccgtcctctctccccggccgggagtcgggttaaaggcgccatgttgctgtcggtaataggcggcaagatgtccgaaggcatcaacttctccgaccgcctcggccggtgcgtcgtcgtcgtcggcatgccctatcccaaccctcactcccccgaatggctagcgcgcagagagtatctcgaagcgaactttatcaagcggtataccgcctcccaacaaaccagcaccgctaccgcacctcttcccgccccagtgattccgcccccgtccaacaccacccactactccacgaacccctcttcgtccagaaacaaagataaacacaaacctgccaacgtccgcaaactcgctgcgcgcgactcccaccaattctacgaaaacgccacgcttcgtgccgtcaaccagtcgatcggaagagcgattcggcatcagaacgattatgcggcgattgtgttgatagacaatcggtttgagaaggagcatgtgagggccaagttgccggggtggatcaga

SEQ ID NO: 27859 - DNA, 1363 bp, Neurospora crassa
gcgcagtctagatatgtcgccaacaacccgctctccaagaagcagcatgaattggccgttgagtcgctgccaggcggcaacacccgcaccttgctacacacttccccgttccccctttgcatgaagcatggaaaaggcacttttgtgtgggacgaagatggccacaagtgagtgaagtgttccatatcacaccctgcagcgggcatcaaaccccctcactcatcgctgatacctacctacttacctctcacatagatacaccgacttcgtaggcgagctctccgccggcctttatgggcattctcaccccgtcatccgcgccgccattctctctacttttgacgagattggtctttccctcggctccaccaccacttacgaagcccgctacgcctcccttttgtgtcaacgcttcaagctcgagcgagtacgcatgaccaacacaggtacggaagcaaatctccatgctctggcggctgctaggcactacacaaggaagaagaaagtggtggtgttcaacggcggatatcacggtgcttgtttctcgttcgggggaggtaaggcggcgccgaataccgctgacaaaggcgattttgtggttgtgcagaattacggggatgacgaggcagctgctgaggcaagaagagtcattgaggagacggcgagggagggcgacctggctgcggtgttggtagagggaatgcaaggtgctggggggtgccttccgggcagcaaagagttcctgttggcggcacaggaagcggcaaagaacactggagcaatctttatcctggatgaggtgatgacttcccggctggcacccaatgggttaggacaggagctgggactgagcccggatctggtcacgctgggcaagtacctgggtggtggattcagttttggagctttcggaggaaagaaggagatcatggactctgtctatgatccgagggtgaagggcagtctggcccactcgggcactttcaataacaataccatgacgatgtgcgctgggtttgcagggctgaaccaggtgtttacggaggaagtctgtgtcgagctcaacagggtgggagacgtcttgagggggaggttgaatggggtggcaaagagaacacggttgagattcacggggaggggctcgttgattgggttgcacttcagggagaatgggacattcgagagccaggagagggcggatttgagagatctattctggtttgagatgctggaggagggcttttggaccacgagaagagggttcattgccatgatgttggatacccctaaagacgagttggatcggtttgttgatgcagtgggcagattcttggagaggcatgctggcatcatgatggtgtag

SEQ ID NO: 27860 - DNA, 988 bp, Neurospora crassa
ttggatcgatcatacagtgacctgacaccctggaaagctctggtttactactaccgaagaacatcatggcttggtgggggtcaaaagtttgtcatcattctagctgccaacgttggcggtggtgtcatggagtggaagggcgccagggaatgggcaatcgagagggactcgattcgcaacaagaagaaatacgttgccaagtggggatacgatctcgagattgtcgacatgagcacaaagaaacgctatgcgcatgaatggcgcgagagctgggaaaaggttgatttcatccgctccactctgcgaaagtatcccaaggcagaatggtaagttcccactctgtcgcttcctggatgtgatccgtggctgattttctcccagggtttggtggcttgacctcaacaccttcattatggagccatcgaagtctctgcaggaccatattttcgaccacatcgaggatgtcacctaccgcgacatcaatgagtacaatccgttgaacatctctcaccccccggccgacccttacctcgacgaactctcgaaaagtccgattggagatggcaacccgaactcgattcacctcatgttgtcgcaggattgctctggattcaatttgggttccttcttcatgcgccgcggcacttggacggatcatttacttgatgtttggtgggatcctgtggcatacgaacagaagcacatggagtgggaacacaaggagcaagatgccttggagcagctttacactgcgcaaccttggattcggaagagtacggccttccttccgcagcgcatgatcaacagtttccctacaggcgcctgctctgaaaagggcactgatccgcgcatacattacgaccagaaggatcgggatttcctggtcaacatggccggatgtgaatggggccgagactgctggggtgagatgtacaacttccgcgagctgagctatcacctcaaccggtcgttgtgggaacgattcaag

SEQ ID NO: 27861 - DNA, 2238 bp, Neurospora crassa
tttatggacgacgacgacgacgacgatgcccagcaacagcgccgctccgaaagagcgaggagacgcgccccccgccacaagtacaaggagcttctccaggaactggccgaccgcaagatcaacgagatagtcatcgacctggacgacctgcagtcatgggaggaggacgtcaacgagggcctcaagctggttgagtcggtagagcgcaacaccaagcactacgtcgaggtgctctcgcgcgccgtcgacaagctgatgccccaaaccagcaacgacatcacattcaaggacgatgtgctcgacgtcctcatggccaaccgccaacagcgcaaccgcaccctcaccgaggccgccgagaacctgcgcgaccccgacatgctcaacgacacataccccgcccagctcacccgccgctacaccctcgtcttcaagccccggaccatgactgctgatgggccccaaaaagccctgtcggtccgccaagtgcgcggcgatcatctcggccacctgatcaccatccgcggtattgctacccgtgtgtccgacgtcaagcccattgtccaggttggcgcctacacgtgcgaccgctgcggttgcgaaatcttccagcccgtcaccgacaagcagtacgcccccctgactctctgcccatccaaggactgcaaggagaaccaggccaaaggtcagctgtacccgtcgtcgcgggcttccaagttcctgcccttccaggagatcaagatccaggaactcgccgagcaggtccccatcggtcagattccccgtacccttaccgtgcttgcgtacggcagtctggtcagaaatgtccaccccggtgacattgtcgacatctcgggaattttcctccctactccttataccggcttcaaggccatgcgcgccggtctgctaaccgacacctacctcgaggcccaccacattgtccagcacaagaaagcctacaccgagatgcagatcgacccctccctgctccgccgtatcgccaaattccaacagaccggcaacacgtacgagtacctcgccaagtccatcgcccccgaaatctacggccacctcgacgtcaagaaggccctcctccttttgttggtcggcggtgtcactaaggaagtcggcgacggcatgaagatccgcggcgacatcaacatctgcctgatgggtgaccccggtgtggccaaatcgcaactgctcaagtacatctccaaggtagccccgcgcggcgtgtatacgtctggccgcggttcctcgggcgttggtctcaccgccgccgtaatgcgcgaccccgtgacagacgaaatggttctcgaaggcggcgccctcgtgctcgccgacaacggcatttgctgcatcgacgagttcgacaagatggacgacaacgaccgcaccgccatccacgaagtcatggaacaacaaaccatctccatctccaaggccggcatttccaccactctcaacgcgcgcacctccatcctcgcggccgccaacccgctttacgggcggtacaacacccgtctctcggccgtcgagaacatcaacctccccgccgctttactctcccgtttcgacatcatgttcctcctcctcgacacgcccacgcgcgacacggacgcccaactcgccaagcacgtcgcctacgtgcacatgcacaaccgccaccccgacattggcacgggcaccggaccggattcatccgtcttctcccccgaggaagtccgtgcctacgtcgccaaagcccgcgagtaccgccccgtcgtcccgcaagcagtctccgaatacatggtgaaaacctacgtccgcctgcgcgcacagcagaaacgcgcagagaagaagaaccagaactttggccataccacgccgcgtactttgctaggtgtcgtccgtcttgcgcaggctttggctcggcttaggttcagcaacaccgtcacgcaagatgatgttgatgaagctctccgtctcgtggaagctagcaaggagtcgttggcgcaggatgataggaatactggcaataagagggcaatgaatgctagtagtaggatttataaccttgtgaaggggttggcggatagtggagcgtgcagacctgatgataccccagaagaggaagaagaagatgagtttggggtggagatgagtttgagaaaggtcaaggaacgggtgattgccaagggctttacggagcagcagtggttgagtgcgttggatgagtatactgatttggatgtg

SEQ ID NO: 27862 - DNA, 3349 bp, Neurospora crassa
caattcacacaaaatggctggcccatcacgactccccgacaagaaacaggcctccatctcgagcttcttcaccccacgaaacaccagtccgctggtcaacctcagccaaaacgcctccaagaagccgccaccagccgagtctaaatcatccaagtcgacatcctcgaggaaacgacccgaaccccaaaccgacgatagcgaagatgacgttcccagagatgccaaacggcgcaggtcgaatggcccatcggcagcaacagacaccgaagacgccgttgcctcactgaagctttcttcctcctcccgaacagaacggtacgctcttaactcgagccggccctcccaagacgagcaagagaaggaagaagacgtcgccgaacgcaaaaagaaggaagaactccaccgaaagtttgtcaagaagctcggtcaccccgacagcatgttcagctacagacaacgagacaccgagtccgctgccgtcgagggcgaaggcgaagagggcgaagacgacgaagaggaaccagcacccaaaaccacggccaaaaagaagggcgccaagacgggcaagctcactcccatggagctgcagttcctcgaaatcaaacggaaacacatggatacactcttgatcgtcgaggtcgggtacaaattccgcttctttggcgaagacgcccgcatcgcggcccgagaactgagcatcgtctgtataccgggcaagttccgatacgacgaacacccttccgaagcccacctcgaccgttttgcgtctgccagcatacccgtccaccggttgcctgtccatgctaagcgtcttgttgctgccgggtacaaagtcggagtagtccggcagatcgagacggccgccttaaaaaaggctggcgataaccgtaacgccccctttgtccgaaagctcaccaatgtctataccaagggcacctatatcgatgagacgggcgagctggaccagccaggcgagacaacgggtgcttcctctggtggttacctgctttgtttgacagagaccccggccaagggcatggggactgacgaaaaggtcaatgtcggcatcattgccgtccagcctgctaccggtgacatcatttacgacgagttcgaggacggcttcatgcggcgggagatcgagacccgactgcttcatatttctccctgcgagtttctcatcgtcggcgacctcagcaaagccactgataaactcatccaacatctctccggcagcagcaccaatgtctttggtgacaagagtcgtgtcgagagagtccccaagagcaagaccatggcagccgagtcttactcgaacgtcacggatttctacgccgggaaggccaaggacagcgatgaacgctcagcagctctgctcaataaggtgctcaagcttccagaggccgtcatgatttgtctctcggccatgatcacccacctgaccgagtatggcctacagcacatctttgaccttaccaaatatttccaatcattcagcacacgccaacacatgctcatcaacggcaccaccctcgagtctctcgaagtctaccgtaacgccaccgaccactccgagaagggctctctgctttgggccctggacaagacgcacacccgcttcggccagcgtctcctccgcaaatggattggccgccctctcctcgaccagcaacgcctagaagagcgcgtctcggcagtcgaagaactactaaacaatcagtccaccgccaaggtcgacaaactagtcaacatgctcaagtccatcaaggccgacctcgagcgcagtttgatcaggatctactacggcaaatgcacccgccccgaactcctctcaactttacaaaccctccaaaagatctccttcgaatacgcccgcgtcaaatctcctgccgacacgggcttctcctccactttgctcacatccgccatcatgaccctgccgtccatcagccccatggtcaccgcccacctctccaaaatcaacgccgaagccgcccgcaaagacgacaagtacgccttcttcctcgagcagcacgaaaccgaggacatttccgaacacaaactgggcatcgcagctgtggaacaagacctcgacgaacaccgctccgaagccgccaaggacctgggcaagaaagttcccgtcaactacgtaaccgtggcgggcatcgagtacctaatcgaagtacccaacacggacctcaagcgcgtcccagcttcatgggccaagatctccggaaccaagaaagtctcgcggtttcacactcctacagtactgaggttgatagccgaaagagatcaacacaaggaatccctagcttcagcctgcgaccaagccttttccgacctactatcgcaaatagcaggggagtaccaaccgctccgcgacgccgtctcctcattatccactttggactgcctcttgtcactaagcacagtcgctgcattaccaggctacaccaaacccactttcctaccctcttcccatccttctttcctctccatcaccgaaggcagacatcccatagccgaacacctgttgcccaatgggtacatcccatttaccatgtccctcggcactttgtcttcgtccgcctcttcccctgaccctaaccctaccagtccctctggaaagccagccctagcccaactaatcactggtcccaacatgggcggcaaatcctcctacacccgcgccgtcgcgctgttggtcttactcgcccagatcggctccttcgtgcccgccacttccatgtctctcaccctctccgacgccatcttcacccgcatgggcgcccgcgataatttgttcaaaggcgaatcgacattcatggtcgaagtctccgagacggctgccattctgcgccaagcaaccccccggagtctggtggtgcttgacgagctaggccgcggcacgtccacgcatgatggacgggcgatcgctggtgccgtgttggagtatgtggttagggacgtggggtgcttgatgctgttcgtgacgcattatcaggatttggctggggtggcggagggtttgaccgtaggtgagggagaggagaaaagacggggagtggagtgtgtgcatatgcggtttgcgagtaataagtctaggacttcgatggatgatgatgcgatggaggtggatggggatggggatgggcaagaaggtgcaggggcggataaggatgaagaggaagagattaccttcttgtatgatttggcgccgggtgtggcgcataggtcgtatggactgaatgttgcgagactggcgaggataccgaggaaggtgttggaggttgctgcgagaaagtcgagtgagttggagaaggaggtgagggcaaagagaatcaag

SEQ ID NO: 27863 - DNA, 1291 bp, Neurospora crassa
ataccctcactatacagccccctccttaccgacaactttggccgcaagacccccatcatcatcggctgcgttatcatgatcgtcggtgccgttctccaggccacggccaagaacctcgatacattcatgggcggccgtaccatgctcggctttggcaactccctcgcccagatcgcctcccccatgcttctcaccgagctcgcccatcctcaacaccgcgctcgtctcaccaccatctacaactgcttgtggaacgttggtgccctcgtcgtctcgtggttggcctttggcaccaactacatcaacaacgactggtcatggcgcattcccgccttgctccaggctttcccctccatcattcagctcctcggtatctggtgggttcccgagtctccccgtttcctcatcgccaaggacaagcacgacgaggccctccacatcctcgccaagtaccacgccaacggcgaccccaaccaccccaccgtccagtttgagttccgcgagatcaaggagaccatccgcctcgagatggaatcgaccaagaacagcagctacctcgacttcttcaagagccgcggcaaccgctaccgcctcgccatcctcctctcgctcggcttcttctcccaatggtccggcaacgccatcatctccaactactcctccaagctgtacgagaccgccggcgtcaccgactccaccgccaaactcggtctttccgccggacagaccggtctcgcgctcatcgtgtccgtcaccatggcgctgctcgtcgacaagctcggtcgtcgtcttgctttcctcgcttccacgggcggcatgtgcggcacctttgtcatttggacgttgacagccggcctgtacggcgagcaccgcctcaagggcgccgacaaggccatgatcttctttatctgggtgttcggcatcttctactcgctcgcctggtccgggttgctggtcggctacgccatcgaaatcctcccttaccgacttcgcggcaaggggttgatggtcatgaacatgtcggtgcagtgcgcgctgacgctcaatacttatgcgaaccctgttgcgtttgattactttggtcctgatcactcgtggaagctttatcttatttacactgtgagcttttcatctcctttttttttgttcttctggcgcaacaaatactaacagtagtgaaaagtgctggatcgccgccgagttcgtcttcgtcttcttcatgtacgtcgagaccaagggccccacgctcgaggagcttgccaaggtcattgatggcgatgaggccgatgtt

SEQ ID NO: 27864 - DNA, 2493 bp, Neurospora crassa
ccatcacaggttgtcgttggatcccagtccgctggaaagtcgtccgtcctcgagaacattgtcggtcgcgactttcttccccgcggcagtggaatcgttactcggagacccctcattcttcagctaataaacgtccccgccgacgacgacgccgaagatgcaacccatcccagctacaggaaccccaatgctgctggccgcaacgagtgggcagagtttcaccacattcccaatcggaggttcaccgattttggcgacgtcaagcgcgaaatcgagaatgagaccgcgcgagttgcgggtaccaacaagggaattaaccgccagcccatcaacctaaagattttctctccccacgttttgaacctaacgctcgttgatttgcctggtctcacaaaggtacgccgctttgaagctctggtgaacatgccgtcataacttggtctaacgtatatccgtgcaggttcccattggagaccagcctacagacatagagaagcagacgcgcaacctcatctccgagtacattgcaaagcccaacagtattgtcttggctgtctcgcctgctaacgtcgacattgtgaactcggaggccttgaagcttgccaggcatgtcgatcccatgggtaggaggaccattggtgttctcacaaaagtcgatctcatggatcacggaacaaatgccctggacatactgtctggtcgggtctacccgctcaagcttggttggattggcgtggtaaacagatcgcagcaggatattcagggcaacaagcccatggaagaggccttgaagtccgagtccgagttcttcaggcatcatcccgcgtatcgaaacatctccacccgttgcggaactcagttcctcgccaggaccctcaacaccaccttgatggctcacattcgcgaacgcttgccagacatcaaggctcgtcttaataccttgatgggtcaaacccagcaggaactggcaagctacggggacatgcacttcagtggcaaggagcaccgaggttctcttattctgcagctcatgaccaggtttgcgtcatctttcatcgcgtccattgacggtacctcaacggaaatctcgacaaaagagctctgcggcggtgctcgcatctactacattttcaactcggtctttggaagctctctggaatcgatcgaccccacttccaatttaaccgcgctcgatatccggaccgcgattcgcaactcgactggtccccggcctagtttgtttgtgcctgagatggccttcgatctccttgtcaagccccagatcaagcttcttgagccacccagtcagcgctgcgtagagttggtatatgaggagctcatcaagatctgccacacttgtggctcgactgagctatcgaggtttcccaggctgcaagccaagctcatcgaagttgtttctgacttgcttagggaacggttgggtcccgcgtccaactatgtcgagtcgctaatttccatccagagggcttacatcaacactaaccaccccaacttcctcggtgcggctgcagcaatgagccacgttgtgagcaataagcaggagagagagaggaaacgtctgattcaagaggagcgcgaaagacgtgaacggagacggctgaaggagcttggcacgaatgccaccgagacccctattgaaggggaagaagaaagtactaccctggagaagacggacaacgtccacgtgcgcaaaaccgctggaaagggtgcccgcagcatgtctccggctgtccgggagaacggccccggcagcattgcaagcgctttgaacggagccagatcgaattctccttctcgcttcaacggagggcaaggcgtgggtaatgccaaggagtcctttctgaactatttttttggcaaagacggagccattgttcccggtccttcaaacagcggcaacattggacgccatgtcaaccaggccatggagcctacatttagccaaagcatgagacgcccagacgacagacaggtgcgagcgcctgctcagtcgatgaaagtggatgatgacatggactatgtcggcaatgcgaagggcactgagcttgtgagttggccatattcgctttaagtctcttgcaaatgttttttttttttttttttttttttttttttttctctttttgcgcggcctatgctaacaactttctgatgcagagcaatgacggcgagccggccatgacagatcgcgaggcgatggaagccgagctgatccgggctttgattagctcctacttcaacattgtgcgcgaaagcatcgcagatcaggtgcccaaggcgatcatgcatttactagtcaaccactgcaaggatgttgttcaaaaccgccttgttagcgaactctacaaggagacgctgtttgaggagctgctttatgaggatgatgcagtgaaaaaggagcgggagaagtgcgaaaagttgctccagacatatcgggaggcggctaagatcattggtgaggttgtataaggc

SEQ ID NO: 27865 - DNA, 1406 bp, Neurospora crassa
tatgcagacactctgccgtttcttcggatcaacagcagcacgcgcgtgatttttcagggctttacaggaaaacaggttcgatcaccctgtcattccttcatgaatatctcctatgtacacccaagctaacgtggagcgggactttcaggccacagcaaatgctaaggactctttagcatgggggaccaagatagtcggtggtgtgatcccgggccgcaccggagagcatctcggccttcccgtgctaccttccgtacgccaggttagaaatgaaccgacagctagctctctacgtcctggtcaagcctttcatccaattctagaaccccgaaagagctgacattgggcttataggccatggagtatctcaagccggacgcaacaggcatctatgttgccgcccatcaggcccccggggctatcgaagaggccatcgaagccgaagtaccacttatagtcgctgtcgccgagcatattccagttcacgacatgctcagagtaagctcctcgcacaagaggaggcccaattacgctcggccctcatatactgacacttgtatgtctagatccactccatgctcaagactcagtccaagtctagacttgtcggtcctaactctcccggcatcatttcagctgtagggaagtgtcgagtaggtaagcaagttgtctcgaccgcccacatacagcatatcgtgggtggaatttgtgtccctggtaaaggtaaagactaacatttcaatatcttccttgatagggttccaaccattgccgtgcttttcgccagggcgggtgggtattgtagccaaatcaggcactttgagttacgaaagtaggcagtactctccccttcccaaggtgtctctgaagtcatcccccaatatgggtgctcatctcatactaatcactgcttactttgcagctgttgcatcaaccaccagggccgggcttggacagagtctgtgcataggcgtgggcggcgacatggtacctggaacggacatggtagaagcgttgagtgtccttgagaaagatccagacactgaagccatcgctttgattggtgagatcggcggtatgggagagctcgaggctgcagcttggatcaaagaatactactctcgtagtaaatctcccaagtatgtcatacagcctactaaatcttcgccgccatgtactgggtctgttgtgaaatggctaatatggtacttgacaggccgattattggtcttatagccggcgtaaatgaggcaccgggccgcatattggggcatgccggtgcctttacgttccttggagaacctactgcaaaggcaaagatcgcagcactcgaggaagctggtgtgattctggttaatcacccagccaaaataggcgatactctaaagacaaagttgcgagaaggc

SEQ ID NO: 27866 - DNA, 849 bp, Neurospora crassa
ctagccgtcggcatcgatcgctcagcacgatctcctgccatcctggtcgccccttctatcgaagactggatggaaggggcccagcgcacctccgcgccggtcaagagctttccgttcgactaccgccggggacccgacgaattggccatcgaacggctcgcgagctacctccagctgagcaacaagggagacagcgcggtcgactcactccggcggctcatcgagaccttggccactctgttctatgaaaaggagggactcctcctgacgacgcacatcgtcgagcgactcagaggaataaaagtcgttcacgcccgctttgccttcgatcaagccaccttccgcaacggcacgcctccggacaagatcaaggctatgtatgtctgcgctaccgatgagccggccgaggccaaggcggaacggagcggcatcgtgtacatcaagctgcccggggaggacgcgaccatcgggacgctggtgaacggggccgggctggccatgaacacggtcgacgctcttgcggacgcgggcgggaaggcggccaacttcttggacacaggtggcaaagctacgagccagacggtgaaagaaagctttatgatcatattgcaggacccgcgcgtgcgtgtaatatttgtgaatatctttggaggactgacacggggtgatgtgattgcccacggcatcattgtggcctttaaggagctgtcgcttacggttccggttgtggtgagaatcaggggtacgaacgagacggagggacagaagatcattgcggatagtcagctgccgctttatgcgttcgatgattttgaggtggcggcggccaaggcgatcgagttgtctcgc

SEQ ID NO: 27867 - DNA, 837 bp, Neurospora crassa
gtcttgtacagcggctcattcatcggcgcctccttttctacccatgcgtggcagcttcttctgagccagggcgtctgctttggccttggtatgggtttctgcttcacagctaccgtcggtattgtcccgcaatggttcaccaagcggcgatctttcgccaatgccctggcaacaggcggttccggattcggtggtctcacctacgctctgggagcgaacgccatgatcgcaaatctcgggttggaatgggcattccgcatcctggccatcacctgcttcaccgtgaacggctgcgtcagtctgatcatcaaagatcgtaacaaggccgtcggggccaagcatatagctttccacaaggatctcttcttccagccagagtattggctcttcgtcggctggggattctttggtatcattggctacatcatcgtcgtcttctccattgcagactttgccctacaggctggcttcactagcaatcaagcatcgttggcatcggccatgttcaattgtaagcgtcgcccattctcctcgcgctgaaagtatggcaagcagcgtcttggtcttgttcatccacgctaaccatttcctctcaattcagtatcccaagcgcttggcagacctgcaattggcctcctcagcgataggctaggaaagatgaacgtcgctggaatagggactcttattgccagtgtagtcgccttctttttgtggatcttcgccggcaaatacttcgccgggctcatcatctacgcgctctttggcgcggtagccggcatcatttggccatgcgtggggcctgtaggagcggaggttgttggtatacagctattgccc

SEQ ID NO: 27868 - DNA, 1140 bp, Neurospora crassa
gttcgcggctacaacccgctgacccctcccgacctgctccaacatgagatcccccagaccgctgaatcgaaacaaaccgtcatcaatggccgcaaggaggtggtcgccgttgtcaatggcaccgacgagaaggaaaggttactagtagtcatcggtccctgctccatccacgatcccaatgccgccctcgaatactgcgatctactactcaaggagaaggagaagcacaaggatgagctgttgattgtcatgcgatcctacctcgaaaagccccggacgaccgttggctggaagggcctgatcaacgaccccgatatcgacaacagcttccagatcaacaagggcttgcgcctgagcagacagttgttcgttgacctcacctccaagggcatgcccctcgccagcgagatgttggataccatcagcccgcaattccttgccgatctgttgagtgtcggcgctgtcggtgctcgcaccaccgaaagccagctccaccgcgagttggccagtggcctcagtttccccgtaggcttcaagaacggcactgacggtaccctgggtgttgccattgatgctattggcgctgtcagacatccccatcactttttgtccgtcaccaagcccggtgtcgttgccatcgtcggaactgttggcaacgaggactgcttcgtcatcctccgtggcggtaccaagggcaccaactacgatgcgaagagcatcgctgaggccaaggctgcgctggagaagagcggcttgcgccagcgcctgatgattgactgcagccacggcaactcgaataagaaccacaagaaccagcccaaggtcgctgccgaaattgcgcaacaacttgagaacggcgaaactggtatcatgggcgtcatgattgagagcaacatcaacgagggcaagtctttttattttgtttattttttttattgggggcatatgaccgtctaaatttgaagctgttcgctaacacaacgtacaggtaaccagaaggtgcccgaggaaggcaagtgcggcctcaagtacggtgtcagtatcactgatgcttgtattggctgggaggacactgtcgccactctcgacacgcttgcgcaggccgtcaaaaagaggagagaagtcctgagcaagaacgcc

SEQ ID NO: 27869 - DNA, 4115 bp, Neurospora crassa
tgtcagtgcaacagcgacttgcccatggccgctttcaagctagctctggcaagcgccttccttatccgtttgatgggatggctccctgtcctttccgggcttactgccgcgagtctgaccatccctctcaatctacacctgtcacgaaagcaacgagaccagaactttggtttgatgcgagtccgagattacaaagcgcatttgctggccgaggcgctattgggaatgcgccagatccggtactcggcccttgaggacttctgggaggacaagatcctggcaagcagagacgacgagctcaagcagtattggagagtggcactcgggaaatgcctaatcttcttgactgttaattttgccccattgttattagccagcgttgccttcacggtgtatgtatggcagcaaggattccatatcaaagcttcagtcatcttcaccgccctcggcttgtttgaccagctggacgacgcagtgtcacttctacgaaaggtacaggtcaacctacttgaagcgtgggcaagtgtctcgagactggacaagtactttggccgtctggacaagcaagtggtcactaagccagggagtctgattgctttcgaggacgctactgtagcttggccccgacctgaagatactgacaaagtcggcgatgctcaagcaccacctcgaggagcacataccatgctcaaagatatcaacgtgaagttcccgcccggtgagctcagtgtcattgcgggcaaaactggttcgggcaaaagtctattgctcgctgcaattttaggcgaagttaagctcatagcgggtgacatctacgttccttctgccccggagcctagcgaagacgagaatatttcggaccaagactggattataccctccctgacgtgctttgtatcccagactccatggattgaaagcggcacagtcagggacaacgttctctttggcctcaagttcgaccgcctccgctaccgcaaggttctctgcgcttgcgcccttgagaaggatctgcagcttttggctgacggtgaccaaacagaagttggacccagaggcgtttcactgtccggcggacaaagatggagaacagccctcgcccgcgccctatattcgcgagccggcatcatcgtgatggatgatatcctgagcgctgtggatacgcatgtgagcaggctcatcgtgggtgaggcattggcgggagagttagccgtcggaaggacaagaattcttgcgactcatcatgtcgatcttgttcgcccgtacgcgaggtgtttggtgcgtctgagtagcggacgcctcaagtctgtcgtgtacaaggctcccgaaagccagaacataagacctgccacatcaatgctcgaacctgggagcctaacgtggactcggcctgatggtaacggagcagcctcgtcctccagttcgaccgcgagggctacagaaagcagacaaaccggcgaagagaagagagctgttggatgggtcaaatgggacgtgtacaaggcatattatgaggccagtggtggtaccctgaactgggctctaggcatggccgtgctctttctcggtcacgttctgggcatcattcgtacatggagtctcaaggaacttgctcaaagggcgtcttccgttgaagcaagttcacagacatcgtctacaacccagtatcatcaaacatactggcaaatgacttttggatacgttgctgaccagcatatgccttggagttctaagctctatattcgcttttgtaagttcagggacaaggatacaaaccatactaaagaagtgtaactaactcgatgtcatagggatctcgacatatgttctagtttgtttcctcgtcggtgcgtcccaactcatccgcgatattgccttcactctcatcggaatgcgagcttccaagaagctatttgaacagctcacacatacgatcctccgtgcgcctatccgatggattgaaactgtaccagcgggccgtgtattaaaccgcttcagttcggacatgtcagtcgtcgacaaaccgctggccaccccgacgtttacgttcctacaagcagccctactactgatgatcatcgtcgtgacatggtatgtagtacccgtcgccttttgttgcatgatgtaatgttacacacaagaatggattcagctaacctgccctacacagttcctccgtctcgctatacgtcctcttctttgtcatactcctttttgccctctacgtttatattgcaaactacttcatatatgtcgccagagaggtcaagcgccttaagtccgtctccaactccccaatctacgaccagttcagctccgtgctgtccggattaacgaccattcgcgcctttcaatgcactcaatcgtacaccaacaacttgtaccgattgattgacgccaacagctccgcaaactgggcacagcaactcttgaagagatggatgggttttcgcatgggcatgctcggcgccgtcttcgtcaccatcgtggccagtgtcgtagcactgggtggtgtaggcgctgcgctcgcgggattcagcttgtcttttgccttccgttacacgtccgcactaacatctttactagagtccgtggcagcgctggaattggggtttagctcctgcgagagggtgttggagtacatcgaggttgagcgtgaaagcgaacagggtctggacgcccctgcagcctggccagcggatgggaacatcgaagtcgaaaacctcacggcctcgtatgcctgcgatcttcctcctgtcttgtccgatctcagcttgaccgttggagccggcgagagggttgggattgttggccggtcgggcgctggcaagtcgacgcttgcctctgttcttttccgtcttcttgaacccagcagaggctcggtccgcattgacggcctcgatatttcgacattgaagctaacgcagctgcgaaaaagtctcgtcattatcccccaagatccattcctcttctcgtacgcatatgaaattgacttgttacaccttttgatgtggatactgatgcattccgtcaatagaggcaccctacgttccaatctagacatcgaaggccgtctagatgatacagagatatacgacgcccttcgaagtgtcaacctaatcggttcaacctacaacaaccagagttacccaccatctttttacactccggtcatgggacccagcacggccgtctctacccacccgaacacggcttccaccacaccgctcctggcaccgattgttttcccccaaaccgtcgacttcgccgtcgagcccgcggccgaagaagtcgacatgttcgacgacatccacacattgggtgacaaccgcgtccaaatcacccctttcgttctcgacaccagcgacattgaccccctcaacctcctcacttttgattcacatcccgaaaatccaacactcctcacctccatcctcgaagtcgaacaaactcccacatccgagcccgcacacatactcgaaccctcaccaacagaagaagagcccatatccccacctcccgtaacccttccagcccctctgctccctcttcccccctccccagccatctccgccacaaccacagctaccaactacaccgcccccgatcgccaccgcatcaaccctttcaccgacctctcccaccccatcatcacaggcgggtccaacctctcgcagggccagcgacagctcgtctgcctcgcgcgcgctttgcttacccgccccaagatcatgattctggatgaggccacgtcggccattgataaagcgaccgacgcagccatccagcgttcgctgcgcaagtgcgttgagagtaccggcaccacggtgctggtgattgcccatcggctgtcgacggtggccgactttgataaaatcctagtgttggacaaggggcaggtggtggagtttggggcgccgcgagagctggtgaggaggggggtcgagagggagagggagaggcatagacaggatgatggtggtcatgatggtggcgctagtgatcacggtgagaggctagcggaaagaagtgttggtagtaatgactattttggtgatgacgaatgttcggaggaggacatggaagatgcagatacgagtacgttttgggggctg

SEQ ID NO: 27870 - DNA, 864 bp, Neurospora crassa
atcccggtcactcatcagagcttccccggcatggagaccgagatgccgaacccgcagcccctgtgggatgagattcctaccgctgacgggaagagccagaagtaccgcgctgccggaaaactcaagggcaagaaggccatcatcaccggaggggactctggcattgggcgcgcgagcgccatcctctttgccatggagggagccgactcagtcatcgcatatcttcccgaggaggaggaggatgcgcaggaaaccaagagaagggttgaggcatacggtcagaagtgccacttggtgtctacagatctccgcgacagggaaaactgcaagaaactggttgatgaggctgtcaagatcttcaatggccaaatcgacatccttttcaacaacgctgcctaccagatggtagtcgatgacattaaggatctgtcagaagaccagtggatcaacaccttcaacaccaacattcacccctacttctacctggccaagtattctttgccatacatgaagcgcggaagcactattatcaacaacgccagcatcaacgcctacatcggtcgtcccgaccttctcgattacacatccaccaagggcgcaatcgtggccttcactcgcggcctgagcaatcagcaggctggaaaaggcatccgcgtcaatgctgttgcccccggacccgtttggacacctctcatcccatcaaccatgaagagagagaaccaggagcagttcggatccacacccttgggtcgtcctgctcagcctagtgaggttgctactgcagttgtcttcttggccagcgaggatagcagcgctttcagtgggcaaacgttgcaccccaacatgggaactgtcgtcagcggt

SEQ ID NO: 27871 - DNA, 1437 bp, Neurospora crassa
atgcatctccccaccgttctttctgtcatcttcgctgcggccggcgttaccgcccagctcaacgatctcgccgtcgctgccggtctcaagtactttggtactgctggccaggaaggcaccatcacctcggataccacttaccgtaacatcatcaacaacgtgcacgagttcggccagctcactcccgagaacggcatgaagtgggatgccaccgagggccaacccggaaagttcaccttccaatcgggagatattgttgctggagtggccaagagcaacggacagctcttgagatgccacacgctggtttggtacagccagctgccttcgtggggtaagtacctctaccttttatcgttgaggtcgacgtggggatggaacggtgtactgacagggaatatacagtctccaacggctcctggaaccgtaacacccttcagtccgttatcgagtcgcacattagcaatgttatgggccactacaagggccagtgctacgcctgggatgttgtgaacgaggccatctccgatgatgctcaaggcaactaccgcgattcgatcttcttcaagaccttcaagacggattacttccccattgccttcaatgctgcgaagaaggctgatcccaacgccaagctgtgagtctgctcttcgcatcagccacatcaacatgatggtacccaaactaacacctcccagctactacaacgactacaacctcgagtacaacggcgccaagaccgaaagggcccttgagctcgtcaagctcatcaaggctgccggcgcccccattgatggtgtcggtttccaggcccatatgactgtcggcggcacgccctcgcgcagtgccatggccaccctcctcaagcgttttaccgctctcggtgttgaggttgcctataccgagctcgacattgcgcacaagaaccagccctcctcctcctcggtccaggcccaacaggctaccgactatgccaacatggttggctcctgcgtggacgtcgacggctgcgtcggtgtcaccatctggggcttcatcgacaagtacaactggatccagaacggtaacgctgcgatcttcgatagcagcttcaacaagaagcccgcctattccgctatcagctccgtcttggccgctgcggcgacgaaagcccctactccggccaagaacgccaactcccctcctgctgtgcacacgaccctcaggaccgcgattgcgactgctcctgcctgtgaggcgaccgccactgcccccaaggccacggcggcgcctgctgcccagccggctaagccggccaccggttcctctactggcgcgcagcagccgcgttgggcgcagtgcggtggtaacggatacacgggccccactgcttgccaggccccgtatacttgcaaggttcagaacccttggtatagccagtgcttgtaagcttttcga

SEQ ID NO: 27872 - DNA, 2436 bp, Neurospora crassa
ccaatcgaaaccaagaccgctgccatagcgaaagatgggagcgttgatgctgagtctgctggtgagcgcttcaatatgttcctagctgccaatttccataccaccaactacctctaacaacgcgtcatccagatatcacaacagacactaccgtcgatacgcctttacagctggtcaccaagaccctcgacacgtccgatgacccgactgagaatatctacaccttccgtgccttcgtccttgggctaggcttgtcggcctttggtgctgttctcggcgagatcttctacttcaagccacaaactgtcaacgtgagcattgtgttcctgatcatgatcgcctactgtcttggcgaggccactgtcttgatccctcgctggggtcctgttggccgttttctcaacccggggccgttcacccagaaggaacacgttttcatcgtcattatggccagctctgccgccacctgtgccctcggaaccgaacaacttgccgcccagtctctatactacggcaatcaaccaaatgcagcgtcggccattttcatgctgttctcctcgcagtgcattggctatggtcttctcggtggcatacgcaaagctttcatctaccccaccaaattcgtctggccatcacagcttccaaatgcagcactattccagtcgatgcacctaaacaaggaactggccaagaaacgactcaaaatcttctggtgcatctgcttggctgtcatggtctgggagattgtgccccaatggatgtttcctctcaccactggaatttccatcttctgcctcgccaaccaggactcggccttcttcacgcgcctgttcggaggagccaatggaaacgagggcatgggcttccttagctggtgcatggactggcagtacattggagaaaaggagtttactctgcccctgagtacattggtcaaccaactcatcggctacattggctgtattgctttgaccttgggcgcttactactccaatctctgggatgcgaagagattcccctttatggcgcaatctttgtttacttccaatgggaccgtctatgaccagacacagatcttgggtccagacaaccaggttgatccagctgctttgcaagcctacgggcttcccaggtttgccaccagcaaagctttgagtttgctgatgaagaacatgggcatcacggcagctgtggtacatgtcattctctggaactggcatgacataaaattcatatttggtccttttcggccttcgacttggaagcaaaacgtccagaaagccagaacgtggtggcaccatgggttcagctcatccttctggaagaacttcacctctgacgcagacacccctcgcaaagaataccccggtaccgaaggggacccccattacgccgctatgcgtgcctacaaggaggtgccatcattgtggtatctcagcatcctcgccatctcaatcatgattggcctgatctgctgttaccagcaaaagactggcctcccttggtgggcgttcctacttgccgtcctgctggcctggatcttgaccattttctttgcgtgcatgtatggcattgttgggttctactatcaaccaacaagcgcggttcagatgatcggtgcttacatggttcctcgcagaccggtagcgaacatgatgttcaccctctatggatccaatgccctggtgcaagccatccagatgttgggcgatctcaagttggcacaatatgcgaagctcccacccagagcaacctttcttgcgcagattcttggaacatgtgctggctcagtgttcaactgggtcatgatgaacagcattgtggataatcggcgcgacattctgttgtccgttcagggcaccaacgtctggtctggtcagaatgtacagacttacaattcccaggcggtcgcttggggcggtacggccaatgagatcttgtgagttgagtctgaccgtgccattagcatccatgtctgagatgtgtgctgacaccaggtaccacagcggacgtcatggaacgtactggatggttccaatggggctgttcttcggaatctttgccccattgccattttggatcggtcagtcaggcgtatcatcctcaaatgggcgatgaagcccttggtacctctgctaacagatgctatattcaggtcacaagtacttccctcaactcagactcaaccatatcaacacatttctcatctgcacttggctgggctggttgtctgtcggtatcaactcttcgcttttggcatactttgtgtttggcttcttttcccagggctatcttcgtcgatacaagccggcgctgtttgccaagtggaacaatatctgtgcggcagccatagccggtggttgttccttgatcatcttcatcctcacctttgccgtggcgggcggcagtggcaaggccagagacttcccggtgagt

SEQ ID NO: 27873 - DNA, 789 bp, Neurospora crassa
ctcgaaggcaaagtcgccctcgtcaccggcgccggccgcggtatcggccgtggcgtcgccctcgagctcgcccgccgcggcgcctccgtcatcgtcaactacgtatcctccgccggccccgccaacgaagtcgtcaaggagatcgaatccctccacaacggagcccgcgccatcgccatccaagccgacgtccgccgcgtgtccgagatcgaccgactcttcgccgaagccaagcgggcctttggccgcatcgacatcgtcatgtccaactcgggcaccgagtcctgggacaagaccgaggacgtcaccgaggagaagtacgactacgtctttgacctcaacgccaaggcgcagttctttgtcgggcaggcggcctacaagcacctggagcgcaacggacgggtgattctcatgacgagcatcgcggcggggctgatgggggtcaggaaccatgcgctgtataatgcgtccaagatggcggtgcaggggtttgtgaaggcgtttgcaacggattttggagataaagggatcacggtcaatggggtggcgccgggaggcatcaagagtgatatgtttgcggagaatgcgtggcattatatcccgggtggaacgcctgatttgggtaaggataagattgaaaagatgatggcggagcattgtccgctgggaagatgtgcggtgccggaggatgtcgcgagggtggtggcgtttttggctagtgaggatggggggtgggttaatggtgagttttctggcttccggtgtgaagggtacttagatgatgatgat

SEQ ID NO: 27874 - DNA, 675 bp, Neurospora crassa
gcgtggctatacctgtttgcggtgcttataaacgccgtcaacctcttccttcaagtcttcttcaccatcatgtacagcgatctggaatggtacgttggtcatcttatccccctctcaaaggcttctgcgaggacacgggacttggcatcctgcgcgctttgtggctggcgcctcttttcccagcagacagttgctaacggcatctcgcagcgattacattaaccctattgacctctgcaaccgcctcaacacttacatcatccccgaagtcgctgtccacggtttcctgaccttcctcttccttatcaacggctactggctgcctctcgtgctcaacctgcctcttctcgcctggaacgtcaagaagtaagttttaacaaccgcttggatggcaatatccgcagcttgcgcgaatcggataactaaccatgcggtgcaggatcgttgacaacgcccaccttctggacgccactgagatcttccgcaagcttaatgtccacaagaaggtatgtcatcagctcaacacaaccaaccgcgtccgctgtggtggagcttcaagaactgcttctaaccgatctgcgcgctctctaggaatctttcactaagctcggcttccatctcattctgttcttcttttacttgtacagcatgattgtggccctcattcgggacgag

SEQ ID NO: 27875 - DNA, 1619 bp, Neurospora crassa
accgaatcctctgccgaggtgggcttgacggaggcgctggcgcaggcagaccccaagtcagcactcagcggcttgacccccaagcagattcaagagttcatcgacctgaaccccgcccttgccaacgagctgctggcggcgtctgggagctcgggaacaaccgacgtgatggaggccttcaagaaactcaagatccaggatatcatcaccggtctggcgagcagtggaaagaaccgtaaggacatggcgtcatacaagttctgggccacccagcctgtgccccagttcgacgagaaaccagccatcttcgaggaaggacccctcaagatccaaaaagtcgaagacattcccgatgagccgatcccactgaacctggcgcctttccgatgggtcaccatggacctcacagacgagaagcagatgcaggaggtcgagaagctcttgtacggtcactttgtggaggacgacgaggccatgttccgtttcaagtactcgacctctattctcaagtggtaagtgacacttggcgagggttatttcagtcgcgtccatgtggcttgtgctaatgactttgggctaggtcgctcatgtctcctggctggagaaaggaatggcacgtcggtatccgtagcggtgacactctttgcgctttcatcgctgccgttcctaccgagatccgcgttcgcgacaaggttatccaaggctccgaggtcaacttcctctgcatccacaagaagcttagaggcaagcgcttggctcccgtcctcatcaaggaaatcactcgtcgcatcaaccgtgagggtatctggcaagccatctacaccggcggtatcgtcttgcccaggcccgtcagcacttgccgctactaccaccgtgcgctcaactggcagaagctgtacgaggttggtttcagcccgtgcccttcaaacagcaagccggccttccaagtccgcaagtacgcccttccggaacagacgtcgaccaagggacttcgcgaacttcaggtcaaggatctcgacgcggtacacagcctgcttgagcgctacctgaagcgtttcgacctcaccccagtattcaaccgggaggagacggaacactggctccttcacaagaaggattcttatgccgagcaggtcatctactcgtatgttgttgaggtaagtttccagctacgatcccttttcctgacagttgaactcgtacgctaatctgattaggatgcctcgggcaaaatcaccgacttcttctccttctaccttctcgagtcgacagtcatcaggcacccgaagcacaattcgatccgcgctgcttacatgttctactatgccaccgagactgctttcaccgagcccttcgacaagggggctcttacgaagcgcctgaacgatctgatggcggatgccctgatcctcgccaagcgccacaactttgatgtcttcaacgctctttctctcatggacaatgcgctctttctggagaagcagaagttcggaccgggtgacggccagcttcactactacctgttcaactacaaggcgaaccccatccacggtggtgttgacaagaagaacaggctggacgaggataacttgagcggtgtcgggtttgtcatggtctaa

SEQ ID NO: 27876 - DNA, 939 bp, Neurospora crassa
atggctcaagagacgacgcgcgacggctccgacagcccctcgggctccgtcagtccccccatcgccaacggcaccaacaacaagaaggacaagaagagcagcaagaagcgcgcccactccagcggcgagaggcgatccagcgtcagcaagcccgcccgcgacccctcggacaagcccgaagagtcgccctccaagaagaagaagagaaagaccacctcctccaccgccgccgccgccgtcccctccaccatcaccgaagaagtctccccatccacctccgtgacccgctctccttcgcccgtcatcgactttgacggcctaagtcgcccttcgcgtggcacccgcgagcgtctggaggaaaccgaagcccaaaagcaggagcgcctcgacaagatgaagggcgccgtccggaccctgctcgaatgcatcggcgaggacccggaccgcgaaggtctcctcgccacgcccgagcgctacgccaaggccatgctcttcctgaccaagggctaccaggagaatgtgcgcgacattgtcaacggggccatcttccaggagggccacaacgagatggtgattgtcaaggacattgaggtcttttccatgtgcgagcaccacctggttcccttcacgggcaagatgcatatcgggtacatccccagcaacgcggtgattggcattagcaagctgccgcggattgcggagctgtttgcgcgccggctgcagatccaggagcggttgaccaaggaggtggcgaatgccattatggaaatcctcaagccgcagggtgtcgcggtcgtcatggagagcagccatttgtgcatggtcatgagaggcgttcagaagaccacgagcagtaccattaccagctgtgtgttggggtgctttgagtcgagggagaagacgaggctcgagttcttgagcttgattggcgtcaaccgc

SEQ ID NO: 27877 - DNA, 1048 bp, Neurospora crassa
atggcctcaacaaccacagacccaacgccagccacccagtatggcggcaacaacaaccccattgcccgcggcgccctaatagtcatcgagggactcgatcgcagcggcaaaacgacccaagtcaagcttttggaggaccgctttctgaaagccgggaaaaaagtcaagaccatgcgatttcccgaccgaaccacgcccataggccagatgatcgattcgtacctcaagtcgcaggcgcaaatggacgatcatgttattcacttgctgtttagtgccaatcgatgggaggctgtgtatgttttctttttttttctttttttttttcttttttcccctcttttggattggggtggtacatatacaaacagacagacagacagacagactaacaagttcttttcaattaaccagaaagaaaatcacctcggaactatcccaaggcaccaccctcattctcgaccgctactaccactcgggcatcgtctactcggccgccaaacaaaacccttccctctccttatcctgggcgcgcgcccccgaaatcggtctcccgcgtcccgacctggtcctcttcctcgacctcgacgaagaacaagcgcgcttgcgcggcgggtggggccacgagctctacgagaaagccgagatgcagcgccgagtaagggagttgttctggggattgtcgctggggagggtggggacggtgacggtgccggttggtggtgtttcggccttgggtggtgctgggacggggggtgagaagaaacggggtggggaggaggtgaataagagggaagcggtcatgcttgccgaaggaccaacggagatggaagaggtggcggttggagcgccgacgccactggctggggctgcgggcggtccgcatattgatagggagtatgcgtttaggcaggaggaggaggatttgcatgttattgatgcgagcgcgagcgtggaggaggtggcggaggagttgtggaaggtggtgagtgcgagagtagacgcggtggagaggggggaggttggcaaggttgtgaggagggtgttgtga

SEQ ID NO: 27878 - DNA, 1450 bp, Neurospora crassa
ctctggaaccccgagaacgtcaaggatgtcgccgagtcgataggaatcaacctgaccgaagagcccctccgcgtcctcacccaagatgtcgaataccgaattggccaggtcgtcgtcgaggccctacgcttcatgcgcgccgccaatcgcaccactctgacagtccaagatgtctcgcaagctctacgagttctcgacgtcgagcccctctacggatacgattccacgcggccacttcgctacggagaagccagcatcggtcccggccaaccgctgttctacattgaagacgaggaggtggactttgagaaggtcatcaacgctcccttaccaaaggtgccccgcgatatgagctttactggtaagcttgtttcagttctctctctcacccagtgctcacctcacctcaacctagtcgcatcagctaacacttttcttcctctcgcgcgcagcccactggctcgcaatcgacggcgtccagccctccatcccccaaaaccccaccacagccgagacctcctccaaggacctcctgcccaagggtcccggcgctaaccccgccgtcgccgccctcgccggcaacgacaacgtcgccttccgccccgccgtcaagcacgtcatcagcaaagagctcatcctctactttgacaaagtccaagcggccatcatggacgacgacccggacgaagaaaagacgcgcctgcgctccgcggctctggactcggtccgctccgaccccggtctccaccaactggtgccctactttgtgtccttcatcaacaaccaagtgacgcaccgactcgacgacctctttgtgctccggcaaatgatggaactcaccggcgccatcctcgacaacccctccatctttctcgacccgtacgcctcctccctcgccgcgcccgtcttgacctgcctcatggcccgcaaactcggcggctccgaatccagtctcgaaggaaccgacgccctgaaagaccagtaccgcctccgcgaagtggctgccagtttgctcggcaccatcgcacggaaatattccaagaccaacgccctgttgcgccccaaactcacgcgcacgtgcctcaagttctttttggacccaagcaagtcccctgcggtcttgtacggcgccatcagcgggctcgcggccgccggcgggcccgaggccgtgcgcatcctggttcttcctaacttgaagatgtttgacgaggggatcttgactccgctccgcgaaaagggcgaggcgagccatttcgagtacgaggcgctggtgggagggatcatgaaggccattgagacgctggtggaggggatcaccctgcctgttgttgcggacgtggccgagttggagagggaggggcagttggtgattgagtttttgggaaggacgattggtgaaagggtggcgaggttggggaaccagcatttgaatcgggggattttggaggtg

SEQ ID NO: 27879 - DNA, 1593 bp, Neurospora crassa
aggaaaatcggtgtcacaggtgccgtgttcctgatcctaaacaagatgatcggaacaggcatcttctcaaccccatccagcatcttcgcttccactggctcggttggcgtgtgcctgttgatgtgggccgtcgctggtcttctgaccctgtccggactcagcgtctttctggaattcggcctggccatccccaaatcgggcggcgaaaagaactacctcgaacgagtataccggcaacccgtctatctcatcaccagcgtctttgctgttcagatcgttcttctcggcttctctgccggcaactcgctcgcttttggccgttatgtcttgctggccctaggatacaacctgcctgatggatggccggccaggaccattgccgtgctgtgcatcactttcgtcgtatttctccactccgtcttacccaaatgggggttgaggctcaccaacgcactcggcgtcttcaaagtcctagtcctgctattgattgtcttctcgggctttgctgccttggctggccatcgtcgagtccccgaccctcacaactttgacgacatgtggtctatcgaaaagggcgatggtttcgggggcggaggggcgtatgcatatgctactgccctccttcaggtcgtctacagctacaagggctgggagaatgccaactatgtcatgggcgagctgaagcatcccaagcggacactgtccatcgccgcgcccttggcggtcgttggcgtgaccatcctttacgttctcgccaacgtcgcttactttgctgccattcccaaagccgagctggccaagtctgaggtcatcgtggccgggcttttcttccgcaacatgtttggagagagcgcggcggccagaagtctcccggctcttgtggccttgagtaacattggcaatgtcttggccgtgagttttacacactcgcgggtgaaccaggagctggccaaggaaggcgttttacctgggagcaagttttgggcatccaccaagccgttcaacacgcctgctgcttcagtgagttgctcaagtcatctggttttttttttcgtcatgtcattttctgactcggtgatagctattacttcattggatcgtgactgtcattgtcctggtcgggcctcctcccggacctgcctacaacttccttgtcaatctgtatgctccctccttccttgttgccacgtttgttgttgccacgttcaagtctaaccatgtggcaccagatacacctaccccggtgcctggatcaacggccttgtcgccggtggcctcatctacctccgcctcagcaagaccgaagaatggagttcaccgtggcgcacttggctaccagttatttttatctacctctgcctcaatatgttccttgccattacccccttcatccctcccaacgacgactggaatgccgacggctacccgtactacgctttcccccttgttggcaccggggtcctgggtctgggtgcagtatactgggtggtatggaccaaggttctgccccgctttgggggctatgaactcgtggccgagagggttcttgatgagaccggggcggaagtggtgcggtacagaaagctttccgcg

SEQ ID NO: 27880 - DNA, 988 bp, Neurospora crassa
ggaacgtatggtgtcgtctacaaggcccgcgacttggctaacagcgggcgcattgtcgccctcaagaagatccgcctcgaagccgaagatgagggcgtcccctctaccgccatccgtgagatctcgctgctcaaggagatgcgcgaccccaacattgtgcgtctcctcaacattgtccacgccgacggcggtcaaggccataagctgtatcttgtcttcgaattcctcgatcttgatctgaagaagtacatggaggcccttcctgtcagcgacggtggtaggggcaaggccctccccgaaggaacgggcgccggactgcacaatttgggactgggcgaggatatcatcaagaagttcatgagccagctttgcgagggcgtccgatactgccacagccaccgtgtcctacaccgcgatctcaagccccagaacctgctcatcgaccgcgacggcaacttgaagctagcagatttcggtctcgcccgcgcctttggtgttccactccgtacttatacccacgaggtcgtcacattgtggtaccgtgcgcccgaaatcctgctgggtggtcgtcagtactcgaccggtgtcgatatgtggtccgttggttgcatctttgccgaaatgtgcacacgcaagcccttgttccctggtgattcggaaattgacgagatcttcaagatcttccggtacgtttatgcagttaccttttcttggcacctttctgcttctcccctagtccgctatactgacctcttttcctccaaacagtctgcttggaacccctactgaggacatctggcccggcgtcacctcctatcccgacttcaaggcatctttccccaagtgggtacgcgactacaacgtaccactttgccaaaacctcgacgatgtcggtcttgagctacttgaatccatgcttgtctacgaccctgctggccgaatctctgccaaggcagcgtgcaatcacccttactttgaagactacaac

SEQ ID NO: 27881 - DNA, 582 bp, Neurospora crassa
atggccaacttccgccaattccgcccagatgacctgaacaaattctcaaagtgcaacctcgacccctttacggaaacatacgaacttggattttacttgcagtaccatgcaaagtggccatcgctcttccaggtcgccgaggatcagcatggcaacataattggatacagtgagcattcactattcatcactctttgtcttaccgtatactaacacacacaaacagtcatgggcaaacttgagtcctccccagactactacaagttctcagagcactacctcccctggcacgctcacatcaccgcagtcaccgtagcgcccgaggctcgtcgtctgggcattggcaagatgcttacggagcagctagaggccgctgctgacgccaacgatgcctggttcgttgatctgtttgtgaggagcaccaaccacaaggccatccaattctacaagagcatgggctacagcatcttccgcaccgtcaaggactactacggcgaccactcgagcgacccgaccaagtcgtcggaggatgcctacgatatgcgcaaacccatgaagagagacgtcaagaaggagcacatc

SEQ ID NO: 27882 - DNA, 1525 bp, Neurospora crassa
atggttatgccgactgttgtctccgaccgcatgggcactatcgatttcatcgattatacaaacaatcatgtcttttcaaagtgtcaaaccgacagcttgaacaccgtcaacaatggctccttgaagcacgatgattacctccacggccttgccaacggcaagttggtcgccaaacaaatgattggtgatgccctccgccagcgtgtggagagcatcgactccgagttctgcgagcccggcgatgaggacacattctttgtcgctgacctcggcgaggtctaccgccagcacctccgctggaagctgaaccttcctcgcgtcaagccgttctatggtgagttatcccaattactatgcgcttcgtatcgaggattcagtttgctgacttggatgtttgtcatcagccgtcaagtgccatcccgacgaaaggctcttgcagctcctggccgctctcggtaccggcttcgactgtgcctccaaggccgagatcgagcaagtcctccgcatgggcgtcgacccctcccgcattatctatgcacagccgtgcaagaccaattcctacttgcgctatgtcgcccagcagggcgtgcgccagatgaccttcgataatgccgacgagctgcgcaagattgcgcgcctgtatcccgacgccgagcttttcctccgcatccttaccgacgattcttcgtccctttgccgtttcagcatgaagttcggcgcttccctcgactcgactgatggtctcttgggccttgcccgccagctgggcctcaacgtggttggcgtcagcttccacgttggctcgggcgcctccgatcctactgctttcttgaaggctgttcaggacgctcatgtcgtcttccagcaggccgctgcttatggttacagcctgaagaccctcgacgttggtggaggtttctgcagcgacgattctttcgaacagatggctaacgtcttgcgtgctgccctcgatgagtacttcccggcccataccggtgtcaaccttatcgctgagcccggtcgctactacgcttcctcggcattcacccttgcctgcaacatcattgctcgccgcactatccaggacggctctgctgtctcggtctccgattcctcttctatgagcgacgatggatcggtgaacaacggcgatgctagatatatggtctacgtcaacgatggtctgtacggaaacttcagcagcatcatgttcgatcatcagcaccctgtggccaagatcctccgtgctggcggccgcaccatgtacaactctgttgctgcccacgagtcttctgcggaggacgccattgagtatagcatctggggtcctacttgcgacggcattgatcgcatcaccgagagcatccgcttccgcgagattcttgatgttggcgactggctgtacttcgaggacatgggtgcctacaccaagtgttcggccaccaccttcaacggcttctctaacgagcatgatgtcatctacgtctgcagcgagcctggtgctatggcgctcttgggattgtaa

SEQ ID NO: 27883 - DNA, 1719 bp, Neurospora crassa
attcgcaacgtcgtcgtcctgagcggtaactcgcacccaaaattcgtcgacagcgtctgcaattacctgggcataccgccggcaagccgcgtgctggaaaagttctcgtctggagagacacgctgcgagattagggactcgatacgtgggaaggacgtatacatcatccagtcgtttggagtgggaaccaacagaaacgcggccaacagtaacaacaacaacaacaacaacgatggatcttcgacttcagctacagcggaaacaggccatgtcactgtcaacgactacttcatcgaactctgcatcatgatatcggcctgtaagacgggatctgctcgcagggtcacggccgtcctgccgttcttcccttactcccgccagccagacctgccgtatgccagcaccggggcgccattggtgtctagaaatcacgatgcagtgacaatgacagtcacggaaggccaagggagtgtctcgtatacgtttgagagcgtcccgcctaccccggccgcacacatcccacgaactgccggtctggctaacggcatgtctagactcgctaatggcctgtccggcagcagcatcacccgtggcagcgacatccgcgacatggctaaggtgatggtgacgggaccggcaagcgacgctggtagtaagtcgttgggggagaagcagccccaacagcaaaaggcaaacgacaagttcaccacgcacgacttcgagaacccggccatggcaatggcgttccaacagaaggtcgggtttaagccgatgatggcacaggcgggatcgttgattgcggatttgttgacgtgtgcgggagcggatcggattgttacgtgcgacttgcatgagagcacgtatcaggggttcttcgatattcccggtgagtttgatgtcccagcacgactgcgttgccctttccggagtacacacccatctgactgggagtcatcacagtcgatcacctcatcgccagaccgctcctcaagcgatacatccagcaccacatcgagaactacaaggaagccgtcatagtcagcccggacgctggcggggctaaacgcgccgctgccattgccgacagtctaggtttacaatttgctcttatccataaaggttagttcatacgtggggaggaggcccgaactcacgtctttgattgtatccgtaaccactgtactgaattacatccagacccgtcccttcaagacgcatgaaaagaaactgacacttgtcttcctcaccctcatagaacgacgccgaccgtccaaaacccacccaaactacccatccatgatgcttgttggcaacgttgccaaccgcatctgcatcttggtagacgacctcgccgacacggtcaacaccatcacacgcgcggccaagctgctcaagcgcgaaggggccgtccaagttgttgcgcttatcacgcacggcgtgtttagcggcgatgcgatacagaggatcaatgcgtcggcgctggatcgggtggtggtgacgaacacggtggcgcagcatcgacatcttgaagcttttggggcagctagagccgggggtacgaaggagatgccggacaagaataagaatgatgtggacccgagggtggtttgtgggaagttggaggtgttggatattgcgcctttttttgcagaggcgattagaaggattgtgtttggggagagcatcagtatgctggtccgggatggggattaaggggtg

SEQ ID NO: 27884 - DNA, 1143 bp, Neurospora crassa
gggctccaagccgcggcagcaccgacgacccttaccccctctacacctcacaagaacctgttctcgtacctatcaccacgacatgctagccttggcggccatccaacgccatcaaggacgccacaaagtcgacatggcatcaatctggacacccgggccgaaatctacagtctctcacccataaaacataaaagccaacaacttttactgagcccgcgaaagcagccgcgcgccatcagcaaggtaccatttaaggtgttggacgcccctgagctgctagacgactactacttgaatctagtcgactgggggagcgccaacgtcctgggcgttggtttaggatccagcgtttacatgtggaatgcgcaaacaagtagagtcaacaagctgtgcacgttggaggacgacacggtggccagcgtatcttggatacaaaaggggacacaccttgctattggtacccataaaggactggtgcagatctgggatgctgagaaagcaagaaggctaagaacgatgactggccatactggcagggttggagcattggcatggaacactcatattctcacgtcaggatcccgggatcgcctaatataccatcgcgacgtccgagcgccagatcagtggctcaaaaagctggttggtcacaagcaggaagtgtgtggtctcaaatggaattgcgacgatggccaacttgccagtggaggaaacgacaataagttgatggtttgggataagctttccgacacacctctatggaagtattccggtcacacagcagccgtcaaagcgatagcctggtcaccacatcaacgcggtctcctggcttccggaggcggtactgctgacagacgcatcatctttcacgacaccgttcgcggcacggtactcaacgaggtggacacgggcagtcaggtctgtaacattgcctggtccaagaactccaacgaaattgtctcgacgcatggatatagccagaaccagatagtagtttggaagtacccctccatgacgcaagtcgccagcctgaccggtcacacttatcgggtgctgtaccttgccatgagcccggacggcaaaaccgtggtgacgggtgccggagatgagacattgcggttctggaatctcttcggtaagagc

SEQ ID NO: 27885 - DNA, 3020 bp, Neurospora crassa
cgctaaaaaggaatggagagaaaagcggcgagaagatccccaggcaacagaatgctatgggcgaggctctgtccaaaagtagctttgcgggtagtctggtccgtcgcgcttcaaacacagtgaacaaagcgcgcgacatacttacacgaagagcatcaatgaacattgtcaatcgggatgctgacccgatggtggcgtctttgcgccgtgggagcaacaccttcccactcggggaacacaactacagaggtcacttgctggaatcagatgatgagtgtgccatagatgacgccggtccgttggacgggttgcgagacgctcaaattcccctgagcattggacccgagattccggttgctttacgccaaggtgtcatgttgaaaaaaatcagcaagaagaaaaaggaaaagagaatcaccctcacccttgatccagacacttccaagatatggtgggacaagagtcgaacagggagaaagtctgtgttcatcgatgacatcaaggaagtaaggacagccgaggacattcgacagtaccgtcttgacgccggggttgaagaatctgaagagcccaggtttttctcgatcctgtatacagtcccagaaaagtcaggaaccaaggtgttgcatctcattgccctgaattccaccgactttcgcaattggaccacgacactcgatgctatacttcaatatcgccaggattttacgacaaacctgatggccttcaacgaaaaggccgtccacgagttctggcaacgacaaatgagaaagaagtacgcagatagggtcattccggctgaaggcgaaaccattgaacttcccgacattgagagaatctgtcgctctcttcacatgcacctatcgccgacagaaattcgcgacaactttaacgctgctaaagctgccaaggctacctccaacggggtctgtgatcccacttccccttccagtttgaacttcaacgagtttaaagagttcgtgcggctattgaaggcgaggtctgagatcagccatgtcttcaagaatcatacgaccaaccctaaagcagggatgacgaggcaagaattcatacaattcttgaaggagattcaatgcgaagacgtggaggaagattctacgcattggaacaatatcttctctcagttcgcgcgtagacgcaggtccaaagatgccgagcagaccatcagcggggatgagtcattgaccatatctgaggctggcttcactggatttctcaattcacatttcaacagtttgctcatccaggagccatccgaatatgttctcgaccgaccaatgaatgagtattatatctcaagctcacataatacatatcttcttggtcgccaagtccgtggaatctccagtgtcgaaggctatatttcggcacttgagcgtggttgcagatgcgttgaagtcgactgctgggacggcccgaatgacgagccttatgtgtcacacggccatacctggaccacaaggatcaagtttgaagaggtgatcaaaaccatcaacaagtatgcctttgtcaagtctcgctttcctctctggatatcgctggaggtccgctgtaacgctgcgactcaagccaacatggcaaagattatgattgacatattcggcgacaagcttgtccgggcacccctcgatccatcctcggatcgacttccctcaccgtctgacttgattgagcgcatcctcatcaaggtcaaaaagtctcagccagtacctaacacaccatctgaggagtcgctgaagactgagcgacctggtcggcggcgcggcaacagcctaccctcaccttatcagaggccgtcacctttaccatctcccatggataacacatccgtcgctgttcctggaagtccctcgttgagtccaagtccgatgttgcgagcgacacggcaaattaacaccatcacggaaggcgaggttcattcccacggggggcctagcaacagccccagcgaatacgagagtgatgctgaaaaggattcggggaagaaggtggtgagcaaaatcaaccctatcctcggtgaactgggcgtttattgcatgggcgttcactttgatgggttcgacagccccgacgctaaaaagttcaaccatatcttttccttcaaagaaaagacctttgctgagagaagccagccgggtgaagcaaagcgtgctttgtaccgtcataacatgcgctatctcatgcgtgtgtatccgaacggaggtcggatatcttctagcaactttgacccgctcctctattggaagcgcggggttcaaatggcagcactgaactggcaaacattcgatctggggatgcagctgaatcaggctatgtttgatagtggcaccgacctgtccggttatgttcttaaacccctcgagggacgtcagattcaagtcgtcccgacggatgctgccgggcagctatcgggtaaaagaccacggaagaggatctcgttcaagattgaggtcatctctgcgcagcagctgatgaggccattgaatcttcccaaggggcggacgcttgatccctacgtcgaagtcgagattttcctggccgatgacaagaggaataagcaagatggtgccacaaatgcaccagctcaggagacgcagctgaaatatcgcaccgacatcgtcaaagacaatggcttcaaccccgttttcaaaggcaataactcttatgagttcattgttaccaccaagtaccctgatctcatctttgtgcgctggagcgtgaagcttggcgacaacaaaggatacaacgaccgcagcccccccttggcgactttcacagctaagcttggcggcctcaagcaaggctaccgcacgataccgctgcttgatcacaacgggtataactacctattctcgaccctcttctgcaaaatcaccaagagccagcctaccgatatcatggttacctactccagtgaagttccaaggaacagtgttagcaggatcaagaacatttttaatcagtccggcatcagccccaaatccagcatggatagtggc

SEQ ID NO: 27886 - DNA, 1125 bp, Neurospora crassa
atggcggccaactactgggaatctactcagcgcaaacactggctgtttaccaaagatgagcttgccgctatgcgcgcaaagctagaggctgaagaacccaacctggtggcctcgtttcctctcccgcaactgcgccatctgaacatctacttcaaccaacgttcgtcgtatctctccacgtcccctaccccgtccacccgtccgtctgttcgatgaagagagtcgccaacatacttctgttttactctagaaatcaaccgtctcggtaagcgcatggggctacgacagcaagccttggccaccgcccaagtctacatcaagcgcttctacaccaaagtcgagatccggcgcaccaatccacaccacgttctcgtgaccgccctatatctggcctgcaagatggaggaatgtccccagcatattcggcttatggccaacgaggcccgcggcttttggcctacagacttccaatcccagacagaagtggcaaggataggagaatgcgagttctaccttatctcagaaatgagctcacatctcattgtccattcaccctaccgtacccttaccagcttacaaggggagcttgggctggcacaagaggacgtcaaccttgcctggtccgtcatcaacgaccattacatgaccgatctgccgctgctccacccaccacatgtgatagccttgacagccattctcttggctctggtgttgcgtcaggatcccagcggtcgtctccctggaacagccgcgtcggcttcgggactggtagccgcttcggcagcgttggctcaggcacaggcgcaagcacaggcacgcgctgccatgatggcggggggtggccagactgtgccaggtctcaccccccagtcttcttctggcttgcaggccatgcttccaccccagtcaccagccggagaaggtcctgccgaagggaacaaaaacccacgtatggcaaaggttcaccgatttgctgcatggctgtctgacagtaatattgatattgaggccatggtggactgcacgcaggagttgatctccttctatgaatgccatgagcagtacaatgacaagaacactcgggagcagatcaataggtttgtcaaagctcgcgggctggacaag

SEQ ID NO: 27887 - DNA, 933 bp, Neurospora crassa
ttccaaaccgccctcttagcaggcgccctcgccggtaccaccgtcgacctctctctcttcccgctcgacacgctcaagacccgtctccaatcggcccaaggctttttcgccagcggcggtttccggggaatctaccgcggcgtcggctcctgcgttatcggttccgctcctggagctgccttcttcttcgttacttatgagaccaccaaggggtttctttctacgacagggaattcgacaacaacaacaacaacaacaacaacaacaacacatacgggggacacaaacaaaggacaggggaagaagggtctgagtagtccgggggtgcagcacggaatcgcggcgagtctgggcgagatcgccgcttgtgcggtccgcgtgccgaccgaggtgatcaagcagcgggcgcaagcgggtcagcatggcgggtcgagcttgagcagcttgctgcacatcctgcaccagcgctcgaccatcggcctgacaggggtgtggagggagctgtacagggggtggggcatcacggtgatgagggaggtgccgtttacggtgctgcagttcccgctgtgggagtcgctcaagaaatggggacgtgagcgccgccaacgaattggctggggcctgtttggggactcggccacgggtaaagatgataaagacgttagtgcccccgagagcgcattgtacggaagcttggcgggcgggtttgcggcggccttgacgacgcctttggatgtgctcaagaccaggatcatgttgagcgagaggagggagggggtggtcagcttaatacaaacaatttggagggatgggaagacaaagacgggaagtggcatcaggccgttctttagtgggattgggccaagagtgatgtggatcagtatcggaggagcgattttcttggggagttatcagagtgttgtcaatgctttt

SEQ ID NO: 27888 - DNA, 894 bp, Neurospora crassa
gcaacagtcgccaagactcgcacccagctcaaccgcaggttagccgagggccagaagctcccatggccgccctttggcgcgcaatggtatgccggctgcacgactctgattatcggcaactcgctcaaggcaggcattcgtacggttcccagacacatcaagagaccaaagaagaaaacagtcgctaaacaagatgtgggacaggattcgtcgcctttgaccagtacaagaagctcctctccgattccaacggcaagctctctgggccaggcaccgtccttgccggctttggcgccggtgtgactgagtcactactggccgtgacgccaaccgagagcatcaagaccacgctgtaagtcgagtcaccgtcaagtctccattttaggtccgctcatcgctgacaagaaaaaacccaacagcatcgacgaccgcaagtccgccaagcctcgcctccgcggcttcctcgacgccgtccctgtcatctaccgcgagcgcggcattcgcggtttcttccaaggtttcgtccccaccaccgcgcgacaagctgccaacagcgccacccgtttctcaacctataccgcgttgaagcaactggccgaaagctacacggcgcccggggagaagcttggtgctgtcggaacctttgcgatgggcggtatcgcgggtctcatcaccgtctacgtcactcagccgttggataccatcaagacgagaatgcagagtatcgaggccaagcagctttacggcaactcgttcaggtgcgccagcatcattttcaagcaggagggcgttttgactttctggagcggagcgctgccgcggttggcgagactgattttgagtggtggtattgtgtttaccatgtacgagaagagcatggatctatttgacagg

SEQ ID NO: 27889 - DNA, 735 bp, Neurospora crassa
gacagagcccactacgcccccacctccccttactccgactccccccaacccatcggccacgccgccaccatctccgccccccacatgcacgccaccgcaatcgaacacctcctgccctccctcctgccctccccctcccgcccggcccctcgtgtcctcgacatcggctcggggtcaggctacctcacgcacgtgctcgccgagctcgtcggttccgaaggcggcaccgtcgtcggtctcgaacacattccggccttgcgcgacctcggcgcgcgcaacatggccaagtccgctgaaggccgcgactttctcgagacaggccgggtgcggttccgtgtgggtgatgggcggaaggggtggcgcgagacgacgtcggattcggcggctacggatggcgcaagtgctgctacgactggtactactgcaagaagaagacgggagtcgagcgtggatgagcggtcgccgatgggggaggtggaagggcaaggagagagaatgggggaggataaggatgaagggaagtgggatgcgattcatgtgggggcgtcggcgaaggagatacataaggagttgatcgatcaactgaggagtccgggacggatgtttgtgcctgttgatgatgatgagatgggactggggcagcatgtgtggttggtgcagaagggggaggatggggaggttagtaagaggagattgtttggggtgaggtatgtgcctttgggggatccgcctcgg

SEQ ID NO: 27890 - DNA, 4281 bp, Neurospora crassa
tttcagagaatcttcaggtacacagaccacatcggttggtggacacatgcagcagccctgacttgcatgatagcgtctggtgttcttcttcccttgatggaccttgtctttggcaaatttgtcacagtcttcaacaatttcatagccggcaaagcgacccccgcagagtttcgttccagcctcaataactacacgtacgtttctatccgttgcggtttgacccctgaaacagggtgctgagaaaatctttggacttccagactatactttgtctatctcttcatcgccaaacttgtcctcgtatacatctggactgtaagaattcctcccatgtgggatttcatcttgatcagccacttacatacatcccaagacccttgcctccaccaacgccatcaggatcacacggtctcttcggatcgacttcctcaaacaaacaatacgccaggaagttgccttcttcgacctgcccgaggccggatccatctccagccatcttacgaccaacgccaacctcgtcaatcaggggatatcggagaagctgggcctcgccatccaagctattgcaaccttcttcgctgcctttgttgtcgcctttgcggtacaatggaagttgaccctcatcaccatctgcatcgtgcccgtcatcgtcatcgtaaccggcatctgcatgggcatcgacgcgaaacaggaaaacgagattatgatcattcactccggagcagcaaagctagccgaggaggtgtttgcgagtgtcaaaactgctcatgccttttgggccttccccaagctgtccggcaaatatgcagctatccttgatgaggccaaagcggtcggtgcccggaagagtccgaactacgccgtcttgttctccgtggaattcttttgcgtgtacgctggatatggcctcgctttctggcagggtatcaggatgtataaggagggagaggtgtctgagccgggacaaattgtcactgttatctttgctgtgctgctggcagcccaggcactcactcaaatcgctcctcaatcggtcgtcatttcgaaggctgccgctgccgcacatcagatgtttcaggtcatcgaccgcaagtcaaagatcgactctttgtcggaggaaggcatcaaaccagctgaatgtcgaggtgatatcgaactccaggatgtcgtatttgcttacccttcgagaccgaacatcaaagtgttgcaaaacttcagccttacgattccagcaaacaaaacgacggcaatcgttggatatagcggatcaggcaaaagttccatattaggcctactggagcgctggggttgtcccgaaagcggtactatcacactggatggtcgaaaaatagaagagtacaatcttcagtggcttcgaaccaaggtccgacttgttcagcaggtaagcatgcaggcttgttccttcacaagccctttcccagctgacaccatcaataggaaccggtcatgctcgaaggcaccgtctttcagaatgttgtgaatgggttagccggaacatccatggctgatctgagcgacgaagagaagcagcggctcgttgaagatgcgtgccgcgcggcgtatgctcacgaattcatagagaaactaccagaggtatgtgacatcaccctgcctcgccgatcatacctaactctgtcagggctatcaaacgcaaatcggccagagaggctccatgttgtcagggggccaaaagcaaaggctcgccatcgccaggagcgtcattgcgaacccacaaatcctcttactcgatgaagctacaagtgccctcgaccctaacgctgagcagattgttcagaaagcactcaacaacgttgctgtcgggagaaccatgatcgtcattgcccatagactctccaccattcgaaatgcggacaacattgttgtcatgtccaacggtcgtcttatcgagcagggtacccatgaccaactcgttgccctggggggcacctattcacaccttgttcgaatacaacgtctcggacaagaacctgacgatgatgacgaaccccaaaaggacaccagagctgaaattggaggagctgcgatagctaacaccacgtcgaacgtagttgagactgttcctgacgcgagtgccatggaagaaggggctgcaaagaaagacgacatcaacctcttgagatgcttgttcatcctcatgcaagaacaaagagtactctggcctgccttttgctgggtgggtatttgctgtctcgcgggaggtaagatccatggcatccaccttctcatcggaattcacgaacactgacagccaaaatccaggggctacatatcccgctcttgccatcatcttctcccgaataatggacgctttcgcccttgagggtgacaaaatggttgaacgaggcaacttcttttctctcatgttctttatcgtagcccttggcaacttggttgcctacgcggtgctcggttggttctgcaacgttatcgcccaggtttgtccccattgtcctaccgtcgtcgtattgatgaggactgatgtttatctccagcaaatggtccgcttctatcggtacacaatcttcgactgcgtcgtccggcaggacatgaccttcttcgacatgccaggtaactctccaggcgctttggtgtctcatttatccaaggaaccggaaagtctgcatgagcttctctccatgaacatgggcgtcatcgcaatcgtggtggtcaacttgctctcaagctgcattcttgccgttgtgattgggtggaaacttgggctcaccctcgtctttggcgctttaccaccccttgtcttttcaggatatctgagaattcgcttggagatcaagctcgatgatgatactgcggacaggtttgcggatagcactggcattgcttctgaggctatcatggccattcgaactatctcgtcactggctatggaacggcagattcttgacagatatgagaataatctgcgctctattgcggcaacgtcggtcaagagtctcacctggacgatggtttggtacgctctgagccaatcgatctccttcctgtcgatggcattgggtttttggtaaatattttcatttttacttggcatgacaggttcaagccagctcacatcgtggttaggtacggcggccgattggtttcatttggagagtacaccgttactcaattctacacagtgttcatcgccgtcattttttccggcgaagcagcggccacattctttacttacacaacaagtgagtctcaccaattgatgtccacattttgtacccgtctaattttggaataggcattaccaaggcgcagcacgccgcaaacttcatcttccggctcagggactcggttcgttccgaaaacaaggacgataacccaccagatgccgaaaaacgtagcaacggcgccgtttccatagactgccaagctctagaattctcataccctctccgtcccagcgctcgagtcctcaaaggagtctccatcaacgtatgtacagccccaaacctgattatctggccgaattttgtttgcgtactaacattagtggcaacacatcagatcccaccgggtcagtttgtcgccttggtaggggcgtccggctcgggcaaaagcagcttaatctctgtctttgagcgattctatgatccttccagcggcaccgttttcttcgacggcgaagactaccaaaaaatccacctcggccgctaccgcgccaacattgcgctagtccagcaagagcccgttctttaccagggatcaataagagaaaacattgccatgggcgttcttgacgcgactgtgtcggacgagcaaatcctcgaggcctgtcgccaggccaacatcgactccttcattgcctcgttgcccgaaggcctagctaccccctgcggatctcagggcctgcagttctctggcgggcagaggcaaagaatcgctattgcgcgcgcgctggttaggaagccgagattgctgttgctggacgaagcgaccagtgcgttggatacggagtcggagcgggtggtgcaggctgctttggatgctgctgcaaagggcgaaggtggagcagatggagatggaattgagggaaatgcaaaggggagaaagcggacaacggtggctgtggctcatcggctgtcaactataaagggcgcggataagatctttgtgttttcgtacggaaggattgcggaggcggggacgcatgaggagttgttggggatgagggggatgtattatgagatgtgtttgggacagtctttggatagatgaagatgccgtatg

SEQ ID NO: 27891 - DNA, 890 bp, Neurospora crassa
cttcctttcgccgtccaggctgcttccggatccggccagtccaccagatattgggactgctgcaaaccatcttgctcctggtccggcaaggctcctgtcaaccgacccgtcctcgcttgcgacgcaaacaacaaccccctgagcgacgccagtgtcaagtctggatgtgatggcggttctgcatacacctgtgccaacaactcaccatgggcggtgaacgaccagctctcctacggctttgccgccacgaaactcagtggtggaaccgagtcatcttggtgctgtgcctgttatgcgtgagtttctcttcaactcttgggtatcactcgatggctaacttttactgcagccttaccttcacttcgggccctgttgctggcaagaccttggtcgttcagtctaccagtaccggcggtgatctcggctccaaccacttcgatatcaacatgcccggcggcggcgtcggcctgtttgatggatgtaaacgacagttcggcggtctccccggcgctcaatatggcggcatcagctcccgcagccagtgcgactcgttccctgccgctctcaagcccggttgccagtggcgcttcgactggttccagaacgccgataacccgaacttcaccttcaagcaggtccaatgcccatccgagctcacatcccgcaccggctgcaagcgaaacgacgactcccaattccctgtcttcactccgccctctggtggaggcagtaacccctctactccgacaacccctccctcttcaggcggcggttccggatgtacagcggataaatacgctcaatgtggtggctcggggtggtctggctgcaccaactgcccgtctggatcgacctgcaagactatcaacgattattaccatcagtgtgcc

SEQ ID NO: 27892 - DNA, 2709 bp, Neurospora crassa
agtgaaaaggttttgattgcccaagagcgctctgccgccaacattgtccaggtctttaagaagcctcctggtggcagcgtctcgtaccaggccgagatccgcagtgctctcgagaagggctcccgtctcatttcctccctccagatgaggctgcacacaaaggctgaccagaacaagggtcgtttggccaacactgtgagcgtcaccctgccctacgtcaaggaggaggtctctctcgccattgtgttccgtgctttgggagttgtctcggacgaggatatcctcaaccacatctgctacgaccgccgcgacagtcaaatgctcgaagcccttcgtccctgcattgaggaagccttctgcattcaggaccgtgaggtcgctctggattacattggcaagcgtggtaacggcagcaccggaataaaccgcaacggccgtatcaaggctgctaaggagatgctccagaaggaactgctaccccatatctctcaggctgaaggttgcgaaaccagaaaggccttcttccttggctacatggttcacaagctgctccagtgtgtccttggccgcagagataccgatgatcgtgatcactttggtaagaagcgcctggacttggctggtcctctgctggccaagcttttccgtggcatcgtgagacgcctgactcaggatctcatgggctacatgaagcgctgcgttgataccaacaagcacttctccctggccctcggtatcaaggcctccacccttaccaacggtctcaagtactcgcttgccactggtaactggggtgaccagaagaaggccatgtcctcgactgctggtgtgtcccaggtcttgaacagatacacattctcgtcgaccctgtcgcatttgcgtcgtacaaacacgcccattggtcgtgacggtaagctcgccaagcctcgtcagctgcacaatacacactggggtttggtctgcccagcagaaacgccagaaggtcaggcttgcggtctggtcaagaacttgtctctgatgtgcttcgtctcggtgggtacactggccgatcccatcatcgagttcatgattgcccgaaacatggaagtgttggaggagtacgagcctttgcggtatcccaacgccaccaaggtgttcgtcaacggtacctgggttggtgtccatcaagatcccaagcatctcgtcactcttgtccagaacctcagacgcaagaacatcatttcgttcgaggtttcgctggttcgcgacatccgtgacagagagttcaagattttctcggatgccggtagagtcatgaggccgttgtttgttgtcgagcaagaagacaacagcgaatccggtgtcgaaaagggtcagctcatccttaccaaggagcatatcaggcgccttgagcaggataaggagcttggcaaataccatgaggattactttggctggcaaggcctgctcgagtcaggtgctatcgaatacctcgacgccgaggaggaagagacggccatgatctgcatgacgccagaagatctggacacttaccgtcagcacaagttcaagggtcgcgagtttgaggacgacgccgccaaccgtggcaatagccgtatcaagacaaaattcaacccgacaacacacatgtacacgcactgcgagattcaccccagtatgcttctcggtatctgcgccagtatcattcctttccccgatcacaaccagtcgcccagaaacacttaccagtctgccatgggtaagcaagctatgggcttcttccttaccaactactcccgacgtatggataccatggccaacattctttactaccctcaaaaaccactggcgaccacccgctctatggaatatctcaagttccgtgagcttcctgccggtcagaacgccattgttgccatcgcttgttactctggttacaaccaggaagattccgtcattatgaaccagagcagtatcgaccgtggtatcttccgcagtcttttcttccgttcctacacggattgcgagaagcgtgtcggcatcaacatcgtggagcaatttgagaagccagatagaagcaacaccctgcggcccaagcacggcacgtacgacaagcttgagaatgatggtatcattgctcctggcataagagtcaccggtgacgacatcatcatcggcaagacatctcccatcaaccccgataaccaagaacttggccagcgcacggctcagcacgtcaagcgcgacgcgtccacgccgctgcgcagcacggagagtggtatcgtcgattccgtggcctttacaaccaaccaggatggtttgcgctacgtaaaggtcagggttcgtacgacaaagattccccagattggtgataagtttgcgtctcgtcacggtcaaaagggtaccattggtgttacttaccgtcaagaggatatgccgtttaccgccgagggtatcacgcctgatattatcatcaaccctcacgccattccttcgcgtatgacaattgcccatttgatcgagtgtctgctgtccaaggtcggtgcgctcaagggcatggagggtgatgccacccccttcacggatgtcacggtcgattccgtctccaacctcctccgcgagcacggctaccaatcccgtggctttgaaatcatgtaccacggccataccggcaagaagcttcgcgcccaggtgttcttcggtcctacgtactaccagcgtttgaggcat

SEQ ID NO: 27893 - DNA, 984 bp, Neurospora crassa
ctcgccgtgaacaacttgttcaatgtcaatggcattgttgcagtcatcaccggcggcggaacaggtgaacctctttgacgttcgccctcgtgcattggctaaccattcaatttcctaggcatcggccttatgatggccagagccctcgccgccaatggtgctaagcgagtctacattctcggccgtcgtgccgatgtcctttccgccgccgtccgagccaaccccgagggaggcatcatcgtcgccatcatctgtgacgtcactgacaaggacgccctccaaaagtgcgtcgacaagattacgaacgacgtcggctacatcaatctcttcgttgccaactctggggttctgggtcctgccaacaagtgggatactagcctccctctctccgaagtccgcaagaacctgttcaccaactaccagatggaggagatgacaagtgcccttcacaccaacgtcacgggtgccttcttttcgatggtcgccttccttgagctgctggaggcgggcaacaagaacgctgtcgagaagggagggtttggcaagccggtcgtacccgggagcaatgtcccgtctgttcagagccagatcatcgtgacggctagtattgcgggattcagccggaaaacggtatcgacgccggcatatggaagtagcaaggctgccatgatctatttgaccaagcaggccagttctgccttggctccctatggtattcgggcaaatgcgttggctccggggtgtaagtgcagtccctttcggccgtcttgggacgctgatgctaacagaatcacagtgttcccttcggagctcgccgccgggcttatcggtaaccgtgatcctgggaccgagtccttcgaaagtccgcacttcattcctgttagaaagtttggtggcgaggaagagatggctggaaccatcctgtatcttgcgagccgtgccggaagcttctgcaacggtctaatccttgttaatgatggtggg

SEQ ID NO: 27894 - DNA, 2193 bp, Neurospora crassa
aactcgccctatgccgaggtccgtgccgttgtcgacaaccatgatgatcccaccatgccctgctccaccatccgtgcctgggtcatcggtctcatcttctccggtgctctcggtgccatcaaccagctcttctccatccgtatgcctgccattactgtcggcctcaacgtcgcccagctgttggcctaccctgttggcaagatttgcgaaaaggctcttccagatgtcggcttcaccctcttcggctctcgccacagcctcaaccctggtcccttcagccgcaaggagcacatgcttatcaccatcatggccaacgttgctggcagcactccttacaccaacaacatcatctggtctcagtaccttcccgagtacttcaaccagtcctacgccggccagtttagctaccagatcctggtcgccctctccaccaacttgatcggctacggcatggctggcttgactcgtcgattcctcgtctaccccagctactgcgtctggcccgcctctctcgtcactattgctctcaacaacgcctttcacaccgagtcgaacgtgccagtgcttggccccctcaagaaggtcttctccatgtcgcgttacaccttcttcttgtgggctactttggccatgtttgtctacttctggcttcccaactacctcttccttgctctcagcgccttcagctggctgtcgtggatctctcccaataacatggtcctcagcaacatcaccggattcaacaacggtctcggcctcaacccgtggcccaccttcgactggaacgtcctgcttttcgacggcaccgacccgctcatggttcccttcttcagcactcttaacaagttcctgggaatgttctgctccttcttcgtcgtcattggtatttggtggaccaacacctacaatacaggctacctgcccatcaactcgaacaaggtctacgacaacacgggcaatcgctacgacatctcccgtgccatcaacgagaagggtctgttcgatgctgcaaagtacgaggcctactcacctgcctacctggctgccggcaacttggttatctacctcttcttctttgccatctatcctgccaccctcacttacatcctgctcaaccaccgctacgaagtctccatgggtttcaagaacctctggaactcgcttcgcaggaacaagaacactgaggctggccaatacaaggatgtgcacaaccgtctcatggccgtctaccccgaagttcccgagtggtggtacctgattatcctgttgggcgccatcggctgcggcattggtggtatcgccggctgggagacctacaccacccctgccgtcgtcttctacggtctcattctctgctttatttttgttatccccgtcggtatcgtcaaggccatgacgggcatggaggttactctgaacgtcttggccgagtttatcggtggttcttgggtacaaggtaacgcactcgccatgaactacttcaagtccttcggctacgttacctgcgcccacgcggtctggttcgccaacgaccttaagctcgcccattatgtcaagatcccgcccaagcacacgttcgctgcccaggtcgtcgccacgctcgtttccaccttcatctgcaccggtatcctcaacttccagatgaacgacatccccagggtctgcactaacgaagcccccaacaagatgacgtgcccgggcatcaacaccttcttcacggcctcggtcctctggggtaccatcggccccaagaagatctttggtcacaacggccagtacacggccctcatgctcggctggcccctcggtctcctcctccccgtcattacctggtacattcagaagaagttcccccagaagaagtggctgcgccagattcaccccatcgtcctgttgtacggagccatgtactgggcgccttacaacttgtcgtacgttatcccctcggtctggatcggttggctgtcctggatttggtgcaggagccgcttccttggcttctggtccaagtacaacttcgtgctgtcggccgctttcaccacgggtatctcggtcgctgctgtcatcatctttttcagcttggactggtcgggtgtcgaagttagctggtggggcaacgacgtggtgtcggaagggtgcgagggtaagccttgcttgttgaagacgttgaaggagggagagatttttgggccc

SEQ ID NO: 27895 - DNA, 2516 bp, Neurospora crassa
ttctggcggttcggcggctacgctgttgccagcacaatagaaaacatcctcgaccgcggcgactttgcccttgaggagcttctcgatgagagcgacttgatccaggagctcaagcaacacaatgcgaagctggtcgagtatcttcgtgaccaggatgtcctcaagaggttgctagaatacgttgtcgcgcccaagctggagcccgtggcggctgctgaaaacgaggacgacgcggaagacgaaaaccagaagggtatttccctacccttcactcgaccccgcgcctcatcgcgggccaccgatgcgagcaatgatgacagcgccgtcgaaaagaaacggaaccgctatgccttcgtcgcggccgagattctgtcgtcagacaattggtcaatattcgaggctcttatggagagcaaagacctgctgcgcgagttctggcaattcctgaagcgccctgccccgctcgaccccctccaggccagttactttaccaaggtcaatgagtccttgtttgacaggaagaccgaggaaatgatcgatcttctcaagtctctcgataatgcggttcccgatatgctcaagcacgtcgactgccccatggttatggatttgctgctgagaatcatcagcttggaaagaaccgaggctgggcatggtatagtcgaggtaggtggatcagtttctgcattgggatttcctcctgtactaactgttgactcgtccagtggctctatacccaggatgtaatgccctctctgctttctttcctcggcccagaacatggctgggcaacccagacatccgccgccgatttcatcaaggccatcattactgtctccgccaatgcctcgcaaaatgaacagacctgcatcggaccgaacgagctcacacgacagcttgtctcgagaccctgcgtggagcagttgatcaattacatgcttggtggcggcaaccccctcacgtgtggtgtgggcattgtcatcgaagtcattagaaagaacaactccgattacgacccagaggcaaccgagcccaactcgaccccctcggcccgcgacccgatctaccttggaaccttgcttcgcatgtttgccgaccatattccggattttatgaggctcatcatgaacgccccagcgcaaaaggaacgcttcacttccacgtttggtgatcatatcgagccgctgggcttcgacaggttcaagacatgtgagctgatggctgagctgctccactgcagcaacatgggcttgctgaatgaggtaggcgccgaagaagtcattgcgcagcgtgatgctcagcgacagttgctgcgcgcgcaaggccagctcgtgcctgttcgggagcaggaacctccatccgcggcggaagatatcacaatgcgcgcggcgcactcttccccagcggataccggcagaaagctgggggtcaccaatacatcggtagatgatgatggctttgaggaggtcacccataccaccgatgaggacatcacgcacggcatcgaggagcttcctgaaggttcattgccaggcccgacatcgtcgttcctggataaggacgaggatgactttgttgacgagccgctgagctctccaaggctgcgtgttcgcgaccaccataatcccatggaggatacagcacccatcaagttcgacgacccgaacctggtggtggcgcctttgtcccctaccaagaaggcatccgtgccaattaggacagcgtcagctcctgaagggcaaaacgatgatggcaacaagacagaagaaaccaccgccaacaaagaaggaagtgattcggacctcaagccgtccgaggatgctcaattggaacttcgcggcgtctcggacaaacccgtagccccagaagagatgtctccccacccggacgatactcctgcgccgctcttttcgacatccccccgaacaacagacctctcggagcctagccaggacaccatatcaaaggaggagcaggcggagaccagtcagatgtctaccggtggagaacaaagtgaccccgatgccaccatcgcccacgacgcttctgaggccgacaaaaagcatgagcctgttgttggcgactaccttaagatgcagtttgtcgaatacaaggttgtccccacgattttgagcttcttcttctcttatccgtggaacaacttcctgcacaacgtggtttacgacattgtgcagcaagtgtttaacggtcctatgaaggacagctataaccataagctggctatcagcctctttgagacggccgacatcaccaaccaaatcattggtggacaactcaccagcgagaaatctgagaacgagagaaagacccgtatgggatacatggggcacttgacgctcattgctgaagaggtggtcaagtttacggagcgccacgaaaccgacgttctcacagaaagcattttggagaaggtcatggcgcgggattggatcgaatacgtggaaggcccacttagcgctacgcgaacacgcgataatgccgtgctcgggggtgta

SEQ ID NO: 27896 - DNA, 1530 bp, Neurospora crassa
ctcaccaaccttcttctcaccaccctccttgcctccgccggccttggggctgccctgcccccgcgcatcggcagcaccgtcatcgaggctcgggagccggaactgccagtcagcggccgcaaaatcacgctgccccagcagaagaacccccgcttccacaagttcaacggcgccctctccgtctacaagacctacctgaagtacggcgcccccgtgcccgaccacctcgtccaagccgtcgccaaccacctcggcatttcagtcgaggaagtccacaactatgccaacacgaccgccaacgcccgaagagaccaaggctccgcaaccgccgcccccattgaccaatccgactcggcctacatcacccccgtctccattggcacccccgcgcagaccctgaacctcgacttcgacacgggctcctcggacctctgggtcttctccaactcccttccctccagccagagagccggccacacaatttataaccccagcaagtcatccacggccaagcgggttaacggcgcctcttgggatatctcttatggcgacgggtcgtcatccaagggccaggtctatctggataaggtgaccatcggaggcttggtggttagcaaccaggcagtcgagacggcgcagcaagtgagccagagcttcacggctgagacgtctatcgatgggctggttgggttggcgttcggtagcctgaataccgtcaggccgaggcagcagaagacgtggttcgagaatgcgatcggccagttggaccagccgttgtttgcggcggatctgaagtatgaagcttgtaagttgatttccctttttcgtttgactcgaattggttcggttggactagatcacacgtcgtcagccctcggagaaatatggggaagttcagggagctccagcaatccggggttccgaaaccggagacacgccatctgaccggatttcggcgaccctatccgaacaagcatgtcgatgatctgagcttatctttgttccgttactgacaacccttcgtttcaaacagccggcacttacgacttcggcttcatcgaccccgccaaacacacaggcgacattacctacgtgcccgtcaacaccaacccgggctactggacctggacctcgacgggctaccaagttggctcctcgcccttcgtctcgcagtccatcaccaacattgccgacacgggcaccacgctcatgtacgtgcccgactcgatcctgcgggcgtactacgggcagattcgcggcgccaccaacagccagtcgtacggtgggtatgtgttcccctgctcgaccgaggcaccggacttcacgttcggagtgacggacgaagccacgatcacgatcccgggtcgcttcatcaactatgggccggtgacggacgacggcgagacgtgctttggtggcctgcagactagcagcgatgtgggcatcaacatctttggcgatgtggcgctcaaggcggcgtatgtggtgttcaaggggggcgactcgccgagtctggggtgggcttccaag

SEQ ID NO: 27897 - DNA, 1575 bp, Neurospora crassa
atgccgagatcaggtaaggtttattatgcccacgaggaagaagtctcttgccacacgtttgctaacaggcgaccagaggcggacacgatccgcatcctcgtctcaaccgataaccatgtcggttacgcagagcgccaccccgtccgcaaggatgacagttggcgcacctttgacgagattatgcaaatagcaaagaagcaggacgtcgacatggtcctgctgggtggtgatctcttccatgaaaacaaaccctcgcgcaaatccatgtaccaggtcatgcgctctcttcgcaaacactgcctcggcatgaagccatgcgaactcgagtttctcagtgacgctgccgaagtctttgaaggagcctttccctttgtcaactacgaggatcccgacatcaacgtcgctattcccgtcttctctatccacggcaaccacgacgacccaagcggcgatggccactactgctcccttgacctactccaagccgccggtctcgtcaactattttggtcgtgtacccgaggcagacaatatacatgtcaagcccatcttgttgcagaagggcaggacgaaaatggctttgtacggattgagcaacgttcgtgatgagcgtatgcacaggacttttagagacaacaaagtaaggttctaccgcccgaaccagcagaaaaacgactggttcaatcttttggctcttcaccagaaccactatgcacacacccgtaccagctatgtcgccgagaatatgcttcccgatttcatggacttggtcatctggggccatgaacacgagtgtcttatcgatcccgtacgaaatccagagaccggattccacgtcatgcaaccggggtcctcagtggccacatcactagttccaggcgaagcagtcccaaagcatgtcgccattctcaacatcaccggcagaaagttcgaagtcgacaagatccccctcaagacagtccgcccttttgtcacaagggagattgttctagcctcagataagcgcttcaagggcctggacaaacagaacaaccgtcatgagattaccaagcgactgatggtgattgttaatgaaatgattgaagaagccaatgcggagtggcgcgctgttcacgcagaggacgacgacatggacgaggatatggagccacctttgccgcttgtacgcctaaaggtcgattacacagcaccggatggggccaggtacgaagtcgagaacccgcatcgattctccaatagatttacgggaaaagttgccaaccataatgatgttgtccgctttcactgcaataccaaaggaaaaagtaagttgagagaattgtgtgatcaacaactgtatgacactgacaatatacagagaacgttgcaactgcgccaggcgtgcgtgaggacatcgctgagatacttgagtcagccgataccatcaaggtcgacaacttggttcaagagttctttgcccaacagtccctcaagatcttgccgcaagcaccattcagcgatgcggtcaaccagttcgttagcaaggacgataagcacgctgtcgaaatgttcgtcatcgagtcactctccacccaag

SEQ ID NO: 27898 - DNA, 1331 bp, Neurospora crassa
atgcgctgcccgataccggaacataaacaaaatctgacctttttctttacctctaggtgatgacgtcctgaagcttttccagtacgctcgcgagaagcagtttgctatccctgcctgcaacgtcacctcctctagcactgccgtcgctgccctcgaggctgctcgcgaccagaaggctcccatcatcctccagacttcccagggtggtgctgccttcttcgccggcaagggcatcaaggactctgctgagaagcgcgaggcttccgtcgccggtgccattgccgccgctcactacatccgctccattgcccccatctacggcattcccgttgtccgtaagtagcttagcttgtcttgttcggttcaacttgccttccaagatgctgacatggtcctagtccacaccgaccactgcgccaagaagcttctcccttggctcgatggcatgctcgaggaggacgagaagttcttcaaggccaacggcgtgcccctcttctcttctcacatgatcgatctctctggtaagtctgcccccgacgaatgcgaccgctctcaccaataccccagcttactgacgtgcaattacagaggagcccgttgaggagaacatctccacctgcgtcaagtaccttaagcgcatggcgcccatgaagcagtggctcgagatggagatcggtatcaccgtacgtcaatgtcataatgcgcttgctccaaaaggaaacaaaactaacacttgcaaacagggtggcgaggaggacggtgttgacaactccgaggttgacaacgcttctctttacactcagcccgaggacatctggcagatcgaggaggctttccgccctatttctccctacttctccattgccgctggcttcgggtaaggctgaaccctaccccttgctctcgattgatcagaactaacgagatgacagcaacgttcacggtgtctacgctcctggcaacgtcaagctccaccccgagctccttggcaagcaccaggcttacgtctccgagaagctcggtggcaaggacaagaagcctgtcttcttcgttttccacggtggttccggctcctccaaggaggagtaccgtgaggctatctccaacggtgtcgtcaaggtcaacgtcgacactgatctccagtggagctacctcgtcggtatccgtgactacatcctcaacaacatcgactacctgaggagccaggtcggtaaccccgagggccccaacaagcccaacaagaagaagtacgacccccgtgtctggatccgcgagggtgagaagaccatgaaggcccgcgtcgaggaggccctcaaggacttcaacgctgc

SEQ ID NO: 27899 - DNA, 2307 bp, Neurospora crassa
gactaattatcagtcgtcacagatggtgagctttccgacctgatcgaggacttcaacgagggtcgcattcaatttgccttcgtcaaagtcaaggaccccaacagtggacttcctaagaacgtcttgattgcctggtgtggcggtggtgttcccgagcgaacaaaggggtactttaccagccatttggccgccgtctccaagattcttcacggctaccatgttcaaataacagcacgctccgacggagacctttctcccgagtctattgtgcaaaaggttgccgatgcttcaggcgccaaatataccgccggtggttcggcacccgcgtcagccgttgccccgccccccgttgcaaagaagcccgttttcaccccgactacctctacatcggccagctctttcaaccccattgttgccgcacggatccggaatcacgggggcgaagatgacgacggctggggtgtcgacgcaccgccagtcacgcggacccagctggagaaggtcgcgtctgcctaccagccgaccaaggtcaacattgccgaactcagaaagaacaaagatgactcgcgttccgaagaaactcagaagcaaaatgaccggccggaagacattgttaagggtggttatcagcctatcggaaaggttgatattgctgctcttcgcgcccaagcaaagaagacccatgatgatcggcctgtaaccgtgaagggagcctatgaaccggtgggcaaggttgatattgccgccattcgcgcaaaggcgcaacaacgtccgactgaaccggaagaattggagacgcccaggagtctggcagagaggactgctgtatttacgcaagcagaacgcttgaccgaacttcccaagcccaaagttgccaagaaatttgtaggcagcgctgcatttactggcaccaaagctcccacgccggctcctctcggtttcagctcgcctgcagttcctaccgctactcctattggggctgccagcagaacatttgcggatcagggaggcaagacgccggcccaaatctgggccgagaagaaggccaaacaaggcggtgcagttgcatttgcgtccactccctctcccgccgctgcgcctattgctgcccagaagagcggcagcgaatggaaaagcggttacgcggggaagagctgggcacctgtgcaggcacccaattacagccgaggtcttgaattacacgcaaccggaggaagcgcctcgcaagagcaatatgagcctgaagcacctgcctcaccggctggcggcatatctgcgctgcgcgagagattcaaggatacggcacctgtggcggtccgtacggggtcacggtcagcaccaagcgtgccttctcccggcccggccactggtgaagaagggcatactccgccgcccctgccaaccggaagccgtccttccggtggctttgctcttcctggtctgccatcccggccttctgttgctgacgacgaggaagggaacgatgaaaggcagctagaagaagaagtccgtgcactcgaaccggccgaccagcatgaagaggagccttcgtcccctgctcgcatcgcagtcccgattgctcggagcgcagtgcctgaggtggagccagctggcaatctgccgccccgtccggtgcccgtatcgcaggatctaccgaaagaagaggacctccccgtagaggaggatacccacgatccgcgtgctgctgccctgaatgttgccagcgaatctcttggccagggtgtcgaggttcagcaggctggttcagatggtggcaagcgtgctctggtacaatatgactacgagaaggccgaggataatgagattgatctccaggaaggtgactatgtcactaatattcagatggtggatgacgattggtggatgggaaccaatgcgcaaggggagagtggacttttccctagcaactacgtggaagtcgtggaagacgatgagcctgctgctgctttcagcgcagccccaacagtagcggcgactcaagcccctgttgtgccttcatctgcgcaggccgaagcggtagcacctgcaactccggccgatcaagttgctggcccaacagcgacggcgcagtttgattacgaggcagcagaagataatggtaagtgatgcttggaagccccgcatatatcagccgcgaaacccaggcctagtagtgactaacgaatcggtacagagttgagcttccccgaaggagccacgattacgggtttggagtttcccgatgatgactggtggtttggccactacagtggagcgtcaggtctgttccccgccaactacgttgag

SEQ ID NO: 27900 - DNA, 589 bp, Neurospora crassa
gccaccgtcgccgccggctgcttctggggcgttgagcacctctaccgcaagcactttgccgacaagggtctttacgatgcgcgtgttggctacattggcggagacgcctccaacccctcctacaagcaggtttgctctggcaacactggccgtaagtcttttacctctctggcgacgccttctgccgccccttttggggatgcggtccccctcgcttcaagcttgttcactcgactgtgtcgctgacaagaccaaagacgccgaagctaccctcctgatctacgatcccacccgtctctcctacacccaaattctcgagttcttctacaagatgcacgaccccacgacgcacaaccagcaggggcccgatcgtggcgcgcagtatcgcagcggcattttctatcacaacgatgaacagaagaaggttgccgaggagatcaccaagaaagccaacgaacagtggtggggtggtaagatcgttactgagatcctccccgccaaggagtggtgggacgccgagcagtaccaccagctgtacttggtgaacaaccccgatgggtacgagtgccccagtcacttcttgcgcaag

SEQ ID NO: 27901 - DNA, 1701 bp, Neurospora crassa
gacgtggtcatagtcggcgctggcctaagcggcttaagagcagctgtcgaactgcacaaagcaggcctcgcaatcgctgtcctcgaagagagcaaccgtgtcggtggtcagtgttgcacgacttttgctcgtcatacgaccaggatcacgtccataggcgacacccacaccgagatgctctctctagccaaggactgcaagatcgacctcaccaagcagcacaaggagggactggacctccaacagcgttatgacggttttcaagacagcccccaagtttccgaaaccatcccggcgcttgaaacagccgtttggccgcctcaagagtaccaactttccttcaggtcactgatcgaagaccccgcaatccagaagttctaccgccgcatctccgatctctctgaaacctggcatggccccgacgccttgttccttgacgcggtctccttcctcgagctcgtggaagctaatttcttccacagcaaggcggtccagcaggaagcccactttctcacccgttatctcctcagcgttgaccccgcccgcgtctcggctctctacgtcctcgaccacatcgcctccggcggcgggcttgccaacctctacttccaccctgactcccctggaggcggcgcccaccatttccgcgtcccacagggaccgcgagcgttcatcaccaagctggtcgaccttcttcccgagggatgcatccatctctccaccatggccaccaaaatcacccaacaaaccacccccattagtaagatttactacccctcacacccatgcaaagtcgaaacctcccctcccgtcgatagcgactccaccgcgagcaccaccgcgagcaccaccacgaaaaccttctacgccaaaaaggtcctcctcgccacacccccggcactatactccccttgttggtcccacctccccgaagtccttaccttccacccgcctctgcctccccacaagctcgcctccatcaaccgccacagcggcgagtacaataattacggcatcttcaccaccgtgaccttctatttttcccagccctggtggcgcgaggccgggctgtcgggatccatggactgccgggttactcgggatctagacggaccgatttcgtgggtgagggacacgagtgaggataaaggtggtggcaagataaacacaaacaagaaggtgtggagtttaacctgctggtgcgcaggcgagaacgcgtatgaagtctggaaatggtatgacaagacctacccggtggatgatgaaaagccagaggagattaagggtggctggaaggcgagtccggtgtggatgcatttgctgagagtgttcaaggagcggatggatgccctggagatggagattccgttgccgggggaagggttctcagattcggaggaggaggaggaaaaagagaatgagatggaagaaggtgcggagccgccgtctgtgtaccttttcaggaaatggactgggctgtgctttacgcccccgagggcattgccgagcaatggggaagaattggaagagctgttgaggacgtggaagtatgatgggccgggaaagggagatgcgacgttcagagagccgttcagtaatgttcattttgcgggcacagagacggcagaggagtggagggggttcatggaaggagcggcgaggagtgggttgaggggagcgaaggagattattcaggcgttg

SEQ ID NO: 27902 - DNA, 1122 bp, Neurospora crassa
atgaaggccagtctcatgatgctgttggcgcctctggcggccatggcagcacccacttccgacaacttggagcctcgtcaagccagccagagcatcgacgctctgatgaaggccaagggcaagctctacttcggtgcctgtaccgaccagggccgtctcacctcgggcaaaaacgcggtcattttgcagaataacttcggccaggtcacgcctgagaacagcatgaagtgggatagcattcaaccccaaaggggccaatataactttggtcaggccgactacctcgtcaactgggccaccgccaacaacaagactatccgtggccataccttcctctggcactcgcagcttgccgggtgggtcaacaacatccgcgacaaaaaccagttgaccacggttctccaggaacacatcaccactgtcatgacccgctacaagggcaagatctatggctatgtaagttccctgcactcatacctgtcaacatatgggcgtaatcactgacacgatcatcccgacaggacgtcgccaacgaaatcttcaatgaagacggctccctccgcagcagcatcttctaccaagtcctcggcgaagacatggtctcgattgccttcaaggcggcccgggcagctgacccgaacgccaagttgtacatcaacgactacaacctcgacagccccaactacgccaaggtaaccacaggcatgatccagcacgtcaacaagtgggtcgcggccggcgtgcccatcgacggtattggtactcagggccacattaatgctggaggcggcagcaacctcgccgccgccatcaaggcgcttgcctctgccaatgtaaaggaggttgcggtcacggagcttgatatccagggtaacaacgctggtgattatgctactatcaccaagggatgcttgagcgagcccaagtgtgtcggtattactgtttggggtgttcgtgattcggtaagtgctcgtcccctcgtgaccactttgtaagacagacgacgatgctgaccatttttcgcaggactcgtggagacccaatggcaacccgctccttttcgatgccaactggaaccccaaggctgcctacaactctattgtccaggctcttcagtgagcg

SEQ ID NO: 27903 - DNA, 2322 bp, Neurospora crassa
aggatcttcctctccgccatcttcctcttctccgcccatgtctttgcagtctcggctgttctgggtgttgatctgggcaccgagtacatcaaggccgccctcgtcaaacctggcatccccctcgaaatcgtcctgaccaaagactcccgtcgtaaagagatctcggctgtcgccttcaagccctcctccaatggccccaagaagggcgcctatcccgagcgcgagtatggctccgacgccatggccatcgcccctcgattccccggcgacgtttacccgaacctcaaggccatccttggcctccccactggcagtgcccaagttagagaatacgccgagaggcacccttccctgaaattggaggcgcacaaggcaaagggatctgcggccttcaagagcgccggtgctttcactgcagaggaggaggcttggctggtcgaggagttgctggccatggaacttcagagcgttcgcgccaatgccgaggctcttgctggtcctggtagctctgtgcgctccgtcgtcatcaccgtcccgcccttctacaccaccgaggagaagcgcgccgtcgagctgtctgccgaattggcgggtctcaaggtcctctctcttgtctccgacggtctcgctgtcggcctcaactatgctaccacccgccagttccccaacgttaacaagggcgcgaaggccgagcaccacctggtcttcgacatgggcgccggttccaccaaggccaccgtcctctcaatgcagtcgcgcaccgtcaaggatgtcggcaagttcaacaagactgtccaggaggtttctgtcctcggcagtggctgggaccgcactctcggcggtgacgccctcaactatcttatcgttgacgacatgatccgccaattcgtcgagtcgcccacggcgaaaaaggccggcgtcaccctcgaggccgtcaagtcccacggccgcaccatcgccaagctgaccaaggaggctgagcgcctgagacacgttctctccgccaatcagaacactcaggcttcttttgagggcttgtatgatgatgtcgacttcaagtacaagatcactcgcgccgagtttgaagagatggcggccacccacgcccagcgcgtcagcgccgcggtcaaaaatgctcttagcatggccggtctgcaaatcaaggatctcgactctgttatcctccacggcggtgccacgcgcacccccttcgtccagaaagagcttgagagcttccttggaggagccgacaagatccgcaccaacgtcaactcggacgaagccgccgttttcggtgctggtttccgcgctgctgagctttcacccagcttcagggtgaaggagatcaagatcactgatattgcctattaccccgccggaatgaagtggaagaatgacgagggaaagcccaagcaccagcgtctgtggatcgccacctcgccattgggagcgcccgcgaaggaggtcaccttcaacaatgtccaggacttgtccgtcagcttctaccagttggtggacggtgccgaacttgacaccaaggtgttcaccaccaagaacttgactgcctccgtagaggcgttggtggaaaagcacaagtgcgaaaaggccgatatcaagttcaaggttggcgttcgtcttctcagcgagaacggcgaagttgatgttaccaaggccgccgttgagtgcgaggctgatgagccggagaaggacggttttgtcgacggcgtcaagaatctctttggttttggcaagaaggacaagactgagggcgaggaggattctgcttctgcgtccaccgaatcatctactagcacctcttcttcggccgctgcatccgcctctgccgagaccaagcccagtgagcccaagaagaagcaactcgttcagattaatgttgatttcaccctcacccccactggccccacctctctcctttccaaggcctccatccaagccctcaaggaccgtctcaagtccttcgccgcctccgaccgcacccgccaactccgcgaggaagcgctcaaccagctcgaagcctacacttacaagatcagcgacattctggaccgcgagtctttcattgcgcactccagcgcttccgagcgtgaggctcttcagcaaaagaaggacgaggtcagcgactggctctacggcgacggcgccgatgccactcgcgaggaattcaaggccaagctcaatgagctccaaaacattgttgatcccgtcctcaagagggcggaggaagcggagaagagacctgaaattctcaagggattgcaggatgctctcgacaacaccaacaaattcgtcaaggacatcagg

SEQ ID NO: 27904 - DNA, 1104 bp, Neurospora crassa
ctacagcccttcgtggcggacttcttgatgggtggtgtctctgccgccgtctcgaagactgctgccgctcccattgagcgtatcaagctcctcgtccagaaccaggtacgttccaataattacctcattctcccatgatcgacaggagaaggaaatcaacttggcctctgtgatccgcgcgtgcggtagcagtctcagcaagtctatctggctgtcacgtgccattcctttaacgtcggcgatgggagaacgagcatccctccacatcttggtccaggtatactgacgaccccctaggatgagatgatccgtgccggccgtctcgaccgccgctacaacggtatcatcgactgcttcaagcgcaccaccgccgatgagggtgtcatggccttgtggcgtggcaacaccgccaacgtcatccgttacttccctacccaggccctgaacttcgctttccgtgacaagttcaagaagatgttcggctacaagaaggacgtcgatggctactggaagtggatggccggtaaccttgcctccggtggtgctgctggtgccacttccctcctcttcgtctactccctcgactacgcccgtacccgtctcgccaacgacgccaagtccgccaagaagggtggtgagcgtcagttcaacggtctcgtcgatgtctaccgcaagaccatcgcttccgatggtattgccggtctctaccgtggtttcggtccctccgtcgctggtatcgtcgtctaccgtggtctctacttcggtctctacgactccatcaagcccgtcctcctcgtcggtgacctcaagaacaacttccttgcctctttcgctctcggctggtgcgtcaccaccgccgctggtatcgcctcttaccctcttgacaccatccgtcgtcgcatgatgatgacctccggtgaggccgtcaagtacaagtcttccttcgatgccgcttcccagatcgttgccaaggagggtgtcaagtctctcttcaagggtgctggtgccaacattctccgtggtgtcgccggtgctggtgtcctctccatctacgaccagctccaggtcctcctcttcggcaaggccttcaagggtggttccggt

SEQ ID NO: 27905 - DNA, 774 bp, Neurospora crassa
tcgtttagcatcggcgctgccgtagcccgccgcctgtggtctctcggcgcccacctcgccctcacctattcttcttcccccgagaagctgcaggccctggagcaagaactctacgaagccttcaccaacggccaaaccgcccacggcccagccctttccctcaatcgtaccaccgccaaccctaatccgctgcccttttctacccacaaatgcgacttgtcctcgccagccgacatccaactcctctttacccagctccaggacctgcacggccagtccggccccgacatcctcatcagcaacgccggttatggcagacgcatccccagcattttagacatcagcctcgacgagttcgacaagatgctcaacatcaacctccgctcgtccttcctcctctgcaagctctccctcccgcacatgatccagcgcaactggggccgcatcatcttcgtctcctccattgctgcccaaggcggtgggatcaacggatgtcattacgctgcttccaaggcggggttgcaaggcttgatgaagaacctagccaggaagcacgccggccagggcatcacggttaatgatgttgcgccggccatgattggggagacgggcatgattccggatgccaagttcgtggagggaacgccgggagatgtcaagaatattcctgttggaaggctggggacgacggacgaggtggggaatgtggtggagatgctggtgaagacggggtacatgacggggcagagtgtgttgttgagtggggggttgatg

SEQ ID NO: 27906 - DNA, 1461 bp, Neurospora crassa
tgctaacacacgacaccacagcccgatggttacctcaccgaggagcgcaaggccgctgaccccgaccatggcttcagcactttcttctccgagaccggtacatagcgcccttgctcaacatagcacgcgaaacggaagcttacaaatacaaatataggcaacgggaaatacgttcctcgcaccatctacgccgatctcgagcccaacgtcattgacgaggtccgcaccggcgcttaccgcggtctcttccaccccgagcacatgattagcggcaaggaggatgcctccaacaactacgctcgtggtcactacaccgtcggcaaggagctgatcgaccaggtcctcgacaaggtccgccgcgttgccgacaactgcagcggtctccagggtttcctcgttttccactcgttcggtggtggtactggttctggtttcggtgctctcctcatggagcgcctctcggtcgactatggcaagaagtccaagctcgagttctgcgtctaccctgctccccagactgccacctcggtcgttgagccttacaactcgatcctcaccacccacaccaccctcgagcacgccgactgctccttcatggtcgacaacgaggccatctacgacatctgccgccgcaacctcggcctcgagcgccccaactacgagaaccttaaccgcctgatcgctcagggtatgtcatggcttggctctatgacgtgtgtgattttcctagactaacttttcccccctcagtcgtctcttccattaccgcctcgctccgcttcgacggctccctcaacgtcgatctcaacgagttccagaccaacttggtcccctacccccgtatccacttccctctggttgcctacgctcccgtcatctcggctgccaaggccgcccacgaggccaactcggtccaggagatgaccatgtcctgcttcgagcccaacaaccagatggtcaagtgcgacccccgccacggcaagtacatggccacctgcttgctctaccgcggtgacgttgttcccaacgacgcccacgctgccgtcgctaccctcaagaccaagcgcaccattcagttcgtcgactggtgccctactggtttcaagcttggtatctgctaccagcctcctcaccaggtccccaacggcgatctggccaaggttaaccgcgctgtgtaagtttctctcgatctctgtatgccgtgacacctagtgttctaaccgtgacaatagctgcatgctttccaacaccactgccattgccgaggcctggtccgctctttcgtccaagtttgatctcatgtactccaagcgtgccttcgtccactggtacgttggtgagggtatggaggaaggcgagttctctgaggctcgtgaggatcttgcggcccttgagcgcgattacgaggaggttgctgccgactcgatggagggcgaggatgtcgaggccgagtactaagtg

SEQ ID NO: 27907 - DNA, 1164 bp, Neurospora crassa
gtacgagatgctgtgacgaaaatatgctccaatttcccaaatacatattggcagcaacatgaccagatggaggagtatcccaagcagttccacgctgctctcgcgcaagacggatggctcggtattgccctaccagaggcgctcggaggagccggacttggtatttccgaagcgaccatgatgatgcagacaattgccgagtcaggggcaggtatggcgggcgcgcagtccattcatgccaacgtctatgccacccaaccgctcgcaaagttcggaacgccggaacaacttgaagagaccattccgaacatcatctcaggaaagctccgcgtctgctttggggtgaccgagcctaacgccggtcttgacacgctgcgcctagagacactcgccaagaagcaagatgatggttcatactcggtatcgggacaaaagatctggataacgtgtgcccaggtggcggacaagatgctgcttctggcgcgaaccacggcgcttgatgaggtgaagaagccgagtgagggactgtctctgttctgcatcgatctgaacagaggagaccaccggttgaaagtgagcaagatcaagaagatgggcggacgcgctgttgatgccaatgaagtctttttcgagaactacccgatccctggcgaatctctcatcggaaaggaggggcaaggatttaagatcattcttcacggcatgaacgcagaacgttgtcttctcgcgggcgaggcacttggactaggatacgcggcgctgggcaaggcggctgcgtatgctcgagagcgcgtggttttccagcgaccgattgggcagaaccaaggcatcgctcaccctttggcggatgtgtatatgaggctcgaggcggcgaagcatgcgacataccatgccgccaggttgtacgatgcgagcaagacagatggctccattcgacaggaggaagtcggagtggcttgcaatagcgccaaatatttggcggcggaggcagcctttgcggcctgcgaaagagccgtactaacccacggcgggatgggatacgctgtcgaatacgatgtcgagcgatactttagggagtgtttggtacccagaatcgctccggtcagccgggagatgattctcaactacatctccgagaaggtactcgacttgccgagaagttac

SEQ ID NO: 27908 - DNA, 1284 bp, Neurospora crassa
atggccgtgacttcctcctcacctggacccgccccgctttcccttctctccaacaacgacgacttcattgctcccttcaacatcaacaccaagttcccatccgccatcgtccctccaaggacctcttcgaatcaaccaatttccgttgccataccctctaatcgcatctcttccgccggtctagctgcaacacagcaggcgcaaacccgtaaacgcaaggcctcggtcgcccaaatcagtctccccagcatgctcccaacttccttctcgccatacacaatggcgccccagccgccccagcctcccccgaacccagaccgatttgcgaccgaagacttcttcagcccctcgcggcgcacctggtccgaagagaaggagaaggttctgacgggtccttacgactatctcaacgggcacccgggcaaggacatccgatcgcagatggtcaaggccttcgacgcctggcttgatgtgccgtccgaaagcctcgaggtgatcaccaaagtcatcagcatgctacacacagcctccttgctcgtcgacgacgtggaagacaacagcgtcctgcgccgcggcttccctgtcgcccactccatcttcggcatcccgcagaccatcaacacgtccaactacgtgtatttctacgcgctgcaagaattgcaaaagctcaagaaccccaaagccgtcagcattttctctgaagaactgctcaacctgcaccggggccagggaatggacctcttttggcgtgacacgctcacctgcccgacggaggacgactacctagagatggtatccaacaagacaggcggtctgttccgcttgggaatcaagctgatgcaggccgagtcgcggtcgccggtggactgcgtcccgctcgtcaacatcatcggactgatcttccagatcgccgacgattatcataatctgtggaaccgcgagtacacggccaacaagggcatgtgcgaggacctgacggagggcaagttcagtttccccgtgatccacagcatccggtcgaacccgagcaacatgcagctgctcaacatcttgaagcagaagacgggggatgaggaggtgaaaaggtacgcggtggcgtatatggagagcacaggcagctttgagtacacgcgcaaggtcatcaaggtgctggtggatagggcgaggcagatgacggaggacatcgatgatgggagggggaaaagtggcgggatccataagattttggatcgcattatgcttcatcaggaggagaatgtggcgcagaagaatgggaagaaggag

SEQ ID NO: 27909 - DNA, 2279 bp, Neurospora crassa
gacacaatgacccatcctcaagacgaggcccagcatctctctctcaccgatcccgaaggattctggggtcatcaagctgaacagcttcactggcacagaaagccttctgcggttctgaaacgcacgactaaagatctgaaattgggtacctctcacagtcattgggaatggttcccagacggcgagatatccacctgctataactgccttgaccgtcatgtcctagcggggcatggagatcagcccgccattctctacgacagttcggtcacgaacaccaagcagcggttgacttacaagcagcttcttgccgaggtcgaaacttttgccggggtccttcgagaggaaggcgttaagaagggagatgttgttttagtttacagtcagttcacccagttacggctttcacgagtgtccactgagccagctactgacagcctacctatttacatagtgcccatggtgcccgccactttgatcggcattctcgccattaatcgcttgggtgccatccacgctgttgtctttggtggctttgcttccacagccctggctcagcgcattgaagcctcacgtccagtcgctatcttgacagcttcttgtggtatcgaaggtaacaaagggcctgtcagttaccgcgcctatatcgaagaagctatcagcatctcatccttcaaaccccccaagactatcatctggcagcgtgagcagctagtgtggcgtccgatcaagaaaaccgagggcgagcgggattggcagaagctggtcaagagcgcgcggttcagaaatatcaaggttgagtgtgttcctgtaaggtcggctgatcccatttacatcatctacaccagcggaaccacaggtcgaccgaaaggtgtcgttcgcgatagcggcggtcatgctgttgggctgcacatgtcgatttcgtatctgttcggtatacatggaccaggtgacgtggtaagttggcgtctcgttcacaagtcaaagcttcgcaaaatgaaagctgttaacaggaccgtgatcagatgggctgtttcagcgacataggctgggtagtttcacacagctacacactttatggtcccctactgacaggcgccgccacggtcctctacgaaggtaagcctgttggaacacccgacgcctcggctttctggagactagccgaggaatataagatcaacaccttgtttaccgcaccaacggcactcagagccatccgaaaggaagaccctgacaatgtctttatcaccgagattggcagacgaggtgggctcaagagcctcaaagccctttttcttgctggagagcggtccgagccagctatcattaacatgtaccaggacttgctcaggcggtatggcgcggcaggctcccaggttgttgataactggtggtcgtcagaatctgggtcgccgatttcgggtgttgcgttggttccgcacgcaggcaagaacaggaagacgaatatgaaagatcatccgccattacctatcaagcccgggagtgctggaaaggccatgcctgggtttgatgtcaggtatataattttcattatttccatttcctcagatgcatggtaactaatgctgcaccgtaatgatcagagttgtggatgacgaaggcaacgaggtgcccaggggcaacatgggaaacatcgttctgggccttccattggcacctactgcgtttcggacactttggggggatgaggaacgattctataagagttacatgattcgcttcaatggcaagtgggttgacactggcgatgccggctatgtcgaccaaacagggtacattcacattatggcacgcactgatgacattatcaacgttgccgcccatcgtcttagcacaggcaagttacctctcccattttttttgtcatccacttgcaaacatacctctaacaccccgcgtcaggcacgctcgagcaagcagtcacaagccaccccctcgtcaccgaagcatgtgtggttagcgtccccgacgccctcaaaggccagcttcctttcgccttcgtcagcacctcggacggcggcgccgacgtcaagtcagacgagcagctgttccaggatatccagaagctcgtccgcgcccaggttggcgccatcgcctcgctgggcgggatgatccggggcaagggcatgattccgaagacgcgctcgggcaagaccttgaggagagtcctacgcgaactgctagaaaatgcggtccatgacgagttcgaaaagcccatcaatatcccctcgacggtggaggatccgagtgtagtg

SEQ ID NO: 27910 - DNA, 1308 bp, Neurospora crassa
gatgcggctcgggcggccaagtcggcctcccacgtgctggccacgctctcggccgaggcccgcaacgacgccctgacggccatccacgccggcctcactgccgcgcgcgacgaaattctggccgccaacgcccgcgaccttgagctggcccgccaagccgctgccgacggcaagctgagcgccagcctggtgtcccgcctcgacctgggcaagacgggcaagtgggaggacatgctcaagggcatctgggacgtgcgcgacctggaggaccccgtcgggcgcgtcacccttcgtaccaagctggacgacggcctcgagctggagcgcgtcacctgcccgatcggcgtgctgctcatcattttcgaggctcgcccggaggtgatcgccaacattgccgcgctggccgtcaagtccggcaacgcggccatcctcaagggcggcaaggagtcgaccgagtcgtttgtggccatcagcaccgccatctccaatgcgctctcgcaaacccaggtacccaacgacgccatccagctcgttaccacgcgcgagtccatcccccagctgctcgccctcgaccgcgacattgacctcgtcatcccccgcggatccaatgagctggtccggtacatcaaggagaacaccaagatccccgtcctcggccacgccgatggcctctgttccatctatctggccgcttctgccgacgccaagctggctgctgacgtcgtcgtcgacgccaagaccagctacccggccgcctgcaacagcgtcgagaccctacttgtccaagaatccgctctcaccaccgtcttccctgccgtcgcctccgccctggccgccaagggcgttgagctgcgatgcgacgccgcctccaaggccgccctttcccccgaaatcaccaccaacatcaaagacgccactgccaaggactacgataccgaattcctctccctcaccctcgcagtcaagaccgtccccgacctgtcagcagccatcgcccacatcaacacgcacggctcgcaccacaccgaagcgatcttgaccgcggaccaggccgaggccgagcgcttcatgtcggccgtggatgcctcgggcgcgtactggaacgcgtcgacccggttcgcggacggcatgcgctacggctttggtactgaagtcggtattagcactaataagatccactcacgcggtcctgtgggcttggaggggctaatgatttacaagtataagattagggggcagggacacgtcagtgcggtttatggagagggagaggggaaaaagaggtttaagcatgagaggttggcgatt

SEQ ID NO: 27911 - DNA, 1778 bp, Neurospora crassa
tatctttggccagcaaattctctcaagctccagggcatcatacttgtgtgctttgttttggtccttcttcagcgctttgtcaacattgcggttcccgctcagatggggagagttaccgatgcattagagccgaaggacggggttttcaaaatgccgtggatgcaggttggactcctcgtattatacaagctgcttcaagggccttctggattgctggggtctttgaggtcgatcctctggattcccgtatcgcagcatacctaccgagcattgacgacagctgcatttgagcatgtgcattccttgtcactggatttccaccttggcaaacgcactggagaggtcctttccgctctcaacaagggagcctctatcaaccagttcctggagcagacaaccttccaagtggctcctatgctcatcgaccttttcatagccatcatcttcttctatgtcaagttcgggcccatgtacgccttgttcgtctcggtcatcaccttttattatttgtttttgacgatccgtatggcggcaaccagggctgaccagcgacgcgatatggtcaacgcggatagagaggaagaggcggttaagaacgattcgatcacgtcttacgaaacggtcaagtacttcaacgccgaaaaatacgagtttgcgcgctaccgcaatgcgatcctcaacttccaggcagccgaggccaaggtgacctttggcatgaatcacatgaacatgtgtcagtccatggtcttcatgtgcggctttcttgtcatcatgatgacctgcgcgtatcaggtcagccaaggcactcggacccttggtgagtttgtgtcgttgatcacttatctcggccaactgcaaggaccactcaacttctttggtactttttaccggaccatccagcaagccatgatctccggagagagactccttgaactcttcaaaatccagccttctgtcatcgacggccctgatgtccaagacttggcaagctgcagcggccatttgaaatggaacaacgtcgggttctcgtacgacaagcgcaggcctgccctgcatgacctgtctttcgagtgcaagcccggaactaccaccgcgtttgtcggcgagtctggaggtggcaaatccaccgttttccgtttgatgttccggtattacaactgccaggagggaagcatacagatggacggccatgacgtgaaagacttgaccatcgactcagtgcgccgattcatcggtgttgttccgcaagatactatcctgttcaacgagaccctcatgtacaacctgaaatatgcgaacccgaacgcaaccgaggaagatgtgtatgatgcttgccgggcggctgcgattcacgatcgtattctgagtttcccggacggctacgccaccaaagttggcgagcgtggccttcgcttgagcggtggtgagaagcaacgtgtcgctatcgcgcgcacaattctcaaaaacccacaaatcatcatgttggacgaggcgacatcagccttggatggtgagacagagcagaagatccagtccaagctaatcagcggcaattttggcgagggccgtacgctcctgatcattgcgtaagtgacttatgtactgatcatcactgaatagttgctgacgataatatgtattacaggcatcgattgtcaactattacgcatgcggatcaaattatcgtccttcacgctggcaccatggtcgaaaaaggtacgcatcaggagctcctagctctgggtggccgctatgcttccatgtgggagaagcattgc

SEQ ID NO: 27912 - DNA, 2612 bp, Neurospora crassa
caaagacatctcgagaaccactcgtgctgaccgatggaacaggaagatgataccgccactgctattctcaagaagaagaagaagcccaaccagttgatgtaggttgacgttgaagatgcggggcactgcaacctgagctaacacatatgcagggttactgacgccgtcaacgatgataactcgattatcgccctctccaacaacaccatggagcagctccagctcttccgtggtgataccgttctcgtccgcggaaagaagagaaaggacaccgtcttgattgttcttgccgatgacgatcttgacgatggcagcgcacgcctcaaccgtgtcgttcgccacaacctccgtgtcaagcacggcgacatcatcaccattcacccttgtcccgatatcaaatatgttagtctataacccggtcacctagtcatagaatgggcaccttgctgacacagcatctccttgtaggccaagcgtattgccgtcctcccgatcgccgataccgttgagggcatcaccggatctctcttcgacgtcttccttgctccctacttccgcgaggcctaccgccctgtcaggcaaggcgatctctttattgtccgcggtggtatgaggcaagtcgagttcaaggtcgtcgaggtggacccaccagagtacggtattgtcgctcaggataccgtcatccactgcgagggcgagcccatccagcgtgacgaggaggagaacaacctcaacgaggttggttacgatgatattggtggttgccgtaagcagatggctcagatccgcgaaatggttgagctgcccctcaggcatcctcagcttttcaagtccattggtatcaagccgccccgtggtgtcctgctttatggccctcctggtaccggtaagactttgatggctcgcgctgttgccaacgagactggtgcctttttcttcttgatcaacggccccgagatcatgtccaagatggccggtgaatccgagtcgaatttgcgcaaggctttcgaggaggctgagaagaactcgcccgctatcatcttcattgatgagatcgactcgatcgcccccaagcgtgagaagaccaacggcgaggttgagcgccgcgtcgtctcccagctccttactctcatggatggtatgaaggcccgttccaacgttgttgttatggctgccaccaaccgtcccaactcgatcgatcccgctctccgtcgtttcggccgtttcgatcgcgaggtcgatatcggcatccccgaccctaccggtcgtcttgagattctccagatccacaccaagaacatgaagcttgccgatgacgtcgatctcgagcagattgctgctgagacccacggttacgttggttctgatattgctgccctctgctccgaggctgccatgcagcagattcgtgagaagatggatctcatcgatctggacgaagacactatcgacgccgaggtccttgactctcttggtgttacccaagagaacttccgctttgctctcggtgtctccaacccctcggctcttcgcgaggttgccgttgtcgaggttcccaacgtccgctgggaggatatcggtggtctcgagactgtcaagcaggagctcagggagagtgtccagtaccccgtcgaccatcccgaaaagttcctcaagtttggcctttcgccatctcgcggtgttcttttctacggtcctcctggtaccggtaagacaatgttggccaaggctgttgccaacgagtgcgcagccaacttcatttccgtcaagggtcccgaactgctttccatgtggttcggtgagtctgagagcaacatccgtgatatcttcgacaaggctcgcgctgctgctccttgcgtcgtcttcctcgacgagttggattctatcgccaaggcccgtggtggctctgttggtgatgctggtggcgcttctgaccgtgttgttaaccagcttcttaccggtaagttgattcttccttggtttgtgccattctgctgtgcatactaacctgagctatagaaatggacggcatgacctccaagaagaatgttttcgttattggtgctaccaaccgtcccgagcagctcgacccagcgctctgccgtcccggccgtctcgactccctcatctacgttccccttcctgatgaggcgggtcgtctcggtattctcaaggctcagctccgcaagacccctgtcgctgccgatgttgacctgaactacatcgcttccaagacccacggcttctctggtgccgatcttggcttcatcacccagcgtgctgtcaagatcgccatcaaggagtctatcaccgccgatattcagcgcactaaggagcgcgaggccgctggcgaggatgtcgagatggaggatgaggttgaggaccccgttcctgagctcaccaagcgccacttcgaggaggccatgtcgatggctcgtcgctccgtcagtgacgtcgaaatccgtcgctatgaggctttctcccagcagatgaagaacgccggcccgggtgccttcttcaaattccctgagggtggtgttgagagcagcggcaacggcggtgctggtaactcgtttggtgatgctggcaacgatgatgatctttacaactag

SEQ ID NO: 27913 - DNA, 918 bp, Neurospora crassa
ggtgccgcggccaccgccgctatgctctccctcaagagcgacaagaaggtcgacaccacctcgctgaacgctcccgttcccgctgccccttccaagcctggtccggttcccgccagccaggtcttcagcgcgcccgctctcgccggcggttataaacctgtcgacccctcggccttcttcgagtacggcttcccgggccccgtcgctgatctcgcgacccgccaaggctttgtgtcctcgtacgaccgccgcaccaagaacccgcactggacggtggagcacatcacgcccgagtccctgtccatgtccgaaggcgaccgcaagaagtctactttcgtcgaagacgaggcgatccccgaaaagttccgcggcaagctcaaggactacttccgctccggcttcgatcgcgggcaccaggttcccgcggccgactgcaagtggtcgcaagccgccatggacgacaccttttacctgtccaacatgtgcccgcaggtgggcgagggtttcaaccgcgactactgggcgcactttgaggatttctgccgtcgcctgacgaagcagtacccttccgtccgcatcgtcaccggacctctgtacctgcccaagcgcgaccccagcgacaacaagtggtacgtcaagtacgagatgatcgggcagccccctaacgtggcggtgccgacgcacttttacaaggtcatctttgccgaggacggcaagaagggaggaaacgttgcgctaggagctttcgtgttgcccaacgccaagatccccaacgataagccgctgcaggactttgaggtgcccctggaggcggtcgagagggcgagcggtctcgagtttgcgagcaagctgccggtacagaggaggaagaggttgtgtgcggaggcgaactgctcccttattgtcaaggactatgcc

SEQ ID NO: 27914 - DNA, 1088 bp, Neurospora crassa
ctcgttcgcctccttcacgccatcaacgtaactaccgccctggttctaacctcctatgtggtttactaccacatccaccaccctttgattggcaccctcacggaagtgcacgccatcgtggtctggctcaagacagcctcgtacgccttcaccaaccgcgacctgagacacgcgtacctgcacccggcccgcggagagctcgacgccttgccaggactgtacgcggagtgtccctatccggagaacatcacgatgggcaatctctgctacttctggtgggctcccacgctagtctaccagcccgtatacccgcgcaccgccaaaatccggtggtcgttcgtggccaagcgatgtggcgaggtgatttgtctcagtgtattcatctggttcctttcggcgcaatacgcgacgccggtgctgcgcaactcgctggacaagattgcttcgcttgatatcccgagcattgtggagcggctgctgaagttgtcgactatttcgttgattatctggctcgctgggttcttcgcgctgttccagagctttttgaacgcgctggctgaggtgaccaggtttgcggaccgctcgttttatgatgagtggtggaacagcgagagcttgggcgtgtactggcgcacgtggaacaagcccgtttatcagtacttcaagcgccatgtgtactcgcccatgcggtcgagggggtggagtaatgcgacggcgagtttggcggttttcttcttgagcgccgtcttgcatgaattgcttgttggtgtgcctactcataaccttattggtatgtttttttcttcttcattttttcttttcctatttttttccctttggccatttcacagacaagccatatggaagaactgtcatctaacacaaaaatcacaggcgtcgcttttctcggcatgttccttcaactgcctctcatccagttcaccaagcctttggaaaagaaaacgtctcccaatggcaagttgctgggcaacatcatcttctgggtctcctttaccatctttggccaaccgtttgcggccctcatgtacttttacgcatggcaggccaagtatgggagtgtgagcaag

SEQ ID NO: 27915 - DNA, 5689 bp, Neurospora crassa
gatcagcagtactatgataaccgtaatggaggacacgctgccggcggtcagcatggcgaaggttactatgatgagtcgtatgttccccaaatcttgctctctctccccccttttttgaacgcctgcggctgacgctttgtcctgtcttgcagcggctactataacgccgacccaaacaacccgtaccaccaggatggtggttattacgacaaccatgaagggtttcaggagggttacgacaacggctactacgaccagcatggctacgaccaggccggcggctatcgagacaaccatgccgctcgtggctctgaggaggattccgagacctttagcgatttcaccatgaggtccgacatggcccgtgccgccgagatggactactatggccgtggtgatgagcgctacgacagtcagtatggcgaccagggcggtgcccggggttatcgccctccttcctcgcagatctcgtacggcggaaaccgctcgtctggcgcgtcgacaccaaactacggcatggactacggtaacgttcttcctgccggccagcgctccaaggaaccgtatcccgcctggacgtcggatgcccaaatccccctctcgaaggaggaggtggaggacatctttttggatctatgcgcaaagttcggtttccagcgtgacagcatgcgcaacatgtacgaccatctcatgacgcttctcgactcccgtgcttctcgtatgactcccaaccaggcccttctctcgctccatgccgactacatcggtggcgacaacgcaaactaccgcaagtggtacttcgctgcccatctggatctggacgatgccgtcggttttgccaacatcaagggcaagaagggcaacctgaagcgcaccaagaaaaaggccaagggtgacgagccccaaaacgaagccgagatccttcaagagctggagggtgatgactcgttggaggcggccgagttccgttggaagactcgcatgaacaggatgtcgcagcatgaccgtgtgcgacagcttgccctctatctcctgatttggggcgaagccaaccaggtccgcttcatgcccgagtgtctgtgcttcctcttcaagtgcgccgatgactatctcaactcgcccgcgtgccaaaacatggtcgagcccgttgaggaattcacctttctcaacaacgtcatcaccccgctgtatcgctactgccgcgatcagggttacgagatctacgaaggtgtctacgtccgtcgcgaaagagatcacgagcagattatcggttatgatgactgcaaccagctcttctggtatcccgagggtatcaaccgtatcgttcttgaggacaagagcaagctggtggacgtccctcccgctgagcgttatctcaagctcaaggatgtcaactggaagaagtgcttcttcaagacctacagggagacacgctcgtggttccacatgcttgtcaacttcaaccgtatctggattattcacttgaccatgttctggttctacactgcctacaacatgcctaccatcatcactcccatgtacgaacagcaggttaaccagtcacctcccaaggctgccatgtggtcctttgtcggtttcggtggtggtgtcgctgcgctgatcaactttggagcaactctggcagaatgggcctatgttcctcgcagatgggctggtgcgcagcatctgtcgaagcgaatgctgttcatggttttcgtcctcatcatcaacttggctcctggtgtctatgtcttccttccgggcctgaaaggccaggctctgattgatcatcagaacagcacccctgtctatatcgtcggcatcgttcacttctttatcgctctcatcaccttcttgttctttgccgtgatgcctctgggtggtctcttcggcagttacctcaccaagaactcacgcaagtacgtcgccagtcagacatttactgccagctggcctcgcctcaacggtcatgacatggccatgtcgtttggtctgtgggttgtggttttcggcgccaagttcggagagtcgtacgtgtatttgacactgtcgattcgtgacccaattcgttacattggtcttatggataccagttcatgtcttggagactcgattttgaagacctggctctgcccgtaccagccgcaaatcacgatgggtctgatgatcttcactggtatgatcttcttcttcctcgatacgtatctgtggtacgtcttgatcaactccgtcttctcggtcgccagagctttctaccttggttcctcgatctggactccttggagaaacgtctacgctcgcttgcccaagcgtatctactccaaggttctcgccactacggacatggagatcaagtacaagcccaaggtcctcatctcccagatctggaatgccatcgtcatctccatgtaccgcgagcaccttctggccattgatcacgttcagaagctcctctaccaccaggtgccctctgagcaggaaggcaagcgtactctgcgtgcccccactttcttcgtttcccaggaagaccagtctttcaagaccgagttcttccctcagtacagcgaagccgagcgcagaatttccttcttcgcccagtcgctctctactcccatccccgagcccctccctgttgacaacatgcctaccttcactgtcatgattcctcactacagcgaaaagattcttctttctctgcgtgaaatcattcgtgaagatgagccctactcgcgtgtcactctcctggaatacctcaagcagctccatccccacgaatgggactgcttcgttaaggacaccaagattctcgcggatgagacctcgcagttcaacggcgagactgagaaggagaaggaaaaggaaaaggagaaggagaccgtcaagagcaagatcgacgatcttcccttctactgcatcggtttcaagtcctcggcacccgagtataccctcagaacccgtatttgggcctcgcttcgcttccagaccttgtaccgtaccgtctcgggtttcatgaactacgctcgtgccattaagcttctctaccgtgtcgagaaccccgaagtcgtccagatgtttggcggtaactccgacaagctcgagcgtgagctggagcgcatggctcgtcgcaagttcaagctctgcatttccatgcagcgtttcgccaagttcaagaaggaggaaatggagaacgccgagttcttgttgcgcgcttaccccgatctccaaatcgcctaccttgacgaagagcctcctcttgccgaaggtgaggagcctcgtctgtactctgctctcatcgacggtcactctgagatcatggagaacggttcgcgccggcccaagttccgtatccagctttccggaaaccccattctcggtgacggaaagtccgacaaccagaaccacgccatcatcttctaccgcggcgagtacatccagcttatcgatgccaaccaagacaactatctcgaggagtgcctcaagatccgcagcgtgttggccgagtttgaggagatgaagaccgacaacctttcgccctacactcccggtgtcaagaacgaggtccgccaccctgttgccattctcggtgctcgtgagtacattttctccgagaacattggtatcctcggtgatattgccgccggtaaggaacagacattcggtacgctcttcgccagaaccttggcccagattggtggcaagctccattacggtcatcctgatttcctcaacggtatcttcatgactacccgtggtggtgtctccaaggctcaaaagggtttgcatctgaacgaggatatttacgctggtatgaacgctcttctgcgtggtggccgcatcaagcactgcgattactaccagtgcggtaagggtcgtgatttgggtttcggctccattctcaacttcaccaccaagattggaactggtatgggtgagcagctgctctctcgcgagtaccactaccttggaactcagctcccgatcgatcgtttcctgtccttctactacgcccatcccggtttccacttgaacaacatgttcattatgctctcggtccagctcttcatgctttgctgcgttaacatcggcgtactgcgtcatgagacgatccgctgcgagtacaaccgcgaggtccccattaccgatgccctcttccccaccggctgctccaacaccgacgctcttctggactgggtttaccgctgtgtcctctcgattatcttcgtcttgttccttgccttcgttcccctgatagtccaggagatgatggagaagggtgtgatccgctctgcgactcgtttcatcaagcagatcctttcgctctcgcccttcttcgaagtgttcgtctgtcagatctacgccaactctgtccagcaagatttgtccttcggtggtgccagatatatcggtaccggtcgtggtttcgccaccgcgcgtattccctttggtgttctctactcccgtttcgccggtccttcgatctacttcggagccagattggtcatgatgctgctctttgcctgcctgactgtctggcacgctgccctgatctatttctggatctcgcttatggccttggtcatctcgcccttcctctacaaccctcaccagttctcttggggcgatttcttcatcgactaccgcgagtatctccgctggctctcgcgtggtaactctcgctcgcacgcctcttcttggatcaccttctgccgtctctcgcgtattcgaatcactggtttcaagcgcaagattatcggagacccgtcgagcaagctttcgggcgatgttgccagggctgccatcaccaacctgttctggtccgagatgcttacccccttcatccttgtctgcttgacgaccatcccgtatctgttcatcaacgcgcagactggtgtcaggggcgaatttggaccccatgccaacgacgatagcatcaagcctaccgcctccttgatccgtctcttggttgtcacgtttgcgcccatggctgtcaacgccggtgtccttggtggcttgttcggtatggcctgctgcatgggtcctcttttgagcatgtgctgcaagaagtttggtagtgttctggccgccattgcccatggtatgtcggtcattatccttttggttatgttcgaagtcatgttcgtcctgcagaactttgagtttacccctacccttctcggcatgatcgccatggtctcgattcagcgcttcatcatcaagatgattgtctcgttggccttgactcgtgagttcaagactgatacctccaacattgccttctggacgggcaagtggtactctatgggctggcactcggtttcgcaacctgctcgtgagtggcttgccaagatcacggagctcagcatgtttggcgccgactttatccttggccacctgattctgttctccatgttccccgtccttatcatccccaaggtcgatgtgctccactcggtcattctcttctggctccgtccaaggtatgtcattccaacctgttccgcgctttgttttgagtctgttgctaacgcaatatctttgtagccgtcaaattcgtgcccccatctactcgctgaagcagacgaagctcaggaggagacgtgtgatccgttatgcgatgctctactttgtcctgcttgtcatctttgtcgccctgattgttggaccgattgtggccggcaaacagattcct

SEQ ID NO: 27916 - DNA, 2127 bp, Neurospora crassa
ccccagaccttgaccgagaagattgtccagcgctactcggtcggcctcgctcccggcaagaaggtcaagtctggcgactatgtcaccctccagcctcaccactgcatgacccacgacaactcgtggcccgtcgccatgaagttcatgtccatcggcgcctccaagatccacgacaaccgccaggtcgtcatgaccctcgaccacgacgtgcagaacaagagcgaggccaacctcaaaaagtaccgccagatcgaggagttcgccaacacgcacggcgtcgatttctaccctgccggccggggcatcggccaccagatcatggttgaagagggctacgcgtggccgggcaccgtcactgtcgcctccgactcgcacagcaacatgtacggcggtgttggctgcctgggcacgcccatggtgcgtaccgacgcggcctccatctgggctaccggcaagacatggtggcagatcccgcccatcgccaaggtcaccttcaccggtctgctcccgcccggtgtcacgggtaaggacgtgatcgttgctttgtgcggcctattcaacaacgacgacgtgctcaaccacgccatcgagttcaccggtgccgaagaaaccatgcgctccatccccgtcgacgaccgcctgaccatcgccaacatgaccaccgaatggggcgccctctccggtctcttccccatcgacgccgtcctggcctcctggatgcgcgccaaggccaccgtcaccgccatggaacaccccgagctgggcgacaaggccaagttcacccacgccaagatcgacgcccttctcgagaaccctctggttgccgaccccggcgccacttacgccaaacagctctacctcaacctgtccaccctctcccccttcgtcgccggccccaactccgtcaagatcgctactcccctcaaggacctcgaggcccaaaacctcaagctcgacaaggcgtacctcgtctcgtgcaccaactcgcgcgcctccgacatcgccgccgccgcccgcgtgttcaaggacgccgctgctgacaacaacggtgtcatccccaaggtcgctcccggcgtcaagttctacatcgccgccgcctccctcctcgagcaaaagcaagccgaagactcgggcgactggcaagtccttctcgatgctggcgccgagcctttgccctccggctgcggcccctgcatcggtctgggcaccggtctgttggagcccggtgagatcggcatctctgcttccaaccgtaacttcaagggccgcatgggttccaccgacgccaaggcctacctcgcctcgcccgaagtcgtcgctgcttctgctctgaagggcaagatcgccggtcccggttggtaccaaaagcccgagggtgtcgagaaggtaatcatcggcgaaggcaacggtgtcgttgagcaagacaaggccatgtccattgaagacgctctcgacaagatcattgccgaggccgagtcgctcatcgccaacgccgaggctggcctcactcccgagtccacctcttcttcttcttcttcttcttcgtcgtcggaagaagaatccctcactgaaatcctccccggcttccccgaagccatttccggcgaaatcatcttctgcgacgccgacaacatcaacacggacggcatctaccccggcaaatacacctaccaggacaacatcaccccggccaagatggccgaagtctgcatggagaactacgatgcctcctttggctccatcgcgcgcgccggcgacattctcgtgacaggcttcaactttggctgcggttcctcgcgtgagcaagcggcgaccgccatcctagcaaagcaaatcccgctggtggtcagcggcagtttcggcaacatctttagcaggaactccatcaacaacgcgctgatgggcgtcgaggtgcccaagctggttcagcgactccgtgaagaattcggcgacaaggtggctactagacgcaccgggtggaagttgacgtgggatgtgcgacgcagcaaggtggttgtcgaagaggcgtcaggcaagaagtgggagcaaaaggtgggcgagttgccgccgaatgtgcaggagattattgccaggggaggattggagaagtgggtcaagagtcagatt

SEQ ID NO: 27917 - DNA, 1854 bp, Neurospora crassa
gacttccgccagatcgagccccgcctgcaggctctcgacaagcacctgatcctgcgcacctacctcgacggctacaccctcggcgacatcgacaccaagatctggctcgccctccgtggcaaccgcgccgccgtctccttcatcaagcgcggctcgctcgccaaccttgccagatggttcaactacattgaggagaaccaccccgagatccaggccgagatcaaggccaaggatgctgccgccaaggccaaggtcgccgccgcctccaaggccggtgccagctatgcgctcgccctccagaacgccgaccagggcgtcgtcacccgtttccttcccgagccctcgggctacctgcacatcggacacgccaaggcggccctcctcagcgactactttgcccaccaggcctacaagggccagttgcgcctccgtctcgacgacaccaacccttccaaggagaagcaggagtaccaggatgccatcatcgaggatctcgccctcatgggcatcaagcccgacacggtcacctacacgtccgactacttcgactacctctacgacatgtgcgtgcgcatgatcaaggagggccacgcctacgccgatgacaccgaccaggacaccatgcgcgaccagcgctggaagggtattgcctctgcccgccgcgaccgctccgtcgaggagaacttgcgcatcttcaccgaggagatgaagaacggtaccgaggagggtctgaagaactgcattcgcgccaagctgtccgtcgacaacccgaacaaggctctccgcgaccccgtcatctaccgctgcaacatcgagaccccccaccaccgtaccggcaccaagtggaagatgtaccccatgtacgacttcgcctgccccgtcgttgacagccacgagggcgtcacccacgctctccgctccaccgagtacaccgaccgcaacccccagtaccagtggttcattgataccctcaagctccgccaggtctacatgtgggatttcgcccgcatgaacttcatccgcaccttcctctccaagcgcaagctcgccaagctcgtcgataccggcaaggtctggggctgggacgaccctcgcatgcccaccatccgtggtgtgcgcaggcgcggtatgaccatccccgctcttcgcgactttatcctcaagcagggcccctcccgcaacgtcgtcaccatggattggaccaacttctgggctagcaacaagaaggagatcgaccccattgctccccgccacaccgccatcaccaagaaggacgccgtcaaggtggtcgtcaagggcgccgatgcccccgccgagcccgtcaagcaggagaagcccaagcaccccaagaacaaggaggtcggcaccaagcaggtcactttcgccaacgagctcatcatggaccaggccgatgccaagtcgttcaaggacggcgaggagattaccattatgggttggggcaacggctttgtccgcaacattgacacctctgccgaggtcatccccgcctttgagatcgatctcaaccttgccggcgatgtcaagtctaccgagaagaaggttacctggctcgcgtccaagggccagacgctggtccctgccgagctctgggactttgactacctcatcaccaaggacgttctccaggaggaggacaacatggaggacttcctcaaccctgtcaccgagaccatggaggaggcctggtgcgacgaggcggcggcctccctcaagaaggacgacatcattcagctcgagagacgcggttactaccgggttgacaagggtctcaatgactggaaggagggcgaggagaagaagctcgtgctgttttgcattcctactggcaagact

SEQ ID NO: 27918 - DNA, 2484 bp, Neurospora crassa
ctctataattaccttggtagaaggtctttctttctcgttaaatatagtataactctcaatagaattgctattacaacttctaatactcttattaatattagaaccgatacttatattattataaacctctctttcgctcgaaagctataaaaactattaaaattacctatttataacaattttaatcctggatatattaccctatataaaaaggccaaatccaattccgtcgaagtagcctttaaaagatacatcaaaatccaaaactataaagtctttaattaatagattattatactcccaaacctaaaacgcaatataattattggaaatatatagctaatttaaaataatatttttactaatttagcctacgcgtatctactattccctacctcttaaaaataaaacttctcccgcaatcttaaaatcggaaaaagcaaagattcggaacctattaaatatttaaacttctaaaaggatgttaaagcctaggaattattaatatagaaagaagataaataatactataatagctataacaattcctaaactatcctatttaaaattaaagagttagaacgccctttactattaaaattatttaaatccaacccctcctaacgccccctcgctatcctataacatcgactagcccaatccctatccctaaacgcagcttaatactatttcaattgtatagaccgataatttttcgaataaactaacgaaataccgttagaactagaggaactcccctaaatatccctacgtcgaactaaacccgaactaacccaaaacttatacttactatataatacgtaaggatactaccgcttaaaatataattagagatagattaaagaccgtccggcggacttaacttttattagtacggaccctttctataaaatagtaaagaagatttatattagtataactaatttttataaattaaatcggtttatcgaagaataatatattatcctctatagttcgttagaaataaacgaagtagaattaaaataataaatccttaaagaagttctaaactactattataatttccttaaagtctttagtaaaattaaatcggacgccctccctaatttatagttaaatattaattactatatccctttaaacgaaaacgcccgtcctaaggatttaaattataaccccctatataaaatatccctcgaggagctagaggcttataaggattatattataaaaaatcttaataaaggatttatcgaacctaatactgcaccctaaaccgcccctatcttattcgtacttaaagctaataaaggactctacttctatatagattatcgaaagttaaataccctctcaaagaaggactattaccctttaccctttatcgaggaaactattactcaattatctaaagttaaaatatttataaagattgatatttaataaatattctactacattcggatatttcctaataacaaaaacctaaccaccttttatacctaatatagcgcttacaaatataaagtcttaccctttaggctaactaataacttagtaattttctaatagtttattaataaaatattaataagttacttaaacgacttctatagcgcttatattaataatatcctaatcttctccgagacgaaggaagaatataaaatctatattaaaaaagtactagagcaacttcgggatgtagaattctaggccgatattaagaagtataaattttatattatatctacgaaattcctaaacttcattattttaaccgaaggggtatctgtagatcccgagaaggttactatagtccggaactagaaggaactaactagcattaagggagtacaatcctttatcggattttacaatttttattgcaaatttgtaaaggaattcggccgtataattcatccccttactcgcctaactaagaaggacacccccttccaataaaccaaggactactaaacctccttctataaattaaaggatcggttactaaaagcgccaattctcgcccacttctactataaaaaacctacttaaatcgaaaccgacgcctttaatagaatctatacgggtgtcctattctaattacaactaagtaataataattagtatctagtaaccttcttctccgaaactatactactaataaaattaaactacgttatctacaataaagaattatttactattataaaaactctaacaatttaacgaaccgaactaattagcatttacccattcatcgtagtaatagactattaagccctaaaatacttttttacaaaacgattcctcaattctcaataaaccgggtaagtagaattaatatcctaatactcttttaaatttatttattggcctaagaaggaaaatataataattaacgctttattaaagaaattagaagatctctaaaccgttaaggataaaaaggaagattaatatatattataattattt

SEQ ID NO: 27919 - DNA, 4632 bp, Neurospora crassa
atctctaatcctacccggatcaacatcctgggcaaggacaacatcatcattgaccacggcatctggctgaactttgtcgcccaggacctcctccagaacatcaagtcctccacctacatcctcatcaccgacacgaacctctacaagacctacgtgccccctttccagtccgttttcgagaaggctgctccccaagatgtccgccttcttacctatgccatccctcccggcgagtactccaagggccgcgacaccaaggccgagatcgaggactggatgctctcgcaccaatgcactcgcgacaccgtcatcattgccctcggtggcggcgtcattggcgacatgatcggctacgtcgccgctaccttcatgcgcggcgtccgcttcgtccagtgcccgaccaccctcctcgccatggtcgactcctccatcggcggcaagactgccattgacgtgcccatgggcaagaacctgattggcgccttctggcagcccgagcgcatctacatcgacctcaccttcctcaacacactgcccgtgcgcgagttcatcaacggcatggccgaggtcatcaagaccgccgccatttgggacgagaacgagttcaccgccctcgaagagaacgcaaaggccatcctcgaggccgtccgctccaagaacaagtcggccgaccgtctggcccccatccgcgacatcctcaagcgcatcgttctcggttcggcccgcgtcaaggccgaggttgtctcgtcggacgagagagaaggcggactccgcaacttgctcaactttggacactccattggtcatgcttatgaggcgatcctgactcctcaggtcctccacggcgaagcggttgccattggcatggtcaaggaagctgagcttgcccgcttcctcggcgtcctccgccccagcgccgtcgctcgtctttccaagtgcattgccagctacgacctgcctacctctctgcaggacaagcgcatcgtcaagcttactgccggaaaggagtgcccagttgatgtgcttctccagaagatggccgttgacaagaagaacgagggccgcaagaagaagattgtcctactttccgccatcggaaagacctatgagcccaaggccagcgtcgtcgaggaccgcgccattcgcattgttctctcgccttgcatcagggtctttgctggtgtacccaaggatctcaacgtcagcgtcactccccctggatccaagagtatctccaaccgtgcccttattctggctgctctcggtgagggtaccacccgcattcataacttgctccattccgacgacacccaggtcatgctcaacgccgtcgcgcagctccagggtgcctccttctcttgggaagagggcgatgtgctcgtcgtcaagggcaacggtggcaagttgcaggctacctcgacccctctgtatctgggcaatgcgggaaccgcttctcggttcttgacctccgtggcggctctttgcaacccttccgacgtcaactctactgttttgactggcaatgcccgcatgaagcagagacccatcggtgctctcgttgatgccctgcgtgccaacggcgtcggtgtcaagtaccttgagaaggaacacagtttgcccgtgcaagttgatgctgctggcggccttgccggcggtgttatggagcttgctgccaccatctcgtcccagtacgtctcctcgctcttgatggccgccccctacgcccgcgagcccgtcacccttcgcctggttggcggtaagcccatctctcagccctacatcgacatgaccatcgctatgatggcttcgtttggtgtgcaagttcagcgatctgctgaggatcccaacacctactatatcccccagggcacctacaagaaccccgagacctatgtcgtcgagagcgatgccagctctgccacctaccctctcgccattgccgccatcactggcactacctgcaccgtccccaacattggctccaagtcgctccagggtgatgctcgcttcgccattgaggttctccgtcccatgggctgcaccgtcgagcagactgacgtctctaccaccgtgactggccctccaatcggcactctcaaggccatcccgcacgtcgatatggagcccatgactgatgctttcctcactgcgtccgtgctcgctgctgttgcctctggcaccactcagattactggcattgccaaccagagagtcaaggagtgcaaccgcatcttggcgatgaaggaccagcttgccaagttcggcgtgcactgcaatgagctcgaggacggtatcgaagtgattggcatcccttacactgagctgaagaacccaacggagggcatctactgctacgacgatcaccgtgtggccatgagcttcagtgtcctctccaccatctcgccccacccggtacttatccttgagcgtgagtgtactggcaagacatggcctggatggtgggataccatgtccaactacttcaaggtccatctcgaaggcgaggaggagccacacagcagccacgtatcccacgagaagcctcggaagggtaaccccaagtctatcttcatcatcggtatgcgtggcgctggcaagtccaccgctggcaagtggatgtccgaggttctcaaccgacctctcatcgatctcgatcatgagctcgagaggagagagggccaaacgattcccgagatcatccgcagcgagcggggctgggaaggcttcagaaaggctgagctcgaactccttgaggatgtgatcaagaacaaccctaccggacacatcttctcctgcggtggcggtattgtggagacagaggctgcccgaaagatgttgctttcctacagccaaaatggtggtattgtccttctagtccatcgtgataccgaccaagttgtcgagtacctcatgagggacaagtcccgccccgcctactccgagaacatccgggaggtctactatcgtcgcaagcccttctttgaggaatgcagcaacttccgctactacagccctcatcctgatgggtcaaaggctctgaccgaaccacccttcgacttcagccagttcctctccgtcatctgtgggcacagcaaccacctcgaggaagtgaagaagaagcctcattctttcttcgtctccctcacagtccccaacgtatccaaggcattggacatcatccccaaggtggttgtgggctccgatgccgtagagctgcgtgtagacttgctggaggattacgatccggaatttgtggccaagcaggttgcgctgcttcggtcggccgcgaggattcctatcgtctacactgtccgcactgtcagccaaggcggcaagttccccgatgacgattatgagttggccctcaagctttaccgcactggtctgcaggctggtgtggaatatctcgatctggagatgaccatgccagacgaggtcattgaagctgtgacgaatgaaaagggctatacccatatcattgcctctcaccatgaccccaaggcaacgctctcctggaagaacggcggttggatccagtactacaacaaagccctgcaacatggtgatgttgtcaagctcgttggtgtcgcccgcgaacttgctgacaattttgccctagcacgtttcaaggccagcctcgctgctgctcatgacaagcctctcattgccttgaacatgggtgcagctggcaagctgagccgcgtactaaatggcttcctgactccagtttcccacccagccctgccgtccaaggctgctccaggtcagctctcggcggctgaaatccgtcaggcgctggctcttatcggcgagctcgagcctcggtctttccaccttttcggaaaccccatctcggcttcgcggtcacccgcccttcacaatgctctcttccgcgacaacggcctgcctcatcagtattccctcttcgagactgataacgctgctgacgtcaaagacctgatccgggctcctgggtttggtggagcgtcggtaaccatccctctcaagcttgacatcatgcctttgctggacgaggtgtctgatgctgccaaggtcattggcgcggtcaataccatcattcctgttcgcaacggcgacaaggtaactcttcgcggtgacaacactgactggatgggcatggtgtatgcgctccgcaacgccggcgtcgtcaagtgcaccaaggagtctccgaccgccggtatggttgtcggagctggcggaactacccgagcggctgtccatgctttgcatgacctaggctttgccccaatctacgtcgttgctagaaacgccgaccgcgtcaaggctcttgcggagtcattccctgccgagtacgacatccgctcgttgagcacgccggaagaggtcgcggccgagtccactgcccagccttcggttgtgatcagcaccatccccgccgacaaacccattgaccagagcatgcgtgaggtcattgttgcttctcttcgtcacccgtcggtcgcggatggcaagcatgtcctgctggagatggcctacaccccgcgccacacccctctcatgcagctggcggaggatgcgcactggcagacgattcccggacttgaggttctcgccgctcagggctggtatcaggtatgtaactttttttct

SEQ ID NO: 27920 - DNA, 1386 bp, Neurospora crassa
ggttactgaccatttatggacaacagtggtcaaatttctggtttcttcgacatggaagacttcggtcgtcggttcggtaactaccaagacgcggatggctgggtcttctcagcataccgccagggtgctattgtcgccctactccctgctggtgcccttcttggttcgctcgttgccggtagaattgcggatacccttggtcgccgtatcgccatctctgcgtccgcccttttctcctgcatcggaacaattatcgagatcgcctccaccacgcactgggcccagtttgcggtcggtcgtcttatcaccggtattggtatcggtgctctctccgtcgtcgtcccgatgtaccagtctgagtccgcgcccgccatcctccgtggtatcctcgtctcgtgctaccagctcttcatcactcttggtatctggaccgctgagatgatcaactacggtactcacgacctcagcaactccgcctcttggcgtattcccaacggtatctccttcctctgggctttggttctcggtggcggaatattgttccttcctgagtctccccgttatgcctaccgtgttggtcgcgaggacgaggctcgcaacaccattgcccgccttgccggtctcgagcccagcgcccgctctgtcaacatgcaaatcgatgagatccgtatgaagcttgaggaggagaaggctggtgccgacaccaagtggtacgagatcttcggacctgctctgttgcgccgcacccttatcggtatcattcttcagtctggccagcagcttactggtgccaacttcttcttctactacggaaccacgattttcaaggctactggtcttagcgactcttacgttacccagatcattcttggttccgtcaacgctggatgcactgttgctggtctctgggttgtcaagaatgttggccgccgtaaggccctcatcggtggtgccctctggatgaccatgtgcttcttggtctactctttcgtcggaagatttgtgctcgaccccgtcaacccggctagcactcctcaggccggcaacgtcctcattgtcttctcctgcttcttcatcgtcgcctttgccaccacttggggtcctctcgtctgggccgtcgttgctgagctctaccctgctcgctaccgtgctcctgccatggccttggccaccgcttccaactggctgtggaacttcctcatgtccctcttcacgcgccccatcaccgactccattggctacttctatggcttggtgttcgccggatgctgccttgccctcgccgctttcgtttggctctttgtgatcgagtccaaggaccgcacccttgaggagatcgagaccatgtacaaccagaaggtcagccctaggcactccacccactgg

SEQ ID NO: 27921 - DNA, 5317 bp, Neurospora crassa
atgaatatttcgcagcccgtgtcgtcctctctggacagcgtcgagttcaccttcctgaccgacaccgagatccgcgccgtctcggtccgcaagatcgagaatgagagcaccttcgacagcctgctgaaccccgtccccggcggtctctacgaccctgccttgggttcctggggcgactcactgtgagactccccgccccgtcgtctactttctctcaacgtgaaaggttggtggtttaggcagtggtgttgactgatgtgacccttttctgaacagctgcacaacatgtaaccttggccagtcgcaatgtcccggtcatcccggccacatcgagctccccgtgcccgtctatcaccccgtcttcatggaccaggcataccgtctgctgcgcgcgcaatgtgtttactgccaccggttccgccttcccaggagggaaatccaccgctactcctgcatgctccgtctgctgcagtgtggccttctcaaggaggcccagatgatcgactctttcggcgaaagcgagttcggctccgccatccgccaattccagctggccgacgtgcccgagatggaggatgacgaggctgaggaggagggaaacaacttgaacgacagcaccatccgccaacgggaagcatatgtccgcgctgtccttcgcgattataggactaaggtgactatgcgcgacatcaacaagggcaagcacgaaggcgccgccgatatgcgcagggctcttgtcaaggagttcctggctgccatcatcaaggacaagaagtgcaggacttgcgacggcatctctcccgtctaccgcaaggatcggtacaccaagattttcgagcgcgacctcacacaaaaggagaaggccgccatggcccaggctggaaggaagcgtgctgacgcgctggccatgaagggcggcaagaagaagaatcatgatgatgatgaggggatcgccgatattgagtcgacagccagcgaatccgacaacagtgaaggagagggagaagagctcgacgagaacggcgatgttgtcatggcggacgcgggcagcaagaccaaggcgaaggagaaggccgagaagagggcccttccccagagatacatcagctctctcgaggtcaaggagaggttgaacttcctcttccagaaggagcaagagattgtctctttgctctttagctccaagcctcgtcccaagcacgcgaagccgatgaccgccgacatgttcttcatccagacacttctcgtccctcccaacaaattcagacccgaggctagaatgggcgaccaagtaacggaagcgcagcaaaacagtctctacaagctaatcctcagggggtcgtctatggtcgcccagatctctcgcgaggtttccgaaaccgccaagggtaatgcccccgaggacggacgcagggccagggatatcaatgcgctctaccaggcgtggacacagcttcaagacgccgtcaactccttgatcgatcgcgataagaaccccgtccagggtgctgctggaaagcgcaacgaggacggtatcaagcagaagctcgagaagaaggagggtcttttccgcaagaacatgatgggtaagcgtgtcaactttgccgccagatccgtcatctctcccgatcccaacatcgagaccagcgagatcggtgtccctcctgtgttcgccaggaagctcacataccccgagcccgtaacgagccacaactaccatgatctcaagaatgcagtgcagaacggtatggagaagtggcccggtgcttccgccattgagatggagaacggccaaatcatcaacttgaggaacaagtcttcggaggagcgtcaggcccttgccaaccagctcttggccccgaccaacaacaacttcagcggagttcgtaacaagaaggtccaccgccatcttaccaacggtgatgtcgtcctcatgaaccgtcagcccaccctccataagccctccatcatgggtcacagagtcagagtgctgccgggcgagaagacgattcgcatgcactacgccaactgcaatacctacaacgccgatttcgatggtgatgagatgaacatgcatttcccccaaaacgagattgcccgtgccgaggcccttcagctcgccgacactgatcaccaatacatctccggcaccgctggcaagcctctccgcggtctcattcaggatcatttgtccgtttccgttattctgtgtaacaaggacaccttcttcgatcgggccaactaccatcaactcatctacgccgctcttcggcccgaaagtggtcacattatgggagacaagattgagcttttgccgccggcgatcatcaagccggttccccgctggacgggtaagcaagtcattaccacaatcctcaagaacatcaagcccccaaattgcggtgatttgtggatgaacggctctacacaagtcaaggctcatcagtggggtgaccatgccccagaagaaggccaggtcactttccgtgatggagagttcatcaccggtatcctcgacaagtctcagctgggtcccagcagtggtggtttgattcactcgattcacgaagtttacggcccttcagctgctggtaagctcctcagttgcatgggtcgtctcctcactcgttacctggccatggttgccttttcgtgcggtatggacgatctagtcatgacgcccaagggagaggcagacagaaaggagaagatcaaggccgccgctcacatcggtctcgaggtcgccgccaagtatgtgtcgctcgaggagcagaagcctactcccgaagatccccttctcttgcaacgcttggaggaagttatgcgcaacgacaagaagcaagagaacttggatctcttgatgaaccaacgctgcgcccaactttctagcgagatcaccaagacatgtcttcctgctggtctgcaaaagaagttccccaagaaccaaatgcaaagtatgacaacatcaggtgctaagggttctcctgtcaacgccaacctcatctcttgtaacttgggtcagcaggttttggaaggtagacgtgtccccgtcatggtcagcggcaagactctccctagtttcaagcccttcgataccaacgccagagctggtggttacatcgtccagcgtttcttgactggtattcgcccccaggagtactacttccatcacatggccggccgtgagggtcttatcgacacagccgtcaagacatcgcgttccggttaccttcagagatgtttgatcaagggcatggaaggtctcaaggtcgcttacgacacctcggtcagagactcggatggctccatcattcagttcctctttggtgaggatggtatcgatatctccaagcaaaaatacttgaacgacttcgagttcgtcctccgcaacctgaaatccgagttggcgcatctccactactcggaagagggtactcaggccctcttcgagcacaaggacgagatgatcaagcggatgaaggctgccatcaagtcgagggatacccgcaacccgctcaacccgatcgagtcggatgttgaccctgccttgtatgctttcgctacttcggagaacttcttcgagaagatgaccaagtacgtcaaggagaataaggatggcttaatcaaggagaagaagggcgactcctctggcatcattgttcgcaagaatgccgagaagattttggcggccaagtacatcaggtcattggtggagcctggtgaggctgttggtatcgtggccggtcagtccgtcggtgagccctcgacacagatgacactgaacactttccatttggctggtcactctgccaagaacgtcacactgggtatcccccgtctgcgtgaaattctcatgacagcttcttccaagatctcgactcctgccatgaccctctaccccaacgctgagctctctgatacagactgcgagcggtttgccaagtccatcagcattcttcccctggccgatgtcaccaaggaagttaccgtcagggagaagatgggccgtggcttgggctaccctcttgccaagctcttcgagatcaggttgcgcttcttcccatctgaggagtactgcaagacatacgcgattgagattgcggatgttcttgcgactgttgagaggaagttcgtgcccctgcttggtcagctcaccaagaaggaaatcaagaagaagtacaaggagaactctgctgccactcccgagatcggtgtcaaggttggcactgtggagatggcggcgcccgacggcgagcgtgctgtcggcgaggacggcgacgcggacgacgatgacgacggtgatgatgacgccaccaacgccaagagcagagccaatagacacgaggcagtgtcctacggccccaacgacgacgatgatgatgccatccagaagtctctacagcgcgcggatgacggtgaggaggagggcgaggagagacttgagttcgacgatgaaggctacggcggtagccctgagcccgaggaccgcaacgccgatggcgatatgtccgtgtacaagtctcgatcacgcgagacccgtatcaaggataagaacgacttcgttgcccgcttccactgcgatgagcaaggcggcgagtggtgcgagatgatcctcgagtttgatcccgcgacacccaagattctcatgctcaacctcgtcaccgaggctgtcaagaaggcgctcatccagcaaattcccagactcggcaccgcgacattcgttgtggagaacaaggagcgtcttgtccacaccgaaggctccaacatcaaggccatgcagcagtatgccgactacatcaaccccaacaagatcatgaccaacgatattgcccaagtgctcgagatctatggtgttgaggccgccaggaacagcatcgttcgcgaattgagcggtgtcttcaagggtcacggtatcggtgtcgacccccgccatctgaacctcattggcgactacatgaccaggtaagatttcatttcccagcactacgtaaacaagcatcaagttattgactagtaatttttacagaaacggtggcttcactcctttcaaccgtatgggtttgaccggcaacgtcagccccttcaccaagatgagttacggtacgttgtcatccatcagccgttcattacctttcctgtagcccgagctcattgctaacatgtcacaacagaaactaccgtcggcttcctcaaggacgccgttctcgacggcgattgggacagccttgacaccccatcaggcagactggttgtcggtaagctgggtgttaccggtaccggctcgttcgacgttttcaccaaggtgcctactgagcac

SEQ ID NO: 27922 - DNA, 1500 bp, Neurospora crassa
ctcgtcggcggcgtcgccgtactgttgtcgtacttgctcctcaccatctcaccacctcatgatccgtccgaaccacccctcatcaagcccaggttcccagtaattggccacctctttggtctgttgaaccaccaagtcaactacttcagcgagctgttcgcgcggtaccatttgcccatcgcaactctccccatcggtaatcagaaactctacgttatcttcgatgcgcctctacaacaggccgctctgaaggccaaggacatggacgcgcagtctttcatggtggacttcgtcccgcgcatctttggcgtcaaacaaggcacggtcgacaagctcctcggaaaggatggcgtgcacccaaacatcatgggcgacatggaacaggttttcaagtccgcgctctcgggagacaaccttcagaagttggccagcaccactcttgcgaccatggccgataccttgaatgatgtggattccaagaaaggtaccaagattcccaacatgtttctctggcttcagtcacttcttagcagatccacatcaaaagcattgtggggagagaagcacaacccgttcaaggaccaccaagtcattgacgcccagtggtacgttaccttccccttaccttctcttagccaaagctaaccaccaccaaaacatcacagggacttcgaatcccacctcggccccttggtcctcggggtcctcccatccatcgtcgcccgccgcgcctatctcgcccgcaacaaagtccaatctgcgcttctttcctacttcagcgcgcgccattacgagactgacccgtccacctcctacttcatccgcgctcgcactcgtttgctaaagagatacgatcttcccgatgacgaactagccaagaatgaagtagccatcacccttgtcgccactaccaacgttctatccactctcttctggtgcatcgccgaaatctggacgcgccctgatctcttacaacaaattcgcgccgaagctttgctggccgtctttggcaacagtcaaaaagctctttcgggtgaggacatgggaacaagaacaatcaccatccccgccacgggcctcgacgccaagtgccccctccttgcctcctgcttccgggaatccatccggcttgcctcgcagatcgttaccgcccgacgcgtgctcaaggatacgttgctcaccgaccccgtctcgggaaattcctatctgctgaaggctgacaccaatgtcatgatgcctgccaaggtagtccaccggaacacctccgtctggggcgccgatgctgaggggttcaacccccgtcgattcatgtgggaggagctgggtccgaaggtggagaggcagaggaaggcggcctttgtcccctttggtggtggaaagcacatgtgcccgggaagacactttgcgtttaccgagaatttggcgctgatggcggcgttggcgattgggtttgaaattgagggattggatagaagtaagttgaagatgggcgactccaag

SEQ ID NO: 27923 - DNA, 1687 bp, Neurospora crassa
gccgccccgactgtcaccatttccaccggtacgattgtgggtgctaacggcatcctcactgaggccttcaacggaatcccctacgcccttcctccgaccggcaaccttcgcctcaagcctcccgtgagacttaagtcgtctctgggtgtctttgatgcgtctggcatcggccctgcttgcccccagttccttgctgacacctcgtcgaacgagtttctgcctcaggttatcgataagatcgttaacacgcagcttttcaagactatactcaacgtcaaggaggactgcttgaccatctcggtcactcgtcccaagggcaccaaggctggtgataagctccccgtccttttctggatctttggtggtggtttcgaagtgagaaatccagcttatatacgcgatgtaatgaacaagtgctaaaacttcacagctcggatcggcgtccatgtacgatggcgctcccctagtcaccaacgctatcaacatgggtaagccgtacgtctacgttgccgtcaactaccgtgtcggtggctttggtttcatgcccggaaaggagatccttaaggacggctcttccaacttgggtcaccttgaccagcgcatgggcctccagtgggttgccgacaacattgctgccttcggcggtgacccagacaaggtcactatctggggcgagtccgccggtgccatgtccgttttcaaccagatgtctctctatgacggtgacaacacgtacaacggcaagccccttttccgtggcgccatcatgaactctggttccatcgtccccgccggccccgtcgactgccccaagggccagaaagtctacgacaccgtcgtcaagaacgccggctgctctggtgctgctgacacccttgcttgcctgcgcgctcttccctacgagacttttctcaaggccgctaactccgtgcctgggattctgtcgtacaactccgttgctctttcttacctcccgcgacccgatggcaaggctttgactcagagcgccgataagctcatgctcgctaagaagtacgccgccgtccccatgatcatcggcgatcaagaggatgagggcactctcttctccctcttccagagcaacatcaccaccaccagcaagctggtcagctacctcaacgatatcttcttcaacgacgccaccgagtcgcagattaagtctctcgtctcgacctacagtacccttatctccgccggctcgccctttggcaccggcctcttcaacgagatttaccccggcttcaagcgcctggccgccattcttggcgatctcatcttcaccctcagccgccgcatctttctcgacgccgccaccactctcaacccctcggtgcccgcctggtcgtatcttgcgtcttacaactttggcacacccatccttggaacctttcacgcctccgatatcctgcaggtgttctacggcatcctgcccaactacgccagcaaaagcatccagtcttactacgccaactttgtttacaaccttgaccccaacgacgcctccggtggcacttcctctaagagcaaggtcagccaggattggccgcaatggcagaaggagagaaagctggtccagttcttttcggactatgccggatatcttgcggatgatttccgctctgattcgtataactggattaaggctaatcttgatgctcttcacatc

SEQ ID NO: 27924 - DNA, 672 bp, Neurospora crassa
gttgctcaggtgccccgcaacttcaagcttctcgccgagctcgagaagggcgagaagggaatgggcgcaggtgcgtcttcttttccatgttggcgatgcgctatgaatgctggacagacgatactgatgatctgcttcgtccgatatacaggtgcctgctcctacggcctcgaagaccccgaggacatcctcatgacccactggactggtaccatctggggccccccgcacgtacgattacccccttcgtcttagtcgccgtcatcgcccctcgctcccagctaaccttggtctgaatagggcaaccacgagaaccgcatctacgaactcaagatggagtgcggcgccaactaccccaaagagcctcccgtcatccactttgtgagccagatcaaccttcccggtgtcagccaaaccgacggccgcgtcgaccccaactacgtcggcatcctgcgcgactggactcgcatctccgccgagctatcgagaaacccccgcccgaaagaggatcccttgagcctcgaggctgctcttatcgccatcagaaagtacgtctaaccggagaacaaagcaatacgcacagaggaaaacagaaaggcgctaacaatgcgacactgcaggtacatggaagagcacaagaagctcccgcagcctcccgagggctccaagtac

SEQ ID NO: 27925 - DNA, 1449 bp, Neurospora crassa
atgcccatctccaagatccacgctcgctacgtctacgactctcgtggcaacccgaccgttgaggttgacgttgttactgagctcggccttcaccgcgccattgtcccctccggtgcctccactggtacgtcagaccgacgctctctcatccactcttcgatagaaatgtacattatgctaacaataaccttctacaggccagcacgaggcttgcgagctccgcgatggtgacaagaccaagtggggtggcaagggtgttctcaaggccgtccagaacgtgaacgaggtcatcggccccgctctcatcaaggagaacattgacgtcaaggaccagtccaaggttgacaagttcctcatcgacctcgatggcacccccaacaagaccaagctcggcgccaacgccatcctcggtgtctcgctcgccgttgccaaggccggtgctgctgagaagggcgttcccctttacgctcacatctccgaccttgctggcaccaagaagccctatgtccttcccgttcccttcatgaacgtcctcaacggcgggtatgtttgaatgccctatcctttgtctgcaaagcagtcaactaacgatgtggcagttcccacgctggtggccgtctcgccttccaggagttcatgatcgtcccctccgccgctcctaccttctctgaggcccttcgtcagggtgctgaggtgtaccagatcctcaagagcctcgccaagaagaagtacggccagtccgctggtaacgtcggtgacgagggtggtgtcgctcccgatatccaaaaccccgaggaggccctcgaccttatcaccgaggccattgagaaggccggctacactggccaggtcaagatcgccatggatgtcgcttccagcgagttctacaaggaggacgtcaagaagtacgacctcgacttcaagaaccccgagtccgacccctccaagtggctcacctacgaggagctcgccaacctctactccgagctctgcaagaagtaccccatcgtctccatcgaggaccccttcgctgaggatgactgggaggcctggagctacttctacaagacccaggacatccagatcgttgctgatgacttgaccgtcaccaaccccctccgcatcaagaaggccattgagctcaaggccgccaacgccctcctcctcaaggtcaaccagatcggtacccttaccgagtccatccaagctgccaaggactcctacgccgatggctggggtgtcatggtctctcaccgctctggtgagactgaggatgtcaccattgccgacattgtcgttggtatccgctctggccagatcaagactggtgctcctgcccgttccgagcgtcttgccaagctcaaccagatcctccgcatcgaggaggagcttgccgacaacgccatctttgccggcgagaagttccgcaaggctgttgagctctaagtg

SEQ ID NO: 27926 - DNA, 4076 bp, Neurospora crassa
atgacaccccaagatgactccgtcaactttgatatcattgaatctcacaaggagaacatccaagccctccccagcggtcgctccgcccgcaaactcgcagaactcttctctccttcacatggcgccagcagttcgaggcaagcgctcgcaccacaactaacaccgaccccgaaccctaccgaagtcaagtccgtcaacgatgccatccgcgccgaatacgaagccgagctagccgccttcaatcccgaagagcaagatgatcccctcgacatctacgaccgctacgtccgctggactctcgacgcctacccgtccgcctcagccacaccgcagtcgcagctgcatctgctgctcgagcgcgccacccgcgccttcgtcggcagcgcccagtaccgtaacgatgcgcgctacttgaggatgtggctgcactacattcgcatgttcagcgatgcgccccgcgaggcattcgtcttcctctcgagacaccagatcggcgaacagctggcgctgtactacgaggagtttgcggcgtacctagagggtgaagggcgctgggcgcaggccgaggaggtttacaagatgggtattgagaaggaggctaggccggtgtcgaggctggtgaggaagtttggcgagtttgagcaacgacgggcggcacttcctgagggtgctgaggatcagagcaatagcgtccctgtcctgccggtggtcagaaaagcgctgggcgtcaagtcagatccgttcttggcggcgggcgtggagaggttgcctcgggatccgcaagcgccgagaccgaatatgggcgttggaggagcagctgcgggaccgtcgaagccgaagagtaagctggcaatcttttcggatgcagatgcggcagcccagcaaccggccctgggctctctaagtgctggttcgaagggatgggatagtattgggagcttggccgatcggaagaaggagaataccgtggaaccgaagccgtgggccggcgaggtactcaaagctggcggaaagaaacctgtacagaagatgcaggtattcagggatacggtaagttttaaaaccccccatcactcctttcctctccttaaaccgatgttgatcaagaataggactaattgtttacgatgggtggtgcgctcggcgttctggcgcactcgtttttgtatgttattgtacagatcaagaagactacgaatcctatgatgatgaacaagcaacaactttctcaatcacatattccaatacaccattctcagtcccaggtgacggtgaacccggtatccggtaagcgggagagggtatttgtggacctcagagtgatctaccctacgcctgacgagcccggtaccgagttgagtttcgaagagatatgggctgctcgaagaggttggctggatgtggtctgggaggacgagagaaagaaacgaccactagatgcgatgttgactccaaagagggacgaaaatatggaagacctgacgttggagatggcgtcgacaaaaattgtggcttaccatgatgttttgaaactggacgaaaacgggaagcccatctaccctgaacacaaggctggcaggagcgccaagaagaacaaggtgattgaggtgaacgagacacagatcagtatgcacttacgtcccacgccgacgcgacgtaaaacttgctaacggacaaccatagtcaaagccaagctggactctccttctgggccaaagatgaagaagagaggctcgtcatcagaaccaaccatgacgctgcacacgaaagcagcaacagatgacatctacgacatcttcaacgctccgcttaaacctacagcaaaccccagtttaagcgacgacgagaatcgctatgattcggatgactatacttgcggtgtggacgacacctcgaagaaccttgccaccagtgaggcaggagatgagaccacagttgtagaggcaatcgaggaaacggatgttgcagacgaggatgacgacgtcaagagcgagtggtccgacttcacagcgcgaaaacacattcctgattaccaaggtggtggggacgaagaccatgaaatgacggatgttttggacgaagaactcaacggccagcctgaaacctcccattcacagtttaatcacaacaaggttccagacgaaaacccaacgcagggtgagcgtcccttgactcacaaccccccacccgcacccgaagaagttcctcctaccacgaggaatatcttcgtaccagtccctcccgcagactacgtcccgacaagaaggccgtatcgagatccggtagaagtggctaataaccgcctgcccttcatgacgcctatcacagaaagaacggagttttcgtcgctcgacgtcacgtatcaccacccaaacatgcatcaccctgttctcaccaagaccccgtctaaggcaccgggcctgcatcacgacatgagggatgacatgtccgtggatggtgaggaggaggacggccaattttctgaaaatgaagatgaagatatgctcgagccggagagcagtccgctgcgtgagatccctgaggaagacgaggaagaagaggagcagcaagagaagttctcgccgattccagtcttgtatggccagttgggccagaatcagcccgcggccagatcccctctcgccgtgaagtcagttaccacatcacctttggcacacagagcggtttctcctctcgcgcccaggcttccagggcctatcatcaaagaactgcagtgcaaccccgtcgacgagctcgtccgcaagaagatcctcgctaacgttcatcctcccctcacctcgtacgagggcttctacgaccaccgccacgagaagatccgcaagggcgccgaaatccgcaagtttgctcaagcccagtccgcggctagtaagcgcgggaggaagagcacctctgccgacaagcgcgattccctcaacgagccgcatcctatcatgttgcagctccccggcaatcccagcaccaagtacaccatcaaaaaggaactcggcgccggtgcctatgcccctgtctacctggtcgagaattccaagcctaccaagactgcctcccgaactggttatggttatgggcaacaagagaacgagaacaacaaccttcccgcccacctaatccgtcacccccgcgaagccctcaagatggaacaacccccgacggcttgggaattctacatgatgcgcctcgcgcatacccgcctcctcgccgccaacacctccttacaccaccgcgccctcgcttccctcagcccggccctcgagctacacctctaccaagacgaaggcttcctctttctcccctttttccagcacggcactctgctcgacgtgatcaacctcttccgctcagagtcttcaggtgtaatggacgagcagctagccatgttcttcaccgtcgaactcttgcgggccatcgaggccttgcactcggtgggcatcatgcacggcgacgtcaaagtcgacaattgtctccttcgcctccctacgacgacggatatcttgccgactaaccagtaccacgccgacggatccggcgggtgggctgcgcgcggattgacgctcattgatttcgggaggggtattgactttaggcagttcagacaagaagtccagttcgtggcggactggaagcctaccgcgcaggactgtgccgagatgagggaggggcggccgtggacgtggcagattgattaccatggtcttgccggggttgtgcacgcgttgttgtttgggaaatacattgatacggtgccttgcggaacttcccactccaggtcgttcggtggcccaggtgggaatgatcagaagaggtataagatcagggagaacctaaagcggtattggcaaacggatatttggggccattgttttgatttgttgctgaaccccgggagctatgtggatgaggaggaaggggggaatatgcctgtcctaaaggggctgaggacggttcgggagaggatggagggctggttggaggcgaattgtgagaggggcgtgggtttgagggggtggatgggaaaggttgaggcttggtctaggggaaggaggtgaagagttacg

SEQ ID NO: 27927 - DNA, 863 bp, Neurospora crassa
atagaatatgccttcaaggccatcacagctgccaacatcatgtcgctcggcgtcagggggaaggactgcgccgtagttctgtcccagaagaaggttcccgtatgttgtcctggatgatgggaggcttccaccggtcgtgtgatatgctgacggttgtgcgacaacaggataagctcatcgacccctcctccgtctcccacatcttccagatctcgccctcggttggctgcgtcatcaccggatccatcgccgatgcgcgcgccttcgcacaacgcgcccaaggagaggctgccgagttccgatacaagtttggctacgagatgccatgcgacgccttggcgaagcgcatcgccaacatcagccaggtctacactcagcgcgtaagctaccttcagctgcccccgcgacgggctacgagtctctgaaaagaggaagaggatgatatactaaccagagactcttctttccaactgcaggccttcatgcgcccatatggcgtcgccgtcaccctcatatcggtcgattcggagtttggcccccagctgttcaagtgcgatccggcaggctactacacaggctacaagggcaccgcggcgggtcccaagcagcaggaggccctcaaccacctggagaagaagctcaagaacaaggatcacgcgcccggtgattggaaggaggtggtggagttggccatcaccacgctcagcacggtgctaagcatggacttcaagaagaccgagatcgagattggtatcgtcggtggacccaggccggacggaaaggagggcacatatcccggcttcaggacgttgactgaagatgagattgacgagaggctacaagctattgccgaaaaggactaa

SEQ ID NO: 27928 - DNA, 1508 bp, Neurospora crassa
actgctcgttacttctccagctcctccgccatggccaagaacaccagaatcgagaccgacgcctttggcgagattgaggtcgaggatgacaagtactggggcgcccagacccagcgctctctgagcaacttcaagatcaaccagccccaggaccgcatgccccctcccatcatcaaggctttcggtatcctcaagggcgctgccgccaaggttaacacgcgctacggccttggtacgtgaatcccctcttcttgggagctctggaagagctatgcgcgcagaagctgacatttgggcgaattacagaccccaagattgccgaggccatccagcaggccgccaaggaggtcgccgacctcaagctcctcgaccacttccccctcgtcgtctggcagaccggctccggcacccagtccaacatgaacgccaacgaggtcatctccaaccgtgccattgagatcctcggcggcgtcaagggctccaagaagcctgtgcaccccaacgaccacgtcaaccgctccgcctcgtccaacgacaccttccctaccgtcatgcacatcgccgccgtcctcgaggtcgagggtgagctcctgcccgcgctcaagtccctccgcgacgccctccaggccaaggtggacgagttcgaggccaagaagatcatcaagatcggccgcacccacttgcaggacgccacccccttgactctcgcccaggagttctctggctacgttgcccagctcgacttcggcatcaagcgcgtcgaggagtccctccccgacctccgcctgctcgcccagggcggcaccgccgtcggcaccggcatcaacacgtacattggcttcgccgaggccattgccgaggaagtcaccaagatgaccggcaccgagttcaagacggcccccaacaagtttgaggctctcgccgcgcacgacgccctcgtccacgctcacggcgccctcaacaccctggctgcctctttgaccaagatcgcccaggacatccgctacctcggctccggcccgcgctgcggcctcggcgagctcaacctgcccgagaacgagcccggctcgtccatcatgccgggcaaggtcaaccccacccagtgcgaggccttgaccatggtctgcgcgcaggtgatgggcaaccacgtggccaccaccattggcggcatgaacggccagttcgagctgaacgtgtacaagcctctgatcatccgcaacttcttgcactctgtccgcctgttggccgatggcatgcgctccttcgagaagaacttggtccacggcttgacggccaacgaggagaggattgccaagatcatgaaggagagtctgatgctggttacttgcttgaaccccaagattggctacgacatggcgtccaaggtggccaagaacgcgcacaagaagggcttgacgctcaagcagtcggcgctcgagctgggtgcgttgacggaggaggagtttgatgccttggtgaagcccgagttgatgattggtcctcagcct

SEQ ID NO: 27929 - DNA, 1355 bp, Neurospora crassa
gaggtgatcaccaccatctctcccaccacgggggaacccatcatcactcgcaatggcatttcagaggaggaactcgtccaactgcccgagactgccttcaaggccttccaaggatggcgcactaccaagttggaggacagacagatcatcgtcaagaaggccttgaagttgctggccgagaagcaggatgaacttgcagaggaactcaccgtccagatgggccgccccattgcttatactgccaaggaggttgccactgccatcaagcgctcagagtatctgctcaagatcagcaacgatgctctgaaggacaccgatggcgaggaggagaagggattcaagaggttcatccgaaaggtgcctgttggtcctgttctcatcatctttgcttggaacgtaagtggtgtccatcatgttgttttgacactccatccgtcacctctaactttgcgcagtacccctatcttattctcgtcaacgccttgattcccgctttattgtctggaaattcggtcattctcaagccctcgcctcagacacccacaattgtcgagcaggtggccaaggtgttttccgaggctgggttgcccgacggagtcatccagtacttccactcgggttcgccgacagtgattgaaacaattgtgcgaaaccccaagattgccaacatttgctttaccggctcggttgctggtggcctggccgtccagaaggccgcgtccgatcgcatcgtcaacgtcggcctcgagctgggtggcaaggatcctgcatatgttcgcggtgatgtcgatattgcctgggctgccgaagagattgtcgacggcgcagttttcaactcgggtcaaagctgctgctcgattgagcgagtgtacgttgacgagaagattcacgacgagtttattgcggccgtccagaacgttcttaagggatacaagcttggagatccgttggataaagggacgcatctcggcccagtcatctcggcgcgctccaaggagaccatccaggcacacatcaaggacgcgctcgacaagggcgccaagaatgcgacacccgagaatgagacattcagcattctgccagacaaaggtaactttgtcgcaccgacattgctgaccggcgtggatcacaccatgaccgttatgaaggacgagacttttggtcccgtcattccagtcatgaaggtcaagagcgatgccgaggcaattcagttgatgaacgacagcgaatttggcctcactgccagtatttggaccaaggacacggccaagggatacgaactcgccgaggaagtagaggcagggacagttttcgtgaaccgttgcgattttcccagccctgtaagtacttttgtg

SEQ ID NO: 27930 - DNA, 732 bp, Burkholderia fungorum
gacatcttcgtcgttgctgcagcacgtaccgcaattggcacctttggcggctcactgaaggacgtgccgcttgcgcaactcgcgatccttgccgttcgcggcacgctcgagcgcagcggcatcgccccgtcacacgtggatcacatcgtgctcggcaacgtaattccgacggaaccgcgcgacgcctatctgtcgagaatcgccgccctggaagccggtattccagcgcaaacgcccgcgttaaatgtcaaccgcctgtgcgggtcggggttgcaggcgatcatcctggcagcacagtctctccttctcggcgacgcacaggttgcaattggtgctggagccgaatcaatgagccggggcccctatctgctgccggccctgcgatggggagccagaacgggtgacgtgcaggccgcagactatatgcttggtatcctgcatgacccgttgcaccgtattcacatgggcgttaccgccgagaacgtggccgagcgggaagccattacccgcgagatgcaggacgtactggctgtggaaagccagcgtcgcgctgcgcacgcaatcgctgaaggttacttccggtcgcagatcatcccggtggaaataccttcgcgcaaaggcatcgtgatattcgacaacgatgagcacgtgcgccctgagaacacattcgaagcaactgtcgaagattaaaccaagcctttaagcatgaagggacgggccctggttggcaat

SEQ ID NO: 27931 - DNA, 1534 bp, Burkholderia fungorum
aaggaagctgagaaagcgcccgctcaggcagaagccaagccgcaggcagccgaggctccggctgccgctccggccaaggcggcggcgcccgcgccgcaagccggcagctattcgggcagcgcggatatcgagtgcgacatgctcgtgctcggatccggccccggcggctactcggcagcgttccgctcggccgacctcggcatgaagacggtgctggtcgagcgttattcgacgctcggcggcgtgtgtctgaatgtcggctgtattccgtcgaaagcgctgttgcatacggctctcgtgatcgacgaagccgaagcgctcggcgcacacggcattacgttcgccaagccgcaaatcgatctcgacaagctgcgtgatttcaagtcgggcgtcgtcaggaagctgaccggcggtctcgccggcatggcgaagatgcgcaaggtcgaagtggtgacgggtaacggcgcgtttgtcgatccgtatcacatggaagtgcagaccgaaggcggcaagaaagtcgtcaagttcaagcaggcgatcatcgccgccggctcggaagcggtgaagctgccgttcattccggaagatccgcgcgtggtcgattcgaccggtgcgctcgaactgcggcagattccgcaacgcatgctggtgatcggcggcggcatcatcggtctggaaatggccacggtgtatgccacgctcggcgcgaagatcgacgtggtcgaaatgctcgacggcctgatggccggcgcggaccgcgatctggtcaaggtctgggagaagtacaacagcaagcgtttcgcaaacgtcatgctgaagaccaaaaccaccgcagccgaagcgaaagacgacggcatccatgtctcgttcgaaggcgaaaaagccccggccgaagcgcaacgctacgacctcgtgctggtggcagtcggccgtacgccgaatggcaagaaaatcggcgcggacaaggccggcgtcgcggtgacggatcgcggctttatcgacgtcgacaagcagatgcgtaccaacgtgccgcacatcttcgcgatcggcgatatcgtcggtcagccgatgctcgcgcataaagcggtgcacgaaggccacgttgccgccgaagccgcgcatggtgagaaggcgtacttcgacgcgctgcagattccgtcggtggcttacaccgatccggaagtggcgtgggccggcaagaccgaagaccagttgaaggcggcgggcatcaagtacggcaaggcggtgttcccgtgggccgcttcgggccgcgcgattgccaacggtcgcgacgaaggcttcacgaagctgttgttcgacgaggaaacgcatcgcgtgatcggcggcgggatcgtcggcctgaatgcgggcgacctgatcagcgaagtgtgtctcgcagtcgagatgggtgcggacgcaacggatatcggtaagacgattcatccgcatccgacgctcggtgaatcgatcggcatggccgcccgagttgtatgaaagcgtgtgcaccgacttgccgccgcagaaaaagaagtag

SEQ ID NO: 27932 - DNA, 1371 bp, Burkholderia fungorum
tctgttcgcacccgtttcgcaccgagtcccaccggcttcatccacctcggcaacattcgctccgcgctttatccgtgggcgttcgcgcgcaagatgaaagggaccttcgtgctgcggatcgaggacaccgacgtcgagcgctccacgagcgaatccgtcgacgccattctcgaaggcatggcgtggctcggcctcgatttcgacgaaggtccgttctaccagatgcagcgcatggaccgctaccgcgaagtgctcaagcagatgcaggacgaggggctggtgtacctgtgctacatgtcgacggaagaactggacgcgttgcgcgaacgccagcgcgaagccggcgaaaagccgcgctacgacggcacgtggcgcccggagccgggcaaggtgctgccggaaccgcctgcgggcgtacagccggtgctgcgcttccgcaacccgctcaacggcgtggtggcatgggacgacgccgtaaagggccgcatcgagatttcgaacgaggaactcgacgacctcgtgatcgcgcgcccggacggcacgccgacctacaacttctgcgtggtggtcgacgatctggacatgcgtatcacgcacgtgattcgcggcgacgatcacgtcaacaacacgccgcgccagatcaacattctgcgcgcgctcggcggcgagccgcccgtctatgcgcacctgcccaccgtgctgaacgaacagggcgagaagatgagcaagcgtcacggcgcaatgagcgtgatgggttatcgcgacgccggttacctgccggaggcggtggtcaactatctggcgcgtctgggctggtcgcatggcgacgcggaaatcttctctcgtgaacagttcgtcgagtggttcgatctggagcatctgggcaagtccccggcccaatatgaccacgacaagctgaactggctgaatgcgcactacatcaaggaagccggcaacgtgcgcctcgcggagttggcgcggcccttcttcgctgggctcggtatcgacgaagccatgcttgcccagggcgccgatctgaccgccgtggtgggcttgctgaaggatcgcgcgtcgacggtaaaggaaatcgcagagaatgccgcgatgttctatcgcgcgccggcgccggacgccgagtcgctcacgcagcatgtgaccgacgcggtgcggccggcgctcgccgatctggcggccgcgctcaaggcagtggagtggaccagggaagccatcgcggccgcgttgaaggcaacgctcggcgcgcacaagctgaagatgccgcagcttgcgatgccggtgcgtctgctggtggcgggcaccacgcacacgccgtcgatcgacagcgtgctgatgctgttcgggcgcgatgtggtg

SEQ ID NO: 27933 - DNA, 1183 bp, Burkholderia fungorum
atgcaaaccgattcaagcttcaccttcgttctcttcggcggcaccggcgatctgtcgatgcgcaagatcctgccggcactgtttgaagcacatcgcgcaggcggcatgctggccgacagcggcaagatcgtcgcggtggcccggcacgcggcggatcgcagcgagtatttgcagcgggtgaacgagcacgtcaaaccgcatgtgtcgaagaacggtgtggacgaagcggcatgggcgagctttctgaagcgcatcgagttcgtgaagatcgacctcggcaacccggacgacttcgcccttctgcgcgacgccattcaggacctgcccggcatccgcgtgttctatctggccaccggcccgtcgctgttcgtgccgatctgccacgcgctcgcctcggtgggattgaatgcgaacgcccgcatcgtgctggaaaagccgctcggctacgacctcaagtcgtccaacgcaattaatgatgcggtcggcgaaatcttcgccgaagagcagatctaccgcatcgaccactacctcggcaaagaaccggtgcagaacctgctggcgctgcgcttcggcaatgcgctgttcgagccgctgtggcgccgcgagtgggtcgaaagcattcagatcacgatcgccgaagaactcggcgtggaagcgcgcggcgacttctacgacaataccggcgcgctgcgcgacatggtgcagaaccatttgctgcagttgctttccatcgtcgcgatggagccgccgcattccatggattcggattcggtgcgtgacgaaaagctgcgcgtgctgcgtgcgctcaagcctgtcgattcgcgcgatatcggcaaggtggccgtgcgcggccagtatcattcgggagtgattcgcggcacttccgtgccggcgtatgcaacggagcctggcgtcaggccagacagcacgaccgagactttcgtcttgctgaaggtcgagatcgaaaactggcgctgggccggacgtgccgtatatcctgcgcaccggaaagacggctggccgatcacgtacgaccgagatcgtggtgaacttaacgcagccgtgaccgcataacggcgctgggacgcctcacagacagcgcgccggcgcgaatcaactgatgaaaacgctagaaacgaaggagaaacgaagagtaaaatgaatggagaaacaaggcggagaa

SEQ ID NO: 27934 - DNA, 951 bp, Burkholderia fungorum
atgagcagccatgacggcctgatggtttttactggcaacgcaaatcccgcgcttgcacaggaagtcgtcaaaatcctcggtattcccctcggcaaagcaatggtcagccgtttctcggacggtgaaatccaggtcgagattcaggaaaacgtgcgtggcaaggatgtcttcgtcctgcagtccacgtgcgcaccggcgaacgacaatctgatggaactgatgatcatggtcgatgcgctcaagcgcgcatccgcaggccggatcaccgcagccatcccctacttcggttatgcccgtcaagatcgccgcccgcgttccgcgcgcgtcgccatctcggcgaagatcgtggcgaacatgctggaaatcgccggcgtcgagcggatcattacgatggatctgcacgccgaccagattcaaggcttcttcgacattccggtcgacaacatctacgctacgcccgtgctgctcggcgatctgcgcaagcagaactacgagaatctgctggtcgtttcgccggacgtcggcggcgtggtgcgtgcccgtgcattggccaaacagctcaattgcgatctcgcgatcatcgacaaacgccgcccgaaggcgaacgttgccgaagtgatgaacatcatcggtgaagtcgaaggtcgtacctgcgtgatcatggacgacatggtcgatactgccggcacgctctgcaaggcagctcaggttctgaaggaacgcggcgcgaaacaggtgttcgcttatgccactcacccggttctgtcgggcggcgcgggcgagcgtatcgctgcctccgcactcgacgaactcgttgtcacggacacgatcccgctcggcgaagaagcccgctcgtgcgcgaagatccgctcgttgaccagcgctggcctgctggccgaaacgttctcgcggattcgccgcggcgattcggtgatgtcgctgttcgctgaa

SEQ ID NO: 27935 - DNA, 934 bp, Burkholderia fungorum
ctccactaccagaacggcttcgctaacgagcatgaatcagaggcaagtccgggtacactccccgtgggccgaaactcgccgcagagaccggcgcacggactctataccgaacagctgagcggtacttcattcaccgcgggtcggtcggaattccgccgctcatggttgtacaggatccggccgagtgccgctcatgcggatttcgtaccggtcgacaacgcacgttatttcgaagccggctcagcgtcctttgttccgagccggtttcgctggatgccgctgccgctacccacaggttccacgaacttcatcgaaggtctgcacacgatggcgattgccggcagccccgaatcgcgtgaaggcgccgcgtatcatgtctatgcagccgccagttcgatggacttcgctttctcgaatcatgatgcggaaatgcttgtgtttccccagtcgggcacactccgggcaattaccgaattcggcgttctggaaattgggccacaggagcttttgttgatcccacgcggcgtcaagttccggattgaactgccggatggggcatcgcgcggatacgtttgcgagaatttcggtgcccatctccggctacccgaacttggcccgatcggatcgaatggccttgcaaatgcgcgcgattttcaagcgcctaccgcatggttcgaagacgtccggcaaacaacacgactgctagtgaaattcgctggctcattgtggcaatggcgatctcgaccattctccgttcgacgtcgtcgcgtggcacggcaatctatgcccgtacaagtacgacatgatgcgcttcatgtctatcaactcagtaagctatgaccatgccgatccatcgattggagccttgttgacttcgccatccgcttttacgggaacccccaactttgagatagcgatttttccccacagatga

SEQ ID NO: 27936 - DNA, 1514 bp, Burkholderia fungorum
gtcgttaaggaagtgaaggtcaaggtcggcgacaattgtgtcaggaaggttcgctgatcgtcgtgctggaaggcgctgaaggcggcgcggccgcgccggcaccggcgcctgcggccgcaccggcagcggctcctgcgccggcaccggctgcggcccccgctgctgcgccggcgcccgcgcccgccgcgagcggcggcggtctgcaggaagtcaaggtgccggatatcggcgactacaaagacattcccgtgatcgaagtcgcggtgaaggtcggtgatcgtgtcgagaaagagcagtcgctagtgacgctcgaatccgacaaggcgaccatggacgtgccgagctcggccgccggcgtcgtcaaggaagtgaaggtcaaggtcggcgataccgtgtcggaaggctcggtgatcgtcgtggtggaagcggaaggcggcgcggccgcgccggcaccggcgccgaagcagcaagccgtcgagcagccgtcggatgcgccggccacgccgtcgccggctccggcggcgccttcggcgctcgctcaggcgccggtgattccggctggcgaaggcggcgcgcgtcacgcgagccatgcgtcgccgtccgtgcgcaagttcgcgcgcgaactgggcgtcgacgtgacgcaggtgcagggtacgggtccgaagggccgcattacgcaagccgacgtgactgccttcatcaagggcgtcatgaccggtcagcgtgcggcgccggctggtgcggccgcaccggctgcggcgggcggcggcgaactgaatctgctgccgtggccgaagatcgacttcacgaagttcggtccggtcgatccgaagccgctgtcgcgcatcaagaagatttcgggcgcgaatctgcatcgcaactgggtcatgattccgcatgtcacgaacaacgacgaagcggacatcacggaactcgaagcgctgcgcgtgcaactgaacaaggaaaacgaaaaggccggcgtgaagatcacgatgctggcattcgtgatcaaggcggttgtttcggctttgaagcagttcccgacgttcaacgccagcctcgacggcgacaacctggtgttcaagcagtacttccatatcggctttgcggccgacacgccgaatggtctggtcgttcctgtcattcgcgatgcggacaagaagggtttgatcgatatcgcgagggaaatggccgagttgtcgaaggctgcgcgcgacggcaagctgaagccggatcagatgcaaggcgggtgcttctcgatctcttctttgggtggcattggcggcacgaacttcacgccgattatcaatgcgcctgaagtcgccattcttggtctgtcgcgcggtgcgacgaagccggtttgggatggtaagcagttcgtgccgcgtttgatcctgccgctttctttgtcgtatgaccatcgggtgatcgatggcgctgcggcggccaggttcaatgcttatcttggggcgattcttgccgatttccggcgtgtgattctttgatgtggtgat

SEQ ID NO: 27937 - DNA, 868 bp, Burkholderia fungorum
atgaaaattaaacgcattggcgtcgttggtgcaggcacgatgggcaatggaatcgctcaggtttgcgccatagcaggccttcctgtttcaatgatcgatgtttcagaaaccgccatcgagcgcgggttgcgcgctatcgacacgagccttgacgcgctcgtcaggaaagaaagactatctgaggtagaaaagcaggctgcattggctcgtgtctcgggcacagtcgactatgacgcgttagccggcgcggatctggtcatcgaggcagcgaccgagaacctgccgctcaagctgcgtattcttcggcagatcgacggcatcatcagcggctcaggcgtcgtctctaccaacacttcatcaatatcgattacccagcttgctgccgtgctcgatcggcccgagcgattcgtcgggctccatttcttcaatccggtgccggtgatgccacttgtcgaagtaattcggggtcttcagacatcggatgaaacacacgcattcgcgattggctttgcggaagttatcggaaaaacgcccgtgacagtacgcaaccatcccggatttacggtaaaccgcattctcgtaccgatgatcaacgaggccatctttgtgcttcaggagcgtctggcaaccgcggacgacattgacctgggcatgaggcttggatgcaatcacccgattgggccgcttgctcttgctgacctgattggactggatacgctgctcgccgtaatggaagttctccacgacggtttccgcgattcgaagtatcgccctgcccccctgctaaaagagatggtcgacgccggacggctcgggcgcaagagtggacatgggttctacagctactagcaatgaagaacaggtaggt

SEQ ID NO: 27938 - DNA, 1497 bp, Burkholderia fungorum
aagcggtcgcaaaaggcggcgctgtttttttatataggagtggggcacatggcgggggtgaaagagttacaggcatttccgatggtcatcggtggcgagcgtgtcccctcagcgtccggggtatggctcgaaagcatcgacccttatacaggtgaaccgtgggcaaaggtgccacggggcgatgcgactgacgcagaggctgctgtgtctgcagcgcgtaaagcactgaccaccggggcttggcatcagctttcggccacccagcgtggcgcgcttttgcgccgcctcgctgatctgatatctcgcgactgggaacgtcttgccgagatcgagattcgggacaacggaaaggtcatcagtgaagtcggtccgcagatccgctatctggcccagtacttccactattacgctggactggcagacaagatagaaggagcggtgattccggtcgatcgcccggggatgcttaactatacgcgacacgagccggtgggtgtcgtggtagccatcacgccctggaactcgccgttaatgctggcttcgtggaagatcgcccccgcgctagccgccggatgcacggtcattctcaaaccgtccgaacatacgtcggtgtccagtctcgttttctctgacctgttcgatgaagccggtttccctcccggtgttgtcaacgtcgtgacaggattcggggcggagattggcaatgcacttgtctcacacccggacgttgcgaaagtcgccttcaccgggggtgatgtagctggtcaggctgtatacgaacgtgcggcggcgggattaaagcgcgtgactctggaactcggcggtaagtcgccccacatcgtgtttgacgatgctgatctcgacggggcgctcgccgcagccatggacggcgtcttttccagcagcggccagatgtgcgttgcgggttcgagactcatgttgcacgaccgtattcatgacgaatttgtagctcgacttttggaccgagtgcggactttgaagttgggagcaccgatgaatccggccacctcgatcggaccggttactacgcaagcgcaatttgagcgcattctgagctacatcgacgtcgcgaaacaggaaggagcgcgctgcctggtgggaggcgttgcatcgccggaggcggagggcggtagcggctggttcgtcgcgcctaccgtttttggtgacgtgaagaacgacatgcggatcgcccgtgaggaggtgttcggtccggtgctgtcaatcatccggttttcgactgacgatgaggctgtccatctggccaatgacagtcgctacggcctggcttcggggatctggacgcgcgacgtcggacgcgccatttcggtcgcagatcgcattcaggcgggaacggtatgggtcaatacgtatcgagccgttagtgcggcatctccatttggcggcatgaaacgctccgggatcggacgcgagaatgggcaggaagccatcatgggcttcctgcagacaaaaagtatc

SEQ ID NO: 27939 - DNA, 1182 bp, Burkholderia fungorum
atgcaacgggacgtagtggtggtaagcggcgtgcgcacggcaatcggcactttcggcggcagtctgaaagatattccgccgaccgatctcggcgcacgcgtggtccgtgaagcgctggcgcgcgccagtgtgtcgggcgacgaagtcggccacgtggtgttcggcaacgtcgtgcatacggaaccgaaagacatgtatctggcgcgagtcgccgcgatcaacggcggcgtcgcgcaacacgtgccggccttgaccgtcaaccgcctgtgcggctccggcctgcaggcgatcgtctcggccgcgcaaagcgtgctgcttggcgacgccgacatcgccatcggcggcggcgcggagaacatgagccgcgcaccgtactccatgcctgccgcgcgcttcggtcagcgcatgggcgacgcgcgcctcgtcgacatgatggtcggcgcgctgaacgacccgttccagtcgatccacatgggtgtgaccgcggagaacgtcgcgcgcaagtacgatatctcgcgtgaaacgcaggacgcactcgcgctcgaatcgcatcgccgcgcggccaacgcgatcacgagcggatacttcaacgaacagatcctgcctatcacgatcccgtcgaagaaaggcgacatcgtgttcgacacggacgagcatgcgcgcatgagcgcgtcggctgaagatttctccaggctgaagcccgtgttcgcgaaagaaaacggcacggtgacggccggcaacgcctcgggcatcaacgacgccgccgcggccgtcgtgctgatggagcgcggcatcgccgaacagcgtggcatcaaaccgctggcgcggctggtctcgtacgcgcatgcgggcgtcgatcccgcgtacatgggcatcggcccggtgccggccacccgcaaggcgctcgaacgggccggactgacgatcgccgacctcgacgtgatcgaggcgaacgaagcgttcgccgcgcaggcctgcgcggtcagcaaggaactgggcttcgatcccgccaaggtcaatccgaacggctcaggcatttcgcttggccacccgatcggcgcgaccggtgcgctcatcaccgtcaaggcgctgtatgagctgcagcgggtcggcggccgctacgcgctggtcacgatgtgcatcggcggcggccagggtatcgcggcgatcttcgagcggatc

SEQ ID NO: 27940 - DNA, 1376 bp, Burkholderia fungorum
gcgggcatccaggccggtgacgcattgccgtgatgctttcgaaccgtctggaagctgtattgtgcgtgctagccatcgcacgagcacagggcatactggtgccgataggtgaacgtctgcgcgcgcctgaggttgcacatatccttcaagattcccaggcgattgctctagtctatcaagagacttgtgagccacaactgccgcccgctgaggctacgcccttatgtgcggcgagattctgctgcggaacaagtcgctgtggaaatcccgcattcgaacagctgctcgcgacgagagcgcaggttcaacaattgccggttctcacgggtacggttgaggatgacatatttggaatactttatacctcgggaacgacaggaagacccaagggcgccacactcacccatctgaacgttattcattcgtgcctgcactgggtcgatcgactcggccttgtgcaagaaggcgagcgcagcgttttgtgtattccgtggtcacatgttgcggggctgtgcggagtggtgttcccccttctttacctggggggagcgctcgttctcgtgaaagaattcaacaagcgcacctttttacggcttgcctcggaagagaggatgtcgcatgcattgctggtgcctgccatgtacggactttgcctgctcgatccggatctacggagttttgatctttcggcctggcgcattggtgtctacgggagcgcgcccatgccggaggcgaccatccggcgttttgctgaagccgtcccacacctcgtcatgtgtaatgcctacggcgcgacagaaaccgcgtcacctgcaacgatcatgccacccggcgatggcctcgatcagtccgatagtatcggaaaggtagtggcgtgcggtgaaattcgcgtaatggacgaaaacggctgcgagatgccaccgggcgaacctggcgaactatggatacggggacccatgatcgcctccggctattggcgcaatccggaggcgactgaaagcgcattcgtcgccggattctggaagtccggcgacattggctcggtcgactcgcaagggtatgtgcgcattgcagaccgcaagaaggacatgattaatcgtggcgggttcaagatctatccagccgaagtcgaaaacgtgttgtgtgagctgggcggtgtgctcgaagtggctgtcgtggggcggccgcacgtcatactcggcgagacggtagtggctttcgttcgctgcgtggacgtcgatgttaccgacgcgatcgtgcgggaattctgcagcgagaaattggcggattacaagatcccggatcatgtggtgatcgtggaagaacctcttccgcgtaacccgaatggaaagatgcagaaggagatgctgcgcgag

SEQ ID NO: 27941 - DNA, 1442 bp, Burkholderia fungorum
ataaagctcaacgatcaagcattgcttcgtcagcatgcatacatcaatggtgaatggcagaccgccgataacggatccacctttactattaccgacccatcgagtggagacttgctggcgcaggttccaatgatgggtgctgccgaagcccgtcgcgccattcacgctgcttgtatcgcgtggtcggtctggcgaaaaaaaaccgcgaaagaccgtgcaatagttatgcgtagatggttcaacctggtgttggagaacgccgacgacctcgcgaccatattgacggctgaacaaggcaagccgctagccgaggctaagggagagattgcatatgccgcgtccttcattgaatggttcgcagaagaaggcaaacgggtttctggtgatacgcctgctactcccgatgcagacaaacgtatcatgttaccaaagaaccgataggcgtgtgcgctgcgattacgccatggaactttccagccgcaatgattacgaggaaggtcgcgcctgcgcttgccgctggttgcaccatagtcgtcaaaccggcagaagcaacaccgctgacggcgctggcactcgcggttctggccgaacgagcaggcatcccatcgggcgttcttaatgttatcaccggggatcccagggcgatcggagctgaattgactgccaatcctggggtgaggaagctatcattcaccgggtcgaccgccattgggcgaatgctaatggcgcaaagcgcgcccacgattaagaaggttacgctggagcttggcggcaatgcgccgtttattgtatttgatgatgctgacattgataacgccgtggaaggagcggtggtgtcaaaatatcggaacagcgggcagacctgtgtttgtccgaaccgcttttacgtgcacgatgcggtgtatgacgcctttgtcgagaagctgtcgaaggctgtttttgagctaaaggttgggagcggacgcgatccaggcgtctctatcggtccgctcattagtgaggcggctgtgaagaaagtcgaggcgcacattgcagacgcattgcagaaaggcgcgaaacttgaggtaggaggggcgcgacacgaacttgggcacagtttctttcagccgacggtgttgagcgacgttacaccagatatgatgctttccagggaagaaacgttcgggccgctagccgcggtatcccgattttcttcggaggatgaggtcgtccggcttgcgaatgataccgagtatggcttggcagcgtatttctatagtcgcaatatcgcgcgagtatggcggcttgctgaggcgcttgagtatggcatggtaggaattaacaccggcttaatatccaatgaggtggcgccgttcggaggagtcaaagaatcgggaattggtcgtgaggggtcacgttacgggattgaggattacctggtgatcaagtatctatgtctcgca

SEQ ID NO: 27942 - DNA, 1446 bp, Burkholderia fungorum
ctcctgggcgacgacgtctggcacggacgtattttcaccggttcgtggtgcaatggcgcttcagaggctgaagtgaaagagcccgcctcgggcaaacgccttgcgcgcatcggcatggccgatggagctcttgttgctgcgtcggcgaagacggcgttcgaagcgcagcaagagtgggccgcgctgccctacgatgagcgcgctgccgtattgcgtcgtgccgcgcgtcttgcggaggagtcggtcgaggagatcgttggatggatcgtgcgtgaaagcggttcgacgcgcgcaaaggctgccttcgagacacaggtgacggtgaaggcactgcacgaagcaagtgcattaccgtcgcgatcggctggcgaggtgctgccatcgggtccggggcggttgtcactcgcccgtcgtcgtccgcttggcgtggtgggcgtaatttctccgttcaacttcccgctgtatctggccatgcgtgccgttgcgcccgcactctccctcggcaacgcggtggtcctcaagccagacccgcgcactgcggtatgcggcggctttgttattgcgcgtctttttgagatggccggcctgccgaacggggttctgcacgtgttgcccggcgacggtgccgcgggcgccgggctcacgagcgatccgcacgtcgcgatgattcagttcacaggttcgacgaacgcgggtcgaaaggttggcgaggcggctgggcgtcatcttaaaaaggtctcgcttgagctgggcggcaaaaactcgcttatcgtcctcgacgatgccgatcttgatcgcgccgtcgccaatacggcgtggggtgcctatttgcatcaaggccagatctgcatggcgacgggccgtgtgcttgtgcaacgcgccatatatgagcgcttcgtcgaaaagcttgtggcgaaggcatcgagtctgacggttggcgaccccgccacggacgatgtcgcgcttggaccacttattaacgggacccaacgtgatcacgtcacgcgcgtgctcgacgccgcgcagcaggcgggcgcgcgcgtcgaagcgggcggcagtttccgtgaccttttcttcgagccgacggtgctcaccggcgtgactaaagaaaatccggccttcagcgaggaaatcttcggtccagttgcggtggtagttccgttcgacacggacgaggaggcgatagcgctcgccaacgacacggagtacggactcgcgatcgccatcgtcacatcaaacgtaggccgtgcgctgcgcatgggcgaacgtctgcgcagcggccttctgcacatcaacgatcagacggttaacgacgaagtgatcaacccattcggtggtgtgggtgcatcgggaaacggaacgagcgtcggcggcccagcgaactgggaggaattcacgcaatggcaatggctcacggtcaagggcgaagcgccgctttatccgctc

SEQ ID NO: 27943 - DNA, 1170 bp, Burkholderia fungorum
agagaggcgttgatcgtttcagcggcgaggaccgcgttcaccaggagctggaaagggagcttcaatactacttacggtgcaacgcttggagcccacgccgtacgtgctgcgcttgccagatctggtgtggaggctggcgctttcgaggacgtattgatgggatgtggcaatccagaaggtacgacgggcggcaatatcgccaggcagatcgggttgcttgccggactgccgaccaaggtgcctggcatgacgctgaatcgatactgcgcttccggactacagacgatcgcgctggctgcgcagagaatatggacgggcgagggcgaggtgttcatggccggtggcgtcgagtcaatttcctgcgtgcagaagtacgcgaattcgtttatggcagaggatccggcgctcaaggcaagccatccttcgagtttcgacaccatgcttcaaacggcggaggtcgttgcgcgacggtacggaattacgcgcgaacgccaggacctgtttggtgttcgcagccagcagcgcgcttgcgcggctgcagaggctggtttgacggcagatgaaattgttcccgtgcgggcgacgatgacgcgggtggatcctcagaccggcgaagcatcaacggtcgatgtgctggtcgatggcgacgaggggctgcgtccagctaccacgtacgaagcgcttgcggccattaagccagcgatcgaaggcggtgtggttaccggtggcaatgccagtcagttctcggacggtgccgcggcggtcgtcgtcgccgattcccggtacgccgagcgacacggcgtgcagccacttggagcgttcagcggtttcgcggtcgccggcgtggagcccgacgaaatgggaatcggtccggtacaggcggtgccaaaactccttgctcgcgcgggccttcgcgttgaggatattgacttgtgggaactcaatgaggcgttcgcatcccaggcgctttactgcatcgaccgacttggtcttccggaggagcgcgtcaatgtgaacgggggcgcgattgcccttggtcatccgtatggcgcgtccggtacgcggctttgcgcgcatgcgttgattgaaggcaggcgccggggtgcgaaatacgcggtcgtcacgatgtgcgtgggtggcggacaaggggcggccgccctcctgaaggtg

SEQ ID NO: 27944 - DNA, 1299 bp, Burkholderia fungorum
cgtatggagcgcataccgccagggagatggttccgcaaactgcggttgaccatgggtatggcgacttttttcgatgctttcgactcgctggctattgcggcagcgttgccggcgctgtcggcaatctggcatctgaagccgactgacatgggtgtgctgatctcggttggctatgccggccaactgctgggagcactggtactcggtcgcttggccgaggcgcggggtcgaaccaacgcggcccttatctctgtggcgattttcacgttgttttccgcgctttgtgccctcgcgccgtcatatacctggctgtgcgcgtgccgatttcttcagggggtggggcttgggggcgaagtgccgattgcggcggcttacatcaacgaatttagccgggccaagggacgggggcgttccttcgtgctatatgaagcgagcttcacgttgggtttggtgttttcaagcctcgtaggcgcctggatcgtgccgcaaatggggtggcgggtgttgctggctttgggtgctgttccggctgtcattatcctttgggcgcgtcgcagtctgcccgaatctccacgctggcttgcggagcacgggcgccttgccgaggccgatgaagtcgtctcgcggattgagcgtagcgtagaagaagaaggcaagacgctgcctccgccagccaaagcagttccacggccagcgatggcgcgaacgcgtattttgacccgaacgagcctggtgcgaagtctgtcagtctgggcaatgtggtttgcatgctattttctgtcatacggcgtggggacctgggctcccacgatcttgcggactgctctgcacttacccttgcagcaggcgctgctgttctcgtttgtgctccagactttgtacctttgcggaactcttggtacggcagtgcttgtcgacagattggggcgaaagatatatttccgagtggcttttgctggcgtgagcattgcccttttctgcgcctatagcatggcaggcaatgaaattgccctgatggcgttaattgcgggagcgtttgttttcaacgctgcaatctcggtcacgctttacctgtacacgcctgaaatttatcccacgacggtacgggcaaagggaagcgcatttgcaacatcattcgcgcgactcgcctccattaccagtcccctggctatcggcgcgataatgcagcacgccgagttttcgcagatttttctgatgctgggactggtagcacttgtgataggcggaagcggtgccctgttcgtaactgaaacgcgtaatcgcgtactggaagatatt

SEQ ID NO: 27945 - DNA, 831 bp, Burkholderia fungorum
atggcaatcgttaaagttaagccgacttcgccgggtcgccgtgcgatggtcaaggtggtcaacaaggatctgcataagggcaagccgttcgcaccgctgctcgactcgcaatccacgaccgccggccgtaacaacaacggccacatcacgacccgtcataagggtggtggtcacaagcatcactatcgtgtcgtcgatttccgtcgcaataaggacggtatcgcagcgaaggtcgaacgtctcgagtacgacccgaaccgtagcgcgaacattgcgctggttctgtacgcagacggcgaacgtcgctacatcattgctccgaagggtgtcaccgtcggccagcaactgatgtcgggttcggaagcgccgatccgcgctggcaacacgctgccgatccgcaacatcccggtcggtacgacgatccactgcatcgaaatgctgccgggcaagggcgcgcaaatggcgcgttcggctggtacgtcggcgatgctgctggctcgtgaaggtatctacgcacaggtccgcctgcgctcgggtgaaatccgccgcgtccacgttgagtgccgcgcgacaatcggtgaagttggcaacgaagagcacagcctccgtcaaatcggtaaggctggcgcaaaccgctggcgcggtatccgcccgacggtgcgtggcgttgcaatgaacccggtcgatcacccgcacggtggtggtgaaggcaagacggctgcaggtcgtgatccggtgagcccgtggggcacgcctactaagggttatcgcacccgcagcaacaagcgcacgacgagcatgatcgtccagcgccgtcacaagcgttaagga

SEQ ID NO: 27946 - DNA, 732 bp, Burkholderia fungorum
tggcgtcccttcaaggtcactcaggtcgtcgacgaaagctcggtgatccgttcgttctaccttgaaccgctcgatggcgccggcctcattccgcacgcggcggcccagcatctgccgatccgcgtcacgctgcccggttgcaccaaaccggtaatccggacctatacgctgtccacagcgccagcggacggttcgtaccggatcagcgtcaagcggcaaggactcgtttccgcacatctgcacgatacgttgcgggtgggcagtgtcatcgaggcgcgcgcgccggccggccagttcaccatcgacgccgccgcacgccggtctgccgtgctgctcgcagcgggtgtcggcgtgacgcccatgctcgcgatgttgcggcacatcgtatatgaaggtttgcgtacacgccgcgtgcggccaacgtggttttttcattcggcacgcacgttggccgagcgcgccttcacgaaggaaatcgatcaactggcggcgagtgccggtggtgcggtgcgcgtggtgcgtacgctgaccgataccgagggcgcgcagatgggcaaggacttcgatgcttcaggccggctcgatgtcgaactcctgcgcgcgacactcccattcaacgactacgatttttacctgtgcggaccggcggggttcatgcagtcgctgtacgacgggctgcgcgagctgaatgtcgccgataaccggattcacgccgaggcgttcgggccggcg

SEQ ID NO: 27947 - DNA, 1334 bp, Burkholderia fungorum
atcgacgtggaattcccgcgtgaccacatgccgaagatttacgacgcgctcattctcgaaggttcggaactgacgctcgaagtccagcagcagctgggcgacggcgttgtccgcaccatctgtctgggtgcatcagacggtctgcgccgcggtacgacggtgaagaacaccggcaagccgatcagcgtgccggtcggcaagccaaccctcggccggatcatggacgtgctgggtcgcccgatcgacgaagccggcccgatcaactcggacgtggttcgcggcattcaccagaaggctccggcgttcgacgaactgtcgccgtcgacggaactgctcgaaaccggcatcaaggttatcgacctgatctgcccgttcgcgaagggcggtaaggttggcctgttcggtggcgccggcgtgggcaagaccgtgaacatgatggaactgatcaacaacatcgcgaaggaacacggtggttactccgtgttcgccggtgttggcgagcgtacccgtgaagggaacgacttctatcacgaaatgaaggactcgaacgttctcgacaaggtcgcgctggtgtacggccagatgaacgagccgccgggcaaccgtctgcgcgtcgcgctgaccggtctgacgatggctgagcacttccgtgacgaaggtctcgacgtgctgttcttcgtcgacaacatctaccgtttcacgctggcaggcacggaagtgtcggcactgctcggccgtatgccgtcggcagtgggttatcagcctacgttggctgaagaaatgggtaagctgcaagagcgtattacgtcgaccaagaccggctcgatcacgtcggttcaggccgtgtacgtccctgcggatgacttgaccgacccgtcgccggctacgactttcggccacctggacgcaaccgtcgtgttgtcgcgtgacatcgcttcgctgggtatctacccggcagtcgacccgctcgattcgacctcgcgtcagatcgacccgaacgtgattggcgaagagcattactcgatcacgcgcggcgtgcagcaaacgctgcagcgctacaaggaactgcgcgacattatcgcgattctgggcatggacgaactggcgccggaagacaagctcgccgtggcgcgtgctcgtaagatccagcgtttcctgtcgcagccgttccacgtcgctgaagtgttcacgggctcgccgggcaagtacgtgccgctgaaggaaacgattcgtggcttcaagatgatcgtggaaggcgagtgcgaccacctgccggaacaggcgttctacatggtcggcacgatcgacgaagccttcgaaaaggccaagaagat

SEQ ID NO: 27948 - DNA, 1686 bp, Burkholderia fungorum
ctcatcgaacccaaagacgggctgtcgtacgtccgcgggccgaccgacattccgttgagcgaagcgaccatcggccagtttctgcgtgatacggcggagcgttttccggatcgtccagcagtggtgtttcgtgagcagcgcattcgctggacatggcaggagttcgtggaagaagtcgacgtgttggcggccggcctgctcgcactcggcatcgagaagggcgaccgcgtcggcatctggtcgccgaatcgcgtggaatggttgctcacccagtttgcgaccgcgcgcatcggcgccgtgctggtcaatatcaacccggcgtaccggctcgcggaactcgagtacgccttgaacaaggttggttgcaaggcgatcattgccgccgagcgtttcaagacatccatgtacctggagatgttgcaggaactcgcacccgagctggccacgcaagcgccgggcgagctgcacgcatcgaggctgcccgaattgcgctacgtgattcgcatgtgcgatacggaaacgccgggcatgttgagcttttccgacgtgatcgaggaaggccgcgcgtcgctggacgtgccgacgctcgacgccatcggcgccacgctctcgtgccgcgacccgatcaacatccagttcaccagcggtaccacaggcaatccgaagggggcgacgctgacccatcgcaacgtggtcaataacgcgcgctacatcgcgatggcgatgcggctgaccgagcaggacggcttgtgcatccccgtgccgttgtatcactgcttcggcatggtgttatcggtgctggcgtgcgtgtcggttggcgccaacatggtgtttccaggcgaaggattcgacccggccgcaagcctggccgcagtcgcggaagagcagtgcaccgcgctgcacggggtgccgaccatgttcatcgccgaactcgatcacccggacttcgccacgtacgatttatcgcgcctgcgcaccggcatcatggcgggctcgccatgcccgatcgagaccatgaagaaggtcgtctcccgaatgcatctgggcgagatcaccatcgcctatggcatgacggaaaccagcccggtctcgttccagagttcgaccaccgatccactcgacaagcgcacaaccacggtcgggcgcatccagccgcatctggaagtgaaaatcgtcgatccccttggcaacattgtgccagtgggcgaaaccggcgagctgtgcacgcgcggctattcggtgatgcaaggctattgggacgatgaggcgaagacacgcgaaagcattgtcgacggctggatgcacaccggcgatctggcgacgctcgatgccgaaggctactgcaacatcgtcgggcgtctgaaggacatgctgattcgcggcggcgagaatatctatccgcgcgaaatcgaggaatttctgttccgccacccgaaaatccagagcgtgcaggtgttcggcgtgcccgactcgaagtacggcgaagaggtttgcgcgtgggtcgtattgcgcgcgggcgagcaggcaaccgctgaagagatccagcagttctgccaagggcagattgcgcactacaaggtgccgaagtacatccgttttgtcgacgaactgcccatgacggtaaccggaaaggtgcagaagttcatcatgcgcgagcggatgatcagcgaattgaagttgcggcag

SEQ ID NO: 27949 - DNA, 906 bp, Burkholderia fungorum
ctgccgctgtatcgctacttcggcggctcgggcgcgatgcaactgccggtgccgatgatgaacatcgtcaacggcggcgcgcacgcgaacaacagcctggatatccaggaattcatgatcgtgccggtcagccagccgagcttccgcgaagcactgcgctgcggcgccgaagtgtttcacgcattgaagaagatcctgtcggatcgcggcatgagcacggcggtgggcgatgaaggcggcttcgcgccgaacttcggcagcaacgacgaatgcctgtcgaccatcctgcaagcaatcgaaaaagcaggctaccgtgccggcgaagacgtgctgctcgcgctcgactgcgcagccagcgagttctaccacgacggcaagtaccagttggccggcgaaggcctgcaactgtcgtcgacggaattcgcggactacctggcgaatctcgccgacaagttcccgatcgtgtcgatcgaggacggcatgcacgaaagcgactgggcgggctggaagacgctgaccgacaagctcggcaagaaaatccagctggtgggcgacgatctgttcgtcaccaacacgcgcattctgaaggaaggcatcgagaagggcatcgcgaactcgatcctgatcatgatcaaccagatcggcacgctgacgggaaactttcgcggcgatcgaaatggccaagcgcgccggctacacggctgtgatctcgcatcgttcgggcgaaaccgaagattcgacgattgcggatatcgccgtcggtctgaacgccgggcagatcaagacgggttcgctgtcgcgttcggaccgcatttcgaagtacaaccagttgctgcgcattgaagaagaccttggggcgatatcgccggctacccggacagatcggcgttctacaccatccagggc

SEQ ID NO: 27950 - DNA, 831 bp, Burkholderia fungorum
atgaaactgaaaggtgaagcggtactgatcacggggggcgcctccggattagggcgcgcgctcgtggaccgattcgtggccgaaggcgccaaagtggcggtgctcgacaagtcggcagagcgccttgcagagctggaaaccgatcatggcgacaacgtgctcggcatcgtcggcgatgtgcgttcactggaagaccagaaacaggctgccagccgctgcgtggccaggttcgggaaaatcgacaccttgattcccaatgcaggcatctgggattactcgacggccttggtcgacctgcccgaagagagcctcgatgccgcgttcgatgaggtctttcacatcaatgtcaagggttatatccatgcagtgaaggcctgcctgccggccctggtcgccagccgtggcaacgtgatcttcacgatctccaatgcgggcttctatcccaatggcggcggccctctttacaccgcagccaagcacgccatcgtgggcctggtgcgtgaactggcgttcgagctggcgccatacgtgcgcgtcaacggcgtggggtcgggcggcatcaatagcgatctgagaggtccttcctcgctgggaatgggcagcaaggcgatttcgaccgtaccgctggccgacatgctgaagtcggtgctgccgattggtcgcatgcccgaggtcgaagagtacaccggggcctatgtgttttttgccacccgaggcgatgcggcgcctgcgaccggggccttgctgaactacgacggtggcttgggcgttcgtggattcttctcgggtgccggaggtaatgacttgctcgaacagctgaatatccatccc

SEQ ID NO: 27951 - DNA, 825 bp, Burkholderia fungorum
ctcgaccggtacgcggttatcggcaatccggtcggccacagcaagtcaccgttcattcacggccgctttgccgagcagaccggcgaggctatcgagtatggccgcctgctcgcgccggtggatgcgttcgtgcccaccgtgcgggctttcatcgaagcaggcgggcgcggcctgaacgtgaccgtgccgttcaagctcgaagcgtgtacgttcgccgacacgttgtcgccgcgcgcggccgccgcgggcgcggtgaacacgttgcgcgtcgatgcgaacggtatttacggcgacaacaccgatggctttggtctcgtgcgcgatatcgaggtgaatctcggcgtgtccctgaagggcgcgcgcattctgttgctgggtgcgggcggcgccgcgcgcggcgtggttctgccgatattggagcgggcgccgcatacgctgaccatcatcaatcgcaccgcgcagaaggccgaagcgctggtcgatcagttcgcgcaggccgcgcgcgacgccgcgtgccggctgggcggcggcagcgcgcgggcgatcgaagcgggcgcgtatgacgtgatcgtgaacgccacggcggggagcctggacgcgtcgttgcccgagtgcgacgaccgagcgttcggcagcggcacactcgcttacgacatgatgtatggcgcgcatcccacggtgttcatggaacacgcgcggaaactgggcgcgcgcggtgcagatggactcggcatgctggtcgagcaggccgccgaatcgttttatgtgtggcgcggcgtgcggcctgacggcgcgccggtgctggccgaattgcgggcgctgttg

SEQ ID NO: 27952 - DNA, 1182 bp, Burkholderia fungorum
atgtcagcaccggtagaacttcatccgacatcgatccgacgaacggtcgagacgctagtgcatagcttcgctgccagcgtagtggagcgcgatgagcgtggcggtacgcccaagaaagagcgcgacgcgttgcgcaagagcgggctgctgacactttcaattcccacgcagtacggcggcttgggggcgagctggatagagaccctggataccgtcagggaatttgcacgaatcgacagctcgattgcgcatgtctacggcttccaccatcttctgcttgcgacagtcaggttgttcgcacgtcccgatcagtgggaaccctggttcacgcaaaccgcgcgccatgaatggttctggggcaacgcgctgaatccgctcgacactcgtaccatcgtccgtaaattcgataactggtacgatttctctggcaaaaagagcttctgctcgggcgcccttgattctgaaatgcttatcgcctccggtttcgaagagacaagcggaaaattactgatcgctgccattccaagttcacgcacgggcatcaccttacatcatgactggaacagctttggccaacgtcaaaccgacagtggcagcgccctgttcgagaaagtgcgagtcgaggaaagcgaactgctactcgacccagggccgttgagtacacccttcgcatcacttcgtccattgctcgcgcaactgatcttcgcacatcttttccaaggcattggagaaggcgtgtttgcagaaatcaagcactataccgtgcatgaaacgcggccatggttcagttctcctgcatcccatgcaaacaaagatcaacatgtgctacggcattacggagagttctgggttgagctggaaggcgcccgactgctgcttcagcatgccactcgtttattcgatgaggcgtgggcgcgcggggaagcgctcaatgccgaggcgcgcggccacgtggcgattgccatagccaccgccaagatagcggctacgcgcagcggactcgatttgagcagccagcttttcgacgtggctggcgctcgggctacgcatggtgccctgcgacttgatcgcttctggcgcaatctccgcacgcaaaccttgcatgacccaatcgactacaagctgcaggagattggcgagtgggctttgaacgacgaactgcctacgccatctttctattct

SEQ ID NO: 27953 - DNA, 1371 bp, Burkholderia fungorum
ctccttgcctggttgtgcttcatcgtgatcgcgtgggtattacccacgccacaaggattgacccatcaaggcagagccacgctcgccgtagtcgcgtgggtggcgatcgtatggatcagcgaagccattcccgtcggcatcagcggtatcttgctacccatgctgctggtgttgtcgcatgcagtaacgccttttcccaaggctgccagcggctttgccgcaccggtcgttttcctgtgcctcgccgcgttcctgttctccgcgatcatgcaggcggctggcctcgaccgccgtattgcgctggtactgctcgacaaactcaaggtacgttccgcgaacggcgtcatctgggcgatgtttattgtcaacttcgtgatgtcactggttgttcccgccgccaatgcacgggccgccgcgttgctgcccgtgaccaacggcatcatcggcttgttcggtaacagcgcgcgtgagcgtgacgcccgaaaggccatcgtaatccagacactcgtctacggttcgatgatcagcggcatgtgcattctgacggcgcatctaccgaacatggttgtctctggcctgctcgaaaagcagttgggcctgcggatctcctacttctcgtggctccggttgcagtggccgtatctggggatgttcgtcctgacgcaattctgggttcagcgctacttcaagtcgcgtggtgtaccggtcccgggcgggcggcaggcaatcattgaagagcgccgcaaactgccgccggtcgcgcgccaggatttgacggtacttctggtattcgccttcgtaggggcaatgtgggcgaccgagtcgcttcaccatctgcaatccgaaatcgtcgcgttgatcgcgcttgcgctgatgttcgctcccggcgtgatgcgcttcggctggaaggacattcaggagcggaccatttggggcacgctgtttctgctgggcggtgcgttgtcgctgtcgtccgcgatcagcgattccgggctcgcccaatgggccgccgatcacatctacgcggtcgcgcacggatatgtctggtggatgacgctcgccatcgtgatgatcggcacccacgtgatccggatcggcatgctgtccaacgtcgcggccgtgacgatgatcgcgccgatcgcgctggcgctcgcgcctcgactcggtttgcacccggtcgctttcaccatgctcatcagcgatacggacagcttcgcgtatctgttgcccactcaaatcacagccggggttattgcatatagcagcggccaattcacgaccgccgactacgcgaaagtcggcatcgtctccgtgctgatagcgatcgtctacggcatttgcgtgatggcgccgtggtatgcgtatcagggc

SEQ ID NO: 27954 - DNA, 1215 bp, Burkholderia fungorum
atgagcgatatcaagaaagtcgtgctcgcctattcgggcggcctcgacacctccgtcatcctgaagtggttgcaggacaattacgacgccgaagtcgtcacgttcacggccgacatcggccagggcgaagagctggaaccggcgcgcaagaaagccctgcaactcggcatcaagccggaaaacatctttatcgaagacctgcgcgaagaattcgtgcgtgacttcgtgttcccgatgttccgcgccaacacgatctatgaaggcgagtacctgctgggcacctcgatcgcgcgtccgctgatcgccaagcgtcagatcgaaatcgcgcgcgccaccggcgcacaagcggtgtcgcacggcgcaaccggcaagggcaacgaccaggttcgcttcgaactcggttactacgcgctggaaccgggcatcaaggtgatcgcgccgtggcgcgaatgggacctgctgtcgcgcgaaaagctgctcgcgtatgccgaaaaggccggcattccaattgaaatgaagcacaagcaaggcggcgcgccgtattcgatggacgcgaacctgctgcacatttcgttcgaaggccgtcacctggaagatccgaaagcggaagcggaagccgacatgtggcgttggaccgtctcgccggaagaagcgccggaccaggctgaatacctcgacatcgagtacgagcacggcgatccggttgcaatcaacggcaagcgtctgtcgcctgcggaaatgctcaccgaactgaaccgtctgggcggcaagcacggcatcggccgtctcgacctggtggaaaaccgttatgtcggcatgaagtcgcgcggctgctacgaaacgccgggcggcacgatcatgctgaaggcgcaccgcggcatcgagtcgatcacgctcgaccgtgaagtggctcacctgaaagacgatctgatgccccgctacgccgcattgatttataacggctactggtggagcccggagcgccgcgcgcttcaggtgctgatcgaccatacgcaagagaaggtcaacggctgggtgcgtgtgaagctgtacaagggcagcgtgtcggttgtcgcgcgcgattcgaaggaaacgctgttcgacaagaccatcgcaacgttcgacgacgacggcggcgcctacaaccaggccgacgccggcggcttcatcaagctgaacgcactgcgtatgcggattgcggaaaacgcgcgtcgt

SEQ ID NO: 27955 - DNA, 894 bp, Burkholderia fungorum
attcgccactacctgcagttcaaggatttctcgctggaagactacgagtacgtgctggaacgcgcgcgcattctgaaacgcaagttcaagaactacgagacctaccatccgctgcacgatcgcacgctggcgatgatcttcgaaaaaaattcgacacgcacgcgcctgtcgttcgaagccggcatcttccagttgggcggccacgccgttttcatgagcacgcgtgacacgcagctcggtcgcggcgaaccgatcgaagacgcagcgcaggtcatctcgcgcatggtcgacatcatcatgatccgcacgttcgggcaggacattctccagcgcttctccgagaattcgcgcgtgccggtgatcaacgggctgaccaacgaatatcacccgtgccaggtgctggcggacatcttcacgtacttcgagcatcgcggcccgattcgcggcaagacggtcgcgtgggtcggcgacgccaacaacatgctgtacacgtggatcgaagccgcgcagattctcggcttcaagctgcgcctgtccacgccgccgggctacaagctcgaccgcgccgtggtcgccgccgagagcgcgccgttctacgaagaattcgacgatccgaacgaggcctgcgccggcgccgacctcgtgaccaccgacgtctggaccagcatgggcttcgaagccgaaaacgaagcgcgcaagaaagccttcgccgactggtgcgtcgacgccgacatgatggcgcgcgccaatccagatgcgctcttcatgcactgcctgcccgcccaccgcggcgaggaagtgagcgcggaggtgatcgacggcccgcaaagcgtcgtgtgggacgaggcggaaaatcgtctgcatgtgcagaaggcgttgatggaatacctgctg

SEQ ID NO: 27956 - DNA, 1059 bp, Burkholderia fungorum
atgaagacctatcgcattgcaaccattcccggcgacggcatcggcaaggaagtcatacccgctggcgcgcaggtcctcgaagcactcgccagaacaagcaagtcgttcgcattcgagttcgaaaacttcggctggggcggtgactactatcgcgagcatggcgtcatgatgccggctgacgggctcgatgcgatccgcaacaaggacgctatcctgttcggctcggccggcgacccggacattcccgatcacatcacgctgtggggcctgcgcctgaaaatctgccagggtttcgaccagtacgcgaacgtccgcccgacccgcatcctgccgggtatcgacggaccgctcaagcgctgcaagccgggagatctgaattgggtcattgtccgcgaaaactcggaaggggaatattccggcgtgggcggccgggtccaccagggccatccgatcgaagccgcgacggacgtgtcgatcctgacccgcgccggtgtcgagcggatcatgcgctttgcgttccgcctcgcgcaatcccgtccgcgcaagctgctgacggtgatcacgaagagcaacgcacagcgtcatgcaatggtgctgtgggacgagattgcgctggaaatctcgaaggagtttccggacgtcaaatgggacaaggaactggtggatgcgtcgactgcacgcatgatcaaccggcccgcgacgctcgacacgatcgtcgccacgaacctgcacgccgacattctcagcgatcttgccgccgcgctcgccggcagtctggggattgcaccgaccggcaatatcgatccggaacgccgctatccctcgatgttcgagccaatccacggttctgcattcgatatcatgggcaaggggctcgccaatccggtcggcaccttctggtcggtcgtcatgctgctcgaacacctgggcgaattcgacgccgcgcagcgcgtgatgcaggcagtcgaagcagtgaccgcggacacctcgctgcacacgggcgatctcggcggcacggcaacgaccgcacaggtgacggccgcggtttgcgcgtttatc

SEQ ID NO: 27957 - DNA, 702 bp, Burkholderia fungorum
acacgccgaccgcggcgtggtgaaagagcgcccgggctcgatcgcgtgacgttcgaagaaatgctggaaatggcaagcctgggttcgaaggtgctgcagatccgctcggtggaattcgccggcaaatatcaggtgaagacgcgtgtgctgtcgagcctgaccgatccgctgataccgctcgacgctgaaatgaagtcgggcaccctgattacttttgaagaagacgagaccatggaaaaagcagtcatctcgggtatcgcgtttcagcgcgatgaagctcgtatcgccgtgatgggtgtgcccgacaagccgggcatcgcgtatcagattctcggcccggtggcggacgcgaatatcgacgtcgacatgatcattcagaaccagagcgtggatggtaaaacggcgttcacgttcacggtcggccgtggcgactatcagcgcgctatggacatcctcacgggacaggtgaagggccacgtgcaggccgagcaggtgctgggcgatccgaaggtgtcgaaggtgtcggtggtcggcgtcggcatgcgctcgcacgtcggtatcgcgagcaccatgttccgcacgctgtcggaagagggcatcaacatccagatgatctcgacctccgaaatcaagatctcggtattgatcgacgagaagtacatggagctcgccgtacgcgcgcttcataaagcgttcgaactg

SEQ ID NO: 27958 - DNA, 756 bp, Burkholderia fungorum
atgggcttcctcgctggcaaacgtatcctgctgaccggcttgttgtcgaaccgctcgattgcatacggtatcgcgcaagcctgcaggcgcgaaggcgccgagttggcgttcacctatgtcggcgagcgcttcaaggatcgcatcaaggagttcgccggcgaattcggcagcgacctggtgttcccctgcgacgtcgccgacgacgcgcagatcgacgccctcttcgcttcactgaagcaacactgggacggcctcgacggtctggtccattcgatcggctttgcgccgcgtgaagcgattgccggcgatttcctcgacggcatgacgcgcgaaaatttccgcatcgcgcatgacatctccgcgtacagcttccccgcgctcgccaaggccgcgcagtccatgttcacaccggacgcgtcgttgctcacgctgagctatctcggcgccgagcgcgcaattccaaactacaacacgatgggtctcgccaaggcttcgctcgaagcgagcgtgcggtatctggcggtctcgctcggcgccaaaggcgtgcgcgtcaacggcatttcggcgggcccgatcaggacgctggctgcgagcggtatcaagggcttcggcaagattctcgagttcgtcgaacagaatgcgccgctcaggcgcaacgtgacgatcgaacaggtcggcaacacggcggctttcctgctgtcggatctggcggccggcgtgaccgcggaaatcgtgcacgtcgatagcggcttcaat

SEQ ID NO: 27959 - DNA, 1071 bp, Burkholderia fungorum
cgcgtctttaatttctccgccggcccagcggccatgcccgaagaagttctgcgtcaagctgccgacgaaatgctcgattggcaaggcagcggcatgagcgtgatggaaatgagccatcgcgggaaagagttcatgtcgatccatgaggaagcgctcgtcgatctgcgcgacctgcttcaggtgccggcgagtcaccgcatcctgttcctgcaaggtggcggtttgggcgagaacgcaatcgtgccgatgaacctgatgggcgccaagccgcgcgcggatttcgtcgtgacgggttcgtggtcgcagaagtcgttcagggaagcgcagaagtacggcaccgtgcatctggcggcgagcggtcagacagccgatggtttcacccgcgcgcccgcccgctcggaatggcaactgtcggacgacccggcttacgtgcatctgtgcacgaacgagacgatccacggcgtcgagacattcgagatccccgatctcggcgatattccgctcgtggcggatgcctcgtcgcacatcctgtcgcgtcctatggacatcgccaaatacggcgtgctgttcggcggcgcgcagaagaacatcggcatggcgggcgtgacggtggtggtcgtgcgcgaagacatgctcgatcgcgcgcagccgatctgcccgtcggcgttcgaatggaagatcgtcgccgagaacaattcgatgtacaacacgccgcccacttacgcgatctacatcgccgggctggtgttcaagtggttgaagaagcagggcggccttgccgcgatggaagcgcgtaacctcgaaaagtcgaagctgctgtacgacgcgatcgacgcgagcagcttctatctgaacaaggtcgaacgcggttcgcgctcgcggatgaacgtgccgttcttcctcgccgacgagtcccgcaacgaagatttcctggccggcgcgaaagcgcggggaatggtgcagctaaagggccacaagtccgtcggcggcatgcgggcgtcgatttataacgccgtcccgctcgagggcgtcaaagcgcttgtcgaatacatgaaggaattcgaacagcgc

SEQ ID NO: 27960 - DNA, 1095 bp, Burkholderia fungorum
ttcggtccttcctacgtgcgtgccattgcgccttacgtcgcgggtaaaccgatttcggaagtggctcgcgaattcgatctggacgaaaagaccatcgtgaaactggcctcgaacgagaatccgctcggcatgccggaatcggcgcagcgcgcgatggcgcaggccgccagcgaactgggccgctaccccgacgccaacgcgttcgaactgaaggccgcgctgagcaagcgctacggcgtgccggccgactggatcacgctcggcaacggcagcaacgacatcctcgaaatcgccgcacacgcgtttgtggaaaaggaccagtcgatcgtctatgcacagtactcgttcgcggtttacgcgttggccacgcaaggtctgggcgctcgcgcgatcgtcgtgccggctgtcgggtacggtcatgacctcggcgccatgctcgcggcgatcaccgacgacacgcgcctgattttcgtcgccaatccgaacaacccgaccggtacgttcatcgaaggcgcgaagctcgaagcgtttctcgacaaggtgccgcgcaacgtggtcgtcgtgctcgacgaggcatacacggaatatctgccgcaggagaagcgctacgactcgatcgcgtgggtgcgccgctatccgaatctgctggtgtcgcgaaccttttcgaaggcgttcggccttgccggtttgcgcgtgggtttcgcgatcgcacagcctgaattgaccgatctgctgaatcgtctgcgtcagccgttcaacgtgaacacgctggcgcaagccgcggcgatcgccgcgctgaacgacagggcgtttctggagaagagcgccgtgttgaacgcgcaaggctatcgccgtttgaccgaagcgttcgacaagctcggtctggaatatgtgccttcggacggcaacttcgtgctggtacgtgtcggcaacgacgacgcagcgggcaaccgcgtcaacctggcgttgctgaagcagggcgtgatcgtgcggccggtcggcaactacggcttgccgcaatggctgcgcgtcacgatcggcctgccggaagaaaacgaagcattcgttgcggcgctcgaaaaagcgctcgccacc

SEQ ID NO: 27961 - DNA, 1245 bp, Burkholderia fungorum
atggaattcctcgatctcggaccgttctctcgcgcgtccggcacgattcgtctgcctggctcgaagagcatctcgaaccgggtgctgctgctcgcggcgctcgccgaaggcgaaacgacgatcacgaacctgctcgactccgacgacacccgcgtgatgctcgacgcgctcgaaaaactcggtgtgcgtctgaagcgcgacggcgacacctgcgtcgtgaccggcacgcgcggcgcattcacggcgcgcacggcggatctgtttctcggcaacgccggcacggcggtgcgtccgctgacggcggcgctggcggtcaatggtggcgactatcggattcacggcgtgccgcgcatgcacgagcggccgatcggcgatctggtcgacggcctgcgccaactcggcgcgaagatcgactacgaagagaacgaaggctatccgccgctgcggattcgccccgggcagatcaatgccgacgcgccgatcaccgtgcgcggcgacgtgtcgagccagttcctgacctcgcttctcatgacgctgccgctcgtgcggaccggaagcggcgtgagcaccgtgcaggtggacggcgaactgatctcgaagccgtacatcgagatcaccctcaagctgatggagcgcttcggcatcaaggtcgaacgccacggctggcatcagttcgtcgtgccggcggggcagcgctatcagtcgccgggcagcatcatggtggagggcgacgcgtcgtccgcttcgtatttcctcgcggccggcgcgctcggcggcgggccgctgaaagtggagggcgtcggccgggccagcatccagggcgacgtcggctttgccgatgcgctcatcaggatgggcgcgaacctgcagatgggcgacgactggatcgaggtgcgcggcgtcggccacgacagcggcaagctcgagccgatcgacatggactgcaacctgattcccgacgctgcaatgacgatcgctgtcgcggccctgttcgcggacggcgccaccacgctgcgcaatatcgccagttggcgcgtgaaggaaaccgaccggctcgccgcaatggcgaccgaactgcgcaaggtcggcgccaaggtgaaggaaggcgaggacttcatcatcatcgagccgcctgaaaagctgattccgaacgccgccatcgacacctacgacgatcaccgcatggccatgtgcttctcgctggtgagtctcggcggcgtaccggtccgtatcaacgagccgaag

SEQ ID NO: 27962 - DNA, 1119 bp, Burkholderia fungorum
ctgaggaatgacgcggcggttggcattatcggcgccgggacaatgggcgcaggcattgcgcagatcgcagcagcagccggacatcgggtcctgctcttcgacgcgaggagcggcgctgcggcgcaggcactggataagctcaacgctgatctgaaaaagcgggtcgacgcgggaaaactcgattccactgatgccagggccctggttgcgcgaatcgagcctgtcgatgctattgccgccgtcagcgaagccggtattgtgattgaagcaattgttgaacgtctcgacgccaagcgtgaactgcttgcgcaactcgagagtctcgtggctgaccggacgatccttgcgtccaatacatcatcgatttccgttaccgcgttaggtcgtgatctgcgcttgccgcaacggctcgtcgggatgcattttttcaacccggtgcctgtcatgaaactcgtcgaagtcgtctccggcgcggcgaccgacagcgctgttgcgcacgcggtggccgatctggcggtgcgttggggcaaggtgccgatccacgcacgctccactccgggttttgtggtcaaccgcattgccaggccgttctacgcggaagcgctgcttctgctgcaggatcaatatgcgacgccgtcgcaaatcgacgctgcgctgcgtgccgcgggcttccggatgggcccttgtgagttgatggacctgatcggtcacgacgtcaatttctcggtgaccgagtcgatgtttgcggccagcttttttgaccggcgctataccccatccatcgtccagcgagaactggtagatggtggcttgctgggccgcaagagcgggcgaggtttccatgattacccggcggaacccctggcagaagctgctgcgatgcccgcacaggtcgataccgacccaccgtgcgtgagcgtgtccggtgacagcttcaccattgcaacgctaggcgctgaactgtccggcgagggatgggacgtcgaatatgccgatcccgccggtgcctcactggggcgtaccgacaatatattgatgaaggacacgctgcttgctggcgatacgctaatttgcgtaacggacggccgtcctgccgcacagatcgctgcacaatctggt

SEQ ID NO: 27963 - DNA, 777 bp, Burkholderia fungorum
atggacatgggaatcgcaggacgcaccgcgctggtctgcgcggccagcaagggactggggcgcggctgtgcggaagcgctcgccgccgaaggcgtcgacctgacgatcgtcgcgcgcaccgccgagacgcttgaagcgaccgccgcggagatccgcaagcaaagcggcgtggaagtgaaaacggtggcatgcgacatcaccacgcccgaaggccgcgccgcggcgctcgcggcctgtccgcagccggacattctggtcaacaacgcgggcggcccgccgccgggcgacttccgcaacttcacgcacgaagactggatccgcgcgctggaaagcaacatgctcacgccgatcgagctgattcgcgcgaccatcgactcgatgagcgcacgcggctatgggcgtatcgtcaacatcacgagttcggcggtgaaggcgcccatcgacgtgctcggtttgtcgaacggcgcgcgttcggggctgaccggcttcgtcgcgggcctcgcgcgcaaggttgcgcccaccggcgtgaccatcaacaacctgctgccgggaattttcgacaccgatcgcattgcggtgaccttcgcggcgcaggccaggtcgcagaacatttcggtcgaccaggcgcgccagcagcgcatgaaaacgattcccgccggccgcttcggcaaccgtgacgaattcggccgcgcctgtgcgttcctgtgcagcgtgcatgccggctacattaccggacagaactggctgatcgacggcggcgcctatccgggtacgttc

SEQ ID NO: 27964 - DNA, 855 bp, Burkholderia fungorum
atgaacctgacgatcatcggtagtggctacgtaggcctcgtgacaggcgcgtgtctggccgacattggccacgacgtgttctgtctcgacgtcgatcagcgcaagatcgacgtgctcaacaacggcggcgtgccgatccatgaaccgggtctgcaggagatcatcgcgcgcaatcgcaaggccggccgcctgaagttttcgaccgacgtcgaagcggcggtcgcgcacggcgatatccagttcatcgcggtcggcacgccgtccgacgaagacggatccgccgacctgcaatacgtgctggccgccgcgcgcaacattggccgccatatgacgggcttcaaggtgatcgtcgacaaatccactgtgccggtcggcacggcctcgcgcgtgcgtgacgtgatcgctgccgaactggccggccgcaacgctgcgcacatgttctcagtggtgtcgaatcccgagttcttgaaagagggcgcggcggtggaagacttcacgcggcccgatcggatcgtgctcggttgcgacgaagacgtgccgggtgaaaaagcgcgcgagctgatgaagcgcctctacgcgccgttcaaccgcaatcgcgaacgcacgctgtacatggacgtgcgctcggccgaattcaccaagtacgcggccaacgccatgctcgccacgcgtatttcgtacatgaacgaactcgcgaatctggccgaccgcgtcggtgcggatatcgaggcggtgcggcgcggcatcgggtccgatccgcgcatcggctacgacttcctgtatgccggttgcggctacggcggttcgtgctttccgaaggacgtgcaggcgctgatccgcacggccgccgaccac

SEQ ID NO: 27965 - DNA, 720 bp, Burkholderia fungorum
agcaaggttgcggccattaccggagcggcgggcggcctcggcacgggtatcgcaaagcggcttgccggactgggcgcgagtgttgcgttgcttgagccgggaatcgaacgtctcgtctcgctcgcgagcgaactgacagattccggagcaaccgtgttgaacgttgcgtgtaatgtcaccgatgccgcatcgacacgttacgctgccgcacaggtgttgtcgagcttcgggcgcatcgacgtgctggtcaataacgcaggtgttctggctcgtccatcggcgctcgaaagcatatcgctcgaggactgggatcgcagcctcgcggtgaatctgacaggtgcattgctgtgcacggcaagcttcggtgcggcaatgctcgaagcgggggcaggcagcatcgttaatattgcttcgatcgcggcgtacagcccaaacacgtccgttgcctacagcgtcagcaaggcgggactactggcactgacgcgtcacacggcagtggagtgggcgccgcgaggcatacgtgcaaactctgtgagcccgggattcattcgcacgccgctttcggaagttcactacgccaatcccgatctgttgcaacttcgcacgcaagcgacgcccgtcagacgtcttggcaccgtcgatgacgtcgccgcaatcgtcggctttctggcgagtcctgcaagcgccttcatcaacggagaggacatcgtcgccgatggc

SEQ ID NO: 27966 - DNA, 780 bp, Burkholderia fungorum
cggatttgtgttgtgacaggtggtgcgtccggtatcggcgcggcgatctgtcgcgccttcgacgctcagggtgcaaagctcgccgtgctcgacgtggaccgcgactctggcgaaacctttgcacggagtctgcggggcgctgtctttatcgaatgcgacgttgcggatgcggcttccgtaaagcgtgcattcgagcggatcgcccaacgctgggatcgtacggatgttctcgtcaataacgcgggcattgtcgggcgcgaagaatatggccgcgtgcagacccggcgagtgcaacagatcgaagatgtcagaagcggccgcaagccgggaccgcttcgcgcaaccgtgagcctgaccgacgagcaatggcgccgcatgatcgacattcatctgaacggcacattttattgcacgcgcgaggccttgctccagatggagcggctggggcagggcgcgatcgtgaatatgtcttcgatcgcgggtctcgacggcggctttggcaatcctcattacgcagccgccaaggcgggaattctcggattcacccgcgcggtcgcaaaagaggcaatccagcagggcattcgcgttaacgcggtggcgccgggattcgtcgattcgccactgcggcgaagtctgtcggaagcgttgcagcaacttcagatcgccgcgactccgatgggccgcgcggccaccggtgacgagattgcttcgctcgtgttgtttctcgcgagcgacgacgcgtcgtacctggtaggcgaaacgatcagtccgaacggtgga

SEQ ID NO: 27967 - DNA, 1797 bp, Burkholderia fungorum
gtcaaaaaccgaaaactggtcgactgggtgcagcgcgtcgccgccatgaccaagccggacagaatcgtctggtgcgacggctcacaggaggaatacgaccggctttgcgcgcagatggtcgaggcgggcaccctcaaaaaactcaaccccgcgaagcgtcccaactcctatctggcatggtctgacccgtccgacgtggcgcgcgtcgaagatcgcaccttcatctgttcgcagcagcgagaggacgcgggccccaccaacaactgggtcgccccggccgagatgcgctcgacgctcggcggcctgttcgaaggcgccatgcgcggccgcaccatgtatgtggtgccgttttcgatggggccactcggttcgccgattgcgcacatcggcgtggaactgagcgacagcccgtacgtggtcaccaacatgcgcatcatgacgcgcatgggccgcaaggtgtacgacgtgctgggcgaagacggcgagttcgtgccgtgcgtccactccgtgggcgcaccgctcgcggcgggcgaaaaagacgtgccgtggccgtgcaacgcaaccaaatacatcgtccactttccggaatcgcgcgaaatctggagctatggctcgggctacggcggcaatgcgctactcggcaagaagtgtttcgcgctgcgcatcgcctcgactatgggccgcgacgaaggctggctggccgagcacatgctgattctcggcgtgacctcgccggaaggccgcaagcatcatgtggcggcggcgtttccgtcggcgtgcggcaagaccaactttgcgatgctgattccgccggaaggcctgaacggctggaaaatctccacgatcggcgacgatatcgcgtggatcaaaccgggcaaggacggccgcctgtatgcgatcaatccggaagccggctacttcggcgtggcgccgggcacgagcgaaaagaccaacttcaacgcaatggccacgttgaaggaaaacgtgatcttcacgaacgtcgcgctgaccgacgacggcgacgtctggtgggaaggcatgaccgacgaaccgccggcgcacctgatcgactggcagggcaaggactggacgccggccggcgcgaagcaaagcggccgcaaggcggcgcacccgaacgcgcgctttacggcgccggcctcgcaatgcccgtctatcgacgccgactgggaaaacccggcgggcgtcgcgatcgacgcgttcatcttcggcggacgccgttccaccaccgtgccgctcgtcaccgaagcgcgcaactgggtggaaggcgtctacatggcggcgactatgggctcggagaccaccgccgccgccgccggccagcagggcgtggtgcgccgcgacccgttcgcgatgctgccgttctgcggctacaacatgagcgactacttcggtcactggctgaaaacgggcgagcgtctggagcaactcggcgcgaagctgccgaaaatcttctgcgtcaactggtttcgcaagggcgcggacggcaagttcgtctggccgggcttcggcgagaacatgcgggtgctgagctggatggtcggccgggtcgaaggctctgctcaaggtgcggaacatgcattcggcgtgtcgcctcactatgaggacatcgactggagcgggctgaatttcagccgcgagcagtttgagcaggtgatttccgtggatgacgccgcctggcgcgacgaactcgccctgcacgccgagctgtttgacacattgcaacacggcttgccgccggcgctaacccaggccaaacgcacactcgaaggaaaactc

SEQ ID NO: 27968 - DNA, 1941 bp, Burkholderia fungorum
atgtccaaagcactgatcatcgccgaaaagccttccgtcgcgaacgacatcgcgcgcgctttgggcggctttaccaagcatgacgaatactacgaaagcgacgagtacgtcctttcctcggcagtcggccacctgctggaaattgccgcgcccgaagactacgaagtcaagcgcggcaagtggagtttcgccaatctgcccgtcatcccgccgcacttcgatctcaacccgatcgccaagagcgagtcgcgcctgaaggtgctgaccaagctgctcaagcgcaaggacgtcgaccgtctgatcaacgcatgcgacgcggggcgcgagggcgagctgatattccgcctgatcgcgcagcacgcgaaagcgaggcagccggtgcagcgcctgtggctgcaatccatgacggcgggcgcgatccgcgacggcttcgcccgtctgcgcagcgacgaagagatgcaaccgctcgccgatgccgcacgctgccgctcggaggcggactggctggtcggcatcaacggcacgcgggccatgaccgcgttcaacagcaagggcggcggcttcttcctgaccaccgtcgggcgggtgcaaacgccaacgctgtcgatcgtggtcgagcgcgaagagaagattcgccgcttcgtgccgcgcgactattgggaagtcaaggcggagttcgtctgctcggccggcttctacgagggccgctggttcgatccgaaattcaagcgcgacgagttcgatccggaaaaacgtgattcgcgcctgtggtcgctacccgcggccgagacgatcgtcgccgcgtgccgtggccagatcggcacggtgactgaggaatcgaagccgtccacgcaactgtcgccggcgctcttcgacctgaccagcttgcagcgggaggccaacggccgcttcggcttctcggcgaagaacaccctgggcctcgcccaggcgctgtacgaaaagcacaaggtgctgacctatccccgtaccgacgcgcgcgcgctgccggaagactatatggatacggtcaaagagacgctcggcatgctcaaggagagcaacaactatctgccgttcgcgaagcaggtgctcgacaagggctgggtgaagccgaacaagcgcatcttcgacaactcgaagatcagcgaccacttcgccatcatcccgacactgcaagcgccgaagaacctgtccgagccggaacagaagctctacgacctcgtcgtgaagcgattcctgtcggtgttcttccccgccgccgaattcaaggtgacgacgcggatcacggaagtggtcggccatcacttcaagaccgaaggcaaggtgctggtcgagccgggctggttgcaggtctacggccgcgagatcagcggcgaagacgcgaacctcgtgccggtgcagaaggacgagaaggtcaagacggacaggatcgccgcccagcaactggtgacgaaaccgcccgcacgctacaacgaagccaccttgctgtcggctatggaaggcgcaggcaaactcgtcgaagacgacgagttgcgtgaagcgatggccgccaaagggctcggcacgccggccacgcgcgcggcgatcatcgaaggtttgctgggtgaaaagtatctgattcgcgaaggccgcgatctgattccgaccgccaaggctttccagctcatgacgctgttgcgcggtctcggcgtgaaggaactgacggcgccggaattgaccggcgagtgggaatacaagctctcgcaaatggaacgcggcaacctgccgcgcgacgcgttcatgcaggaaatcgcccgcatgacgcagaccatcgtgaagcgcgcgaaagagtacgactccgacacgatcccgggcgactacgcaacgctggaaacgccgtgtccgaattgcggcggtcaggtgaaggagaactaccggcgctttgcctgctcgaagtgcgag

SEQ ID NO: 27969 - DNA, 1374 bp, Burkholderia fungorum
ggcgagcgcgtgacgcgcccgcgcacgctcgacgtgttcgatccatatacgggaacgcgcgtgggcacggtcccgttggcgagcgtcgacgacgtgcgtgctgcgttcgagtacgcggcagcctatcaggcgcagctcacgcgttacgaacgctcgcagattctggagcgcgcggcttcgatcatgcgcgagcggaccgaagaggcgtcggatctgatttcgctcgagtccggcctgtcgaagcaggattcgcgttacgagatcggccgcgtggcggacgtgttgaagtttgcttcgatcgaggcattgcgtgacgacggccagagcttttcgtgcgatctgacgccgcacggcaagaaacgccgtgtgttttcgcagcgcgagccgctggcgggtgtgatcgtggcgattacgccgttcaaccatccgatgaaccaggttgcgcacaagatcgcgccagctatcgcgaccaataatcgggtgctgctgaaaccgtcggaaaaggtgccgctgtcggcgctctatctcgccgacgttctatacgaagccggcttgcccgcgccgatgctgcaggtgctgaccggcgatccgcgagaaatcgccgatgaactgatcacgcatccgttggcggaactcgtcacgttcacgggcggcgtggcgatcggcaaatacattgcggcgagagcggcgtaccggcgcgtggtgctggagttgggcggcaacgatccactgatcgtgctcgacgacgccgatctcgaacgcgcggcgacgcttgccgtgcagggctcgtataagaactccgggcagcgctgcaccgcggtcaagcggatgctggtgcaaaagagcgtggccgcggatttcaccgatctggtcgtcgagaagacgcgcgcctggactttcggcgatccgttcgatgcatcgagtcagatgggcaccgtgatcgatgttgccgcggcgcagcttttcgaagcgcgcgtgaacgaggcggtggcgagcggggcgcgtcttctgaccggcaatcagcgcaacggcgcgctgtatgcaccgaccgtgctggacggcgtcgacccgtcgatgacgctggtgcgcgaggaaaccttcgggcccgtgtcgccgatcatcaccttcgacacgctcgacgacgccatccgcatcagcaacggcacggcgttcgggttgtcgtcaggtgtgtgcacgaaccggcaggatgcgatcacgcgcttcatcaacgaattgcgcgtggggacggtcaatgtgtgggaagtgcccggctaccggatcgagttgacgccgttcggcggcatcaaggactccgggcttggctataaggaaggtgttcaggaagccatgaagagcttcaccaatctgaagact

SEQ ID NO: 27970 - DNA, 1050 bp, Burkholderia fungorum
ctcgccttcgacgccctgtgcatggcaaccccagccgacgcgctcacgctgccggagattgcacctgacacgcccgcgctgctgctgtttacttcgggcagtaccggccggcccaaggtcgtacaactcacgcaagccgcattgctcaataacgccctcggcgtgatcgacatgagcgcgctgaacagcgaggaccgcctgctgcatgtcatgccgatctatcacaccaacggtgtgaacaaccagttgttcgcgccgttactggccggaagcaccgtcctgttctgttcgcgttttcgcgcggcggacatgcccgctctgctcaattcgtatcggccaaccatcatcaccggcgtgccgaccatgtattcgcgcatgctctcgcaatcgttcgataccgaagcgctcgccggcttacgcatggcacgctgcggatcggcgccgatcaccgagacactgcaccgcgaagtggaagcgaagctcggttgcccgctggtcgtctcgtacggactctcggaagcgacctgcaccagcacgctcaatccgccgcaggcacgccgcatcggttcagtcggtaaggtgctggcgggacagaccgtcgagctgcgcgcgcccgacggcagcatgagcgcgacgccgggcgtcgagggcgaaatctgtatcggcggcgcgaatctgatgagcggctatctgggcgcgccggatgccaccgcccgcgcggtcaccgacaactggctgcgcacgggcgacctcggccggttcgacgacgacggctacctgaacatcacgggccgcatcaaggacgtgatcattcgcggcggcgagaatctgtcgccgctgctgatcgaaagcgcgattgtcggcgtcacggcggtgtcggcgtgctgcgtggtcggcatggccgaacgcgatctcggcgaggtgccggtggcgttcgtggtggcggatgaagcggcgagcgggttgagcgtcgagctcatccagaacgccgtgcgcgagcgaatctcgcgcatctttgttccacacgaagtctttttcgccaatacgctg

SEQ ID NO: 27971 - DNA, 768 bp, Burkholderia fungorum
  unsure (1)..(768): unsure at all n locations
gactactcgaacatgaaaaacattcttatcgtcggcgctacgtcggcgattgccattgcttgtgcccgcaaatgggcttcagaaggcgcacgcttttttctggtggctcgcaatggcgaacgcctccagcagatcgccgacgatctgacctcgcgcggcgctcaactcgccgcgtgccatcaactcgacatcgacagtctggatcgtcatgcgggcatgctcgancgcgcgtgcaagaacccgnanancntgggngnncgnccgcctccngatanntcgtactggtcgcgcccggcacgctgccggaccaggccaggtgccatctgatcctgcctggctgtgctcgaatttaacaccaatgccgtctcggtcattgccctgttgacgccaatcgcgaacatcctcgaagcgcaaaagcgcggcgcgttggcggtaatctcgtccgtggcgggtgatcgcggccgtccgtcgaactatctgtacggcagcgcgaaggcggcgctttccgcattctgcgaaggattgaatgcaaggctattcaagtctggcgtacatgtcatgacggtcaagcccgggttcgtcgctacgccgatgacggcaggtttgcctttgccgggaccactcgttgcaacgcccgatcaagtggcgaccgacatcgtacgggcggtcgaaaagcgcaaggacgtcctgtacacccgctggttctgggcaatcatcatgctgatcatccgctgcgtgccgcgattcctgttcaagcgcgcgtcgctg

SEQ ID NO: 27972 - DNA, 1403 bp, Burkholderia fungorum
gcaaatccgaaacacgtcgcggatccgaccaggcttcgtaatcagaatctgattggcggccagtggaaagctgcgctttctggccagtcgatcgccgtcgagaatcccgcgaatgaagagatcatcgcgcaagtcccgagaggacagcaggaggatatcgacgaggcagtgaaagttgcgcgggcgacgttcgagtcggctgcgtggcgcaagattcgtcccatcgaccgcggtcgcatcctggagaacatcgcgcgcaaggtcgaagagcacgccgaggaactgtcctggctggagtctctggacactggcaaggcgatctcgttcgccagggtcatcgatcttccctcgaccgttgacgtgttccgttacatgggcggctggtgctccaagctgggcggtacgactccgcctatctctttcgatggaaaggaataccacgcttacacgcgtcgcgagccggtgggcgtggtcggtgcgatcacgccatggaactacccgctcgcactgggctcctggaagatcgcatcagcgctcgccgcggggtgcacgatggtgctgaagcccaccgagctcacgccgctcagcacgcttcggctggccgaattgtgtcttgaggcggggttgccggaaggggcactgaacgtcgtcaacggctacggccatgaggccggtgaggcgctggcgcgtcaccccgacatcgacaagatcaccttcacgggatcgacggtggtgggcaagaagattgtcgagtacgcgcttggcaacatgaagcgcgtgacgctcgaactgggcggcaagtctccaagcatcgtgttcgacgacgctgatcttgatcaggtcggcctcggtgcagcacttgctgtcttcttcaactccgggcagatctgttttgctgccagccgcctgttcgtccaggccagcgtctacgatcgcgtcgtcgaagctgttgccgccgtggcgtcgcagttcaaggtgggcaacgggcaggacaccgacaccatgctcgggccgcttgtgtcccgtaagcagcaggagcgggtcctcggctacgtccaatctggcatcgagcagggcgcaagcctcatctacggcggccagaaaatcggcgacaagggctacttcctgcagcccacggtgtttgcggatgcggatcagtcgatgaagatcgcgcaggaggagatttttgggcccgtggtgagcatcatccgcttcaaggacgaggtggaggccattcgtcttgcaaacgacacaacgtatggactggccgccaacatctggacgcgcgatatcaagaaagcgcatcgggtcgcccaccggttgcaggccggatcggtgtggatcaactgccacggcgtcatcgacccggcggcgccatttggcggttcaaacagtcgggctgg

SEQ ID NO: 27973 - DNA, 756 bp, Burkholderia fungorum
atgagacttgaaggcaaggtggcgatcatcaccggtgcggcaaccggtatcggcaacgcgatcgcgcgggcgtatgtggccgaaggtgcgaaggtcgtgattgcagacctgaagggggcggaggcagcggcatctgaacttggcgcgggtattgcgctaggtatttacgccaacgtcgccgatccggacagcaccaggcagatggctgctgctgctgtcgagcggtttggcaagatcgacgtgctggtcaacaatgccggcattttcacgggcctcagcggtgttccgatggaaggcatcacggtcgaggactgggacaaactctacgctgtcaatgtcaagggtccgtggctttgcacgagcgcagtctcggcggcgatgcgtgagggcggtggcggcaagatcatcaacatcgcctcggtcatcgcgcacgtcggcgtgcccttcatgctgcactacgtctcgagcaagggtgccgtggcagccatgacccgcgcaatggcgcgggagtttgctgccaccaaggcgggaattacggtcaacgcgatctctcccggctatacccattctgcaaacgcagtggccaatacccagcagcacgagcagttcgaaggcgtcgccgcacagatgcgcacgatcgggcggccgcaggtgcccgaggacattgccggcgcagcactctggctcgcgagcgacgaagcgtcctacgtcaacgggcagaacatcattgtggacggtggcattttcatgagcctc

SEQ ID NO: 27974 - DNA, 1569 bp, Burkholderia fungorum
atgaaaactgttcagcatgcagcttatgaaattcttcgccgccacggcctgaccacgatcttcggcaatcccggctcgaacgagctgccgttcctgaagcatttcccatcggattttcggtacatcctcggtttgcacgaaggtgtcgtgacgggcatggcagacggctacgcgcaggccaccggcaaccctgcattcgtgaacctgcactcggccgcgggtaccggcaacgcgatgggcgcgctcgccaacgcgtggaattcgcatacgccgctcgtcgtgacctcgggccagcaggtccgctcgaccatcgggatggaaccgctgctcgcgaacgtcgacgccgtcaacctgccgaggccactagtgaaatggagcaccgagccagccagcgccgaagacgtcccccgttccttcgcccaggcgattcacatcgcccgtacaccggccaccggccccgtatatctttcgattccctacgacgactgggaccagcccgcacccgagtacgcgcactatctggcagcacgcgaggtgcagcatgccggactgccttcggaggcgatcctgcaggcgctcgctgaccgcttacagcgcgcgacgaacccagtactggtcctcggcccggacgtcgacgcgcagcacgcgaacgagtcggccgttgccctggccgagcgcctgaagatgccggcctggatggcaccgtccgcaccgcgctgttcgttcccgacgacccatgcgtgctttcgcggcgtgctgccggcgggcatcgcaagcatctcccggctgctcgacggccacgacctgatcctcgtggtcggtgcgccggtgttccggtatcaccagtacgaaccaggcgcactactgccggccggcgcggagctggtcagcattacctgcgacgtgctcgaagcggcacgcgcaccaatgggcgatgcgatcgtcgccgacatcgcactgacgctcgaagcgctcgccgcgcgcgccgaaccagctgcgcggccgatgcccgttgccgtcgcccgccctgccgcagcagcagaaacgccgggcccgctcgcaccggaacgggtgttcgacatcgtcgacgcaatcgcgccgcgagacgccatctacgtgaacgaatcgacgtcgaccacaaacctgatgtggcagcgcctgcgcatgacgtcgcagggcagctactacttcgcggcggcaggcggtctcgggttcgcgatgccggcggcggcggggatccagctcgcgcagcccggtcggcgcgtgatcggcatcatcggcgacggctccgcgaattacggcatcaccgcgctgtggaccgccgcgcaatacagcatcccgaccatcttcatcatcatgaagaacggcacatacggcgcactgcgctggttcgccggcgtgctgggcgtcgaggacgtgccggggctctacgtgccagggatcgacttctgcgcgctcgcccgtggctacggcgtcgaggcgctgcacgctgattcgggagcttccctcactgtcgcgcttgaacgggcattgagttcctccaggccgacgctcatcgaggtcgaaacc

SEQ ID NO: 27975 - DNA, 1461 bp, Burkholderia fungorum
atgattattgagtccggccatttgacattggcccaactacgtcgcattgcacacttctccgagacagtccaactttgtcccagcacctttgctgcgatcgatgcgtctgcacaggccgttgagaatatagtgagaaaaggaaagccggtgtacggcgttaatacggggttcggtcgtctcgcgagcacgcacattcccttggagcagctcgatctattgcagcgcaatctcgtgctctcgcatgctgtaggcgtgggcgaaccgatgtcgcgatctgttgtgcgtttgatgatcgtgctaaaggtgtcgagcctcgcccgtggacactcgggtattcggagggaagtaatcgccgctttggttacgcttctcaatgccgacgtcctaccggtaatccccgtcaagggatcggtcggagcatcgggcgatctcgcgcctctggcgcacatgtccgccgtgcttcttggcgtcggtgaggtgaccattggcgagcggcgtgccagcgcaaacgaaggcttgcatgctgcgggacttgagccatttaccctacgcgccaaagagggattggcgttactgaatggcacgcaagcatcgacggcactcgcgctgttcaacatgtttgccattgaggacctgttttgcaccgcactggtagccggtgcgctgtcagtggatgcggcggccgcctccgttgttccgttcgacgcccgtatccatgcgctacggggccatcaggggcaaatcgattcggcggcagcgtaccgtgccttgctggagggctccgagattaacctgtcgcactcagactgcgacaaggtgcaggatccctacagccttcgctgccagccacaagtcatgggtgcttgtttgcaccagatgcgccactcggcggaagtgcttctgtgcgaggcaaattcggtctccgacaatcctttgatcttcccggatacctgcgacgtgctttcgggtggaaatttccacgcagagcccgtcgcgttcgcggctgataacctggcgcttgctgttgccgagatcggcgcgctcgctgagcgccgcatcgcacttttgatcgacacaacgttgtccggacttcctccctttctagttcgcgatagcggcttgaactcgggattcatgatcgcccatgtgactgccgcggcgctagcatccgagaacaagacgctcgctcacccagcttccgtggactcgttgccgacctcggcaaatcaggaggaccatgtctcgatggccaccttcgccgcgcgaaagcttggcgatatggctagcaacacagcgcacattctcgcgatcgagctactcgcggccactcaaggaatagacctgcgtgagccacatcgcaccagcatgcgcttgcaatcggtcaccgaggcagttcgccgggatgtaggccactaccactcggaccgacacttttctcccgacattgctgcgatcgcagcg

SEQ ID NO: 27976 - DNA, 747 bp, Burkholderia fungorum
aaggtggccattctgacgggtgcggcaagcggaatcggtgaagccgtggctcgacgatatctggatgaaggcgcgaaatgcgtgctggtcgacgtaaagccggccgacagtttcggcgacgcgctacgcgccgcatacggcgatcgcgtgctgaccgtgagcgccgacgtcacgcgccgcgacgatatcgaacgcatcgtggcgagcacgctggagcgtttcggccagatcgacattctgttcaacaacgcggcgctcttcgatatgcgcccgatcctcgacgaatcctgggacgtgttcgaccgcctcttcgcggtcaacgtgaagggcatgttcttcctgatgcaagccgtcgcgcggaagatggtcgagcagggccgcggcggcaagatcatcaatatgtcgtcgcaagccggccggcgcggcgaggcgctcgtctcacactactgcgcgaccaaggccgccgtgctgagctacacgcaatccgcggcgttggcgctcgcgccgcacaagatcaatgtgaacggcattgcgccgggcgtcgtcgatacgccgatgtggaacgaagtcgacgcgctcttcgcccgctatgaaaaccgtccgctcggcgagaagaaacgcctggtcggcgaagcggtgccgctcggccgcatgggtgtgccggacgatctgaccggcgccgccctgttcctcgcgtcggcggacgcggactacatcactgcgcaaaccctgaatgtcgacggcggc

SEQ ID NO: 27977 - DNA, 1098 bp, Burkholderia fungorum
atgaagaccaaagcagcaatcgcatggaaagccggcgccccgttgacgatcgaggaagtcgatctggaaggtccgcgggccggtgaagtcctgatcgaagtgaaggccacgggcatctgccataccgattactacacgctctccggcgcggatccggaaggcattttcccggcgattctcggccacgaaggcgcgggcgtgatcgtcgacaccgggccgggtgtcggcacgctgaagaagggcgaccacgtcattccgctctacacgccggaatgccggcagtgcaagttctgcctgtcgcgcaagaccaatctctgtcaggcaatccgatcgacgcagggcaagggtctgatgcccgactcgacctcgcgtttctcgatcgacggcaagcctttgttccactacatgggcacgtccacgttttcgaactacatcgtcgtgccggaaatcgcggtcgccaaggtgcgtgaagacgcgcccttcgacaagatctgctacatcggctgcggtgtgacgacgggcgtgggcgcggtcgtgtattcggccaaggtcgaggccggcgcgaacgtggtggtgttcggtctcggcggcatcggcctgaacgtgatccagggtgccaaaatggtcggcgcggacaggatcatcggtgtggacatcaattcgggccgcgtcgaactcgcgaagaagttcggcatgacgcacttcatcaacccgaccgaagtggagaacgtggtcgatcacatcgtgcaactcactgatggcggcgcggactattcgttcgagtgcatcggcaacaccaaggtgatgcgtcaggcgctggagtgcacgcacaagggctggggccagtcgttcatcatcggcgtggcggcggcgggcgaggagatcagcacgcgtccgttccagctggtgacgggccgcgaatggaaaggctcggcgttcggcggcgcgcgcggacgcacggacgtgccgaagatcgtcgactggtacatggaaggcaagatcaatatcgacgacctgatcacgcaccgtctgccgctcgaacgcatcaacgaaggcttcgatctgatgaagaagggcgagtcgatccgctcggtcgtg

SEQ ID NO: 27978 - DNA, 1269 bp, Burkholderia fungorum
tttctcggcatcgacctgggcaccggctctctcaaagtggcgatcgtcgacgaaaacggtcgcgagcaggcggtggcgagcgtcgcttatgcaatcgaaacgccgcatgcgggttgggcggagacgtcggtgcaaacgtggtggcgcgcgctgtgcgaagccgccgcacgtctgccggacggtctgcgccgcgaggtgcgggccattggcttttccggccagatgcacggcgtcgtgctgatcgacgaggcgggcgaggccgtgcggcccgccatgctgtggcccgacacccgcgcgctggccttgctcgacgcgtggcccgagccgcagccgaatccggttgcgccgggcatggccggtccgctgctgcgctggatcgtgttgcacgaaccgcagtccgcgagccgcacgcgttgggcgctgcaaccgaaagactggctgcgcgtcgcgctgggcggcgctgtcgtgaccgatccgtccgatgcctgcgccaccgcgctcgccgatccagcgggcatgtgggacgcggcgctactcgatcggctcggtattccgcgcgcgtggttcgcgccgctggcgccgtcttatgccgcgggtggcgtgctatcggaaaaggcggcacaggctctgggtttgcgccccggcatcgtgctcgcgacgggcgcagcggatacgccgtgcgccgcactcggcagcggactcgcgcacgacggcgacgccttgctgaccaccggcaccggcggacaaatcgtcgtactggccgagtgtgcgcctgcggcggccagaggcttgcatcgctatcgggcggcgagcgaccactggtaccggatggcggcaatgcagaacgtcggcattgcgctcgaacgggtacgcggctggctgtcgtatgaatgggccgatgcgtatcgtgacgcgttcggcgacgcagccggcgcgagcacaacggctgcgtcgggcctcacgtttctgccttatctcacgggcgaacgcacgccctggctcaacccgatggcgcgcggcggctggctcggccttgccctcgatcacacgcgcggcacgatgatgcgcgccgcgttcgaaggcgtcgcgttctcgttgcgcgccggcctcgacgcgattcgcgcgagcggcgcgacggtgacggcattgaagctggcgggcggcggttccatcgacgcgcactggcggcagttgctcgccgatgcgttgaacgtcgaactgcacgcggtcgattgtccgaacgccgcgccgcgcggcgcggccattctc

SEQ ID NO: 27979 - DNA, 1125 bp, Burkholderia fungorum
aaaccgaaaaaatccgtcgccctgtcgggcgtgacggcgggcaacacggccctctgtacggtcggcaagaccggcaacgacctgcactatcgcggctacgacattctcgatatcgccagcgcctgcgaattcgaagaaatcgcgtacctgctggtccacgaaaagctgccgacgcaagccgaactcaccgcgtacaaaacgaagctcaaggcgctgcgcggcctgcccgcgaacgtcaaggccgcgctcgaatggatcccggccgccgcgcatccaatggacgtgatgcgcaccggcgtatcggtgctcggcaccgtgctgccggagaaagacgatcacaacctgccgggcgcgcgcgacatcgccgacaggctgatggcctcgctcggttcgatgctgctgtactggtaccactactcgcacaacggcaagcgcatcgaggtggaaaccgacgacgattcgatcggcggccacttcctgcatctgctgcatggcgtggagccgtccaacgcatgggtcgacgcgatgcacgtgtcgctgaacctgtacgccgagcatgaattcaacgcatcgaccttcacgggccgcgtgatcgcgggcacgggctcggacatctactcggcccttaccggcgcgatcggcgcgctgcgcggaccgaagcacggcggcgcgaatgaagtcgcgttcgagatccagtcacgctaccagacgccggacgaagccgaagcggatatccgccgccgcgtcgagaacaaggaagtggtgatcggtttcggccaccccgtgtacacgatttcggacccgcgcaacaaggtcatcaaggaagtcgcgaagaagctctcgaaggaagcgggcaacaccaggctgttcagcattgccgagcggctggagtcggtgatgtgggacgcgaagaagatgttcccgaatctggactggttcagcgcggtctcgtatcacatgatgggcgtgcccacggccatgttcacgccgctcttcgtgatcgcgcgtacggcgggctggagcgcgcacatcatcgagcagcgtatcgacaacaagatcatccgtccgagcgcgaattacaccggacccgagaatttgaagtacctgccgctaaataggagaaaa

SEQ ID NO: 27980 - DNA, 981 bp, Burkholderia fungorum
atggctaagcccgcaaagcgcgttgccgtcaccggcgccgcaggtcaaattgcttactccctgctgttccgcatcgccaatggcgacctgctcggcaaggatcagccggttatcctgcaactgctcgacctgccgcaagcgcaaggcgccgtcaaaggcgtcgtgatggaactggatgattgcgcattcccgctgctgtcgggcgtcgtgatcaccgacgaccccaaggttgcattcaaggacgcagacgtcgccctgctggtcggcgcccgtccgcgttcgaaaggcatggagcgtaaggacctgctgtcggccaacgccgaaatcttcacggttcagggcaaagcgctgaacgaagtcgcgagccgcgacgtgaaggtgctggtggtcggcaacccggccaacacgaacgcgtacatcgccatgaagtcggcgccggatctgcccaagaaaaacttcaccgccatgctgcgtctggaccacaaccgcgcgctgtcgcaactggcggccaagtcgggcaagccggtcgcatcgatcgagaagctggctgtgtggggcaaccactcgccgaccatgtacccggacttccgcgttgcaacggcagaaggccaggacctgaccaagctgatcaacgacgaagaatggaaccgcaacacgttcatcccgaccgtcggcaagcgcggcgcggcgatcatcgaagcgcgtggcctgtcgtcggcggcgtcggcggctaacgcggcaatcgaccacgtgcgcgactgggtgctcggcacgaacggcaagtgggtcactatgggtatcccgtcggacggttcgtacggcattccggaagacatcatctacggtgtgccggttacgtgcgaaaacggcgagtacaagcgcgtcgaaggtctggaaatcgacgcgttctcgcgcgagaagatggacggcacgctgcaggaactgctggaagagcgcgacggcgttcaacacctgctcggc

SEQ ID NO: 27981 - DNA, 1752 bp, Burkholderia fungorum
ctgccgcgtcgcaagtttgacgtggttatcgtcggcgcaggcggctcggggatgcgcgcttcgctgcaactcgcgcgcgccggtctgtcggtctgcgtgctgtccaaagtgttcccgacgcgttcgcacacggttgctgcccagggcggcatcggcgcttcgctcggcaacatgagcgaagacaactggcactatcacttctacgacacgatcaagggttccgactggctcggcgaccaggacgcgatcgagtacatgtgccgcgaagcgccgaacgcagtctacgaactcgaacacttcggcatgccgttcgaccgtaatgcagacggcacgatttaccaacgcccgttcggcggccataccgcgaactacggcgaaaagccggtgcaacgcgcttgcgcggccgccgaccgtaccggtcacgcgctgctgcacacgctgtaccagcagaacgtggcggccaagacgcagttcttcgtcgaatggatggcgctcgacctgatccgcgacgccgaaggcgacgtgctcggcgtgaccgcgctggaaatggaaaccggcgacgtctacattctcgaaggcaagaccacgctgttcgccacgggcggcgcgggccgcattttcgcggcttccacgaatgcattcatcaacacgggtgacggcctgggcatggccgcgcgttcgggcatcgcactgcaagacatggaattctggcaattccaccccaccggcgtggccggcgcgggcgtgctgattaccgaaggcgtgcgcggcgaaggcggcattctgcgcaactcgaacggcgagcgtttcatggaacgctacgcgcctactttgaaggatctggcgccgcgcgacttcgtgtcgcgttcaatggaccaggaaatcaaggaaggccgcggcgtgggtccgaacaaggatcacgtgctgctcgacctgtcgcacatcggcgccgagacgatcatgaagcgtctgccgtctatccgcgaaatcgcgctgaagttcgcgaacgtcgattgcattaaagagccgatcccggtcgtgccgaccatccactatcagatgggcggtattccgacgaacattcacggccaggtggtgggcacgtcgaagggcgcggaagatccggtcaacggtttctacgcagtgggcgaatgctcgtgcgtgtcggtgcatggtgcgaaccgtctcggcacgaactcgctgctcgacctggtggtgttcggccgcgcggccggcaaccacatcgtcaagcacgtgaaggaaatcaaggagcacaagccactgccggccgacgccgctgatttcgcactgtcgcgtctggctaagctcgatagctcgtcctcgggcgagtacgcgcaatcggtcgcgaacgacattcgcggcacgatgcagaagcacgccggtgtgttccgtacctcggcgttgctggctgaaggcgtcgagcgcatccgcgaagtggccgaccgcgtcgacaacatccatctgaaggacaagtcgaaggtgttcaacacggcgcgtatcgaagcgctggaagtggcgaacctgatcgaagtggcacgcgccacgatggtttccgccgaagcgcgcaaggaaagccgtggcgcgcacgcgcaggacgacttcgaacatcgcgacgacgaaaactggctgcgccatacgctgtggttcagcaaaggcgatcgcctcgactacaagccggttcacatgcaaccgctgacggtcgaatcggttccgccgaaagcgcggaccttc

SEQ ID NO: 27982 - DNA, 702 bp, Burkholderia fungorum
atggcaaagcgtacatttgaaatttatcgctacgacccggacaaggacgcagcgccgcgcatgcaaacgtacgagatcgagatcgactcgcacgaacgcatgctgctcgacgcactgctcaagctgaaggcaatggacgagacgttgtcgttccgccgctcgtgccgtgaaggcgtgtgcggttcggacgcaatgaacatcaacggcaagaacggtctggcgtgcctgacgaacctgaacgacctgccgcaaaagatcgtgctgcgtccgctgccgggcctgcctgtggtgcgcgacctgatctgcgacttcacgcagttcttcaaccagtaccattcgatcaagccgtatctgatcaacgacacgccgccgccggaaaaggaacgtctgcagtcgccggaagaacgcgacgagctcgacggcctgtacgaatgtatcctgtgcgctagctgctcgacgtcgtgcccgagcttctggtggaatccggacaagttcgtcggcccggccggcctgctgcaagcctaccgtttcatcgcggatagccgcgacgaggcgacgggcgagcgtctcgacaacctggaagatccgtaccgtctgttccgttgccataccatcatgaattgcgtcgacgtttgtccgaagggcctgaacccgaccaaggcgattggcaagatcaaggaattgatggttcgccgcgctgtt

SEQ ID NO: 27983 - DNA, 1275 bp, Burkholderia fungorum
acgctatcgttcagcgacaattcgccgagcgttgaaatgccgatctacaagggcactctcggcccggacgtgatcgacatccgcaaactgtacggccagaccggcaagttcacgtacgacccgggcttcatgtcgacggcggcgtgcaattcggcgatcacctacatcgacggcgataagggcgagttgctgtaccgcggctacccgatcgacaacctcgcggaaaacgccgacttcctcgaaacctgctatctgctgctgaagggcgaactgccgaacgcacagcagaacgccgaattcgtgaagacggtcacgaaccacacaatggtgcatgagcaaatgcacttcttcttccgtggtttccgtcgcgacgcgcacccgatggcgattctggttgccgcagtcggcgcattgtcggccttctatcacgactcgctcgacatcaacaatccgcgtcaccgtgaagtgtcggctattcgcatgatcgcgaagctgccgacgctggtggcaatggcgtacaagtacagcatcggccagccgtttgcgtacccgaagaacgacctgtcgtacagcgcgaacttcatgcacatgatgttctcgaacccgtgcgaagagtacaaggtcaacgacgtgctggtgcgcgcgctcgaccgtatcctgatcctgcacgccgaccacgaacagaatgcgtcgacctcgaccgtgcgtctcgccggttcgtcgggtgcgaatccgttcgcgtgtatcgcggccggtatcgcgtgtctatggggcccggcgcacggcggtgcgaacgaagccgcactgaacatgctggaagaaatcggctcggtggacaacattcccgagttcatcaagcaggtgaaggacaagaactcgggcgtgaagctgatgggcttcggtcaccgcgtctacaagaactacgatccgcgtgccaagctgatgcgcgaaacctgccacgaagtgctggaagaactgggcctgcacgacgacccgctgttcaagctggcaatggcgctggaaaagatcgcactggaagacgaatacttcgtgtcgcgcaagctgtacccgaacgtcgacttctactcgggcatcgtgcagcgcgcgctgggcatcccgacctccatgttcacgtgtatcttcgcgatggcgcgtacggtcggctggatcgcacagtggaacgaaatgatcgcggatccggaacagaagattggccgtccgcgtcagctgttcattggcgacacgcaacgtgaagccaagccgatcgcgcaacgt
